United States Patent 6,551,795 (NUCLEIC ACID AND AMINO ACID SEQUENCES RELATING TO PSEUDOMONAS AERUGINOSA FOR DIAGNOSTICS AND THERAPEUTICS) - sequence listing, part 8

SEQ ID NO: 18667 - protein, 340 aa, Pseudomonas aeruginosa
SSPAITRPERWSVARRCRQRTNGRDASACHWAPWIGGRRRRIDCVRCSTRPSCRMACCPIQPLPKSRSGCSIDRPSGSASIRRCRPSRSRRKSSTSAWSVFPVPVRSLRRVTPTARNGDAGLPRTMPGGNGSPTWRRRRMPSTVAGATSRRGRRRCTVAMPRRCRAAIPGWRAVPGESTATGWCCTGAAWPSVASCCSARCLATAACSGPWSCPSSVPSGCSAWMPTTCFSAAVERKAGGWCGSICAGAAASSIASGAAARHCSGSSGPKANRDRLRPAWVAAQRGGRAPIQGFLKTNTPLSTRRVRRMRSSRVRWAARKRGTCASGIARPSLSPGPTAV

SEQ ID NO: 18668 - protein, 148 aa, Pseudomonas aeruginosa
STTSTKVIRSWSSCVSSRRRAEPQAHFRLPARNWRRRSLRGAPNTWSGVPCSSITPWWRKITWLETWRAKAISWVTRTMVRPSSANCCMTFSTSPTSSGSSAEVGSSNSITCGSMARARAIATRCCWPPESSQGYCRSTFSARPTLAR

SEQ ID NO: 18669 - protein, 354 aa, Pseudomonas aeruginosa
ESPGRVWHSGCRRRCRRTATGCTAGCRGTRRCRARPGSAAAGCRRSAPPPAGWPAGSQAPRRGSAATGSSPVRSVAGRRSTGRPASIRRVPRSWQRPPDAQRAAPLQPQQRGVGDCGDGQVDQPADQGEVEELQGAFAGVLGGLDQVAETDDRDQRGGLDQHLPVVADARQGVAQHLRQEYPAEHSPAPHAVGLRGFDLAGRDRLEGAAEGFREVGAIDERQGDAAGGERVDVDLADAEGVGDAVEEDLQAEEQQQHDDQVGDAADQRRIAAGQGAQRAVGGELGAGAEEADEHGAEQGAQRQFQGHQGAGEYLRAEAVEEHFTLHCLLLSVEVKSGRTPFRACRRGRSRSSGR

SEQ ID NO: 18670 - protein, 404 aa, Pseudomonas aeruginosa
CRPSCFRPIRSGLAAPRRGLRRSRCRSLPGGRPAACIRAAGRSGRRPGAGPCLSSRRRRPVRRGGGRGRCCRGFLSLWLSSVDPRAPGRAPVENPGSGQEALGQSHPVAGADGQAVVVEVVAGVVQLAAALALAIADHQVAAGTAFEDEGEILAGGERPQSVDQAFLAQPVAGHLAGERGLPGMVDQHRMAMPVVDLRPRAEAGGLAAGQFADAALQQGTGFRGQGPDAEDHFGAGRDHVGDRPGMDRADADDRGVLRVDVARDDALQGQHDGGADHHRVDGALRHRAVAATADHADDHGIGRGHEGAGMEAEVADGVSRDVVHGEDGVAGEALQQPVVEHRAGTAEALFGRLEDQLQGAAPVRRLDQVPGRGEEHRGVAVVAAGVHHAVHLAGVGQAGGFLDR

SEQ ID NO: 18671 - protein, 306 aa, Pseudomonas aeruginosa
ARETPPVASPGRQCRRRRHPRRRPRPGDFPGGRDPRAARTGNRTASAAVRPHAQRPDLHRIRQGAADPRPAGAQATGARAGRTRPPAWPGQRPAVHRGDALGGADLPLGGGAGVPRAHAGGAPGAFRKPDGGGPAIASRRQHGFRHRPAARRPGGPGVRLREAARLRHRGAGPPGASAGGLRLDPRAAGTGLGVELHRRRPRRPDARVVLAPRRLDRRAAHRPRALRGDPADPGGAGRHVHLGAGDHRRRPAVARPGGAAGAAGNLRATTAGHHHPARRSPQQSGAMLRRVPAAGDPPPRPLGEEG

SEQ ID NO: 18672 - protein, 178 aa, Pseudomonas aeruginosa
QRSPVRGDARGDQPARRDGRGGRGRRRRGVLRAGRAPPLAAGGAGGVRPAGVPVAGAGVPRPGDPSVAASAATPGRDRQRRWRPARAPGGHFARRTRPPRQRLQRLPRQVAAADPRGRPGHRRGRRFSRFAGRHDRRQRSSDQQRARIGGPGQHRRDADEQRRPRGGAQCPERRAGGR

SEQ ID NO: 18673 - protein, 371 aa, Pseudomonas aeruginosa
RPPAGARGRQRGGSDHRGDPPVGAGSGEQFREHPATGPGNRQHRRGADGDQGHRRTDQPARPQRRHRSRAGRRAGSRFRRGGRRGAGAGGAHPGFDQGHPGAHRAPPGRGAERRAGHAVGQPQGARQRRARRRGRRRAGRHRRRGGADQRPRRADRLGLRGAEPGNRRNRPQHQRGARAFRPGGGTFGAGYRGQPPAVRAVLGTGAAGRPFPRLKRRRLARRQPDRHAGQCRRDQEDQQQDRQFFAQAVAGVLDADPQVDQRDGQPGRQEQAGSERRPGIPEFAEEQEQTEQDDAAGDYQGHVHEGFPQAGSDRRGGRCVAHLVEKPPLMRMVWPVIHQPSLTRWRMNGTTSSMSVRPVLENGDKAAAFFR

SEQ ID NO: 18674 - protein, 302 aa, Pseudomonas aeruginosa
PWRGRRQHAAQGTSMLIPDITAFFDPATSTYSYVVRDPSSRACAIVDPVLDYDPAAGRTSHASAERLIAHVRQHDLQVEWLLETHVHADHLSAAIFLQRELGGCLAIGARITQAQAKFSGLFNLGEAFPVDGRQFEHLFEDGESFRIGALECRALHTPGHTPACMTYLVGDSAFVGDTLFMPDYGTARCDFPGGDARQLYRSIQRLFALPDATRLFMCHDYTAPGRDEHRCETSVGEQRRHNVHVREGVDEEAFVAMRQQRDATLGMPTLMLPAIQVNMRGGNLPPVEGNGVRYLKIPLDLF

SEQ ID NO: 18675 - protein, 371 aa, Pseudomonas aeruginosa
SAAATQQENEEQPADGRGGDADGQVLGGDQGARGDIHPDQEQRAEQGAHRQQSAVLGTHQQARGVRQHETDEADGAAHRDQHAGQQRAADEDPQAYATGVQAEGHGGLFAGHQRVQRTAQPEQYQQAAGHAQRRQPDQRPARQAEAAEHPEQHRGGGAVVAEEQQQVGQRQEHERHRDPRQQQPVAAQAAAATGHAEHQQHAAEGAEEGRQRQGQQADHLADVEHHQHRAEGRAGGGAEQVRIGQRIARDRLQGRSHQRQAGADAGAEQYPWGADQPDDVLLAGAPGTGLRRHAEQALEDDAADQAAVQSRRTEAEGDHAGQAEQHDQAAQQQAIGARAAEQGHGRGARGWRPATRVSIAAALPMPGVAWL

SEQ ID NO: 18676 - protein, 271 aa, Pseudomonas aeruginosa
GRGSSPGCSGRGRAAGAEAPAGSAGRGGWSVRRGSAGAVPGPAREPAGRAASRHRRGWRRGSRHALRDRPGVAPGGPAGGRPRRGRRTGPCAACGPWRPRPRRQGRSPRGTPATPPRYAGRPSAAAGARGRRRRAPPGRAAVAHSGRRSAAGWSCRCRWGRSGRRNCWPGLPDARRAATRWRRRATSAGHRGEGTTWLLAGPVVQQRRLPRRRLQKLKSAVTLNERGWPMIHCWPLLLSARAYWRSNRLYSSRPRVRSGRTRQPRLESTTV

SEQ ID NO: 18677 - protein, 132 aa, Pseudomonas aeruginosa
GTLGFEMTDQATPNLPSRDFDSTAAFYERLGFGIVFRDAGWMILQRGDLMLEFFAHPGLDPLASWFSCCLRLDDLAEFYRQCKSVGIQETSSGYPRIHAPELQEWGGTMAALVDPDGTLLRLIQNELLAGIS

SEQ ID NO: 18678 - protein, 78 aa, Pseudomonas aeruginosa
RLRHVPVPHAAQEKSEAAVQGQGVLLGQVGVAFGIVLAGVWFATQWTAAALGYQLRLGSAWFDLLGTPVYHRWRLFEW

SEQ ID NO: 18679 - protein, 147 aa, Pseudomonas aeruginosa
FSFDAYASRIFDTGCAIAGGSGLVAVVVAIVMSVWRSRQSNLVTTYGSARWANAADIRVGIDKPRGVFLGLHRRQYLRHEGPEHVLIFARRRSDKGVGLVVPTLLSWPASAVISSVPTSWPNRGWPSGAASAPSPPATCWARCATGN

SEQ ID NO: 18680 - protein, 66 aa, Pseudomonas aeruginosa
AALLGFGESRDDCLAVIPLCSLAHGGRGVMDLSIKTPKLSSVCTKPGKDAHLFRHGRLGMVGDSWC

SEQ ID NO: 18681 - protein, 679 aa, Pseudomonas aeruginosa
GKSAGEIGGQVMQGTNVLFGQIAVVFGIVIAGVWGATQWTAAALGYQVRLGSPWFDFLGTSIYHPWKLFEWWFFFGAYAPEVFDTGGAIAGASGMVAVGVAIAMSVWRSRQARLVTTYGSARWANAQEIRKAGLTQPAGVFLGQHDRQYLRHEGPEHVLTFAPTRSGKGVGLVVPTLLSWPASAVIHDIKGENWQITAGWRSRFSHCLLFNPTDAKSAAYNPLLEVRRGAHEVRDVQNIADILVDPEGALEKRNHWEKTSHALLVGAILHVLYAGEDKTLRGVANFLSDPASPFELTLHRMMTTPHLGDGPHPVVASAAREVLNKSDNERSGVLSTAMSFLGLYRDPTVAEVTSRCDWRIADLIAAEHPVSLYLVVPPSDISRTKPLIRLILNQIGRRLTESLDGSDGIERRHKLLLMLDEFPALGRLDFFETALAFMAGYGIRSFLIAQSLNQIDKAYGQNHSILDNCHVRVTFATNDERTAKRISETLGTATELRAQRNYAGHRLAPWLGHLMVSRQETARPLLTPGEVMQLPPDEAVVMVSSVAPIKAKKLRYYADANFKRRVLPPPALAGGQYADAPPLRPDDWSGLAIPRTPAIPATVSADGLGSLTADDGGPRRQHELSEAVAYAPELVVPAADLALLDDDDDLPLPLPRQLDPAMQRTARLASLDPNDGIEL

SEQ ID NO: 18682 - protein, 133 aa, Pseudomonas aeruginosa
LTWRTAMTQMTFPAFRFSANPALRLARLRCLARPAGQGLLLAALLLFLTGTAQAAGSSMPWEGPLQSILESIQGPVARIVAVIIIIATGLALAFGDTSGGFRKLIQIVFGLSIAFAASSFFLSFFSFSGGAVV

SEQ ID NO: 18683 - protein, 865 aa, Pseudomonas aeruginosa
TACCWTSAYPASRAPGCAIAASIGRPTCCPRSPVSRRVPSVPPTTHRRACHEEATCRRRHCGRSLHRHCPCAMGRDRPHEPRAEHVNRDPHAGADQQPDPAAPERSADVDEPGAQPGQPAVQCGEPVARQPGDDRAADRPGPRLGLRRDESGSGVRAPVSRAIRRHRERRPDVPRRAGALAKHAQRLADHDADASSGVAEPGRRRKRAGRPRGQEPVGRRCVAGNAGHEPVAGLAGQAVDPVSTAPGHARPGGVAGAGAAGGSHRARPRSAAALPGRRHAVHAAVRELLRQLTGGRHAMRPRPVCCGACRAAGRLQQAAGRQPCRCSGRRSCAAQGIARAMRRRPADQGRGRLPRRRRSLPAALLLRRGRAGRIPDAGRPAADSAELRGTGRWHGAGLSRRTGGHAMNDVTIIDQFLNTFAAYIDSGFGLLRGEVAFLTATLIVIDMTIAGLYWAMSHATGQGEDVIAKLLRKVLYVGAFAYIINNFNWLASIVFRSFAGLGITATGSAITMENFLQPGRLAKTGIDAGAPILEQIGEMAGFPEVFVNLDPIVVMFLAWLVAVLRFLVLAIQLFITLIEFKLTTLAGFVLVPFALWNKTAFLAEKVLGNVVASGVKVLVLAVIVGIGSGLFAQFQIHPAEPSIDHALVIMLASLTLLALGIFGPGIATGLVSGAPQLGAGAMAGAAVGAAGTAVAIGAAATGVGGAVAAGARMAPAAAKLAGSGARAATSAASNAKSAFQAGSAAAGGGAKGAMAGLGHVAKTGAQSAGRAAASRASAAGQRMAAPFRAGWNRSTADAGASTGQASAGEASAGEAAAQKPEQPAWAKRLHRRQQLTHAATTAAHTLRGGDGGGSGQGPSLRGSDD

SEQ ID NO: 18684 - protein, 242 aa, Pseudomonas aeruginosa
CDSQGELTMRFRKPQVRYADTPQPATPYQAAGQVWDDRIGSPRVQAKNWRLMAFGCLTLALLMAGGLVWRSAQSIVTPYVVEVDSAGQVRAVGEAATPYRPNDAQTAHHIARFVTLVRSLSIDPIVVRQNWLDAYDYTTDKGAAVLNDYARVNDPFARIGKESVTVQITSVVRASDTSFNVRWTERRYVNGAAAGLERWTAVVSIVLQPPRTEERLRKNPLGIYVNGLSWSRELDSSEGAKP

SEQ ID NO: 18685 - protein, 251 aa, Pseudomonas aeruginosa
HATGGQGRARVGDAARPAASGHAPEPAHAGRPCRRPVGRRARGHDLVAATAAAQRRRTDRAIQRRSRLEVRRAGRSAGRLLEAAAEGARAGAAAAGRPRPCHRELAAAGRGRLRGPRPRPQRCLAQRGGSRCGFVGVLPLGRPRPSRRDRGAGDTGCAWWCKRARGLRPTRGRAGIGGDAACRPDRRTEPARPERGVPESRLYGNPQFRQSGAAGVALSGDGRNRDRGRAGDWHEVGLAGRRDRHCHGAGL

SEQ ID NO: 18686 - protein, 86 aa, Pseudomonas aeruginosa
PGSFAMTTTKKLRLGPLPKTESVKLTFACPASLKADLDRYASLHAQAYGEAVDAEKLIPHMLEAFMAGDRGFRKGTATRSAPSKPT

SEQ ID NO: 18687 - protein, 246 aa, Pseudomonas aeruginosa
TDRSFPRWSAWIPNALRTSRVAGSACTTRISRRSAGPSRSSATGSPMKAASNRSRSPGRSPRPPRKRRSIWWSATPSCSNSTVSTCRPGARSIGKSSRRCASGSCRRHPKNHRNPGASASREATCPHPPTVPETGSLSPALSRKRERQRGSRSPAVGRITRSVIRRQPQVGLRTPLLPDRRRRSRRRTACAGRTIAGAPADRRRRPCPRAGVCRRRPSAPGLPPASCAPSAPSRIPPAPRRPPGWN

SEQ ID NO: 18688 - protein, 385 aa, Pseudomonas aeruginosa
TSMWMGTAAAWAGLRDASHASSRSQCSETPAAGIGDDAGQGAAKPMARAPPVDGSGLGLQTLQQCLVEAFRSLYLRGMAKVGEFHQGRLGNPSGGVLAQLRVVAQPGFQFRRRGVLADGGVVFLADQQQGRHLQPVQFVDHRLGEDHVVGQRRVPGHRLAPLAAIHAGLHLYPAIELGAPFAGVVGGLLVLANAFGAGLQVAPVPVVDAAPGHAQGLPVLQTDGVDQHQSFDLPRIEQGVAGSEHAAHGVADHAGPGDAELFQQGVGVGCQLLEAVLVMGRLARLAETDLVDGDHPVAGVGEHVDGALPGPGAEILAVHEQDGAAVGFLRRDVEVGHAQRLALGGEVQIMHRIGVVEAFQAFAVDRRLAGQRRPAGEGETYTEAG

SEQ ID NO: 18689 - protein, 435 aa, Pseudomonas aeruginosa
TCRPITCVRSSATMACMARSASISARTAACWRCNASPERVLDGYNRHPSFCRPIPDHVHPGPPAAVQTVPGNLPRTVHRPDRGRRSPGPEPPADAQAGQPAGLCAGPGVSQSGGAGRGPGQERRRHRRVRPARFRLHRDRHRHSATAAGQSQAAPVPPAASQRDHQSHGLQQPRRRPPAGTGARGEVSRRTGDQHRQELRYPGGARGRRLPDLPGQGLRRRQLRHRQRQLAEHARPAQPAVRRFAQATAGGTAPAPGSAGAAAWPAGTAGDQDRPGHDRRRDRAGRRGAGRGGDGRGDRDQYHSRPRRRGRPAAWRRGGWPVRRAGAGEEHAHGEGAGRRAGRTAADHRRRRYHRGRARGGEDRRRGEPGADLFGFHLQGTGVDPRSGGCHRRFAAAELKRAPCGALGLAPAARMGRALGKSVLSVLSLTRAGVD

SEQ ID NO: 18690 - protein, 414 aa, Pseudomonas aeruginosa
SGRVPCWRPARPWRTPAGEVVTGSACRRLAKDSGWPWRRCRRNSRSSWRALRYEPFLSGGARASGHFPGHFRGVAVGHAGDEIDHLEEGAVQRPLRVGRVASEQVEDAPVLERRRMPAILLQRGATEGVEEDLQSGVGADLVEGLALVLEDLFPRDGLGPLHAELGRAMHVFHQVAGKLPGEQGLLLVDEGTGGGIGQVLDGLAAEDRQFTPAGVPGAELAIGVGQVVADQAEQQRLDLAVFEQFHFQAVFEVDQAIADVVRRFHQVDQRMASPALVVELRHAELMGDLLEQRQFALVAAELVLLVAQRFGVARGPGVLQVGTQGGVGQPRAAVELVVFQLGEDPEALGVAFEVEKVGTLGVAHLVQPATSGGLLEPVADRVFAGVPEWWVADVVGQAGRLDDDPEVAGVAPLG

SEQ ID NO: 18691 - protein, 511 aa, Pseudomonas aeruginosa
RFALASSIVALGKRRAPTVAGRRILQRPFCLRRPSNSGARATPRRSRRCQRPPLPSSTPSSAAPPAPQSAALPPPNSCWLRLWPSPWAWRKGCTSSWLSRRNCWRCISRRRRITALRNSRRDRPVAFTGSWLMRVSLSWQQSLAVVGQFFQGGAERRAFVVDRLVQAPAAEQRADHVEQAQPERRCEPVGVPEHDQHQQRQADQQEQGEYQGQPGEQQQAQGIGLLFLQLDAEQLDVTVQQAEEGGAEAPQGGAAVRRVLSFAHGSAPADQQAKQEADAGGDADALPGVFADVHLGGVHRGLAAFADVVLQRVLGVAQGIASALEAVVDLAADFFRLVARHVGGALQEFLGIGDQCLEFSQQFILCSVCSGLAGHDELLWSWGVFFSSRARGGRFNRWVISARCRSLPAFLSLKTATACLSARLRRDDAHPAASQRGANWYGACNSLVRTSAGMPLARAPGAPGGYFGMNVQPNENQGKSGSFPCCLRHLAKRLPKKSGGSHDDYCFVMVR

SEQ ID NO: 18692 - protein, 410 aa, Pseudomonas aeruginosa
CGASPDPRLQYPVHPARSGDGAGDARRLRLPRGGHRAPEEPGQRPVEDSVRLRHLGAGLFLRRLLDCLRRDFLPSGGGADRGQWLCAGEVLLPADLRRGNPGDHLRRHRRACQVRSAVVRHGADRGLRVPVFRRLGVERQFRLAGMAEAGVRRALPRFRRLRGGACAGRLAGIGGGAIAGQPQRPLSRRQAGGDGAVEHPVPGTGVVDPDHRLVRLQRDERPDPRWGQRAGGGQLLAGDGWRHHGVAADRPQRPGFPAQRSAGRVGGGVRRFRPDASDRRAGYRPGGGGPVRLGVHRDPGALEDRRRPRCLAVARSLRGLGRDCLRHLWPAGIGWARRGEPGQPGARQPAGGDGGFRRRPVGLWADEGAAGHPLEPGGGVLRRGPVDPQDRRDQPRMRGRTSLVRWGIGG

SEQ ID NO: 18693 - protein, 523 aa, Pseudomonas aeruginosa
GRWINPEFPSGLTGNSREPAWRRTRRRSFGPLSRTAGVWGSGRRGSAFPLNERGRLMKTPAWTRHALWVMPLALGLQSAVVAGDEQPSKTSSYSPVVINEDFATIMKRMTANKPSIEQAHKTLLEQRYDLSDRPAKGASMTRGKPLQEGIRVKLPAGTSWEELARLSPEEIRKQGLFPGGFLPLPHPNHAEGGMVFPKFLIDEIKRQESRDLTRFDLDYDLPDHFLPEFPAPMFLTTRPDLGDVSKGKLVTIDNYFELFNGILNPKQLEGLRLLLTAFPQQQFNLTDDRRSEHPSRGVACFDCHANGHTNAATHLAGDVRPQPFRHRIDTPTLRGVNIQRLFGSQRALKTVEDFTEFEQRAAYFDGDPVIATKKGVNVLERGSQVHFMGEFQALLDFPPAPKLDVEGRLDPGKASEQELRGEKLFYGKAACAGCHAPPYFTDNLMHNLKVERFYDPKLVNGVMASADGPIKTFPLRGIKDSPPYLHDDRLLTLEDTVEFFNLVLERKLSAEEKGDLVAYLRTL

SEQ ID NO: 18694 - protein, 423 aa, Pseudomonas aeruginosa
EEFPLKTSVPPTFEKIRLDVPSVLLQFAVISQQLGGVQVGQPRIARGQLDGLRAKRQQDVAWATVALAPGVFYLFGQVRRDQAEQRFPLAAAAQHPGARRCAAGGLQQGFQQGAVDARRVAGQHQQPGMPGHRQAGADAGERAGEVSAVVAHQAVGIGRIAFLVAVAGDDQVIGERAHQAMQVGDQGQALPLDQALVATAHALAAASRQEKDGAGGQGAIGHLGSPCRACDITPRSRPQARANPMSHKAETAFVPLNIAVLTVSDTRTLETDTSGQLFVDRLTEAGHNLAARVLLKDDLYRIRAQVATWIAEDSVQVVLITGGTGFTGRDSTPEAVACLLDKQVDGFGELFRQISLADIGTSTIQSRALAGLSNGTLVCCLPGSTNACRTAWEGILVEQLDARHRPCNFVPHLKQAAPCESRG

SEQ ID NO: 18695 - protein, 401 aa, Pseudomonas aeruginosa
LGHQRQGMFLQGAQQRRVGLAQRQRQVVQRYQQRRTGLGEAHRTAEEGLVVFHAGSVRQVVFQPDLVRRTFQVGDPARVEDPGSQDVLDHVAPYQGCLVAAVPDQPDLPAGRLDAAGAHVADQLLVGRDAAHGLAQGGAVHRDVAEHAPGAGLDETRRMQAEQGIAGMLAEIAEQALVGFARQALAIVVELVGLEAGGGQGRGDVQAEPFGMAQVFQQGRNRGGAKGLHGRCSCRGGWNRPSGVRAGCLDRSQGVSRSDSDRRGRLASIGSQKGSDKQVAATSEGRGSCAVGMAGAKKAPWSNCRTAPVGSWRNWSGRAHACRTPAWRRRWRRSRRRAWRPIRATASTPVSVCCMPAGRACRTGWRCARATSASTRTPWPIRKPPNRSASCWPWPTPATCN

SEQ ID NO: 18696 - protein, 406 aa, Pseudomonas aeruginosa
NASAGSSPEPCWGASGRRTASASPTCARPCGRRATPWTPWRPPPTGATSTACCRRSRPACATAWRPRARGSMCSPTSRMSMARGRASIPPTCSVRPRAMRRRWSAGSVSSMRPARRSSTIAAPSATSMASARTTHPTCPARRANWASPRCVPWPVTSTRPGGSTAAPCCRTERNDFSLERGVASPPPAGAGGAGVGPDRGRRRHQRCRHPPRSRAARLALPAAGAAGLRLGHLEPLVEDGPWRPALHREGPVAADPRLGARAPAPARRGAWAGGAVELRDGPLPRRLSRPAAIRRPAERVRRPCRAAQPPFLRRRRVALPGAGPEGTTAARRHAILRCGDRRCAPGAAGAGRGASRRRRGIQRHACARIAARGRPGGRPARRGPRERRAFRLSLPRPGAGHRGLGR

SEQ ID NO: 18697 - protein, 543 aa, Pseudomonas aeruginosa
ATGLSGPLAPAIQPARLTSRDENEMNDKNYLLAIDNGTQSVRALLFDLQGNLLGKGKVELEAYYSKHPGWAEQDPEYYWAMLGEACRRLWDQVDIDRGLIRGVSLTTQRGTVIHVDAEGRPLRPAILWLDQRRAEVRERIRGPWGWLFKLVGAEGAVEHFRAQAEVNWVAQEQPEIAAKTDKVLLLSGFLSHRLTGRFVDSVGCCVAYLPFDYKRLRWAAPRDWKWQALAVRREQLPELFKPGERLGEISAEASRHTGIPQGLPLIAAGADKACEVLGAGALEPTIACLSYGTTATINTTRARYLETVPLIPPYPAAIPDHFNTEVMIYRGYWMVSWFKREFGLREMQQAREQGVEPEQLFDELVNGVPPGSMGLTLQPYWSPGIREPGLEAKGAMIGFGDVHTRAHIYRAILEGLAYALRQGKERIEKRSGTPIVRLRVAGGGSQSDAAMQLTADIFGLPAERPHVYEASGLGAAIDCAVGLGLYPDVASAVAGMTRVGRVFLPQAEARQIYQRLYGEVYLRMYRQLRPLYRSIREITGYPA

SEQ ID NO: 18698 - protein, 121 aa, Pseudomonas aeruginosa
TSIPTMTWRASRGSSRNSRRAMAGACSNWWTAPSAACSCRPTRPSPNSPAAGVGACCWPRRWSPSRTCCCSTNRPTTWTSAPSPGSRKRCWASTARCCSLPTTAPSCNPWRPASSSWIVAT

SEQ ID NO: 18699 - protein, 455 aa, Pseudomonas aeruginosa
SLRALPAVGAVPRRSLWLASLTGRPSPEKGSVHGNRVPHHAGRPASAQLSHRAGAALRPAGGCRSAALDAPGTQSLQQLPARSRTLQPLSGGGRPAWGDRGFPQPAGVPQGRHLRAHAGARVHQAGGPGGRTARADRLDHGQQRLSAAGAAEADGHAAPAVRQQPGVRAAGGAAVPDAPVLQLPRGAACRLGTERAGAAVPAVATGQPGVLAANPRHLCQRFQPEGVPDLLLAVVEHQLFAGNPVAEDPPAGDERRGNARLRRRPRPSGERSGFLQVHREHVAGRAVQHVVGSGTEQQRQAVATVAADHDQVASLFRGEAVDFLARLPVDQVALLAAEVRIAYGEGIQAFTGLVELLLLQHRQVHRHVPTEGHGHGLDHMHHREPGLVAGGQGRRTLHHRVAFVGQVDGDQNVLIGHERLLPEGDSVFIMDFRAARGTCSVALGKKLLRRGRIRL

SEQ ID NO: 18700 - protein, 152 aa, Pseudomonas aeruginosa
PFFECPFLMTTWLVILLLAVMLSPLAWLMPSNRQRGRMALRLEARRLGLAMQLARQDWPHWLESAPPTSCAQFHCPRRRGREAWCYWQNTPGQWLNQWREPCADDELLDALRSLPGDVYKVEATAQFLALYWGERGDSADLGRIAEFLRQRA

SEQ ID NO: 18701 - protein, 179 aa, Pseudomonas aeruginosa
SRTAVPLACPPCAWAWDRVSPPSSSASKRSSKGKAGASCPGFRFSVSVVSGCIERMTPRERGFAYCAIRAYTGLLYVGIVPLFSDFRDKVRNMDLQAGLYRHYKGQNYRVLGVARHSETEEALVIYQALYGEFGLWVRPLEMFTEAVEVDGEWVPRFVLVSPEADPLGLQKAPGGEDRA

SEQ ID NO: 18702 - protein, 889 aa, Pseudomonas aeruginosa
RCRASRSLLYIHLFDAGTFRSMGKSLVIVESPAKAKTINKYLGSQYVVKSSIGHIRDLPTSGSSSSKEPAAKGRKSASEAPALSPKEKARRQLVSRMGVDPEHGWKAKYEILPGKEKVIDELRRLAKDADTVYLATDLDREGEAIAWHLREAIGGDESRYKRVVFNEITKKAIQEAFSQPGELDINRVNAQQARRFLDRVVGYMVSPLLWQKIARGLSAGRVQSVAVKLVVEREREIRAFVPEEYWEVHADLGTAKGANVRFEVTREKGEAFKPLNEAQAMAALEKLKASAYSVAKREDRPTSSRPSAPFITSTLQQAASNRLGFGVKKTMMMAQRLYEAGYITYMRTDSTNLSADAIGMVRGFIEDEFGQKYLPGKANVYSSKEGAQEAHEAIRPSDVNLKPTQLSGMERDAERLYDLIWRQFVACQMTPAEYLSTSVSVTAGDFELRAKGRILKFDGYTRVLPQQSKPGEDDVLPEMKEGENLKLIKLDPSQHFTKPPARYSEASLVKELEKRGIGRPSTYAAIISTIQERGYVTTHNRRFYAEKMGDIVTDRLNESFANLMDYGFTAGMEEHLDDVAQGERDWKHLLDEFYGDFKKKLEVAEVSEKGMRANQPTLTNIPCRECGRPMMIRTASTGVFLGCSGYSLPPKERCKATVNLIPGDEIAADDEGESESRVLRGKHRCPICSTAMDAYLLDEKHKLHICGNNPDCPGYEIEEGQYRIKGYEGPSLECDKCGSEMQLKTGRFGKFFGCTNPTCKNTRKLLKNGEAAPPKMDAIRMPELKCEKVDDIYVLRDGASGMFLAASQFPKNRETRAPLVSEIIPHKAELDPKYHYLCDAPQKDPDGRPAVIRFSRKTKEQYVQSEVDGKPTGWRAFYDGGKWKVEDKR

SEQ ID NO: 18703 - protein, 285 aa, Pseudomonas aeruginosa
NVCFKQVFVRRRNHGPVGNRRTHSRCGGTAVRGKRLRRNLVASDHQQGRGQPGGGELSLRFEEGADPGGVLALPRAILRQPGKGAGSSPGQARGPARHPGGPPAPAGVPGDGGEAAQRQRPVDLHALARPGLQPEPGAPAQVPGGGLRQGLPALHAAGQRGCAEAAAHRAVLARALHARRGRLQHVGDQGPAGDGGNRFRREHFHRAGDAPDGAVLRCRHARRERHRRSAAGRGATAPAEQDARQGLIADGAPGRRFPFSFLCAPGGTPCARPAPLAGARYRPGT

SEQ ID NO: 18704 - protein, 136 aa, Pseudomonas aeruginosa
FPGHRTFHARLSDARHRRHLADRRGPPNPAPPRGGRADHLRSQHRASCPGSRTVCGHSRHPSRPVAGRRPGRRARAAPAPGLRAPAGDARDRRQPQCRRAGRALWLADGDRGAGGRPRPEFRAGAGSRPPAQRRGR

SEQ ID NO: 18705 - protein, 250 aa, Pseudomonas aeruginosa
  UNSURE (46),(63),(112): Identity of amino acid at the above locations are unknown.
LRELSMSVYAIIGGTGLTQLEGLTLSESLPIETPYGAPSAPFQRGXYAGREVLFLARHGHPHXFPPHQVNYRANLWALKQAGAEAVIAVNAVGGIHAAMGTGHLCVPHQLIXYTSGREHTYFAGDIEHVTHIDFSHPYDEPLRQRLIEALRALGLAHSSHGVYACTQGPRLETVAEIARLERDGNDIVGMTGMPEAALARELDLPYACLALVVNPAAGKSAGIITMAEIEQALHDGIGKVREVLARVLAG

SEQ ID NO: 18706 - protein, 340 aa, Pseudomonas aeruginosa
PEQETTHFDLGFFNGWSTSAPGRAEAWPEESPHPVDRAGRGDRHRAVPRLGGRHQDGRPVDDPRLRHWRLHRLPDHAPARRDDRRGAGGRLLQSLRTQVLGRIRRFPFRLELLGAVHPGGHVGADRGGQVHPVLVAGRADLGDGGGVLRADQRDQPGQRESLRRDRVLVRDHQGSGDHRHDPARYLPAGRRRWRTASLGEQPVGPRRLLPQRSQRPGDDPGDHHVLLRGAGAGGYHRRRGVRAAEGDPEGDQPGDLPDPDLLYRRPGGAALAVSMGPVGGDHQRFRRRLQRQPVRADLLVDRQRHRGQHPQLRSTHRGIVGLQQRRLLQQPDALRPGRPG

SEQ ID NO: 18707 - protein, 409 aa, Pseudomonas aeruginosa
PARQGRASFREGRALREVVPAVRSRGHLPLSSRQRHPHHCTRARRHRPEAHDDHRLAMHLPGDVLRHVQRRPPGQPDLRPEPRPVERPGWLALRPDRRAGRVRPEQLVGLPGPGRRVLPAGVPDHLHRRRFLGGAVRQHPPPRGQRRLLRHLGAVRPDPAAVRPVVAGSPGDQLRRGAGQGSVRRHREELPQSGTGRPGLPVLRLPGADVRRRGMDLGGRLRRRHLAEPGRRRRRGQHPRPRLDLDGCLPRPHAGFDGRDQHPGDLHRRRRAAADPHRLLAHRRRGDAGDGRHELPVQRHRLGQQPDVRHALVLAPGHRRLRLRHDLHGHRPGLGVHDRYRQVAVRRPDRSDGHADPGGQPGVPGRHDAGDPVRQPVRTADRPFRRSGQHQAEAGAQWLIKNPPPAHCW

SEQ ID NO: 18708 - protein, 330 aa, Pseudomonas aeruginosa
PEQAALGVRRADHHQLHRDGPRRSLRHGQPAARVVLRRHRQRSRLQRHAAGAGLRPRAVRRRQALRHQRVADGQRWRLVPAERPAPAAAFGVLPDRPDHLGPADLEERPGRGPDLQDGPAGIQQGGLLMEHYISLFVKAVFVENMALAFFLGMCTFIAISKKVETAIGLGIAVIVVQTITVPANNLIYTYLLKDGALAWAGLPEVDLSFLGLLSYIGVIAAIVQILEMLLDKYVPSLYNALGVFLPLITVNCAIMAGSLFMVERDYNLAESTVYGVGSGFSWALAIAALAGIREKLKYSDVPEGLQGLGITFITIGLMSLGFMSFSGVQL

SEQ ID NO: 18709 - protein, 397 aa, Pseudomonas aeruginosa
RGLRGEEMGVHGGVQPQRRHLHQGTHPAPAGRRERGLSCRRLRAAGMPAARGRVQGLRYPAGISRRLGQVQHVALRVEGRRDGDPRLLDGQLPGREGRGQVQHPHRLAAAGQRPAAGADVVLGVQPQAGRQGHRVRAVRRVLRQGHRGRDGLHRRRRRHGADAFAHLRPVAPAQVEPQDQLLVRRALAARGLLYRGVRPAAGGESQLPVAPGAVRPAAGGQLDRPDRFHPQRAVRELPEGPPGARGLRVLHVRPADDECRGDQDAHRPGRGAREYPAGRFRWLSVSVRLPWPDWQRWRWSWPVAATPWKASAARPWAAPIRSSTCAAPRRPTSRRRKPRWRRSSPRSTGRCPPTATIPWSRVSMRCRRSPAWSCRHRCWSCCATAASCRNRARAPST

SEQ ID NO: 18710 - protein, 438 aa, Pseudomonas aeruginosa
GRRRCLATSPSRRIHFLPAKGDMFRPLSVFIGTRYTRAKRRSHFVSFISLTSMIGLALGVLVMIVVLSVMNGFDREMRTRILGMVPQATVESYQPIDDWRALAEKVKAHEHVTAVAPFTQMQGMLSANGAVQTVMVDAVDPLEEAKVSIIPDFFKQGSLAELKAGGFGIVIGQLAAQKLGVGIGDKVTLILPEVAVTPAGVFPRMKRFTVVGTFRVGAGELDGGLSLIHLEDAARLQRWKTNQVQGLRLKLDDLFQAPRVAWEIARTLTDNDFYARDWTRSHGNLYQAIRMEKTMIGLLLLLIVAVAAFNIISTLVMVVTDKKSDIAILRTLGATPGQIMATFMVQGTVIGVIGTLVGGVLGVVAALNVSAWISALEKLLGHQFLASDVYFIDYLPSQLMLDDVVLVCGAALVLSFFATLYPAWRAARTQPAEALRYE

SEQ ID NO: 18711 - protein, 760 aa, Pseudomonas aeruginosa
PHVTCRGAEGTPRGWEEPFMRLGLPALAAGLLALRFLAELPSVGWLLGMAAAGLLLLFGRLYWLGLFLLGFAWACGSAQVALDGRLAAELDGRTLWLEGRVVDLPASGEGVTRFRLEEVRAARGVLLPERLRLSWRGAPPLMGGERWRLAVTLKRPRGLVNAAGFDYEAWLLAQRVGAVGTVKAGQRLQPASGLDAWRDAWRQRLLAVDAQGRGAALAALVLGDGSGLSAAEWRMFQDTGTVHLMVISGSHISLLAGMLYGLVAALHRLGCWPRRLPWLPCACALGLLGAWSYGLMAGFEVPVRRACLMVSLALVWRLRFRHLGLLTPLLATLVLVLLVEPLASLQAGFWLSFLAVALLLWLFAGRLGRWRWWAAWGRAQWGMALGLAMPLLALGLPLSLSGAPANLLAVPWIELLVVPPALAGSLLLWVPGLGEGLLRAAGVSLDLLFRALGLLAGLAEAWQPPAAAAWSVALGMLGALCWLAPAGLPLRALGAALLLPALLPSSPPVEWGRAEVRVLDVGQGLAVLVRTRKHVLLYDSGARQGAFDMGERVVVPVLRSLDLRRLDGLLLSHADNDHAGGAPTVASRFPPVWLVSGEPARLPSPLFADSCDERSWSWDGVVFEQWAWAQAGDSNDRSCVLRVEADGEVLLLTGDISRAAEHAWLARQADPRVDWLLAPHHGSRSSSGVAFVLRTRPRHVLVSRGWRNAFGHPHGEVMERYARVAAQVHDTARDGALTFLLGSRGGARRERDSAHFWREK

SEQ ID NO: 18712 - protein, 235 aa, Pseudomonas aeruginosa
EPWRSAEKGRCARVAPLFFRGYATVWELVQAGGWMMLPIILSSIAATAIVAERLWTLRKSRVAPPELLGQVWKQIKGKQLSAQKLKDLRANSPLGEILAAGLANSKHGREIMKECIEEAASGVIHELERYLNALGTIAAMAPLLGLLGTVFGMIQIFGAFMDNGMANSPMLAAGISKALITTAAGLLVAIPAVFFHRYLLRRVDELVIAMEQEAIKLVEVVQGDREVDYVEEGKA

SEQ ID NO: 18713 - protein, 274 aa, Pseudomonas aeruginosa
GLRAVQSERGQGRHRHRRPGPDFQSCALALGSRRLRPRSRQPAGGRALSSPHRHLRLSRGFPCRFRRLGTVLAGERRKPRAIARALARGANPCGRCPRNHASGRGYAGRPRTRSPRAGGLMRVLFVCLGNICRSPTAEGVFRRKVEEAGLASRIHVDSAGTAGWHVGKAPDQRTRLAAQRRGYDLSALRGRQVGIEDFSCHDLILAMDLSNLADLETLRAGRGAAELDLFLRRYGSERDEVPDPYYGGEEGFEQVLDLIEHACDRLLIEAKGRL

SEQ ID NO: 18714 - protein, 1181 aa, Pseudomonas aeruginosa
KRDAGGIPFSLCVFGGSGHDGRYAGVPRNGAQKKGMPWHPLFSACHSGMRARGFAFLGLFRVLRVGGVFAGSFRLGLYRFLGFVRLGRNVGLGDFFSLGCSRFLLGRRFLARYSRDLLDGGSGLSCRFGCCCGFACQTLGFALQATFFPWVVEGTASRVGRHRRDGRGRLLGGCGLARGCYFDGHRSGNFFGRFRCRLHGALGVFAAFHAFAGEGSFFSGLRDQQGALVGFVPDHADGHRRFDVGGFAGIGLAVRVLGFDGFAGRRVGLIACRGFAGSLAGSGRGLLHVCFYGFAGDSDTGSGGGCDGVQRRGGIIGRLAAFHLAADLALAFAAVAATTLAAGAAARALAIGIVLLVLLQALVVRQCLGFQGRGVASLAILARLALFAGRAFDAFFTAFAGLALFAGRAFGALFAAAFAAFLATFAAFARLALFAGCPLGALFTAFARLALLASRTLGALFAAAFAALFAVRAFGALFARLTLCTLLARFALFVAAIAIAAIAAAVLLAAVATLVLAGLALGSRLAGFSRLGGRLILACEQADQGLHQALEQARLGHRLGRLDRCFGVLRCGLLGSDGLDCCFLADQGAGRADRLGFFVLDGGHFVAGLAGNQFGAVIAQTLHFEMRGFQMIVRQDEDARAGTQFDLGDGVALLVEQEGGDLEGHAGADFRGAVLQGFFLDQAQDGQRQRLDVADDALAVAARADDAAGLAEGRTQALAGHFQQAEARDATDLDARAVGLEGFADTLFHGALVLRRGHVDEVDDDQAADVTQAQLAGDFLGRFQVGLQGGFLDVAALGGARRVDVDGNQGLGRVDDDGAAGRQLHFALESGLDLALDLEAIEQRNAVLVQLHLAGVLRHHLADEVQGFFLGVDAVDQHFADVLAQVVADGADDDVAFLVDQEGRATFAGRFLDRAPQLQQVVEVPLQFLGAAAEAGGAHDQAHVGRCVEAVQGLAQLVALFAFDTAGDAAGARVVRHQHQVTAGQADEGGQGGALVAALFLLDLDDDFLAFAQDFLDVDPAFGGFLEVFAGDFFEGEEAVAFGAEVDEGGFEAGFDASDAAFVDVGLLLLAGARLDVEVEQALAVDQCNTQLLGLSRVDQHSFHVVPMVSGATGNGDRHTRLSRSVLGRVFRNGGPFPCPAALGTGCRSATTSPASCVSEALESGGGIGCRRRTKNASGSS

SEQ ID NO: 18715 - protein, 326 aa, Pseudomonas aeruginosa
MKNCYDVRMTTPASPTTGVQLLDVPPELAGQRIDNFLIARLKGAPKTLIYRILRKGEVRVNKGRIKPDYRLQAGDQVRVPPLRLAERDEPAPLAQGLLERMEAAIVYEDKALIVVNKPAGIAVHGGSGVSAGVIEVFRQLRPDAKDIELVHRLDRDTSGLLMIAKKRSMLRHLHEALRGEKIVDKRYHALVRGHWPAGKKNVRAPLLKNNLRSGERMVEVNVEGKDALTEFRVLRRFGDFATLVEARPITGRTHQIRVHAKHAGHAIAGDPKYGDEDFSREIRELGGKRLFLHAAQLRVPLPDGQVLELEAPVDEMWQRSLERLND

SEQ ID NO: 18716 - protein, 189 aa, Pseudomonas aeruginosa
QARGRPYNGALMLNGPIPPHIDPRKLVDRGATLEGVYALADMPRVCEQLTSDAGEVRVKVSFERDHQKLAVMHMQLDTEVSMVCQRCLDAAAIPVHGEYTYAILREGQSADGLPKGYDALEVGEEPLDLLALVEDELLLALPIVPAHDPEVCQHPAGFVVEDEPESSEVEDKRPNPFSVLAQLKRDPNV

SEQ ID NO: 18717 - protein, 275 aa, Pseudomonas aeruginosa
CNGWGLRSPLRCSGLYCLPGREFLFATDPRRSACPPRRTPFPLSVARPAAPACACGQRSDRFRRTSLPGLAWQAGRFHARGAGAGPRRPGARVRQRRQYRGVDGAVAAPAEDPARYRPPCDGDGGSDREGALSSARPRRQRGLQCRASLSVRGDGRGGGRGLGLRLAPGRPAQRGDRGDQGQPAGQAGGESVAEGAGVEFQRIYRGRWPVSRRGRRGGLRRFRRQHPAESQRRPGCHGVGADRTALPRWTGGEAGRCAGVAAAAPAARRYRSGTL

SEQ ID NO: 18718 - protein, 302 aa, Pseudomonas aeruginosa
SQAAQDRRGPVELVRFRRDQRHPGVPQVRRLMLDWVDGRPAAELSVRDRGLAYGDGLFETLAVRAGTPRLLERHLARLEEGCRRLAIPLDAAALRQELLAFCAALGDGVAKLIVTRGEGLRGYAPPAEASPRRILSGSPRPAYPERHWQQGVRLFACRTRLAEQPLLAGLKHLNRLEQVLARAEWSDAGHAEGLMLDVHERVVEGVFSNLLLVLDGTLVAPDLRRCGVAGVMRAELLERAEGIGVPLAIRDVSMAELATADEVFLCNSQFGIWPVRALDEHVWPVGELTRKLQDQLRDDLDF

SEQ ID NO: 18719 - protein, 238 aa, Pseudomonas aeruginosa
SVARTIAPAPRPSPRRHNERRSQDKECRVTGLFVTLEGPEGAGKSTNRDYLAERLRERGIEVQLTREPGGTPLAERIRELLLAPSDEPMAADTELLLMFAARAQHLAGVIRPALARGAVVLCDRFTDATYAYQGGGRGLPEARIAALESFVQGDLRPDLTLVFDLPVEIGLARAAARGRLDRFEQEDRRFFEAVRQTYLQRAAQAPERYQVLDAGLPLAEVQAGLDRLLPNLLERLNG

SEQ ID NO: 18720 - protein, 201 aa, Pseudomonas aeruginosa
RAVGRYCAAADQPPAQPPVADHQEPLRAAGLPFAGRGGESGMAGAGPARRAGRGPGGTVGAFRRLAAHRPAPARPGRARAARAGGRGGEEAAQAADRRQPTGRKLEQRAVAIALRLVLRLDAGHPALPVDPRRGGAGVGRHAQGDPVPGRQIRAGQGAGHAGLAAATAAESVEQGQPQPCPASRSPAGAVGKPARAGLESR

SEQ ID NO: 18721 - protein, 288 aa, Pseudomonas aeruginosa
QHRPQQDRNLPGRGAEVGPADPHDVTLDRIMLVDSHCHLDRLDLAAHGGSLDAALDAARARGVGQFLCIGVSADNAQAVKALAERYADVHCSVGVHPLDLEPGSAPALDWLLGELAHPRVVAIGETGLDYHYEPEAAELQQEAFRLHLEAARITAKPVIVHTREARADTLALLREAALPQAGVLHCFTEDWEMARSALDLGFYISLSGIVTFRNADALREVARQVPADRLLVETDSPYLAPIPHRGKPNLPEYVRDVAEFLATLRGVSLETLAEQTTANFHRLFPLAR

SEQ ID NO: 18722 - protein, 211 aa, Pseudomonas aeruginosa
PMLHLFRIALAMLLLGSLSACMKPSDLADGADYYLRDAGVLDHSASQRSNNRRIQADSFIYIGQGPFVPPGYRYARPNVVAEQAFEGFVEYFPLVRRAKAPLGLDDAMREARAAGAHYLLYCRFARGDNRIGNWEEWEDEEELGRVGRDRSVIQVMLIETSTRFLVDSATIRSRGGFLTFYDATPEDLLRPPLEQYAQELLGLNSRGTGYE

SEQ ID NO: 18723 - protein, 155 aa, Pseudomonas aeruginosa
PCDPGGEQRRAELPGRGQAAQGRGRQGAAAAGDPRQAGHRQRQQPDRPDARRADRLRPGHLRLQGRGRWRQGQRDPRDRWRSADRRAEPAGHRHHRPAPERAALRVAAEHHESQEEAAGRGDPGRPGRFHRFHREDPEGRGAGCTLRWHQGQVRG

SEQ ID NO: 18724 - protein, 322 aa, Pseudomonas aeruginosa
TGRETEERGEGNLMAILVIAEHNNAALAAATLNTVAAAKAIGGDIHVLVAGQNVAAVAEAAAKVEGVSKVLVADNAAYAHQLPENVAPLIAELGKNYSHVLAPATTNGKNFLPRVAALLDVDQISEIVEVVSPDTFKRPIYAGNAIATVQSSAAVKVITVRTTGFDAVAAEGGSAAVEQVSGPADAGKSAFVGEELAKSDRPELTAAKIVVSGGRGMQNGDNFKILYALADKLGAAVGASRAAVDAGFVPNDMQVGQTGKIVAPQLYIAVGISGAIQHLAGMKDSKVIVAINKDEEAPIFQVADYGLVADLFDAVPELEKAV

SEQ ID NO: 18725 - protein, 497 aa, Pseudomonas aeruginosa
PFGHDSCLRSAQAEVSHLQCATSLAPECAFPASSNRGFHDHQTARAWLHLRHYPSGRLRGQRQATDRLRRGQGPRRQRTEEGPGHRFLHRLWPGCPHHRRVRFRRRYPRGVLRASGQREQAGHRRLVQLGGLREVRPRERPVCPQHQWRRFLRRGEAADHRDHQARSRQGRPGGLQPGRAAPYPSEERRSVLLDPQADRQVGQLPWPGHRQGSDQGRGPGGGQRPGGRRYRCGDGRRGLADVDRRAAGGRRAGRRREDHRVHLPGREDHPRHLLERFHRRGQEGSRPEGPRYPRQARPAGRRRARVGAQGGGDPGQLGDPDDAAVPVAAVQGDEGAGHPRRLHRAGRRPVPGEPVRRRAAPRRGRPPACRLQGTAAGSAVPCRGAVGQGNQREPLRIDRLRWLQERVPQPVRFRGRWGRLRAGRQPGRADRQPDPGLRPGSEPSSRRLPLPRTGAQAPVRVFSDRPPGRSVRRRGRPGSAARFPPGVRPSARVRSFP

SEQ ID NO: 18726 - protein, 214 aa, Pseudomonas aeruginosa
PCRPAVASLVTSLGVLPVVGAEPKDGGSFAGSIEMSMLGAVQRRVGEAFGGQHLADQDQRGAAEIPGGDLGQDVAEGAANLFLVGPTGPVDHRDRAVGAVVRQQFLDDLRQVGDAQVDRQGRPVPRQVTQALAFRHLRACGVAGQDQRLGHFGQGQLAPEQGGAGGGGGDPGDDLIGDAEFAQVADLLADGAVQGGIAGMHAGYVEAAAMGLRE

SEQ ID NO: 18727 - protein, 221 aa, Pseudomonas aeruginosa
SCRTAGARKCTGRSSSVASCRRPGSSRLPSMLARASSSARLRPCSPSVRSSSARRCSALQPRRQPMPAISRLGMGRGMRAPEEMEGEALWTRDRQGSRVAGGQASTPPRLRRNSQAAARPRAAQNSALLTSEATTKRWARASGARLAWTSGCGAPNRCGSASRTAPTSFSGQLPPNTSRARPTAVAAAVAIHQYWRCTRSAAAVPGSSGGRPSDGARQNTE

SEQ ID NO: 18728 - protein, 118 aa, Pseudomonas aeruginosa
RSSRRAGASCRCRSCWDSTPRPSCTSTAGRPTTTTKATRTTTTTSSTPSTSISPRWRKLRCSRPSASWWSVTTYFASRVSPPFRASPCACWYRASASASTGISTASGWPTKSAAPGWW

SEQ ID NO: 18729 - protein, 1125 aa, Pseudomonas aeruginosa
APLATCRRSRPSASGNTCARAGWRTPGSSTAAWPASASAATTPGANRRRCRGWRCSIHGMPRRPWEHWRADWQAGRPVVALLFYRTHLQAANTAFIARFCERLAAQGLNPLPIALASLKESACLAQVEDWLERSDAALIVNTTGFAQSNPEAPELRPFRRDVPVLQAICSLDNRPLWLDNPQGLGPRDLAMHVALPELDGRIVTRPISFKGLAWRSERSESDVVCYLADDERMDFVAELARRWAELARKPNAEKRVALVLANYPTRDGRIGNGVGLDTPAAALNILRALRQQGYPVDGLPASGTELIRQLLGGVSNDLEHLDLRPCAQSLALDDYLACFARLPERNRQAVLARWGEPQQDPMFRDGRMMVAGLRYGLTFVGIQPARGYQLDPAAVYHDPDLVPPHGYLAFYFWLRHAYRADALLHVGKHGNLEWLPGKGVGLSAECWPDALLGPLPNIYPFIVNDPGEGAQAKRRTQAVIIDHLMPPLTRAESYGPLRDLERLADEFYDASLLDPRRAEQLRGEILVLLRDNRLDREIGLQLSDDPDSWLPQLDAYLCDLKESQIRDGLHVFGESPSGRLRLDTLLALLRVPRGDGKGANAGLLKSLADDLGLGFDPLACDMGEAWQGARPACLEERGGEPWRTLGDTRERLELLALHWIERCLGGESPPATWRASGEVLRGLCEQVAPTLDACGGAEIDGLLAALEGRFVPAGPSGAPSRGRLDVLPTGRNFFSVDVRNLPTPTAWRIGFQSANLLLERHLQEHGDHLRQLGLSVWGTATMRTGGDDIAQALALLGVRPVWQAGSQRVADFEILPVSLLDRPRVDVTLRVSGFFRDAFANLIRLFDAAVQAVAELDEAEELNPLAARVRLERQRLEAQGTAPAEARRQAGWRIFGAKPGAYGAGVQGAIEERLWETRADLAEVYLNWGGYAYGAADDGTPARERFAQRLERLQAVLHNQDNREHDLLDSNDYYQFQGGMLAAVETLRGAPVASYHGDHSQPDNPRIRTLKEELNRVVRARAVNPKWIAGMKRHGYKGAFELAATVDYLCAFDATSELIDDHQYALLADAYLLDAETREFVRQHNPQALRDMAERLVEAQRRGLWQEPGAYREALENLLLDVEEE

SEQ ID NO: 18730 - protein, 142 aa, Pseudomonas aeruginosa
ARITRSNWPSSSSLSAARRSAYSRAERGSWIEQGPTTTSRRGSSPSRMARMASRLAATWLASSSGNGWRALSSSGLGRRSRAVRAVALGRATAWTFGERVVSADTDEFMVWLPGLAAGVPRASCPIEVFGNVVGWRAAGGRR

SEQ ID NO: 18731 - protein, 406 aa, Pseudomonas aeruginosa
TRKRANCARNCSTVSASTCVSTPSRRRPSGQRSSVAGWPSMPTRRPSPNAGKASRTPCAAVAPRRAGGWRGFPWTMRRWTASLDAASRRLSMACAPTWSGCARRAPMRPGAAASGSRRRTSMRWNISPCCIAVASRTRHHRRPIHRHRPRRPLSRSRSAPATAKGSGVNCRLGRWPWGPPASCRAGQKSPEHPPALGHGCGCQEQTRSPARRSWRRPEPGCGGRHPMVADPAAWTSPTAPRPASPAAQPAPGRTLAGDRRCLRQHPPVRRPGPGQGGVGDAVRGGLSAAYPPGRAARHRAAGAMALAGAEGLAGVAGLAAPAGRRRRYAAARRPAPGRWLAGAPTAAETRRASASAGAYRRPSARLAGAAGGCLPEPAGRPRKRPVAPGQGRAPGPGTGGRVSAYQ

SEQ ID NO: 18732 - protein, 191 aa, Pseudomonas aeruginosa
SRRSAAASPPPPRRRSPMAAPRCWSVARTSRAATGWRSWRGSRRWRWPVVRRRSWAWGRCRRRARFCNGPGWASPTSTWWRSTRPSPANPSPASANWGWTWTGSTWMAAPWPSVIRWAPPARGSPARPLRCCGAPAGAMPSPPSASPAARAWRPCWKRWSDRAPMKKGPVDEPGLDGEPAPAARRRVVAVT

SEQ ID NO: 18733 - protein, 249 aa, Pseudomonas aeruginosa
SRSPRRPSTITSPVGSPPSSIPASVPRRSWRSCSTWRSTTSPPATPTSSRCSSPPASGPCATRTSPPCTKATISSTASCTTPRATKCRWPATTAMARRRDGAAKPLKPAAPEPRRDERRPSLRGPFSLCASEQRLAAVQALVHQPFAVGDGGALGVFQVGEEGEAHGQGDALAGVAFGIGDVAAAGPGRGNARMLDDVGGDGVAAVLAVQAGHGMLLSVGGRPGYLRDACGCHGGASGRRGFPCVSLPL

SEQ ID NO: 18734 - protein, 164 aa, Pseudomonas aeruginosa
SKLSNVTLLHRNSAASRFFPKRKLLGGIIPGRDHCKLVFPSPRHSRHAGRAWGGARLTLKHYREIYSVVFPLTFCRQQADTDVIELDRFVSIVFEHFAVHFQGRQVHILRLFRHDDSRGESMSSEHDGKDQDDLFSPLPYLLVSGAVVLMTLLLRCLFCPGEQF

SEQ ID NO: 18735 - protein, 174 aa, Pseudomonas aeruginosa
SAWPVPASVGAIRTRSGRNRAPASPAAPGRLSRSAASRRRLPGRRFRSHSGRGIPRRRSRPGRRSGRCRPGGRGRVYRGSWLCFLGGLSEGFGRRGTARWQLGVAPASAAGPRPSPPGRPARRPRRAAPGRCRRSPSCRRGRRCRSRRCRRRCSARRRTPGPAARTSSPAPGRR

SEQ ID NO: 18736 - protein, 153 aa, Pseudomonas aeruginosa
RPAATATGGRAPAVGATRSPGCAARYPAVRECAAARRPAAAPWPGPARRVRRMPGANPRRRRSACRWECQARWRRRCRRTPAPRRALRARGRPGARRFRWPWPKTPGAPGPGRSAPRPSSRYRRPRRPAHWPRRTAAGRRRTAACVRRPPARR

SEQ ID NO: 18737 - protein, 433 aa, Pseudomonas aeruginosa
SRRRPAGGSAIARQDSSASAAVAAPGNDAWEGRESGRSGLAESRVIGVAGSVATVEPRLVGLGQRRAETDPLDQVGVGDERPADRHRVGQSGLEYRFGALGVVVAADDQRRAEAFAQALAEALRVGRAAAPFPLGQVQVGDAASQQGFGKVKGHRFRLVVVHVVDRAPGRQAQADALGTDRGDQRVDDLQQEPRAVLQATAIGIAAPVAGAGEELVDQVAIGAMQLDQVEAGVERVACGADEFVADPADVFQGHFPRRVGGRHGPAALAIGDEHLGLGLDRRGRDRRLAAGLQRAMRHAPDMPELRGDQSAGGVHRLGDLAPAGQLRLAVDTGGVGVALAEAGNLRALADDQPGAGALRIVESVQGGRHVARLLRPGAGHRRHDDAVAQGQVAYGERGEEQVGHGLFLSKAAGRWLEYLYRSLNNMAMATLVK

SEQ ID NO: 18738 - protein, 151 aa, Pseudomonas aeruginosa
GMVPGSRDAWELHEEGSDAFRRPLGGTRPGPAGRFAGGHSFHSRPVRRGRLQRAATGLRGTGPFLPGVHPRRLSRQRSGQRRGTRQQPQLCPGGRPGGRQPALEHAPGCRQRARRRLGFRRTAGPVVALPVLPAQRTLRTRPARRRPCAGV

SEQ ID NO: 18739 - protein, 200 aa, Pseudomonas aeruginosa
RAGAAHWRAAVEVGALGEGRLSLRRRPGRIADARAGRPRLVPRRRQPGPARSSGSRCRAVFPRRPAAAGECRDRLAGAGPDAPARRTPADPRQRSRGPSAGAWRGAAGSEPTGATPAPVTGHPGLAVAGGESTASAARRGLPAGWPAARSSRCRRAAAAARSTVRAAAPASVAAARAAAAGRVRRARGAFSQYPCVPCGA

SEQ ID NO: 18740 - protein, 290 aa, Pseudomonas aeruginosa
APHGCRSACGCLRPAGCTCACLRERSVGLRSEVGQPAQLAAAEQPDQQEGGAGVERAGDAEGQERRIGGGIDVAGHLEQVRHCGGERHRGGMQHQDHFVAEVRQCPAQRRGQDDAPVEGEAAHAVGARRFHFAVGRVPDRAGEDFRHVGAGVEDEGQHRAVEAVAEERVEKVLGAYGIQAVDAGVEEQQLDVQRGAAEHVGVEPDRVAQQRVAAGPRHRQRDGQQEAKRHGEDQQPQGHRQSGQLQAVGPQVGLPVFVEYRVHGSGLLTPSELRRSSHSSAALEIAVMAR

SEQ ID NO: 18741 - protein, 299 aa, Pseudomonas aeruginosa
KAAGRRSGRAVEVEVEVAGVDSRVGSVGADRRQRLVQVLAQRHVLLAQADAVADPEVARVVQHRSGQFEILADRLVEEAVAGLHRALQRGVEAAHDEVGVDLVLVLVGDDPHPLGGPFGLGVGLLVGALADPHALAAQALGVGQERRATAYHQAARRVGDAVGEGDVLCAFRRDGHRRDDGVDLARQQRRDDAVPVAFDPFAAGSQLRAEGFADLDAEACQAAVRLLVFERRVGRVDAQAQDLACPVGGAGRCGEEEGEGDAAEGSCHCGCPLSIRARQAARPLKTLAQARKRSASRTQ

SEQ ID NO: 18742 - protein, 200 aa, Pseudomonas aeruginosa
STSARAPKLAAWPRASSPMRRSSRARVSAVRARTLRIISALAGITLETVPAWIAPTLTIAVSCGSTLRETMLCKASTMAEQTTTGSTVRCGTAPWPPLPITRMTTVSAEAMKGPGWKPRWPTGYPGTLCMAKMASQGKRSSSPSSSIARAPPRPSSAGWKISCRVPRQCGDSTRCLAAARSIAVWPSWPQACITPSTWLA

SEQ ID NO: 18743 - protein, 341 aa, Pseudomonas aeruginosa
ASGGLAGRLALAMMTTFRCHLGKPVKLHQLQALVASADAGGIRAAARVLGISQAAVTRALRELETEQHLPLFVRTPSGLTFTEYGKALLIHARLVLKQLEHAQVELDHLRGQASGRLCIGVTPWVALTFLSEAVQAFRERMPEVRLELFESLMAVAQPLLRDGSMDFAIGPLHGAQAAQEFACEKLLDYDTAVLVRQGHPLAGCGSIHELLEQDWALNYTGDGHDALMRELFWRHGALIDERRIVRAHSVAILQTLVEQADMCTWVPAIIGAAPPLLGRVVPLALRETFEPRRLGIITRRGGALSNPAQCFVECLLQVIRRHARSAKKDDRRLFETLRLLV

SEQ ID NO: 18744 - protein, 573 aa, Pseudomonas aeruginosa
FLLARTYGRSRSVVLRPIAWKATSEDAGMLQWFANLSFRRKIALPILLLAVLLLLVGALGVHGIAQLNESNQRLGKRFLPGIALLLNADRDLYQAFVAERSLLEGHLSAEQIAGLRNDHAENLQQALDRVRQYAAMQPGEAELAKVAEFERGYALWSATSARVLSLAASDPSAAAQLSYGDSDRQFGAMREVINQLDEMEEAAAAADGEASSALGERHRWQQVALVAFGLLVCLSLVLVFPGLVTRPLQRLLQRLEEIANGDGDLRVRLEVTSRDEPGRLGSAFNAFLDKLQPLIREVGRVTGEVADSAGSLAGMTAANDRLINSEHASVDQVSTAATQMSSAVHEVARNAQSAAQVADDARRQAREGANVVEATIEVIRQLAQEVESSSESIQQLAQETASIDAVLTVIKGIAEQTNLLALNAAIEAARAGEQGRGFAVVADEVRALAARTQDSTKDIQARIERLQAGVQNAVRAMQSGSLKARDSVERAAGVDGVLAATGDAVGRINDLAAQIASACEEQSRVIDEIARNISEVRELSAQAAEHSEQGTGASRRLSELSSELARLVGRFRV

SEQ ID NO: 18745 - protein, 361 aa, Pseudomonas aeruginosa
WSGRPWGVSPAVSGEPSLGRAALRSNRGGLDRLSRNADQFPPPEERSRLHESSRTPGRARYSRGDETNEWEDLTHDGEPRLDRPGPRRRDRDRDPARPFRGPRLRSALARQLPDRLHRDRRAAIQLPPTPTRQHRRPGIPGRTGGDPRRSRADRRRLHLLDAVPAAGLAAARTAGDLRRCAQRPRPRLPRQPHRRPAPDPGHRPGLPRPAWPRAATAAADRPGAGAGAAARAPRLARGEAIRSAPAAGGAESPRLPACALLPGHRPGRAGQRLRHRPLPPEPCIQGRLRLATLRLPGPVAPGQGAADARCRRATGGPRQRSRFRRPEPSRPLVPARLRDDPGGLPPAVHPASRLRPGASPG

SEQ ID NO: 18746 - protein, 206 aa, Pseudomonas aeruginosa
RLPRHRSPSMQSLVPFLLFAVVASITPGPTNILVLSNSQRHGLAAAWPIVLGACAAVAALILLLGLGLGELLRRHPLLQQGLAWLGVGWLSYLAWSLFRSAGGIDGAEPPRRLGVLGGAALQLVNPKAWMMALAALALFAGEGAGQAGRIGLLALLFFLVSLPCLASWALLGVGSARLLRSPSLMKRFNQGMALLLLASAWAALLL

SEQ ID NO: 18747 - protein, 230 aa, Pseudomonas aeruginosa
RSRWICSDQLRRRSRRMKNSPPMAAVAMPMGRSWGAIRVRAATSIQTRNSAPSRAHTGSSRRCSAPTSRRAACGSMRPTKPMAPLTETSTPVSSEQQTKTHRRTRRASRPRVTAVCSPAISAFSARPSPSSTSRPPATHSAGSQINDQRARPRPPSIQNSTEEAARWSPRNSSRLASARSTNDTATPASNSRSLPRRPPRLATPSTSSMLPRAPRKAASGRVSRPITSPM

SEQ ID NO: 18748 - protein, 111 aa, Pseudomonas aeruginosa
STTNTAPRVAPEVAPSRCGSASGLRVTACRAAPTSARPAPTQAPSSTRGARISQTMCSWPALQAPGSAATPNRRWRTMRPTRPLSSRAGPKPRATTQDRPSNMTRLPSNRQ

SEQ ID NO: 18749 - protein, 159 aa, Pseudomonas aeruginosa
AGSARPARHRRRRAGRRAAGGAGSGASCLGNPGQARVVGEGVAVDQGADAEHPPQQVGIEHLGRRALGDDAPAVEHVEAVAEGRRQVEVVEARQGAQAEAAQQAQKLQLVARVEVVGRFVEDQQARFLDQRASQQGALLLATGEAGEGARGTPFETDLE

SEQ ID NO: 18750 - protein, 150 aa, Pseudomonas aeruginosa
SIAGRCCCQPGRTGGRTGCTAQGRGSGPAVPASPGWSRPPCSRAGWPGWRRRRSAGRRSAARRRRAGSRRRTCPARGWRCAVARSWGDCRCASRSARRSFRRSRRIRHAPARRSPTAASPGPGSVPGWPPGRPNSAGRPAARRAAAAGWR

SEQ ID NO: 18751 - protein, 326 aa, Pseudomonas aeruginosa
RRAGQHSWQPAMASASNRIGETNDIPAPKPGRGVMSLTHARLEYPRESRFPDLPRLRHVHRCLRRGHRQGLQPGSAAPVGGAAHRDNLRRDRGHHPSGRLAAWPGRQPVRRRLGSLDRLRPAGAARPAHDPQRPARGSCDGTGKARPAFVLDSRGDGAGHQHRRAGGGRRPGLRRRQHLPRRRCHRPGHHDHGHPRHHARPGARRGDRQARGDGRRGGADPGRRDHSLRASQRGVSGAGDGGGTGRGEWVGVRFRRFPNRGSPSAAPRRRRTRGPPAAAPDAPGPAPAGPFPAPPGASARWPGYRCSCSPARRRRGARTTPVRHPG

SEQ ID NO: 18752 - protein, 314 aa, Pseudomonas aeruginosa
RGAGTERGGPAGQLRQVDAGMAAVQVEVAAGELADLAEAAAQAELFHRRPAQVLEHRAGEVAHLDQGDLRQRIAPAHGVLAGVAGTGGDVTDAVGASDIDALMDRGDIGRAGERPDDAAGAEDRQPAEDAQARVHGLQRQLGAALHADGDLEAAGVAPFGGELGEVAFDHLSRHRIDRRLADRQGQPRAGHRTDPGAGMEAHARLGAQAHPGEHQGAMGDVGIVAGILEGAGFRAVFPGAAEFQAHQHLLALGQDDLHRVADRAAQQQARRRQAGGGGATAGGVSAAQRRGLLGGFLTHRGEASWRRACAIPAG

SEQ ID NO: 18753 - protein, 518 aa, Pseudomonas aeruginosa
TRTLCRTIRRARSSPPASASAPRPSPPAGCRKRRAANWPAGSATSSTTSAMPTWKPRSPPRSPVSARTSRSIAEPPEDGRGARRAPAQPSPREREQQFRSIHMQRYSGFGLLKHSLSHHENWQRMWRTPTPKPVYDVVIVGGGGHGLATAYYLAKEHGISNVAVVEKGWLGGGNTARNTTIVRSNYLWDESALLYEHAMKLWEGLSQDLNYNVMFSQRGVYNLCHTLQDMRDGERRVSANRLNGVDGELLNAQQVAEEIPYLDCSKNTRYPIMGATIQRRGGVARHDAVAWGFARAADALGVDLIQQTEVTGFRKQDGAVIGVETNRGFIGARRVGVVTAGNSGHMARLAGFRLPLESHPLQALVSEPLKPIIDSVIMSNAVHGYISQSDKGDLVIGAGIDGYNGYGQRGSYPVIEHTLQAIVEMFPVLSRVRMNRQWGGIVDTTPDACPIIGKTPVQNLFFNCGWGTGGFKATPGSGNVFAATLAKGEPHPLAAPFSIERFHSGALIDEHGAAAVAH

SEQ ID NO: 18754 - protein, 137 aa, Pseudomonas aeruginosa
QKPPEGRNPLPLALQGEGAGQPARTVSGGYKMLNIFCPHCGELRSEEEFHAKGQAHIPRPLDPNACSDEEWGDYMFFRDNPRGLHHELWVHAAGCRKYFNVTRHTVTYEILETYLIGEQPSVVADGEKKPAVQGEPA

SEQ ID NO: 18755 - protein, 179 aa, Pseudomonas aeruginosa
FSPTSRKSSAAACWTPARPSTASPPPSGSRTPWPSCKACRKSSCYRAPRSTATTTTTSSPSTSGAPTTSARSPRSARSASACTACAPSAWYWPPAPMSGRWSTATTTCPATCSPARFPPMYGATAWHRARNWCWPPTTTTPTASPSTGRKPACKWWPSPTPGPIRAASGSRKHANAVCG

SEQ ID NO: 18756 - protein, 135 aa, Pseudomonas aeruginosa
TACSGSPRCSPTATRPGVAPPSTPATRPPPAACRRSSRAARKRPSRCSRCPTRSPRHAHRSSSSIRRTTSPPPPSNWPAARASSPSSTSSATPRWASAPTRASWATSTAWRSPRGPRARASPTPAPPCSVRTTPR

SEQ ID NO: 18757 - protein, 304 aa, Pseudomonas aeruginosa
RHEQPSPLPERGYRTRSLAMSRTPDTWILTADSPSLLGTVDVVTRYLFEQRCYVTEHHSFDDRLAQRFFIRVEFRAGDGFDEASFRAGLAERVAPFGMRTELTAPGYRSQVAIMVSKADHCLNDLLYRQRIGQLPMDVVAVISNHPDLEPLARWHGIPYHHFPLDPNDKPAQEARVWQVLEESGAELVILARYMQVLSPELCRRLDGWAINIHHSLLPGFKGAKPYHQAYQKGVKLVGATAHYINNDLDEGPIIAQGVETVDHAHYPEDLIAKGRDIECLTLARAVGYHIERRVFLNANRTVVL

SEQ ID NO: 18758 - protein, 267 aa, Pseudomonas aeruginosa
RSIRRVPAAPYGYVDMGGWVGGQAEYVAGAIRRLQPAETAQPRSGDGEDPRPDLPFGHPPHRLPRRGHRRRRPGQHGLHRRRRSGRPGRGGLGTPARRGGGDRRRRQPDPPGPRQETGLRDRRPVQGHPAARTDRRSTGRAGGRLRGRCGRFRGARPRPFGLAAGSPGHRAQLADGHHPGRRQDRHPRPVRHRRPGRGGRGRQARRPEHPLRPGLGQVAQLPYRPDPGDEVQPPADAGDHVGPDQDRRHRRGGSHHPRRCAERLRRV

SEQ ID NO: 18759 - protein, 321 aa, Pseudomonas aeruginosa
NGSVILLPSIRLPETAMNTDSPINRVEQVQVDDLACWRIHTAHGEALIAQQGAQLLSYQPHEQPPLVWLSDEAGYRRGQSVRGGVPVCWPWFGPLERNPQEVRGQVEDGLKAPAHGLVRAVDWEIDDIAEEDGDLCVSFRLDAPDGLPGWPHPAALRMLFRFGERLTLRLTSENLGSKPLVLSQALHTYFAVSDSREIAIEGLEGARYIETLENWEERTQHGAVRVKGELDRIYLGLERDLLIKDPRWERSIHLHALDSRSAVVWNPWVDKSRRLSQFADDAWQQMLCIETGRVWDDLMVVAPGRSESFGVQIWSEPLKRP

SEQ ID NO: 18760 - protein, 689 aa, Pseudomonas aeruginosa
SHDSPSLRVYAHVLRLPWDSVEKPWVQCRPPTQGWAGGNRSRLDQRLDLGDARLQRRPVGTTQGGVADLAAVLEGLAVVMQVAVGDGDHLSHRGDRADEIEHRALADLGGRAQRQAGDGAQVVLELAALGAFDGPVPGVVHARGDLVGLQAAVHLEELEGQHADVVEPGQHAADVVLGQRLQRMPAAGHGELEDAAVVGVVHQRVETRLAIASAHRHQRDFPGERHEALEDARHAAQFGERALHVGRLAQDLLALAVVAQGAGLEHRRQADGGCGGIEVGLGLDVGEVRSGNAEVLEHRLLEPAVAGDAQRLGVRVDRHELGEEGHGFRRHALELEGHQVDLVGQLPQVLLVAVVGADVLAQGGRAGVRRRVEESEVHAQRGSRQGQHAAQLAATDDTDFHGSSLTFSEPVSRIARVGIVQHGFGLVGAELLQRLVVLRVLGAEDARREQRRVDRAGLADGQGGDRYAGGHLHDGEQRVDTRQHRRLYRHAEYRQVGLGRAHARQVGGAASAGDDHFEAAAFGFLGVLEEQVRGAVGGNHLHFVGDAQLVQHVRGVTEGAPVRFGTHDHANQCAHRRASLKCAVRRVRNQQATLRRGAWLVLGRAGGQCRFEGGAVYRKGRPGARRGLPSVPFFRAMAGNLPQLNARLPRAARLVVAARSEGAAAAPVPQPVAVPVKGTATGAQPRPRR

SEQ ID NO: 18761 - protein, 216 aa, Pseudomonas aeruginosa
RSTPGRKTRWRRSSATSAAPTGCWSPRYPTAPSARPSAWPAAAAPLPWSACRRVTSRRRSSTWCSRACTSPAPSSAPARTCRKPSTLPAKAWSRRPSIRASWTTSTRSSTRCAPGRSRGASSSRCDLRGGVPAPPLPVYSTLPSPPSSLRQSRRIAALRTSAQRYRRISCGTNHCGPPQIASSPRSSSLTTLSRGTQATPMPCSAMLFRLSAIAVS

SEQ ID NO: 18762 - protein, 305 aa, Pseudomonas aeruginosa
VQVPAPEQRCEHGAVDQRRLPDRHPPGPAARPRHPAGQPRQPDPGLRRQGRRIRRRTEDGPHPIAGRRADDPRPGIPRFRHHPRRRPRSPASPGAGAAHRSEPRRHRHRHRHQRRPRLPEARRRAPGRHQRAAAETGRRPDRSHLRHGRLRAVLRHAQAHRGQAVEDLQRPAPALQRPAHRHQRDQPAAAPAGQFDHAGQGQPGDPGSGQPGRLRSDRQRPRPDPGGRRRPVATERDGAADRLQDLRLDPPAATRHGHAPRTLHHRHHRQRRALPRTGRAQHRPGHRAEPVHRLRELHADRQDRP

SEQ ID NO: 18763 - protein, 161 aa, Pseudomonas aeruginosa
SGGTFTRTWNRAMSTSLQIRPVGAGDHAAWLPLWEGYQRFYKTEIAAATSDATWQRFLDADEPMNAALAWLDERAVGLVHWIYHRSCWTVGDYCYLQDLFVAEGLRGEGIGRRLIEHVYAEAGAAGCSRVHWLTHESNSDAMKLYERIADKSGFLQYRRIL

SEQ ID NO: 18764 - protein, 297 aa, Pseudomonas aeruginosa
TGAPSPLHPTPRSTAASSSSNRSIRNATATTCGTPCKGLAPTRCCGNTWPTARSPSARRSTPGWPARRPAATRCSSPCASGARSAPSACSATCGSRRRMASSKSAISPSARLCSAHRGLPRRSTCSPNSPSAASATAAWSGSAMPATPVRCAPPSAWASPTKAPSASTWWSSSATATPPGSPCSTANGRRDRRRSSAGSILPTSTPKAASGRRWRRCATSPWQGLPVAQRYSGSQCRLARMCATALATPNSSTSTIAGVPPQARNSGLPKRLREARAISAGTITAQNAAASPAKPMA

SEQ ID NO: 18765 - protein, 158 aa, Pseudomonas aeruginosa
SAPAARRAVGQRRHSRRRARRAHPGRANSRPTRQPMPIKKGEHHAPPGTLTVCRGQPAISIRISPGLTRSPLATWIALTVPAMPAWTSVSIFIASVINTAWPALTLSPSFTSTSTMLPGMVVLTWPGSLACLRPLAEPATYSLSGSNTTSSGMPSMDR

SEQ ID NO: 18766 - protein, 334 aa, Pseudomonas aeruginosa
PLEKLYSRPTDLGQSVTGMRKSLMRMTLRQLQVFRAVCESRSYSRAAEEMALTQPAVSLQIRQLEELVGQPLFEYVGKKLYLTDAAEALLKTSTDLFQRLESLDMQLSDLKGSLQGQLRLAVESSAKYITPHLFKAFQNLHPEVSLSLTVVNRTQVIKRLADNRDDLVIMSLVPQDMALEFLPFLNNPIIAVAPPDHPLCNAAKLALKDLEPFPLLVREPGSGTRKACEEFFQQRRAHFSQIQEIASLESLREGVIAGLGLALLPRHAAHQELANGLLRELPVEELPLYRSWCLVHAKGKRLSPVAQAFVAFVREERALISQLAGRFAGPGGSS

SEQ ID NO: 18767 - protein, 505 aa, Pseudomonas aeruginosa
LYYKQSATPSQRRRELALSTPATPTSCDILVFGGTGDLALHKLLPALYRLHREDRLPADTRIFALARSALDNAAFLALAERNVRAVVARSEFAAEQWKGFAARLDYLAMDASQSADFGRLARHLKSSEGRVLVHYLATSPSLFAPIAQNLSIAGLAGPQARIVLEKPLGHSLDSARAINQSIGRVFDESRVFRIDHYLGKETVQNLMALRFANALFEPVWRAAHIDHVQISVNETLGVENRGGYYDHAGAMRDMVQNHLLQLLCLVAMEAPVRFDAEAVRNEKLKVLQALKPISGLDVQDKTVRGQYAAGRIGGQEVPAYYFEKNVDNDSDTETFVALQAEVENWRWAGVPFYLRTGKRMARKCSEIVIQFKPVPHSLIDGGGGPANRLWIRLQPEERISVQLMAKTPGKGMQLEPVELDLNLAEALSRNKRRWDAYERLLLDVIEGDSTLFMRRDEVEAAWGWVDPILAGWREHYQSPRPYPAGSNGPEQAQLLLELQGRRWLE

SEQ ID NO: 18768 - protein, 656 aa, Pseudomonas aeruginosa
SVPAGCTASRPAPAPAAARRRSTARRRRSPRRAPRPRRTATAAGPATGPPARLASASPVVLQFLGPGAVGVGRLERTEPLLALGLRDVLLAAGVVAGRGEAVDRAEQRVGLVFARSLGVVHDQAIAIQPGVHLALEAARGAAQLVGLGLAVQRHAVETVAQDEFAQAVQALRVLVIGGQRRGRLGDGRANVAGLGLVALPAEQLQAVTGAVDIAEAGAQLGLRGGFAEQREVLAEVGEAAAAQVLVKESEQRGIALFRRRALLGLAAQQRGVGDVAQEDAAQQRLLDRRTFGEDLFQLAAALVVERQGQLQLALLVRLRGLRQQFQPERLGGFPVLLLLQRQPAQGLLAEADVVEAADLLRQRFEGLRRVLVDIEAIGRLQVGEQFGMRGEAGLLGLQRFPGEAARGRRIVGAHLHQVGHRQQQRSLDVAELDTGQELVVDLLDQVFQGHVALPLLGFGELRGIVLGQQLLVAGQPMHAPLQALGRGGVEPLRIRLQVGLEGAAGLFQASLVDILQLGEAHVVEGVLLGGVEQGARLQVQGGFLQPGLRHVLQRLEALFGFVEATAVEVGRSLQVRGEGLACGRLDALREHTAQFLLFPAAGTEQVQAAVGQGLGLRLAQPGVTHLAKKRQRAVLVVAAAAAALALEEFGAGDLFR

SEQ ID NO: 18769 - protein, 731 aa, Pseudomonas aeruginosa
NAAMNDDLSLLLNSLNDPQRQAVAAPLGRQLVLAGAGSGKTRVLVHRIAWLIQVEHASPYSILSVTFTNKAAAEMRHRIEQLLGINPAGMWVGTFHGLAHRLLRAHWREAGLSENFQILDSDDQQRLVKRVIRELGLDEQRWPARQAQWFINGQKDEGLRPQHIQPGGDLFLATMLKIYEAYEAACARAGVIDFSELLLRALDLWRDHPGVLEHYQRRFRHILVDEFQDTNAVQYAWLRILAKGGDSLMVVGDDDQSIYGWRGARIENIQQFSDDFADAEVIRLEQNYRSTASILKAANALIANNQGRLGKELWTDGEDGESLSLYAAFNEHDEARYVVESIESALKGGLARSEIAILYRSNAQSRVLEEALLREKIPYRIYGGQRFFERAEIKNAMAYLRLLDGRGNDAALERVVNVPARGIGEKTVESIREFARGNDVSMWEAIRLMIANKVLPGRAASALTGFVELIENLSAKVMDMPLHLMTQTVIEQSGLISYHKEEKGEKGQARVENLEELVSAARAFENSEEEEDLTPLQAFLSHASLEAGETQADAHEDSVQLMTLHSAKGLEFPLVFLVGMEEGLFPHKMSLEESGRLEEERRLAYVGVTRAMQRLVLTYAETRRLYGSETYNKVSRFIREIPPALIQEVRLSNTVSRPYGGTSRNAGGSLFSGAGVPETPFSLGQRVRHALFGEGTILNFEGAGAQARVQVNFESEGSKWLMLGYAKLEAL

SEQ ID NO: 18770 - protein, 519 aa, Pseudomonas aeruginosa
RRKIAETLDWRAPNNSSSEVRSMYRDRVRLPPLLDKVMSAAEAADLIQDGMTVGMSGFTRAGEAKAVPQALAMRAKERPLRISLMTGASLGNDLDKQLTEAGVLARRMPFQVDSTLRKAINAGEVMFIDQHLSETVEQLRNHQLKLPDIAVIEAAAITEQGHIVPTTSVGNSASFAIFAKQVIVEINLAHSTNLEGLHDIYIPTYRPTRTPIPLTRVDDRIGSTAIPIPPEKIVAIVINDQPDSPSTVLPPDGETQAIANHLIDFFKREVDAGRMSNSLGPLQAGIGSIANAVMCGLIESPFENLTMYSEVLQDSTFDLIDAGKLRFASGSSITLSPRRNADVFGNLERYKDKLVLRPQEISNHPEVVRRLGIIGINTALEFDIYGNVNSTHVGGTKMMNGIGGSGDFARNAHLAIFVTKSIAKGGNISSVVPMVSHVDHTEHDVDILVTEQGLADLRGLAPRERARVIIENCVHPSYQAPLLDYFEAACAKGGHTPHLLREALAWHLNLEERGHMLAG

SEQ ID NO: 18771 - protein, 482 aa, Pseudomonas aeruginosa
PWDARTHRCIRPTDASWSALRGSGVQSRLAGAADMGFGAQPGATDEVFLAVVDDMEDQAVVAPFEVAVQVRVQPRQAQRHRVVPLAQAHVEGEAVGDALAGLQVGERLVQAVGIDPVHRLAEAVLDHEAEDQPLDVLANLDLDFQRHRLAYLDHLQRALPLVDHPYVEDRCLAGAGNRPYLAVGEHFLAHGLPLALGEQGVVVVHHFFRPPAHGHPSLLQEDRGVADGLDRRAVVGNDQQGGAGLAETADALEALVLEIGIANRQGLVDDQDVRPPGSRHAERQAHLHAAGVGAHRLLDGLGDFGEGLDLRHQRLDFLDLHAQQLPGHEDVLPAGEVRVEAHAQLEQRGDPAGHADLAAGRLGGAGDHLQQGALAGAVDPDDADRFARLDGELDLAQDPVQVVARRAERHQPFEQPAPAIGILLVGLAEAGYAYLSHQSSSTISPTRWRNRRRPSAHSSSASRVIGSNEGQSGHCPWRNSCW

SEQ ID NO: 18772 - protein, 331 aa, Pseudomonas aeruginosa
ISSFTRISTSARSATTSVAPNTATTSSSRPTGQSSNRWDRSTWYRARTKSTRSTGNCMNRAKTACSSPSPRRTRRRGACNARCCAWSPGSSSRFPTWRGTAIRRRTGARSWPAMAQPSPSPSRLPARFAGCWAKIFRYWRCRRRSGRTSPRSASKANGIRSSPARPCNSRAASSTAACWAFPPTASSHRSGKRPRTRSSRSSPRRPPSPSPNRSLSQNQSQSRFLSTGGADWSSASTTCCCGTGKPSATWYPYRYAAGCSVTCAGRCRPRQRRWKRCRSHCPRPSSRCRPPSPSIRRRCCRPSTSTSRSSWTGWSTSRCSIRWTGARTGIS

SEQ ID NO: 18773 - protein, 198 aa, Pseudomonas aeruginosa
PGNSRSAIGNCPPRPTNACAATAPATWSASAWNPSFPPARQPLRPASNWRPPPQATFHADHHPLRGPTRPPSGRTSGARSTAITSSSRNSVRCWKRSARWSKSAIPTNWWTASTTTAASAANPASSSPSRRPIARRSTMPARPSRCSPGSSAPCPAKPGTANRATTGDMCCATADGPSPTPASRSTWCAPPWVATTRY

SEQ ID NO: 18774 - protein, 285 aa, Pseudomonas aeruginosa
STTSTPTTPSSSTPRKKPPPGPTTRARPTARCATSPTGSRCAGPTGPVSRSLARSRSATHACPRMPAPASNASAAASWPWSACVASSTKRHKATPPPCKASRHDPRPAPTLAFPSRCGERAGVATHVRSARCGAGWLVPQRNRRTARRLRHRRPGHPARSRLRRRRRHPLRRPPGRFGDLHRQRGGQGAEPGAAGRGGGPAALHRPGQRQRPAAAARRLRRQAGVHGSARTRGQPSAGDGRTRASRAPWRAVPAERAGPGRRTPAAGHRPGRLLPGAQPHPHLFP

SEQ ID NO: 18775 - protein, 443 aa, Pseudomonas aeruginosa
ARRRRPRPYPAALPGADGRLGTALGKPPGPSRRSGDQAPARPFHAQEPGDHRAQAARPRIVADMSGKRILDIELLRGLAVLGVVFHHLHGNLFSGSPALLDGINQRVQFWWGVDLFFAISGFVIARTLIPQLREAPTRQAFWEQARYFWIRRAFRLLPSAWLWLALILACCLLLNRSGAFGSLSANLAASLAGFLQVANFRFADSFYRYEYGASFVYWSLSLEEQFYLLLPLLILCLRRYLGWALLALVLVQFFSLRTPLLMVLRTDALAIGVLLALASLQPGYARWNPTLLGRAWSGPLLLAAVAAALGVLASEAYSLVAVRIGAIALLCGLLVWIASYDRDYLLSNGPLKRLLVWVGARSYAIYLIHIPAFYLSRELCFRLGWDAGERPLSLLAISLVLIVVLSELNYRFVESPCRDLGSRLVKRLSAARRVATTSGATSC

SEQ ID NO: 18776 - protein, 266 aa, Pseudomonas aeruginosa
TSSRRSSRRPAPPPSPSPRHPHPRRSTRTCSGCATRCSAAGSTRRPTSCSAAFRFPPRTPCSTWGAATAATFISAPCAALASSSPTSTRKRSPGPASAWPIPRPANWNAWSATATRCPWLTPRPPGWSPPRSSSTSTIRGSSSPSWCGSASPAHSICSACRIPRRKTCRKTSPPTNTSANPTTSACSARSSSPHWCAKPGWKSSATAATASTGRCGCCCSGRPRSISAIPTIPSSNTGPGPGRRCSTRRAARPSSRPWTPWSPRAR

SEQ ID NO: 18777 - protein, 181 aa, Pseudomonas aeruginosa
PARRSRTNCYAMPGAMRPASSPAMAASVVRAWKRRCAGCVSRTPSWRPAIRNWPKQFLPNRRSPPFRRTSMRRSSMRHSPLFAALLLALCATAAEARSVVATSNIIVRALDRSIDFTSDTTTSVRDMKVVTEARDDAASFVASDGAIRGAQLEAAMRTLRSRLPEAREASDQVLAEAILAL

SEQ ID NO: 18778 - protein, 157 aa, Pseudomonas aeruginosa
SWTARRSPAWSSAPRRVTGATTASTTSSPTIARWKPSSCCAAASPGDRCKAWTASPPTACSRCWRTASWPIPVCSTTPRKPCAWATASTPSATATRRCSTCSSSACTFPRTRSRTGWRCRPGSASPGSPRPTCAPARRCCCSSRPRCGASCCSPRTS

SEQ ID NO: 18779 - protein, 262 aa, Pseudomonas aeruginosa
LTETSDRFMEWLTSPEIWIAFFTLTALEIVLGIDNIIMISILVGRMPKHLQPRTRFFGLALAMVTRILLLLSITWVMRLTADLFHLFGQGISGRDLILFFGGLFLLWKSSSDIYQGLEGEEESGDEPKGSAGGFIGTIIQIAIIDIVFSLDSVITAVGMVSHVPVMVAAIIVAVLVMMLCAGAISDFIDKHPSLKMLALSFLIVVGTVLIAEAFEVHVPKGYVYFAMGFSLAVEALNIRMRGAAARKRGEEPVKLRKEVLGD

SEQ ID NO: 18780 - protein, 628 aa, Pseudomonas aeruginosa
TLPFHRGRWRRCPGSAAQRTRNLARGWPFVVVPGGPRHAETARPALCRRPAGVGHAYRPHRNPPGLRRRPAAHPQSQRGKTPAGVRRRHRRHRPGAKQQRHRPAGHLLRRPGPDGTGAGPGDHARRRCRHRADGAGADPRPVVAFAIADLLRRDFLPQPQTDPPRPARPGIHRPRPDHPGAPADRRRRRADDPSQGRQGTVLQPDRRHHARRADRRVVRHDFLFQPGRRAAYRDPRRVQGDLAESRAVPGGRRQPRQRHPGHAQRHRAKRRRSPGGPRQPVVQGRRLPAGAAPGGAAGGLDGSLAVQHSRTGDRLPRALQRRALPRLPAADQRHGQLLHPCDARPCPSRRRRPAAPSRPRRPRHAEPGAGQRGARDPAHGRHRRADAEQSDADHPRRRSAARQGHPQARRRRRRPLHRDQAVSGKDAARGPVRTRQPALGGDHRAGDQPGAGRRHHRAHARRRAGQEDLAQPLVLRHRPGRDRHPVPAVGLQPAPGSLGVPQRRPRQRQAPAPGQAALPSAGTALRPCPCRPPAPAGGTEHRDQLAAPGPDQRHEASQLAVLRHRLRRAGQSRRAEQRGRRGHSAGRGRLGRRSRRHDLGAAGRASARRGASGNAPFATLAVLRVGSS

SEQ ID NO: 18781 - protein, 229 aa, Pseudomonas aeruginosa
SIRYSRYFQFQARPMRSLSTLLLFCLLCPWSYADQRSEVEAFQLENGMGVLLKPTEQHRHVSIRLVVGVGFADFSCREKQLPHLLEHLFFSGLDGGDEADLEARMQALGGQWNAYTSEGDTTFVIEAPAATQRQVLDLLLDTITRTELDEPRIAAAKRVIEREGGGHYSHLQRWLDRENLGRGAMDQLAGKLALACSQRAPLAQAWRGAAGAAAQRLLRTGQHDPDPGR

SEQ ID NO: 18782 - protein, 177 aa, Pseudomonas aeruginosa
TTRCTPTCVCVADSPTGHRPIARCSPTRASSASTRMSSAATYPPPRPPCASCSAASASMAWTRVVSSGCNSPSAPGWPGAPRATRRWRTITGARWPTTRTAISPMRSAAWRRSACNRRTRWRSGCSTAKATCASKSRYSTTTCSTHCCSPPVSWPAACSGSACAAGAPDRATGPGGG

SEQ ID NO: 18783 - protein, 436 aa, Pseudomonas aeruginosa
KLLSNNLKLPERCELKGFERLSKASRPSVGKATPFSLVDLQKGERSLCRAKETFATRQLSFVHTQETRPGLCCAPRPAGRAAPIENPLVPMPNQQRPVLKARLEQLIALVGGLMARYPRTIALFGFCSGVFSFIMVDRQKGFAQVLAIIMLVSWVWLILENLLRETFARRFGWEIPAPLLRYATQLIHQESLFFVLPFFLITTTWNSGQALFTGTLAAAALISITDPLYYRWLSRRRWVFLAYHTLTLFAVLLTSLPILLHLTTPESYRLSLGIAVVLSFPSLLVTFPLQHWWRGFLLLGLTLAVGLAGWFGRTWVPPATLWLTEVAVSSQFDDQSRTPGDSLEQVGAAQLRSQGLFAYTAINAPRGLDERIYHVWMFNGKEFDRIALDIHGGRKEGYRAWTHKQNFPGDPVGHWQVKVLTEAGQMIGTLRFDVTQ

SEQ ID NO: 18784 - protein, 424 aa, Pseudomonas aeruginosa
RRSLATSGEEPVAHGDGGDDPGQVRGQRAAHRVARALQADRAEIDGEHVEGGLGTALHGGGDQRRETVDAVGLHGLQQHRPRRAAGERLDQRGGQRFDEAAVPTQPLDRPAYPAEYHFQRPGGAQHANRAKHCDQVRQQVPGDVETFLRPLHEALVDRHLLQRADDQEQHDQAEQRQVAQQRGQLRQRGGRERAEHRHEAGQQQRAGDQVGQHHRVPQAQALHQRHRQQAGQGRGAGGQGDRQEYQGRIGRALLRAVHEDSHRQQGQGRGVEHQEEDLRIARGGAAGIELLQRLHRLQADRRGGVVQTQAIGGEVQGDQADRRMPRRHFRHQPAEQRTEQHRQALHQPGLLGDAQKAEPERQGAEQQDHHLDRQLGHGEQALHHRREHRRIAADQPARQRTRRRHQEKTQPQAVQHSESPALRG

SEQ ID NO: 18785 - protein, 230 aa, Pseudomonas aeruginosa
TRITSLASGSSEAKPKLATVTAIRAKTPIGAYFMIMWVTLNMVSETPWQHLHQRLAQVVGQARQAEAEHHREEDDRQHLATGDGGEDVGGNQVEDGRDERMVMLHFLGGLLVLGNVHGTQGAHVDAGAGLEQVGQQQADDDGDGGDDLEVDDGLQADAAKLLRVADAGDADHQRGNHDRHHDHLDQTDEDVAGRLQHVGDPPGLFGAEMVEHCADGDTECQTDHDLPGEA

SEQ ID NO: 18786 - protein, 384 aa, Pseudomonas aeruginosa
WPPARPSTRPPRPSVSMPRPCTGSASSMAYEHAAADEAPDPVVPQHFRADHRLAVRPAARAVQRDAARPRPGTTDVAPLRDHRGEPATAPVARRPAGHTAPRNPRRAGPGALAKRLPTSPGTGPGEYRRQRRAGRPGWRSRRLPATAGAHPGAAQGAHGRQRRLQRSLQYPAPTPAGPAATGAGRHQRRRDQRPPPCLPGRRPAWPGGRRHPADRFRHRPQHRPALRRADRNPGAGGGQDRRRRFRRDPADDQRRRGRPVDPAFRPDGRGPAAVSQDQRRRGAFRRAAPAGGTRQHRRRPGDLRQPGTHRTRQPGRDPPAVRLQRPPWQADRRNTQRCRCPGGGGKGPARRSPGRGDARPGGGRRRRVAPAGLVAVSGHPSRRA

SEQ ID NO: 18787 - protein, 431 aa, Pseudomonas aeruginosa
SSHSGPSKVVRRVISIASAEGPATAGVARGTSSGSPSGTSPSSPWGDGKIRRMAITNRMMPPAIPVASRDRPRPLRMCSPRVRKSSSRPRAKASSRNATRRRRPGATPFSAARNTAMLPKGSVTRKIRTATPNISMGVSRAGQPVILPGGTILASRGNTCRRARPESSECALVALQATSRRSRPARLARYSAWSARSKTASPASLPSNAVMPAEQVMLRGSPLKWNGQAAIAARSRSSSCRPASRDVAGSRTTNSSPPKRAMKSACRNRLRNSPAMIFSTLSPARWPKSSLIRLKWSMSSTASSRSPPSRCRRATSCSRRSLSAARLGRPVSGSVRAFCRWSSRWLWNALASCSMLLTRSISACRRPDTSCSCSACSRWCSSMEASRPFSRLSTASLRLFRSVACCTLACRPLTCSRSDWSKPRALSSTSV

SEQ ID NO: 18788 - protein, 359 aa, Pseudomonas aeruginosa
ASSTACPSRLSTGVAGASGALSTSAGIAGDGSAPASSSVSLKLRPAGSGRLSSQISRGSSSRIWFGSPRSATPTQPAGALSMAATVQAGNGCGGPPGASSCSATGRDGAAAAGWIGVLLAATTDGTDALGSAVVSDSLPPNRRCNRLGRPSSASPPLRSASAWRCSLLSSLSRIGISRDCRARSSISRANCFSGLRSSRGRSRASNCWASSPRASMFCWVRCWRRCSESSTAFSRRGIRPDRPASMSSRRRISRSSFMHWSTALSLPSAARLLRTRPRRSRSIRASQRRCRRSCCSMFSRYLSFQRWTSSRLMADSRHPRARPRPCRAGCPAGESPPIPADGRRSAGRARRPARERDRN

SEQ ID NO: 18789 - protein, 404 aa, Pseudomonas aeruginosa
ESGYASFTPRRGQCRSPAGFGPVSSTGGSGHGFQHCSDGGRKKGQPRPPFFIHLFCRATQRSVQTLDVAGNRGDVLVRQLGGDGLHDLGVAVVGAGTFAEVGQLLGHVGRVLAAQVRETGGCDADAARGMATGAGRHAFGDLAAAEQRFALGHQVRIGHADAHLLAGEVGGDVGQVLVAEVGQQPGHFQHGTLAVLDVMHLLEQVTLALAGQFREVRRRAVAIRTVTGAAHRGFRLARGGIASGMGKAGQTQGQQQTHEKFVHQLIQLRLRVKDSGLRLLLHHPLDGCLVVFGTAVGAQAAGRHGVESVGHMLDQGRHALGQPRLPGGMVALFRRHRQLAVVTRATGPVEHCFRVLRRMRRNGHRNDCRCEQQFLHDRPHQGERPRSTARKMLCPFPRALDPGG

SEQ ID NO: 18790 - protein, 216 aa, Pseudomonas aeruginosa
PMSEKNPIVGLCQKASFLISAAQVDQCPPDEGLEVAFAGRSNAGKSSALNTLTHANLARTSKTPGRTQLLNFFALDDSRRLVDLPGYGYAKVPIPLKQHWQRHLEAYLSSRASLAGVFLMMDIRHPLTDFDRLMLDWAQASQLPIHVLMTKADKLAFGAAKNALLKVRREVQQGWGDVATLQLFSAPKRQGVDEAQMVLAQWLGLLDEEQEAFEEA

SEQ ID NO: 18791 - protein, 172 aa, Pseudomonas aeruginosa
LSAKRESSAHREKLFHGTLTGHSGPARKARHTGLATVHQWASSQFEPTPASTTSGTSRVAAPLISGRIPSHTCSTSSSRTSSTSSSCTWRITRASRPLSCSQLSTATMARFMMSAAVPCIGALIAVRSAALRMAPFFEWISGRYRRRPNRVSTKPCSAAWARVRSMYARTPG

SEQ ID NO: 18792 - protein, 225 aa, Pseudomonas aeruginosa
STSRPPPTPVSRPSAVFSPTPGTPGMLSTLSPIRARKSMISSGPTPNFSFTPSTSRRLPVMVLTSVMCPSTSCAMSLSPVEITTGRSAAALLRARVPITSSASTPSTHSSGRPRARTLACSGSTWTRRSSGIDGRLALYSANSSSRKVGPLASKTTANGLSGYCLRRLRSMFSTPFTAPVGLPVEVVSGGRAWKARYRYEEPSTRTRGAWLMRGINLFRRPGRVE

SEQ ID NO: 18793 - protein, 293 aa, Pseudomonas aeruginosa
HVGVHPTRTLDPGSLPRPLRPGPPAGFPWHRRRLREQQLLRQPGTRRVRPDPGRARPGAGPAVLHRTARRAPRGRPAGALRPAHPRRRGPAPSRRQAGAAATAPGRPPRAAAERPPLPGSGRSARPPSRRHPRAHPRTPERPWPALDAGTRCQPRPATTGTGPRPARPGPGGDRRAGCRASSAAARQPACRPVPRQRAVRRPAPGRPDRLLQRLLRLDALRPGDHPERLVLQYRRQPGPGPRPRPARRLRQPPAVHRAGSRALAEHAAGRLRALLAVATDRRRGVRRTGRADP

SEQ ID NO: 18794 - protein, 176 aa, Pseudomonas aeruginosa
RLYPRASQPMYKIAPKTPLACQPHDHSQCVSTALAEADALCARQGVRLTELRRRVLELVWQSHKPLGAYDILAVLSETDGRRAAPPTVYRALDFLQENGLVHRIASLNAFVGCNNPEHSHQGQFLICRTCHTAIELEQPDISRAIVAGANSVGFAVESQTVEVVGLCGTCRDQKDA

SEQ ID NO: 18795 - protein, 334 aa, Pseudomonas aeruginosa
TAMSAAQGTPSRSAATRPSSSCSARTLAAWRSTTTITTTPTTSTARWSRPVPAPCLQAPASLLSTSTAPTATMADFLLNALLAGLALALVAGPLGSFVVWRRMAYFGDTLSHAALLGVALGFLLDVSPTLAVTVGCVLLAVLLVTLQQRQPLAADTLLGILAHSTLSLGLVTLSFMKEVRVDLMAYLFGDLLAVSASDLLWIIAGSALVLALICFLWRPLLAITVHEELAKVEGLPVGAIRLALMLLIAIVIAVAMKIVGVLLITSLLIIPAAAAQRHARSPEQMAVGASLLGLVAVCAGLALSWFKDTPAGPSIVVSAAGLFLLSFVLPRRTV

SEQ ID NO: 18796 - protein, 110 aa, Pseudomonas aeruginosa
CRPSFACCPSWRRRCWSAPARAMRRRNRRRWSRPRRSPPIPMPNCSKPWPPASSNRPSNNGWPCAAQPPATSASKRSAASWPRPTCSAGKPRCVKETSTPPPAPSAMPAD

SEQ ID NO: 18797 - protein, 339 aa, Pseudomonas aeruginosa
LTAHASRQARAPAVTASPHPQGSPSDRIPRRPQDLSSCRSGNPRLATDPPEHPGRADFRPDRPFRCRQEHPAAPDQPPRGAQRRPHPGRGRRRHRPRRRRPAPFPPARRDDLPALQPAVLEDRRRQHRHAPAPGRRLQPCRSRCAGLRAARAGRPVRPRAQVSGPALRRTETARRHRSRPGLPAEHPALRRGHQRPRSADHRLGPATAGGNQSRAEADHRPHHPRDGRDPSCLRPGRGHGRRRHRRAGRCRRCLPPSAAPDHTPLRVRGRTGRRRRASRRFRPRAGSHPAPDLPRRSHLCATAGHRGSADRGRLQHPFRTHRPHQGHALRPVDPGPGRR

SEQ ID NO: 18798 - protein, 233 aa, Pseudomonas aeruginosa
RTCGGTALMDFFETMSFANIDWYEIWLASVDTFWMLGGSLLFTVVLGLPLGVLLFLTGPRQMFEQKAVYTLLSLVVNILRSLPFIILLIVMIPLTVLITGTSLGVAGAIPPLVVGATPFFARLVETALREVDKGIIEATQAMGASTRQIIWNALLPEARPGIIAAITVTAITLVSYTAMAGVVGAGGLGDLAIRFGYQRFQTDVMVVTVVMLLILVQILQTVGDKLVVHFSRK

SEQ ID NO: 18799 - protein, 180 aa, Pseudomonas aeruginosa
VQQGQGHRPGRRDRRTHRAAGRLLEQVQEARRTAFRRYRGDPQRRHQRRPRPAPAGQGRGDQAQGQQEHHRHAEGHRRQSEEHQDPRTGSRDPAARADPGRHGADQYQLRPGSQAEPDQGCAGHRRQRLALREHPRRAAGQQGQRRHAEAGQGPAQRRGQAVHPGEIQRRGGTGVLSQAA

SEQ ID NO: 18800 - protein, 110 aa, Pseudomonas aeruginosa
PAPMTSSASPTGCSTAACACTATADASAVSSPATWSPICACCARSADCSTTAPCSPTSSTTSAARTCWSCSTIAATRARPSTWPRPPRHAAHGWCCSPTSTPRRCANTPT

SEQ ID NO: 18801 - protein, 251 aa, Pseudomonas aeruginosa
RPWWRAWARRSTNAWRASTSSATRSAVIFWRNDPMFSLPHHSPRDLPFGRRQTAILFVDMQRAWVEPGRDPHVDPQAAGYFYERVQNQVIPNQQRLLRAMRAVDENVLHTVIESLTADGRDRSLDHKLSEMHLPKGSPDARVIDALEPTANEIVLPKTSSGVFNSTAIDYVLRNLGTRHLIVCGVVTDQCVDMAVRDAADRGYLVTLVEDACATHTPERHQACLEAIKGYCWISDTETVLQRIAALGRSNL

SEQ ID NO: 18802 - protein, 149 aa, Pseudomonas aeruginosa
STRAAPGAATATCACCPTRTAGCASSRVPTPLRRRSTTCTATWWKPTARRGRPARAACCGPRWNAIATAACRSSRRSNTNSACSACPASVRPRRFRCRPSVPPGSSPAGWSAPWPRLAPSRRCSSPNTASASTRSPAARRRAWPPPTAR

SEQ ID NO: 18803 - protein, 262 aa, Pseudomonas aeruginosa
RRAFPTTTCAATMPSFTDNPELGIYQLPPYRLLNPEGAHPVVLVCEHASRHIPLELQRLGLDQAAAEEHIAWDIGALALAEELSRRLDAPLLAAGYSRLLIDLNRPLEAPDSIPPHSEIYPVPGNRELSETVRRYRQDCLFHPFHQRLTQLLDERQAAGVPTRVVGVHSFTPVYHGRPRPLVAGVLYRNAGAYARRILDGLRRHGLEVAGNQPYAIDPAEDTTVPVHGDARGLEAVLLEIRNDGLRTPDAVYAWAERLYPWL

SEQ ID NO: 18804 - protein, 154 aa, Pseudomonas aeruginosa
RSAALASSRTLPGQPWAISRASSAGAAGCGSRPRRWLATLAKCSKSSGMSSRRSRIGGRRSSATFRRYTRSSRKRPARASASRSGLVAAITRRSTWILWFEPSRSSCCSCRTRSSLTCCANGMLSISSRNRVPPWACSSLPMRLPCAPVNAPLS

SEQ ID NO: 18805 - protein, 193 aa, Pseudomonas aeruginosa
SHGPGLPTSAPGRPAWPPAPGRPARYAGRRCAARPGAPAPPGYVAAGGRYASAGAGTSRGRPAPAKCRRRPGARWRRRPGCSRCRAASGGSSRRWAGPAIARGSPSRRRRFPPAPDGCLRRSCARSGGAGVSGAGDRIAGSPPVRSGPRYPAVPVRGSANRRGWRGTRCPWRRWPGPGRGSGSTAVPDRETPA

SEQ ID NO: 18806 - protein, 345 aa, Pseudomonas aeruginosa
PRWSRARRRRRRATFSSSSSTPCLAQCCLASSNARSRTPWARHHQAAAAPNRSMTKRLPRVTSGIRCRGTASLPVLPAGSEWGVFSPCELAPILRRLSCRKSSHATYAPPARHPVPCGLRPRRQCRGGVPDAAHRNQRLAVEHGAILQPHPVRSMDRAGAAAGADSGAGGRYCRHRRTGQLRRGAVRLSRQRRPGPRHSRCGGTDQTGQPSGVVPLRPGHGPPGKRLHRGPGSQRLPAGRSRRGRRLPVPQPVGAGQLLRPPAELPRRLRGNGTEPAGTRSQGNPGKAPELSGQGRRHLRDAAGGRRSGLAPATPAAGLPAATGRGRRPGLGAVPLSPAARRRPA

SEQ ID NO: 18807 - protein, 321 aa, Pseudomonas aeruginosa
RRRNMSGRLRQRCVGAALVTVESQAMDHAAGDLALAHDHQVGAVLLQVVHLGVEMRPGDDVQRRVHRAGVAGDLPGLEAVGNGDQQPARLGDVGQFQHAGTGGIAEDHAVALFAQFVGLVALVHHYHEGRPGGAQASADQPANPAMTDQHRMLALQDRRRQVLRRHLADPASGLRQALLLALLQAIDGDEQQRIDQDRQDRPGQHQVAALLRHQFEANAQADENEGKLADLRQAGGDHQCGAVRMAESTDDQVGGHRLAEDDDQEGGQDRQRLLQQDHRIEQHPHRDEEQHRESVAQRQRVLRRLVAEFGLVEDHPGEEGA

SEQ ID NO: 18808 - protein, 245 aa, Pseudomonas aeruginosa
REGHPEQHRRAIGDAQGNGQHGQGEELPRTAGGDPLQHPGHHPATAEDHQGDEGGDLAQGNQQRPEQTGVAAVGLAAEGAGERRQEHQGQDHRQVLDDQPADGDPATLGVQQLALLQGAQQHHGTGHRQAQAEYQAAAEAPAEQLGQADAKQRGDADLHQRPGNGNGLHREQVLEREVQADAEHQQDHAEFGDFLRQRLVGDITGSERPGQDAREQVADQRRNAQAIGQGPEEEGEDEPRGECSE

SEQ ID NO: 18809 - protein, 257 aa, Pseudomonas aeruginosa
TGPFPPGIAPMPAAIRILLLALAVLAGIGAAAIQAEDTPCATAAECNTRGTQAYRQGSYPQALDAFAWQLRLAERQEQGGADSEQALNNLALTSLKAGQPGRARAWMNLALDRGYSGKATRYNLEQVALKVDYPSLQGLAGHYLRYAGQAEWESLQIEPVKGGYQASFALMRIGNPEKLMEYGPAAVGELSGRLEGQGALYRLRSEGLGAGCSLLVWQEGIDLRVVESLGGNCQGYGGMGIAAAGNWVKISSQARDD

SEQ ID NO: 18810 - protein, 301 aa, Pseudomonas aeruginosa
PATPAAVHSGLVEIPAPVLLADLAHEGTVFGLLDRQVDLQEILAERLARPGRALQRAQRGQPVARQRLGGLSVAVASDRRTGVESLANTQAHRREQRRRRQVGIGVGAADAVLDVPAGRRAAGNPQRHGAVVDSPGRRQRRVAVRLEAAERVGVRTEQRQRLQQARLHSTDGLAQQRGPGRVLAGEQIVASGVGQADVQVQAAAGKIGERLGHEAGLQPMAIRHALDQALVAHAFVDRLERVEAMLQGNFHLPRRVLRNRRARRQALGLAGGIQVIEEWLQLLQLVDAIDLGRPRPLAIHL

SEQ ID NO: 18811 - protein, 254 aa, Pseudomonas aeruginosa
SKTNGAEHAQLQPDAFPASGATGDPELTMAENLQERLYQRLREDLLAGRFQPGERLKIRDLANQWGTSPMPVRAALQRLVAEGALEGEAQRSLRVPLMTRERFLQILQVRLSLEGLAAESASGRLDEQALEGLEGCLRRMEDALRQREVQAYLEANSEFHLTLYRACGNPVLLRLIETLWLQVGPFFNRLFTEADLSLRLNDFHEDALDALRRGDGPAARAAIEQDLAYFGQYLLNLLELEARPRKRHRSGEHA

SEQ ID NO: 18812 - protein, 727 aa, Pseudomonas aeruginosa
PHRAQDKCRGWPSAMAPDEWSVNPPTEMKKPPFPGGSGGFGGPRRDRNHSGSVLPDTGHQPWLVLALGALHPPAFAEGFALVEARGLRHTAEGQGGDCLVGLVVDAVQLHDQVVDVGGLVGVADLGALLLQPLQHLRGDELGDLVHLVGIPMLLQGHEVFASGTDEALLVEPARRVDHRARRSGSSGGATEDRRLGRHFALHRRVPGHRRLALVLLAPASGDEAEGDEGHQGDQQDVEHLDALEAVAHEHGSEQAARGDTGQRAEPARSTAGGSGGTSGVGGGSSGVRRSGRLRLAGLVAGCRAEALAAAEALGIGIQADGQRQAEGEGDAENTLHCSLSLLGESTRAMLRRYGRQDQPDFVSGYCSPAAVFSPAASGSRVGARVHLRCRGRQACTRIGARRSARRPGKHNAEPRRNVCYSFFQPTDQALADASLRVCEAARSPRLPTHSPSEDRRHACRRFHPGPRRDHAGGGCGHYPLPPPAPTGGPRLHRRRLHHRPAHPALRTDPRRRHDQDPGRTRGDLPDVLPRPGVQPAQALPGRRHGVHRGVPGNRPDDLDRLRDRSLLRVEHHGLAVPRRDPGDLLHHHHRQGARRPEDEERALRPTDLRRADRRGHPRHRHHRPAVGNRRERFGGNRRGVLHGRQAQPVHDRRAGRRHPPGATPAGLRGEVREQRDAAGHRARPVLRLLPAGGEAGIQHGARRLPDRRDHGRVAPVGADRTIDRAGP

SEQ ID NO: 18813 - protein, 78 aa, Pseudomonas aeruginosa
PRCGYSPSPAPGVAIGPFALKDRRISAYPLSRSADSRSAKTTPLLFQPSPHAAFPRWHGTCYRAIQYVALAMCRCAAP

SEQ ID NO: 18814 - protein, 195 aa, Pseudomonas aeruginosa
TGGSMRNGLMSLSLRLPLGRPAGPCEPLGAVCAPGVLCPTVGAGGGGAALDGLGWLDASVLGSGSGLGLGSGFGLALGMAFSTGLGLGFGLGLGFSTGFGFGGSGLGSSIFGGVGSGAAAGGCGVGSAFFSSWTKFTCMVFGSSPWPRLSSAGVGITHTSAPMIATCIATAAPEDNHQRDLGGSPGTSSGSLPWA

SEQ ID NO: 18815 - protein, 327 aa, Pseudomonas aeruginosa
GISTSSTATSSSRRAPEQSTTRRLGSPRWAFTHGRDSLSSPWAGAVGWSSASAASEKRSGDREGCGDMRATCGEVKGKEVESSDNYYHSVASSGQPWRIIPRPSDTPGTPLRAPFHPRLRRGSVPADYPAATRTCPSYPQTARHSLHTNRPRNAAPPWLAAVRTDGSARRPLRPDRNAPTAPAASRWRTGRPARARRAAVARQAAPFPTEQAPPAGPPRSSRYLPRQRWSADRAMPGDRARSSATAGPAGARARRSAASRRAFRICSAATCQPLPAPVPVPPAAVGRRPARRHPAPLPGVAGPGRRTREEPAAVSTAPADVPTRRVR

SEQ ID NO: 18816 - protein, 247 aa, Pseudomonas aeruginosa
SKRPSRARRPTSSSRSSRRVQQIQPLLISTSRSSARFRLTSRWTSLPSILISLISLTITATRRFSRFFSTWLSSVLLPAPRKPDSTVTGRRWFTVGNLFSCAARGVRASPGALSPRCRGWRWDATAGGAGRSARRFPGTSRSRRGPGAPALRRSCRAASSPAPAGEVAIAAVPRGKPGRPRRWGVRDRAARRIRLRCAPEVPGADAAAGRGRSPAGLRPCRQRRAGQAVPVRSWAEPGKFKTLYYNN

SEQ ID NO: 18817 - protein, 129 aa, Pseudomonas aeruginosa
PAGGSAAAAKALAGRLRAERRQVAAGGRALPEVALHASEDRLGQALAMAFVHQPATIAAIRDEAGLHQDRRDVRRLEHGEAGLLDTLLVQRGDVRQLAENAVAEVQAAGDGRTQGHVEDHPGEYLVAAL

SEQ ID NO: 18818 - protein, 459 aa, Pseudomonas aeruginosa
VQDQAMALSRLRFQGEAARPDRLAQVEDDARPAATQLAAADGAHGAVQRQLGERCEQLRVGQVEDQPLGGLQGKGSITRRAVQFQHQAPAFRGIPGPGLADSYIGAGGQERLEGQAGEQALQEATALHRRNTRLQGSALANTLYYNIQAISRPCLPFFEFSMNALTLPDIARQTTTADLPLDWVGMQGIALPVQIGGQRVAAEADAGVSLDDPQARGIHMSRLYLALAELEQGELDLSRLRAVLQRFLDSHAGLSRRAYLRLRLAPLLRRPALVSPLSGWKRYPLVLDTRLEGDDFQAEVHLELTYSSTCPCSAALARQLIQERFDQDFAGQPLDHASVLAWLGSSAGIVATPHSQRSSAHLRIGLAEDCVGLPLEELADLGESALGTAVQTAVKRADEQAFALANGQNLMFCEDAVRRLHRALQGYPQASRFSIRVVHAESLHAHDAVAESHWQRGAA

SEQ ID NO: 18819 - protein, 223 aa, Pseudomonas aeruginosa
PSASTAPSPTAPSSTVLAKSATGSSSASTACCSTAGSAMAAWSATTRWSTAATCQRVSTYRPPSASVRAPTWRACRGSAFPPASSRKTWRAPTSTWYAATSRCRTSSEHAKPADPQCPDGQRGTGTRRRSAGPPRSHRTHRRLPGKLRRQPGDRCRRTLPAAGNDRRPGALPRAGLSTEGLDRQRIPRRRGGRHHQFHGHAQYPPGDAEPRSAGGKEAPRRRP

SEQ ID NO: 18820 - protein, 317 aa, Pseudomonas aeruginosa
RDQLRFPLRRQPRQPRHRGRPRSTRGRRGEGVHGRLHRRHAGGRPADSGAPVRQRSDPAAEPLRRHAADRSQPGALATTLRRTYSGSRPPAHSRRRGLLPFHRPGGGTGATTWHAAACPALIHSARTGPVRGQAAVPETHNRGSLRPPPAVRRQRLRPPRPSAQVQPGDQEPRGPRRPAQGAGRQPPGRDRHRPRAARLGREAAGLSTGAGRPATGPACVAGTPGAGPRRLAVAGHPGGEDQPPGRRTVRHRRSRFPPRRLLGRPGAGQRTGAPGAGQRHAAAVALQLDAVPPPGIPPSDRYHHRLRAARLARGTPV

SEQ ID NO: 18821 - protein, 436 aa, Pseudomonas aeruginosa
RLPGTAPAVFPLKSCPQPAVDIRSPTALAQGFHRRAKEGIGLLLAIVHLRLRPGAPDHRHDLLLAVDVEVLAEDALGFEGPTVMLGQGLGAHREGPPLVAVAERVFAIVELARGQVGRSLDATGTIDPTFGEDTFAIDHPVLEDELAEAAIVAQGRAQAAAADLLPGRRFQLPEAVALHAHSRPDPLGQVVAHRNAGRRVQQLTLQVRLAGAVGEVGTARVLPRQARQQPQDATGTFGELGVEHLPAVGLRIAIGLVPADPGTHLQDLLHRHPLVGGAGQARQVLVHRLVESQQALLHGGAHQGRGDRLDHRERGPARAFVVAQAVALQGDLAILEDQHPANAVAPHEIVDAVFLAADPVARRDGHTRRQRTDLGPLVDNPGRIDLVHVPVGVRLVFRDQFIEIGGTADPRVFHSRVGAGRAACRDEQCQQGRPED

SEQ ID NO: 18822 - protein, 458 aa, Pseudomonas aeruginosa
RPGTRKRPGPRRTTRAASFPPQDAARSDDRSCIDSLQPETRGTRSAARTGATEKRASLGQYALLLVEALGAGMQRNRQVLRRLVQGDVLGGSMGGDQARQVVEHQLGHLVGQLVADPGVADQDIVDRHRRHVLLLAVVGAGGNARGVVGRAVDLRHHVRRDRDEGDRHGRGQVADGRHAQAGGLQRSVELAVLDQLHRLGVGQVLHLAHVLVAQAGGLEDRSGVQLGTALGRAHRNALAFQVGQGLDARGLAGHYLDIVRIGIADSPQLLQRRLEAGVGDPVPGVGDRVAQRQRQFSTPGLQQVEVLDRSLGGLHRGFRALDIVPVDLREADPYGVIDPAGAAGEDIDEGRRGKDRGTEGHRCGKREKTEASAQRHGKSPVLIVVVALSRKRPGFLRPRRTSCRLDRPATQDNQQGPIARPAPQGSRSPAFRRTGRAATRAARGSHPRGGEWRGSGAG

SEQ ID NO: 18823 - protein, 508 aa, Pseudomonas aeruginosa
FLQHSRAPSGFRGEPLEAIRRSLLRNRALAPRISLRSLLFSPPFLHQPNSHALHSPSGSSLTLAPAPRAGAPLAFVRSFSQREHHEPENFPAFTEARRPVPAGPVDGRILRRRDRVHAVLHARAAGAGVPHHYQRRRLADLQLRVLLCDRRAVAGLLLRPHATQEAAAARPGPLRGRYSGHRHRPDPGNCRRPAGDRGHRLGNHHPDHLRPGRGGGRPAKTGRCHGPGDARHDPRHCRRPGTGRPPLGLLRLGGALPVGLVRLRAGLPDGTPAPSRASRGTARRGPCAGLVQAMEHPQATDRQGCLERHRGRRPASLGRGAAPALRLQHRADRRQHRRLRRGPGRGQPRRGLPATLSEARRRHAPAGAGAPGVIDVDLHAPAATVTRGALLPGRLGRRAGPGRAGGHGGTRLALRAGQGHGAVVRRDVQQHRHSRQRAPGCATAGAEGAARHPVGIGHRPGDRRLAHRAGLVRQPQERRGAAVARLTASAGAACLPRLLGHAAGVTRR

SEQ ID NO: 18824 - protein, 440 aa, Pseudomonas aeruginosa
LAERTGVPLRAKMSMPLCTPERPQGSNQKVRGFQSRALAPSTGIRGHSGSTAQAMSSPSTIRFAGFGIRAAPLLLDFFRALPVFQVLLPGAAEGQVLRRNLMGDGGAGRGRRAIADLQRRHQRVVRADEHIVAQLGAELVRAIVVAGDGAGADVAVGAQLGIAQVAQVAGLAALAQAGILQFDEVADMGPSAEHAARTQAGERTGIATLAQLRAFQVAVGLDHRATPQDAVANHAVRSDAHVVLDHHAAFQHHIDVDQHVAADRDFATDIQALRIEQGHALAHQLLCAQALVVTLQLGLLHAVIDALHFHRVQRLGAGHHQAVADRHGDHVGQVVLALGVVVGQAAEPVGKALARHREDAGVDLADLALRRGRVLVLDDGLHRALVVTDDAAVAGGVEHVDGEQRQLVRGDLRQQALQGVQLDQRHVAVEDQHLVCTEER

SEQ ID NO: 18825 - protein, 298 aa, Pseudomonas aeruginosa
GLGHRMARTELFGLEHEIQVVGGHPLTHQIRAVADHHVDPFRLQLARAVDDVAEHRLAGNGMEDLGQGRTHAGALAGGENHDFKGHGLDYRSWWSQAKPVSEDAKRKKGSPQATLFPDTARSTGWKSAAELLAQLLDGAQLGCGFGQTRGSGAVVELGALALQRLFGSLQGFLGGRFVEVAGTNHGVGEDLDHVRLDFEETAGDVVHLLLAALLDQADGARFQVGDQRRVARGDTQVTQSAVRDNHLDQAGEDLRLGADDVAMDCYGHTLASHERPSPGAQDYSFLAFSTASSIPPTM

SEQ ID NO: 18826 - protein, 175 aa, Pseudomonas aeruginosa
RPRLDLGCQFGNQLLVRVCVDRSTQDLLCAGDGQGTHLGTQGVLDAVQFLFDFRLGLGLQAFAFGTGLVAGFIDDLVSAFLRLFDDFGCLSLGFAQLLARFLMSQLQITSRAVGSVQAVSDLLLTLLQSRDDRRPHELHAEQHKDEERNGLANQGCINVHANTSLVRCPSNTQIE

SEQ ID NO: 18827 - protein, 498 aa, Pseudomonas aeruginosa
SAGPGRPAAGVACRRRGRRLARQHRARVRRRGVGLPQTSSALLQLAARGTLLQVDQQQRNRSRRDAGDPRSLSEGFRTGLVQLVLDFLRQAGNPQVIDIHRQAGIFAGAQTGDFLLLAVDVAGVLGANLHLLGHLGVIHSVAGDLHQAGVIDLGAAQQVEQIVFMGQRRTEALGDGVALRGIRPHPGALQPLFLAFDTFALGFEGSPAPIVDKAQLASLLGETQVGVVLAEDQAVFRPRGEHAVRLLGAERDQVVHQHADVGLVAARAPAVLALRTQRSIGAGQQALGASFLVAGGAVDLAGEEQAADDLGLQAVPEIAGIEEVVLDRIARPHDVGVFHATDGTHDLQLHVERQGRGNAVGIQLVGRQAFRLEEDLVAFLIGEAMDLVFDRRAVARADAFDHTGIHRRTIEIGGDDLVGPGVGMGDPATDLLGMLFLRTEEGHHRDRRVARLLGHHREVHAAPVDPRRRTGLQPADPQRQFTQTTRQCDGRRVAGASA

SEQ ID NO: 18828 - protein, 249 aa, Pseudomonas aeruginosa
VVLQADVDKSAEEGAGSQDHVVGMEAQSHLGHYAADLILLDDQVVAGLLEYPQVRLVFQCMADSGLIEHAIGLCTSGAHCRPLAAVKDAELDTALVGGFGHGAAKGVDFLDQMALADAADGGVAAHLPQGFHIVGQQQGFHTHARSRECGFGACMATADHDYVKTGREIHHAPRPVQKQEFRKAGQYKDLANLNEDSWTKNSQSRSREQNGSAGLQKIKGKECLYLFRTCVYYLAAAFLLISTSSPVKT

SEQ ID NO: 18829 - protein, 316 aa, Pseudomonas aeruginosa
VPAARGTVKGKYAANLALVIHNSAWAEPHYLPMQKLEKMRPSRSSGVNAPVISPRCCWAWRRSSASSSPAPLWISWLWPCSSACPARRSASKWRRRALKPLSAVCSKPMQAFRCSRSSSRPAPVRAERVMVTWPSALSSRPMDSVDKSALLRIRVTLPGSGRWSRNSGHRENGSAASGAVASTTSSTRSASPMAFSARSTPIFSTWSSVSRRPAVSTTCRGMPSMWICSRSTSRVVPAMSVTMAASRPARAFSRLDLPAFGRPAMTTVMPSRSRAPWEASRCTVDNSVRTFSRSPSTWPSARKSISSSGKSMAAST

SEQ ID NO: 18830 - protein, 529 aa, Pseudomonas aeruginosa
ALISLCRLSNLWGISVSVELWQQCVDLLRDELPSQQFNTWIRPLQVEAEGDELRVYAPNRFVLDWVNEKYLGRLLELLGERGEGQLPALSLLIGSKRSRTPRAAIVPSQTHVAPPPPVAPPPAPVQPVSAAPVVVPREELPPVTTATSVSSDPYEPEEPSIDPLAAAMPAGAAPAVRTERNVQVEGALKHTSYLNRTFTFENFVEGKSNQLARAAAWQVADNLKHGYNPLFLYGGVGLGKTHLMHAVGNHLLKKNPNAKVVYLHSERFVADMVKALQLNAINEFKRFYRSVDALLIDDIQFFARKERSQEEFFHTFNALLEGGQQVILTSDRYPKEIEGLEERLKSRFGWGLTVAVEPPELETRVAILMKKAEQAKIELPHDAAFFIAQRIRSNVRELEGALKRVIAHSHFMGRPITIELIRESLKDLLALQDKLVSIDNIQRTVAEYYKIKISDLLSKRRSRSVARPRQVAMALSKELTNHSLPEIGVAFGGRDHTTVLHACRKIAQLRESDADIREDYKNLLRTLTT

SEQ ID NO: 18831 - protein, 807 aa, Pseudomonas aeruginosa
SMSENNTYDSSSIKVLKGLDAVRKRPGMYIGDTDDGTGLHHMVFEVVDNSIDEALAGYCSEISITIHTDESITVRDNGRGIPVDIHKEEGVSAAEVIMTVLHAGGKFDDNTYKVSGGLHGVGVSVVNALSHELRLTIRRHNKVWEQVYHHGVPQFPLREVGETDGSGTEVHFKPSPETFSNIHFSWDILAKRIRELSFLNSGVGILLRDERTGKEELFKYEGGLKAFVEYLNTNKTAVNEVFHFNVQREEDGVGVEVALQWNDSFNENLLCFTNNIPQRDGGTHLAGFRSALTRNLNNYIEAEGLAKKFKIATTGDDAREGLTAIISVKVPDPKFSSQTKDKLVSSEVKTAVEQEMGKYFADFLLENPNEAKAVVGKMIDAARAREAARKAREMTRRKGALDIAGLPGKLADCQEKDPALSELYIVEGDSAGGSAKQGRNRRTQAILPLKGKILNVEKARFDKMLSSQEVGTLITALGCGIGREEYNIDKLRYHNIIIMTDADVDGSHIRTLLLTFFFRQMPELIERGYIYIAQPPLYKVKRGKQEQYIKDDQAMEEYMTQSALEDASLHVNEHAPGLSGAALEKLVNEYRGVIATLKRLSRLYPQELTEHFIYLPTVSVDDLANESAMQGWLEKFQARLTAAEKSGLTYKASLREDRERHLWLPEVELVAHGLSSYVTFNRDFFASNDYRSVSLLGDQLNSLLEDGAYVQKGERKRPISAFKDGLDWLMAEGTKRHSIQRYKGLGEMNPEQLWETTMDPNVRRMLKVTIEDAIAADQIFNTLMGDAVEPRRDFIESNALAVSNLDV

SEQ ID NO: 18832 - protein, 90 aa, Pseudomonas aeruginosa
PRNRAISSSARVTRKPLIPCSTRMPTDSLVKSSTTVRHLIRRPVLSASKTKSIDQTWFGALGKLRRSRSTATPWRRRRRFTIKPAARYRR

SEQ ID NO: 18833 - protein, 340 aa, Pseudomonas aeruginosa
GLLAAALRCPVRPGNPWRSSFGLLQLGQYFVTQFGGGHGEAEARAGLQVALRHGAGQGTHAKDVALALGDRDGAPRIQQVEGMRSLEDHLVGRQRQLQRDQAVGFAFVEVEQFEQLRHVGVLEVESGLLHLVLVEHVAIGDLAERAVGPDQVVDRVHALQVHGQALQAVGDLAGDRIALDAADLLEVGELGDFHAVQPDFPTQAPGAEGRRLPVVLDEADVVDQRVDADGFQRAEVQLLEVLRVRLQDHLKLVVVLQAVGVLAVATVGGAAARLDVGGVPGLRADGAEEGGGVEGAGAHFHVVGLQHHAALLCPVVLQGENQVLEGAHGGRSLAHEIHLC

SEQ ID NO: 18834 - protein, 175 aa, Pseudomonas aeruginosa
SQSGRNRCRLSARMRAARHGAGHGFPHPIAQKGQHMSASSPAAWRGTLAGLIAFHIFIIIASNYLVQLPITLFGWHTTWGAFSFPFIFLATDLTVRLLGKGPARLVIARVMIPALIASYVVSVLFQEAAFRGFSALLEFNTFVARISLASFPRPIVLGQNPRTSRLFRPPSGSFP

SEQ ID NO: 18835 - protein, 416 aa, Pseudomonas aeruginosa
RRPRADSGAHHQADVPRQFADPLDIGIPGTHETRATFTDEGVEAPAARAQGFDRRLGKLQEHAVGFYREHQADAGNVGHQLGQQARAAVGVIGVAQPGIVLQYADPGRGEEAHLRGQLAGLLAAVVEVLGQVAVEEQDRLAHRHAVLGAAEAEHVDPGLPAELRRRAAEEGAGVGEARAVHVQVQAELLAGGADRLQLVRAVHRADLGGLGESHHARLRIVDILALESDVADRRRGQLADLGLRQQQLGAIGEELRRAALVGLDVGGLRADHAVVALAQRSQGQGVGGGAVEGEEHFAIGLEQLAEVVRSTRGPLVVAIGAFVAAVGFGHRRPGFGADAGIVVAGELLGVIGHVGLWNGCRALVGLHAVVPARVRAGTVCQGSLVSFICSTNGTSTWRIAVALPPLGVSRVLRVST

SEQ ID NO: 18836 - protein, 314 aa, Pseudomonas aeruginosa
SASSPASSPTVRRNPPYKGNRHEPDQSPVQRRPHRPQPPADLQLQRPALPGLCRRHPGRRAAGQRRRHRRPQLQVLAGARHRRRRRRGAQRDPADRLPRSHPDPQRTRHPAGALRRPGGHQHQRLAERAERPDGNLRQGRRQADAARFLLQDLHVPAVDVDDLREVHPQGRRPGPRADRGRSGQLRLDEPPLRRAGGRRRPGRPGRRPRRRSQRRAGDSRRRAGRVRRQPAGHPRDPRRQARRRVGRGRRGRAARPAGSHPATALHGQRLPRPQLPHHPRAAHRPPRRGRPARPGPPARAPRARQARGTGRRRP

SEQ ID NO: 18837 - protein, 605 aa, Pseudomonas aeruginosa
AAAGLRQQRPARQHARRRGFHLCTALRRGTGQETGAGHQQRLRLPRRPRLAGSRPASGGHRRRPGQSARRVDRGSTPTRYAGDHWQFGDRGSRRQAGQRRQGRPDRPAGHARQRRRMAGLRPDRQLRRLQPGRAPGLAPGRQAGMARGNPRLRPRRRPAEAHLRRRRERRVRARRGARRRLPGRESRRPRRRLQDHRRQPAEGPAAPRGSVRRAVPGAPREAHGTRTEAVRRSAERRHRRRHRTGLPRGLRVHRARQALHRAGLRHRPGQAGQHQRPGDRRAGPGQEHRRHRHHHVPSELHPGDLRRRRRPPLRAPVRTGAFHRPARLAREERRRVRGRRPVEAAVVLPAPRRGHARRRGPRMPRGARGGRPARRLDPGQDRHPGPGRAGVPQPGLHQRLDQARRRQGALRPDVQGRRDGLRRRRDRLPGRQPLRHDHHHRRRRPRTGVAGAVPPDRMAGAEGVLHLGHRPLRDPHPVRPEQPQAARRSHRHRPGQGCLPLHDLEGRQGRRGAGAGVPHLLHRRAELRGERPGRLRHGRARSARRARREVRPDALRHRDHARPARREGLHHRPPGHRCLGHPGRSQHGLGGGPHQAVLLDRLGAA

SEQ ID NO: 18838 - protein, 493 aa, Pseudomonas aeruginosa
PWRGRWATTSSGGYSSTPIGPWCCKRALSSQPSLKEEGQGEGRFPRPRVPSNTDSPPAASILRPCRATDDFPVQSRAAVDAAHLYPQRQRGNAYVWQSWCGLSRPGQGRGAEHSLSEDAGPAGPADRPRGDPAGGLHQHLRLRPAHGARPYHRAGRPGAGPRDHRRGGGDRAWRGNHEDRRPGLGTVQRRLRPLPYLQGTAHRRLPDGQSGACRRRPTATSTWVAGSAARPNTWLVPYADFNLLKLPNREAAMEKIRDLTCLSDILPTGYHGAVTAGVGPGSTVYIAGAGPVGLAAAASARLLGAAVVIVGDVNPTRLAHAKKQGFEIADLSKDTPLHEQIAALLGEPEVDCAVDAVGFEARGHGHSGSQQEAPATVLNSLMGITRVAGKIGIPGLYVTEDPGAVDAAAKHGALSIRFGLGWAKSHSFHTGQTPVMKYNRQLMQAIMWDRIKIADIVGVEVITLDDAPKGYGEFDAGVPKKFVIDPHNLFRAA

SEQ ID NO: 18839 - protein, 189 aa, Pseudomonas aeruginosa
SARMCSPREAAQASGAGSRKAKFMPSGVPARASMRPSWPPPMTPIFMVRALPSQSLSHASRGSGLSSTVSVWLARNCFSASWYCGCLAPRMLAESSAALTAPALPMARVATGTPAGICTMESSESTPDSIDDCTGTPSTGRWVLAAHMPGRWAAPPAPAMITSRPRPSASSAYWKSRSGVRWAETTFTS

SEQ ID NO: 18840 - protein, 281 aa, Pseudomonas aeruginosa
LRVLQSDLEPMITPTSALIVVPLSNAPSGASETNKPRFVEGRGLYWAEPAGSAGSKAAQYTAKAGRARAGGYRPSRFFAPWRETCRNSMRACHERPDWLSRRAPRERRPRRFRSLSRCPSKAPRQALSPVQGDDHDPATDHESRGRARLRRAAADRGSQGSAARPRAGTGEDRSLRRLPHRPARRRGRLAGEAAVAVHSRSRRRRLRRRGGQRSDPGEGRRPGRHPLAVHRLRLLRALPDRLGDPLRKPAEHRLLGERRLCRIRIGRPELRRNSAEKRRIR

SEQ ID NO: 18841 - protein, 141 aa, Pseudomonas aeruginosa
PRDRGRRWRCRRAAARSGRSPGRTAAGPRRSPRRPAASRCAPGAARGRSPGPSATRRQGRRTPASGRSYPRAGNAPPRRRWWRSAGWRCSAPRCAAARSTAGRSPAPASGRRRTAAPRPARLPGGAGGAPPGRAARPRCAR

SEQ ID NO: 18842 - protein, 489 aa, Pseudomonas aeruginosa
WASRHWPCPSETNPVMSPVASSRIEKDLLGTLEVPADAYYGIQTLRAVNNFRLSGVPLSHYPKLVVALAMVKQAAADANRQLGHLPEDKHAAISEACARLIRGDFHEQFVVDMIQGGAGTSTNMNANEVIANIALEAMGHTKGEYKYLHPNNDVNMAQSTNDAYPTAIRLGLLLGHDTLLASLDSLIQAFAAKGVEFAGVLKMGRTQLQDAVPMTLGQEFHAFATTLGEDLDRLRRLAPELLTEVNLGGTAIGTGINADPGYQKLAVERLAAISGQPLKPAADLIEATSDMGAFVLFSGMLKRTAVKLSKICNDLRLLSSGPRTGINEINLPPRQPGSSIMPGKVNPVIPEAVNQVAFEVIGNDLALTLAAEGGQLQLNVMEPLIAYKIFDSIRLLQRAMDMLREHCITGITANVERCHELVEHSIGLVTALNPYIGYENSTRIAKTALESGRGVLELVREEKLLDEATLADILLPENMIAPRLIPLRA

SEQ ID NO: 18843 - protein, 207 aa, Pseudomonas aeruginosa
RSPVPPRSAGRARCAGRRRSARAGAPRRPGRRSPGSPPVGCARSAPVAAPRCRRGTGRRPARRRGTLAARLPVAAPGPPGRAARERSGRRRGPCLGFPATRQRRCRRLCARRYSPRRATVHRPAPRCCARPSGPGPARGWRASACGCRGGRRGSVRAARRRAGGPGPGRGRGGCRRRRRAVRWPWRSRREESASVDWTCGIDQQWIF

SEQ ID NO: 18844 - protein, 326 aa, Pseudomonas aeruginosa
SCTSASPTSPVSFSTAGFSEAHHARTLELAPRRHSTPRPARRPLRQARTARSATPRRRPVGRPARAWRRPVAVGIPGLRPVRRAPGVRRLAGRPGGQPRPAVLRRARAAHAARRRPAQLPADHAEGWRHRNRPYRLRRAYAAHTGVYRGGLPARRTRPRPPRLPPPGVEVQCRQRPFDARRRAPGLHLRRHLPPAHGGQAAQPRHRLVLPARQRMAGATGGVRALARSFQLRRRRPPAADAGGAARLAPGRDCRSLNGTPAASAGWPGCARPRWPRRTAAPARSPACRPRRGTAGCRSACARPAPSAPERSPPRTPRPARRNRWRR

SEQ ID NO: 18845 - protein, 83 aa, Pseudomonas aeruginosa
WPCASPMRCSSRSGARRTSTMCRSASTRPLAWRTVAATTTTPGRCATWCRTICSSCSAWWRWRRRCVSTPRLCATRSSRCCRR

SEQ ID NO: 18846 - protein, 780 aa, Pseudomonas aeruginosa
RPPGAGSTRSSPAGASTTRARGPTRPAATARNRRNCCWNCRVDAGWNDADIDPAQDRPARARLESRAHVVASPNHDRHHPPPRTAVPRRHPEKHALCLRLRRRCRLRRAAALQPAGAQQRFRPRPTGRRHRRGPRTWQALLRGGQHRPAQRQAENLPARPGAGGRHGSGCADHVRSRPDHAGSPAFPADAHPPVGAGQRGELGRGAILAAAGPDPGDPFPRAVAGGDRGNPPAGAGHGAGSVRPRRLVHGLFRALPAVRLHQPPRPQPGHLHQCLPLGIQGGGGPRGRAGQRGGAGADPGTRRADRAGVPPRGRQPSRRTDGRLRGRTRHLHHEFQGPPRRAARRAAGADRRALAEDRGPHQIPLLRGAHRPGLPPGDRRRGGRQAVRPRPDGHRGVPRPPRLHRGLPAPPRARRVPELPARPFVVRAPAVRRRTHRRTPRRTGRGGGEEPLPARRQRRTDDSARQPEPARGGPAQRRRRGHRGGAGQWPRGLPGAAGRPGPVLRATDARSPARPGYPPAAGRTQRRVCRQGRLRLRSLRVEQEHHVAPEPGALFQVVGGLPVAALDQADPVRQLQAADPREVGGVVGNAVAPLVGLHHHFVDHALEPVDRRRLGVAAPVEQPGDAQAVFAGQAPAQVAEEIDVLVEVAGTRIEVDLDADHRVAGTLPALHLVQHGLVDLRRPAQGMGAVHHPDLTPRQARHRDALGDQPHALAGAPARLADLSLQDVQRLGPRQHRLRRDAAPQPEGAVVLGAHRGLDGRQQRQAQQQARQPGSPAPHQ

SEQ ID NO: 18847 - protein, 140 aa, Pseudomonas aeruginosa
KLAAASRYVAKALPAADSTPCASTPPSSSCSQPQAPSRSRRLLARALVSASPSPASRTWRRNASALSWSLLRQRLPSPSKNSAPAIFSGSASAPICRASSASGEGAGAGGGVSASLAADGAGGWLPSPGSRRNRPNGTRP

SEQ ID NO: 18848 - protein, 854 aa, Pseudomonas aeruginosa
LHPHLAQLAEGRQDTIEGVQPLAFGQLQLQLRRRQAAVGKRRAHYVEQVALAQLVDREVHRDPQVQAPLAPLGGLQAGPAQDEFTDLADQPALLGEADEGRRRDHALLRMVPAHQRLDRVRAGAGQAQLGLVMHVQLALLDRLAQPGFQAQAFEGAVLQVVAEELEGIAAELLGMLHRQVRLAHQHGDFPCLLGKQADPQRGAEDQLVAEHAHRLAQLDQQAFGQARQGRGAGAAIEENGELVAGQTRQGVGFRRGAPQALGHLPEQLVGDLVAEAVVEQLEAVQVDQQQGQPALLLARPLGRLVQPLAEQPAVGQAGQFVVVQQVTQALLDVAAGTEIGEETDDVGRLAIAVAQQVELQPLGIGIAILPRIHQFALPLPVLAQLGADLPVVALGLGGIHQQAGVAPDHVLAAIAGDATEGLVDRQQVVGRIEDHDALAGRLEHCRGQLLLLFQALARADVAARAEHPRHPSPRVASHGPATILQPAPAALPVAHAVLHPVQLAAPLEMFGEGATDARQVAGVDAFDQPAIVLGTAPGVAEDRLEIGMLDPAALQVPVPQPQFAGLQGHGQARLALAERLAGRAKLLGARLHPALQGVAGGAQLAFDQAPLADLLGELAIERFGLGVDAFQVQVQRLGLEASQQRALHQPVDLPGDHQQRHQQDQAEHAPALQQAMRLQQQENDGWQQARQGESEEGRQAHRIGDAGGEDRRRHQAEHQHLLEEGIGRDQHDHRERQGQARGAGAAQEGPPPVAAGLATAVGLLEGGDLQQAQDGEQHQPDQPAAEQPTADLAPHQAGAGHAAEQHEQGRRARAEIKEPGTLDGDFAGVEPQYIGAAARQRQGLDMDGHRRLFL

SEQ ID NO: 18849 - protein, 151 aa, Pseudomonas aeruginosa
CSATPSWKPCSGAARGEGPEEDDMLASWAFWALLSALFAALTAIFAKIGLDRVDSDFATFIRTLVILVTLGGILAVLGKFQAPGSILPRSWLFLVLSGLATGASWICYFRALKLGPASLVAPVEQIQRGAGGTARRGLPRRTPGTCAKGWA

SEQ ID NO: 18850 - protein, 517 aa, Pseudomonas aeruginosa
CPMPVRGAWRIRALTAIRMYCLAMRRGLAEGEQDPRDQLPTRLVPADPAPFADRSLGRELARGFEAGDQVRQGLRIGEVEVGHEFAADLAEHRDVAAHRRQAALHGLHQRQAETFHIGREDQRCGMGVCVLQALVGEVVEHEQALVQLRMLPHPFHQRLALPADASGDAQPRLRTLGPGTLEGIQQVTVVLPRLDGADHQEYRRLGLEHAQQIGLDGGAVLHQVQLRTQVEIIEPALRDLLRADAPQHLRAHFVADGLGNRDVAVGGGRDPVEPVVEHLDQAGIAELRMGQGNQVVDHRDDAHTLALEAFRQREEIGVPGGVQQDQLVAGPMFERGRAHGCRLLLAEDAVEQAQRNAEEGESEQAAGYIEKAPGPRRGTERAALFQGALAQPEVVGGSLHQDAQAYQRRMRPRVQRRQAVDLIQGAVEHCHRDALHRLVGFRQLADDVAHHPLNTGIDLGMLEHIGAFDQQTRHGVLSAEVGSRAASPERLIWVSAPSQEQPTKSSWRLLMTWKTRP

SEQ ID NO: 18851 - protein, 452 aa, Pseudomonas aeruginosa
RCRERSHDSPTRNETSQEASDHPAVLVLEADDVVLSQVFAALHLDHHQVDDPRVFQAMPVARGNVGRLVAVDQPRAIAIGDPGHALHHDPVLAAVMVHLQRQALSRPDHDSLDLEARPLLEDGIAAPGTVDGPMQPIGLVPLVLQPLHHPAHLLDPVGAGDQQRIGSIHHDQVVDPDRGDQAPVALHEGVTGVDEQGVAAAAIALCVRVEQRAHRAPGTDIAPVEGRRHHGDPRGALHQRIVDGNVRQRGEGFACQLMLDAIGHLHRRTGGQAGPGLLQQGRGMLRQLVDQGRGRETEHPGIPQETATFHVATGGFLIGFLDEAAHLGRPLLVQPVAQLDIAETGFRCVRHHAEGNQVPGDGETRGMPHRLAEGLLVADQVIRRHHHQYRRVAMFGLQRQGGDGNRRSGVAPGRFEDEMSSVPPQAGRLELVLALEVMLAVGHRDDFAMPGQ

SEQ ID NO: 18852 - protein, 368 aa, Pseudomonas aeruginosa
PGGTSVGLAQQGLAIGQAHERLRLSFTRHRPQAGTGAAGKHHGNQHGLLPGNASQVRLDHHPDQLVQAGPGLPAEHTLGLGRITQQHVDLGGPEERRVDLEEVAVVQAHMLESDLAHVAHGGSDTGGHHVVVGLVLLQHQPHGFDVVPGKAPVALGVDVAQAQFLLLAELDAGHRVGNLARDELDAAQRRLVVEQDAAGGMQAEALAIVDGDPVAIELGHAVGAARVERRVLVLALGLDQAEHLAGGSLVEARFRAELADRLEQVGHAQAVDDGGGHRLVPGSPDEALCRQVVDLLRLRLDHRALHRTGIGHVAVLVLDIAFDPQFAQAPARVAAAPRHQAVDPVALLQQQLGQVRSVLTGDPSYQCT

SEQ ID NO: 18853 - protein, 1044 aa, Pseudomonas aeruginosa
ARTRARAGSSRLEAPTGHQQALPAAVVPGSRQRPGTHTGTPLAVPSPAPAAAAPANGAGNAAGAIAPGHRADAARRARASAGAVAGRRPAPAGRRGRGGLRLGVQSAGRAQELASADHRLLLGIPRHQRCHAGAEDDPERPDDLPRRTAHPAFPTVAIRLPGHRPARLSRCRGVRPLVRSRQLLRERLALRGPVPAADGIHVLRHPGDRSGPFGDGRLHGRPGGLRGPLQPGARGLAAGFAPVVQHPALPAELGVPEGGLPGELPGSPGTAGALSATVRRGQPTHARLLRRRRGPPAPGTLPFRPQGNPCARRRTGGHRHRQRSMLIIIHSEDQQDHHPAEPRAPGVQLLLRPQGIPSAAGRDRPGGRSQRSRRTGGPPLPRLPQARRTLRLPLLLAAPSHADPPCLPDHPGVRLGVQHPAQRNLARRTAPRLATCAAPQRTGHHPLQLHGRRGARRHGSRLPGTERAGAGLGSLRQPRLAAGRPSRSPGCAPAPGRPAGGQPPAGPGRPCRPRAVGGGPGPAGPRGETGRAEPRRGHLHLGVQPLRRAQELAGHDQRVLRHLPRRARRHPGAETDPPQRRRSAGRHASPPVQEPVLPLPHRADPRLPRRPGLRAAGRGHQLRGEHLLRRRPMPAADGIHVQRQAGRGSAQYRDDRLHRRRQRLHRRLLGRSHRLAPRPARGLPHAALHHRLGVAVPGLPGQFRGRSPGAGALRTHVRACQRQPRTLLQPQAGRGAPASLPRRSGTRRPRRLAKHPGMIRALLQRWRSRPAAASEPVSPRMCGLRDAVLDGWFRSETGELLAGFAIGAQDTLLDLGCGEGVATLFAARQGASVIFTDSEEDKVRSLAQQVEAVARRPFTGLVSDSDPLPLRDACADKLVCMEVLEHVANPARVMAELVRLGRPGAQYLLSVPDPVGEHLQQGIAPADYFRAPNHIHIFSRDDFARLVQDAGLVIEHRQASGFFWVMGMIFFWASERAAGRELGGAVRDRIQPPYPALMEDWARLWENLLARPDGLEIKHLLDHFMPKSQVIIARKPLDPGSSRT

SEQ ID NO: 18854 - protein, 101 aa, Pseudomonas aeruginosa
AANASSTSNCCAGWPCSAWYSTICTATCSAAPRHCWTASTSASSSGGAWTCSSPSPASSSPAPSSRNCARRPHARHSGNRRGTSGSAAPSACCPRPGCGWR

SEQ ID NO: 18855 - protein, 135 aa, Pseudomonas aeruginosa
APPAASPPLPEPPHAELPQEDRLAAQPRHRARRRATRTRAGRPVHARVARRGAQRLVQPGDRRAVQRLSDFRRGHRARRGVRRRRQRSFLRHARRSHHHRRHRRGKDRQDPRAPGRYPGPRTGMPGQRLRPVAPG

SEQ ID NO: 18856 - protein, 133 aa, Pseudomonas aeruginosa
RGAQLVSLSVDTAARMRPSTLTSFGATHMKRLRLIGAAALLACASSAFASSFVVTTDTLVRATGMTSNATSDITNSFRDDKIVLEARDDAASFVASQGDIRGSHLEAALRHIRGKLPSLAANDMQLAQAILTI

SEQ ID NO: 18857 - protein, 679 aa, Pseudomonas aeruginosa
TGPCAARGQPATLGRSRGQVAAGLPRTPGPRDRGRVARRPARQRHGPGPWPAAHRAEPQVPGRSHRRQRRQPPDRARARHRAARAAGDPAARADPRLRSRAPVVGGGKTRDPPLHAPGRNPRPDRPAHRLPRAERSPLHALRRPAPARSRRLAAARRPARAARGAQWLRTAQPGRLRAEQSARVRRGEHGVLPPRSQLRLPPPGALPLLPATLRLGAGTQCLCAELRLPQRRPRLRPAAAGPARPRAGLRGRLPAGRGQRQPGQPLGPHHAPPGDLRPRPAAWSGLPAGPRPASGAVLPRLRRRPAIVQLGRPDRRLSVAPVRPAAVAGDRGIHQGRAAQPRLGAAEAGPRGGRQPGRARRAESLELRRPVLLHLQQLRGGNPQAAAQRHPPATAAKPGQHHPLRRARDAGEPQAGRSQCARRPQGSPAPGLPLRLLPRPLPGDVRRAQAAPAHSPGQGRGLAGAAGQGAPALVRQGRPARQRGAAAARAGLAAAPAAARPGRVEAPVPRPSGQAGRRPAPGSGRQDLPADPRRQRLPQSSGGTPGGRLRPAAGRRVEAPGRADPRTPGAPAPAQRRPRPRGPRPARSRAPRRAGSQRGQHQGGRRAPARAAQGGRRADAALREAPAGRMVPSALSAPRRRRITLCVIRPTGATSGLRSRVVRSGDELLVLFGQLRVEV

SEQ ID NO: 18858 - protein, 574 aa, Pseudomonas aeruginosa
PWQAAADPDVPVGGGALGMVEAGHGEVQGIGAEPGEQRQVGPATRAEVARAAGRRGIFRRFARQPAERRARHRGPGGDDAACGAPADRAVAVSDIVQRRGDGVAQIAAMATAGMGLGHGESSSRECQHKPDLPCAAATSQDERIPLSGGARDRSALLPLAAVRPHRRRLRPAPLGLSRRSLLACRRTPELLHPVSRAAVQQPGDRAAGRPRPGPPGPGRTARARRRLARPAALQALARLGRRALRRHRPGRIALQHLSRPGRGRQPVRQAGPDPGRADAGADGADGERDVGLGADRRARHQPARAAAADPEEPADPRLPRRRTGQPGRRRPARRQRSPAQPAGGGQPAAGPAVRRRGAETPGTRRRSRGPWLELRGAAAGDAPSGLRHRSRAGPAEHGKRRAGTVLRPADGAHRLCADPPTGRRRPPDGGHHYLANAAFRRHSGRRTPRAARKPMTTGRVAAALTALCLLCQPAFGFIKVFPEFDDEPGAATFFWAAVTTVGPFIGSTVSAQESSADEGDKLVQARDDAASFVASDGAIRGAYLQAALQVLRQAPEYAGYSDLQLAAALLARQP

SEQ ID NO: 18859 - protein, 527 aa, Pseudomonas aeruginosa
STTYPKLPARFPPLSSESCLKASRRSIRPPPAEDRTRRRAHETPAYPYKNNNGDCHAPFRTRLQPHSVRATPPARRLLTARRTPVRRLPRSEPMLTLLAFAMVATFMFLIMTKRLSALIALILVPIAFALIGGFAAGLGPMMLDGIRTLAPTGVMLMFAILYFAIMIDSGLFDPAVRKILRLVKGDPLKVSLGTAALAMIVSLDGDGSTTYMICVAAVLPLYSRLGMSPLVMACLIMLSSGVLNMTPWGGPTARAASALHVDPADIFVPMIPAMIAGLLAIFAIAWMYGKRERARLGELHLPTDHEDLAEISESQYPEARRPKLLWFNAILTVVLMATLIAGLLPMPVLFMIAFGIAMIVNYPCIQEQKKRIGAHAENILAVVSLIFAAGVFTGILSGTGMVDAMSKSLLAVIPPALGPYLATITALVSMPFTFFMSNDAFYYGVLPILTQAAAEYGITPVEMARASIVGQPVHLLSPLVPSTYLLVGLAKIDFGDHQRFTLKWAVLVCLAILAMALLLGLFPLFSN

SEQ ID NO: 18860 - protein, 329 aa, Pseudomonas aeruginosa
TSSCAHALPGRGWGRSTGYRRTSARRALRRQCRAAPEAANARCADARRPPPRLPRPRRRLAPPRGTAARTPSPPPGSIPPAPGPRRVAAGSSAALPTGLVGQHRLQAGDQAQQAGFEQRADHRVDTLVGFRRFLVDQLAVATDHPAAKARTAQLVDAEARRQTLPTLAALPFATGAVGQGEQALRARHRLHQVAVVAARAGDHQHALVGRGGALAVQPAVDAIDLCRRHQVVVDVEQFQAVAAQAFENAPGDELAVTLGEAQRIGVARQVGGSFQAAVEQAGVAMQADLFLQDRLAETARATVHQQLQAAGIEAEGVQGGLVEHGLDLL

SEQ ID NO: 18861 - protein, 588 aa, Pseudomonas aeruginosa
CQGGHAMLKLLDLLSAVALLVWGTHIVRTGILRVYGADLRRILSRSVEKRPLAFAAGIGVTALVQSSNATALLATSFVAQGLMALAPALAIMLGADVGTALMARVLTLDLSWLSPLLIFFGVIFFLSRKQTRLGQLGRVFIGLGLIILALQLIVAAAEPMTQAKGVKVLFSSLTGDIMLDALTGALFAMISYSSLAAVLLTATLAASKVISLKVALCLVVGANLGSGILAMLSATAQNAAGRRVALGSLLFKVAGCLLVLPLVGPLADWMDHWQFSTAELVIAFHVLYNAARCLACLPLTNAMASFCTRVMPDRALPDDVARPRHLDPAALDTPSLALANAVRETLRMGDTVEQMLNNLMQIIRGGDPLLGKDIRKLDDDVDALYTAIKLYLARMPREDLSERDSRRWAEIIELAINLEQAGDIIEHMLAAVQDKKTSRSRSFSDTGLEEIGTLYQQLVSNLRLGLSVFLNGDLDSAKRLRRAKQRFRLQERRYAHAHVDRLHQQVVQSIETSSLHLDLISDMKRLNSLFCAIAYAVLDNPDAPSSAADEGTRRDEDDWADEVDDMTSAPLAEPALAEERAETRRSRH

SEQ ID NO: 18862 - protein, 139 aa, Pseudomonas aeruginosa
VRHEASAILGIFSSRLGPCVRCPPCCCSACSAPGRTPTSAARSKPSSWKTAWACCSSPPSSTGTSRSGWWWGSVSPTSRAVKSSCRTCSSTFSSAAWTAATRPTWKPACRPSADNGTPTPAKATPPSSSRHLPPPSGRS

SEQ ID NO: 18863 - protein, 279 aa, Pseudomonas aeruginosa
ASTTGSHKRRRCISATDNRPARVEALVARGIGRNTRVGSAAPCCARYMKIVTGSRVRDEALSTRKRICALLAVVLLGLSSCNAFIAFRPIGVAALSRPRPLAAKFRVIRPIAGCPGGTSGISRRNNGPSSTARRSTSPAFSAMRRKPSQSVRVPNSRTITSTASLAMANRLSTIAANTVASPPINQRASALAAATRKKPNHKPFSIQNPPRCADDSGAGGAGARNAEAPDDAGASWAGSRLIRGWPACPWLRRPPAAGAAANPSSAGPWPRRTCLPTWR

SEQ ID NO: 18864 - protein, 222 aa, Pseudomonas aeruginosa
RVGDPAHFPLLPRRRRLQRGHRQQRAAGGGPVAAPGIRPVLPRPAPGRRQRARRSRPDARPGAMDARGDRHRAFGGGYRGRCHAGRRGGLPGQALQPGPTAPGRRQATGGAPTDRAPGGPGGRSAPPGRRPGIAQPGHGRGTGDRAPGSGDRRQHPHPRRIRLRQGRTGTRHPHLEQTREEAPGHHQLPVADRRTDGKRTVRAQSRRLHRCHRKHPGQGQPG

SEQ ID NO: 18865 - protein, 805 aa, Pseudomonas aeruginosa
RRHPVPRRDRRLPADLATQAAALHPGQGIRTRRRSGDPPRRRTHPCRDQPRPGRDGRPGPVPRGPALSPQRDRAQPASPARTRRGYPRPGRTFPRPLRQGLRPPRPRLQRSRPRGHAAIPLAGQRTRATQRDRTRQHHLQPGTGGCRPPRFQRCAICQQRAADRRIAEPGRPGESPYHGGDGLQRDPRPGRQDPRYRCLDPVPEAQAVWPMSMPLPMKLRTRLFLSISALITVSLFGLLLGLFSVMQLGRAQEQRMSHHYATIEVSQQLRQLLGDQLVILLRETPDGQALERSQNDFRRVLEQGRANTVDSAEQAALDGVRDAYLQLQAHTPALLKAPMADNDGFSEAFNTLRLRLQDLQQLALAGISDAETSARHRAYLVAGLLGLVGVAILLIGFVTAHSIARRFGAPIETLARAADRIGEGDFDVTLPMTNVAEVGQLTRRFGLMAEALRQYRKTSVEEVLSGERRLQAVLDSIDDGLVIFDNQGRIEHANPVAIRQLFVSNDPHGKRIDEILSDVDVQEAVEKALLGEVQDEAMPDLVVDVAGESRLLAWSLYPVTHPGGHSVGAVLVVRDVTEQRAFERVRSEFVLRASHELRTPVTGMQMAFSLLRERLDFPAESREADLIQTVDEEMSRLVLLINDLLNFSRYQTGMQKLELASCDLVDLLTQAQQRFIPKGEARRVSLQLELGDELPRLQLDRLQIERVIDNLLENALRHSSEGGQIHLQARRQGDRVLIAVEDNGEGIPFSQQGRIFEPFVQVGRKKGGAGLGLALCKEIIQLHGGRIAVRSQPGQGARFYMLLPV

SEQ ID NO: 18866 - protein, 712 aa, Pseudomonas aeruginosa
AGSESRATAGRAPRYRGRTASAACAVPAAGPGPATAGPVRREHRCSAGCVAGGAVRSRARPFPGAESGPTGRRPCRRDGGSRAAPSCTGRPPCRCLRPPDCYAPGRDAAGRSGHPSAVAGAPAARCSPGTCLSSAGRRRDSWRTPGIPAHDQGLVAQVVRQANLHRYRQMVGDRLVEHVDPLESEIGTEQDVIEIALRPPAGKRRLDLRRHQAEVAQGRVFQKIDGVGVHVAHQHLMAVVADQLADIGELAGAGASAESEMHHHYHQRVGAFAKAHEDRAASRRTGQRMIFQQGRPPAAEQAVAVLGDTPEVAVELLVPVGERPQLGQVLDLIDVAGTQAAAVGFLEGDEVVVGEQFADPLQVGRPPRVGQQVLPTAGQVVAVALGADTDLDVEAEKAQAAVVGQLPRIVTGGVHSRVAAACDPRFTLPAAQHAESPCLLLGRCALFLDQVVGQLEGFLRTTGGADVEAVFAIDHHGRYAGDLVGHRQLLGLFHLALDGKGIIGAQEFFLVHALAGEEIGHFFRSGELLVLLVDRLEHGVVYVMLDAHAFQGQEHLPMDVPDTAEQGRQAHEMDICRQLLAPRHDGRLERVAMRAAIPEQFHHFDLARLGHRHRAAQLDVFLAGGIVVGLGGHAEQAGHGQHGGENQVTHRSLLGEVSAALRPGSARSVRPGGAVTGSSIVAMADAKKGSRGHPFSYIFFAVLRSDQCRPWM

SEQ ID NO: 18867 - protein, 154 aa, Pseudomonas aeruginosa
IPAQPGRMPGAPGRPSSRPVRGSGCPAGWRRPARRCARSAPAPVPAASRCRSGPWPGTGSPPASATGPGAGAGSRRRPPPHRARPVRWRSGRRSVAWRPCRRCPRNGWCCGRGTSGPGCPCRGEWRWSPAHRTRAWCRRLRPAARWGCWHWPGH

SEQ ID NO: 18868 - protein, 101 aa, Pseudomonas aeruginosa
RSKVTMRTLNRLMLAGLLAFAPLVAMAADDDAPSGEPDVTIRQEGDKTIQEYRVNGFLYAIKVVPKHGKPYFLVRADGSDGNFIRSDQPDKLIPQWEIFSW

SEQ ID NO: 18869 - protein, 327 aa, Pseudomonas aeruginosa
CAFPTGRGRADMSVFTPLERSTLEAFLAPYDLGRLRDFRGIAEGSENSNFFVSLEHGEFVLTLVERGPVQDLPFFIELLDVLHEDGLPVPYALRTRDGEALRRLEGKPALLQPRLAGRHERQPNAHHCQEVGDLLGHLHAATRGRILERPSDRGLPWMLEQGANLAPRLPEQARALLAPALAEIAALDAERPALPRANLHADLFRDNVLFDGPHLAGLIDFYNACSGWMLYDLAITLNDWCSNTDGSLDPGRARALLAAYANRRPFTALEAEHWPSMLRVACVRFWLSRLIAAEAFAGQDVLIHDPAEFEMRLAQRQNVEIHLPFAL

SEQ ID NO: 18870 - protein, 441 aa, Pseudomonas aeruginosa
PNCGGACWSWSGRATSRWGPTISSRCSAKPTAAAPRRRPSTARWTSSRRTAWCTASPRSTRSSAATTRSTATRASSSSAAPATPRSSWNSRISAGPSSPERTASASPLKARPSRWSASAAPAGTRRTPDGQRAGAADPGRRVLQRPGGAERCRPGHRARPDRHPDRPQRRRQDHPGTQRARPAQAARRRGLATAAADHRLHAAETPRRRHPAAQRTALPPPGTRGQARAGAGGVARGRRGARAGAPAAKHFRWRTATRAAGPRSAAQARATGARRAGAGRRRRRPGRTLPPHRQTARPLRLRCADGLPRPAPGDERHRPGGLPEPPCLLLRAPRAGQRRPGLRRAVRPGRSQPGDLPPPSRPRPRPPRRGGQGRSRRLASRHPLHSCPQARPRLQPWLTSCSTPSSPASPWPWWLAPWAPSWSGGGWPISAIPCPTPHCSG

SEQ ID NO: 18871 - protein, 315 aa, Pseudomonas aeruginosa
VLSCPAARCRIWRFFDQTRTRRNDVVLLSPAVRPGGGAAGQRLPGQCVVATDAGGRAPGAARRSLCRTAANPGRRQARTGRATMAGPAQRSRRRRARRSVPPPVGRGLHAARGNRAASRRPQHRHQRPRPCPRTDAQSAGADRRAGRCDQPRQGRSRPRRAGPTHAAGGPAADAADHPDAARRRAEAAARRSPPDRSASGQQRRAPADARRHRPGRPRCGARRGGRGCRRLPLQGAYRSAPGQRLSAGFRPALGAGEEALTRFRPASQPCRTGRQANPIDTYPPELRPVLPRPQQKALVGSAPDAYSISMIFHHQ

SEQ ID NO: 18872 - protein, 345 aa, Pseudomonas aeruginosa
QHRRTHKVRPVIEFHDVHKTYRVAGREIPALQPTRLNIQAGQIFGLIGHSGAGKSTLLRLINRLEEPSGGRILVEGEDVTALDAEGLRRFRQRVGMIFQHFNLLSSKTVADNIAMPLRLAGGFSRAEVDARVSELLARVGLSDHARKYPAQLSGGQKQRVGIARALACRPSILLCDEATSALDPQTTASVLQLLAEINRELKLTIVLITHEMDVIRRVCDQVAVMDGGAIVEQGDVADVFLHPQHPTTRRFVFEAERVDEDERHDDFAHVPGLILRLTFRGEATYAPLLGTVARQTGVDYSILSGRIDRIKDTPYGQLTLALVGGDLEAAMSQLNAADVHVEVLR

SEQ ID NO: 18873 - protein, 306 aa, Pseudomonas aeruginosa
SSSRFCKPWATSWWCTSRASKLAGQAQNPERRGYPQPPGTPRKELKMKKLLAAFSAVAALGLTAAQAAESLTVAATPVPHAEILNVVKPLLAKEGVDLKIKEFTDYVQPNVQVSEKRLDANFFQHQPYLDEFNKAKGTDLVAVTGVHIEPLGAYSSKYKKLDELPSGATVVIPNDATNGGRALLLLDKAGVIKLKDNKSITATPKDIVDNPKNIKIRELEAATLPRVLTQVDMALINTNYALEAKLNPTKDALAIEGSDSPYVNILVARPDNKDSDAMQKLAKALHSAEVKQFIQEKYKGAVVPAF

SEQ ID NO: 18874 - protein, 221 aa, Pseudomonas aeruginosa
HPAPRRLAARQPPARALPRRTLQPFPRRLPGHPSAPAAPAVPIARRRRPAPRPALRPRPPGPAGPVRLSPLPEPGPARGPGRQGTRHTAGAVHRHLRLAAARTRRPDRQFASGIRLALRLAGAGHGPGRGTGSDPGGAHGRAARRTPGGHRPAPQRVQQSYSGGMTRCSACPTTRRATCHSAAGRPPSCSSTCSVPGSSRGATRTSIRRQPVTSTSACRTR

SEQ ID NO: 18875 - protein, 596 aa, Pseudomonas aeruginosa
SSAGWSPTSAWTWPCAMPPTAVTWSPWSRMPAPPIPRNATRPAWKRSRATAGSATPRPSCNASPPSAGATCEPPAAGTPGQLRHHRPGRHHPRAFAAPGDPGGAIGQRLRLGTGEQLADPAGPDRREQPLGQPRRPALAARPEQPGARRAGSRRRCAGARLPARQPGGNRRHAVAGLPAQPAAGRGGTLSRQRPAGHRGVRTRIQPARPARRASGRGVFAAGPACRRAVPRLAGQRPGPGWHRAGDVPPRIRPAPVRGHLPPGAGRGRRRPRGERPRGHSRSGAADGPAYLLRTAAGTRRGDQRGAPAPEPATCRRQPAAVRARSTQRSLRTRRALGRRRARAPASAVRADRAYRRLLPAPETPPLERRLRLPGTAQPRSGAAHLPGGERRRQAAGQAVQPGIPADGRHRLSAPGDGRGADRRPPGHRTTPAAARPGRYRSARPQRRRAPGPRHPGPAGDPRRCARLPAARRDALRRAAKAAAGHLPRHEAPRTGTDGGPFRRRPVPPLCRALLTTPNSASTSCHPTACSTPKGRTRWSWSASTPAGTSRWSCSASAWTRPRRKNTSPGISAPWRWPKSFPGGSTRHCWRPATRAC

SEQ ID NO: 18876 - protein, 479 aa, Pseudomonas aeruginosa
RQYAAFSRGARHGHRTVRIPATAAPQPVPERPDHLRDDLHDPHRPVRGLRLGPCRRPRHGADGLPGGHAGDALHRPQLRSHGQGLSDCRLGVFLRPARHPPPCRLHRRLGAAARLPADPAAALRVQRAGAEPLVPGDPQAGLDAAVPGLGDPGQPARHHLRRPRQPVVPDRRAGGAGDLPGGRLPGAGRRPGQRPADPRTAVSPGSLRSRPGDEGRLDRRTVVPRLRRHLHPRRGGQGRSRPADRPRRADRAVHHGRHLHRADLAGHRPRRRDELQVGGHRLLRDRRSGRWPVAVDADRGSHRAGLGCHRVDHLAGSGLAPALLDGPGRQAAARAGQGPSALPDAARQPVPGGGAVAGNRLGLPRRTGRAHLTGELRCPHRLLPAAPERDQPLLPPPALRPVVAASTVPAGGPGDHRLRAVQHEPRRTVARTGLDRGGAGLPGVAATRRAPGTNGVGEGSLTPREGWFRPALRRRNRCG

SEQ ID NO: 18877 - protein, 601 aa, Pseudomonas aeruginosa
PPRRRTCPTLPGIPRRAGTGAPRSRTAPAIAAPLRGSSLRRRRRSPGRSCRYARVIGGRRQDQAEHRSRLGIGDLQAAAEFVDDPIGYRQAEAESLSHRLGGEERIEDAAQVLGGNPAAVVGDAQHPVAAKPLQGQADPWPLLAGNGIQGVAQQVDQHLFQADRVTHHPGRPEQRLLDLHPFGADSRQQQLLRLFDHVTQLDTLAQAAGALAREGLQVAGERGHAFEHLVDARQRLARLVVASGVEQQAQAGQLHALGGERLVDLMGQGCRHLPQGGQLGRLHQAVLRGTQVGGALLDQALQLLPATLPQAGDTPALVQEQAEEDQRQPSAGGGQARGGDVVLDARGVAQQVEGPAVVGQVQRLPEVVLLAVGAFHPRQTAVFAVAAQGLVAQGCQGLAIVLPGLRQFEAVHGIQRFQFAVAPTGVVGEEHDALGVAGQDQVGGLVPLPFQIGKLQLDHDCAQEAAVLGAHRVGQEITGNPADHPDRIETSGALGDGLAEIGTETVVVAHVAGRQVPVARRHGQPGTVEQLQGGGAGGQVDAFQLEVEALLQLAVDRPGQRRAQVRIQRQYRRQAAEAFDQGLQRAGVEVQLLAHLFALGA

SEQ ID NO: 18878 - protein, 354 aa, Pseudomonas aeruginosa
RLLPRLATRPVHGQQQAAEQRQQQQEQAQWTGQGHRRIETAAGSGDDSTAPGYTARRTRSPPMSLSPWSHSCSAGFTLRGWRSEPSGKPLLHFLHGNGFCGRTYEPMLRLLTEDFDLWLCDIQGHGESDHGGRFHGWNRNAEMAVEAFEAGRGPYGDVQRLACGHSFGGVLSSLVLARHPTLFARAVLLDPVLFTPAMIGVMALSETLGLQLRGSLAKKARLRRSQWPDRAAAYAGLRGRGIFKGWTDEALWAYVEYALKESDGGVELKCRPSREAEIFSSFPRRLWPSLGKIITPTRVLYGDRTYPFVAKSVARWCSLNPQVSAHVVVGGHCFMQEDPADAAERVRDFLLPNP

SEQ ID NO: 18879 - protein, 301 aa, Pseudomonas aeruginosa
PPYCADSAVGSRLMPRTPHLLAIQSHVVFGHAGNAAAVFPMQRIGINVWPLNTVQFSNHTQYGQWTGQVLPPEQIPALVDGIAGIGELGNCDAVLSGYLGSAAQGRAILDVVARIKQANPRALYLCDPVMGHPEKGCIVAPEVSDFLLEEAAAVADYLCPNQLELDSFCDRQPNSLADCVEMARSLLARGPRAILVKHLNYPGKAGDTFEMLLVAADQAWHLQRPLLAFPRQPVGVGDLASGLFLSRLLLGDDLRNAFEFTGAAVHEVLLETQACGSYELELVRAQDRIAHPRVRFDAVRL

SEQ ID NO: 18880 - protein, 190 aa, Pseudomonas aeruginosa
AMPRAMASTARVKSSREPLAAILSSTQGTTRRPPKIIRATKAATLPRVISSGQSRPASPPSVLPPRVPASAGRSTRVRTIARSSTISQPMAILPRLVSSNWRCSRARNSTTVLATDRLRPNTRPPPKLQPSSLARPMPSSVATPICTSAPGMAMAFTESRSLSEKCRPTPNISRITPSSAISCDSAWSAT

SEQ ID NO: 18881 - protein, 458 aa, Pseudomonas aeruginosa
TASSSSRCSSLPRGTPLASIRNSSMLRTSGCAARNSRASRGSAKCISGLPRAGYGEQLAERLVEAGEQAVDIFFASVRATQGHVVERRDEDAAVDQIQVQGHLQAVVERRLGGRAVAWGLRAELELAARAELGHRPGQAVLVDNPAEALGQTRRQGQHVGVGGIGHHLFQVGAHTAHRQGVGRQRGTHAAVAVAFALLAGTCPGQLHGAGHRRAATIHRARYAAGDRLAEGDEVRLELPGAGTAARTCGDGVGLVDDQQRAVTTGQLAQLLVEAGLRQDHADVGHRRLAEHGGHVFAGQRPLQGLEVVERHRAAELGEVVGLAEQAGAMHGAAVAAANQGVVDRAVVATVENQHHLATGDRTRPAQDEAVGVGSGGRYLPERQAEALRQQLACDDGILPRKHGGQAVRALLGERPGDRRRRMAEHAAGIAQAEVHVGVAVHIMETRAVGTFHEQRTGC

SEQ ID NO: 18882 - protein, 955 aa, Pseudomonas aeruginosa
ASPISARSCFSHCNICGVTNSAILSISLASQCCCRDMKCSRAAPTKRSSLNQLGALITGLGAAAAAAAPPKIGAWAGISRCIGACPAIAGWPWFCWRRRAAMKRKAMKATRAINRMSSIWMPSKPSPMNMEASRPPAAIPASGPSQREAPLAAAAGRAALGAAAVAFGAVAGCAWRVWWLGAEPRLLPPPKRLALASRLTVSARQKARAMLRTRCIVVFLSWGNRRAPCCGGTGDRTSRILFRAIAPRPPFFRPPRLARGSAPGYTFVAGDDRHARGSAREDPPGDPGSTTQSLAETSVTVFFSPPIKHLRMLVCGSARPPGRRVCRPIPRARTAAMHAVDFIQDLAVIMLVAGVVTILFHRLRQPVVLGYIVAGFIIGPHTPPFGLIHDEDTIKTLAELGVIFLMFCLGLEFSLRKLFQVGATAFIAAFLEIVLMIWIGFEIGRFFEWSTMDSLFLGAILAISSTTIIVKALGDLKMKNERFAQLIFGVLIVEDILGIGIIALLSGIAVSGSVETGEVFSTVGKLSLFMIVALVVGILLVPRLLAYVAKFESNEMLLVTVLGLCFGFCLLVVKLEYSMVLGAFLIGAIMAESRQLVQIERLIEPVRDMFSAIFFVAIGLLIDPKILVEYAWPIALITVAVVLGKMFSCGMGAFIAGNDGRTSLRVGMGLSQIGEFSFIIAALGMTPESHQRLPLPGGGSGLGHHHPAHPVPDPRRRPALAAPGQRHAAAHGEDLRPLRRLAAQHPAAGRPCGAGGDDPAHLAAGRGEPGAGDRDLPRRRLFRRYAFRLDEPVGRLRRATQGIDLGRRAAGLAGLPDRRVPQAQGPVDAAGRTRGQAGESRTPYGAGTSGDLRDNPAAVAGRHDGAAGGAQLEHPAAGRVAGRSGAGRRPGDRSALALADPRAFADADRADGNPRPGKGQPLRAKRSRPAVESADNHAAVIRPRLHLVSLSDPLP

SEQ ID NO: 18883 - protein, 364 aa, Pseudomonas aeruginosa
SLLIIIIIQSRPQGNLGGSFRDHPTRQERLFERLFIRACGEDQFQPIIPPPRGLAPVIHKRRGIRCIPTVRAMQHRLGSPQSGQTVQPGVHCGPIETHRRRQPPADGELAVLLAHGAQRSLGRQHRSQLSRRLRQGRPGRRATFPGNAGRQIAQCQVTAHAPAQRQDRQARAHGAALRRVERFGFVQQQHASRFQRLFLCLRQRLAGGQRGGIQHHYQGLQGQDAGPGRSLQLFPQRQRMSQPGGFDEQPVRPCPTQQATEPHLERHAIDAAEAPARHLADGHAVDVRGQQRGIQADLAELVDQHRPALARRLLRQQRADQAGLAGPQRAADQVCGYLSKHLRNRNVKACGSMRSLPAGSQAPC

SEQ ID NO: 18884 - protein, 132 aa, Pseudomonas aeruginosa
SRARLQWSPRMRPFLFFLSCLPGLALAEACIVHSQAKNLDVKVCQQNRSIPAKLFHEGFCQPQLQGQKVEVTFAEECPTGAFGVCRDARVPNAPYRQDIFYYGIATDARYLEPFCASQSQGRWEEPSAAKKP

SEQ ID NO: 18885 - protein, 179 aa, Pseudomonas aeruginosa
VVTSRSGTWSTWKRGHIGLSRTRRRRPIRRAPVRQEKASTSQPRSSRKSVCPGSCCASSRPSKTGSRSSSISSVWLSASPGRLRTRAAAKSRSAGLNRRVQTARLTPSRSTSASTWGSSSNAWRGNGFSCGSALMRRAPSPRRGRPGPASRGCPGSSRRHPAGRRPGLRAGPRSPGSDR

SEQ ID NO: 18886 - protein, 134 aa, Pseudomonas aeruginosa
SPAGPLRPVATVRSARSATSGPPGRSASGRRPATSCRPRGAGWRARRSPWSAAAAPASADCAGRRGSARGGTAGAPGRPWRRCHIPRFPAGARRAVPSASPARTPRDRNRSDRYRGSSPAAPDPSPSAGSPPRH

SEQ ID NO: 18887 - protein, 153 aa, Pseudomonas aeruginosa
PCTPAKIASARRWRWRSSINRRQSPRFEMKPVSTRIEGMSGDLSTAKPACSTRFWCSAVTSDNWPRTLWPRSRLLAMVELRAMSRITPASTLSRPCSGRLPLLPIRSAPFSRSAIQRAMVELAPCSERAYTDAPEAVSRGAASACTETNMSAL

SEQ ID NO: 18888 - protein, 170 aa, Pseudomonas aeruginosa
RRATSGRLRSGTNTSPLRTRRALKPFSRSIRRASRRAIASATSFSRSPLLPTAPGSLPPWPASTTTRMSRPVEGSGRASASIGSGGAASACGYRSRTRRWPFPACGSRAKLRGLTAWRRSRTMRVPPPPSWPLRMARTGPSSGSSESVASNCASGRSRINRSGACREKVR

SEQ ID NO: 18889 - protein, 681 aa, Pseudomonas aeruginosa
CSAKTRCAGCTAPCRVIHRRAGSPYGSSMRKACMPTTPSPKATGSEVPHDPQESLRRPAGDRRIGLCGQDRDHLRQGDHPGQRLRRSLRGDPCRRSRRRRRHATDRDRRQLEHPGRRGDPFQVGCRGDHRRAQLHRPPLHRPRSLRSRRPGLHRLQQRAVQLPGRRWLRGPPQRGGRRLRPASGFLRTVHRAHRSAHRPGEHAAGQRFRQRVLGRRGAHQRRPGTRLQVAAERVLNMQSLLIRNARMVNEGQVREGDLLVRHGRIERIAGCLENCGASREIDAAGRYLLPGMIDDQVHFREPGYPQKGSIASESRAAVAGGITSFMDMPNTRPATLSLEALAEKKRLAAAHSVTNYGFHFGVSRDNLDTVAALDPREVAAVKVFMGASTGDMLVDDLPTLERLFASVPTLLLSHCEDTPRIEANLARWRQRFGERIPAAAHPRIRDAEACYRSTALAVELAQRHGTLLHVLHLSTARELALFEDKPLCQKRITAEVCVHHLLFDDSDYARLGHLLKCNPAIKSREDRDALRRALAGNRLDVIGTDHAPHAWAEKQQAYPQAPAGLPLVQHALPALLELVREGWLSLATLVAKTSHRVAELFAIADRGFLREGYWADLVLVSELEHPALASAMPLLSRCNWTPFRHRAFHHRIDTTIVSGQLAWHAGRLSDDCQGLPLRFSR

SEQ ID NO: 18890 - protein, 180 aa, Pseudomonas aeruginosa
RSAARPIRGFSTAASAPAEPLAETNSASRAGRKTDIQLRMDVFLMTGSSSGFVVFMDVDWRLRVIHRTFSRSGPVSDTPRVRPPGAQGPADRSSAPAHRSAPDGRSGSRRPPVCAPAATVAAAAPHGGNARRRHAARRPRESPSPPRCPAPGPLPAAGRAHSGDSLLPRAPSRPCVARPG

SEQ ID NO: 18891 - protein, 371 aa, Pseudomonas aeruginosa
TTAAAASPRRCRPCPDTARSRHRLARTLAPEVPADHQRAEDEAQLVADRQGQDQAGPRGERHQALPPGQRPLQVADGSHAPQADGQHRLAGDIERRPPTAFLQHQRRGIHRHERHHETRQGDAHRPEADLQSPFLGDRRGRETGQRHRRGEVGEDAEVEDEHVRDDQRHPQFQQRRRGDGAGDDVVGDGRDAHSQDQAGDHGQDQRQQQVLPSQVEHVAGEGGGDAGQRNHPDDDSHQGAGDAHRNRMSRTFGEGADADAQGFPAATDEPAGQGQGRDHDEDHPDAEAEEPRAEQPQRHPEGDAQAERGHPQDDRRTEDDDGGQRQADGSGEQRRAPGEQQRDQHQQRNQQEPALADGTPGARTLIARQAL

SEQ ID NO: 18892 - protein, 67 aa, Pseudomonas aeruginosa
TPLVPPVRILMKVGAAKTEVLKVTVAASVKRPKRLLSDMGSLLFLSLLSRCRGSVPASFDRAGLRAD

SEQ ID NO: 18893 - protein, 376 aa, Pseudomonas aeruginosa
TAPPRRTISKDRLRDRLRKGAGRRRSGVQVAPRPGQLVGAILVGANGEDLVQVDPAALEAVGASGQVQPPDPQGFLGHQASRLLQPGFQVGAPEVQGPGVVQTQAFHVDYFQPGFAHPRHRQRQVRQLAVGKHVAIDEVAGPLANRAAVGVARGDAVVHHQAAGTHRLVQLLEVQPQVGVPDVLEHADADHLVEAAIARQVAVIQQLEGDSVLQAFGLDSLPAERQLLLAQCDAGDLDAELASGQARQPSPTATDIEQLLARLQTQLAAQVTELGQLRGGEVFLAGLEISAGIDHFRIQPELVEVVGQVVVVMDGFGVCVLVVAFANRRRAAIGFAERFAEGIADTDDLADRSFDVETLLDVGLAQRIEAGMGDLG

SEQ ID NO: 18894 - protein, 210 aa, Pseudomonas aeruginosa
GMPMNETVSLETREVRFLSVFDFDGTLTYRDSFVPFLRFAFGNRVFVRRMLRMAGPSLAYLCRRIDRDDLKARLIATFLTDVPVHVLEERALAYQNRFWETLMRPHALTAVADQVSSGSTVTICSASPSLLLRPFAEKLGVHLIATELEVVDGVLTGRIVGRNCRRDEKVCRLERHYGPLTQYSLRAWGDSRGDTELLAAALERFWKPFR

SEQ ID NO: 18895 - protein, 424 aa, Pseudomonas aeruginosa
PWRRLHEPAPPWRSSAHSAKENIMNQKISPPSQKLDGLFLLALSMAVFFVGVTEFMLSSMLGPLAQAFHTTTSGAAWLISSYAFSYAIAAPLLGYFSDRMQRRKLLLLALVLFAVDTLAIVIAPTLEIAVVLRVIGGIASAIIIPTTFALVAEVVAPQRQAGAMGQVMLGMTLGIAAGPALAGLLSDFFGWAAPFLLVSCGCVLVFLMARQRLPVQAVVPRAEGHALGWCRQWSILRPLIAKGAWNGTGVAGLLLSGEVLRQRYGFSTAQIGVSIAAFGVGLAVGNLAAGYLRRYLKRDEDMLLLVLALLVLSMSTFMLLPLPLPVALCCLGAWGAALGLGAPAGTVVLASRSGPDKGMVLSFAETFNNIAILASVPLAVRLLELKGPPATLWVLGIGLGIGAWLTVLDWFASRRSDEALPLRD

SEQ ID NO: 18896 - protein, 723 aa, Pseudomonas aeruginosa
RRAPGPHACPGFSGTRPALLDGDRLGQVARLVDVGALEHGDMVREQLQRDGVEDRREHVADVRHAHHMGALASLDARAFVGEHHQFAAAGADFLQVRLELLHQLVVRRHGNHRHVAVHQRQRAMLEFAGRVGFGMDIGNFLELQRAFQGHRELRATAEEQGVVLLGEQLGNLLHRPVHRQRLAQPGRQATQFVHQLGFDAIGQALLHLADAQGQQQQGDQLGGEGLGRGHADFRAGLGQQGQVGFAHQRTGGNVADRHAGEEAQLLGVAQGSQGVGGLTGLGDGDEQAIRLHRDLAVAELAGDLHLAGNPGQAFQPVTGDHAGVVTGAAGDDLHVADLGEQLRRLRTEAFNHYLVLPEAAFQGTLHDAGLLVDFLEHEMPVLALVGGFGAFVVLHGLALHVVALDIPQAHAVATDLGDIAFFQVDEAVGHLAQRQLVGSEEVLAKPEADHQRAAAASGDDAVRLRRADHCQAIGPVQFLDRVLQRQGQVADGLQLVVQQVDDDLGVGLRGEHVAQPLEPLTERFVVLDDAVVHHRQFVAGEMRVGVAFGWRAVGRPAGMGDAQAAEQRRTGQAFLQAGDLADPAAALQPAFVIEDRHAGAVVAAILEALEAFDKDGGYVALGDRAYDSTHGVFLLSGLDRGADQRDAPGGYLFARGRFQALVGNQGMDAAPGQFLVGNAPTDLVGLGHDDHLAGDLGHHPAQAQQFVERGRPAFEIDAVGTDE

SEQ ID NO: 18897 - protein, 82 aa, Pseudomonas aeruginosa
TTERHGLRHGTSRPWSGRSVRRADGCPAARSSGRIPGLPCPVRWSPSSRGRSRYPHEYARPHPRTRNNRCARWRCYGSVPSC

SEQ ID NO: 18898 - protein, 590 aa, Pseudomonas aeruginosa
CSQSCCESLLRLPFDTYRVSRREPRGSRCGLPGLGGLELLDAGLDARVDFVVEVTFLVDLRQQSGMLALEVGDQRLLEATDLGDFDVLQEATLGGIQGQRHLGDRHRRVLLLLHQLGNALTMLQLLAGRFVQVRGELGEGRQFTVLGQSGTDAAGQLLDDLGLGRATYAGYRDTGVDGRTDTRVEHGGFQEDLAVGDRDHVGRNERGNVAGLGLDDRQRGQRAGLAGHGAVGELLDILFGNAGSALQQTAVEIEHVARVGFATRRTAQQQGDLAISHGLLGQVVVDDQGVFTAIAEVFAHGATGVRRQVLQGGGLGSAGGDHDGVGQGTVLFQLAYDVGDSGLLLADGHVDALNAAVFLVDDGVDREGGLADLAVADDQLALATAYRDHGVDRLVAGLYRLVYRLTPDHARSDLLDRVGGLGVDRTLAVDRIAQCVDYATQQFRTDRNLQDAPGALGVHAFGEALVFTQDHGTHGILLQVQRHTVDAARELDHLAVHDVGQTVDAHDTVGHADDGAFVSCLGGDVEFLDAPLDDFTNFGRIELLHAAAPSNSRFQRFGQFRELAAHRAIDYQVTGANDHAADQARVFRRM

SEQ ID NO: 18899 - protein, 85 aa, Pseudomonas aeruginosa
ISAASLETSCSCAFASIEAPRIFSAPVTARAPTWARRASLTLFSSCSISAWAWAFRRSPSVRAWSRASSTIWLARFFACSTISAA

SEQ ID NO: 18900 - protein, 355 aa, Pseudomonas aeruginosa
RAAPSRNLPPSRPKPMAVPRAPRPISRATAIAVSPTTVSIFPPDFLSCWLKVEANRLMVVFVRHRQVDDGQHHEDEGLQGDDQDVEHSPRPVQGYAQGTQQEHSATEHDGDQNEDQFAGIHVAEQTQRQRNRLGDQGHELEQEVHRNQQDLNDDVLAAEGVQGQFTEEAADALDLDAVKDDQREHRDRQAEGGVRVGGGHRAEEQVLVAGDLRGQHRQVVHRYQVDQVEQEDPDEHGQGQGRDQRVAPVEGVLDAGVDELDHHLDEVLQSTRLAAGGLLGCQAEDEQEHHAEQYRPAQGVYVECPEAHFLGLLGGVGEPPITIRQTPEGQVLQVVLDVTRSGFCCHVCLNRSKVL

SEQ ID NO: 18901 - protein, 410 aa, Pseudomonas aeruginosa
EGVAEMLLQLRGDIVGQADARIVHGPQQTLDLQRRVEQLADALDAVHQVGQPLQRVVLALHGDDHAVGGGQRVDGEHRQRRRAVDEDVVVVLADRRQRVAQAIFLHVHFQQHHFRGGQVAVGRQQLVAAVFGELHGLGEVALAGEHVVDGVLQVVLVDAAAGGGVALGIQVQQEDAALGRHEGGREVDTGRGLADTAFLVGDREYLSHGYPCSPSCCAPQYQQMPLTLATGYRQRVLGFDPEILRECRQLFVRMHALHRQPAGFLATEVAGPVGEVLQAAESAGNDAIEGALGTEGFHPAVHDFEVGQLQFELHLGQEAGLLAVAVEQGQALFREQNGQRHAGHAAAAADIQPVIPSLGIRHDAQAVEQVARNHLVRVAYGGQVVGLVPFDQQGQVGQQLALLVGVEGDA

SEQ ID NO: 18902 - protein, 122 aa, Pseudomonas aeruginosa
STRSACARVARTAGPLRLLRMRNWIPPLSVASAMAPPRASISLTRWLLPMPPMAGLQLICPRVSTLWVNSRVFTPMRAAASAASVPAWPPPITITSKRVGKSTTHLGLFRSRNSGKPDSIRI

SEQ ID NO: 18903 - protein, 639 aa, Pseudomonas aeruginosa
RSRRWFRWRLACGYLRIARRPSRGRLVVDSFRDRRQAVFAAASILRVMYHCCAIDRQLLTTQYSTRPAGEPEEEEGEDDRHQFHHLGLHRVRRGRVEHLLDQHGAAHDDRQDEERILHRQVGDPAEPRRLAHFHAFQEYPVEGEEDRHLDQDRQAAAQRIDLLLLVQLHHRLGHLLPIVAVLFLDRLHLRRHRAHARHRTVAGGGQREEGQLDQDGQGDDRPAPVADQAVDMLQQPEDRLGDEPKETVVDGQFQARGEFLQVLLEFRAGIQGQVGFHLATRRNAQGRAGETDDVVALAVLAGHDLVLLALGRNPGGHEVVLQPGDPATLHGLLELFLVHVLGGDLLVRRIRGPDRGAEVGGHPGGGGRGRVGAAVALELGEQVAAPGLAALVVDQVADADLIGVFIDALDLLLGLFLVRAIGFQATVEGEALDVVDTVVAEAQVHDQFVLAVGQLVAALRTVEQRAAGAAGVRAVGTGEAALRQVGTFATVVEQRERHVRTVQAARILQQAELDDIAATGIDGQVEDVGLHLDQLVADRNRLVGGFGAGRAALGSGNVTAGARGGRSVRQALRGVHRSAGGGQLRLTVILVPLENQQVGHDCKGDDENRALNVHGYSAIEKGRCLKETDSSRSRLRDCQ

SEQ ID NO: 18904 - protein, 368 aa, Pseudomonas aeruginosa
TMHFTIQREALLKPLQLVAGVVERRQTLPVLSNVLLVVEGQQLSLTGTDLEVELVGRVVLEDAAEPGEITVPARKLMDICKSLPNDVLIDIRVEEQKLLVKAGRSRFTLSTLPANDFPTVEEGPGSLNFSIAQSKLRRLIDRTSFAMAQQDVRYYLNGMLLEVNGGTLRSVATDGHRLAMCSLDAQIPSQDRHQVIVPRKGILELARLLTEQDGEVGIVLGQHHIRATTGEFTFTSKLVDGKFPDYERVLPRGGDKLVVGDRQQLREAFSRTAILSNEKYRGIRLQLSNGLLKIQANNPEQEEAEEEVQVEYNGGNLEIGFNVSYLLDVLGVIGTEQVRFILSDSNSSALVHEADNDDSAYVVMPMRL

SEQ ID NO: 18905 - protein, 369 aa, Pseudomonas aeruginosa
MSLTRVSVTAVRNLHPVTLSPSPRINILYGDNGSGKTSVLEAIHLLGLARSFRSARLQPVIQYEEAACTVFGQVMLANGIASNLGISRERQGEFTIRIDGQNARSAAQLAETLPLQLINPDSFRLLEGAPKIRRQFLDWGVFHVEPRFLPVWQRLQKALRQRNSWLRHGKLDPASQAAWDRELSLASDEIDAYRRSYIQALKPVFEETLAELVSLDDLTLSYYRGWDKDRDLLEVLASSLLRDQQMGHTQAGPQRADLRIRLAGHNAAEILSRGQQKLVVCALRIAQGHLINRAKRGQCVYLVDDLPSELDEQHRMALCRLLEDLGCQVFITCVDPQLLKDGWRTDTPVSMFHVEHGKVSQTTTIGSEA

SEQ ID NO: 18906 - protein, 178 aa, Pseudomonas aeruginosa
PARQHAAAGSAGGDSQSAGALGPVPPVGLAARCFAHWLAAGSATPSGTARSTDRHDARRCRFAPASPAPPPAVLSGLPFSPGDHFQRLDVEVGLGEQLLQSAIFQFKILQPFGVRHGHTAKLRPPSVERGITEAVSATQFLHRHTGLRLLEEVENLLFGKTLFHCRLLLGKRTLLSLT

SEQ ID NO: 18907 - protein, 109 aa, Pseudomonas aeruginosa
EARCQGGGGQAGKRDDRRNPATADRLPEAAAYPGRPLPLRVAGPAGDLGGGAVPAQRLGADPGRVAEAGRGAGGILPGGLGLRRGQGRPRRPADPIRQLCAEDHRLRAA

SEQ ID NO: 18908 - protein, 287 aa, Pseudomonas aeruginosa
VRHQPVGRGEACAAGVSEGPVVKKARCREDAGPFLRGGTGSAEQRDVRHPEERPAQLGQQRIAVGAHRCVVDIDHHIGEERIHRLAQGRQAGQRGAIVACRCQRRDFAFGVRHGAAQGLLGGFHQQAGIHVRRNLVLGLGENIRHPFVRRGQGLGFRQLSEGLDGLYALVEVQRRAWLERAHRLVHGHVHAFVLVARAQAVEHEVQHLLGQAGGLDLVAVLLDGGVDRGYQVQVELLLDEDAQHAQRSAAQRVGVLAAGGKHADAEDTDQGIELVGHRHGGAGQGRG

SEQ ID NO: 18909 - protein, 360 aa, Pseudomonas aeruginosa
LGAGAARHVLLVEGQGDVFRFAAVGGVVVAGDALHFGELADHLGRQVTLGQDAGARGVLRIAAYTFGDVGGQAGDALGLLEHGAELGLEHYVAQALIEAFERLLLVLLEEELGVGEARANHLLVTADDVLRRLALDVGDGDEARQQLAVGVQQAEVFLVVLHGGDQGFLRDLEEALLEGADQRHRPLDQCSHFVEQARRHDGAALLLGGQFGHALGDQLAALGEIGQHMSAAQVFQIRCRAGNTHIVRIVEAVATGFAPGFLGEDLALDHIVAEQHHQPLGRTHELLAASCPAHPLGNRQFVQRGLDDARQQAGGRLAGDGLAEAQLRTALVDLLQIHAALLGEAQGGLGRVTAGVEGGL

SEQ ID NO: 18910 - protein, 508 aa, Pseudomonas aeruginosa
GVGCAAARSRRAVRTSAAGGLPGRIVLDHRAEEARALPRGAVRLRRAAGGTDERRGDRRTDARPRHHSQSGQAQRCAAERPGLAGAGRPGWVPLVLRRRPAEDQPFRRSRRGAGDYPGSRGHEQGAAQGRLQLRRADHLLRLHAGQRHGHGPYPGLRPLRPTRRLAGRSLTDAFGCSTWNIGAQHSWSPRFLGCRPRLLPGVQCAFESSEECFVEKFKGALVVGALRLFALLPWRAVQGVGAGIGWLMWKLPNRSREVVRINLSKCFPELSETELEKLVGQSLMDIGRTLTESACAWIWPPEKSLRYIREVEGMEVLEEALASGDGLVGITSHLGNWEVLNHFYCSYAKPIIFYRPPKLKAVDELLKKQRVQLGNRVAPSTPEGILSVIKEVKKGGCVGIPADPEPARTAGLFVPYLGTTALISKFVPQLLSRGKARGVFFHAVRLPDGSGYKVILEAAPADMYDKDLEVSVAAMSRELAKYVRAYPSQYMWSMKRFKNRPDGEKKWY

SEQ ID NO: 18911 - protein, 116 aa, Pseudomonas aeruginosa
GKGVGRRLFHIRVLCSALPPPPQVPRDSMDNQRQYPRTPLKCRIRISHPLFGELMAQTRDLSDTGVYVKHPDLTQLPTGSVVTGQVQDLPIDAPILQMEVVRVDAEGVGLRFLSEA

SEQ ID NO: 18912 - protein, 574 aa, Pseudomonas aeruginosa
GRSPGACCRRRRRRPRWHRCSRTGGRGSRSRTVACRPAARPLRVHGRCRNRPAAQARRPAFHRRPRTLAGMRRAARRKGRSAGVSWCSRKTKSTQFSASPGRSASVAESHRHVANAPPRGVHRHLGRQGRSYHRWQRDRVSRCSHSGAVPAPQGDPAMFSKHDQIRGYDDELLAAMDAEEARQEDHLELIASENYTSKRVMQAQGSGLTNKYAEGYPGKRYYGGCEHVDKVEQLAIDRARQLFGADYANVQPHSGSSANAAVYLALLNAGDTILGMSLAHGGHLTHGAKVSSSGKLYNAVQYGLDTATGLIDYDEFERLAVEHKPKMIVAGFSAYSKTLDFPRFRAIADKVGAYLFVDMAHVAGLVAAGLYPNPIPFADVVTTTTHKTLRGPRGGLILARANEEIEKKLNSAVFPGAQGGPLMHVIAAKAVCFKEALEPGFKDYQAQVIRNAKAMAEVFIGRGYDVVSGGTDNHLMLISLVRQGLTGKEADAALGRVGITVNKNAVPNDPQSPFVTSGIRIGTPAITTRGLQEAQSRELAGWICDILDHLGDADVEAKVATQVAGLCADFPVYR

SEQ ID NO: 18913 - protein, 212 aa, Pseudomonas aeruginosa
APRRRSGSPTRPGPTLSAGEGATVQEHPHATLLRLRPVKAFTEPSRELATHVAHAHAEAGLRRGHRRRRRARPGHRLLPGQGTRHQQRGGSRERLAGRRQHRAQHHHRALQLPVGRVRAALRTRDEAVGGPVPGPQLQRDVLPARGLQPLPHPPGHARRRAPGQRQPPQRRRRRIVERAAGGGGDSLPGLQQEHPLPDHGRDHPASRRRRPP

SEQ ID NO: 18914 - protein, 1016 aa, Pseudomonas aeruginosa
  UNSURE (960): Identity of amino acid at the above locations are unknown.
EETRRTRGTGMSQINRLSSGGRIDRNRPLTFSFNGQHYQGYAGDTLAAALLANGVDIVGRSFKYSRARGIVAAGAEEPNAILQIGSREATQIPNVRATQQALYGGLVATSTNGWPNVQNDLMGIFGKVGGKLMPPGFYYKTFMYPQSMWMTYEKYIRKAAGLGRAPTEVDPDSYDWMNHHCDVLVVGAGPAGLAAALAAARSGARVILADEQEEFGGSLLDTRETLDGKPAAEWVADAVAELQGLPEVILLPRSTVNGYHDHNFLTIHERRTDHLGEVAPLGQVRQRVHRVRAKRVVLAAGAHERPLVYGNNDLPGNMLAGAVSTYVRRYGVAPGKKLVLATNNDYAYRVALDWQEAGLQVVAIADARANPRGEWIEEARQRGMRVITGSSVIEARGGKRVSGAKVARIDLQAMRASGGEWLDCDLIASSGGYSPVVHLASHLGGKPEWREEILAFVPGEGLQKRICAGAVNGVFGLAEVLADGYQAGSRAALDAGYKTTAGSLPKVQPRREEASVALFQVPHEKPTARAPKQFVDPQNDVTAAAIELACREGFESIEHVKRYTALGFGTDQGKLGNINGLAIAARAQGKSIADTGTTMFRPNYTPVTFGAVAGRHCGHLFEPVRFTALHAWHVKNGAEFEDVGQWKRPWYFPRRGEDMHAAVARECRAVREAVGLLDASTLGKIDIQGPDAREFLNRVYTNAWTKLDVGKARYGLMCKEDGMVFDDGVTACLADNHFVMTTTTGGAARVLEWLELYHQTEWPELKVYFTSVTDHYATLTLSGPNSRKLLAEVTDIDLDKDAFPFMTWKEGKVAGVPARVFRISFTGELSYEVNVQADYAMGVLEALAEHGAKYGLTPYGTETMHVLRAEKGFIIVPQDTDASVTPDDLNMGWAVGRTKPFSWIGWARHEPRRLAARGSQATGRTQAEQPAGGTARRRANWCSTPQQAIPMKMVGHVTSXYMSASIGHGFALAVVKGGLKRMGQKVYAPLADGRFIEAEICSSVFYDPKGERQNVD

SEQ ID NO: 18915 - protein, 213 aa, Pseudomonas aeruginosa
KRMSKANVYQQRPEPGVHAESPLHHAELHKLAGKTAAKAGIVLREKKLLGHLVLRGDAADPAFAAAVHQALGLELPVALTLVASGETSLQWLAPDEWLLIVPGGEEYAVEQRLRQALGEELHYAVVNVSGGQTLLELSGANVRELLMKSTSYDVHPSNFPVGKAVGSIFAKSQCVIRHTGEDTWELVVRRSFADYFWLWLQDASAEYGLQVAA

SEQ ID NO: 18916 - protein, 311 aa, Pseudomonas aeruginosa
AAFPSPREGIPDPEPRDEPYPRHLDPHRRQSQPAGHRRRGDALPLRAALLRHRAPLVRRPPGATLLHPRGVPRRRRLRRSLLPRRTGRTGGTVRHAYRADRAGLPQPGGDHGFQGRPLPERPALPPAHRPVADGRGGGDFQSPGPGAAGALARHSLPPLPARPERQAGPGSQGLAGARREWRRAGDPRSLHAGAVAGTVPAPGRLGDQHPSLPAARLQGRQAVPPGLPEGREAGRRHRPLHQQRPRRRADHRPGRRDGRPRPLPRGPNRQGPRHRVPDPGAGGGLPHRAEGIPQRQSDRGAVSAPSLPNPR

SEQ ID NO: 18917 - protein, 209 aa, Pseudomonas aeruginosa
RKRARERGASHGLASRATPTARRLPAFSGPVAQQTTFQCKAARPWTPRICTHNDKEETRMSGNRGVVYLGPGKVEVQNIPYPKMQDPQGRQIDHGVILRVVSTNICGSDQHMVRGRTTAPEGLVLGHEITGEVVEIGRGVETMKIGDLVSVPFNVACGHCRTCKEQHTGVCLTVNPARAGGALRLRRHGWLGRRPGRIRGWCHTPTSTC

SEQ ID NO: 18918 - protein, 489 aa, Pseudomonas aeruginosa
PDQPRRTGTGRRPGLLAHPHRPWRGADRPAGRATAQLPAPRTAAAGLAQRRGRLPARAVGTRRGAGVLAVVRSAGAQPAGSPRPGGRWPEGARPRAGPGGRLGNRRHRRGGRRPLRQLPSRRPRWPPRLAAPGGAAHAVPLRRAPDPATHQREPRQQAAGAQPGTAHLLRGQRQPRDRHRGPGRRALHRDPGELGRTHSARRGTGQGRTGSHLPRSRTRPADQGPALGTQHPPARPRLALGGGLEPLGGQVPASLAVRRRRLAADALHRDRAGLGRPHGGRPRAQRKLWRADLERAAETTLSGSASGRRGSHRPPWTVAQVPALQVRFLHHLHPRLVDGVGGIGQVIAHLLDLQRAADPQRGVDIGQLQPLWITHQDDLVRRRRRHVDAGARIGHQEEFGDAALGVVLQRHRVAAEADRLAIQAGDGLGRIHHRRHLSVRLLQAPLAGEGAGGLRGVVDDVGHFFQRLAVGRRHQFQPVGLGQFGVDQG

SEQ ID NO: 18919 - protein, 465 aa, Pseudomonas aeruginosa
SRQPVRSSSCLSQMRRPARQKPTSHASSRGVACTGPSRRAVPVRRRRSIPQRQAGRAPGATVRPVFSRHGGKLAATQCAPATSGQTGCRGALRGSGGRAGSAACRGARQRHRDRRSAPSKEMTMTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEAIQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 18920 - protein, 341 aa, Pseudomonas aeruginosa
PAGRRPGAALACLLDAAQPAFQLAPEQADRRLAHQRAAVQADFLRHEPLRPATDRQFAALQFVDHAQPWHPGHAHALQRHALQAVGHRRLVDRGVAQVALAQQQVDPATEEGAGAVGEQRHALAVLQVEQRLALGVHRADRQHLGAPQVQRGEDLRVHLQRGVRVVERQHQVAATLAQGMHRLADVGGDQPAGDVQPLVAQPRDPLREEAQRQRVGGGELQHLALPAFQVVQVAHHLAELLDHAARGDQEQLPGLGQFHRRALAIHQGQAEGVLQAADAPAEGRLGDEALLRRLGKAAGAGQGDEILQPLQFEVHDGKGSGNAMTRPPSYQRHIQHYAVCA

SEQ ID NO: 18921 - protein, 460 aa, Pseudomonas aeruginosa
  UNSURE (252),(292): Identity of amino acid at the above locations are unknown.
GARRPAVSLLFFHRSRRPADLPRCRGVVWLRSPVDNVRVIRPTKAYPLSTPRQPLLPPLLREEIGPQYPYPDAVAGKRRHQPQPAMQAAGRDPAEIRADVAAIGQARAVAEQQPADHRRRQRTARDVQVRREASGQAGGEQRAEDDADVHHAGDVFPQRRGQRLGVRRRLPEGPGADVQAHALGDLRAPQGEGRRDAPGASGEVQGEEVEQRQRQRAPDQRARAAEEAPPTPPLGARRGIQGAVAGLLHAYXDPGDADEHRQALHQRRCQAQFGDQRDRRQRRQGEPPADMXGGDQRAEDEEQQGHQHPRVAAADGEQGAGGAAAAQLHADAENEGADDHRSTDRRDETAHRLAEQAARRQRREEQQHRQRQHHHLRAQPGAAPFADEYPPGGGEAEGGVVEGQAQGAADDEEDGLARADRVEQEQPAEHQQGEGDQGGGELALGRGGKGDTHGYSWARG

SEQ ID NO: 18922 - protein, 239 aa, Pseudomonas aeruginosa
SGGILVSRDDGSNQGLPPPGLAQRPQRLVDTHLGYCREAQHQARAVVWRNAGVVHPVVAQGADFHPGGCRRGDQGPFPRQAVDPHAQVQPRIHRRQRLATRRFWPAPQQGVAAGAGGAAHAADVALEMPLGDEVGHDPLGAHLRMAYLDGPPLAEALDQRRRDHQVAQAQRREGDLAEGPDVEHPALSVQRGQRRQRRTAVAILAVVVVLDDPTVGALGPLQQLQAPRQRQGDAGGVLV

SEQ ID NO: 18923 - protein, 556 aa, Pseudomonas aeruginosa
PRPGVEGEQVEGRHADAERSRRAFRWRRQGRRAARRGSARGDGGGPAWDFLQLGNVGAVACAPVDIALGVQLFIGPHHGVARDLQGLGQLAAGGHPRAAAEAAVEDPFAQRGVELAGQALGGVEVDAGGVEGQYGGHGGLGGKKAPVWIGPVELTSNGSSSGPFPGLVWRHLYPDMEPSHEHVPADSSRRRRRPRRLAAAVGGLPALLQDRDRRRYQRRHLAALPRRRRTDERRPRLARRARRGPGALDLPPLLLDRRRLLLPAGPVRRRGPARRRHRAPADRACLRRGRRRWLFAGALADPREQQRRDEAVRAHRRQVRFPSVPQDSLRPTMREPLNWRPVATPPHAPLDGRFVKLEPLDPQRHGDDLWDALQGPGADPLLWEYLAYGPFAERPAFDAWLAGQAASRDPLFFAVRERRTQRAVGLLSYLRITPKDGVIEIGHIAFGAPMQRTPGSTEAVYLLAELALGRLGYRRLEWKCNAGNARSMRAAERLGFTYEGTFRQHMVVKQRNRDTAWFSLLDSEWPARQAAFERWLDPSNFDAEGRQRQTLEALRD

SEQ ID NO: 18924 - protein, 446 aa, Pseudomonas aeruginosa
PLAGTAGRSTVLRQPVQAGQDVRDRVGHAEQQHQHDRRRAAPGAEQRAAEALARGPRHQRRNDHRPERRGQPGETDGVDEAVGEQQPADGRWDEGQQRGLEAPEVAVVEPAQVGQVVEQAEGHAEEGAGHRQVGEGGEQRVQRIRRGDPVQVFHQGADVAAAGDDALELLARDGAQGAGLPQQVDGQGDQGADPQRTADPLRVLAVVLHQARHVAVVTEGSQAERQGRQQVGPVDRVRLAAVEQDRRLDAPEQAADGEAEGNDHAAEHQRGDAVHRAGAPPHHQRHRQGEQQPGELFRQGHAEAAGQGVADDRAAAGDIGIGEDIEDEGDAQPVDHIPALAEQVTGDGREARAHRVVEVGLEDHHPRQQHAEPGEQEHRHRPAEPDAGHGDGQGEHSGADGGAGDDHRTAEQRGPAAGRLSWRGRHLDFPIVSACGATRRWAEAAF

SEQ ID NO: 18925 - protein, 968 aa, Pseudomonas aeruginosa
AARAPGAPWQGEQPADAATDADKKRGASCSPRDFNRLSRSARNLDQDLARVDPVALGHVDRLDRTGDAGLDLGFHLHRLGDQHRLAGLDAIAFLHQHVDDVARHGGADVARLAGMLAAAGGAGDIFVERLEHHFFRHAVDGQVEVPLVVALHADPGDVDAVGLAVHVDDELGRGAFRASGGDALAGENRQQFLGLQGAGLTLFEELAPDVREHRVGEYVFLGLGQVADLAAQLVQLRLDQVGRAHVDDFLAADGLAPQLLVDLAGGLAITALQVQLHFVGDGLVALAGEHVEERLGADDLRSRRHQRRETEVGADPRDFLEHLAHTVQRALLLELVGQVGNHPARHLVDLYAGIHAGEFALELVVLLAHRVEVHADLLDQLQVQAGVVGGAAQRRDHRLGARVAGAPGHAGDRRVDTVGAVFHGLQLAHAGDTGGVMGMHHHVQRQGVLQGLDQVAGGIGGEQAGHVLDGDGVDAHVGHRLALGDEGLDGVHRAGGVADGALGVLAGGLHRLDGDAQVTHVVHRVEDAEHVDAVDRRLGHEGAHHIVAVVAVAEQVLPAQEHLQASVGQRCLELAQAFPRVFLEEAHAGVEGGAAPDFQRPVADAVELVADRQHVLGAHAGRQQRLVGIAQDGIGDAGLLRLDGVAHVLLLPLQAGVGRDGGGDGDGQVRRVALDRVLGQFRVAFDEAGVELAAAEFRVAEDFLVVRRGGLDPLHAHVVEGAQAAIEGLFPGQRPDDQLQAHRVVVRRDGVAGVDRRVGTHAGAAGGVVAGDLAERGQEVVLRVLGVDAELQGVAAMDDVVLLDRQLQPGSDADLLADHVDAGDFLGDGVLHLDPGVHLHEVHLAVGEQELHGAGVLVAHRLGRAHRQVADIGALLGGELRARGDLDELLVAALDRAVALEQVHGVAEGIGEDLRLDVLGIDDALLEEYLGAAEGLGRLGDHPRGTPVPAPRGCCSDGCRDRRRRRWP

SEQ ID NO: 18926 - protein, 315 aa, Pseudomonas aeruginosa
VVDAYDITAASGFSCRMREPLLQPGGGGNGPDPAGGQPADPPTGRAGRPAAVRVRRQEALPDRCRRSPAEDQHRPVPAPGKPGHAALGPEGLAAGPVAPGGGVQRQVHHPAPVQGVPEPASGSQPEPDGGQPHPGDQAPGRQPRRPGDHVPGTAGHGPGVPALPEQPDHRRGAAGPSAVQRREAGPEGPGALPATGPRTGLRHPQGLRGVLPATPRALLADPGDRLAGVPARRGDRRPRPGPAAAPCGAPGTGQRPAARTTGGGIAALSQLVPGARQGQAPEPGGPGVRRLRPRGAGADQPARWALRRPWRFELR

SEQ ID NO: 18927 - protein, 843 aa, Pseudomonas aeruginosa
RFGGRPVKTALCLPGGASGRLAALFLVLHHLRRQAQAAQAALDALEVVDQVRAAGHGHAHRQHVDHHQVGDARGQRGVDVGVLVHVDRQVDRGQVGQRGLARAQGDQRGAGLAHQVGGDQQVLRATRLGNADGHVAGLEGHRRHRLHVRVGVGRRRQQQAEELVLGIRGHRAGSAEAVELHALGVGDGGDGALQGVGVQVLADFHQAVQRGVEDLQAEVGHRVALMDRELAEAGAGRQALRQLQLEVLEAAAADGAAEAHDGRLADPDPMGQFGHGAVHDRRRIVENVIGDLEFRLAELLAGLGYVLQQVHRLGSILCSNLVVILQTVSHAQPTPSGACLEYTSHSNVLRHPGLRRYRRPGPAQAAAGALSPAPGGPPAGRYADLRPRPQRAGQRRLPRPRRAQRPRGGGAQRVRRRTMERLRRAPRLPGHGRLAERRLRPSRAAPEEQRGPGAGALPGDLAEPVRADRAEPLHRRPRRAASAHRAGKTAGPFAGLGEGDQPVHRPGVRRVAGVPHRPLPGQGNRAEPDGPALRQCVVRAGLARGAHRPCADQRQRDPWRGEPWRLLRPRRGDARHGAEPSAPVALPGGDGGAGAFRRRGCAQREAQGAAGAEADLRARRAGQDGTRPVRRRQDRRPGGAGVLLREERRQRQRYRDLRRAPGRGRELALGRGAVLPAHRQAHGAQVLGNRHPVQAGAAQPDRRRRRAGQPPVDKVAAGGADQRATDGQDPGQGHATGTGGAGPQPGRGPQPQQAALGRLRAPAAGRDRGRLDAVHAPRRGRGRLGLGRPDPRRLARALPEPAALPGRQQRPGTGATAAGTAGSTLAGMTRTLIRLRIARRALG

SEQ ID NO: 18928 - protein, 475 aa, Pseudomonas aeruginosa
SRAPTSLRARTMTATTLRPELLCPAGTLKSMRYAFAYGADAVYAGQPRYSLRVRNNDFDHAQLAEGIAEAHALGKRFYVVVNIAPHNAKLKTFLRDLEPVVAMGPDALIMSDPGLIMLVRQHFPQMPIHLSVQANAVNWAAVQFWRQQGLTRVILSRELSLEEIEEIRQQVPDMELEVFVHGALCMAYSGRCLLSGYINRRDPNQGTCTNACRWEYKAVEGREDELGNVVAREPTLGRGAPTEQVFLLEEGNRPGEPMAAFEDEHGTYIMNSKDLRAVQHVERLARIGVHSLKIEGRTKSHYYVARTAQVYRQAIDDAAAGKPFDRGLMDTVESLAHRGYTEGFLRRHVHDEYQNYQHGHSLSERQQFVGELTGERRDGLAEVEVKNRFQRGDSVELMTPRGNLSLRVEDLRNAAGEAIEVAPGNGHVVYLALPEGLDLCYALLMRDLQPGQDTRQPQAERSGGCAGKGACGCAH

SEQ ID NO: 18929 - protein, 234 aa, Pseudomonas aeruginosa
SPVRLRRSDRCRSWPQPPGTWRRPCLRPTRRLARAHRPVPLVPSRRHRAGPGGCWPGPWSPPRPARRHAPGEETPARCPGRCCGSGCPRPRRIRRRRSFPVALRRPSAGPVRRAARALAQAAVSRPRSPPTARAAGCRRRAAGGTGRTAPGRSLRASLPPTAAPPPAASGRRRPAAGAGWRGCRCPGRGTAGYRRHRRRPETNRDSRSRRCWPGPAGRDRRPPAGGREEAASSA

SEQ ID NO: 18930 - protein, 672 aa, Pseudomonas aeruginosa
SGRSITEQGQAAQGRDRAFFRSQARRCAGLRRMAARFARLFPAPVECRDERRPLPPAELPQRPAAPGRGRAAGPPTGPRRRRLGQDPRAGAPDRLADPGRARLALQHPVGDLHQQGGGGDAPPHRAVARDQSGGHVGRHLPRPRPSPAARALARGRAERELPDPRQRRPATPGQAGDPRTRPRRAALAGAPGPVVHQRAEGRGPAAATHPARRRPVPRHHAEDLRSLRGGLRPRRGDRLLRAAAARPGPLARPSRRARALPAALPPYPGGRVPGHQRRAVRLATDSRQGRRQPDGGRRRRPVDLRLAWRTDREHPAVQRRLRRRRGDPPGAELPFHRVDPQGRQRPDRQQPGTPGQGVVDRRRGRRVAEPVRRVQRARRGALRGRVDRERAQGRPGAQRDRHPLPLQRPVAGAGGSPAAGEDSLPHLRRPALLRACRDQERHGLPAPARRPRQRRGAGTGGQRAGTRHRREDRGEHPRIRPRQRCVDVGGDPPDDRQQGPARPRRQRPDRLRRADRESFGEGHGHAAAPDDPDGDRAVRTDQLPQGRKRRERPGPGGEPRGTGQRRPRLREQRGRGRPHPAAGLPQPRLPGGRGNPGRRPRGQCPADDPAQRQGPGVPAGVPGRHGGRAVPAQDEPGGIRPPGRGTPPGLRRRHPRHAATGPDLRGDPPALR

SEQ ID NO: 18931 - protein, 78 aa, Pseudomonas aeruginosa
LPTTSGKDRHIMERTLGSNTFDIARSNRRSSSLLGTMKLWQRRIQSRRQLARLDSRLLADAGISEAQRYAELNKPFWR

SEQ ID NO: 18932 - protein, 297 aa, Pseudomonas aeruginosa
AILACRWPWLPAQAGRSLRRSRGRPAPERPTSTRRPARPAGSRAAAPFPKPAPGAVRRRASDFPIPACRRSSAENAGGPPPAVAHGRAGPATGSCAVRGFLRRGNTRAAPGHARARARAGTPGPADGTARHGRGAPPRSARAAGRNTPAPRRRSPASRSGSTAPFPSRAPAGVLFRASGRRVASPDNAGGSGRAGSSASARRSPAARDWAHGRDRPAADRYRNAAAPASVVPGRLRAGCAARATDANSRAAPPPAGRRSSPSHGTGKTRSPRAPATRPATRPGNARCRSAAPGESAR

SEQ ID NO: 18933 - protein, 279 aa, Pseudomonas aeruginosa
RPVRPLPVEEQLLVAAHQRGHRIEFDQRADTLGQDADRIDDRRQPEPELQADAEQLADVAEEHVEHPEDHPQSRREQHLDRQQRHQREQCRARQAPAEGEKAEEQGEDDGEIDPGVEQYDDRQADAREADLLQQVGVLDEHALAARGDFREQAPGQQAGAEIDAVGQAVVDPRQARAHHLGEDHRVDDDHRQRIEHRPQRAEQRPAVARLELALDAAENEATIAPQGTRQAKKHQTTLPYWSSKRTMSSSPRYSPLCTSIITRSMTPGFSRRCRWPAGM

SEQ ID NO: 18934 - protein, 596 aa, Pseudomonas aeruginosa
LPPVLSIEQVAVAITEQEHDGSTSPPGRLPDNEAAPGLAHHHQAVERAVSSRDAMNFILYSDINERSIGHNLGRPEYSYYFVLKAYRPILESLGQVHLVQSTDEVDPLYRQLHEQGEDCLFLSFTPPHKAARGLQCPMLCVVAWEFESIPDVAWDGDPAQDWSQVLAGHGAAITLSEQTARAVRRVLGEDFPVLALPTPIWEDFAAIRQQGERNPVKSGETLQLKGCVIDSRLLGLSADGLIAPIREETEDEILEVLPETPAEPEPEPVPEPEPEPEPVPLDWRRRLVISKHYLLLWYREAVSDLVPIPVRRWLFRHLRRPLPPPPTALETLPEPLPQAIEPMPPAEPEHPPALLPAVDQHQQVVVDGVVYVSVFNPLDGRKNWHQLITAFCWAFRDTSDATLVLKMTQSDLTTYHVELLTLLSQLSPFACRVIALHGYLDAAEYARLYGAASYYVNASRCEGLCLPLMEFMSCGTPAIAPDHSAMADYMDAQVGFVVRSSQEPAAWPQDSRRLYSTRRYRPSWESLKEAYLESYRVAREQPERYRQLSAAANQRMRGYCAGDVVRQRLEPFLSARKATPAPGVELAATATGNVPC

SEQ ID NO: 18935 - protein, 431 aa, Pseudomonas aeruginosa
SSSTPRTNKTTIRQNLGRPEYSYYFVLKEFRPLLEEIGQVVEVSDPDELVDRLYHDCRKRGEPCVFLSFSPPHRTPIHHACPTIPVFAWEFSTLPSETWHGEPRHDWRHVLRHSGRAITHSSFTVDVVRAAMGRDYPVLSVPAPVWDRFANRASQQAGRPEARDVRLRLDGLLVDSRQLDLAVHADPEPSAEVLALPDRAAKQVELSLDGVIYTSVFNPYDGRKNWQDMISAFCATFRDEPDATLVLKLTHHNVGEALADMLHHLYKNQSYRCRIVLIHGYLADPDYERLVEATSYVVNTSYGEGQCLPLMEFMSSGKPAVAPRNTAMIDYIDADNAFIVDSSEEATAWPHDPRAAYRTLRYITDWESLCRAYRASFEVARQEPERYARMSAHASASLERFCSRKLAVERLRRFLDEAAQGDPAALQSIPA

SEQ ID NO: 18936 - protein, 670 aa, Pseudomonas aeruginosa
SSRASRSTPDRRGHERQTHPRHRTVARAGRARRGIPPSARQPVQRLPGTAGRHQPARPVLVGRGPVLRHLRLRHRPHPHPATARGAHTPGILGTGAVLLDPPRLPPAALGLAVAGADPGLLPAAEPLRSLRQPVGQPRGEPRRFPPGRQLPLRRQFLPLRIRCQLRLLEPFPGGTVLPPAAAADPLPASLPGLGPPGAGAGPVLQPAHAAADGIAHRRPGHRRTTRPRLPAAWLCPLEPHPAGPRLERAVAAGRRGRGPGRAGQRSVQPGRRADRRHRAIVRTAGVDSLLRPRLPALQRAAEALAGLGRRALLCDLPDPHPGVLSQSRTLLPPGLGRRRAAPVAARHQPGPDRRTQRAQLPLRREPLPRPGLPPGQAPERRPPRRHHFRSHLMLNFLKKIVSPPSPATEPVAAPPAPAPVDPYMLGLRDAVLSGWFNQETDELFSGFPISAEDTVLDVGCGDGGNVHFCAMRGARIIIADIDAEKIARTRERLADTPARELECLVSDCDPLPLADATATRVVSTEVIEHVDDPRQFLAELVRVGQPGALYLLSVPHPTSEDLQKDFAADEYFRKPNHIRVLGEEQFAALVREAGLEILSHSRYGFYWSLWMLLFWEAKVDFGNPDHPLLEHWARTWQALLDSPRGPAIKQALDAVVAKSQVIIARKPAQA

SEQ ID NO: 18937 - protein, 141 aa, Pseudomonas aeruginosa
PSESPAPPPQPPGCGDDLADRPHWLRAAHSVSLGGCSSPIPPNPMRYRFSLLFCCLLAPAAHAFDTTTAFTAKSLYVTSKLTSTPFENKLLRDARGDAASFVASDGSIRGARLEAALRWLRVAHPELAASDQELAEAILAQ

SEQ ID NO: 18938 - protein, 754 aa, Pseudomonas aeruginosa
PPVRRPAAGALRHGRGSTLGGRDQQYHRPRPRPQHRLHFRHHHFRARHESGHRGARRRRQFRRQRRRHSRRPAGSRDADPAQPSAGSPGSLRPGTCRSHSRPVRKACAWLLALALCGAGNATAALRLKLDAPELDPAQREASQQLLDEAADKLPPAFRERLDREIEVEWRDDLPANGMGQARGPQRIALNRKYLADLTDGSAASRQTGRVHGTERRELLATLLHELTHVYDRARLWSAEEKREIRRCTRQEETLGRIAQPTDCRGQSGRRFTLSDDPRLLDLAGWPQRAGQRGRREAHNGFVLRSPDVYELSNPREFVAVNMEYFLLDPSYACRRPALYRYYQQRFGWAPEHSACAQSFAYLNAGRDFGQQPLGQLDPERVYEVDYLLAEANDNLVSRWGHTMLRLVICAPGRPRGPDCRLDLDQHLVLSYRAFVGDLQLSSWDGLTGAYPSRLFVLPLSQVIEEYTKVELRSLASVPLKLDREEVASLVERAAQSHWSYDGQYYFISNNCAVETLKLLRSGIPRRPLQSLDSITPYGVLEMLENRKLADPSVLDDPKEALRLGYRFDSFRDRYQAMFDVLKQRLHIPQDKVEDWLALPARERQPWFAKADLRASAALLLLEQASLRRQLLLAQDELKRLYLGHLDKPAGDQRLEVAGKTFQQILDDSGFLSRPAELLEGGYGLPQAAEWKHLEEQTRERQARLRRLSDDLDREVRALLDPERRAELEANEANIKEVGAHLRELHKAAGGLMLP

SEQ ID NO: 18939 - protein, 348 aa, Pseudomonas aeruginosa
PQWQPPVWVSGMANPPRGSASISRTCPVPQPPRKMSGFHYPGVPVTALLYSLWPLFALIVGGYALRRWDFPGEAFWPAAERLNYFILFPALLFSNLATAPLDDPGLARQALAVLLGLGVAWLALLLCKRWRGWDAGRFGAIAQGVLRFNTYLGLAAVGSLYGKPGLTLAALMLALMVPTVNVMSVWALTAERGISLRALLLPILKNPLILACLAGALVNLAGVGLPGGSDRLLNLLAVASLPLGLLCVGAALKPQELGGEVAALGWNCAARLLAMPLLAFAIARGLGLPSMESAVLVLFFALPTAPTAYVLTRQLGGDGHLMAGIITLQTLLSGATLVGVLLVLQGSP

SEQ ID NO: 18940 - protein, 139 aa, Pseudomonas aeruginosa
RQDASPPPSRRSACSANRPSVSSRCFPNSTTNPAPPPSSGRPSPPSARSSAAPSAHRSPALTRATSSSRRGTTPPASSPATVRSVARTSRQPCRSCARPRNTPGTATCNWPRRSSRGSPDRPHIRNYPHVSRRYPAKAA

SEQ ID NO: 18941 - protein, 352 aa, Pseudomonas aeruginosa
TEGVGGRLHRHHHPDRDHRHRLFPGLGDHRRRHGLPRAGDGRGDHRRGTGDDALRRRHQRLHRQAPVAEDARPVVPHRGRHGADRRSLRSPCAEGLRLLRHGLLPGRGGAEHPHARRCRAQAGRRASEAAQGSARRLSRSGRLETLAAEYPASRAATDPTVGPAALRAQRVGRAARLVREAPGDQQDRQAFVGVLATLALHPDADAAGQVGGAHRRVGGVDMLAAGAGRAQGLETDLALQTGRRRGEALRADEPVLARMPCPVGAGADPLDTAAPALGERFGGSAAQPQKQRTPGARTLAGHLLDYLDLDAGLRRLEAQPLERLRHRQAAFRRPLGRGELQQDHRQHSPRVL

SEQ ID NO: 18942 - protein, 159 aa, Pseudomonas aeruginosa
CRSSAAAIRCSARTSASSTTTSTPSTPRSSCIWQGCRARTCPNATAGAGRRSSSWRSTWSRPATSSSTCSPPCRTRRPRAAARSPTPAWKRSAPCTSSWSPTCAWVSRCSSTATSTAPSACAGPSSASVCRNGATPMPMSTACTSRWYRASRPARCTWT

SEQ ID NO: 18943 - protein, 145 aa, Pseudomonas aeruginosa
KAAAAPARAPFLQRPGRRRRGRPGSPHAGPRRTMERLHQRRRHHLRHRGTCRHPAAGPRPAAGHHHPHRTGRAAHRRRQASDRARRRRPLLAPAALARPREPGPWRHGPTGGEIGLGLFPAGAAGPGLARSSWSGCAATVTYRAT

SEQ ID NO: 18944 - protein, 224 aa, Pseudomonas aeruginosa
DHELPERRELPAANGHAEARRTLITRPFGEGAMLHWIYPEPDDADPDAMVLLQAYMNDALYADLRVRRGLTYGPSTDRQVFANQGFFSLDADVERSDLPATEAALRELLGGIRQHGLDPGRFKRVQFAERARLAWSTQGNAALADYYWGSLADYEDGHFPNEERRLAKVSLQQANALAKRLFDGEGYLRIEKPLFDDDMLYPLLLAAGLLASGLLWFGLRRRRA

SEQ ID NO: 18945 - protein, 172 aa, Pseudomonas aeruginosa
STSTPPPQPRREPTHGMRRNASGVGQLGLGDLLAAPAEQHQGGEQPQQRRATEPDARGRAVVQGVDQPGADRRGETTEGRRSQAVGEGETGSAHVRRHHLGQRHHHRAVVAAVEERQPQLDAEQAGETRLADQPGQRRVGGQQCQRGGTQQQWLAPDAVGERAHHRQPDEVG

SEQ ID NO: 18946 - protein, 330 aa, Pseudomonas aeruginosa
ADAHGHQQAVEVRQLQFVLAEGRRVGGDQVERYGGHHHHRGTGQHYAEVLPDGAQHLRQRRSVGARLELRRFLQRATDDEQRRNDQAADEERHAPAPFAHVLRAQPLVEEHAEQAGENHRDLLAGRLPTDEEAFASWRGDLRQVDRNPSQLDAGGKTLQEPAEQHQQRRRHAQRGIAGNEGDQQGAHGHQAEGDDQALAAAVAIDVGAQEHRTQRPHQEAGAKGGEGQHQGGERVVAGEEGLGDGGGVEAIHHEVVHLEEVATDHTENGETFGFIRGHGTHTQADTGKRSMAASMATQAGTSSIDRVVTICVKTPVEQSKIARKVRIEGV

SEQ ID NO: 18947 - protein, 416 aa, Pseudomonas aeruginosa
SGRSPDAPAALPASAGGTTDRAAPPGAPPARPSRRCAESRARASGCRTAGPSPRPPAWPWRTGSPPSPRTPSHRRRSTSAPAHSPPPPGKNPTTSRSAFRIPRVARMIAAQAVPAPETPRPRTMPGPPGREAALFEGGLLALGFADRLPQVRQRIPVALALGRVVHAFPLGDDQHREGIADHVEGGARHVHDAVHAGDEGQALERDADAAQGGEQHHEGYARHAGDTLGGHHQGQHQHDLLADGQVDAVELRDEDRRDALVQGRAIEVEGVAGGHHEAADRLRRAVGFHFLDDARQHGFRAGGGIGEDQVVLEDADQAHDREAEHPRDQAQHHQGEEDDGHVDQDHQLGQRQQRGEAEVGDGHRDQGEDTDRGVLHDHVGDLEHGLGNALATPSPAARAGRWAGSTGRGRTSPRRR

SEQ ID NO: 18948 - protein, 452 aa, Pseudomonas aeruginosa
KATMETTSEKQGRILLVDDESAILRTFRYCLEDEGYSVATASSAPQAEALLQRQVFDLCFLDLRLGEDNGLDVLAQMRVQAPWMRVVIVTAHSAVDTAVDAMQAGAVDYLVKPCSPDQLRLAAAKQLEVRQLTARLEALEDEVRRQGDGLESHSPAMAAVLETARQVAATDANILILGESGSGKGELARAIHTWSKRAKKPQVTINCPSLTAELMESELFGHSRGAFTGATESTLGRVSQADGGTLFLDEIGDFPLTLQPKLLRFIQDKEYERVGDPVTRRADVRILAATNRDLGAMVAQGQFREDLLYRLNVIVLNLPPLRERAEDILGLAERFLARFVKDYGRPARGFSEAAREAMRQYPWPGNVRELRNVIERASIICNQELVDVDHLGFSAAQSASSAPRIGESLSLEDLEKAHITAVMASSATLDQAAKTLGIDASTLYRKRKQYGL

SEQ ID NO: 18949 - protein, 646 aa, Pseudomonas aeruginosa
AAWSGGDVQHAAQVVQQHIDAEHDQQHAGQALDGGQPARAEETLEERRLQQDQRSSGPGQHHRQVKLPQRTVEGGAQGDQHRQRRGPGHRRGGQGYQQRLAVGHFAEQPLGRREDQAHGDHEQDDATRDPGRLAGQAEAAEDVLAEGEEEQQQAQGESQLAKRHAQAAPRCDAFQRGEEHGDVAEGVGDQKDQDGDAEHIHGSFQSGTAGHSTGRDHSSEPRQHLQASPSRVVGMCAGRPSGHFQAVPAGALGSIQRLVGTLENRFAGLVAFERGDAGGTGDAQGLALEMERTGGDRRAQPFEQLPAGFQGRGREQDDELLAAETGDEIGLPQPFAQFAGNDLQHLVPGQVAEVVVDPLEVVDVQHRQQQIAAVPVPARHFLFQALAERRAVGQAGQRIGQGFLSLVLQVAVERLGILLHAVDPLHQRLQAAGHLLFVLGLFALVFVHGGKQAVQPAVHRQLEAVQVGRLLHAGLQATDLLTQRLVKAARVVQHVGIAGVGVAQVAEEAFQALVELPQVFLEVALATVRQGQHQHRQVVEYRHQLIPVQAAIDPLPQRLGLGLVAARQGQAVEQPQQAGLDVRRHRAVAGLRYRRRQFVGLVYRLPVEVIHRSGRSFGRAFNVRRHCGRRLRTRFFQRLAKAQAGR

SEQ ID NO: 18950 - protein, 299 aa, Pseudomonas aeruginosa
SSSSGGTPAFYRAENALSVPARARPWGIKRTQNPRHYILPIPKRKRNSPPRHRVAPLWITHVREEPHRRPVPEGQLSHQCRPGRPVPPRRRPGSRFRRALQCRQVERAEHPHSRQPGAHLENPGTYPTAQFLRPGRLAAPGGPARLRLREGADPPEAALAAPPGSLPEQPRKPGRGVPDDGHPPPAHRLRPTDAGLGPGQPATDPCTDDQGRQAGLRRGQERPAQGTPGSPARLGRRRHPATVLRAQAPGRRRGANGPGAMAGPAGRGTRGVRGSLNSRQKKPRASYGEGEVRGSSPDR

SEQ ID NO: 18951 - protein, 292 aa, Pseudomonas aeruginosa
GGVQESANTKHCKGASKGSRSHSCVLTVGKTGKFSAPRKTFPRHPHRALRTCSQGPPHGPRNRSSVGFVPVRTDTRLDHQRYVQGRRSAHQRADSLAHLLDQLLAHFQHQFVVHLEDHPGIEAAFLQPVIHSDHGALHDVRRRALHRRVDRGALGGLAHGAVLRMDLRQVQATAEQGFDEALLRGLGAGPFHVRQDAGVAGEVTVDVGLGLLALDTDLLGQAEGAHAVDQSEVDRLGAASLVAADVFQRHAEDFRRGGAVYVQVVAEGIQQAIVLGQVGHDPQLDLRVVRGQ

SEQ ID NO: 18952 - protein, 420 aa, Pseudomonas aeruginosa
GMDASGTRVDLLGQAVGVGALELAHGAVLHDHLGQLEVLLGQFGEHCLGGGRLAGRGLAQNRQAELVVEDRAELLGRTEVEFLPSQVVCLALQGDHLLAQFAALDAQQVGVDQRAVALDPRQHRYQRHLDVGQDPGQGRDRLQLLPQGLVQAQGHVGVLRRIGPGLFDGDLVEGQLLGALAGDVLETDGAVAEVLQGQAVHVVASGGGVQHIGLEHGVVGYAPQRDGGAGIGQDIDVVLGMLADLELLRILQQRFQRTQHRVTVQLLRNAHVAVGQRHVGGLALLHGEGHPHHLRLLGVDAGGLGIEGDQLGLLQLLQPGVESGLVEHHVVVDLGLDRRFRLAVLAGLLGLAQEVVQPVLELQLAVQGDQRFALRLAGIQLVDLHVQFDVGLDGRQLIGQERLLAIFLELRRQALGAADR

SEQ ID NO: 18953 - protein, 250 aa, Pseudomonas aeruginosa
LGHLVQAGVEHLQAATDTGQQAQRGFLADTRNAGDVVDLVAHQGEEIDDQLRTDAEFLFHAIHVEAATGHGVDQRNVPVDQLRHVLVAGGNHHRAVSRGAAARQGADHVVGLDPLHAQQRQAKGADAGMQRLDLDPQVVGHRRPVGLVLGEQLVAEGRALGVEDHRERAVRVLLAQAQEHVQHALHRTGGLAGRGGQRRQGMEGAVQVRGTVHQDEGRLAHEGNQPFPETRACRMNPGRFDKGARLPCVR

SEQ ID NO: 18954 - protein, 156 aa, Pseudomonas aeruginosa
PWSSAARCRTCRSSSNCSTCSTRTACRCPTPCAPATARPCAVSKASRRCCNRAWPAATSGSRTPTTARKWAICSATFTPPPAGASSNARATVACPGCWNKVPTSPRDYRNRPAPCSPRPWRRSPRWMPSVQRCRAPTCMPTCSATTCCSTARTWPA

SEQ ID NO: 18955 - protein, 795 aa, Pseudomonas aeruginosa
VAPIRVSGRSRVSSICTTDAASAAAARACSSASLTTLKPLIFCVILTADISIPPASVLAVIAFFQGVEEVGGGMDLTVVLDLLVALELHHAAVLQFEAVAGLLQVGLLDQHALERLGIEAEGGAALESLVPGVAVDVLEVLERVVGGHVGGLGDRRIDPLLRRRLDVHVLRRGDAVGGDEVVRQASRRVVAVRQGLGVDQGPVGQQLVAVDLDLFLGLAAFADKVARIMVGEARLDTVGGIVGQAQADGPGRRDGAVVGEARAGFSQRLDQFRSMFGDPLHVAGILGVKHATADAVAGLIAIGGHFRTLAKHFRSDFVVLRQDRRRALLPGQLQGHFPAHQGHFPRHFLGEYAGLGTAVAQLEQGQGRAQAEEAHAMPALAKDFLALLFQRQAVDFHHVVEHPGKHPHHFAETVPVEARLVAKWLLDEAGEVDRAEQTRAVRRQRLLAAGVGGADRLAPPVVVQFVDPVDEDEARLRIVVGGDHDHVPQVAGADLAVDLAGDQPVGALNVVVLDRPFAPDHRVGVVEVDLVALLHVHREYQRPVGVLFHRLHELVGDQQAQVELAQAPVLALGADEFADVRVADIEGAHLRAAAAACGADGEAHLVVDVHERQRPAGVGTGTGNVGAARAQGAELIADAAAGLERQPGLVDFLEDVVHGVLDGPGHRAVDGRGGRLVPQGAGVGDDPAGRDGTVAQGPEEAPVPVFAGGLFLDIGKGAGDALPGTVDAGIHRRTVLALEPVLLVPDILRRVLQGDGPAFGAGTACVCLGHPLINLPMVVGASEAGHRTQHLVIRT

SEQ ID NO: 18956 - protein, 289 aa, Pseudomonas aeruginosa
KPDRRGGRPLRHLPGPEGRLMDNALVRLTQVGVSFNGQAVLSDVDLAIEPGQIVTLIGPNGAGKTTLVRSVLGLLKPHVGEVWRRPRLTIGYMPQKLHVDATLPLSVLRFLRLVPGVRREQALAALREVGAAHVLERPLQSISGGELQRVLLARALLRKPELLVLDEPVQGVDVAGQAELYRLIGKLRDRYGCGVLMVSHDLHLVMSATDQVVCLNRHVCCSGHPEQVSGDPAFVELFGQDARSLAIYHHHHDHAHDLHGEVVKAGPGALPPGTRFTPVHKHGPDCNHG

SEQ ID NO: 18957 - protein, 536 aa, Pseudomonas aeruginosa
LPAQRPPRRPRPGPGGWPPGLLRGLAADGLFRRYPVPRRTARGSPGFPPRCQPDPGCDRRLRAARSAAGDPAAAPAAGRRHPAGHPRPQHPVAGPGHPELHEGSAGRPDGLPVRRSAGGKRQRPAVDNRRQRAGPGTDLLPLAAAAGDHRARGTGEGGRPAGRSDPPGADVADRHRHRRGDEDRRRTADHLAADHSRRRRPAPCPQSRADGGRRQPAGTGRGVRRPGPVLVQGYPRRPLDRGQRRRPVPAEFCPAPPHGVESGDFLTKREPAGMMSSFFRLLSVLAAALLVSACQGNASSQPTPVVAPQAQPADPYAELQQTLAAGKLEQAEQQWLALRSAAAGDERVEAFRRQLAEAYMQRGETALRQGDLNTATSALGHARGLMPKAPALTAGLDGAINRAKVDPARAEQARRMQQAAQQQMQQIIQTPPGGELKPLPGAPHLIDPQAASSAVPLPMLDGTGQGGLGAVLDAVAADVVAYRCRVHIEVRRDSDYPLVSDQLLARVKKLSPDFDLHLSHVVQADKPTRLILTPRN

SEQ ID NO: 18958 - protein, 261 aa, Pseudomonas aeruginosa
TPLTYMWRYCADGLLRNHELRQHRLVRNLAGQRRHLLDARRFAAVHGGPRPAPRRPAVPYRATADVRAEGGLHPALASGEHPPFVAVHHPADRDDPADRTDHRYLAGRRRGHPAAGGGRHAVLRAPGGNRAARGRQGHHRGNPGDGRQHPADHLERPAAGSPAGHHRRHHRHRHHPGLVHRDGRSGRRRRAGRPGDPLRLSALPDRRDGGHGGDAADPRPDSANRGRQAGGALLAQVSLPAKPKTLSAAVIHSRQEHLERS

SEQ ID NO: 18959 - protein, 396 aa, Pseudomonas aeruginosa
TSSSRGRTTRTATPCRSWPRPCTAPRSSSSSRRNTKARWYRRSEPSRVTAPGKSPVFDRAFSFPSRPYVCLPCHDRGHSAVCGKCSEKNIPSHIEQSEKFTTQSTHLRGCPMQELKQRLASPPAELTPAERKVVRALLDDYPRLGLGPMTRLARHAGVSDPTIMRLVKKLGFVGYGDFQEALLADVDDRLRSPRTLLAERRERMGRDDTWARYLDQAGQSLQQTLGLTRPDDIQRLADWLLDSRLRVHCHGGRFSRFLAGYLVTHLRLLRPQCRLLDDGALLPDQLYDLGRQDLLVLFDYRRYQSQAQHVAQAAKARGTRLVLFTDIYASPLREHADLIVSSPVESASPFDSLVPAMAQVEALVATLVARMGAPLDERLEGIDQLRNAFSSHILEE

SEQ ID NO: 18960 - protein, 661 aa, Pseudomonas aeruginosa
PDVQPAPPLAARPAIRPPADRHPVRRHAACLGRAGARPARRSAGSRLLLRARAEPGDPQPAAPAQGHARSGRERPAHRHREPHRRWSRPLAGSQAVGDAPAQGQPGRQGDRRPGADRQRDRAAEDFFRRFQLHRHRLRTAQPRHPPPDRLRGGHRPVRGHGRARCRRPRLPGHPGRGCLRHPYPGTPPGLPGSDQGLLLDQRHRDRPATHRRPRPEQPVNRLQPVRLVSFVTTDLAGITRGRSLPLATLEEQLASGCGWVPANSSLTPQDLIDESSPWGSHGDLRLLPDPNSRVRVEQGPDAAAPALDYLHGNLVETDGTPWPACPRSLLRAEVERYRDSGLQVIAAFEHEFSLLGLPGERPAAAFSLQAQRAAGQFPGWLVSALAQAGTEPEMFLPEYGQRQYEVTCRPAQGVAAADRAVNVREVTREVARQMGLRTCFAPLPAPGAVTNGVHLHLSLQHADGSPLLYEPGRPNDLSELGEHWAAGVLAHLPALCALTAPTAASYLRLKPHHWSAAYACLGLRNREAALRICPVVSVGGKPLGKQYNLEFRPMDATACPHLAMAAVLIAGRLGIERRLPLRALADIDPHGLSDEERQARGIQALPATLGDALDCLQRDETLCAELPKPLLDTYLAMKRHELALTAGLSDDDLCRHYAELY

SEQ ID NO: 18961 - protein, 480 aa, Pseudomonas aeruginosa
PAPPVANNEKEARFACGADNDNTLPFPEEPVMAIEQFGYRQQLRRSLSLSDLIIYGMIFMIPIAPFGVYGWVHADAHGMVPMAYLVGMLAMLFTALSYGAMAKAFPIAGSVYSYAQRGIHPHVGFIAGWVLLLDYLLIPPLLYVFSALALNHLFPAIPKLAWMLLFLVSATLVNLRGITFAARANLLFLIGELVVLAIFLVVGYQALEGGLGNGRLTLEPLYRPEAFDLGLVMKAASIAVLSFLGFDAISTLAEEVKGDPARQIGRAALIALFIMGGIFIAQTWLATDLAAGMNFKSADTAFYEIAEAAGGQWLSMLTAVATALAWGVTVSITSQAAVSRLLYSMARDGRLPRALARVHPRYQTPHVSLYLVAVLSLGIGWAFLDAPDVLTSLVNFGALTGFCLLHLSVINHYYRRQRSGQWLRHLLFPLVGLAIIAYVLYSMSLDAQLLGLAWIAVGLVYLALLQRGGRQAPTELAKDL

SEQ ID NO: 18962 - protein, 490 aa, Pseudomonas aeruginosa
RLARAGSGRLFADEIAAAEAMPQHLFVECPARQLQQLHHRLDIPAALAERLAQALRLEGFHAFRQPRGEAAAFLGVPTLQAEDMTLGGVGQLAYIARPAVGHQPRQFRRRGGLRLAAEALAGNAGEMFEEQRDVLATLADRRQAQLGDVQAIHQVLAEASGTCFGQQVGLGRGNHPQVDVDTLVRAEPLQLLLLQDAQQLDLLRQRHAFDLVEEQGAAMGMLELADALALRAGERTALMTEQLALEQLLGNRRAVQRHERLVGARPEVVQAAGNQFLAAAGLATDQDVHRGRRQGQNLPAQRFHRLGHAEQTRIDLVLETGLLLQAPVLQHQAALFQRAPQTAEQALGREGFLDEVVGTLAHGLHRHRHVAVPGDHDHRQVAIDRLQVGEQLQAVHAGHAHIADDHPGEGLVQRSQAFLGAQAQAHLEAGQLQPLLHRFADRRFVVDEDHLVAHVVTLVSSGAAGRIRLNTAPASALATCRRPPSSWTIP

SEQ ID NO: 18963 - protein, 372 aa, Pseudomonas aeruginosa
SAGQAAKRRSSAPSPGGCGRRWARSSRRPACSTVTAPTLSSPSRWRAGARSTPRSAPTWWSAATASCRKTRPMPPNAYATFSCPIHERSFRGESGAHSSVPGRMTPQDRAMRPLLFSALLLLSGHTQASEWNDSQAVDKLFGAAGVKGTFVLYDVQRQRYVGHDRERAETRFVPASTYKVANSLIGLSTGAVRSADEVLPYGGKPQRFKAWEHDMSLREAIKASNVPVYQELARRIGLERMRANVSRLGYGNAEIGQVVDNFWLVGPLKISAMEQTHFLLRLAQGELPFPAPVQSTVRAMTLLESGPGWELHGKTGWCFDCTPELGWWVGWVKRNERLYGFALNIDMPGGEADIGKRVELGKASLKALGILP

SEQ ID NO: 18964 - protein, 505 aa, Pseudomonas aeruginosa
PVDVAGVLPGTPVSYQEMSGMDASRGKPLRFLMKSCENSRNGSRSEAGSTGHRQPSSSVFANRLVAGLQLRAQLAALLGLGEAALLLGGFQLQRADGHRLALVIQGDHGEETAVGMTHGLLADVLGDDLDADFHGSPPGVVDRSEEGHQFADMHRLAEDHLIHRQGHHVATGIATGACIGDFVEILQEGAAMDIAGEIGHVRSHQHGHRQLVVSGLHSAFSLIRTGGGHHRRKRRRQRPQIFNRHDRNRAGSCRHPRAFLDWPFSTGNRSNACRHTHPSPGPGRACRHRCRCHPGRGYALRHRRGMQHARHPGLSTGELSTGAGRLRLAIAPGRAPGAGRSRLGTGAEQSRADQPQGRATGTRPRLDEPGAGSRLQRQSHALQPGTGCPESRLSVPPGPRRALPALRRAGRMGKPADRTGEGRLPGELRPDAHRQSGETDGIWARGGRRAVRSAGGARRALPAAQRRPGRRLQPAGMAGRHRPASGGEPWRELPGLRRHGHRRRR

SEQ ID NO: 18965 - protein, 271 aa, Pseudomonas aeruginosa
SVFHVNFVITKMNDFSKWTGQVALISGAGSELGIGFAIARRLAREGVRLLITASSERIRQRAEELSACGHDVRAASADLTDEAQVQGLLDWAEAQWGRVDILVNNAGMAQLDSAEPFSAVEATSLRDWQLSLSRNLTSAFLLTRGLLPGMRERGYGRIVNVASTTGTRGSNPGEAAYSAAKAGLVGWSMGLALEVAKSGITVNSVAPGWIATASSTAEERQAALASPSGRAGRPEEVAAAVAFLASPEASFVNGELLVVDGGNCLIENKRS

SEQ ID NO: 18966 - protein, 236 aa, Pseudomonas aeruginosa
LLKVTSDFLYPVAVAVSAITTLLTPYLIRAADPLSQHLANAMPQRMARIFGHYGDWLRSIQPQGDRAVLAAMIRRILLQVGVNLALVIAIFLAGGYFADTLSAWMSQWVAYDGLHKALIWGGALLVSLAFLIAAYRKLKALSMLLAELGVKPEKAGRHTARVRRVISEIIPLLSLAGMMVLLAALSSSILPPGELLVVVVLVAGLVIAVLWRWLIRVHSRMQIALMETLDQEKGSH

SEQ ID NO: 18967 - protein, 540 aa, Pseudomonas aeruginosa
EPSDPGLPSNRRITTLRLFALACTWCRYRTLCPEGSADFRLSTLPVGGLPLGQDHPAPLPTQSPRGFPALARHLLSSHPIRRPRDVPVCCALISTSKTTTKRGNTMESANAISASAQPRTTSQRIKSIFSGSVGNLVEWYDWYVYAAFSLYFAKAFFPQGDMTAQLLNTAAIFAVGFLMRPIGGWLMGIYADRKGRKAALLASVLLMCFGSLIIALTPSYETIGVAAPILLVVARLLQGLSVGGEYGTSATYLSEMANKEQRGFFSSFQYVTLISGQLIALAVLIVLQQTLTVEQLESWGWRVPFFIGALCAVVAMFLRRGMEETESFSKKKEEPKESLLRTLLRHPKEVLTVVGLTMGGTLAFYTYTTYMQKYLVNTVGMSKTDSTMISAATLFLFMLLQPIVGALSDKIGRRPILIAFGVLGTVFTYPILSTLHSVDSWWGAFFLIMAALVIVSGYTSINAVVKAELFPTEIRALGVGLPYALTVSIFGGTAEYVALWFKSVGLESGFYWYVTACIACSLLVYVFMKDTQKHSKITTD

SEQ ID NO: 18968 - protein, 476 aa, Pseudomonas aeruginosa
LSLVLMAPTHSGPFYPQDGDLRVAVLLFGAATDSPTPADCWSTARHPDRSPRARNAGGVILRCPCVPRRITASGYSPCGSSFRRGWNLGAQTPISSRSHGGTAQGACRPQAAKPRLRDLPGIKNRARRRGSFRCQRTASAALLDLEEEHLGRLAGDNLATTDTRLETPLGHGLAHFTVEHARRHRLQHLDVVNAAIAGDGEQHLHPAFDTPGLGHPGIDRRIHAQRLDVTVVEAAAGQAGRTLRAAGRGLRAGRALPDGRCGRRRGGAGRAGLAGCLCARLGFRLGFGFRLRLGLGNGVFHRFGLGFRLGLGFFHRLRLRRLRLGFLDLRRRRLRRGSRRLRGRLGLLLELDEIHLHGLRQFAVAKVEFGRGRHHPHQRTDDRHMHRHRRAGGQPPARLGRLAGDVFGIAAMGVGDQHFLDRHFLVAARAGAVHHAQVGFSALGIHAWQGLAFVSLGGSSGVVFGERGQRKTVRRP

SEQ ID NO: 18969 - protein, 189 aa, Pseudomonas aeruginosa
PRTLQRNGRTGRRARTAQRCVASSVSDLFSSNMPAASSACSCASGSGWPEASAAASSTTTRGCRARTPDQGGACSCFHSASGCPNPEGSMNSRSGRARRNKRPSPTWNGTPLTQQRHPPATSPMATPSTSVASSAASRPISPNSLTSTAQRSPAGFCASSERIRLVLPAPRGPPIRCVGISRSICATGM

SEQ ID NO: 18970 - protein, 424 aa, Pseudomonas aeruginosa
RPREAPRPAPGDRHRTPGAATVFPAAVRSCGVPPVLEGVVQALPAGDAQVHLGVIQQAGVQGCAQGREVQVLTDENQLLATVADAFLPVPHDRPQALFVLWPLSGRHEAPPAARQAVAHQAAGLRPAAGLAGPAGEPEEALGAQQPPLLQRIVQEGVEARGVERPARPVGHGGDAIFLGFRQVLAAQFLQPARRGRRAIEIEATGIEDLRQRHLTHHHRQDLRLGIELAQDRQQFLALLAGDQVDLADQDHVGEFDLVDQQVGDRALILLTEGFATTGQAGGLLVVAEKIHPVDHRDHGIQSRHVGQAAVQLVAEGEGLGHRHRFGNPGGLDQQVVEAAFPGETADLFQQVFAQGAADTAVAHLHQPFFSAVQADIALDLAAIDIDFAHIVDDHRNPSVLAVLQHMVEQRALAGAEKAGQHGDR

SEQ ID NO: 18971 - protein, 163 aa, Pseudomonas aeruginosa
QLTPQSMARQSPSGYPGPTSSRDPPMRRVLRLYCLALLLLAPAAQAQGFLPGTRPAECAYLRTVLACMDRLGNHYSVATGGNDTWLRGYDAASGRRWAQTNTRYGRLTFFSGIASDGEIWVGLSRNIGWTSISRLSSSSGQRQRLTCGRVSGCSEGPSREAAR

SEQ ID NO: 18972 - protein, 148 aa, Pseudomonas aeruginosa
HSSHFQALPALLRVLHECLDASRYCPPDHHRRSSPGLGRHAGHRPPRADRRAEGRRRSRCRCQPGRPAGPRHPYVAPLPGAGRTGTGRARPFPPARRPATLPRQPRRPVASRLPAPAPRAAAAASGAGQPAERLETLSTGAGHAPGRR

SEQ ID NO: 18973 - protein, 350 aa, Pseudomonas aeruginosa
LPGRSPSRADLLLDLPLFGGTGPAIDPGALRPGLRRTAARSCQRARLARQQRRHRRHPAQPAQQRAPAHRPGGRLRRTAPGRAGGSRRKRPRHRGADCGETRRRAGLRPRQRAEPDVLRRRGAPAAPRPAGLSTGEPVLHTGRPCGKPACPRRRRRKPLAARCRMIRKNPSGDLPVIDESAYVDKTAIICGKVIIQANVFVGPYAVIRADEVDADGGMQPIVIGANSNIQDGVVIHSKSGAAVTIGEHSSIAHRSIVHGPCEVGDRVFIGFNSVLFNCRVGDGCVVRHNAVVDGCDLPAGFYVPSTERIGPRTDLASMPRVSVSASEFSEDVARTNVDLVRGYKSLQNEF

SEQ ID NO: 18974 - protein, 73 aa, Pseudomonas aeruginosa
WCRRRCCSWRPTRHRPGSSGGRPCCPRPGGHSSVRRSCRHGPERRARCPDAGGRTDRHRYPRPAPRLPGGCWP

SEQ ID NO: 18975 - protein, 471 aa, Pseudomonas aeruginosa
APVAGRTGLQFFGFLDRFFDTADHVERLLRQVIVVAVENALEASDGVLQGNVLARRTGEDFRYEERLGQEALDLTSARHQQLVGFGQFVHAQDRDDVLQLLVALQNILDAASGVVVILADHQRIELARGGVQRVDRGVDTQRGDVTGQYDGRVQVGEGGRRGRVGEVVRGNVYGLDRGDRAFLGGGDALLQNAHLFGQGRLIAHRGRHTAQQCGYFGTGEGVTVDVVDEQQNVTAFVTELLGHGQAGQCDAQTVARRLVHLAVYQGYLVQYVGVLHLVVEVVTLTSTLAHTREHGITAVLDGDVTDQFHHVDGLAHAGAAEQAYLAALGERADQVDHLDAGFQQLVAASLVGIGRSFAVDAPALFFADGTGFVDRVTQYVHDPAQGRFTDRHGDGSTSAVHVQATLEAFGGTHRNGTNHAVAQLLLDFQGGFNALNLQGFIDARHGIAREFHVDHGADDLNDTSATHVWFL

SEQ ID NO: 18976 - protein, 349 aa, Pseudomonas aeruginosa
ILNLFLHRGSAADDFRDFLGDRRLTRLVVDQLQIADQLAGVVGSVLHCNHPGRLLTGVVLNHGLVHLGFHVTHQQPVEERLGVGFVEIVPVVLQLLIVIGHQRNQLFHGRLLGHGVDELVGDHEQAIDTAFEVCVEHHLDTADQVVDRRLFAEVADSCHDVAAETAEERSALATDHAKVDFRPLLAVAAHVLDEGLEQVDVQTAAQTTVTAHHDVADALDFTLDHERVTVFRVGVGQMADHLANTLRVGTAGRHAHLCLAHLAHRHFFHGIGDLLRAFDARNLAANLFCACHLTPIGLAGGSLAAPAAAYQVWVALNFSMPALMPASISSLKSPFSLIFASRAACSRWK

SEQ ID NO: 18977 - protein, 175 aa, Pseudomonas aeruginosa
MRTIPSDTLTMVPSFRAWEATSSFSMRPLMISLISEGLSCCMPLPLQTQDFNASASFASLPRTEPSITKSPARMITPPIRLASSDACSRTSRLSRALRALASLSCCSLLKVKALVTSTSTDFSCSAFNCSYISAMVGSSSSRLFSATVRTKFWAGAFSLSPHTSIRLWALAEEVS

SEQ ID NO: 18978 - protein, 199 aa, Pseudomonas aeruginosa
GALPGGVLPHLQCPSRRRPAGDPHQRPLSEGNRRPGRAAEIPLRLGPDGGRRAAGTGNPGGDPDEEGRAGEDRAAARCGLLHRPAHPFQRARTGRCAEAGDRPLALHGPADHHRADSRVAEGPVGPSGQAGQHRQHPAHRRRVLQDQDIRSVVQAAFALGGAPAPGGHGALQGADQPQPAGDRRGLRRSGSHHGVARLS

SEQ ID NO: 18979 - protein, 133 aa, Pseudomonas aeruginosa
PEQLHRGRRPGEEVQDRHHRRRCPRRPHRDHLGEGTGPEVQLADQGQAGLLRGEDCGGTGDGQVLRRLPAGESQRSQGRGRQDDRRRPCPRGRAQGARDDPPQGRAGHRRPARQAGRLPGKGPGALRTVHRGG

SEQ ID NO: 18980 - protein, 332 aa, Pseudomonas aeruginosa
FFLLQLLLASSPTCSKFCRGEIANRAVRSVFVVIPPPGHDADSRFGQRTEPVLIEAFVPELTVERLDEGILRGLTRLNQLQLDVALIGPLIECLAGELGPLVGADRFRVAAKPRHLVQRPCDAKAADTVLHQDADRLLGEVIDHRQAFDPPPGAQCIEDEVHRPDLVWCARQTQTFALHRDAMAAAPPFHHQAGSAVQAIDPLVVDLHASTPQQEVQAAIAKAPALLGQFHQLGLQLGVLHTGSRLVAQHRAGQPDQLTGTTLGDAGSRLHLLHRLPPCCRAYPFPRATTFSDSMSRWASASNFFNRLFSSSRSFNRLASATVIPPNFARQV

SEQ ID NO: 18981 - protein, 607 aa, Pseudomonas aeruginosa
CSKRLSHASTADRPCFHHRWSGHDDGEFRGVCPFPRTVTVKRLKKTLHLSSLSLASLALSSAALAAAPVMLDQGKEWTESHRQDFYSRDQGSQVMPLPWLKALRQPDGTPFLADSLARYGYLPNPKAPAEGLPVGFTVAGTGARQMVGMTCSACHTRQIEVKGTAYRIDGGPAIVDFQAFLADLDRAVGPLTSDDAAFDAFAKQILGANPPPGARDALLAAVKEWYEPYHTLIERALPKDTWGPARLDAVSMIFNRLTGLDIGTAPPYLIPDNIKAADAPVRYPFLWNAARQNKTQWPGFAANGNDLLGLARNVGEVYGVFATFHPQKSKFHLLGMDYLKINSANFHGLGKLEDLIKKIGPPKWPWAVDKHLARKGALIFARKTDEGGCVECHGIRIKDLVLWDTPLRDVGSDSRQHAILDGQVQTGVMEGARMPFGQPLKATDGAFDVLAVAVAGSILQHFVPILGEKHDAKAAAVKPESVMTDETRQLLTAFQKPLRTQADPYPYESRVLQGIWAAAPYLHNGSVPTLEELLKPAAERVESFPVGSAYDVDKVGLAAQQTQFGSYVLKTTGCEQRDSGNSRCGHEYGTSLSAEEKRALLEYLKVL

SEQ ID NO: 18982 - protein, 159 aa, Pseudomonas aeruginosa
AARPETRWAFSNTVPSWAWNTTLRRRSLKLSSGCFLSCLKKNSASVRRGRTTFSLPLTMFSGALLSTLATVMKRGSSLPLASSRQKYFWLSCMVVIRASCGTSRKRSSKEQTSGTGHSTSAVTSSSRLGGTMALPCCSAASSATRLAISSRRSAKSAST

SEQ ID NO: 18983 - protein, 160 aa, Pseudomonas aeruginosa
APRRSSRYAAGLEIRTLSGLWKRWPRDSRPAFWARISHSTTSSPNSITSHWVGRTNSSRRAAQRIRLGIGSSFNEASTMPGSRPAAGWPAMVWLKRSFGPLLSICCRSTPHFLAKPRAAWVGLPLASKAACSGGPSRLTVRSGCCTASCSTSTARRRGAA

SEQ ID NO: 18984 - protein, 139 aa, Pseudomonas aeruginosa
LPCRSARFPNPGPRRRGSATPSCPRRSGCRGPAGRCRWLSASRGTAPGSSPGSASGPPETGSSAAGGWGSRRSDRRWGGGSAGRRRRSRSPGRWRGGRWRCGRCRRPLPCRRAAAPRSPALPSSSAGRESGLGRCARRA

SEQ ID NO: 18985 - protein, 221 aa, Pseudomonas aeruginosa
SGSRNSPVLRLRYKTRKYTRFPRRLARPPDPWKTTESLMPRCFWCNDDPLYMAYHDEEWGVPQRDPDALFELLLLEGFQAGLSWITVLKKRERYREVLFGFDVQRVAQMSDAEIDELMLDPGIIRNRAKLNAARQNAQAWLELDDPAGFLWSFVGGQPKINHFAGRAEVPAITPEAEAMSKALRKAGFNFVGPTICYAFMQASGMVMDHTQDCDRYAQLVG

SEQ ID NO: 18986 - protein, 128 aa, Pseudomonas aeruginosa
PGRSGVLPEHNRAREACQGYPCDEGVELQQRGETTERRFLEQHRDHVGGDQRRDHDPGDDQPGRALAQQAHGEVGSQEDERKAEGAPGGVPAKQGDRQLHQVVAGDDDEDVEGDQAGQGAAPGRRRRG

SEQ ID NO: 18987 - protein, 349 aa, Pseudomonas aeruginosa
GFPWFSRDRGDGRGGAGIGYTSAFCIEASAQVNFVSQTTPAVRTFQDLILALQNYWAEQGCVVLQPYDMEVGAGTFHTATFLRAIGPETWNAAYVQPSRRPTDGRYGENPNRLQHYYQFQVVLKPNPENFQELYLGSLKAIGIDPLVHDIRFVEDNWESPTLGAWGLGWEIWLNGMEVTQFTYFQQVGGIECYPVTGEITYGLERLAMYLQGVDSVYDLVWTDGPFGKVTYGDVFHQNEVEQSTFNFEHANVPKLFELFDFYESEANRLIALELPLPTYEMVLKASHTFNLLDARRAISVTERQRYILRVRTLARAVAQSYLQARARLGFPMATPELRDEVLAKLKEAE

SEQ ID NO: 18988 - protein, 184 aa, Pseudomonas aeruginosa
WSMSTTQRCAPTAMRCWPSCAGRSSGWRTSRCSAEPVPPRRKGPASSRHRAFFTTGPSDTPAAHASPRPTGWCRTHGRSGCCRNHAARSRWSSAHSCRIGSAGRRGRPCPRRRPSPPGRIPPAPRPASATLPGSAPSRCAGTAPPPRSPAGPATRRGRGRPGYAAASGRRSAVAGFRRSSRFPA

SEQ ID NO: 18989 - protein, 946 aa, Pseudomonas aeruginosa
PMKPLKLSHVPGCWVSQTLPSGQGERRGIVKMAIAKEAEDQLQVHWFSPEKKLAYVDASAVRSGFQNGMDVVDETPGSGVRSLGQGVIMQQRTLAGSEQVLVDFPERGERHWLPYQYLRQVKGVKHRFVTASKGEAVDAERMRLRMLAHAIKVWNENTGALSHLEIEPLPHQIHLVHHIIASGNYNWLIADDVGLGKTIETGMLLHALRQRDLIKRILLVTPAGLTKQWQEELYHKFKIEDFEIYGEDFFINEPRQWKMHDCVIGSMDRLKQEGHLESLLQAEPWDLVIFDEGHRLSRRQYGQKLDSSERYDLAKSLRSQTEHMLLLSATPHQGMQDKFVALLELLRPERRTDLMALNIKPEILHDMVFRNHKADVTDAEGNFIFQGKITSALQVPSSKESIEFDKTLQDYLRKGYDAGEALGRTGNAIGFVMTVYRKLAASSAAAIHRALCNRLQRLLDDEANGLSDEEPRDQRYLGEWEEQFTSDAREFFAGEVQLLKDLIAEAAALKANDLKLKLFIEDIIGKIHAANADEKVLIFTEYRTTQNYLREALADHYGSDQVELINGSMQHAERREAIKRFEEQGGFLISTEAGGEGINLQSKCHVMVNYDLPWNPMRLVQRIGRLYRYGQKKKVVVFNIQQTDSLDQNIVDLMYERIDSVVTDLAEIQRHEFNEGLKDEILGQLAELIDVEDILQEATKLGIDRTRERIDEALKQARTAAAKQRELFAHAATSDPNELRDELEITVDHLYSFVLGMFDQLGIEVAERSHKERLLRIRLSEQVMRDMGLSPKASRRMDVTLDRMLAANRPDTHMLDLNSKLMQYLLGKACEYDFGGLAAMLKAPELEEGALLGAMLRWQGPQGKRMRQEFVAIQVNDGKAKLNPAKASQWLLTPAEHSPQSPDTDTSKLLFKVAEEMANQRLANASNRYLIPENLDWASAGWTHIH

SEQ ID NO: 18990 - protein, 689 aa, Pseudomonas aeruginosa
LWPKWQITLPAYNLSHVQVRHRQRVAFDEVAARLHGIAHQGVEDLVGGDGVLDGHLEHAPDVRIHGGFPQLLRVHLAQPLVSLDAVALGTFGHQPVQAVLEGADRALALTLLHVGAVFQQAVQLVAEQRHRAVVIAGEEVTVEGDVAGQAVGHQFHLGQPEVALAVFAQAGLVGQARLLGGGQARLELLQPALHGRLVSQVVHRHGRQVDEVLGQLLGVQARQALEGGDHPAILVDQFLQRCPGQARSVLVDVQAGVFQGRLGHVLFHGLVVLDVLLLLAALDLVQRGLGDVDVATLDQLGHLAEEEGQQQGADVRTVDVSIGHDDDVVVAQLVDVVLLAADATAQGGDQRTDLLGGEHLVEACLLDVEDLALERQDRLGPAITALLGGTARGVTLHDVQFGERRVLFLAIGQLAGQAGDVQRALAAGHLARLARGLAGTGGVDHLADHGLGFVGILQQEVGEVLAHLLFHRSLHLGGDQLVLGLRAELRVRYLHRDDRGEAFAGIVAGGGDLELLRQAFGLDVVVQVTRQRRTETGQVGAAVTLRDVVGEAEQVLVEAVVPLQGDFHTHAVLFTLDVEVEYLVHRGLVGVQVLDEGLQTAFVLEQLLLAGTLVAQQDADAGVEEGQLADALGQDVPTEVDVAEGLRGRLEVNFGAGAIGLAHFAQWELRNAVVVDLFPDLVVATDGQA

SEQ ID NO: 18991 - protein, 139 aa, Pseudomonas aeruginosa
FMGQRVHHRDAHTVQAAGHLVGVVVELAAGVEDGHDHFRRRNPFFLVDIHRNTASIVADSDRLIRMDGDADFAAVTGQRFVDGVIHHLEHHVVQTGAIVGVADVHAGALAYGIQPLQHLDAGRVVRVVLAHASLPMVVV

SEQ ID NO: 18992 - protein, 146 aa, Pseudomonas aeruginosa
RTSCWAMAKLVRSIRRRSLLWAMLKFSEPGPSSTVGKSLAGRVDRVKRLRPAFTRSFCSSTRMSISTSFGRLLQMSISLRAGTVISPGSAASSSTTRPTSSTSRSVPVSDSCWPSTTSRTLERTGNVWRRSTTPATSCSGFNRASR

SEQ ID NO: 18993 - protein, 445 aa, Pseudomonas aeruginosa
SLASWAASGCQGTQQVLVVLADIRVGFPKLSDLTTGVQHRGVIPTAEGHADLRQAVVGQLLGERHGHLARARHRARTPLGQQIGYLDLVVLGDGALDVVDADQLVLKGQQVLQRLANQLDGDRPAHEVRVGDHPLQRTFQFAHVGTDALGDEEGRIVRQLDLRLLGLLHQDRHPGFQFRRLDGHRQAPAEAGFQPLFQAFDFLRIAVAGEDHLLAAFEKGIEGVEELLLGALLTGEELDVVDQQCVHRAVEALEFVDGVELQGLHHVRDETFRMQVDHLGVRVLLQQVVAHRMHQVGLAQTDATVEEQRVVAVLEVVRHLPGGGAGQLVGLALDEVLEGEGTVEIAGVLQRAFDLDVALGAYRRCGSGRHSGGQRIDAGLFRLVGVARHAGSRRHWRQLFTWHHHGRGRYRLHWRRRRSNRRRGSHVGLRWDDGGARRTATLAAY

SEQ ID NO: 18994 - protein, 72 aa, Pseudomonas aeruginosa
PARSISLESPVSLNGVTATSSRQPRYRIMKRTFQPSTLKRARVHGFRARMATKNGRQVLSRRRAKGRKRLTV

SEQ ID NO: 18995 - protein, 595 aa, Pseudomonas aeruginosa
RLSRKLSTTRRPLEGRLAIRRYPHASRHRNHRRDRYRPGPRRRGNRPRLRTSRRTDGRGRERTPAESPACALRTVPRCRWAGDRRRPVTVFPRPELVHRRRRTRTAGARRPRGTRPAGAALSGTGRPPGATGRVQRARVPQRQARPGPGRSHRRSDRGQLGAGRAQCITFPAGRILTPGTCIDRATDFPAHLCRSRHRLPRGRNRLPRRWPCTGASGKSTHRIIHSAARSFPRRPAARRHDRGHRRTTECRQVQPAECPGRSRGGHRHGHSRHHPRCTARTYPHRWHAPACGGHRRPAGYRGPCGKDRRGTCAESHRRSRSRAAGGGRHRPGSSGPVFPMAGVSRPATGTGQGHPDPQQGGFVHRVHWPRGKRGRPRHHHPLGAHRRRPGAAARTPEGLHGLRTDRGKRFQRPPAPLGSATPGRAGAGAWPQPTYPQWRRRTAGRGSAPGPAAPGRNHRRIHPRRPAGSHLLEFLHRQVMGLGPRRVVDNQGKVRCVLSFHCAPCRRHSTTQAWIAGAPLRPRENHLRRCRSAWDGYPPGRGLCTGTALRSGVREGAALWSISICSPLSNGVSIPLSRLALSPRAGTFRARKSTR

SEQ ID NO: 18996 - protein, 649 aa, Pseudomonas aeruginosa
ILILSGFPEFLLLNRPRCVVDFPTRFDVIVIGGGHAGTEAALAAARMGVKTLLLTHNVETLGQMSCNPAIGGIGKSHLVKEIDALGGAMAEATDKGGIQFRILNSRKGPAVRATRAQADRVLYKAAIRHTLENQPNLWIFQQACDDLIVEQDQVRGVVTQMGLRFHADNVVLTTGTFLGGLIHIGLENYSGGRAGDPPSIALARRLRELPLRVGRLKTGTPPRIDGRSVDFSVMTEQPGDTPIPVMSFLGSKEQHPEQVSCWITHTNARTHEIIAANLDRSPMYSGVIEGIGPRYCPSIEDKIHRFADKESHQVFLEPEGLTTHELYPNGISTSLPFDVQLQIVRSIRGMENAHIVRPGYAIEYDFFDPRDLRYSLETKVIGGLFFAGQINGTTGYEEAGAQGLLAGANAALRSQGKDSWCPRRDEAYIGVLVDDLITLGTQEPYRMFTSRAEYRLILREDNADLRLTEKGRELGLVDDRRWAAFEAKREGIEREEQRLKSTWVRPNTPQGDAIAERFGTPLTHEYNLLNLLSRPEIDYAGLVEITGNAVDNPQVAEQVEIRTKYAGYIDRQQEEISRLRASEDTRLPVDIDYLGISGLSKEIQNKLNQARPETLGQASRIPGVTPAAISLLLIHLKKRASGRQLEQSA

SEQ ID NO: 18997 - protein, 70 aa, Pseudomonas aeruginosa
PTMSPRSCRSISATPSYSTVIPRNVRLAEAPSFGMPALVYDKQSRGAIAYLALAGELVRRQRAKGRAATA

SEQ ID NO: 18998 - protein, 293 aa, Pseudomonas aeruginosa
GTRMAAKKRGLGRGLDALLGGSSPAKLQEEAVQADRRELQQIPLDLMQRGKYQPRRDMDPQALEELAQSIKAQGVMQPIVVRPIANGRYEIIAGERRWRASQQAGLEKIPALVRDVPDEAAIAMALIENIQREDLNPIEEAAALQRLQQEFQLTQQQVAEAVGKSRATITNLLRLIGLPEEIKTLLSHGDLEMGHARALLGLPAERQVEGARHVVAHGLTVRQTEALVRQWTHAPGKPAGPVKSDPDIARLEQRLAERLGASVQIRHGQKGKGQLVIRYSSLDELQGVLAHIR

SEQ ID NO: 18999 - protein, 115 aa, Pseudomonas aeruginosa
PSSTCRWRTKTTINRFASTFNQHDKKSGGKMETVVGLTAIAVALLIGLGALGTAIGFGLLGGKFLEGAARQPEMVPMLQVKMFIVAGLLDAVTMIGVGIALFFTFANPFVGQIAG

SEQ ID NO: 19000 - protein, 165 aa, Pseudomonas aeruginosa
RTTNERGVGVNINATLIGQSVAFFIFVLFCMKFVWPPVIAALQERQKKIADGLDAANRAARDLELAHEKAGQQLREAKAQAAEIVEQAKKRANQIVDEARDQARTEGERLKAQAQAEIEQELNSVKDALRAQVGALAVTGAEKILGASIDANAHEQLVSKLAAEI

SEQ ID NO: 19001 - protein, 144 aa, Pseudomonas aeruginosa
GKRMAITVHCDIVSAEAEIFSGLVEMVIAHGALGDLGIAPGHAPLITDLKPGPIRLVKQGGEQEVYYISGGFLEVQPNMVKVLADTVVRAGDLDEAAAQEALKAAEKALQGKGAEFDYSAAAARLAEAAAQLRTVQQLRKKFGG

SEQ ID NO: 19002 - protein, 462 aa, Pseudomonas aeruginosa
PPGTVVQSMSLEIVILAAGQGTRMRSALPKVLHPIAGKPMLGHVIDCARQLQPERIHVVIGHGADLVRERMAADDLNFVLQAEQLGTGHAVAQALPFLSADQVLILYGDVPLIQLDTLQRLLAQVTPDQLSLLTVDMLDPTGYGRIVRDDQGAVQAIVEHKDATPAQRQIGEINTGILAVPGKRLADWLGRLSNDNAQGEYYLTDVIAMAVGDGLVVASAQPLDAMEVQGVNDRMQQAQLERHYQRLRAEELMRQGVTLLDPQRLDVRGEISVGRDVLIDVNVVLEGRVVIEDDVRIGPNCVIRDSVLRRGAVIKANSHLEGAELGEGSDAGPFARLRPGSVLGARAHVGNFVELKNARLGEGSKAGHLSYLGDAELGANCNIGAGTITCNYDGANKFRTELGDDVFIGSNNSLVAPLKIGDGATTAAGSTITHEVPAKNLAFGRARQKNLENWKRPEKIKK

SEQ ID NO: 19003 - protein, 129 aa, Pseudomonas aeruginosa
PPSLSKASSASSIAATTAPAWRSSITKAGCSAAAGSARSPAWRKAWPVRRCSAAWASPIPAGRPTARQPKATPTRISPATNWRWCTTASSRTTNLSVSGSRGWATCSPRRPTPRSSSTCCTTSCSPSAT

SEQ ID NO: 19004 - protein, 168 aa, Pseudomonas aeruginosa
RWRSTSPERSRPATPVPFQAPLAISGLRMLHCLHQPSAWPSARGTTACTGRRWRAIRKTSTQPHETNRKGAAQPKKSERRPASAGPAAMPRVMPSITWPMAPACLCGATTSATRAKVVGMMIAEAMPPITRRTTAISRVGAMTMARVSTAKRTRASSSSFLRCMRSEK

SEQ ID NO: 19005 - protein, 145 aa, Pseudomonas aeruginosa
PRSPIPASMRWARPTSRSVSTSKDRSARSSVSAMPSAKRSANPMAARRRFAKATTRTQTPKPSITTTTCPTTSTSSGWIRKWSIPALISRPARKTSPPRNWPSSVTCAASCVCSRARSCSMSVAVGEGWRAWPLASSASRSPASH

SEQ ID NO: 19006 - protein, 347 aa, Pseudomonas aeruginosa
SARSPARSKEAGTLPRQRDNNDKNRRLPMSLSRRFGLFTLAATVTFSTSVFAAPTFINILTGGTSGVYYPIGVGLSQIYGHDIQGAKTSVQATKASVENLNLLQAGRGELALALGDSVADAWNGVADAGFKAPLKKLRAIGNTYPNYIQVVASQASGIKTLADLKGKRISVGAPKSGTELNARAIFKAAGLSYEDMGKVEYLPYAESVELIKNRQLDATLQSSGLGMAAIRDLASTMPITFVAIPADVVAKIDSPAYHAASIPAGTYDGQEQDVPTVAIDNILVSHSGVSDELAYQMTKLMFDNLPRLVTAHAAAKDIALDKAAKNLPIPLHPGAERFYKEKGVLPE

SEQ ID NO: 19007 - protein, 460 aa, Pseudomonas aeruginosa
APGGRTLGVSDTGPERLNVLWITLRRQSTSIKTTKPELLPVIRKTSMRSCISVFRPALLALFVSASGSAGADAAVENPRIGRAADLYELIPEYQPDTYRNMDKVYPTRVIHKGTKVRPLPAGVAIAPRYRIGGEEYGVDDFMRRNRVGGVLVLKDGKVALERYGLGNDERTRWTSFSVVKSISSTLVGAAVQQGLLALDQPVDKYLPSLAGSAYQGVTVEQVLQMSSGVRWNETYRDPKSDRRQMFDAQLAERPGGILRLLASLPRQYPSGTHFTYSTGESHLQSELLHAATRIPVSDYLSERIWARMGMESDGFWQLESPAGQEIGSSGLSATLRDYGRFGQFVLENGVIDGERILPEGWVDRASRVEASSHLAPGKLYDGEYALGYGYQWWTFPVGAKALPEHDGGAFEAQGIFGQYLYINRKEKIVAVVWSAWPKPEMDDREEETYAFLGAAVKALR

SEQ ID NO: 19008 - protein, 407 aa, Pseudomonas aeruginosa
CRPLQSGISSMKRRRLLQSLLAGLALQPFLAASANVRIRQARAWNSSESWRLVLELDGPPRYRTFSLQAPERLILDLPDAQLLATLSELPLDGPVRAIRSGQLGGGGTRIVLDLRQAVRPRSFALEPQAGKGHRLVLDLYPQALAAPPEPMLALARPLPSTGRDILVVVDAGHGGKDPGAVGSKGEREKDVALAIARLLARRIDREKGFKARLVRNGDVFVPLRKRPEVARRYNADMFVSVHADAAPRLTASGASVYALSEHGASSTMARWMAERENGADLIGNSGNLPLQGRDKVLAGVILDMALSSTIASSLDLGHSVLGQLSDVTALHQKRVEQAGFAVLKSPDIPSILVETGFISNRGDCRRLMDERHRQRLAEAIFAGVQGYFRQRPPAGSYLAALSAQPPG

SEQ ID NO: 19009 - protein, 198 aa, Pseudomonas aeruginosa
PNRNCLPSPTLPTWTKPSRTSSATCCCVSARNFRRASKANSASCAISNAPATRPTWLPARNSGNGNFACWSGRRSCSTRSTKRWSAWPAATTAGARKPASRSACAACCCVPPPPSASRRKSARRSANATCGTTEEVTNREPTPTCHRAVRLSRRRQEHAAQPCAEEPREPTGCGDRQRYERNQYRWQRGPARCQPEPR

SEQ ID NO: 19010 - protein, 237 aa, Pseudomonas aeruginosa
RRDEPGHPRLAGPGRPLRGLGARRMSALPQEKPLPRQAFDDDPQVLAEVLREGVNLAVWTRRLSPALRDFAAALVRNRPGLALSQTLEMEEERLPVLDGLLDAQQLPGQTDFLDDLGWLVEAFSCLTGARRIGLRLRVLDKPMCPRFHVDHVPLRLVTTYQGAASEWLDESGLDRRLLGGAQAEVVDEQLIHSLSTGDVALLKGERWEGNEGAGLVHRSPRAEPGLARLLLTLDWLA

SEQ ID NO: 19011 - protein, 243 aa, Pseudomonas aeruginosa
PFFAGRARRRPPHCSRPGRRKRVPAMRECPARRTQPARGGLLRRAPRRGSGGRGSADPLRPWQRSRRRPRRAAQVALVVVLRRGGGDACGDHRCAGVGDADPGRTQPWPRRTAEDHAGEFRPAREEGRADPAAAGCRAGADAAEDRGTQAGAAEAEAGGKTQAQAETQAQTGGKRHSQGQAEAGTQTQAGTRAEHRGIQPAQPVQRRPAAARTYRRAEHARRADRAQRLARSGRPAQRQPQRQ

SEQ ID NO: 19012 - protein, 438 aa, Pseudomonas aeruginosa
PRTTGWRRRWKRIVTTPATSMITARSWMKSTACMAAVLARGMGRQTRRPGGLADPQTSIRKCLIGGLKKTVTDVSARLCVVLPGSPGGSSRADPRACLSSPATKVYPGADPRARRGGRKNGGRGAIARNKIRLVLSPVPPQHGARRFPQERKTTMQRVLSIALAFCLALTVSLDANAKRFGGGKSLGSAPSHQTRQAQPATAPNATAAAPNAARPAAAASGASRWLGPLAGIAAGGLLASMFMGDGFEGIQMLDILLIALVAFIAFRFIAARRRQQNQGQPAMAGHAPMQREMPAQAPIFGGAAAAAAAPSPVINAPSWFNEERFVGAAREHFMSLQQHWDANEMDKIAEFVTPQMLQWLKQERAEIGDAYQSTYIDNLVVQLDGVDDQADKTIATLTFSGVSKTSRFDQGEAFSESWRMERAQGENQPWLVAGIRQN

SEQ ID NO: 19013 - protein, 90 aa, Pseudomonas aeruginosa
SSTRPTPSPQVLAAVPAPGSSSRTSSPSASRSPAAYRARCMVAARRWPAPCNWPGHVPASRAKATATAAWVPRCRPTPWRCAVCAPTWKR

SEQ ID NO: 19014 - protein, 491 aa, Pseudomonas aeruginosa
PCVARTLAKKMSTACSPASTRRSASCSPYPARGRPEMHFADPREAREFLAAHPEVRSIELFLIDANGVPRGKLLHRDELLAVYESGRPLPSTILGLTINGDDVEETGLVWDVGDADCWTFPLPGSLTLQPWRQSPTGQVQVSMHPELGLPAAAGDPRHVLQRVIHSLQAEGFHPVMAVELEFYLLDRERDSDGRPLPALQMNGQRPRATQVYGVYELEQLQPFLDDLYAACEAQGLPARTAISEYAPGQVEITLQHRFDTLQAIDEGVRYKRLVKGVANRHGLQACFMAKPFADLSGSGLHLHVSLADAAGNNLFASEDPAGTPLLRQAIGGMKACLLESLALFCPNANSFRRFQANSYAPLAPTWGINNRTVSLRVPGGPASSRHIEHRICGADANPYLAAAALLAAVRLGIRERLDPGAPITGNGYAQATQALPSDWLTALRALEGSAWAREALGEDFLKIYLAIKQAEYRAFMGEVGEQDWRWYLNQA

SEQ ID NO: 19015 - protein, 483 aa, Pseudomonas aeruginosa
LPYPDVEDSRPYRTSRRPGECRGRLARGACGKLHRGGFRPGPGSQPQGLLLHVPGRDSLPEGKPGQHRQHLQRLRTPGLPGFGGVLREQGGADHAEQDPGAGTGRAGRAGQRRVAGGYRHADARLPGRTLWDGQSGWLQARAAEGLSTGQGGTLHPPGRSRRAGLVSLRPSGRSDHGCRPGGGLRPVRWPLSGFSTGRSAGAACGKVSVVPGLTGYLHPVTGGGDAHAAVTLAVPAKALHHSQVDAFLPYQQAAAGAQAFAAQPVERALPLQPTGQLADRRGPIFHQFLRIADAHQGEARLVAALHRFDLQAFPFGLPGVAQVVPGEALEGRIVDFQGNLFQVVARGFAAVAAIQRQVHPGAGASRLPGLEAGQREIVQRLFRVGSALLLALGQAQLPGEGVQRLWITPLSISLGAARVAFRGGGAGRILGLDGSGTDAGKHGQGQEKDAYGGRHWSDSRWKRASLEKPADVCTTRRDFDHDD

SEQ ID NO: 19016 - protein, 671 aa, Pseudomonas aeruginosa
ENAEVCLCWRPFLTFLDKKPACLVKLQQRQRVNLSVSRRVSPGTIAAVGSLECHGPVALPGSVGGKPFRLSALPSRARVRDPFRTSSSAGQAAEDAFPVLPGVLMHHTPLLTTLAAGFVLAFLFGALANRLRISPLVGYLLAGVLAGPFTPGYVADQALSQEIAELGVILLMFGVGLHFSLKDLLSVKAIAIPGALVQIGVATLLGIGLAKLLGWSFGGGLVFGLSLSVASTVVLLRALEQRQLLDTKRGRIAIGWLIVEDLAMVLTLVLLPALAGTLGGKTDGGDAGLLWPLLITLGKVAAFVALMIFGGRRVVPWVLERIAASGSRELFTLAVLAIALGIAYGSAVLFGVSFALGAFFAGMILNESELSHEAAENSLPLRDAFAVLFFVSVGMLFNPMILLQEPLTVLATFLVIVFGKSVAAYLIVRAFGHPNSTALVIAASLAQIGEFSFILIGLGIGLELVPEQSRDLVLAGAILSILVNPLLFIAIDRLQQRKEQRLAEAAGGVREMPAQDLPPPILEREHAVLIGHGRVGGLVSARLRTAGTPFVVVVDKRDKADELREQGYSVVLGNAASPGVLELANIAEARWLLIAIPNGFEAGQIASHARAVNPPLDIVARAHFDAEVDYLEQNGANLVIMGEREIACGMVHRLGLDRDERGADAPLPQSA

SEQ ID NO: 19017 - protein, 217 aa, Pseudomonas aeruginosa
RHERPGDLRRRRSDDPRSGAAMAGAVRLRGAPVPARRGMPGSVGQVLRRGGHQRCAHARHGRPATARQPAGGRSRPAGDHGHRARRRADGGGGHAPGCLRLHRETLHARAPARQFAARAGKAPPGAGEPAPEGAGQSQGPGRCASARRVQADGSVAPAGSGPGADPGERPDPWRDRQRQGTGCPLPARLRAARRQAVRGAELRGDSRATVRERAVRS

SEQ ID NO: 19018 - protein, 283 aa, Pseudomonas aeruginosa
ERCVHRRAGQAHRQARACPWRHPVPRRDRKHAVGAAGQAAARPAGAATGAARLEPEYPRRPAGDCRDQARPAGRSTCRTLPRGPGVSPERRRAAPAADPRASRGHPAALRTFRQRCQPAPRPRAAARRAGGTGAADGPRLAGQCTRAGQRRRASCPRPGAWGRRGRRRPHLGAGGTHGSLRGGVPAPGARPVPRGYQGGDGVAATAAPDTQRKDAAAWPQPQRFRRRRAGLNQPSRGVRDPSPTPLVPGARRVAATPGRPAPPRSRPVRATVRRGSCCTARRR

SEQ ID NO: 19019 - protein, 235 aa, Pseudomonas aeruginosa
PGVPAAGGSQVAPAEGGDALQDGLGVADPAVALDRFQAGLVAFRGMGGAGILDQGDQVTAVGGIAHGHVHALVGDHPADDQVAGAEVAQYVVDGGGVENAGRSLRQHDLVGGRLQGVDHPGVRAALGQVHLRQLVIQRAVATIGGEALDDGVQDVLVHCAHGPEQALLVGDHLVLHALVEVTGCLRIDVRVAPRLDPGTLHVDEQDGGLPAAEWQVARRVVGQAEHRVIPPEYDC

SEQ ID NO: 19020 - protein, 172 aa, Pseudomonas aeruginosa
PRRSGFWAWPASLLAREVHHQLVAHGLQNLDEDQQHHHRDHHHVGLEALIAEADRQVAQPAGADHSGHRGVRDQGDGGDGDGGDDARPGFRQQGVPDDLPGAGAHRLGCLDDALVDLAQRGFHQAREERRGAHHQRRDGPGDAQRGTGDQYGQRDHHDQQDDERQRTEDVHH

SEQ ID NO: 19021 - protein, 242 aa, Pseudomonas aeruginosa
RSSSSTRSASNTKRRVVGCCGWRKTSATSPCSTMAPPSMTATWSQTRRITSISWVMRTMVSFSSRLISASSCRTEAVVCGSRALVASSQSRMLGRQARARAMPTRCFCPPESWAGYLRAWSDRPTRASSSETRASTSARLKPPARRRGMAMLSATVFEDSRLKCWKIIPTRWRKRRRPSASRAVTSSPSTRMRPPLGSSRRLIRRSRVLLPAPEWPIRPKICPAWMFRRVGCKAGISRPATR

SEQ ID NO: 19022 - protein, 304 aa, Pseudomonas aeruginosa
PAAPPPGRTAGERRTTSFLRVLVWSKNRQILHRAAGQDKTQQEQAGGADHDRGAGGGILEPGQGQAGAHRDQSQQAGADRHLLGTAGMALGGGGGNDQQRGDQQYADDLHRHGDDDGDQQHQRQADRSDRQAFHLRQFLVHGDRQQRPPEEADQCQDQRAAGDYPQQVAGAYRQQIAEQVSHQVDPHFLHEAQGDQAQRQGAVGEDAQQGVGGQRLALLQGHQQHCEQHAADGHSQGRADIEEETQGYPEQCGVGQGIAEIGHPPPDHEGAQGASHQGQGEAGEEGVEQEVSHGCSRGRACGQE

SEQ ID NO: 19023 - protein, 512 aa, Pseudomonas aeruginosa
RTRRPGSAAPARCPSGVLLVPAGAAEADHLDGLAFNGEADAVRSGDDGPADIRLFQLDRGVAGAADEELALVAVLRVVAADERVERGDAVHQAVLLEEVQRAVDGRRRGAAAVGFAEHREDIVGPQRLVALPDQLQHAPPQFGQAYALARAQRIGLGQRGADALAVVMGLAGQRGLGRNLVHGLRRSRVETLLYYPLTTFHVSAAVTLRPFALLSACFALFLLASPARAEVSVLTSIKPLQLVAAAIQDGVGQPDVLLPPGASPHQYALRPSDVRRLREVQLFYWIGPDLENFLPKVLAGRQGASVAVQDLPGMHLRKFVNFEEEEHAGHDEHDHDHRPGMLDAHLWLLPANARTIAARMAEDLAQVDPANAGRYRANLKAFEERLGGLDGKLRERLGKLAGKPFFVFHEAFDYFEEAYGLRHTGVFAVSAEVQPGARHVAAMRAQLKAAGPACIFSEPPLRPRLADTLSEGLPVRLAELDDLGVNVSVDANGYENLLNNLAGEFAGCLEKL

SEQ ID NO: 19024 - protein, 335 aa, Pseudomonas aeruginosa
VQHPAPARRLRFRCRCLHQRAAVVHGHLRQDVLHRQLRRRPPRRADGHLRCQPPGRPRIHPRQARGRALAPVQPEPADHRPVHAGGGTGRRLAAGIPGAREGARRDRPRRPQRGGLARMADPGRLRSARRRAGRLQGLRPGPRLPPVGHDHGLHLRLCGAGLHPHRPGQRTEQQLVVRGDPRHQPLRRAASAAVRLVSARLGQPHLLRRAAIWRRGALRLGPFPRSGAGVYPDARQRGGNQRPAAGTATPGNPWQAPAWHGLPRPGLDPDPAQAALRQSRGLRIHRGSGAGNGPGGLGSGPGAGQGEGPGADPGAGLRSHCGNASQASGNGRRWL

SEQ ID NO: 19025 - protein, 203 aa, Pseudomonas aeruginosa
RKPFTRYSWMVLSPSWRMVTSGSPEGASSSAAIATSGANASSPASIKRFSVRMVTLLLYRIVQGSFYTPWSPEKVDSPHEPSAPRPGGRFLVPVPRLPCPAAADHLDRQAHRCGEGRAEHAPEPAQAVPGQPVRGGLRRQGPDLPRRAVRRVQGQPAVDARRPAGPGRAAACQRPRPWPAAAVRGGGRGRRRDRHPGAQQRRG

SEQ ID NO: 19026 - protein, 468 aa, Pseudomonas aeruginosa
RGAACVETAAGGSEEAQGRPACQVRHQCPGQCQHPHRAAGRSLRHHARVLCAGLHRHSPRHGQPGPEVPRPQHHPFRGHRRQGRQATDLRPDRHRTGRALCGGGRRRDPAPAPGPVAEAGGDPVPGQGPDRHRDAAGTGAGADRAQRRAGRRQPAGHPEPRTGREDGRPGAPGIRPGWAGIQPRFAQAARRDPLRQARPAGSEQDRDRPAVHRRGSARRTGRAGLRAAQGDHAVPLHEQAQEHLHRPPARADQPAYRTHPYLIPPGGGGYRAAVVERPEPAEHPDPYRGGPAHPPGVRRAAGLQAIGRGLLADRAADHGPPGQGRWPAGCLPPRPGRTPRHRGGSLRRAAGRRQRRPATQRQGDQLRIDLRHERLRPGQADRCRAQGGPGLHRPLLRPLPRRPGVHGTDPRPGRGAGLRRNPVRPSPVPAGDPFEERRHAQGRRAHRDQRADAGHGGGHHEARHGRCG

SEQ ID NO: 19027 - protein, 159 aa, Pseudomonas aeruginosa
HGLSTGVRLGVAGGCFVSVSVSEVYNAADFVCALSPRVERARERTEHFPRGRTRAFPLMRTIMKKLLLAATVVAVAVTAHAAQDPEAVFNRTCGACHDGQLPMAPKKGDHAAWEPRLAKGMPTLVQHVTNGFNAMPPRGLCTDCSAEDYQATIQWMVKK

SEQ ID NO: 19028 - protein, 202 aa, Pseudomonas aeruginosa
LMNKLLVSLLLTLGLTGLAHAAGDAAAGQAKAAVCGACHGADGNSPAPNFPKLAGQGERYLLKQMHDIKDGKRTVLEMTGLLTNLSDQDLADIAAYFASQKMSVGMADPNLVAQGEALFRGGKIAEGMPACTGCHSPSGVGIATAGFPHLGGQHATYVAKQLTDFREGTRTNDGDTKIMQSIAAKLSNKDIAAISSYIQGLH

SEQ ID NO: 19029 - protein, 213 aa, Pseudomonas aeruginosa
QSGGRRQRQGGRPVHEGAARDPPSRRHGRRPVGPDSAPGKGRARLRTAPPATHPAEHRCSRRTGPAVAGPGPAAGTAQAAEAVRPRYRGARPAVARDSDPAQRAEQAATPGAGRAQGRRCRRRSPEPVATPVRRQGVGNHRGAERIGAVRCGGKQYTDPTGGGRAVPAGRRARRGARRSAAAVARLHGRRHRKRASGLGRGRRAWRAEPDPAG

SEQ ID NO: 19030 - protein, 262 aa, Pseudomonas aeruginosa
AGQWPAGQRAAGDRPEQPQAGGGQPAERPACLHGRTPARTGRARTGGVRPPAGADGAGQQHGAGCQGVPQPPGGPATESPDRSADRPAQPRGAQRAPGTGSGAPAPGRRRSAAGGAGHRPLQADQRRLRPPGRGQGAEDHCRRIAQTVAAGRFHRPFRRRGVRRPAPGHVPGSRPATARTAARGDRRLSVPFQGRAPEHHLFRRHHRVRRQRGRRSGFRACRPGAVSSQARRPGPPGSGLKGDQRTFRRLGTGSPAGVAAAR

SEQ ID NO: 19031 - protein, 270 aa, Pseudomonas aeruginosa
REKFNRSLISRTSRDISSSTVWIRSASRDSAGKSRRSRSRLKAICMPVTGVRSSWEARRTNSLRTRSKARCSVTSRTTSTAPTLCPPGWVTGYSDQASRRDSPATSTTRSGIASSWTSPSRAFSTASWTSTSLSISSIRLPWGSLETNSWRIATGLACSMRPWLSKITRPSSMLSSTACRRRSPESTSSTLVLRYCRRASAIRPKRRVNWPTSATLVIGRVTSKSPSPILSAARARVSIGAPKRRAMLWAVTKPISRMATPTRPSRPATR

SEQ ID NO: 19032 - protein, 481 aa, Pseudomonas aeruginosa
RNMGKAKLSLAWQIVIGLALGIAVGAVLNHFSAEKAWWIANVLQPAGDIFIRLIKMIVVPIVISSLVVGIAGVGDAKKLGRIGLKTIIYFEIVTTVAIVVGLLLANLFQPGTGIDMSTLGTVDISQYQKTTQEVQHDHAFIATILNLIPSNVFAAIARGEMLPIIFFSVMFGLGLSSLPNDLREPLVKVLPGRFRDHVQGHPHDHEVRPYRCLRPDRGDRRQLRLRLAAAAGQAGDPGLRGHRLLRPGGAGPDRADVRLLDHAPDPHLQGRPGPRLFHRQLGNRAAAHHRENGSLRRAEGDQQLRGAHRLLLQPRWLDPVPEHRGDLHRAALRHRPVHRPADHAGADPDGDLQGYRRRAGRILRGAARHPGQRRHPARGPGLHRRRGPHHGHGAHRPQRDRQCPRGAGHLQVGRHVRRGQGPALLGFAAAPAAGGRRSQGQAGHPRIRRLPAQEAPASSGASAFLAPAPPAPLSSAQRGGF

SEQ ID NO: 19033 - protein, 409 aa, Pseudomonas aeruginosa
MLNGLWLGFFLVAAASALARWLIGGDATVFAAMVESLFAMAKLAVEVMVLLFGTLTLWLGFLRIAEKAGLVERLAVLLGPLFRRLMPEVPPGHPAIGLITLNFAANGLGLDNAATPIGLKAMKALQELNPSSTTASNAQILFLVLNASSLTLLPVTIFMYRAQQGAADPTLVFLPIPLATSASTLAGLLSVALMQRLRLWDPVVLAYLIPGALLLAGFMAVLGTLSATALAQLSSLLGNLTLFSLIVLFLIVGALKKVPVYESFVEGAKEGFDVARNLLPYLVAMLCAVGVLRASGALEVVLGGIRWAVEGLGWDSRFVEALPTALVKPFSGSAARAMLLETMQTHGVDSFPALVAATVQGSTETTFYVLAVYFGSVGLQRARHAVGCALTADLAGVIASIAVCYWFFA

SEQ ID NO: 19034 - protein, 488 aa, Pseudomonas aeruginosa
IQRFRHFPCGQWQLPRDVRLHGVWLLRHRHRQDLLPRRQPVRLPDVVPRHLWRRLPDAAAGCGVPGRLHRSPRPPPGPDHHPRPDGHGHPADRLRSRLCHAGRGGAVAGAVRPAPAGFFRRRRAGRGFGLPVGDRHARTQRLLRQLAVGQPAGRGGFRRPARRAPQPVAEPAGHGRMGLARAVLHRLPDRSGAVRHPSLAGGNAGVRGAHPPTVAVAGAALHRAELRRSAGRYRDGGDDHRIVLPDHRLHADLRQERTATVGPRQPAGDHVHRPIQLHLAAGDGRVLRPHRAQAIVAGCLRAGTADRLPGAVLAGPRAEFRRPARRRVVAVVPLQQLQRRDGGGVDRGDAGGRAHYRFLPRLQPGYGDLRWFHPGGLHLADPHPGQPRGPGHLAQWRGAAGAARHPGAVPPARQGDRRGRAGQRLRRFAACRASAPAGAAAAALMSINRSCAKPRRQEGSGCTDFLPFLEIASCPMYKMPAGLPRSRR

SEQ ID NO: 19035 - protein, 156 aa, Pseudomonas aeruginosa
EIMANNAPVSASSMMSPVRLENSTLTPLAWVIGSAAATISWSARMIRPRPMNTRPSWPRRVCLRLRKKITPKKISNGESHDRSRVSTRAISAVPTSAPSMIARAGASAIRPWATKEVASRAVALLLCTRAVTPMPAANASGRFSTLRLRMRRRSAP

SEQ ID NO: 19036 - protein, 253 aa, Pseudomonas aeruginosa
SPRTAPGSKARRSSNCKPPPSWTACAASSVSRTCIPAAAIRSARRSSPSVASIRRWSATTSAVAWPCGKPAWPPASCRRTNWKSAWAISTCRWTRPGATASKPWIYRPASTGARSARSVAATTSPSYSRSRPCSTRPPCTPSASMPAACNCWCTVARAVSARRSCKNRSACMATPACSTAAWKLPPTWRATPMRCASPRVTASSSPGAFSNACAATAWNCSTSTTTWWRRHRSMASTAGCTARAPPRPTRACW

SEQ ID NO: 19037 - protein, 364 aa, Pseudomonas aeruginosa
PARQQTPGDPADRPAPRGPGEQRGRRAARGAPPGPRSDQSRRGSPGIPRRAFRAGLSGSVAEHFLAQLHWLFAPLARGSAAHADVQRLHGQGEAHGEVDVALRHMDFEGFGDQHRADHDEERQGEHLQRRVLVDEVADGAGAEHHHQYRDDDRRDHHRHVGDHADGGDHRVQGKDDVDDRDLDDGADEAARRPLRFIAAFFLAFQALVDIRAAFPEQEQAAEEQDQVASGDALAEQVEEVGGQAHDPGDRQQQQDPRHHRQGQAEEAGAWLQVLRHAPDQDRDHDDVVDAEDDLQGGQGEERNPDFRAGQPFHEAVTRLGQLLNRGNRPSSRAMARIARHTSTAHFRVKRWWSPKSILASPTSR

SEQ ID NO: 19038 - protein, 242 aa, Pseudomonas aeruginosa
GRTAARGSRAERSRAPPDSGIRSSCEVAAAQGKSGLCWHSREEDSPCPRPIPAVAIAAICATPSPRRWTMSLTATARSAGAPQAASSPPGPRCRARRSAGWRANRRNMPRRPAARATSARVAGPTWRCSPGSAPIPWTSPWPASTIPSAPPPTGTSGSAAACHGYTSTRSCPKRTRSSSPERTTRERRPEVAPVGRITQSVIRRLRGAERALGTMRPAGASLRAASARRPPCAARAGARRPP

SEQ ID NO: 19039 - protein, 152 aa, Pseudomonas aeruginosa
GRSNSCTPGARGSAGWWSCWSSEWMMISMERCLWRWPPVRRRAQGLPCGRKGRVPGAGGPRRRRSSRACVGWPRRTVADSAPAVPGLPGSSPGRPPSGTPSSAGSAGCCTTGANPAARPRAPGWSGPRSPPGRPCSRPSPNGPERSPGCRRT

SEQ ID NO: 19040 - protein, 84 aa, Pseudomonas aeruginosa
NSWHLVMKLPVRQLGGDERGQALLRCPEAFPADWSTHRVLVLLSRPRPVRSTEQEAVKHEIERHSKHTFRKNVKADGENVMPFE

SEQ ID NO: 19041 - protein, 338 aa, Pseudomonas aeruginosa
SEQHAIRHDLWNVVFLGRASPSVASDKRPASLTQRLFVTGLSGFVGKHLQAYLAAAHTPWALLPVPHRYDLLEPDSLGDLWPELPDAVIHLAGQTYVPEAFRDPARTLQINLLGTLNLLQALKARGFSGTFLYISSGDVYGQVAEAALPIHEELIPHPRNPYAVSKLAAESLCLQWGITEGWRVLVARPFNHIGPGQKDSFVIASAARQIARMKQGLQANRLEVGDIDVSRDFLDVQDVLSAYLRLLSHGEAGAVYNVCSGQEQKIRELIELLADIAQVELEIVQDPARMRRAEQRRVRGSHARLHDTTGWKPEITIKQSLRAILSDWESRVRKSNDF

SEQ ID NO: 19042 - protein, 423 aa, Pseudomonas aeruginosa
TLMGQIRVSGLGKAYKQYPNRWSRLFEWLVPFSPPRHHLHWILREVEFTIEPGEAVGIVGVNGAGKSTLLKMIAGTTQPTCGEIRVAGRVAALLELGMGFHPDFTGRQNVFMAGQLLGMQVEEIQALMPEIEAFAEIAEAIEQPVRTYSSGMQMRLAFSVATARRPDILIVDEALSVGDAYFQHKSFERIRSFRKAGTTLLIVSHDRSAIQSICDSAILLEQGRMAMRGRPEEVMDYYNALLAEREGQTVRQEMLADGQVRTISGTGEAAILDVRMVDQRQRALEVVEVGQAVTLEVEVEVRQDIERLILGFMIKDRLGQPMYGINTHRLDKALTDLKAGERITYRFAFDMRLGKGHYSVALSLSRLDSHLDRNFEWRDYGLVFHVINNRQEDFVGCSWLGAETHISRSGEAALDPTSAESTP

SEQ ID NO: 19043 - protein, 393 aa, Pseudomonas aeruginosa
SRGSCSPSARPRRMARQYMRIAVNARILQAPRTGIGHYLVELLGALQAHADFEFSLFHGWGWSGDLPAAALPGYSRLSPWLRNLPGAYRARRWLEQRRFDSGRPPVDLYHEPSLWPLDFDGPMLMTLHDLTHLHYPATQPAARLREIERRLARGMEKARLILTDSQAIADEAQAYFGLPRERFVVAPLGHAARFRPRDRESLREPLRAHGLVPRGYFLCVGTLEPRKNLSLALRAHGQLPAAVRQRFPLMIVGMPGWESRSLDDELRQALASGTVRLLGYLPDERVAELMSGARALVFPSIYEGFGLPVLEAMASGTPVLLTRLSAMPEVAGEAGSYIDPDDANGLSDMLVRMTEDTVYWECCREAGLRRAEQFSWKRCANLTAAAYRRAVEG

SEQ ID NO: 19044 - protein, 381 aa, Pseudomonas aeruginosa
MRVLHFYKTYLSETVGGIEQVIFQLCESSGSWGIDNHVLTLSSDPHPPVVPFGGHVVHRARLDLQLASTGFSLSVFKQFRELAAEADVVNYHFPWPFMDLVHFLTGMNKPSVVTYHSDIIRQRVLLKLYRPLMGRFLHSVDRIAVASPNYFSTSDVLRQYREKTRVITYGLDKACYPKPAAQRLEHWREKLGPRFFLFVGVMRYYKGLHILLDALQGTDYPVVIVGAGPLQAELYAQAAALGLRNVHFLGRVDDEDKVALLQLSYAMVFPSHLRSEAFGISLLEGAMYGKPMISSEIGTGTSYINIHGETGLVVPPSQPAAFRQAMRWLWEHPQQAEEMGRNAEARYRQLFTAEEMGRRWSELYRELLEEKASSRYVKAAR

SEQ ID NO: 19045 - protein, 516 aa, Pseudomonas aeruginosa
NGSASAGQHVSAFFQVQVPGQRLAQQMRRVAAFRASRLEVVQQRCLVGRVDTVLDDHPGPFARRQAAQVGEALLGDEDVDVVLGVVDVADHRHHAGNVAALGDRLGDEDRQVRVAGEVAGAADAVHHLGAADVGRVDVAVDVELQRRIDADDAQATDHLGVVGDFLRAQHQLVLVALQVTEHVGVAPRRQGDRAARGEAQLAGVDQVEGRVLQHFGVHGQVLERRLDQAAHHRVGDAADTGLQRAEAVAHAPGVDLALEEIDQVVGDGLGLAVRRQHGGWRVRLVVDDDGDDLLRRDRDRRAADAVVDAGQRDRRAGRPVGRDIDVVQAFQVGAVGQVDLDDDLLGEDREARRVAHRGGRHDVALLGDRGGFDDGDVRQLQLVVAQLLDGFREVLVDEHHFAGVDRLAQGAVDLERHAPGEHAGLGELLVEVVAEAGAGHQADTQRTFLGAHGQRLGYGLGLAGAGETAHADGHAVLDQVGGFGRTHHLVEQGGQAHAITVHGTNLRRRIIRGPPV

SEQ ID NO: 19046 - protein, 590 aa, Pseudomonas aeruginosa
QIQEAPVASPESTRNSQLRGRMLPGAWNLPRTARMPPRVTRITRVRMKVAKSESTRSRPILAKIAVSAANSAESSAQKAQDASMSSSSGPSPRAAPLQGFQLGVAEHQPLAAFALEVHLHPGLGAGAFEVEDSPFAEQRVANPLAEGEGRLRHPGAAEQAAAGVARSAAVGAADGIGQAHFLDQRRRDLADEARNLVVGLATVEPAGLRVGQDQSLHGAGDADVGQAAFLFQAAGFLQAHLVREQPFLHADQEHQRELQALGAVQGHQLDTVLVGVGLGFPGLQGGVAEEGLQRGEVFLFLAVLEGAGGADQFLEVLHPGLAFLAFFFLVVADQSGLLDHRLGHQVQRHVHDLRRKILDQLDEAGQGAGGAAGQDLVGDHQADRLPHRHIVAAGEFADALHGLLADAACRHVDHPFQRRVVAAAVEQAQVGHGVLDLGTLEEALAAVDAVGNLLPQQGFLQHPRLGVGAVEDGDLAARQAALERALDRLDHVARLVVLVERGVQAQRLAVLAVGPQLLAQASLVVGDQGVGGLEDRRGGTVVLLQADHLGVGEVVAELLDVLDPCATPAVDRLVVVADHHQAVAALGENP

SEQ ID NO: 19047 - protein, 293 aa, Pseudomonas aeruginosa
PGVLHGVGVLELVHQDMAEAPLVVLEHAGMVAPEVQGAQQQLGEVDHPGAGAGRLVGFVDLQHGGEEQVAAGLDVLRPQALVLLPVDEPLGLARRPALLVEAEFADHPLDQALLVVAVEDLEVLAQPGLAPVRAQQAMGEAVEGADPHARRIDPEQLLDAVAHLRRRLVGEGHRQDAVGRGVLDLDQPGDPVHQHAGLARAGAGEDQLAAQRRGHGLALRVVEGVQQEGEVVVHRGILPGRGKAGQTGPPFGAGRRSVGPGCGKMLYPGLGQPAPARLCSGHFKANHYKNKRL

SEQ ID NO: 19048 - protein, 736 aa, Pseudomonas aeruginosa
GRFMRSKPLLPALLLVGAGLSPLAQASSDDSCYPDWSLVGGGVCDTLPFLAPGNDTRANLRLLLADAGHWRLVEAPPSEEEKLEGYGLVPFGLFRLLPGDGSQPPAPSAASEAETPPPAPAPSPLAELARQMGAEALPEKIAGAEFFEGEGSRCRSNDQDSALAFLRQVRDAGLGEAETKALANSRLDLLGACGWEQEELGGVLAQGVESAAGKAFATYLEAAANFYSGRFDEAEQGFKALQDVSQPWLKETALYLQARTLLNAAQQNAFDDMGFPELQNVDKARLEQTRSALEAYLQAYPKGLYAASAKGLQRRVHWLAGDQKLLAQDYAAQFAEAEQGQRNMALEDLVQEVDNKLLTGIQLGDIQTPLLLAVADLVQMRAHDPSTPRSFTWETLQAQQASFAAHPELFAYLQAAYRFYVDQDPAKTLEALPQKVGSLDYVGFSQQTLRGLALEQQKDWKAAEALWLELLPQAAQPYQKGQLQLALALNYERSGQLEKVFAEGSPVQEPLLRSILLRNVADAALLRRQAKQGATAEERDTALFTLLYKDLRRSRFADFGKDFALLGETPSQTKLGTSLGYVYGAGNSLELFRWKSDKAESGYVCPAIAESAAALAADDKDPKGLNCLGEFILRNGLDGMPLDSQPEANELGGTPSGFKGEVYSRLDGYRLVMDNPKAPREDKAYALFRAINCFAPAGYNTCGQQDIPQAERKQWFRTLKSTYADSSWAKELKYYW

SEQ ID NO: 19049 - protein, 190 aa, Pseudomonas aeruginosa
ASPGCSTGAATPSRRRSTGSRAWSTKWWCRPTRGATAFPTTPPTSRGSAACNCRTGSAWSRAATGKPPTTWKRAPGSGATWCSCSTLSERSRKRPCRHTRRCVRPAAGGYPGRAGDRASVARSTGPGLPAAPGRPRGHCPAPPRWPRRRRCAGPPRAGSGCLAESSVRRCRRAGSGSSPPPRPVRRGVRR

SEQ ID NO: 19050 - protein, 506 aa, Pseudomonas aeruginosa
AGSMSASFQPASTLQFQQQLRLFRAVAAGRVGPRALVVLAPAGEDRVDPAPGGLYLVAAHEQRRVALDHVQQQALVGVPAPLVAAEGLGQVEVQLHRFQLHALARGLGHQLHADPLLRLQPYPQAVGRPAAAVDQAVRHRLELDDDFRALARHALAGAQVERHPGPAPVLDLGLERDEGLGIAVVVDVLLEVVRRHLLAADPAGGVLAAYRLVLHVEPGDRLQRLQHLELLVAHSLGVETHRRLHRHQAEQLEQMVLHHVAHRPGVVVVAATVLHAKGLVDADLHMVDVRRAPDRLEQRIGEAQGHQVLHGFLAQVVVDAEHPRLVEHPADGLVDRPRRVQRMAQRFFQHDARLRPGEAGDGEVLRDRREQARRGRQVVHQHPALAALQVPRETAEVGALRGVHGQVVEARGEAFPLFGGELAARHHRADVALGEGEEGGVVQRAAGEGEDPRIGRQAVLPVQAIERRQQLVQGQVAGTAEDQDVAGRWSGWCTQGKLPTALAGRG

SEQ ID NO: 19051 - protein, 294 aa, Pseudomonas aeruginosa
ERLGGRLQPEDLRHHAAQPDGSPRAPGHPRPGARHRRHRPRPARGVLRLRRFRRGGLGCPAQVLPPAAVGGGLLRPAHAGDVGGDPQAQRRGHLHFPVGSLEGPADHRQPGARGRRHADHPVPEPDPAGRPGHGQPGDRRARGHRHLHPADLAHRPLGGDRRAGDGRGHGPRPGPGQPPQERQAQPAQPAPVAEGDEEPGRARRAVLRRRREGITQSSPACRQTVTLLRDARDSSQSAMGDARCPVIAMPMPSTWIRKPAASSKTSGACNSAGRSRTTAKNCACARNWPTTPSW

SEQ ID NO: 19052 - protein, 650 aa, Pseudomonas aeruginosa
LLIFVNHPHGGRVKARPGAACRSCSDRNIRIDRTRFPTPKRETSVIKKILIANRGEIAVRIVRACAEMGIRSVAVYSEADRHALHVKRADEAHSIGADPLAGYLNPRALVNLAVESGCDALHPGYGFLSENAELAEICAERGIKFIGPSAQVIRRMGDKTEARRSMIAAGVPCTPGTEGNVADLAEALREAERIGYPVMLKATSGGGGRGIRRCNSREELEQAFPAGDLRGDQGLRQRRGIPREVHRQSQAHRGADPRRFLRQHRAPVRARLLDPAPQPEAHRDRPEPAAHPRAARLYRRPGGARGQGGGLRERRHRGVPARRRRGVLHGDEHPGPGGAHHHRGNHRHRRGPRADPHRFRAGAVGQAGRHRPSRLRPAVPHQRRGPEEQLPALVRQDHPLLRPRRPRRAYRHGDLHRLHHPAVLRLDVPEADRLGADLGRGPRSRPARPRRHARAGGQDHRAVLPGNPPQPGIPQRPVQHQLRRKPPGTDPVLDQAQPVAPGHRHRHRHRGPRRPVREGAEHEQHHPSEEDRRHRYHPARCPPVAAGDPHAHRGHAADLRQARPRRLLVAGSLGRRHLRRLRALPQGRPVGTPAQAQGSAAQHSPADAPARAEPARLPPLQRRCGARLRGQGGGQRHRRVPHLRRDERRA

SEQ ID NO: 19053 - protein, 392 aa, Pseudomonas aeruginosa
PARPGLECGQRAEHRLRPLYPHLCLYLRRRLDHRLHPVQRPRRDPAGKARRAAVRPGGGAGGVVEHPRGGPHHHADARRHDHYLRPLHQRPARAHPAGDPVQQRRAGRGLLALPAGDPAVLPDFLRLPRQRAEPDEVLRQGPAADQPFAVDRHPDRPGHLPAVAGQHPGHHPARAVQGHHRRRQQRRHPGGIPAPDHRVGFAERVAHHLLQPGGGQLLPRRDPRPVRLPGRPVQVRRQPLRALQDRVADLRPTDHRRAAVPQRLHLRHRFRRAGRGVLGGDRSGADGAGLAQALRQPAVPRLGRHAGDRAGAAVRRGQRGRAHPGQPALAAGVPLSDRQSLPGASRAAPPASAAGGLRRRSWKDRASARTPPVAPAIRCRAGRTRRCRGCAA

SEQ ID NO: 19054 - protein, 425 aa, Pseudomonas aeruginosa
TVARRGLYRRAHRRRHLRCRVAGNPRQGPRRRPERSRAARPGGPGAATGRRAASVPRRRAGLRPVPLRHLGAATGALLAQPTGGLPGLRRPGRRGAPARADRRLPAQRARPALRGGTGDRHPWRAAGHPPVRPGVARERRSGGCGKPWLPRGAPGLRRDRRGTARDRPRRRGAAQRPARGHCRLPPGLCHAVTPVPHRRHPVAGAAPGAAGVGRARRRLDRRGRLRRRVSLQRYAAGAAGRAGPTGPGALRRDLLQDRLPGVAPGLPGGPAGAGRALPPAAGHRGTPFGGGHPAGHGRLHRRGAFPAPRPPHAPRRPRPPRRLAAGLAKSAGLPAVAGGGCGAAPVRAGRQPGAGTGPDRRGGSRRGGSQRLERLLDGRLQRCARRPRGPGAGLPGSTRGAYRRGAAGVAQGLAAGGPGWTRRRD

SEQ ID NO: 19055 - protein, 424 aa, Pseudomonas aeruginosa
  UNSURE (176),(216): Identity of amino acid at the above locations are unknown.
LECPRITLAPRSSHECRPFRRARAQARRPPDRLRPAGARRAVPVQRGQRAPGHPLRRRRRPGPDPLPRRLRLHLRLAGIHPRTARRRAARADGDAGAGGAAVLPGAGGGQPVRPAGERFRLAGRYFGDRRRLHFRHRHATGRRLRLRHPVHRRRRQRADAGDPAVLHPRLADRHPXCRLVVRPAVAAADLAGRRTGPGTGAGVEPGGVHRHRRGHXTHGEGPPRHPGYPAERLMAGLAALLPRPWPAGLGRVGAGAAQLPHPVPRRTPLGHHVGLRPVGREDRPGRGPGRRRLGLLADAGERQGAGRAAVGRHHQRDGHRHRPRRAARRRPGRTLRAEPGHPAPFAGGGGDRRAAARLRRAPGLWLQHRRVFQRDRVRQPAWLVVVGGGVCRQQRRGTGIEALFLPGGAAGARVDGVLRGDMPS

SEQ ID NO: 19056 - protein, 181 aa, Pseudomonas aeruginosa
GCDDFVANAVKRCLMHKRHNVGCDAGMMADVSSHYRSLSRREPRTEVAGGFHRPGRHPQLFPGGGEALRHPAGLQPAHPQPGGRPRPDPGESPAHAGGTDRGRAAVPGHRAQRGRAARPGGAPPAPPGRRAGRGAAVRRRPLAGAGLLPAVDRAAAQRGAEHRQPADRHQRRRGGAFPARG

SEQ ID NO: 19057 - protein, 215 aa, Pseudomonas aeruginosa
PPARARPAFAVYCAAFEPALPAGSAQYKPRPSTKRGLLVSDAPDGAFERGTTMSALVGVIMGSKSDWSTLSHTADMLDKLGIPYEVKVVSAHRTPDLLFQYAEEAEGRGLEVIIAGAGGAAHLPGMCAAKTHLPVLGVPVQSSMLSGVDSLLSIVQMPAGVPVATLAIGKAGAVNAALLSASILGAKHPQYHEALKQFRANQTETVLDNPDPRDA

SEQ ID NO: 19058 - protein, 366 aa, Pseudomonas aeruginosa
EGKARTMKIGVIGGGQLGRMLALAGTPLGMNFAFLDPAPDACAASLGEHIRADYGDQEHLRQLADEVDLVTFEFESVPAETVAFLSQFVPVYPNAESLRIARDRWFEKSMFKDLGIPTPDFADVQSQADLDAAAAAIGLPAVLKTRTLGYDGKGQKVLRQPADVQGAFAELGSVPCILEGFVPFTGEVSLVAVRARDGETRFYPLVHNTHDSGILKLSVASSGHPLQALAEDYVGRVLARLDYVGVLAFEFFEVDGGLKANEIAPRVHNSGHWTIEGAECSQFENHLRAVAGLPLGSTAKVGESAMLNFIGAVPPVAQVVAVADCHLHHYGKAFKNGRKVGHATLRCADRATLQARIAEVEALIEA

SEQ ID NO: 19059 - protein, 85 aa, Pseudomonas aeruginosa
GGTVMGLIGTIIVGLIVGLVARFLKPGDDSMGWIMTILLGIGGSLLATYGGQAIGFYQAGQAAGFIGAVVGAVVLLVIYGLIKKN

SEQ ID NO: 19060 - protein, 414 aa, Pseudomonas aeruginosa
PGRCRLRHRQGAGEGGGGSGPVGPAPAQRSMADDASRAVRSPTRSGSFQRLAPDLHAKAFAAPGGDHHEVVPDPPGLDAEHLLPGVVGELRETPGLVHPGVPDHRRARVEGVQVDAAFPARVLDQQVAFETEVDAIQFALDPYRAVLSAFFPVLQGLDVARAFQALDGDLAAVADREVGVQCLAEHQRLAAEVLAGESQGQALAEAEQHAQRRRVRPAGEAIGGVETEADAEVAVLLGDVVDFPVDRPDQPVGGRLQAIFHLAADFLRVALQRTEPRPAHRHPAAYRLPAPVAGLVAEPDQRRLFVGLVAEQLRALLGDQRLAMGGVDAPAGQVVDLYLFDAVDRAIGVHGGLREANGWQQYHRSILSPAVPPDSANEDAARRPRRLLPVVQAARNRLCGSMTNFFGTPASNSP

SEQ ID NO: 19061 - protein, 352 aa, Pseudomonas aeruginosa
VLGVVGVVDRLDALGDDRPFVEVVVDVVGGGADQLHALLVGLVVRLGALEAGQQGVMDVDRPAVQAPAQFRRQHLHVASEDHQLGATLFEHLPDPGFLGRLVVRVEREVVVGNAVPARQRLQVRVIGNHRHHVHRQLADALAVEQVVQAVVGLGNHDRHLAAVARRGQLGTHAERCHPFGQSGAEGGFVEAVAGAELHADEEALRQAVVERVVLGDVAALLEEVARHHVDGAQQAGTVGGEDPGVGGTAHREAPGPVSPLGERGRLLMPLPAGRIRRWRLATRARSSRRSCGARPAPRCPRRYGGSRIATWRRCCRPPCPPGSCSDARRSWWISSAVRGRSLRSVRAASARR

SEQ ID NO: 19062 - protein, 134 aa, Pseudomonas aeruginosa
PPRSAAPRPGPGAGAVRRRIPRRRGRSATIRPGPAIAARSRRWRPGSGPPAVPGRGPGARRRRRPGRRHRRAAPGGRAASSRAGRYRPSRRSCRRACAARHGAAAIRRGRRVRGVAGRRLPCSFVFTLGRRAPW

SEQ ID NO: 19063 - protein, 139 aa, Pseudomonas aeruginosa
RRSADRRTASVRVPWASRGAPGTARRTLPRGAAGPSAGCRRWSCSRRRGRRDSRPGSRRRAPRRARTRRSRRRRRCASAGLRRGRRRGFPRAIPACRPGARPGARPGCSRRSWRSGRSPAIRRRWRAWPAGRSGRPWRR

SEQ ID NO: 19064 - protein, 544 aa, Pseudomonas aeruginosa
SGSCRFPLYGGFLLTVGDDAGLLADQVGLEDLVGHRMAGDVEVLAAAGGVHPQLVMEAARVVAEEHVVAPFLVAAGVRVERARDVGLTLGVEFLFGTQFAAVGAEDIQHFVASGNCSCRLTGTLSLKGEGQRISPFGRLLSVRHCRRAVLVDQRTAVEAFDGEGRGQRMRFALGQGGGEDVSGAGSGLEAAGAPAAVEEQVLHRSLADDRAGVRGGVDDAAPLAVHAYPREHREHLDDGLQGVLDHRVRAALAVAVVAVDAGADDQVALVRLADVAMHGVGHDHAVDDRLQRLGDQRLQRVRLQRQAEAGEPGHVPGVAGGDHPDTTRADEAAVGLDADHRAVLLAEAGDFGLLDQVHAEGIGGAGEAPGHRVMAGDAAATLDGRAHDRVAGVLAAVQVGNLLRHLLRVQQFAVDAVEAVGADPALAVAHVLEGVAEVVDPALGEHHVVVEVLGQALPQLHRVFVEQRGLVPQVVGAHDGGVARGVAAAQPTFLDYRHVADAVFLGQVVGGGQAVPAAADDDHVVDRLRRGRAPHALPVLVMAQ

SEQ ID NO: 19065 - protein, 223 aa, Pseudomonas aeruginosa
TACSSSCENTMKRPLIFLSAVLLGASLQGCGGGDEKQAAAPALPADSCTGHELEVALPPAGKPLFGYDFLSRQCGYNDATVVFGAADGSKRLEIVLTDTGLPAPPTEGDAVSYRAAQDKLREMTQTNLTLLHKTRETALKNGTAERFGGEDYLPLIDTTRMGDPLGVMVPAKGEEGVSTLSGVIKNRYVLTLSTRDTPNGGSATAMRQVLVPFVEQMKLTKLP

SEQ ID NO: 19066 - protein, 125 aa, Pseudomonas aeruginosa
RRSAPPARSSACTCTWTARASPTPAPSSAARRRSSAGRPGSTCSASAAPRTAWRWARRSCSSTATWPRTSTTAASRPANWPRRCASSPRPGSAYCRTMPGCATPITPTAARACWPSWWPTFPASA

SEQ ID NO: 19067 - protein, 95 aa, Pseudomonas aeruginosa
TAWKSPSSPTSSRSAASSAIRSPARSPTAWSAWPCTCRAWTRSTTWSGPTARSARSPMATCSTRTRWSNPLSTSSTPTCRSCSNCSTSTKAKPTA

SEQ ID NO: 19068 - protein, 178 aa, Pseudomonas aeruginosa
PGDRDGRRVPRNAGHRRLLLRHPRRRSGRRRPGPQRAVHAARRRRRATLDPDRRRRGGGRQARYPGRYLRHRHASHRQQGPLRAAPRCAGRAAHPHREAARPGPGSRGQRRRRAIRRQGQGRRPGRAGAGLRVRPPARALRGRRRGRGRVPVGARAQAKLAAGLRPARTGRPGLPTVA

SEQ ID NO: 19069 - protein, 692 aa, Pseudomonas aeruginosa
SRGPGRGEQTGVEYSRQVRGRGSAERGCQPAGGSRREGPGQRRGERRKRSRAAGSGTRLSRRAGPPGGLARAGGYVLRRCDGQCRRRSGARQPLCAAGQAARVVPRGGGHLAARLSQSRLEEKARRPRDTGPFSLQDLQILQQRTLLLGRQAGAVLMAAAAVAGITLLAAGGLQHIAAELGLLGGEADLVHVVGRAHREGFHPLRGRLQQLFQGRHRAVVQVRRRRPDPLQDPRLVGVGVGLGTQRLLEGGQQLPGFVGHHAFRLDRRRLGIVLLTEDRHEVLQDRTGHRYGEYIEGSVGRLQRLAERHPRALHHAGLHLAIEDGVLAAVAADVPQRSVPKHQVLDPDAVALHAATFVGLAGEDQRAFPGQVLVHRPGPLRRADLLDQVFQLAQTVEVGRVDLQVVHAQQVELALLRVEGGEHPVDLADIARQAEQVVAVGGEAGPLGLVLPRRVPQERIAHRRIRRLDVVGNQVGRRGADIQPGKAVEDHRYRVQPRRSPGVLGQRALDQRMIGLVPFLHRREQSVARTGRRIGPEDLLGEGVEGGVIAGQRSHGAIEVGEECLEVDDRRTAVDPIGSALHLDLPGMAGRTGHADHLPGARAGYGEAHRQAFRGRLGVGQIAVAGQAVGEERRSIRLSQRLEPGQGHHLRALVAAVEVLAVAFGPFLALVEHDRSGRQGGGRKSQGSEGQA

SEQ ID NO: 19070 - protein, 308 aa, Pseudomonas aeruginosa
PGGGAGRRLSAGIGKDRKRCTYAGQALARGHPDIRRSGGSRQRITSVRSEYMSTVQAIRTVLFYLLLSASAFVWGTLSFFIAPILPFRARYRFVVQNWCRFAIWLARVVAGIRYEVRGLENIPEKPCVILSKHQSTWETFFLSGFFEPLSQVLKRELLYVPFFGWALALLKPIAIDRSQPKLALKQLAKQGDECLKKGAWVLIFPEGTRIPVGQMGKFSRGGTALAVNAGLPVLPIAHNAGQYWPKAGWAKYPGTIQVVIGPAMHAEGEGPRAIAELNQRAEAWVSETMAEISPIQQRVSHPEPSVVS

SEQ ID NO: 19071 - protein, 759 aa, Pseudomonas aeruginosa
GSARPTRHDLCRSGLCPHGIGMEMDWEALLDELRSYAASDPNELETKIRACLKGHSSEGLLQAVALLISQGQHATARTHLSEFLKSHQAAADIGRRLELILYFKKSRAPQPLSLKSKQHNKETLLQDVNHLVAAGKLQAAESLLLEAIDTSEEPDFLNLLSRVYMLQRRPIDGAKAMQRALLLKRQQEAFVEPDLDSEDDLPTASDLAFLNDSATSLATLELPSVPSAQTSTVAVDNELSFIQQASAQLPPLNQDGWWENHVEPASIETTELTDAGEETDALDAAPAITEDVVEQVDEDETSSPTPKKPLLKLGLPRKPTEPGESKASVKVFNKSGRPLRIIPTSPLSPPGPDTDELPEPPDTAPVSEEPVIPSEVHDEILDEYDDDLPQDELELDVPSPVQMGLGLEDPEDDIDFDHDLHDLTIIELGKEHDGDTNAALDDFRDLDDDYAAYAFDPDEVFDNEEPSAAESTDWLADKLSREDRALQKAAELIGKANWPLSTLPLVQQIFVMSGWGATRLALEREIEKGLTPEELILAAHIKVIWAENDIYWIAFDKTGSSRLSYYVLSWPTALLIVRSFESLPQVEEIEVFLENLFASWYENSTLRRAFKAFARYLWFRFANLEGCLPASQHFDFHDPRELPAEEYGDLGLCDTLEIEKTERLREFGVFQTKHPQEPSCYFSDKPYVREEEPSLNASGKRKQVKADPADTEPLSDIEDDTAGIDGVEEDSAVPQWSAAPLASALHTQNIDQPSPSIEP

SEQ ID NO: 19072 - protein, 86 aa, Pseudomonas aeruginosa
YPRIWTGPPQDGHTSTSPKRSLAPVNQQVTDDLPPDFSITSNLVESVFRAGDGSEKAFYRRADSRLPQAGGGRCAGEGTVSPTRLQ

SEQ ID NO: 19073 - protein, 316 aa, Pseudomonas aeruginosa
PIEEVARRGPPRHRVAESGRPGKRVSPTARREAVQEMQARTGISERRACQLIGLSRSVLRYQPRASVQNTELQAQLVELAQERRRFGYRRLHFLLRRAGVQVNHKRIYRLYRAAGLMVKRRRRRHGVAVERERLSLPSAPNQVWSMDFVFDALSTGRRIKCLTVVDDFTKESVGILVEHGISGFRVTRALDEMARFRGYPKAIRTDQGPEFTGKALDQWAYQRDIKLKLIQPGKPTQNAFIESFNGKFRDECLNEHWFCSLAEARIRIVAWRRDYNEHRPHSAIGNLTPAEFAASWRTRQQQLKQEKLISTPGPTN

SEQ ID NO: 19074 - protein, 193 aa, Pseudomonas aeruginosa
RSLSMLYSSRPMPQPRAVISVPTSWEESILSKRAFSTLRILPLSGRIAWVRRLRPCLAEPPAESPSTMYSSESAGSFSWQSASLPGRPAMSSAPLRRVISRALRAASRARAASIILPTTALASLGFSSRKSAKYLPISCSTAVFTSEETSLSLVCELNFGSGTFTEMIAVRPSRASSPVVAILNFFARPSASM

SEQ ID NO: 19075 - protein, 143 aa, Pseudomonas aeruginosa
PSPRSPSSSRSRPRYFSFTQSRTKRLGAYTRNSSPSASTCKGRIQVLNCWDGSSSRRRSTHCCQSSTDTDIPQRLERRHNEISAYCSRTGRTYPHADALRPQANQDLNKSRQADGRSSWTLWITLALKGVHPCAQPCGKNRCG

SEQ ID NO: 19076 - protein, 503 aa, Pseudomonas aeruginosa
STTACRSHSSGTLPARSRQPRRPPDVYRENCPQQDAPSRGVLLSGDIHMQAATETIVAIATAQGRGGVGIVRVSGPLAGQMAVAVSGRQLKARHAHYGPFLDAGGQVIDEGLSLYFPGPNSFTGEDVLELQGHGGPVVLDLLVQRCLELGARQARPGEFSERAFLNDKLDLAQAEAIADLIEASSEQAARNALRSLQGEFSRRVHALTEQLISLRIYVEAAIDFPEEEIDFLADGHVLGLLEKVRTELSTVQREASQGALLRDGMTVVIAGRPNAGKSSLLNALAGREAAIVTDIAGTTRDVLREHIHIDGMPLHVVDTAGLRDTEDHVEKIGVERALKAIGEADRVLLVVDATAPEAADPFSLWPEFLDQRPEPGKVTLIRNKADLSTESIGLEESADGHVTITLSARTGAGLELLREHLKACMGFEQTAESGFSARRRHLEALRLAGQALEHGHSQLIHNGAGELLAEDLRQAQQHLGEITGAFTPDDLLGRIFSSFCIGK

SEQ ID NO: 19077 - protein, 236 aa, Pseudomonas aeruginosa
WGSAHAELWITRARFAAYFPFTVPLAAGTQPRRHGLPARRFVPEKTICADVGLHGMDIHLGEVYAQAPRSDPASAKALRCGQSLSARPSRTAYLSRCLAWRYRHAPGRSVHASQPGKRFIHKPGRDSAKRAVADPGLRRYRPGGALAFGSQGVPRRALGHYSMEIVANLAVWLGGECQVGQMINWFGSYDRTSGLSARLLLRKPANEGSERDFQVSAKRRFERLSSSIDTLESGND

SEQ ID NO: 19078 - protein, 164 aa, Pseudomonas aeruginosa
TGGTPPLYSARYFVGTFYAKSLIWQCRHQKTESAMESRMPSRLPAFRLLLVQLVVVLVAAISLWISWGPVAGYSGLLGGMIAWLPNCYFAYKAFRFSGARAAREIVRSFYAGEAGKLILTAVLFALAFAGVKPLMAPALFGVYLLTLMVSWCAPLLMGKTFTRP

SEQ ID NO: 19079 - protein, 155 aa, Pseudomonas aeruginosa
LGVRPHRRASQGNGLLGIPRRHPGLVGTARRGVPVHLPPGSQEGHQRPAGWTAELRRGDGRVRRHQRQGHLPRAQPVDRAPGPDRVRLDLPAQPDRPGTGGLPADAGREDHRRRAPVLPRGGHHRPERHPRPVDLGVRADRLLQHQGQGHRRLPR

SEQ ID NO: 19080 - protein, 291 aa, Pseudomonas aeruginosa
PDRCQMAGAKEIRSKIASIKSTQKITNAMEKVAVSKMRKAQMRMAAGRPYAERIRQVIGHLANANPEYRHPFMVEREVKRVGYIVVSSDRGLCGGLNINLFKSLVKDMSGYREQGAEIDLCVIGSKGASFFRSFGGNVVAAISHLGEEPSINDLIGSVKVMLDAYLEGRIDRLFVVSNKFVNTMTQKPTVEQLIPLVADDDQELKHHWDYLYEPDAKSLLDGLLVRYVESQVYQAVVENNACEQAARMIAMKNATDNAGELISDLQLIYNKARQAAITQEISEIVGGAAAV

SEQ ID NO: 19081 - protein, 468 aa, Pseudomonas aeruginosa
EQVQNSEEPDMSSGRIVQIIGAVIDVEFPRDAVPSIYEALKVQGVETTLEVQQQLGDGVVRSIAMGSTEGLKRGLNVDSTGAAISVPVGKATLGRIMDVLGNPIDEAGPIGEEERWGIHREAPSYADQAGGNELLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGRDVLLFIDNIYRYTLAGTEVSALLGRMPSAVGYQPTLAEEMGVLQERITSTKKGSITSIQAVYVPADDLTDPSPATTFAHLDATVVLSRDIASLGIYPAVDPLDSTSRQLDPLVIGQDHYDTARGVQYVLQRYKELKDIIAILGMDELSEADKLLVARARKIQRFLSQPFFVAEVFTGSPGKYVSLKDTIAGFKGILNGDYDHLPEQAFYMVGGIEEAVEKAKKL

SEQ ID NO: 19082 - protein, 218 aa, Pseudomonas aeruginosa
RSAMARRPRPAPPSPMRFRRRTWPSAAPGRRTWKTGSARKKSRSNGAARMPKPAKRIVLGLLIAWAVLPEWPRIPVEGASARDWNPRTFWFEPWGRSGVHKGIDIFARSGTPVRSASYGLVLYRGEIALGGKVVLVLAPKWRLHYYAHLDSLDAYPGQPVLAGSRLGTVGTTGNARGKPAHLHYAIITLLPYPWLADDSTQGWKKMFYLDPDTVLPSR

SEQ ID NO: 19083 - protein, 297 aa, Pseudomonas aeruginosa
DRRHPGCPAQRQGAGLPLQRGDLQRCHQFAGARIRPDPADPGRPGNRRGLDQGLHHPVGRPAAADPGHRPGAEAPGRWRRSRAGGRTASPADPAGRGAGDEPDGGEGFRAVRREAPHPVPRPWRAVPGGPGRRAEAQGNFLYPCRSLPGRRTQAWPAGAGGQRHAGGYRGAEQRAGGEAQVEPAGSPRPRRRTGGVRRRRRGHRGWRGHPCGGHAAHRRRALADPLHHPVAIALVPCRRAQGHRRRPAAQPGQVGHRRVTPAACPRSRGRHAAPALAVNRATAAPRRSCGWRTSPAR

SEQ ID NO: 19084 - protein, 404 aa, Pseudomonas aeruginosa
VAVPATAVADPHRRCSGVRSGAGSTGNHGHSRPLAANRDHPSQPRCAGQGLRREASRHRRTDQPGHRYRRCPQRSARRTRWRRAAGSRKPRQGHRRRSHPLPLRPVQRLLPALAGSGNGLFLRLFRDRQGRPRHRATGQAPSPVPQAAFAAGREAARCRLRLGRAGAPGRSRVRRRGHRHHIEQGAAGARPGASQGRRPGGPSHPQAAGLPRPAARWPLRQGGQRRHVRARRARQPGAVLPATVRGGASRRPGDEPRHHLALHRRPPGWQGGRRLHRSLRVSPRRAAAPVAGGGADERSRAGSSRRGKPASALRPDPGLLERQPGSQAEGGGSPGARGNLADLAAVPGRMRLRLQARLDQPAPDPRHSPPRGWLPRAALVAARPVRLNAGDRLPCGAGRAIGPC

SEQ ID NO: 19085 - protein, 795 aa, Pseudomonas aeruginosa
GGKLAARVVRRGPGLFRVPGRHRGLSPDFHPGPAGNARRTAVAGGVHQLSRLRHRSPLAAAGLVAGHGRPGHGGLPVGFRGRPDPALRRADPGRHGRRRGADRPGLRGGATGDGHRLADHLRAVSCLWPVRRTPAGRPGPPRLRLRPDRQPAVVRYRRSLRHADLRIGHLHLSVHPVRRLPRAGRHDPPVHRFRHGPVRSPGRRAGQGLGILLGADGHHHRLRRGQRGHHRTVHHPTDEAFRLQAGVRRRRRGDREHGQPTDAAGDGGGGVHYGRDHQRPLRGDRQGGADPGPAVFRLGVLDGPPRGPPGRSKGPAARSVSERLGCRPRALVPADSVAGADRAAVLRAHAAVLRNHRPGADRHRHPRFGDHPAGVLARPAHRLLGGAGAALRGVLPPRHRGDLRRDRGPGPGLLVRPWRPGNPAHLRPRPRRRCATCDSGGHRLHPGGSHHRGDFADRHRHHLRQLRARPGTGEPAAVAGPDHGHLPGPGNGHPDHPQLHHHQLHRRAGAAGTGGAADRLAHVRLLLRHPRRPHPSGGAGLFRGRADRQGKGIEDQLLGGAHRPGGFRGAVHGGVFPGADAAGRRLGGDALCHLQGGAGHRPVGHGFHRLPAGAAGLVGAPGGVRRGGQPGPGLADQRRAGLRPRRAGDRLAPLAPACARGGGVIALCLGMAGSVWATLPLQSFTLAWQHTVEKVLWEEDYRLSERGLLLEEARVRGSGAGMEIPEGAVLRDGAWHYHRGVPPLQPLRLGRTPEAGDYRICRQGRCDALARWIGPPDPERPAVELWACPIRDPSD

SEQ ID NO: 19086 - protein, 550 aa, Pseudomonas aeruginosa
YNVLNFPGSAHDRTGTACPARRCLHGRSPAGLLPRPAAASAPGTSGAHRRRIRRAARSRTPQRRGRPGFPRGTAAMATSPAGAGEEAARQDRRSAGAPGPRRLRLVPGNRRADRPAPPAVASHRHPLHRGERAPGEARTPRAAQLKRLPTVNQRLPVTVLSGFLGAGKSTLLNHVLKNRENRRVAVIVNDMSEINIDGSEVQRDVSLNRAEERLVEMSNGCICCTLREDLLEEVGRLAREGRFDYLLIESTGISEPMPVAETFTFRDELDRSLSDVARLDTMVTVVDGMNFLRDYQEAASLASRGETLGEEDQRSITDLLIDQVEFADVILVSKIDLISSEQREELLAILRQLNAEAEILPMVMGQVPLAKILDTGRFDFDRAASAPGWLKELRGEHLPETEEYGIASMAYRARRPFHPARFHAFLHNPLKQGRLLRSKGFFWLASRPREAGSWSQAGGLMRYGLAGRWWRFVPTGQWPQDEEGLRAIMRHWEEGVGDCRQELVFIGQNLDFAALRAALDACLLDDAEMNLGIPGWQGLDDPFEDWGHAA

SEQ ID NO: 19087 - protein, 348 aa, Pseudomonas aeruginosa
ALPSDLGSGWRRTAPGSVRRSRCRSRRCPADRARWVPWRRGRRRRRPSDTPRRTSPRPSGPAVVAGRSLRGTAWPGCCGSAGRPSRRDSSPGYGRCRLRPGPGPAGRTGRTGTDACEDSIADGRDSSTGPGSPQARTALIHRLSHSGCADASRDTHTPDRRPSGGRQDQPDPLAAGAEAGGRALGGAGQRVRRDRPGCRAAGHGRRRRGHRRGGGRVPLLRQWRAVPGGARSLVASGTAGPAVHRTLRVGTSAGAVETAAGSSLVRRPGPATPGSGAGCRRAGLRPTAAGGTGTGAGSGWHVAAEQIRNARRDAALRRARAPAGPAVALERARSPGIARSADQRCRGR

SEQ ID NO: 19088 - protein, 360 aa, Pseudomonas aeruginosa
LSEDSTSLPFTSPQVALMSPQPSRSPDRFSLAALAEDHPTAPAQGDESESLPCVNAQRGEPNLRVVDCSGARRDEEVAVEEVLIPYAHGSDPEDVPGEPPKSRWWLSSGAAVAMHVAIIGALVWVMPTPAELNLGHGELPKTMQVNFVQLEKKAEPTPQPPAAAPEPTPPKIEEPKPEPPKPKPVEKPKPKPKPKPKPVENAIPKAKPKPEPKPKPEPEPSTEASSQPSPSSAAPPPPAPTVGQSTPGAQTAPSGSQGPAGLPSGSLNDSDIKPLRMDPPVYPRMAQARGIEGRVKVLFTITSDGRIDDIQVLESVPSRMFDREVRQAMAKWRFEPRVSGGKIVARQATKMFFFKIEKRR

SEQ ID NO: 19089 - protein, 546 aa, Pseudomonas aeruginosa
RAAGRITACGYPPWNAGTPEDYAAGVARPRAPVGMPCRRPTVGGCGGVGCRAKKQDGDPKVAVLWIKRPGVCRGHEHEAQSIGRDLRVLLGVLHEHIDQQRAGDTGGDVPVEAALQADALEPQGNVFGGAAEDRHGQGIRQADAQGADLGGEQFGLHHRIDRGVAADDHQRRHDQEERSPPAVDAVQCAEDRVGEDGAEYAEGDQDRPPADLVGEGADDGLQQHEEEQGGSRDHGRIGLAHAYRVHQVLLHVGGVGVEGQGAAHGQADHGQHFLRVAQQGAQQAFLRLFLLLREGLGLFHAATQEHRHHCAQRADEEGDAPAPAFQLFYGQGLLQDDQHRQGDELAGNQGHVLEAGEEPALFLVRHLAQVGGGGAVFAADRQALEQARDHQQDRRGDADGFIAGGQGDDQRAKAHQQHRGQQRRLAALAVGIDTHQPATDRAHQEAHGEDSCGVQQLGGHVALGEECLCEVQREGGVDVPVVPLDQVADGTAEDRLDALRSGAGLGRRGNGVGAFHRVSSFRCCLGCADQGAAHRHIARATYWMAR

SEQ ID NO: 19090 - protein, 240 aa, Pseudomonas aeruginosa
PSAVCRRPRASTRAKPSAKAGGWSAPRARTSHGWWPVSGRTDPEWLRSLRGPPKPPLPPGNGGFFISVGGLTDHSSGAMAEGQPRHLSCARCGYCIKSAPPVAREPVVEDVIEKLRELNEPVPVPLELPEEELLVEIEEELLIGIPAEFREFLLLVSDVVYGRLEPVTVTDPHSHTYLPEVAATAWDLGVPRELIPLCEDDGSYYCVAEDGEVVLWADGDLTDESWDSVWVWARDVWLES

SEQ ID NO: 19091 - protein, 314 aa, Pseudomonas aeruginosa
SRSWRFSAMVSSGSPVAPEAGKASGCSCACSAPFVFDQAVAAIHHQQFAVDEAGFGRGEEGHRGGHLFGPAGTSAGAGQGGLAFFGGARGGGDPARRDAVHRDAALRHLQRQAHAPADQTGLGRAIRGFARVAAAGSGGGGDVDDPPVAALAHARQQAAGEQESAGQVARQGQLPIPQRGRFHCAEGLRAVQLGHAGIVHQDVDPSPLGFGPVQQALHLGFVGQVGARGAHVVTTCAQFLRSLPNPLAAGGDQQAHAFAGQPPGNGETDAEFAAGAADERDLTCPLRKVIHFCDHKIDMENRLSVLSNTVLTFL

SEQ ID NO: 19092 - protein, 421 aa, Pseudomonas aeruginosa
CGRPRLRGLLPGRYRQHVRPFSGADRPGARRAGRERPDHHASGGGCHRRRRAAGAALRPAVLAGSDHRYRRQPLRPALGACDHRSQGGAGFRRLLPRHGRRHPGSLPRRPHRASLRPARPGPRPHPVQPRGAVQRPPGPGAGAGQRRRGRRALRAGDDQHRHGPAATRLPPEAARADPSSRHAADHRRDPHHLHRSWRLYPRLEARAGLHHPRQADRRRRTVLGVWLQRGDGQRHATGQGTCQRAERRPRPQRHGYHAVGQRPGDALYARQPGRGDDRYRLRPHAVPGGASGRGLPQDYPQVRPGLVGDRARRAQRVPVLPATPTRRRGRRGGVPRQPADGLAPVSDQPRHPHHAVPQHDPVLPGHSRRRCRPPALQPRRGARRAARHTRRAGGLRCISPIRGKPASSSPHTPRCAASSCS

SEQ ID NO: 19093 - protein, 282 aa, Pseudomonas aeruginosa
TAAGVAGQSLKRAADWPSVFSTRHRSKEKQMSTPVVLITGAAGGLGRAIAKRFAQSHWRIAATDVDKEGLHALNAQVPLDASGVADLRSADNCHTLMSKILARTGRLDALVNAAGVWREGPVENFTEEDFDLVLGVNLKASFYMCQAAIPYLKENQGSIVNISSDSGRQAYRGSAAYCASKAALTMLSKTLALELAEQGVRVNAVSPADIATPMLDYQAERYGMGNPDGYKRALLKDYPQGKAARFIRPEEVAELVWYLCGPQAEAITGADLAVDFGLSAGR

SEQ ID NO: 19094 - protein, 202 aa, Pseudomonas aeruginosa
KSPRMSARPGAISIMTIENLWPLPSSFASMVSPARPDERKSAMQPGNNQLSMTVLMTPDMANFSGNVHGGTLLKYLDEVAYACASRYAGRYVVTLSVDQVIFREPVHVGELVTFLASVNYTGRTSMEIGVKVITENIREQSVRHTNSCFFTMVALDDERKPVAVRPLELETAEQKRRFAQAQQRRQLRAELEARYQAIREDG

SEQ ID NO: 19095 - protein, 227 aa, Pseudomonas aeruginosa
SWASARSPAAWSIAWDSTVTSAAPTHRCRSRPDMLRRLYDWTLRLAGHPRAELALGGVTFAESSFFPIPPDALLVPMVLANRAKAWRYAAICAISSVLGGIAGYFIGLLLFESVAMPILAFYGLLENFEQVAERYNELGWLMVLLGGGFTPLPYKVITITSGVTQLDLWLFVGLSLVARSLRFAATCALLFWAGPRLKTLIERRLGMAFVLMAVMVVGGLMLGKYVL

SEQ ID NO: 19096 - protein, 116 aa, Pseudomonas aeruginosa
IRRRYAGRRRAAGERGTAPRPGRRPRPVAAGRPAAGVAGARPDRRPPAASRRCRRPCPDSSGALPGLPWDRVPAGSVPFPRSRRGSSAGGRRSCPAPTGWGTGSRRPRRLLPAGSR

SEQ ID NO: 19097 - protein, 176 aa, Pseudomonas aeruginosa
DDFLQLSRRSMGANSHGENTPHSLPAGRTGKLAVPLHRIPLVTLGNLFVMLLLGAAAAWWWRAHGVRERALLLAKQHCAKQGVELLDENVARRRLRLARDHRGQWRLSREFGFEFTVSGEERYAGRIVMYGYHLGAIELAPHRFEAAAEVDNPPVHSAEVIRLDEWRQSRQKKVGD

SEQ ID NO: 19098 - protein, 371 aa, Pseudomonas aeruginosa
NRPSRNGTRGIATWADSSYGAQCNRAPCYRRRFPPPFRSADVLVPSTAPVPAVAAAARRPAAVHGLGGSPGAAAGATRRGRTGAQAAGPLRRLAADPDRTLPQPAGGTGAGSGPARGAGRADRRRVAAAPQPQAGKHQPGRPLLHPGAARPYRAGRGGEQLEPADQLRGPQLRFPSLFPPDHRPRLRTFLCGRGDQRDSRLFPVPRGARRGRQLPGRNRGQAGVSRSGTAVEPDPRPGPGQRRQGHRVPRQPRRLALPRTGTAGYRGPLRTGGDPAIRSPAPDTPAPPDLAQLRRRQPSGAGGKRRRREGLPLAIAGPAQRRLDPPLAARHREHPGRRRHRAPGRRRHLAGAGLPRLVPAPALAYRPPAAT

SEQ ID NO: 19099 - protein, 452 aa, Pseudomonas aeruginosa
HERNDMSDQVIFVDDEATIREAVQQWLELSGFEVRLCLRAEECLGALDKSFAGVVISDVRMPGMDGLQLLANLQAVDRDLPVIMVTGHGDVPMAVEAMRQGAYDFIEKPFTPERLLGSLRRALEKRRLVLENRRLKEQASLKDQVDARLLGVSKPMEALRRQVLALAPTPVNVLIRGETGSGKELVARCLHDFGPRADKPFVALNCAAIPEQLFESELFGHESGAFTGAQGKRIGKLEHAHGGTLFLDEIESMPLAQQVKLLRVLQEQQLERLGSNQSIHVDLRVIAATKPDLLAEARAGRFREDLVYRLNVAELRLPPIRERREDIPLLFEHFASVASQRLGREPQPAAPAELARLMAHGWPGNVRELANAAERHVLGLERGDAEEGGGLTSGLAERMEAFEAECLRQALGQCRGDIKAVMELLQLPRRTLNEKMLRHGLSRSDFVGEEPA

SEQ ID NO: 19100 - protein, 443 aa, Pseudomonas aeruginosa
GEHVRCVEEGPADSQRQHRHQVQADVRRLVARMDPGQRARQPAVPGHRVEQARDRCLRGDRHGDTPGQRGGYRGQHRQPLATGRFGDLVEGGVRRLEVHPGGEVGGQPGLRDEDAAHDEQRDQRGAADLPGGIALDLLGEGGDGVEAEERQYGDRGGLHHQAEIEGFRAIQRFEGQPAVAQAAFQRLVADHQEDRQHHQLSDQEQQVGAGGEGDAAQVDQGRRDQEQQHPGQLGDRREQVVQRQRAEHVEQRRDQQVVEQQHPAGDEADMGVDAALGVGIHRAGNRKGLGHGSVAEGGEEHRQHAHQVGHRHHAVGVGMDPAVDPERGDGDHEDHPVDDQVAQGQAAAQLLPVSELFDGHDGLLGKRQRIVVIGAAREAGLFLVVGDRRRRSSHQSQGYRRSAQAYTASGVRNPSLRISSSTASRPRASPCTGTVVSSAGSIA

SEQ ID NO: 19101 - protein, 471 aa, Pseudomonas aeruginosa
MPSSGLSVKLGIVAAQVVVGKARRQCQFVALHGEVSVQQRLWQLGAERLVALQAVERIAEGRRQGLDAAGLALFVAEAVRIDIGQGAQRQASFDAQAAGDQHRGHRQVRTGGGVHRPEFQVVLLAQRLAADAHHRADAQRRFAVAQSQAGVGGAPVVGFQAQVGGGGRRGQRAQRWQVREHAGGPVLAEFGEIVGSTGLVQQRAAVGMLQAQVQVHPVGHRAGCRQRCEAGTQAHLPRHFASDLADVHRAVGGGHALRRAAGDLVLALAVFGEEHLRLGASLGQGADQPAGELPGGTLGLQRKRRGRTLAGQAEQAEFVFERRDDLQAAVAIAFHLGPQQAARAGRPRRAVGFHQVAVQVVERRRSGVGTLLDAHPAVRVGQQAQVAVAAPGAALVDQVLRGQRAVRRYPAATAGQLLLQGRQGQRTPAGDAGQVGGDEADQAYRLQAVHRLLRPRAAMRCRTVSVSLIQQ

SEQ ID NO: 19102 - protein, 69 aa, Pseudomonas aeruginosa
TEHFTLLSYALLIFIGDEKSLKWNKRLVRSRQALSAAAGAGPVSIPGGKYQSGWLVGLYDMAEMQVEIG

SEQ ID NO: 19103 - protein, 399 aa, Pseudomonas aeruginosa
ELLHPRQELVGNQRIVAVPAHFDMHPATVGDDIRGHRVEHRTEAALAGAVEHRQGHGAAGRLRIDQVGSAGQRLQLAAGRRLDDLLHLLLGRLLHASGLLGAGGIDLGAVDRTVQPGGQRRRFGHQSAGMAEGAGGGVEVSLTQRGFPALHVGLGQLAAERFDALVAGGCAAQGQPLLLGLFELAGGQGLLQFGIGIGGLRLGRDHRRRLRRRIALAGADQQRRRQDGQQAKEGRHHSCGFSFGQKIARFYTVRRGRTKLSRNRPAALTTIEGPAGVSLNQDRARPAHTATSPSRLAPTAICSGLRAWRWAAAAGMISSEVISSTPTIFIATAMTMAISNISARRIAPTGRPSTFASSSCTVIASSGRQRKQISARTSALPAIIHSRSLALTASRSPNR

SEQ ID NO: 19104 - protein, 229 aa, Pseudomonas aeruginosa
LGLAQQSAGQQHALQFATGNALQRALQHVRRADLAQRRQRLLAPDPGYQAEEAQYAERQGGVDVEFLRHVADGQPRPSPDLADVRLEQAEHAAYQGGLAGAVGADQGDDLAGLDGQVDIAQHRLAVEGHADLGQPHQRVVHQASFWSRQVPQRPTTSTVWLSTAKPTLFAPATMARLISGCSSSIAVWQVRQMRNWPWWLCSGLLQPTNALSEAMRCTRPFSWRKSSAR

SEQ ID NO: 19105 - protein, 144 aa, Pseudomonas aeruginosa
PASNRCNWSPRPSRTASASRTYCCRRAPRRTSTPCVLPTYGGCARCNCSTGSARTWRTSCPRCSPAARAPASRCRTCRACTCASSSISRKRSMPGTTSTTMTIVPACSTPTSGCCRPTPAPSPRGWPRTWPRSTRPTPGATGPT

SEQ ID NO: 19106 - protein, 734 aa, Pseudomonas aeruginosa
MLRTVAGFGRPNNHREVNQRMAKTDARSPRTERGTIALQDASQDIWDKKYRLKSKDGTPVDASVDGTWQRVARALADVEEKASREHWYGRFLWALRNGAIPAGRIISNAGALGHKPATSTINCTVSGTIQDSMDNILEKVHEAGLTLKAGCGIGYEFSTLRPRGAYVSGAGAYTSGPLSFMDIYDKMCFTVSSAGGRRGAQMGTFDVSHPDVREFIRAKREDGRLRQFNLSLLITDQFMQAVEQDADWPLVFPVHVKERDEIDLDDPNAVVWREWPIQDDYVQRADGLVACKVYGQVRACHLWDMIMVSTYDYAEPGFILIDRVNELNNNWWCEAIRATNPCGEQPLPPYGSCLLGSVNLTCFVEQPFGDEARFDWDRFREVVRVFTRMLDNVVEINGLPLEQQRQEILGKRRHGMGFLGLGSTLTLLKLRYGSPEACVFTEEVAREMALVGWEVALELAREKGPAPILAQDYEVTAEMLRKRPEMAADGYKAGDRIRGSVLHAKYSRYMQRVAEHAPELIEALAETGARFTHHSSIAPTGTISLSLANNASNGIEPSFAHHYSRNLIREGRKTKEKVEVYSYELLAYRTLVNAQALPDSDDPARRLPDYFITADSVTPAQHVDIQAAAQKWVDSSISKTANVPTDYPFEDFKDIYRYAWHQGLKGCTTFRFNPEAFQGVLVKESDLEKTRYRFELEDGSVVEFKGNEQVEYDGEIHTAANLFDALKEGYYGKY

SEQ ID NO: 19107 - protein, 159 aa, Pseudomonas aeruginosa
SPGRRASSRSRRCRSRSGRPGAGRRTARCRGTGRHAGWRAAALDARHPARRSPPGPGRAGRGPVPVVAGRGWHLVPASRAGHGRSGVRGCARGWRREGGRADRPLPGSGGRSAAARGGRPGAVAAAPACLRDGAGPRRRGCAGRRAPAGRPRGARRAVR

SEQ ID NO: 19108 - protein, 937 aa, Pseudomonas aeruginosa
PCSFIESSRVHSTRPGLRKRLIPLMSQAPLVLVDGSSYLYRAFHALPPLTTSTGKPTGAVKGVLNMLLSLRKQYPDSPFAVVFDAKGPTFRDELFAEYKANRPSMPDDLRVQVEPLHASVRALGLPLLCVEGVEADDVIGTLARSSAAADRPVVISTGDKDMAQLVDGHITLVNTMTGSRLDVDGVKEKFGVGPELIIDFLALMGDKVDNIPGVPGVGEKTALGLLTGVGGGLEVLYASLDKVPELPIRGAKGLPAKLEENREQAFLSYQLATIKTDVELDVEIDKLYPGEPQREALIALYRELEFKNWLDDLLREAKEAGENGEAETPIQAEVDYDVVLDQAGFDAWLKKLEEAELIAFDTETTSIDAQQAQVVGVSFAVKEGEAAYVPLAHSYMGVPEQLDRDAVLRALKPLLEDPKKLKVGQHAKYDINVLANASTPIALRGVAYDTMLESYVLDSTATRHDMDSLALKYLGHSTIRFEDIAGKGAKQLTFDQIAIEQAGPYAAEDADVTLRLHQALWQKLEAIPSLARVLTDIEMPLVPVLARIERNGALVDANLLGIQSRELGEKMVALERQAYDLAGQEFNLGSPKQLGAILYDKLGLPVLSKTATGQPSTAEAVLAELAEQDFELPKVIMQYRSMSKLKSTYTDRLPEQINPRTGRIHTSYHQAVAATGRLSSSDPNLQNIPIRTAEGRRIRQAFVAPQGYKLLAADYSQIELRIMAHLAKDDGLLDAFRHDLDVHRATAAEVFGVPLEDVSGDQRRSAKAINFGLIYGMSAFGLAKQIGVERKEAQAYIDRYFARYPGVLAYMERTRAQAAEQGFVETLFGRRLYLPEIHSKNGAMRKAAERTAINAPMQGTAADIMKRAMVAVDNWLQESGLDARVILQVHDELVLEVREELVEQVCEGIRPLMSGAATLDVPLVVEAGVGSNWDEAH

SEQ ID NO: 19109 - protein, 939 aa, Pseudomonas aeruginosa
RFAGAARRRPPAPSQLQHPGRYQHRALPPLPDPRLAAPAAPRGAGDQPEADRRTARRLRPRRPPGSRRRQPAFRLRQSGRALGPVGGVPLLVPAAQPQPRAYRPAQQRPAQPLAADPAGRSSVARSAGTRRDLRALWRRRRRAGGSDDASRSRRSHPHPPARLYPRADRRLPPSGADGRHEHPRRRSSGKLAPARPRPDGAAGRGDVSQLAAAAQSRSHPAQFRSRSRAGRRARPADLRPSAGIGGDSPAGQPARQGLGRARGCRESAMSRDDVQRWKDKYLENIEQQERLQRRWDARIDLLRRGLVRSSLAAEGSDKAVDQCMKELREILRRDDMDAGLSGLIPRLEKAVLDSEQRRQQRTQQNIDALGELAQQLLALDLPRELRKPLKQFARDIEERARQSREIPILLSELSRLQRQALAERKGGDAEDGRPSLLQRLFGGKESETTAEPSASVPSVVAASNTPIQPAAAAPSLPVAEHDEAPGGPPQPLPACTVAAIESAPAGWVGVAERGEPNQILLDEPREIWLDSLPLPAGLSFSETLEEAGAEPSPAMPADVESAPEAPATPVDNLDGQAVDEAYELPPPIPEPGYSAVAPHIEASLLRLLDGLSLPSSHQPQAEALRERIDGSLNWYELVPVLDDLAVLVLSLADSGQRDFEEYLRQLNERLESFLGHLGDAHAGYTDVLDNARGFDQSLREQVSGLQASVQQATDLNSLKLAVDSRLNGLLASMDEHQREQAEHEQEVSGRLQALMERVNSMEQDAKAFHSHLEDQRQKALTDPLTGLPNRAALSERLEQEVARRHRDGGDLLLAVLDIDHFKRINDDFGHLAGDKVLKIIAGELRKRLRQADFIARFGGEEFVVLLPATSLEAGRQLLERLRAAIAACPFHFKGEPLSITCSAGITAFEGNEAGEAVFERADQALYRAKRAGRDRLEVA

SEQ ID NO: 19110 - protein, 236 aa, Pseudomonas aeruginosa
RATSAHSDDSGRARLQVLPRLARMVPPGRMTGCPALETPMDMFGVAVLIFLVTDPFGNIAVFLAALKGVAPGRRLRVAFRELAFALGLLLLFLTLGEHILSGLGLSREATGIAGGIILFVIAMRLIFPSPQGLLGEVPDGEPLLVPLATPAVAGPSALAMLITLRTTFDGPLWELYLAVVLAWAATALILLQAAFLQRFLGPRGLTAIERLAGMLLIMLSVDMLLDNLRSVLHIAA

SEQ ID NO: 19111 - protein, 268 aa, Pseudomonas aeruginosa
PRCLSFGVIMRSFVLLAFTLSLLAGCSSGPRLNTDYTSANQDSRVQFIVLHYTSTDLPHSLGILTHGGVSAHYLIGDDEPATVYRLVDENRRAWHAGVSEWQGRTWLNATSIGIEIVNQGYRDTPQGRVWYPFSEAQIQALIPLLKDIAKRHGITPDRIIGHSDIAPGRKVDPGPLFPWKRLADAGLVPWPKPGELARRLAELNGQLPDVRWFQQQLARHGYLVPQTGELEKDTRDVIGAFQMKYRPARFDGEPDLETAALLLAVPTS

SEQ ID NO: 19112 - protein, 382 aa, Pseudomonas aeruginosa
LAYVARPGVLPHGLAGGFAEAAGGAAVVLDEAGEETFGQAEDILGAFAQGRQVEHDHVEAIEQVLAELALGDHRAQVAVGRGKDAYVGAAGHRIADAFVFLVLDEAQQLGLQGQREVADLVEEQGAAVSLADPAQGAFGGTGEGAATVPEQFAFHQFGGQRRAVDGDLGLLRAFAPGVDGACQFALAGAGFAEDEDVGVGRRYLARGLQYRGHGRAVRFQAVALAAHFVLQGLQARGQLAHLQLLGGGQAQLVRAAGLDQVIHRAGLHGIDRGIHRRMRGDDHHAHPWRLDAHLGENVEPVVFAQAQVEEAQVEYLALQQGLRLRRAAGGGHAVAFVFEAITESAQDRRLVIDQQDAPLFFGSGFHRCFLSSREFTAIRLLG

SEQ ID NO: 19113 - protein, 90 aa, Pseudomonas aeruginosa
GSHGLPEEKMDTGRFATPMGPAPRRYRQFRRHTGENIMLSWAITFLIIAIIAAVLGFGGIAGAATGIAKILFVLFLVLFVVSFFFGRRRG

SEQ ID NO: 19114 - protein, 162 aa, Pseudomonas aeruginosa
PDAKEKAMRLMRNLMNALLLGAAASSLAVAADRDGEYRLNELQSTDAGYRKAWQNLVEDESRLPDWVMNLSGTATPMHAVDDQGDKYLVGGLCEKSDCKGQRLLVAFDWDKSHAYGLYVQVPEGLPQDKSPSKHASFRWLGKPEPAVQKILDEQLKADPNWY

SEQ ID NO: 19115 - protein, 259 aa, Pseudomonas aeruginosa
RCCQGVSETMFKVTHMIMKYAPIGVFALIAVTVANFGFASLLPLAKLVILVYVAIVFFALVVLGLIARMFGFSIMRLIRIFKDDLVLAYSTASSETVLPRIIEKMEAYGAPKAISSFVVPTGYSFNLDGSTLYQSIAAIFIAQLYGIDLSIGQQIMLVLTLMVTSKGIAGVPGVSFVVLLATLGSVGIPLEGLAFIAGVDRIMDMARTALNVIGNALAVLVISKWEGMYDAAKGQRYWDSLPHLRQAVGEAKGKQATLE

SEQ ID NO: 19116 - protein, 452 aa, Pseudomonas aeruginosa
RTRLRGHRRRHGPLPRVCLSVCPMASNKSKGFAIFRVVSGNFLEMYDFMVYGFYATAIAKTFFPGDNPFASLMLSLATFGAGFLMRPLGAVFLGAYIDRHGRRQGLIITLGLMAMGTLLIAFVPGYATLGVAAPLLVLFGRLLQGFSAGVELGGVSVYLSEIATPGRKGFFVSWQSASQQVAVVFAGLLGVLLNQWLSPQDMGEWGWRVPFFIGCLIVPALFVIRRSLEETPEFEARTHRPSLSQVLRSIGQNFGVVLAGTAMVVMTTVSFYLITAYTPTFGKNELQLSDLDSLLVTMCIGLSNFIWLPVMGAFSDRIGRKPLLLGASALALLTAYPALSWLVREPSFAGLLGVELWLSFLYSSYNGAMVVALTEVMPADVRTTGFSLAYSLATATFGGFTPAVCTWLIHTLDNRAAPGIWLSGAALLGLLATLVLFRRRGKEIAEAELANA

SEQ ID NO: 19117 - protein, 420 aa, Pseudomonas aeruginosa
GCAAGRRRRPGGFRCGRYACPTPAGRRQRAGRAVSAWRGPPGTTTNGQPRARFRVRCAAEPGQRRQRPRWKGSVQASCNTNVIFGQAPPAGVRLGSPSGRAPTLHSSVRAGKRRRFFRLPFDACVCATGHGISRQEGYPLHLLKSPGLEGYRGVVRMRFSGISGCLSAAVLALGVGGAPVVQADALGDSLEQAHIRKATFAAPAWEGYTNADGSGLYWDLLKQVYAPYGLDVKFINMPWNRANKLMTAGSMVDGVPGEIPGVEGKLYAQLPIDIEYHGVMHAAKTPFSGRASLTGKRVGWRHSYNLIPAEQRDFTLVECVRPERCTEQVQNGELDFFLDEPDELEKQRSEAHLPADAYPIAQLPPGKESFMTFADSASGRLLREVYDARVRQMAASGELRALYQRWNSEVPGAVQALSAQ

SEQ ID NO: 19118 - protein, 368 aa, Pseudomonas aeruginosa
PPAHRPAHSRTLALRRLGTARHQPQPGGAGTGRWRRRLAAPQGRHPGRPGRAGDPRLARRLQLPGGACAERAEPVLPGPRRRSQMAARRVSGASGGALQRRPVGPYAPWQQGDLWRPPTDLRGSAGSLQGYRLGGRRAARSRPAAPGRPPEAGADLQDPWGVLPMILLQLSAAQGPAECCLAVAKAFERLCLEAAQAGVEVEVIEEVAGERPRTWRSLLLGLRGTAAEALAERWCGGIQWICPSPYRARHARKNWFIGAERFAAPPASLEGEIRFETLRSSGPGGQHVNTTDSAVRAAHLASGISVRVQSQRSQHANKRLAILLIARRLADQASSAADALRAERRRAHGRISRGAARRVFRGERFEPA

SEQ ID NO: 19119 - protein, 493 aa, Pseudomonas aeruginosa
GRRRRVLSSWASLQHEEYADQSGAGKQRLQGNDARHQVAVAAQLAGQHIGGGRRRQGEEQYQHGAFHARQAQPASDGEGQKGHRQQPRRAVPAKGRDFAAEFLGFQRRADAQQAQRQAGHRQQVEQAIAAAGQADAGQVDQCAGEAGEDQRVLQDRQQQRAQADAALGGQRPDRHHVHRRHHQRQHQRGQGQARLAVQAADRGQAEIGVEAQYALGDGAEAPGVPAAPALAEQQGEPGDAEPEQYGQGLAGQAGVVQRRGRQVAEQQRGKQDEVVQAFCGRPEGFAGKVPAAQGVTADDEGEQRPEGVEQSGHGHPRIVESAHLARWLRHRASPAYAGTPARRIRHARDPYRRLPLRLSALRRRRAAGRCRSLPLLDLPAHHRRHRHHLGHGAARGVPLAGGRTGGICLVGQLHALLLPALRGQPGVVHPAQRRYPGLHRGQPRPSRARPRQPAHLGRQPPAMATPRPAVARRGRGVHRRSGRPVSEDRRWHL

SEQ ID NO: 19120 - protein, 780 aa, Pseudomonas aeruginosa
RRALSAVCEALKERSGPCVLQAPPSGQHQPAGRLVQLAQVRADLLDVGLVGFQLGAALGIEQGADLAVEVVAEPAQARLAFAGLLFQVLPLGGLRQAVAALQEFRRTTEEAAVVEDLLEGLAGHFQALVAGRLVQMAEVQALQLVLGEQQLAPQRGLLEQQQRRAGAQVGLGEPGLALPGRQRQPVLDLVLGNVQALLEHVEHRLVAVAEGVEAVAQAQGFLGVVEHTGIGQLAVLQHLEHAVGGDAVQALQRSPGDAAAQQLEGFHRAIVGDEVVLAVVAPVTLRGALDQAGDLLAVQLQRHRGEAAQLDLGVFLDHLRQRQDEQARRIGAGQAVPAGQLQVADEGAVGQHQMLVEVQPAVRTTRPAGGADHQAEHGVAPAADQVVVGLGQQVVDLVDPLGVELAQRLLAEVAAGVEVGEALRTGTVFRRPAEALLVVAVERRAAAGVAGIEEEVLHVHRDELARIAQLVDVRAAQYEAIVRLAPPALAGALRPAGEIEQARVVGEREAATALPAAIGGLGDPAEGFFLARAAADLAFFLRRPQARAIVDVGQLVQQGRQQLAPLGAVHAPGLAAGGAAVGEIGQVLAVQRDALRATGLAHAVGGQVVAPLDLDLAVQAFAEGRRQLVRGFVQELLAGLALRRVQFRRVEFQAQGRRRVAGSAEGQRQQPGAGLPHRARMASASTWSEASRASGRRLRRVRIAASSWAPRMAPSLATKLAASSRASVTTFMSRTEVVVSEVKSMLRSRARTMILLVATTERASAAVAQSASSRAANRGL

SEQ ID NO: 19121 - protein, 506 aa, Pseudomonas aeruginosa
RSPKRPGGRRRGWRRLRRSRDRAGCPGRRWRSRRAVRRFRCGTSHPAPHRADRTCVATPARSPQRDGNASVGAGRGSCRDALQGGGVALCRFVEEATQALHGQLAAAEAFEAGAGMRGHACVALRLLASDLETGPVGPAQRLPVGDVAQRAVGRARVVGPGGGFFRGVDDEGVVGVDVVDHRGIARSHGRLAAGHEFHQRQALAFAVGGVHHVAGGLDQPLVVRVGEVAVDQHDAAAVGLVLVQVVKHVGQRFADVVVGQFQHQGGVGLVAEGGAERADHVLPVLAPVVGVEHRGVDDPVEAQLDLFRRAVRQGQDLRRRLGVGMDGQVQLAAVHQQAVQAQAHIPGFGTACLLRGAVGEAIPDRRRHAQYRVVATHGGAHHVDREAGVGDGPSAVAQHMSPVVARFAVPGFAGQGAELPGEHRDGRAGMVDRRAMGRREGEEDAGFAALAAVVVEAVHQFVGIADFDHLADLFQQRTEFLEDEVIAVLRAPEVLPDGGLVGPRSG

SEQ ID NO: 19122 - protein, 546 aa, Pseudomonas aeruginosa
SAWNVACGGGRQFDAGRRGCLAGGKEGFQALADHVAGAVAAHALVGRGGQLPIALRLFPGYPVALQVGLLQGLPARPVAPGAVQPARILRPGRGLLAGADHEAHLGVHVVGHRRMVRSDRRGAAGHEFHQRQAQALAARGVHVVAGGSVQAGVLRGIEIAVQGDDPAGEWRQLGKQGEQFDVVGRQVALGHLQHQRGIAGVAECPAEGGDQLMPVLAPVQRIEHRDVDHPVHDDLLVLVDGRQQRRRMLGLGGRHRLDGLGQWLRQRFQRRWRGRQRPAQVTEQPAAYRYGYQVADGFPVPQQQVVLADDQSAPPVERNRLWLWFWLRDRFGLGLGGRLGEDLEDLVLGLFPDRCDEAVGGKAQQAAVDDAALELQGLAGLDRIPFALLADRGEVLPDRRRQRQYRKIFAQHPANRAGSLLGEGDGCAMAGQDLAPVLRRIAVPRHVGNRLELPGDHAQHRALQAPRRLVRRGEGEEQAVFALFMQLPVERVDFVRALYQVDLSQRFEDWPVGLEDEVVAVFGATEVVADRALVDIRVKDEIHGIS

SEQ ID NO: 19123 - protein, 161 aa, Pseudomonas aeruginosa
RTAEAVHAPARWPDPAGQDLPTCRRATGRAWRNRHGDQPRALLPEQGPVPGGPPGAAPRTFHPRTDRAQHRSGDCRRRPGAASRTWRRGGTGGDAGGSPDPQRGGLPRGGGACRASRRRRAPGYLRRGAGRSGNRFRLYRAGRPAGRAGGGQGAPLRRETR

SEQ ID NO: 19124 - protein, 435 aa, Pseudomonas aeruginosa
HLRAERRAPGRHGRGRRPGRGGYFRCAADRPRRPGPGGAQGGAAAEGRAARGLSAASDRQPSLGQLYRPRGGAALQDQANRGQAGRALVAADAPSPQRALDRGARHGQGHQWRWRAAGQQQRVDLHSRGPPASPGKPGGHRPGDDRGAERRIPGRGRHRPLRGPVRQGGLMLLGLSRSLWGYRGFVLGSVKREFQSRYRGSLFGALWTVLNPLSMIVVYTVIFSQVMRARLPGVDDGLAYSVYLCAGLLTWGLFAEITSRSQSMFIENANLLKKISFPRICLPVIVLLNAGVNFAIILALFLGFLALSGRLPGAALLALVPLLAIQVLFAAGLGMILGVLNVFFRDVGQLFGICLQFWFWLTPIVYPIGILPEGIRSLIELNPMTALMRSYQQLFLHGQWPDWPSLLPITLLALLLCALGLRLFRQRVGEMVDEL

SEQ ID NO: 19125 - protein, 621 aa, Pseudomonas aeruginosa
ACRGWTRTWTATSNGATTAWSSMSSTTARKTSSVAPGWAPKPISAAPARRLWTPLPRRALHDASVGRMHLCVRASQGQFRYSAGGAQRHPRVAGSRRDGGVHPGGNARRHPVSGPQPGAAGPAAAFAAGTPAHPGGASRQLLLAGPAHPGKAPPVPFLAVGPAPSLCSLPPVRFRLPQHSAAPARPHPRQAAACTRARDPARTSGRRPTGLAGLLLARRFLPAGGTPQERGCGHRLGDLRPDSPDPSAILRCRPGQGVQPLVRLDRGHRRRLRRDFRDHPRRSARGDAAAHRPGEGRATLVRLFPPGFGAGPGGGRRLRRARSAAHVQGQGAGIPDGQHHRAAEEPRLPAGCLRACLGPGFAGAVVHRRTHRLEVRGAGGTGAAASGAEQAPVHVQRPLRQEPGVRILPCRIAGLPVLCGRFRPAAGGGHAARPAGDGQRHPGVPRDRRRIHGLLRPRRSADPGEPGHPLRSHGRVPGRATGRRMALDRLARGESATDRADPARPRQGPGAWRGSTCGLRLTRGFSRRRGPASGITWSSCWARCRRTRTSSFPCSMAGAGAATCRRRRCPAIRVCRPGCATCPEPTGHDAGWSSGVSIAVGRRSISTMSPVSGRWTSTGRC

SEQ ID NO: 19126 - protein, 265 aa, Pseudomonas aeruginosa
MSCRPSRLVLWARLISTMTCLAKIAKLAELPTEVVGTMWPCSVIAAASMTAMSGSFSWWLRNCSTVSERCWSMNITSPALIALRRVLSTWNGMRRASTPASVSCLSRSLPRLAPVIRLIRSGRSLARMASAWGTALASPARVKPLMPTVMPSWIRSAASAALITLSSRGGRRTRSRYMERTSDDELLGARQSRVSAIFRLYTKVEAPFRGFIGGLPGPPRPLSPGATPSLWRKSRAFAEEGPAEQCHQHHAEFVPPAPLGTPGRA

SEQ ID NO: 19127 - protein, 590 aa, Pseudomonas aeruginosa
PVAGLGRARPDPAGGAAGGRRADPPAGAGRAAATLPDPGAEPAPGTRQRRGRSAQSQARPGGRPAAPGRTRAARRPRRLAAPGGGAHRGAWRDQPGAQPERGAPGHGPGGQRTGVVGLGPGERPGPAFLSRGGLQRRRGRSRGLSQADRKHPPRRPAAHPSRPRRTSQGAQRAVPGGVPRARPGGRLALAGGSWPGHGSRPAGTGDADARHAQRHQRAQAPGRAAATGRDSVRGGQREHRDPRSGLQPAGGQPGLQSHHRLSPRGRGRAQRQPAGEYPRGPAPLPADPRRAAPARAVAGRTGGYAEEWRSLSPMAAAQPAARRQWRGDPHRRFLHRSQCPPRRRGAPASPAALRRTDRPGQPPVVPRAAARGGPAGAPGGGRAGPAADRPGPLQAAQRQPRPRGRRPVAQGDGPAPAAHRAGSQHPGASGRRRVRHSPRWRHRHRGPVAPGRTPAGPVAPAGERARPRVDPRRLAGDQPVFRAGTGNLRADEPGEPGDATCQATRRQYLPVLPRQPAGQHPRTPAPGNPVAQGGRGGPAGRALPAQAVPGQRPPGLGRGAGALAPSGGGHDPAVDLHRPRRGVRVDRRDR

SEQ ID NO: 19128 - protein, 266 aa, Pseudomonas aeruginosa
PVSSSATSRLRCCWRWPTWCRCAPTIRRPRAASPGKRCRPNRPASPRIPNCSPTCRRPIASMSTRTRRRPSKRCRKRSAASTTSASASRPCAGWRWSSRRTGKPPRRSGWNCCRRPRSRTRRASCSWPWRSTTSAAASWKRSSPKVRRSRSRCCAASSCATSPTPRCCAARPSRARRRKSAIPRCSLSFTRTCAAAASPTSARTSRCSAKPPRRPSWAPASAMSTAPVTAWSCSAGRATRPSPATFARPSPSRPRRWPPMTRTRRA

SEQ ID NO: 19129 - protein, 188 aa, Pseudomonas aeruginosa
GLGGVPRPYPALDAADLPGRAEPGAALEACRQPGGRHPDRLRCAYPLPRRVRRFPPRPAPAPAPRIPLEHHRVARLGQQRRAGGDQPAQGRGRRSGGADLPGAPQHSQPRRLPPAGQPPATAVPDRPGPGRRLASPRLPGKEPLVQGLRGVPAQPSVSAAASALAGTPAAAFGLRLAGILAGLEIAHQ

SEQ ID NO: 19130 - protein, 482 aa, Pseudomonas aeruginosa
RVAQVQAFRQRQVDHVAIARRHLDGLAGGVAQVLHAQAQVASRSHQFDAVAALEAVLHLHLGQSVAAFAGEFADELLALGQRMAVLVVLVLVVHVAAQEALGVAAVGEGLHGVHQAAVERLAGRRVVDRLAVDLGGARHVVVGFGAALDLQRVHADPRQPLDVLHGAEVLGIHDVGAVFVLEGGHRFAGTVAFLEEEHLLGRRAASQGRLPRHHVAQLVLAALHRLVFPAAGIGAGALVGVAAVDVAGQQAAPGIGHAQGAVDEHFQLHVRHLLADFLDLLQRQLAGKDHPGQALLPPELHRGPVHRVGLHRQVDGHLREMLANQHDQAGIGHDQRIRTHGDHRLQVAQEGFQLGVVRGDVDHHVEALAKCVGLGDAFGQLGVVEIVVAHPQAVARLPGVDGIGAVGEGIAHAFQGAGGAQQFGAEGGGGHGSGSQRRGRATLAERAPGDPEPDQCPRHSSQRRPCSSSSSCACSGPLLPAG

SEQ ID NO: 19131 - protein, 75 aa, Pseudomonas aeruginosa
YAGTSWPPILPAAYWPRTVLSCTSSPEIGFSACSTLSFSLRTASASKRTGASIATRQSNWSRWFCTMSRIAPAWS

SEQ ID NO: 19132 - protein, 306 aa, Pseudomonas aeruginosa
YNYKVTTENRAQPVNLLQHIAQSRQQLRKSELKVADHVLNDPASVMHSSMAELAHGVGVSEPTIVRFCRAIGCSGFQDLKLKLAQSLAAGASFGQFSIHESDSVADFSLKIFDTTLHSLMEVREHLDTHALERAIAAIAHAQRVEFYGFGASGAVASDAQHKFFRLLLSAAAYSDPHMQAMSAVTLKPSDVAICISQSGRSKDLLITANLVREAGATLITLCPSQTPLADLATVNLAIDVHEDTDIYTPLTSRIAHLVVIDVLAMGVAMARGPDLVNHLKSVKRSLRSLRLSPKVMKNQEERGEPS

SEQ ID NO: 19133 - protein, 317 aa, Pseudomonas aeruginosa
CSRPPPAAAVAASVAATAARSWNRRSPRVISEATKAFGSAEVFLEKCIVNPKHIEAQILADSFGNTVHLFERDCSIQRRNQKLIEIAPSPQLTPEQRAYIGDLAVRAAKAVGYENAGTVEFLLADGEVYFMEMNTRVQVEHTITEEITGIDVVREQIRIASGLELSVKQDDIVHRGYALQFRINAEDPKNNFLPSFGKITRYYAPGGPGVRTDTAIYTGYTIPPYYDSMCLKLIVWALTWEEALDRGLRALDDMRVQGVKTTAPYYQEILRNPEFRSGQFNTSFVESHPELTQYSIKRNPSHLAIAIATAIAAHAGL

SEQ ID NO: 19134 - protein, 612 aa, Pseudomonas aeruginosa
GKEQNMSNTIQAKKTGVTDTILRDAHQSLLATRMRTEDMLPICDKLDRVGYWSLEVWGGATFDACVRFLKEDPWERLRKLKAALPNTRLQMLLRGQNLLGYRHYSDDVVRAFVAKAAVNGIDVFRIFDAMNDVRNLRVSIEAVKAAGKHAQGTICYTTSPVHTIEAFVAQGKAMADMGVDSIAIKDMAGLLTPYATGDLVKALKDALPLDVVVHSHDTAGVASMCQLKAVENGADRIDTAISSMAWGTSHPGTESMVAALRGTPYDTGLDLELIQEIGMYFHAVRKKYHQFESEFTGVDTRVQVNQVPGGMISNLANQLKEQGALNRMGEVLEEIPRVRADLGFPPLVTPTSQIVGTQAFFNVLAGERYKTITNEVKLYLQGRYGKAPGEVNEQLRRQAIGSEEVIDVRPADLIKPELNKLRSEIGNLAKSEEDVLTYAMFPDIGRKFLEEREAGTLKPEELLPILTGKGVAAAGAEGTPTEFVIDVHGETYRVDITGVGVKSDNKRHFYLSIDGMPEEVVFEPLNEYVAGSASGRKHASEPGHVSTTMPGNIVDVLVKEGDSVKAGQAVLITEAMKMETEVQAGIAGTVKAIHVAKGDRVNPGEILIEIAG

SEQ ID NO: 19135 - protein, 465 aa, Pseudomonas aeruginosa
CSPFFIGIGCRVGRLFALPGCARRARRLECRLCPTARRAAGADYREVQVSSSPAQTPSRRPSLLGGSMIIAGTAVGAGMFSLPIAMSGIWFGWSVAVFLLTWFCMLLSGMMILEANLNYPVGSSFSTITRDLLGQGWNVVNGLSIAFVLYILTYAYISGGGSIIGYTLSSGLGVTLPEKLAGLLFALAVALVVWWSTRAVDRITTLMLGGMIITFGLSISGLLGRIQPAILFNSGEPDAVYWPYLLATLPFCLTSFGYHGNVPSLMKYYGKDPQRISRSLWIGTLIALAIYLLWQASTLGTIPREQFKGIIAGGSNVGTLVEYLHRITASDSLNALLTTFSNLAVASSFLGVTLGLFDYLADLCRFDDSHFGRFKTALLTFVPPTIGGLLFPNGFIYAIGFAGLAAAFWAVIVPALMARASRKRFGSPLFRAWGGTPAIVLVLLFGVANAVAHILASLHWLPEYR

SEQ ID NO: 19136 - protein, 242 aa, Pseudomonas aeruginosa
ATGSPCQGLVAQRLQRLPLAAFGVEVGRIEPALERRLSRRPFAVEQGEPGGVAVALLDHHVLAEGAFVGEAQALGGAHRTGVAGIALPLQAAVAEAAEGEFGEQVDRLGRPRCALHRRAEGDMADFDDAILRRDPQVAEQADGALRAPLAHGEEQRVAAGRLAGQPGVERRALGERAVGQVFPQQRVGARPLQGVPQVVAVALRIERFELDEAAVERGVGWSGDGAPVQGFAHGGPQRILRY

SEQ ID NO: 19137 - protein, 520 aa, Pseudomonas aeruginosa
AGKWSARRSIAGQFHRSNPHWRFLPSETAMATVLPFDAAGIHLDPAQGLARQLYAALRERILDGRLGSRTRMPASRELAQALKVSRNTVVRAYEQLHAEGYIDGRTGDGTYVAELQEIPGRAPAVAPSAPAPRGPAALAPPPEGAPRAFRVGVPAFDLFPFDTWARLQARFWRNPPADCLGYGDPAGEARLRELIAAYLRSARGLRCEAEQVIVTHGAQQAIRLCAQVLLENGDPVAVENPGYRAARLAFAATGAVPHGIDLDAEGLRSDRLAGIAGCRLAYVTPSHQYPTGVTLSLARRLELLEWAERADGWIVEDDYDGEYRYSGTPLAPLAALDRQGRVLYVGTFCKIAFPALRLGYLVVPPALVERFRQRRAIEVRHSEVGTQRVMADFIAEGHFQRHVRRMRRAARARRDALLRGWPKAPGCQPLPAVDAGLHLCVRVDSLARERALIAAAAAAGVEVSALSDYWMDDSSVAPDDRAGLVLGFPAVPEVRIDEALRALRKAWRREALVGPVVATD

SEQ ID NO: 19138 - protein, 201 aa, Pseudomonas aeruginosa
  UNSURE (174): Identity of amino acid at the above locations are unknown.
NAPGSPSRPGVAMSVALSAAPERKLAAPLIAFALLVLGGLFLFNAVSARQAILFVVGGALGLTLYHAAFGFTSAWRVFIRERRGAGLRAQMVMLALAVLLFFPALAAGSLFGQPVSGFVSPVGTSVIVGAFIFGIGMQLGGGCASGTLFTVGGGNARMLVTLLFFILGSLIATXHVGWWFALPSLPPISLVAELGLAPALV

SEQ ID NO: 19139 - protein, 184 aa, Pseudomonas aeruginosa
WRGWRRFFRGPGPLVWGALALALLNFLTLYLAGRPWGITSAFALWGAKIAQGVGLDVGAWAFWQTPANAKALAAPLWEDITSVMDIGIVLGALLAAGLAGRFAPNLDIPRRSLAAAVIGGLLLGYGARLAYGCNIGAYFSGIASGSLHGWLWLVAAFAGNSVGVRVLRPYFFPEERREQGLTGC

SEQ ID NO: 19140 - protein, 315 aa, Pseudomonas aeruginosa
WRTCHRITGAFPVVNLELKWLEDFIALAGTRSFSQAAEKRFVTQPAFSRRIRSLEDALGLTLVNRQRTPVELTEAGQLFLVTARSVVEQLGQVVRHLHHLEGGQGEVLQFAAAHSLALGFFPQWIARLRNEGLNIASRLIATNVGEAVHSLREGSCDLMLAFYDPDAALQMDPEIFPSLHLGRTEMLPVCAVNAEGQPLFDLENGQSVPLLAYSASAFLGRGVNLLLRQRNLRYTTVYETAMADSLKSMALQGMGVAWVPRLSVVNELERGELAICGGPQWFVPQEIRLYRCALVRKAAIRLLWRKLEGGLGSVE

SEQ ID NO: 19141 - protein, 146 aa, Pseudomonas aeruginosa
TGKGGAGTPPRRSHLEDDAPLDLPGAHLVEDLVDVVQLARMDGRLDQAFAGKVEGFLQVRAGADDGAGDVQALEHHVEDRRREVTRRQADQGNGAAAAGHADGLAEGAVGYRGDQHPVGAADVALDRLHRVFLPGVDRQAGTELAR

SEQ ID NO: 19142 - protein, 215 aa, Pseudomonas aeruginosa
FQLGVVDVDGGDVQAHGPGVLHGDVAEAADAGDRHPLAGARVGLLEPLVDGDAGAEDRRDFSEFDVFRQNSDVVRVGQYVFGIAAVHRVAGVLLAFAEGLPAGQAVLAAAAGGVQPGDADPVAFLHPGHSAAHRGDVADAFVTGNERQRRLHRPVALGGVQVGVADAGGFDLHQYLPGAGQRNLDFLDPQRRAVGVHDRGFHGLWQGHGHLLGRG

SEQ ID NO: 19143 - protein, 187 aa, Pseudomonas aeruginosa
PSSSRACRRKPWPSSPSSCRSTRTPSRCASPATAGSRSRCSRTSAFPLRTSPTSSPRPTSMPPQPPSACRRCSRPAPWATTARARRSCASRPTCRARSPNWAACRASSRASCRSPGKSRWWRCALAMARRVSTRWCTTPTTAASSSSPWPAAGIRCRRWPRTTSAACWPGSTTSACWPSSSSRWTAA

SEQ ID NO: 19144 - protein, 207 aa, Pseudomonas aeruginosa
SRRIDGSGRPPRGPAFPHFAGIPAIMRRFPFARLLLLALLSSPLVHAELPETDWLELMPPADRKALEEMPDIVHDTPEAAGTFTSKGGLKQSDRKMPAVMYSAKTVASLDGKAIRLGGYPVPLENDAKGRVTEFFLVPYPGACIHVPPPPPNQIVLVRYPQGLKLTDIYTPLWVSGTLKIEQVSNDLADAAYAIDKARVKVVEEADL

SEQ ID NO: 19145 - protein, 1051 aa, Pseudomonas aeruginosa
  UNSURE (343): Identity of amino acid at the above locations are unknown.
RVTTSTVPSRLGLSAVRIQVSGVRLIARLRVRYPLSGRGEGCSCRYLQAVFGAGVLQPEPEVVGEAAAHDQLPGVLAGMADHALRLGEDAADRLAHREVARMHVVAGGFHQQFADVRSAQFEQRLPAADVDHRVVQLLAQGLAQALFDGVFLAAGDDQQPFVRGQPLQRGLAAGDQGQGHRQFQAEGLVHGGGEGRVGGIAAQHQVAEQLLLAQDDTGLRGGLAGELVQLGMVQRRFGVDAGFGALLVDVCLAHSFSPWGAARPGSLSAFSLREEGRGEERIPLRSIHVLPLPFGVVKHRGADLRLDEAAVRQRRVNLLAHALEAAFHHRQGETVADAGAHVXGGDVADHLHRDRLLGCRTPVGAPSGSTSCGLLGLSPTSCLRSSRGQSARFMPRPADPGERLGAAHRPAHVEIVRGDRGIGVLGDDDEALLGAQDVHGLGAVGRQAVLRAVLGERFEHAHGVVGLDVHLVAQLAGEGDAEHPRRHPGDLAFLPGHEGEGILVQVDVGDFGEQLAAVRAGQGEGRVVVGDRGEVHLQLRPFGLVVQLQPLQYAGGAAGGGGHDEVVVGQAGGHAVVEDHPVFLAHQAVARLADVELGPGVGVDPVEELPRVRALDVDLAQGRGVEQADRLAHRAAFAGHGGVHVLAAAREVPRPLPLADVLELGAVLHVPGVQGGETHRFEQVPAVAAGDGAEGHRGVVRTEHGGAGVGDALALGPRGDRQAVDVAQLALVGAEAQRGVALDVLDGLEALAAGQFDGGGGDVVLRIDELLRCACRGLLVGHLEQRDGRFLAARLDLRQAAGGGLVAGVEGGATPGLVAVGEHLGEPEHAVHGAGADALLQAFAGDEGEDFLAPFRLAAQVRGQVHDRAVAAGAGDQVAVQPFAAAGAHGLQVDPGDLGAADPLAAASLDHRTASDHPHTALACFLDPLAARIGPGVGDGHHLQAGFLPVEGDAVGVVVVGGQHQFLARCHAVAPYIGGNRAGEHVAGQVVVAVDQRPLMGAGGQYHALGAHAVHALADLAERGDLAEVVGAPLVDGEEVVVVVAVDRGAR

SEQ ID NO: 19146 - protein, 475 aa, Pseudomonas aeruginosa
RCMWMLLNCCSLSRGEGWAGARRAPRPSSGGSAIDREVRAETGDLGGDLGFHVGIAEVVEDVADPAGQFAALRFLQPAGGDGRGADADAGGDERALRIVRHSVLVHRDADPAEGGVGFLAGQALAHQADQHQVVVGAAGNHVVAAPDEHLGHRLGVADHLRLVVLEARLQRFLEAHRLGRDHVHQRAALGAGEYRGVELLLDLLVGARQDQAAARAAQGLVGGGGDHVGEGDRVRVEAGGDQPGDVGHVDEQVGADLVGDGAEAREVEGLGVGGEAGDDHLRLMLHGQALEFVVVDQPGSGVQAVLHGVVQLAGGGHLGAVGEMAAVGQAHAEDGVAGVEQRQVHRGVGRGTGMRLDVGVVGAEQLPGAVDGQLLDLVDVFAAAVVALARIALGILVGQAAALRLHDPLAGVVLRGDQFEMVFLAGLFGVHRGEQFVVVAADLVMLAEHRWVSLRRRNRAGMAATGHAVPLPAMV

SEQ ID NO: 19147 - protein, 695 aa, Pseudomonas aeruginosa
RSTGQAEGGRMMSAKDFLVELGTEELPPKALNSLGEAFLSGIEKGLKAAGLSYAAARFYAAPRRLAVLVEQLAVQQPDRTVNLDGPPLQAAFDASGNPTQAALGFAKKCGVDLQQIDKSGPKLRFSQTIAGQPAAGLLPGIVEASLNELPIPKRMRWAARREEFVRPTQWLVMLFGDDVVECEILAQKAGRESRGHRFHNPDNVRISSPAAYLEDLRGAHVLADFAERRELIAKRVAELAAEQQGSAIVPPSLLDEVTALVEWPVPLVCSFEERFLEVPQEALITTMQDNQKYFCLLDANGKLLPRFITVANVESKAPENIVSGNEKVVRPRLTDAEFFFKQDKKQPLESFNERLRNVVFQAQLGTVFEKAQRVSGLAAYIAERIGGNAQNASRAGILSKCDLATEMVGEFPEMQGIAGYYYATHGGEAEDVALALNEQYMPRGAGAELPSTLTGAAVAVADKLDTLVGIFGIGMLPTGSKDPYALRRAALGVLRILIEKQLDLDLVAAVNAAVEQYGDKVKAAGLAEQVLDFVFDRLRARYEDEGVDVAVYQSVRALKPSSPLDFDQRVQAVQAFRQLPEAEALAAANKRVSNILAKSEDEVPPNVDASLLVEAAEKALGSAVANAESEVAPLAAARDYRAALARLAALREPVDTFFADVMVNVDDAAVRANRYALLAKLRGSFLGVADISLLG

SEQ ID NO: 19148 - protein, 190 aa, Pseudomonas aeruginosa
NRSFPFMANCASMSRSLLILDRDGVINLDSDDYIKTLDEWIPIPSSIEAIARLSQAGWTVAVATNQSGIARGYYDLAVLEAMHARLRELVAEQGGEVGLIVYCPHGPDDGCDCRKPKPGMLRQIGEHYGVDLSGIWFVGDSIGDLEAARAVDCQPVLVKTGKGVRTLGKPLPEGTLIFDDLAAVASALLQ

SEQ ID NO: 19149 - protein, 96 aa, Pseudomonas aeruginosa
SPFSEQETAVKKRFTEEQILDFLKQAEAGVPVKELCRRHGFSDASFYTWRAKFGGMTVADAKRLKDLELENSRLKKLLAEAHLDIESLKVVARGKG

SEQ ID NO: 19150 - protein, 64 aa, Pseudomonas aeruginosa
SGCPARCCATSREPVCKTPSCKPNWWNWPKSAGALAIAACTSCCGVLACRSTTSGSIACTALPA

SEQ ID NO: 19151 - protein, 113 aa, Pseudomonas aeruginosa
AAGSPGSGDYGPAWRNRPRSHPPRCTVRRAPGPFPGNRPACRAGRRCPARPCGGSSRAPCARPRGHGRRRSSCRPRPWLRWDSPAGSRRSTCPSPVPPQSSPRRRPACPWSAS

SEQ ID NO: 19152 - protein, 398 aa, Pseudomonas aeruginosa
LEAHRHDDIGRIVIVGLVDQGAAVGIGKDEADLLGTDHTQHVEQVTDVEADLQVAAVVLDLHFFLGLFLLRVVRLDFQQTVGKLQANAAVLLVGEDRGAAEGFAQLLAVTDHQLVATARQYAFVVRELAVHQLRSEGEFASGGTDMVLAQDDTDFAVLLGEQTSQFEDAFARHDHLVAVLRRDLRIQRAHGQSVAVGGDGTQGTAVHFQQHAVEVVTHVLLGHGEAGAVDQATQLALGNAEVQRAGTFLHGGEIVGRQGGQGEAATPGLHQEFLLFDTDVDQHVVRQALADVHQLARRYGDLAGFGGIFQYHATNQLDFEVGAGQRQLLAFDHQQDVGENRQCLAAFHDAGDQLQRFQQGFALNGEMHGLVPCLVGCVRLSGYAAGSCSPRGYPRRIP

SEQ ID NO: 19153 - protein, 145 aa, Pseudomonas aeruginosa
ASDRLIYPVRVVSRDFDRDKRLLTARQFSAVFDSPTGKVPGKHVLLLARENGLDHPRLGLVIGKKNVKLAVQRNRLKRLIRESFRHNQETLAGWDIVVIARKGLGELENPELHQQFGKLWKRLLRNRPRTESPADAPGVADGTHA

SEQ ID NO: 19154 - protein, 659 aa, Pseudomonas aeruginosa
PRSATVSFLQAPPFLDGRVTMDIQRSILIVALAVVSYLLVLQWNKDYGQPELPAASASMNTTQGLPDTPSASGTSSDVPTAQSSAAGTEAADKPVAVSDKLIQVKTDVLDLAIDPRGGDIVQLGLLQYPRRLDRPDVPFPLFDNGRERTYLAQSGLTGADGPDASSAGRPLFHSAQSSYQLADGQNELVVDLSFSHDGVNYIKRFTFHRGLKADCSDKEKAQKKIECINENAYQVGVSYLIDNQSGKTWSGNLFAQLKRDGSADPSSTTATGVSTYLGAAVWTPDSPYKKISTKDMDKEQFKESVQGGWVAWLQHYFVTAWVPTKGEQHQVMTRKDGQGNYIVGFTGPTLSVPAGSKVETDLTLYAGPKLQKHLKELSPGLELTVDYGFLWFIAQPIFWLLQHIHSLIGNWGWSIIALTVLIKLAFFPLSAASYRSMARMRAVSPKMQAIKEQHGDDRQKMSQAMMELYKKEKINPLGGCLPILVQMPVFLSLYWVLLESVEMRQAPWLGWITDLSVKDPFFILPIVMGGTMLIQQMLNPTPPDPMQAKVMKLMPIIFTFFFLWFPSRSGAVLGSQQLPVDRTAVVHYPQDRGSREDRLTSIAKTVHNKTPPRGASCYPEISTCKPPPKPSSRSLPPRAAAAWESSASPDLSPDRWPWP

SEQ ID NO: 19155 - protein, 83 aa, Pseudomonas aeruginosa
GRYPPYTGKPAEPVDIPAGLRRPDRRAGSGPRRSDPDGTALPCRQRGPDYRHLPRRTYPHRPGELLRRTRRRPAVHRTGASSA

SEQ ID NO: 19156 - protein, 215 aa, Pseudomonas aeruginosa
GKPPGLPRAGRPDDPRAVSQRHFHVPAVRRATADRAFHPWHGKRPHRAAGLCDRVRLLRSPRSQVQPGDQGHRRPVLRRPDQRHHRLRGSWRPGPAGRRQCCVAFARQGQLVPAPRRGLHRRAGGRPDHARHPGAVPHVHLAGGIPPDPPRGQRRPASHREGTRAGPCRRSALGCLRSQARRYRTRGTAAEEHLGAAEYPAGRRHRRALRYAADP

SEQ ID NO: 19157 - protein, 312 aa, Pseudomonas aeruginosa
PPGGRAGGDSHQVRRLHRPPAGGNLPSARQRRYPPACGYRLPGDFRPVEGNPEQAEPGPSGNPRTGFADPRRHAGCDFAVVDPPEEACLWPPTGAERLMSAVTQHHADELARGADELGVALDADKQRQLLAYLALLIKWNKAYNLTAVRDPDEMVSRHLLDSLSIVPYAEAGDNWLDVGSGGGMPGVPLAILFPEKRLTLLDSNGKKTRFLTQVKLELKLANLEVVHSRVEAFRPESPFDGIVSRAFSSLEDFANWTRHLGGQETRWLAMKGVHPNEELAALPEDFRVEAEHALAVPGCQGQRHLLILRRTA

SEQ ID NO: 19158 - protein, 221 aa, Pseudomonas aeruginosa
GGTGITMAKVFAIANQKGGVGKTTTCINLAASLVATKRRVLLLDLDPQGNATTGSGIDKHNLEHSIYDVLTGECNLAEAMQFSEHGGYQLLPANRDLTAAEVVLLEMDMKENRLRNALAPIRENYDYILIDCPPSLSMLTVNALTAADGVIIPMQCEYYALEGLTDLMNSIQRIGQLLNPTLKIEGLLRTMYDPRISLTNDVSAQLQEHFGDTLLQHRHPA

SEQ ID NO: 19159 - protein, 330 aa, Pseudomonas aeruginosa
CAPRRSPQLRHAGAGLRQAIPRRHRLPGAGRRAGPPPARQRPRRNRIRNPHGSQETWTGTRARCPAGRLESRQTAGGSRTGRPPRVAADPPRPDAARQVPAASRHGPSGAGGTGAVDQGPGRDAAHRGAADRQWPLRDHCRRAALAGQPAGRTGKDPGAGARRAGRSGHRHGADREHPARGPQPDRGSRCPAALAAGVPADPAAGRGSGRQVARDHYQPAAPDRPAGRDQDPAFPWRPGDGPCPCAPRSAGRTAGGRGATCCRTWADRTSDRSPGSAVDACPWQACGTGQERPGHRPPGTAPGRAPGRFGADPAWSEGQGTVGHPLQLPG

SEQ ID NO: 19160 - protein, 303 aa, Pseudomonas aeruginosa
WEKHLQDLRAIEANMAAETASGYIQHHLQNLTFGRLPNGDWGFAHTAEQAKEMGFWAFHVDTLGWSVLLGVVFLFIFRLAAKKATSGQPGGLQNFVEVMVEFVDTSVKDTFHGRNPLIAPLALTVFVWIFLLNLIDLVPVDYLPMLAAKITGDEHLFFRAVATTDPNATLGLSISVFALIVFYSIKVKGIGGFLGELTLHPFSSKNIVVQILLIPVNFLLEFVTLIAKPVSLALRLFGNMYAGELIFILIAVMFGSGMFLLSALGVALNWAWAVFHILIITLQAFIFMMLTIVYLSMAHEDNH

SEQ ID NO: 19161 - protein, 250 aa, Pseudomonas aeruginosa
SPRPGPYRRRTPEGPGPSGNRTGTEQRQGRPACPSGCPGRHRRREDPGCFDRRKRARAAGFQTGSRDLSEGAMAELTTLARPYAKAAFEYAQAHQQLADWSAALGVLAAVSQDDTVRQLLKEPQLTSSAKAQSLIDVCGDKLNAPAQNFVRTVAENKRLELLPTIAEMYEQLKAEQEKSVEVEVTSAFTLSKEQQDKLAKALSARLSREVRLHASEDASLIGGVIIRAGDLVIDGSVRGKLAKLAEALKS

SEQ ID NO: 19162 - protein, 518 aa, Pseudomonas aeruginosa
RGSGMQQLNPSEISEIIKGRIEKLDVASQARNEGTIVSVSDGIVRIYGLADVMYGEMIEFPGGVYGMALNLEQDSVGAVVLGEYQGLAEGMNAKCTGRILEVPVGPELLGRVVDALGNPIDGKGPIDAKATDAVEKVAPGVIWRKSVDQPVQTGYKSVDAMIPVGRGQRELIIGDRQIGKTALAVDAIINQKDSGIKCVYVAIGQKQSTIANVVRKLEENGALANTIVVAASASESAALQYLAPYSGCTMGEYFRDRGEDALIVYDDLSKQAVAYRQISLLLRRPPGREAYPGDVFYLHSRLLERASRVSEEYVEKFTNGAVTGKTGSLTALPIIETQAGDVSAFVPTNVISITDGQIFLESAMFNSGIRPAVNAGISVSRVGGAAQTKIIKKLSGGIRTALAQYRELAAFAQFASDLDEATRKQLEHGQRVTELMKQKQYAPMSIAEMSLSLYAAERGFLQDVEIAKVGSFEQALISYFQREHAALLAKINEKGDFNDEIDAGIKAGIEKFKATQTW

SEQ ID NO: 19163 - protein, 257 aa, Pseudomonas aeruginosa
VISKRNTPQRRHAILALLSEQGEVSVDALAKRFSTSEVTIRKDLAAMESHGLLLRRYGGAVPMPQELIGEAAQPVSPYKQAIGRAAAARIREHARIIIDSGSTTAAMIPELGHKPGLVVMTNSLNVVNALRELEHEPVLLMTGGTWDPHSESFQGQVAEQVLRSYDFDQLFIGADGIDLERGTTTFNELLGLSRVMAEVAREVIVMAEADKVGRRIPNQELPWSSIHTLITDERLESSAREQITARGVTLICTPVEA

SEQ ID NO: 19164 - protein, 616 aa, Pseudomonas aeruginosa
KEKDPMCGIVGAIAERNITPILIEGLKRLEYRGYDSAGVAVFDNEGRLQRCRRVGKVASLEEGLAGTPLLGRLGIAHTRWATHGAPTEGNAHPHFSSDELAVVHNGIIENHEPLRERLKGLGYVFTSQTDTEVIVHLLHHKLQSIGDLTLALKDAVKELHGAYGLAVISAAQPDRIVAARSGSPLVIGLGLGENFLASDQLALRQVTDRFIYLEEGDIAEIRRDSVRLWDVQGNDVQRETVQYHEGAEAADKGEYRHFMLKEIHEQPSVVQRTLEGRLGQNQVMVESFGPQAAELFAKVRNVQIVACGTSYHAGMVARYWLESLTGIPCQVEVASEFRYRKVAVQPDCLFVTISQSGETADTLAALRNAKELGFLSSVAICNVATSSLVRESDLTLLTQAGPEIGVASTKAFTTQLVALLLLTLGIGQVQKRLADGVEAELVDELRRLPTRLGEALAMNRTVEKVSELFAEKHHTLFLGRGAQFPVALEGALKLKEISYIHAEAYPAGELKHGPLALVDSDMPVVTVAPNNELVEKLKSNLQEVRARGGELVVFADEGAGIEAGEGTHVVGMPHIGDVLSPILYTIPLQLLSYHVAVLKGTDVDQPRNLAKSVTVE

SEQ ID NO: 19165 - protein, 279 aa, Pseudomonas aeruginosa
HQERQHQQEHVFVALQITSQVTRGEVAHGQAHAEGGDADAYLRGAEAVALAQHLSREKQAGDPGAVPGTLGDQWPEDAPLPAPAQRMALGARYHGLHGKALACHQEDQHATARDQQEGRRPAEEVREEAGQCRAGGNAEGHAEHHLAHGTGLSLRGDHLRDQGEGGRDDDCRGDAPDHPQDDGNFQGRGDDDGQSIDREEDQGEQQQLPALHAVGEVAQQRRGDRIGERVAGDQPSGAAGSGVERLRQRPEHGGQHELGHADEEYGHRQGQQEQAVELL

SEQ ID NO: 19166 - protein, 404 aa, Pseudomonas aeruginosa
CSRLVTRRFGMIAQLPSELLSLQLPLRIRIGDAQAFDLGPDPQVTMVIRDPSLLTEITHPSLDALGKAYVEKRLDIEGPISQVIGIGDALSEALGEPDGGAPPVRESHDKDTDAEAIHYHYDLSNDFYQLWLDPEMVYSCAYFETGKEDLATAQLAKLRHLCRKLRLQPGEKLLDVGCGWGGLARLAAREFGVEVTGITLSKEQLALGRERVKAEGLEDRVTLKLLDYRDLPRDGRFDKVVSVGMFEHVGHANLGLYFQQLYEAVRPGGLVMNHGITSRYTDGRPVGKGAGDFIDRYVFPHGELPHLSLAVARMSEAGLEVVDVESLRLHYARTLDFWSANLEARLKEAARLVPEETLRIWRLYLAGCAYGFKRGWINLHQILAIRPHEDGSHELPWSRRDLYA

SEQ ID NO: 19167 - protein, 693 aa, Pseudomonas aeruginosa
PRSVRRTGFPAFPAVGSRCMSDHQNGLHLEAENWPRALFAVALAFSVFQVVTAAFPLISTQVLRAMHVGLLLLVVYISYPAFGIGRPWQPLAWLLGMAGLGTAVYQWVFEGDLIQRSGELTQADMVVGVVLIVLVFEAARRVMGIALPIICALFLAYGLFGEHLPGDLAHRGYGFDQIVNQLSFGTEGLYGTPTYVSATYIYLFILFGAFLEQAGMIRLFTDFAMGLFGHRVGGPAKVSVFSSALMGTITGSGVANVVTTGQFTIPLMKRFGYKPAFAGGVEATASMGSQLMPPVMGAVAFIMAETINVPYVEIAKAALIPALLYFGSVYWMVHLEARRADLKGLPRDQCPSAWGAVRERWFLLIPLLVLIALLFSGRTPLFSGTIGLALTAIVILGSAIILRVSSLGLRIAFWVALGLLCAGFFRLGIGVIFVVIAALALACWFVRGGRETLRICVRALAEGARHAIPVGIACTLVGVIIGVISLTGIATTFASYVLDLGRENLLLSLVLTMVTCLVLGMGIPTIPNYIITSSIAAPALLELGVPLIVSHMFVFYFGILADLTPPVALACFAAAPIAKERGLKISFWAVRIALAGFVVPFMAVYSPALMLQEGGWGATLYVTCKAVLAIGLWGMASIGYLQGPLAWWERLVAFAAGASLVLALPISDELGFVLGALVIGWHLWRQRAREAVA

SEQ ID NO: 19168 - protein, 183 aa, Pseudomonas aeruginosa
LMPTLAIGYFVDEAPSPPAKPARRPGPPAVPGRQRQCTNPPGPGLEFLGKLAPGAGTGRPAALSNLFPAGPRAVDPRPARRAIARNALRAAAGRPRARHPQRPTGWRRDAHRPRPAPGGQAAQLRPGTAGGKGPSPGPGPISTGAGGAPRANAGAGPPATLDGPRHPRGGRCRPWRQGPRRGR

SEQ ID NO: 19169 - protein, 278 aa, Pseudomonas aeruginosa
QGRARKGRGAGYRPPAGAADRPRERLQGAPGAQRRRVRPAAQAAGSGPALQRRHVRFGARRRGAATDRLRRVGICPLRAWRQLDHGALDGRARERRRPDRQQRQPAATGPRQGTRRGDPRHGPEFDHRQQPGPRPQRSRPVVGRHRAAPEACRAGRLRRAQVAGHPFDPGGDRLHLESRRLSPVDGRTPSPAPGRGDLRWRAGLLPATPSRRQLPGGAQRAASRLGPSLQPLTRPQVRRWRWPDELLRRLMLVQPMLRLRPTQISPSLAMPLKKVRRP

SEQ ID NO: 19170 - protein, 140 aa, Pseudomonas aeruginosa
ISQVQPMTEQELLAQPDAAYMDEAQQDFFRDLLLRQRQELQARIEGEFGELRDLERPSDEADLASREEQRQWQLRLLEREKKLLDKIDEALERLARGDYGWCQETGEPIGLRRLLLRPTATLCIEAKERQEKRERHVRHN

SEQ ID NO: 19171 - protein, 332 aa, Pseudomonas aeruginosa
STGFHIPVAQMLREIPTHLIGGPLGAGKTSLIRSLLAQKPAGERWAVLVNEFGEIGLDAALLATDVDGVAIGEVAGGCLCCVNGVPFQVGLGRLLRRARPDRLFIEPSGLGHPLALWKQLQAPPWSGVLALQPLVVVLDAAALASGQPLPEAQEQALEAAGMLLLNKSETLDATQRCAVRARLPVLPLRWSVRGHLALRDLPTSVAGEGSATTWAALPEAPAQLGTVLPAERPLRAVREQDGQFAIGWRLAPSVRFDRAAVDAWLNRLSGLRRAKAVLHCADGWYAANAAPFVDNWGKSSWRRDNRLELILAAGADEKALEEAFLACRMVAE

SEQ ID NO: 19172 - protein, 149 aa, Pseudomonas aeruginosa
ISSSSRRRPSRPRSRRLPRRSRRRRRSRNPSRSRRSRSRWKNPSPSRNPSPNRWKTPFPRPSRSRNPNPSRNPSRAQRHPASPARPAPPRRRPHLPSGRARPARRPRPAARKVRPACPAAASTTVTSSRCAWILRSIPGWPRPGVSKAG

SEQ ID NO: 19173 - protein, 381 aa, Pseudomonas aeruginosa
RKSLVTFRSHAQGGDDEGELADLRQAHADPQRSASVVAGDERTHAAGEHLAEHYRDGDQGDRPGVLDEDLRVYQQADGDEEDRTEHVTDRLDQSFDLHQLARLGHDRADQEGAEHHAVFQLHHQQAEAEAQAEHGDQQHLVALELRHVGQQAWHQEDADDQRDDHEQAELADRGEHLAGFHRTAHGDSRQQGDDADAEDVLDDQHAEDQLGEALVLHLQVAERLDDDGGGGDRQDRAEEQRVHGAPLEEATDLEADPDHQDDFQERRDERRGADLEELAQAELQAEAEHQEDHPEFGQGLDRVFVVDQSEGRGVRADDEAGDDVAEDHRLAQAVEEDSDHTRHQHDHGEVLDEIDGMHGGGPRSGNGSADAATGRPRRPAD

SEQ ID NO: 19174 - protein, 410 aa, Pseudomonas aeruginosa
HPQVLDRWAEKNCNRRFGEALRCASRVAGRIFARRSACMPVVPGNEGVPWRRPASQTRRAKKRRPGSNSPKQNPAGPVARTAATWRASIPPREKDYNAACSQHRPRLLPGADRQPGCQCQALRRRQEPRLGTQPPDPPGAAGHCAERHCCRPQRRSSRRCRQRCFALARPAGRYRRGRPARFHVHGRRLRGHPDARHPVDRPGGLHRLPLHRRSPAPAEPGPACDGRARADAARNAGPGADLRWRRRCCRCAEPGDQRAELVQRGALRRCRSRTLHVPAAALGCQRDGQDRRVRHPADVAMAEAGARRDRRRLPVHLHRQPGRATGRRRRPGRQDNRHPDLQRCVEDLALRPGRSLQRKLADGARPGREPAMAGGRYPAELIPSGCGPFGGRRNPRFRQGTGVFSSPLAG

SEQ ID NO: 19175 - protein, 100 aa, Pseudomonas aeruginosa
GISLDCDGHKGNSALVAPDVGKCAAPCGDSMKFKALFAALLLTSLAGCANQAVVTLQDGSEVLVKDQSDYDKYNDYYEFEQLNGDTILIKKDNVRTIRPQ

SEQ ID NO: 19176 - protein, 203 aa, Pseudomonas aeruginosa
ASVVPRPPAPLPPPAVAGRREPASGWCPTGSPGRGSSVARRAGNVRPASLPAVVGRVVPGDSRPWSAPGRRWRRKLGKRQAAVAHVQLRLFSIRQLPPSTTSSSPLTKLASGEARKATAAATSSGRPARPLGLARAAWRSSAVLEAVAIQPGATLFTVMPLFATSSARPMLQPTRPALAALYAASPGLLPRVPVVEATLTIRP

SEQ ID NO: 19177 - protein, 475 aa, Pseudomonas aeruginosa
KLCEIKNEVFEMTASGIAEAAVETFMAREQQRFLAQNPQSVALAERARRALFDGVPMHWMSDWSTPCPLFVERAHGARFHDVDGHAYVDFCLGDTGSMFGHSPAPIARALAEQGANGLTTMLPGEDAIVAGELLAQRFGLPFWQVATTATDANRFVLRWARAITGRKVVLVFDGCYHGTVDDTLVRCRDGRTVHRSGLLGQAHDLTQFSRAVPFNDLQALERALASEDVAAVLCEPAMTNIGMVLPQPGFHQKLRELTRRHGTLLIIDETHTISTGPGGCTRAWKLEPDFITLGKPIAGGVPCSVYGCSAAMASAMQLARARASEQSEGHGHSGMGTTLSANALAMRCMRANLEEVMTDTAYAHMLSLAARLAEGFRRIIHKYGLAWSVTELGARSEFQFCPQPPRDGAAAEAAFHDSLQMALHLYLINRGILITPFHNMTLCCPDTREEDVDRLLSSLDEALGELLAIPGAREA

SEQ ID NO: 19178 - protein, 577 aa, Pseudomonas aeruginosa
SISNVVVRRPGRGGRVPRVAGSPDAPYAVTHYTRRGVRPRLPLRGPGQSPAHFAAGRLLARGRPGRAVHSRLCRRPGAVAGNRRTRRDPADVRRRPALLAQGPALGEGHCHSRGAGADRRRHAAWHRPGQAARLELRRRPGIRPEPVGGQYRGAVARPGAAPVAGHQAWQDRHRLADRRGPGDGPDPGAPAGARRHPRRQDRRRRRRSALAAADYPGQGRRLRRPDDLRRSPGGALGAGEDRRQRFAGALHPGRAGHCPGHRLWLGGAVRGVLRARRLLRRDDPQRVRTQPRGGGELVAAARRFRGAVLRLGGDAVQSDDPVAGAADGPGHLPGHRLRQVGGRLPDRPCFRPSEQHRTGDRRQPGADRRVFLHSHRPGHWPRTGAGAEPRPGAGRGDPVDPGQSAAVHRHRSPAATQGAAPGGGRWRGPRDAGAGPAAADPGARACGADRSWPGWRVGQRSPAHRRDALRGSGGQARQGRRTARTGLQRGPRQCRQSRRAGTGQHRRGALVADRHSQRLRGRADRQPRPRGEPAAGHRRPGAFRRRGGLPGAERRQPGDHGRARDRLRHGPSPGTRP

SEQ ID NO: 19179 - protein, 315 aa, Pseudomonas aeruginosa
CWGNTFFEPPVDDFHPQGRRLKAHCVETNPWVCDPILRPHQFQLVAAAGLGFQQHFMDRGAGEFEGVTQVVAEQQAREEQPRGQVADPDRLPREGQQRALQVPGLIGGHQQHLEGVAGLARIVQVLYQDCPGTACQQAPCHFHAVGEGVRLAVAEAVQLQLVGAQVVGDRGGFFQQEVADFRGHDAAFFRVAHDRVAEVQRPRVGLFDPCHHIENGAALGGAAEIAGQHRVAVAQFADAGNTVHQRRNLLRRQHLPGPLTVLGVVGELHRVQRPDVDSDALHREHRRGIAGVAEDHMGLDGEQVGRTWHETTSYS

SEQ ID NO: 19180 - protein, 617 aa, Pseudomonas aeruginosa
RHGRTPRTARSVTGRRAIVAASRRRFDPPMSLSRPLRLFLLLLPLLGGLLLSMDWAGRQARQQALRAEGEQVRKQLDLYAGSLQTLIERFRSLPAVLALDPDLRAALAGPIDGELQQRLNLKLESINLAARSSTLELLDRTGLAVAASNWNLPTSYVGHNYGFRPYFRQTIAQGSGRFYAVGVISGIPGYFLSHAVRAEDGSFLGAIVVKLEFPDLERQWNQTPDLVLASDAKGIVFLANHAGWRYRELEPLDTVDRFELAETRQYDRQPLTPLRHQTLRSYGEDSRLARVESADGEKDYLWQSLDLPNDGWTLHLLRDTASIQDDVATARLAAAGTWLALVFLGLFLHQRWRIARLRQRSREELERLVEQRTADLRTAQDGLVQAAKLAALGQMSAALAHEINQPLTAQRMQLASLRLLLDAGRHDEARQALPRIDQMLERMAALTGHLKTFARKSAGGLRERIELGHVVEQAQQLLLPRIRAERVEIEQALLWPAWVMGDAIRLEQVLVNLLRNALDAVAGQERPWIRLALQRLGGDWVLSVADNGGGIPAEHLGSVFDPFFTTKPVGEGLGLGLAVSYGIVHELGGRLQVANAEAGAVFSLILPAAPDDTSVTT

SEQ ID NO: 19181 - protein, 346 aa, Pseudomonas aeruginosa
PLSWHGRQTYGRDGNEKARSKTGLFPGAVTRLGSERRYHRAFVFLLDELLDLGAVQGLGQLLHGVAVLVVRPRDEDVHVGRVAAFDGQRILGRVQLGFQGVVGIDQRHVDLGQHARQGRGFQFADLDVLRIVDDVLRRGGDALVVLELDHPGLVQQEQGAAAVGGVVGDHHGSAGRQFVELLVLARVGAQRLDVYAGHGDQVGALGLVELIEVRLVLEEVGVQALFRDLHVRLHVVGELLDLQVHAFLGQQRLDHVEDLRVRHRGGRDGEGLGGLGGGEAERRDSGESSKQFFHLQLLSRCSWRLWITAALRVLGLAGKLTCARSAPPACRPRFAESGRGSAASPP

SEQ ID NO: 19182 - protein, 406 aa, Pseudomonas aeruginosa
TAANRRASRRCRRWPARFRTSRCWRSSWFRRSPSAQYLHMYVSGVQLAHGGFQVTADQGQGQLAVGRVLDAVDASGKDAVVDPGLPSHGAQQWRIGGFAAEGQAQDETRHVGEIVVTLVFVDPFGLEHEAACGRVLRMEEDIGDIALLDDGAAVHDRDLVADTTDHVHLVGDEDDGQLQLAIDFRQQLQDRGGGLRIEGAGGLVAEQDARPAGQGASDADALFLSAGELGRILARVVGQADPREQLGDPRIDFGTAEAAGQAQGHGDVVGDGLRGQQVEVLEDHPDALAETAQAFGVEGGDVFALDQDAAAAGLLEAVDQAQQGALAGTGMADQAENLPGLDVQAGRLQGGDFPTGNSIGLVDVVEFDHWANLVGAAMLLRLEHGLGGKHGRSAKPSILPCFLMHY

SEQ ID NO: 19183 - protein, 106 aa, Pseudomonas aeruginosa
PMVSRGRRQTSPTCGLSRPSTLRTRVVLPAPLGPIRVTIWPGSMARSTSLSTAWPLKDTPTWVSRTSALSIRRPSGPGRCRRGRPPRRSGFQRRSRRCSLRRRWPG

SEQ ID NO: 19184 - protein, 199 aa, Pseudomonas aeruginosa
ESSEQPGRRICRLSGKALKTRDRWPRPLARGVPMTKVVCCCLTQDIDSRQVRITRCCVRWPASDAPTTIGRLISGWPRQTHAVPAPNAGPSPCRTRRRISGTRSTGSRARTVRRWMPASTVPGNASPAPLPMSRKRPPANTGTGASSGPCATVPSRPAGSSPTPAPWGTSRPPRPSTARCPGPSRTPWTTSSRKSTRPG

SEQ ID NO: 19185 - protein, 180 aa, Pseudomonas aeruginosa
AWPTMPPTVSSRASPTIIRATLSAKAARPRKRSRSTATSCWPTGPWSTPRPCRTATTRRDACRTTSSPPTASPRRSTWTSRRRRRSGSIRRSPRPPTCPPTTRSRTSRTSTATPGTRDSRAAPPSASIPRRSRACWSRSPTWRRPATASNWRTAAWWSSRATSRSSTTVRSIPPPTSSTP

SEQ ID NO: 19186 - protein, 243 aa, Pseudomonas aeruginosa
KKAITASTEAGGIDMSAVKITQKIKGFKVVNEAEEQALAAAAEAASVVQMDETLERPDTLIGATYKIKSPLFEHALYVTINDMVLNAGTAHEQRRPFEIFINSKNMDHFQWIVALTRIMSAVFRKGGDCTFLVEELKAVFDPRGGYLKKGGIYMPSIVAEIGGVLERHLTAIGLLRGPELDEEQRLFLAEKRAAYEAAQGTSKVEPGEGFPAGAQLCGKCNSMAVVQMDGCATCLNCGHSKCG

SEQ ID NO: 19187 - protein, 139 aa, Pseudomonas aeruginosa
HQGRQAYRAGNDRAADQPQRPGPGRHRRLLRQPEDERRHGRSEPGGPGRSAVPRRQDRRRHAGLHRLPFPERRRHRNRRFPAPGRPARDLRGQAADRLPRRYPHQRRRHQDHAVHRRQAVEQGHRRDFQLHPGSALIAA

SEQ ID NO: 19188 - protein, 212 aa, Pseudomonas aeruginosa
TMRNLILTAMLAMASLFGMAAQADDYTAGKEYVELSSPVPVSQPGKIEVVELFWYGCPHCYAFEPTIVPWSEKLPADVHFVRLPALFGGIWNVHGQMFLTLESMGVEHDVHNAVFEAIHKEHKKLATPEEMADFLAGKGVDKEKFLSTYNSFAIKGQMEKAKKLAMAYQVTGVPTMVVNGKYRFDIGSAGGPEETLKLADYLIEKERAAAKK

SEQ ID NO: 19189 - protein, 294 aa, Pseudomonas aeruginosa
FGMLRRWQREPRVAGSCDPRVNPSCDDSRELPDDGRLRLLSFNIQVGISTERYRHYLTRGWQHLLPHAGRATNLKRIGELLADYDLVALQEADGGSLRSGYVNQVEHLAQLGAFPYWYQQLNRNLGRIAQHSNGLLSRWRPTLLEDHPLPGPPGRGAIFVRFGEGADALVVVMMHLALGARTRTRQLAYIRELIGDYRHQVLMGDMNTHAVDLLENSPLRDLGLMAPQVEATFPSWRPQRNLDHILLSSDLALERVDVLDQPISDHLPVSVEIRLPDNLRDKALVVRGDAGSPP

SEQ ID NO: 19190 - protein, 199 aa, Pseudomonas aeruginosa
SRSSRNWPWATIAPRSRLVAARMRTSARRVTGSPTRSYSLSWMKRSSLGCKVSGKSPISSRNRVPPSAWLTLPRVLSVAPVKAPRLCPNSSLSISSAVSDGQLMVTWGFFARLLQVWMARASSPLPEPDSPRMRMLASVAATWRAVSSTAAMAGLCDSRPSPWRRTSSSRASRRAVSWRTSSCLAAARRSWSGLQGLTR

SEQ ID NO: 19191 - protein, 501 aa, Pseudomonas aeruginosa
SAMPSRCWSSPSGKACTTRPRASATGIRCRTCGRRSAKPRASRPPSNKAASRPGGPGIVRGLGVSGAGTACAAIIRATRGILNAERLVVGFFPGGGGECAGALVDRRRCDGVRGDGGEPVRHGQAGGRGDGPAVRHPDALARLSAHRREGRAGGAPGGAARSVVPPADAGSAAGASGDRPDHPELRRQWPGSGQRRHADRPEGDEGVAGAQSQQHHREQCADPLPGAQRLVPDPAAGDYLHVPRAAGRGRSDPGIPADPPGHQRLDPGRPVVGGADAAPALVGPGGAGLPDPRRVAAGRLHGGARHALGHRAGAAVLAAGQPDAVQPDRAVPDRRRAEEGAGLRELRGGGEGRFRRRQEPVAVPGRNALRGWRVARLRGAGSGTRRDTLGGRGAGLGQPLRRSAAHRAGQAVLRQRGAGDAAGDHADPRRRQFPGAGRRHRAGQYRDHLLRARRLFRLGRPAARAPRGGLRADRGPGRGHRLHRRVLLVLRLRSPGFDVTG

SEQ ID NO: 19192 - protein, 137 aa, Pseudomonas aeruginosa
SRYRRTGPGCATGRRRPAPGCRRACGSGRRTGCSPPLRSATGWPAVPRCGRTIRPGPPPGSGREAGSRATSAVAGRSRAGWGRTARRRCPATTGSFPGWSGAAGSAARSATPRTGSGCGRRGTPNDAWTASDSRADR

SEQ ID NO: 19193 - protein, 203 aa, Pseudomonas aeruginosa
TGRKWLYRLPSLPGDRIMSNVQNASRSSAFAAVEGDHWVESLDDGRHVLIRPLREEDRERERQFINRLSPATRHFRFLGEIKEASPALLDQLMDIDYQQSMAFVALVHEDGELREVGISRYAACCEEGQCECAVTIADDYQGLGLDAVLMRHLIDVARRNGFRQMYSVDSAANRAMRDLCCALGFVGQRDPDDSTQVIHRLAL

SEQ ID NO: 19194 - protein, 749 aa, Pseudomonas aeruginosa
AARPCRFPAGRLRPRCAGRRTTRGRAGRTAAGWTTNAWAEPGTENTENSGCFMTNLPAERLMSRTARFRSLLGERWLGQRRRGHVVDFVGPVVLVPPSALVGRAARRVWIVQHGVGDGAEQRVETLHVADQVQVQRAGLDALYHLLVQAVDMGMGVAPFLQTEALLGPAQALGAVEVAVEEHRETQAQVGDQLLVQGADLFQAGVGERAAARGLLVLHGGEHVLDDVAGLLQVDRQLDDLRPAPAVAFGQVLARHPCQIQLDRGVEGVDVVVELADVLAEQRIAAADDLHQIVQHLLDGVAHAQGLAHRVGQRQARRVEGGGVEMARPGDVVGKGTVGHHTGAEAGHGVGQRQAGEAARGVVEHVEGDHQFGCAELPVIHPVRQRPHQGQHQQAAGDLEQQAAEGHPATGGVLRGGAEHGQDAAAEVGADHQAQRDFQRDHLGRGEGRGKQHGGQAGIGNHGEQRAGQRVEHDVAGQAGEQYLDALGLGHRLGGGDDQLERQDDQAEADEYPAELAEAGLFAAEEENHAEEDQQWRKPRQVEGQHPRHQRGADIGAEHDRQGRRQCHQALGDEGGGQQGGGVAALHQGGDADAGGERQRAFFHAATEDAPQVGAVDPEDSGADDMRAPHQQGDGREQVEQFQHGVAPLALRRMANLAPGSACVAPRSPDNGANGHDGKAAFRRVVTRTSYLDRRPPREFVSAARAAGRLPFIQACAPGNGEDFFAFRSMHAFAPQAMELADRKGILCTF

SEQ ID NO: 19195 - protein, 406 aa, Pseudomonas aeruginosa
TPFALPRVPARLRSAPRIYRFNHMDWIMGNYIKPLSAGVALIASDSTWIEGKAIQQLQTTAELDGMCRVVGLPDLHPGRGYPVGAAFFSVGRFYPALVGNDIGCGMALWETGLAPGKLSADKLEKRLGNLDLPLDETWSDCIEALDLPAREHWRALGTIGGGNHFAELQQVETVFDQAALHALGLDAGRLQLLVHSGSRGLGQAILQEQVSLHGHAGLLDGSLEASAYLARHADALRFAEGNRQLIARRILERLRCDGLELLDINHNLVAPAQVDGVDGWLHRKGATPADQGVLVIPGSRGDYSYLVEPVPSAQSLFSLAHGAGRKWQRGECRERLAARFSVDQLGRTRLGSRVICGDRQLIYEEAPEAYKGIDSVVGALLEAGLLRLVARLKPVLTYKTRGECCR

SEQ ID NO: 19196 - protein, 471 aa, Pseudomonas aeruginosa
SGHSSRSVTEQGEQAQQQGHGEDCQAHQHGPFQGEALVVAEVDLGQPHQQVGGGHQRAEQVHRLADDRGAGHFHRGDAVFGGGLGEDRQDAVVEGVVGHEEGERHAHQRGDGRQVWAQRRRDHRQQALGHGVDHPGAGEDAGEHPGGEDQRDHCENVLGVCADALLLLLDARVVDDHGDAEGDHEQHRHRQQAGDQGRHQDHGENSVEPQQLGPARLRILRLADLRQVLMVGGQVQLAETGALALAVHPGDGEDRQQPGDHRRDHRHEDIRRVDVQGTRRAGGGATPGGHVEHAAGEHDQAGHHQRAHAQAAVQRQYGGHADHVGGRAVAVEGDDHRQRRGAQRDLQRVALDQPEDLAHRRVEQPGVDHDGEVEDREHQHHAGRRQGADAVEHHRAEAGGETADQGEGDRDQDQRDQRGQALGHDQEHEGRHHGEGEQGQHGFTPGKTADGRAACGQQAAGGWRRADGVRL

SEQ ID NO: 19197 - protein, 157 aa, Pseudomonas aeruginosa
AVGAVGRAKNSTSTALSMLGRPSPRAMAKARRGIASSRAAQFQPRAATSPPSSWGFSAAPTHSRPSGRLATASRLSRRSLPPGRPTPARLTSAPARQARISGFFRIGSSSARRLMPRSAVSAQTDITFTVGTISASISAARVRPGLPYRLPTAARPR

SEQ ID NO: 19198 - protein, 166 aa, Pseudomonas aeruginosa
WNPLILRGGCGTGQVRLMLALPRGGFAMPETHTGGCHCGYLRYAVAAPLDDVAHCHCSICRRTTGGIVTTWATVPRAAFRWLAGEPAEYASSASCTRYFCPRCGANLALFTRLSADTLDFTVASLDHPERAPANRHIWVGSRLPWLHLDPQLPEEDEEFIAGADDP

SEQ ID NO: 19199 - protein, 191 aa, Pseudomonas aeruginosa
RMGLGGIGLEQPPRLTECAARSQCGRSARSSPQPGGCGGGAGDSDGQDRLGQLHVVGGQARQLATDVAQCGFQVRTADVALAGDEAGGVVARFEDDLVVAEGIGDVRSGIGGHAGGADQGIRGDHEAAGERAGGAGEQGSGTDQAQTFHVSCSERSQRRRPHPRGRVNAETNQLCATSPAAQRQKGFEIST

SEQ ID NO: 19200 - protein, 183 aa, Pseudomonas aeruginosa
CLLMTSRRLQSRGTGSGSGSGSGTGSGSGSAGVSGRTSRISSSVSSLIGAMRPSAERPSRRLSMTQPLSCRVSPDLTGFRSPCWRIAAKSSQIGVGSASTGKSSPSTRRTARAVCSERVMAAPWPARTWLQSCAGSPSHATSGIDSNSQATTHSIGHCRPRAALCGGVKERNRQSSPCSCSCR

SEQ ID NO: 19201 - protein, 322 aa, Pseudomonas aeruginosa
LLSALVTGITGQDGAYLAKLLLEKGYRVHGLVARRSSDTRWRLRELGIEGDIQYEDGDMADACSVQRAVIKAQPQEVYNLAAQSFVGASWNQPVTTAVVDGLGVTHLLEAIRQFSPETRFYQASTSEMFGLIQAERQDENTPFYPRSPYGVAKLYGHWITVNYRESFGLHASSGILFNHESPLRGIEFVTRKVTDAVARIKLGKQQELRLGNVDAKRDWGFAGDYVEAMWLMLQQDKADDYVVATGVTTTVRDMCQIAFEHVGLDYRDFLKIDPAFFRPAEVDVLLGNPAKAQRVLGWKPRTSLDELIRMMVEADLRRVSRE

SEQ ID NO: 19202 - protein, 480 aa, Pseudomonas aeruginosa
AMLIPVVLSGGAGTRLWPVSREGQPKPFMRLPDGQTLLGKTYRRAAGLLAGHGEIVTVTNREHYFQSKDQFQAARLGRHRGHFILEPTGRNTAPAIAVAALALQAEHGDAAVLVVMPADHLIRNEEAFREAVGHAARLAVAGHLVTFGVVPDAAETGFGYIELGDRLDEQGAAKVRRFVEKPDEETARRYVESGGFLWNSGMFCFTASTLVDELAQHAPALLEQARACLAASAAVKMADGIQHELAGEAFAALPDISIDYALMERSARVAVVPAAFDWSDIGSWGAMSALLDADAEGNRGSGDTLFVDTRNTFVQSDGRLVATVGVDDLVVVDTSDALLIARADRVQEVRRVVQRLKDERHEAYRLHRTVNRPWGSYTVLEEGPRFKIKRIVVRPGERLSLQMHHHRSEHWIVVQGMARVTNGDGARLVNSNESTYIPAGHRHRLENPGVIDLVMIEVQSGEYLGEDDIVRFEDQYGRVV

SEQ ID NO: 19203 - protein, 929 aa, Pseudomonas aeruginosa
CAATSSCSSTGNGRTGLHCCRSPCWRCCCARSACVCSASGSAKWWMNSDGTDTRIRPRQGLQAVSQSLEPVVRMAGAFQPSAPPPALDPARGRVHHRAGRSGRHRRGQRRRQEHPAEDDRRHHPADLRRDPRGRPGRRAARAGHGLPPGLHRPAERLHGRATAGHAGRGNPGADAGDRGLRRNRRGHRATGAHLLQRHADAPGVQRGDCPAAGHPDRRRGPVGWRCLFPAQELRAHPQFPQGRHHPADRFPRPLGDPVHLRLRDPPGAGTDGHARAAGRSDGLLQRPARRARGADRAPGNARRRPGTDDFRHRRGSDPRRTDGRPAAARAGGGRGRPGGDAGSRGRGSPGHRAADPRLHDQGPPRPADVRDQYPPPGQGAHRPEGRRAHHLPLRLRHAPGQGALLGGAEPVAAGLAPGPQLRMARLRPGLPCHQQPPGRLRRLLLAGRRNPYQPLRRGGSGPHFRGEHSMTRLLVECTYVFEHPKVNSGIQRVVRNVIRELPEADETVECIPVAMLDGTLYQVHSLAPLDPRPHSPLVRLRILVERAANYFWLGQRTLEKRRPFRSSPWARRLLYVACRLFAFAFLSIPLRLLDRILGKQQPAPVRATPLEHRAGDQLVLLDSSWHADFFPLAERLKSEGVGIVSVIYDLIPLTHPQFCDAGLVKVFNHWFDWIAATADGYVAISETIRDEVRAEMLRRIGPEKVAQRWFDYFHLGSELDLVEDGASVEPDLLRMFKAKAPVFLMVSTIEPRKNHGYLLDAFERAWAQGSQARLCIAGRIGWKCEALVERVRQHPELNKRLFMFNDLSDKSLEYAYSHAASLVFPSYVEGFGLPLVEAMQRGLPAMGSDIPVFREIGGEFMAYFDLADPQTLANLVTRFEATGEFPAERPVGEWRWIGWHEASRQLIARILLALGKAPAHGEAVHADCG

SEQ ID NO: 19204 - protein, 184 aa, Pseudomonas aeruginosa
HAGPHDRGYRLLGVLPGSRPATGGAVFLEALRESHRCSLSSCRGGLNAGTALLQDLPERNGRRDRTGDLPALREQRVVGDRQPRPDPEQRSASACRALRRTCGASRQARPAARFHRVFPERVQAVPRAGGGGGRGQLPLPLAVHGPGAFPHRYEQAERGHLPFGHHPPARPVETVPAADGALPS

SEQ ID NO: 19205 - protein, 1021 aa, Pseudomonas aeruginosa
GSSAGGRGRRSSRHSTGAGKSRANRAAIRRRPAQRRAWLRKNALSRPWAACPCSVMLRPLQGKPLQEQAPMTVHVEPLALPGGSTDVLRLYAREIAIERTRLLYLGSRTPTLLMLLGGVTSACLVWGKVSSWLLGGWLVWLVLLAVLRLLQVAAFQQADSRRQASRHWRRTFLCGAGASGLTLAFAVIMLVPADAFLQQVLVFGLVAAAILSASVAYAVSLPAFLTFALPGLLPSIVFLLLQPHSLLQGWGVLGLILLVALLVVAGQIHRLVQGALLRRFQTQALNLHLERVNAEAEALNRKLAQEVGQRRLVERELRAARDALQRRVEARTEELGATSQALSQSEARLAMALEASELGLWDWDLESGRVQHSYLEAVFSDAGGGPEDYRRLIESIHPGDLPRIRRALAEHLKGRSELYRVEYRVRDREGGWRWLEDRGRAMARDPRGRVTRMLGTRSDISARKRLEEQQQLAATVFEAASESIVILDPAYNLLAVNQAFSRITGYRREDVVGRNASLLVNTPEAQRHYRQIRAELRQHGQWQGELVDTRKNGDPYPQWLQLNLLRDGNGEATHIVGFFTDLSARRDVEERLRHLLHYDELTGLANRRLFRERLHEAAQRARQEEGGLALLLIDLDRFKLLNDSLGHEVADQLLREMAQRLRRTAPEANTLARLAGDEFAILLDGGTGTAALSRLAERLLVQLRQPVSVLGHELILGASLGISLFSEQAREISVLMSQANLAMQHAKQLGGNTFQFFRDNLQDSTLERLRLETRLRKAVEEGQLDVHYQPKLCLASARPDSVEALVRWHHPEEGMIPPSTFIGLAEECGLIGEIGEFVLRRACLQAAEWSQRGLNLRVSVNLSVHQLRQGDLLDVVRSALADSGLPAAQLELELTESQWLDALDSVLATFRQLREMGVKLSVDDFGTGYSSLSYLKRLPLDYLKIDQSFVRDLTQNSEDAAIIRAIIAMAHSLDLKVVAEGVETIEQWDFLVAQRCDELQGYLIGRPLPAHALEEGLRQAR

SEQ ID NO: 19206 - protein, 415 aa, Pseudomonas aeruginosa
RRAGRGGDQGPGQQPPGPARCLRLGTRGTGRCARARRRVGRRQGLRHVPGGCGQLLQRSLRRSRTGLQGVAGRVAALAEGNRPVPAGAHPAQRRPAERLRRHGLPRAAECRQGSPGTDPQRPRGLPAGVSEGALRRLGQGLATARALAGRRPEAAGPGLCRAIRRSRARAAQHGPGRPGPGGRQQAPDRYPARRHPDSAAAGGGRPGADARPRSVDPAQLHLGNAAGPTGQLRRASRTVRLPAGGLSLLCRPGPGEDPRSAAAKGRQPRLRRLQPADPARAGAGAAEGLESRRGALAGTVAAGRAAVPEGPVAAGPGAQLRAQRPVGKGLRRRFAGPGAAAAQHPPAQRRRRRAVAPPGQAGRDGGRARYRAVHSPLQGPAPQPLRRLRQGLRAARRNPLADQAGHQPRLCLRRR

SEQ ID NO: 19207 - protein, 358 aa, Pseudomonas aeruginosa
QGPEGPELPGRIHPAQRSRRHAAGQPARGQRAGRHPERLQGRGVLPAGWLSPGHGQPQGSARRQGLRAVPRDQLLRPGRLQHLRPAGHPAGRAQAMVPYAQVDLRRQLLGQGTEVLLVRRWRAWLAGLLLGLPLLPSVEAAVRAEDYGAFWLWSGVAPQPVLARAETLYILQGQISQSRRRPGEGVRLIAQGISVPRLARGEVWVVYRAHTLRWTPQIYQAVLNQVQRWKRAGNPVVGIQIDFDARTRYLDEYVDFLRDLRRRLPREYRLSITGLLDWGSNAEPAAINRLKGVVDEVVVQTYQGRHSIPNHAAYLPRVSRLQLPYRIGLVQGGDWQAPDYLEKSPWFRGYVVFLLNPQ

SEQ ID NO: 19208 - protein, 117 aa, Pseudomonas aeruginosa
RTRKSAASRPEAPPGRHNAVFTGLPPNRHIAARCSRLQPVGHGRREMPRHSDANAQHVDSKTRRKLEDQRRMQFRRAIEDHCEELRLRQELADYPELVAAAYLSSNRQGRRSAQRAG

SEQ ID NO: 19209 - protein, 123 aa, Pseudomonas aeruginosa
ATPSKRRRPASPIPSCAMPTSRCWRPACAPRTCCRSATSSTASATGRWKSGAAPPSTPACASSRKTRGNACASSRQRCPTLACRCSCAGRTCSATATTATMWCAPSWPRRRSTASTCSASSTR

SEQ ID NO: 19210 - protein, 171 aa, Pseudomonas aeruginosa
ARYSHSNGSAPGPCRASHRSSPWRCGSSGSSLTKRPSSGAWGGVATGRQFKGSRMVGLRESCGTEGNRTCRRCARTASSRRCCSRGSASAPANSQRRRPRRRHARSAGALCLRRAGPRRRTGPAGSSSRRRSSRSGGRSSAPGPRRARRARRGRRSSVRRRRGSAARWRRW

SEQ ID NO: 19211 - protein, 239 aa, Pseudomonas aeruginosa
SSPMARSRPSACAPRCCSRTAIRWLWKTLATARRAWPSPRPARYRTGSTSTPRGCAATGSRALPAAAWPMSRRHTSTPPASPCRWRGAWSCWSGPSAPTVGSSRTTTTASIATAVRRWRRWPRWTDRAGCSTSGPSARSPSRRCAWATWWSRRRWSSASASGGPSRYAIRRWAPSGSWPTSSPRGISSATSAACAAPPAPAATPCCGAGQKRRVASRCRRWMRGCTCACGSTAWRGNGP

SEQ ID NO: 19212 - protein, 520 aa, Pseudomonas aeruginosa
AFFDRLRCGPAASIAGPGRARSRIGSGAQWNQARRDHVFRQQDVGQGGFVQQLFLAYQFQYAAAALKGGLGDPRGVLVADVRVQRGDQADAVLDQFVAALDVGGDAGDAVFAEHVHGALQQADRVEDLVGDQRLHHVQLQLAAFGRQGQGEVVADHFEGDLVDRFRDHRVDLARHDRTARLARRQVDLVDAGARAAGEQAQVVADLRQLDRGALEHAGEQHEGAHVGGGFDQVGGRFQRLPADGGQALDGELLVAGVGVDAGADGGAAEVHFGEQLRRQATQAIEVFAEGGGESVEFLAEGHRHGVLQLGAAHLQYAGEFDALGGEGLDQAVEAGQQGVVAEQQAQADGGRVGVVGRLRHVHIVVRVQVLVLTLGMAHGFQRDVRDHFVRVHVGGGTGAALDHVHHELLVEIAADQAGAGLADGGVLVFREMAELTVGVGGGLLDHGQGNDQLRVVRQRHPGEAEVVHGAQGLDAVVGVSGHFEGAEQVFLDTGRCNGGHDGICLRGTRPVPRCPLELRM

SEQ ID NO: 19213 - protein, 249 aa, Pseudomonas aeruginosa
AWSTNWSAANWRSVAGRNGSCRRKSACTAARWCARRRSACSGASWKAGWAASSRQARAAPGRRPAGHISRTMRPSICPARIWSRIWLMSSSLPGWMVALTRPSPAKSRASCRSARVPTMEPAMCRPLSTTSKIGVGKSPGGRPTRAMVPPRRAMPMAWPKALLDTAVTSTPWAPPMSRWIASTGSSCRALTVRLAPSLRASSSLASSMSMAATCRPMALAYCTATWPRPPMPEIATHWPGRALVCLSPL

SEQ ID NO: 19214 - protein, 425 aa, Pseudomonas aeruginosa
GSNHENRCHRWRPAGPHAGPGGNPAGHELRFPRPGAGRLRGLPGRAHPRRLRRPGAPAATGRRGRPGDLRVRERAGGNRGLPLPVRAGLPERRVAAHRPRPLVREVDVQGPRHSHSGLRRRPVPGRPRCRRSRHRPAGGAQDPHPGLRRQGPEGPAPAGRRAGRVRRTGQRAVHPRGLRAVHRGSLAGGGARSRWRDAFLPAGAQHPRQRHPQALRGQQRASVAGAGRGLRRPRAGPARLRRRAGLRVLRGGRRPEGQRDRPARAQLRALDHRRRRVQPVREPLARRRRPAAGLDRQGRRERDAQFHRRGPPGGSGGRRRRLPPASLRQGLQERPQGRPRHPALCRPGDAAGAHRRGRGADRGVSDCRPPILGLAGGTEPKAFLHCPMAGAIHAHTPVRRDCHGINRNHHRRTDRWSRCTLSEAR

SEQ ID NO: 19215 - protein, 228 aa, Pseudomonas aeruginosa
SGDLFVQRGVLGQVGDLEALFLGVGQAGRVDVADDHHRRAEQACRGRRGQADRTGAGDVDRAARADAGGDRAVVAGGEDVRKAGQVADLLHRRFAVGQFQQVEVGVWHQPRIRPGRRPSHPCRRSRRAPPARAGLTVRQTPVCCSLQVRQWPQATLNGTETRSPIFMVSTPRPISTTSPVISWPSTRPSGAVVRPRTMCWSEPQMLVETTRRITPWSICRPCGSCIFG

SEQ ID NO: 19216 - protein, 96 aa, Pseudomonas aeruginosa
SPSRPGAGTVPATAPACSERGSPARRHSLRAPARPWLPGPACRSGRAGSGGRECRASAPAAPGPGDWKSPPPRPSATGRCAGGRAGRSGSGRPWKP

SEQ ID NO: 19217 - protein, 457 aa, Pseudomonas aeruginosa
ERHRRALRRRGLPAADRYHADGRPAGSDGPGQGRGGRLDPQRSDQEPLRTDPQHPRHAQWRQRHGDAPGAGAVRRADEADQATLTDCAGTYPCRHDRMEPHKGSATVPEAHMTDHTQQFASDNYSGICPEAWAAMAEANRGHERAYGDDQWTARASDYFRQLFETDCEVFFAFNGTAANSLALAALCQSYHSVICSETAHVETDECGAPEFFSNGSKLLLAQTEVGKLTPASIRDIALKRQDIHYPKPRVVTLTQATEVGTVYRPDELKAISATCKELGLHLHMDGARFSNACAFLGCSPAELSWKAGVDVLCFGGTKNGMAVGEAILFFNRDLAEDFDYRCKQAGQLASKMRFLAAPWVGVLQDDAWLRYADHANRCARLLAELVADVPGVSLMFPVEANGVFLQLSEPAIEALRARGWRFYTFIGEGGARFMCSWDTDIERVRELARDIRLVMGA

SEQ ID NO: 19218 - protein, 416 aa, Pseudomonas aeruginosa
  UNSURE (20): Identity of amino acid at the above locations are unknown.
RRDARRRAPGRTVPGFRRRXASRSQPLPSGKRTMNQAIREPIEHTTGETMPAATRRRRTWLLGGLAGAIALAALLAWWWSSGRFLEGTDDAYVRADWVAVSAQVSGYVAEVLVADDADVQAGDLLLRLDPRDFRQRLRAAEAREAAAQAALEAQRAKLETLDRQLLEQAQTISRARADGEAARAEWRRAETDWRRYRQLADEHATSRQRLENADAAHQRARAAARRASAEEGRQRAAKDVLKSRRREAEAALAQRQAELQEAAAARELARHALDDTEIRAPFAGRVGQRKVRLRQYVTPGLPLLAVVPLEQAYVVANYKETQLERIRPGQPVELEVDTFGRRWRGRVDSVAPASGAVFALLPPDNATGNFTKIVQRFPVRIRLDADAAERGRLLPGMSVIATVDTREPDGASADER

SEQ ID NO: 19219 - protein, 315 aa, Pseudomonas aeruginosa
RDHPLHRRARHRPAADHGRALGTGGEGPGQGRGRLGLGADLDAAQPRRRDRHRAADATGLAARALPLRADRRDPDDLRRRPAAAPGRWPGADTTAGAAAGAGPARPRGAPAGLPDGLLRRLLPFLRGAPGLRPGLADAAPEGLNSVALGHPVGGAAAEIEARRNAQGPAKHGAEGALAVVAEVQCDLEDRVPCRQRIEAGEQAHAPQPLDEAETGFALEGAGQGPRADAQATRGIAQAPVGGRLGAQAAAQRRQSRIDRLWHVQGEDRQHPQFIEDQLHHPLVAATRRVVRGDPHRRDDQLPQQRRHVHHPAVPR

SEQ ID NO: 19220 - protein, 157 aa, Pseudomonas aeruginosa
RALRDRHPLGLSEVRAESPPGDRASSRAVARRRRSRARRAPVGRPAGTGRRPSAAPVHAPPSAGPNASRRRSGTPSAWKTAPPGHRGSPGAQRSAPATRLDRHPAGRLPRRPRRPASGDGAPVPRQPHRHAAQRPAPASPRRARRDAGAPARTRSCG

SEQ ID NO: 19221 - protein, 466 aa, Pseudomonas aeruginosa
SATAQWTPRKTANPVAGRAPGRAPERQRRCCAARSPGCRSARATATPRTNRARRTPTPPSKVLLQPAGQPPVPRGPRLQHLDTAGHASGKHHARRYPVEFDAHRHALRQAYPAEVRADLRQAAVGTAFVEVGDTATDARDMAVEQRIEPHQLDRRRRADLYIAQLGFLEIAGDPEASPIDDEDVGPARRRVIAGLHAQLRHIAVHRRAQLAAPQVQPRLVERRPGGLGAGAGDTQGASGVGDLLARNRAGQLHASAPLLVTLAQGFPRLLQLRLALAHGQAIAARIDAVQRIAAGHPLVICDEHRLDAAGDFRRNADHLRADPPVAGPGRQHVGLPQLQRQAQGEQAAGEGRSHLGKTNDGHGDLGSELQHQHGQHDERQEETQQAGMPGAFQPAPGEALQQQVERHRQAQVEEQWRHVEAGNGDFAQHAGHQGIEGAERSAAPVGLRSTGYGSWRFANIDYSARK

SEQ ID NO: 19222 - protein, 342 aa, Pseudomonas aeruginosa
QPGHRQRQGLLPLRRAGGGTPAERLLHPGPVAAGPRTDPAPERATAGLSARRPARTSRRGAAGTPGTGADRTALPAAAGQPRPAPHRRRTDPRPRRPRQHGRMGQASGDERAVPGADGAPGDRHDLRPVAPAIADHHRPAATVRRRFGATHRRDPRLRVGQLVHRHVPQGARQPPGPLRARQHAAASRLNEGRRKGLAVRQLFSPRGWHSKTLLGIMPPFFLQEDQMVTHFLSESGQAACGRGDSNVNGSSDVGQVSCKTCRRTNAFAQAQENAAPASAPVTPTAAAPVIDKAAPRPKAEARPAAAQRQDRDAARKAWQARLNELSGKNRMPRSRRRAQAYL

SEQ ID NO: 19223 - protein, 176 aa, Pseudomonas aeruginosa
IPGAADRCPRRRSRTHRSAARPRYRMPCSSHGRRRSRRSNPADRQAAWHIPAPSVPRVRARPQAAAARRACASPQATPRDAPARLQPPACAPVAVDAARRRSAPTHRRPPAVRVRPGAGSPRPGGNRQAVSRGGKTAAVPQTPAAPAPAGSPPDAPGVARRPRAAAPPRPPRRAET

SEQ ID NO: 19224 - protein, 483 aa, Pseudomonas aeruginosa
SSSLIIIPALSPTPSPRASPKAWSVPAIPRKPPIWRRKASSRASAWPTTPCIAARRRLPPTSSPSRRASIAPIPWCWSTRSTGGRCRPCSRAGSIACSPMAGPSTTASAATCGKSCSACAWCWSVSAAPMPAPSSGTATPGRCAPRSTMASSITAAHGWSVPNCCWSRRAPIRSGIWTRPCTSAASSSPHAARRGPPRRSRWKPDPRSFGQVHGETGPLRGKFVAQGQRRDQVVAAVLPAERDRRSALQVIEAPAQLLAQRGETLRVDPAAAIDDERRQYLEAGVMQDAVVDGEQQVVHRSVDTARGVVRLPAAGGDYQHRPLALHPALAVAVAPVAVGMFADPVGEAAGIDAIDPTLEDRRHAEPPERELQDQRIGPAQLVLLTGDVDALPTVLEGAQGSCGRIEAFAGLALEAVAGIEHGLPAHRVEVRNLHRMAGRLEAGDREVLERTVEGARLGMGIDDEYVHGGSPAKGGRRIGHRRI

SEQ ID NO: 19225 - protein, 305 aa, Pseudomonas aeruginosa
ISEIPGIWMINLRRLDLNLLVTLDVLLTEHNVTRAAERLNFSQPSVSVHLAKLRAIFDDPLLLPGPRGMRPTARAEELREPLRLALEALEQAVAPAAPFDPTQSRHTWRVAATDYAESAILLPILASLRRQAPGSRLAVLELAPTRIVRQAERGEIDLGFHTLEESPPGLRCRRLFSERYVLAGRAGHPGLRRRPTLKQFCRLEQAIVSPDGGGFLGPTDQALAELGAERRVALSVPHFLFLRAVLESTDLVALLPSRLVRERDRLRVVEAPLEVPGYDLAMLWHERSHRDPAHRWLRELIAASV

SEQ ID NO: 19226 - protein, 193 aa, Pseudomonas aeruginosa
GRAVLARLPVALVLRDGLQRAVRRRPDPFRHLLPGSGRGAGIRPDAPGTAPARRVPVARQPGGQRRGRFRTGRPRAARGEPGAGSRPLRRRKRAHRSAAATPAFPVRARPAATVPRALRRTCALGRLAASPGRRRRLRQRAAGPPGRAQRRPHDRSGGPRVRLPPAAMAPGAPAARAQDQAGRLLERARRGVP

SEQ ID NO: 19227 - protein, 386 aa, Pseudomonas aeruginosa
TGEPALGGARQPLRGFPLGCHARRRRSRPADPARLRPGSRPGQPGRHRQGLGADPGQPAQSPRHGGFRLLAEPGAAVAGRRDRRGHLRTTQARGLRAQPAAGGGHRRTGRAALCRRPGDDQCHRPAIPQRRVHPPADTEEPPAADPDPGPARRRRLGRQPGQPLRPRTDPGAGGGHGRGATPMLILLPDFIGHPSCFRGLLARLGATDCRLVDYHRLDAYASIEALASQVLDGLAEEPDWLIGYSFGGLVGYEMARQLPASRLLMIDSHLPWPALRRMPPSEQYQRWLSAEMREWIALMSELGELREEVLLRNVELFGRWQPRHRLARASWVRCRDDAGRDPAAERWCDLIERLDTFPCERPHHLALQDPAVIDFIVHTVSKESVQ

SEQ ID NO: 19228 - protein, 145 aa, Pseudomonas aeruginosa
RWSPSSPVSPASSAMRRRSTTSSGSRGWRRCRPRTRERDDDPGHRLHPARGVPGPPVQLRQRAVGPAGTGNRGAGGGYDRVRPPADFRGRTRAGTRRGGGGFHAGAGPHPGAPGGYRRGAGNRCASGSGCSPRSTRSRWKPSSRA

SEQ ID NO: 19229 - protein, 276 aa, Pseudomonas aeruginosa
STTATAPASASSCSTGACSTARRSTSSPASSTTSATAGRATSTATYTTATRCSCSSAATRTTAAWRWKSCSAASCAVCRARPACSSPLASSTATATSAAAAPTSISSTRAITTRAYWRLPNEAVRQARRRLQRGPRQDRLSGFALPQPRRTRPGTRSGAGHRLRQRRLDRPPATLVPLRGRQRPGRGADRQGPRELPGDPLQRVAGGNLRAATPLRPGHQRHLLLLDGPQAGADAHGRLADPRRAVLRLQVRLPDRLRAAARLHRARTGEQVGQTP

SEQ ID NO: 19230 - protein, 491 aa, Pseudomonas aeruginosa
RHPGDHGQLPAPARLPPRSVRQHHLPQPGGGRAVLPLHQLRDPLHRAGRRRRLRRPLHRRGARDRERAAGGGELRHPRLHRAESLRSRHEQPPRTRIARQHPPPSRQRRPAAAVPDRRPRAGATAGIHLGRRRPPGRCPRRADRRACLPQCRRAARQQLPQPLPDLCGHARGQASGADRSRVGGGREAGHRRRDAPGRAGQRTSARGRAGRAAPGAGLRAQRDAPARPRRAQPHDPVHLGHHRPAERHRTQPAGHAPCLPHRPRLPGHRRAHALRLLLPDQRPGHPRHQFPLPAAVRRQRGAPAAALLGRQRRLLGMRGTLRHQFPLPGAAGGQPHGQGRLPAAAPLAVAAPALRRRLGAPGRRPAGGLPARLRGAGEHLRPQRVRLCLPLRQASRRCVRQLGGTCRRPGTQADRPRRPPAGGQRRTRAPVGAHAEPVLRLRQPPRPDRPGARGRLAEHPGPRLLRRGPLRARPRPLRRHHQQGRQPVPPE

SEQ ID NO: 19231 - protein, 621 aa, Pseudomonas aeruginosa
MRKGAQRPGRGDRRLLPEGRLPALWRKLCRRDPHRAAGRVRLPALAPAAARHPPRATARGAVAPGPAAERRRQARPPCARRPAATGSLVMCGILGYVGTGFSVSRFAGALRLLAHRGPFGEGIAALPNGAIGMTRLPMSGAAAVPLPPQEGQRRVAYNGEVYQAGCEIHGEIRLLLDGLQRGVLPDGMYALASWDPQTRQLTLLRDEFGIKPLYYSYQPERGLLAFASEPRALLHLLGGARADAEAIAQVVAAGVPLEGQTLFQQVRLLLPGEVLRFDLSQERPRLCQRQRLATAPASEVDSLDEQLGETLERCRQTFRPCALLVSGGVDSNLLGSYLDPQLQRFHLCLEGDEESLLPHPRLQRFELRQEAFMPLLRRAVGNFGGATRMSSLLMYQRLADGIGEQGYHCVLLGEGADELFWGYPRHLELWRRRDAPEPRRFAAAWFGEYRRKAALLAEPAGRRVAERIEELAHEALGQGLEAAIGQFDLHYSLEPLLRRADHLLMSRTIEARTPYLHGALAQRAGRLQRIVGDTAKAPLVALLEQREKRWQAQPKRHFRLPFERWPQALGEMRRHLAERLPALHDLGLEGLDAPSVAALPGDQLFTLTTLSLWQQEYGASL

SEQ ID NO: 19232 - protein, 422 aa, Pseudomonas aeruginosa
AAQPCPAILDGVPRSLPEHGPASRLHPAVAVQHAGRADLRHLRFDPRAVPHPQRSARRGQQHRPAGDHQRADHSGRPVSPPPPAGKHRHRRPPDARHAAHAPGPARLRLDPGDPVRRPGAGHGGAQPRRTDRVPDLQRGGRPTDPRRLARQLFRRGQSLQPRHRAGTAVRRDHARPCRQPGAVPRPGRAVRGDHAAAGRRGRPAPGRAGRRMTGALLVSGFFLRRSAWSVEGAGWRSCDHLRDAPGCDLAHWLDQAAATLAGEERVILCGHSFGGYLAQCLAARLGERAAHLYLFSALVSEGGGALESYQDSGQDNLLGLCRLDPLGGRVRLEDRAGFLELLGAEVPTSASEPAQLLIDPPPQVRPACPVTYVVAAADRLSPPPLQRTFAHRLDARVREYPGGHLAALADPRFLRALIESNN

SEQ ID NO: 19233 - protein, 256 aa, Pseudomonas aeruginosa
RMMTPSTARTLAQTSGDGPNGDPIMIERRPFDRLGHANHGWLNARHHFSFADYYDPEREDWGRLRVWNDDEIAAGSGFPPHPHRDMEIITYVREGAITHQDSLGNKGRTEAGDVQVMSAGTGIVHSEYNLEAETTRIFQIWIIPDRRGDQPRWGSKPFPKAERDGRFVTLASGDEQDSEALHIRADAEVAAVTLKAGQSAEYALENGRRAYLVPATGSIEVNGVRAEARDGLAVRDEPTLKVTALEDSEVLLVEVA

SEQ ID NO: 19234 - protein, 337 aa, Pseudomonas aeruginosa
TATPAGEPRAAPAVPQRALRAGRAADPRLPGADRRRRAGHAGRRRAAGRGPAGGGARLPAGGRRLVPGRTPLRRLPPAQHLQGLAVPGQLHPPEPEHVPAGRSEGAADVEVPARRQCVVHHPGRHDPHPPAPLPRLRRRRLGTLGRFRAAAGGDLQRCGRPPAGPAQRLRGHRRAADRRRLRRLHRLEALAAPAPAVAQPADSANQRGGTGKPSRTGAIAGDPRCPRPSRRRAERHSGSHPGGAERVAEGPPRRPQGRQHRHLLRLSPRTFRRDARPAPQRLRLHPHLGAGRRPGRLAQGLRAGRGERLSDAHRVQPRACTAAPPACRCGAGEENTR

SEQ ID NO: 19235 - protein, 715 aa, Pseudomonas aeruginosa
AAPTPDNPAPTMSTSRCSTGIRFLDRRKRPAVCWADALHPTEGMPRGYPNLRTAISAKYGPRRGNHPCRRTGMGRALGGAGRFLRGLRRYRATVFQLVGLEQRLQLDPRLASAFDQRVAVVVEQVLGGQDLFVVPAETTDPRVRLFLAQTQAAEHHAAHLQAGEEGLAHRLDPGVEQQVDVLAVTRASDDLQVRIQLAHALGRLDVGLRVIGGDDEELGLLYLGRAKDLRAHRVAVEDRDRAEGTGQLDGLHRGVQGDERHALGAQHASDDLAHAADPGDHHARGVVVVDAFHFRRRLRRLRLLRQQAREAEYQQRGQGHRQGDGKHQQVVQVVLEQALVAGHLEHDEGELAAGRQDHAQAQRRGLVEAAGNASDEVQHRRLQGDQQHGQAEHHPRRLEQQADVRAHPHADEEQAKQQALERLDLRLQFVAVLRVGQQQAGEEGTEGHGHAGQLHQQRGTHHHQQRSGGGHVLQLGLGDDAEHRAQQVAATDHHRGDATDHLEGLGQFAAAGVAVRTAEQRDHGDQRDRRDVLEQQDGEGQAAMGLGQFLALGEDLQAEGGGRQRQAQAEHHRAVHRLVEADQGHGADHHAGQQHLQQADAEHRLAHHPQAPRRQLQADDEQQQYHAHLGDLRDAFRVVHQAQHAGTDQHAGQQVAEHRAQLQALGQRHHEHRRDQEDHAGLEKTASVFHAQLPLAALAPNRSRMVAMVSTSMAI

SEQ ID NO: 19236 - protein, 331 aa, Pseudomonas aeruginosa
GSAIHNCAAWAWRSSGSDSSVWAMPWPAVIRLTWPGRITWTLPRLSRCNASPWIIQVKVCRPMCGCGPTARPPPGSNSAGPAWSRKHQAPIIRRWRDGISRLTVIPPPISAARAVTRCSRCSWRSGQSREEDRSQRSSVLLMFRLSGDEAFNRAGGAPIAAGPATAAGSARAPCRRAAGPGRRRRSARWRSSLPACSADERRGTPASGASDTAPARCRNARRWHRGSPPACRRTAAPAAARPSRWHSSAPRPSNSCIPGWRTAARPPRGSARGSVPPRAGSRGRRRPRCIAGCRRCPPARCSCPAGPGQSPPAAPRCCRSRCAGCRKCPIP

SEQ ID NO: 19237 - protein, 269 aa, Pseudomonas aeruginosa
PWGFSCAWGGVPEPRVPAKRRSDENTWTENDTRHPMVGVPCVRDSGEAGLLLRAEALDQVGVRRQVAAEDGTEAFDVVAPVAVQFAADAEPVHQLRAGGGHARPGGVAHHRVEGAGGVGDDEYVKPLLQRREGREGYADIGHHAGDDQLLLAGGLDRLDEVLVVPGVDVAGAGDVRGLRKHFLEFRHQRAVGAILEAGGEDGRQVEEPGDVGQCQDIVLELVRAEIADQGEQACLVVDEQHRRIVLVESLVGEGHGVSPVSGGVRRRAV

SEQ ID NO: 19238 - protein, 357 aa, Pseudomonas aeruginosa
  UNSURE (349): Identity of amino acid at the above locations are unknown.
NAKTVFSIREQCHSPGALRLPCHCLSRTCDARIPLPGVLPHATVCLPIVSRFAMSLRLEDIQAFLNVVELGSISAAAERMSLSKSVISKRVSDLERHLGVRLLYRSTRNVEPTEAGGFFYKSAKASLQDLNNAAESVALRENDLCGELRVMAPMSFGTLWLGPLVMEFMARNPRLEVVLQLDDRIVDFEKEGYDLAIRITRLQDSSLIARQLGTSRRVVCCSPEYLERHGPLQRIEDILCHPCIGYSHNTPSQLWSFEPRVAGEPARMITPRGRFNTNNGQTMRDAAVRGLGLAMLPLFIAAEDLAAGRLVEALPQERPLDDLIYAMYSRAATFSPKVKLFVQFIPAGXGQPAVGRA

SEQ ID NO: 19239 - protein, 203 aa, Pseudomonas aeruginosa
VGIPESAERPAPVMTRMRSARRRAWATVAIGLWLSMVGSCQAGGSREAGKPSRRMRPSRVVRGIRNRAAARERLPRAWRKASSIRLRSCCASASRRPPTAALFIESAASPPTASAPSSANATSSSSAPPSPCSNRLRRITFSSCRTLPGQSQASNCASARSPRAVTRGLRLRASRRTNARASSSTSPGRSRSGGMHRLPTSRR

SEQ ID NO: 19240 - protein, 168 aa, Pseudomonas aeruginosa
LPSCRTRSSLLCMAIGMELISSRNKLPPCARANMPLRFSAPVKAPRVVPNRVLSSSVSGIAAQFRLIIGPLRRGLRAWARRANSSLPVPVSPWISSGRSVAAKTSRRCNCRSRLGATLRMFGQSARPAASSVSATTSPSSIAPSRQPSRPRSGIARWRYCNSSPPAPT

SEQ ID NO: 19241 - protein, 532 aa, Pseudomonas aeruginosa
SRWTPPNIARSTAASVACRCASEPCRGGPTRRLPPSHPGAGSACAWRDIPDAVSEVPHGRFGQGKTGAAGADRAGGGRHHRQRHLQPAAEHGRRRRRRRDPDRLGDHLRRHADPDADIPVAVDHPPRTGRRRLRLRPRRLRRIPGVQCRLGLLDFRLGRQRRLPGGAVQRPRLVRRAGLLRRRNHLAGAARRIDGALADACLRPPRRAQRGDHQRHRDPRQGGADRPVHPLRSPGLPHRDLSPGLLGQPGPGQRHPPGGNHHALHRLGIPRHRERHGLCQPRAARGRCQPRNPARLRGHPAVAGLRLGAVAGRGAAARTGADEEPLDGPGDGRGGGPLGRHADQRRVDRLGRRRAAGLDHARGGNALPGQPWPNAHRAGTVRPHQCGGNPGAGTVADQHADLCAAAGGLPQRLGLQRADPVGHLDGADPLPALRRLLPEAGGAPPALGRDAGAGAVGDALRGLADLRRRAEIPAAVDDPLRARPGLLPACPSPARPAGVRQSRRRQRRGAGADPRAGGAMDDRQRSAEPLAQ

SEQ ID NO: 19242 - protein, 323 aa, Pseudomonas aeruginosa
SRIGNPCRPERRTDPRRGSEVHHVEEARRGVLVDAQVGEVEQVAVGQLRRHHVLQGAEHDLGTPRRFAFPFQQHFLDHLALQVLLRTAEVAGDDRELLELGIGLDVLLAAIGQRPDHHVAPVVGQQLRRHGLQGAAVEHVEEEGLEDVVAMVTEGHLGRADLVGEGVQRATAQARAQRAGGLAFRDLLLDHRVGVLLDDVVLHADRLQVLRQDMLGKTGLLLVHVHRDDLEADRRDLLQVEQDVEHGVAVLAAGQADHDLVAILDHVEVGDGLAGQAAQALLQFVLIDRKGAHGALESGCSRRKAGYFTHKATPTPAPPDARC

SEQ ID NO: 19243 - protein, 200 aa, Pseudomonas aeruginosa
SCPMTPDLDHRLDLAGQILCLLREHPEGLSEYQLIQLLKARHSTHIPHRELADKLVLFRTHFLLFNALYHLRDHLWAEREAHLEISPLSLRLHPYVDGTQALEQGDPLRDYYLDLRHLGETSEADVERLLQSFWTRMQGSEEKAAALALFELEGAVDYPAIKLRYRQLVSQHHPDRGGSTARLQSINKAMEILQRYYSRP

SEQ ID NO: 19244 - protein, 191 aa, Pseudomonas aeruginosa
SPAAGVFPNARTPQRPRRGLLSAGRTLLPTQLPPPDRQLPPARPESRGRPSRREPAALQSPAVPREPRALPGTDRGPRSRAPDRAPVVRPAHPPPRGGVAVDHARHLRPAAGPLPHLRGQAPRHHPLPVPLPLPGAQRLPVLPATPHPGGQGAPLLLPALQGDPGVHRRSAPRVIQAMAPAAFSSAIRSAE

SEQ ID NO: 19245 - protein, 139 aa, Pseudomonas aeruginosa
PRPSSTATVSAPSAAPMWRGAGRPAENLIGQAICAWLPPSASGTRATSPRACNCGCSSASESGSSGSTQASRAANTACHSAKSRFSNSISISRFSARCSSGFGDRPRAASSGRPMAAQNCCMNCGSRLPTENQRPSRVR

SEQ ID NO: 19246 - protein, 479 aa, Pseudomonas aeruginosa
LAEVPSTCGGSTRTRSMRPGDSTRSTSAPMSASSSEANGPGNRVEKSSTFNDDNGPFMLPPLGRRALVGIACRAAYPPAARRDMAVASELHAAADDLFHDLRGTGEDPLDAGVGVHPADRILPHVAPAAMQLHAFVDHLAQQLGGEQLGFGGDLGGQLLLVVVHHAAVGEDLRHVDLGTHFGELEAGVLEVRDRPAEGLALLHVVDGRLQRRLGPGHRAAGVGQALLGEHVHQVEEAALGVAQQVFLRHPHIVEEQLGGVLALHAELLQVAPALEALHAALHQEQAHGVLVRRIGLRRDDHQVGQQAVGDEHLGAVEQPVVALVHRGAAHAGQVGAGGRLGHGHGEDGLATDDPRQQAGLLLGATVFGDVRPAQRRVQRDHEARLVDPRQLLAHDLLVAEVLEPGATVLLVRPGQQEAHLPRLPPDSAVDHPGLFPGVLVRHHLFVEKGAEGIAEQVVFGLEDLPLHVRGLPAVSGSAG

SEQ ID NO: 19247 - protein, 622 aa, Pseudomonas aeruginosa
LAHVAAGDGGGGRPAQRERSGFRRRPAAGSRRRGRPGYRAGTGDPCPRRDRQRPPGGRPRAALAEPLRLLRGEPARSGATSAPLAVPRLAARAGRRRGIKKPATRAGSKGGRELFTSPCRTGLSLDRFAAAHRNIAGRRRSVALAGQFALQGALVELLAPLGNHYRGHAVADQVGQRAGFGHEAVDAEDQRQAGDRQVADGGKGRGEHDEAAAGDAGGALGSDQQHQQQGDLVGDVHRCIGGLGDEHRGHGQVDRGAVEVEGVTGGNHQADHRLVAAELLHLVDHPRQGRLGRRGAQHDQQFLADVPDEAQDAEAVGAGDAAEDDEHEQDAGDVEAQHQLAELHQRTHAVGAHGEGHGAERADRGDFHDHVDDVEHHVGDALDELEHRLAVAAQAMQGVAEEHGEEQDLEDVAVGERADHGAGDHVHQEVDSALLLAGSGVGSDLAGVEGVRVDVHAGARLDHVDHYQADDQGHGGDDLEVQQRHAAGLADRLHALHAGDAGDHGAEDDRRDGHLDQFDEAVAERLHRHRRFRVPVAERDTDGDGDQNLHVQALVEGLFGHGQSPHGGASPVPWNALTGSVTPLAGEIFCREPPRRNLAQALQRLCQDALSLNKILIYQQVK

SEQ ID NO: 19248 - protein, 179 aa, Pseudomonas aeruginosa
RTARSPAAGLPACRDRPCPARRTGSPPAAPVARDGVPGRSCAGWRAATDSLSAGSCARSGPVAPAPARGCRAPRRAGRRPPARPPAASSDCAPGRRGSGGSARAACARCATGGSASGSGAAARADAPRSGSRARRIRSGPARNSTRASPGSPRSDPARAARARPAGRRRATGRAARGTP

SEQ ID NO: 19249 - protein, 339 aa, Pseudomonas aeruginosa
TAPPGRRRRASDGCAGNGSPAALGEQVALAAHRIDRLEAAAGLQLAPQAADQHLDDVGVALLVVGVELFHQAFLGHHLLVMPHEVFEDAVFVGGQRHRLLLDQRLLAVQVEDQGAGLDGRLDEPRGASQQRVQARFQFLELERLDHVVVGPGGQAFDLVLPVAAGGEDQDREGLALRTQLADQVQAAHARQAEVDHRQVVVVFADPVEGFLGIRYRVHHVPLFTQAGIEVVAQQRLVFHYQQFHEVPPDEMRPDLPARPSKHALAGAARSFRTCSWRPGRIASCCAGPGSPACCRHAGSSRCWRWCADNDSRLRSRHSCSAPAGYRPAARQRSRHRCRA

SEQ ID NO: 19250 - protein, 100 aa, Pseudomonas aeruginosa
TRAERLAFAGERSVSRLPRAGSARFLPVLQVGSRLSTVACIEAGPMNEQPDQGRVKGMEARLFLFLVICLFPLLSVALVGGFGFCVWMYQLLAGPPGPPA

SEQ ID NO: 19251 - protein, 224 aa, Pseudomonas aeruginosa
SSAPVGSSNSTSPAPAARCAGNAPAAARPACSMARARPSPGSPRSAKPAWPWPGSTAAVARTPANPPRSASARPPAASPWPSWTASAATAAAPAWRPVRARPSNCARYPPRSLHDMPEALQIASLILHCRPERLPAVKANLALLDGLEIYQESPQGKLILVLEAEREEQILDTLGQLQNLPGVLNAVLVYHEILHDDDSNDAAAMTDRAIPCSPEETIDEPHPS

SEQ ID NO: 19252 - protein, 832 aa, Pseudomonas aeruginosa
IRQGQRRRHRRGGGRPADPGPRQQPGDRGGRHQPGLEQGPLPLLRHRLQRDGRHPRRPGGSHPWRHQGRGQPRDQLREGLLPVEDHVRQRPPDPPTAAHEGRQVRQAGRVPADQLGTGLRHHGREVQGRAQGQGTGVGRHVRLRPVDGLGRLCGEQAVQGRPAQQQHRPQRPPLHGLGGDGLHAQLRHGRADGLLLRHRGHRQLRPLGLEHGRDAPGALVAGHRPPAQRAAGQGRGAVHLRAPQLRAGRLAHGVQAADRPDHPQLYRQPHHRERRGEPRLRRAPRALRPWRRGHRLRPAPGRPAGEEGEERRQGQHLERYRLQGLRRVRQALYPGAHRARKRRAGRAAEGPRRTLRRPQAQGGVVLDHGLQPAHPRGLGEQPDLQHPPAHREDQRTGQQPLLAHRPALGLRHRARGRHLLPPAPRRPGGDQPEAPGNRGEDLEGAGRHHPGEGRLPRRAAEPDAQGRRAQRLLDPGQQQHAGRSQRDAGSAARLAQPGQLRDRLRRLPHRLGPGRRPDPAQRHVGGEGRRLRQCRAPHAVLAPVGEGTGRSEVRPLAAGGILQALHHRRSLARGTAGEGPRAEGQDPLRRAVPQRPGRPLPGQRPGQGLRQRRGRRIRLLYPEGSVRGIRRLRSRPRPRPRPLRRLPRGARPALAGGGRQGDPLALPRGLRPLREQGQRRAVLWLSGQEGDRLRPALRAAGRGAGPGLPVLARHRPGARTLAHREHDRAGPGAVQGGARRAGLHAPGGCAPAQAAPRQRGQGGEPARRDPRAGRDPRAQQAAPGAGVRAVLRRQQADQQGHPGRHRPDFQADRLQEVRRSHRTAQPGLRSAP

SEQ ID NO: 19253 - protein, 228 aa, Pseudomonas aeruginosa
SRWSTTASRTSTRSSRKKPPMRRANPEGGRMKALIAWLAGYWRVLRRPSVHFSLGFLTLGGFIAGIVFWGGFNTALEATNTETFCISCHEMRDNVFVELKDTIHYSNRSGVRATCPDCHVPHKWTDKIARKMQASKEVWGKIFGTINTREKFLDHRRELAEHEWARLKANDSLECRNCHNFEFMDFTRQSVRARQMHSTALASGEATCIDCHKGIAHHLPDMTGVKGW

SEQ ID NO: 19254 - protein, 366 aa, Pseudomonas aeruginosa
NLARADWRRNTHAGCLAADPPRHIRARTRCATRASVFRALAGRSPVQAVFPASVHKPEPAPTVPDHRRKAGRPPPATAPGFPPSLHVSEYNLDPLVERPDVLDSPAADRRHRYPPGRRQCRSHRPRLPAPAGAPAQAGDLRRRRRCHPDPHPAAVLRPAPARPALPQGNRRAPAAVDRHQAAAAGGGERRRHQGQHPPARRDQDHHHRRRGDEPGQRHRPVRRLGRGFLPGLPGRADQHPDHRLGQPADPAPDRPLPADHPLRRRPARLDRRRHAAHRQRPEALAGALRAMGFLPALRRGGLRRAVRDPPRQPPGAPPVEAAACRAGGRRRKRRPLRATGRPGAPRPLSPAQILVLAGIRLGNRYS

SEQ ID NO: 19255 - protein, 271 aa, Pseudomonas aeruginosa
SGTLSRRDAMRLFCALLLIACAASAQAAIQTREMPYRSADGTRMVGYFAYDDSKPGIRPGVIVVHEWWGLNDYAKRRARDLAELGYSALAIDMYGEGKHTEHPQDAMAFMQAATRDADAAKARFLAGLELLKRQPQTDPSQIAAIGYCFGGKIVLDMARQGLPLAGVASFHGALGTATPASKGSVKAKILVEHGSADSLVPAKDLDALKQELNAAGADYRVVIQDDAKHGFTNPDADAHKGHGLDIGYDRQADQRSWADLQAFLKDIFGQG

SEQ ID NO: 19256 - protein, 162 aa, Pseudomonas aeruginosa
TTVSPPSAPHWTTAGRCPSRCPACNCAAPASTRRCCNPATSPWPASSRRRTSSARWPSARPSFSPGASAHAPPCSPSMAAPRRRPSARTAHRSGRPRSAARSPMATAGPPPWWRRAATGAGSAWTWKPCSKPNGRATCMARYSPKASACASPTTWSDAPACW

SEQ ID NO: 19257 - protein, 904 aa, Pseudomonas aeruginosa
TCNRPAGPAPVHPGGCGVACAAPCSAKHPEPGFISMSSRKIGLNLVVIVALAALFTGIWALYNRPVSVPDWPERISGLSFSPFRLNQNPQSGRYPSAEQMRTDLELVARHTHSIRTYSVQGALGDIPALAEAFGLRVSLGIWLGPDLASNEAEIARAIRIANESPSVVRVIVGNEALFRREVTAEQLIAYLDRVRAAVKVPVTTAEQWHVYREYPELAQHVDLIAAHVLPYWEATPVADAVDFVLERARELKAAFPRKPLLLAEVGWPSNGRMRGSAEATPADQAIYLRRLTNALNGEGYSYFVIEAFDQPWKVSAEGSVGAYWGVYNADRKAKFNFTGPVVPIPKWRALAIASAVLAVLAFTLLLIDSSSMRQRGRTFLAVVSFACASVLVWIAYEYSQQYSTWFSLTVGALLGVGALGVVIVLFTEAHELAEAVWTRKRRRPFLPITAAQAYRPKVSIHVPCYNEPPELLKQTLDALARLDYPDYEVLVIDNNTRDPAVWQPVEAHCARLGERFRFFHVAPLEGFKAGALNFALGHVAADVEVVAVIDADYCVDPDWLRHMVPHFGDPRIAVVQSPQDYRDQHESAFKRLCYAEYKGFFHIGMVTRNDRDAIIEHGTMTMIRRSVLDELRWPEWCITEDAELGLRVFEKGLSAAYFERSYGKGVMPDTFIDFKKQRFRWAYGAIQIMKRHTDALLRGRSPDGSRLTRGQRYHFVAGWLPWIADGLNIFFTLGALLWSAAMIIVPKRVDPPLLIFAILPLALFVFKVGKILFLYRRTVGVDLRDSFFAALAGLSLSHTIAKAVLYGFVTRGIPFFRTPKMRSSHGLLVALAEAREEVFVMLLLWGAAAGIVAVQGVPSRDLLIWVAMLLVQSLPYLAALVMALLSSLPKPREELAGGAERIGG

SEQ ID NO: 19258 - protein, 689 aa, Pseudomonas aeruginosa
GRARRRDSRLRSPKRRPFARVYALRFPLSARPAQDALPMTASSPSLSPTLELACELIRRPSVTPLDADCQALMMRRLEAAGFALEPMRIEEVDNFWARRGGDGPVLCFAGHTDVVPTGPLQAWQHQPFDALIDDQGMLLRARRGGHERQPGVDDRRRRALRRRPPGAQGCHRLPHHQRRGRPGPPRHQGGGRTPRRTRRAPGLVHRRRTVEHQPGRRRGEERPPRLPWSQADHPRRTGPCGLPAPGEEPDPPGRPGAGRTGGGTLGRRQCLLPADQLPGFQPELRHRRHQRHPRRTDRAVQLPLLHRIHRRRPAETRRGDPRQARPGLARRMGAVRPAVPHRAGRTARCGGRQHQGGHRPRDPALDQRRHLRRTLHRHHGHPGGRTRPGQRHHPPGQRAGPGQRPGAAHRNLLPDPGEAARLMLICPLCSAALGDVDNGVACPAGHRFDRARQGYLNLLPVQHKKSLDPGDNAAMVEARRQFLGAGHYAPLARRLAELAAERAPRRWLDIGCGEGYYSARLGEALAGAEGYALDISREAVKRACRRAPQLSWLVASMARLPLADASCELIASVFSPIDWNEAVRVLAPGGGVLRLGPASAHLLELRQRLYDDVRDYADDKHLAGLPAQLRLRHTETLEFRLALDSYDARENLLAMTPHGWRVNPERRARILAEPFEVSVAVRYDWLQRD

SEQ ID NO: 19259 - protein, 515 aa, Pseudomonas aeruginosa
EWRKEPLPLRLRHPRPVVLDIHPATLQADPEADPDPTIGMPQRIGQQVLQGPMQVARLGLDPTAQLLRHQRALLATDQHLAAQRGDLLHHLAHQRAQLQALVGQRRRALFQACVGEHLVDQLVEVLDIVVHALQVLQAGAVGLGGLDHLQAEAQPRHRRAQLVGHRANHLALHRQQPVDVLGHMVEGRAQASHRVATAHLDASIQAAAGDPRGGRLQAAQALLQTTHQQVGDQADEAQAQRAEQQQQLRRIGVHLEQRAQLQHPGRVEDAGEDADRVAVLAQRHHRVALHHSPALVVVEVQLLDLEQVHREAEALVADDPRKVVRLFAGRVAHQFVHQQVHRGPRQLLADLLHLAAEHQVLGGAGLGIDGDGVLGGLLHQHLAVHQARAAASVHPQLIQPVQLQGNTQQAAPLRQGALALGGGHRLQVVGHQAEGAARKLLAVVLAAHLVDPVQAEQAQAADQQQGQEHAAIDAQEDGFHRRAPGRCPLLLILADRDARAPARRKKAPQPSPTNR

SEQ ID NO: 19260 - protein, 201 aa, Pseudomonas aeruginosa
SSAPISRPSTSSISSVRAVSIRIGPSNCGRTWRQMDRPSSPGSIRSSTTRSGRSARIRAAASAPLASMSTFRPLPSRYSRVSSARRRSSSTIRMRQASCSTQPPRIAVPEPPCGPLRAARIVANTGAARQHARNILQTLHIVGRVRAPKGWGVGLRRCFPRATNGILQRCRGLRTLPRTHAQKTHTLSTGFPQTVTLQTPH

SEQ ID NO: 19261 - protein, 138 aa, Pseudomonas aeruginosa
TPTRTRSPSATWARSTWSTTSSTASWTPPSWRRPSRPRYACSITSSTSTTTRSRRRRTPTSSTVRSAWASWASRTPCTCSTSPTVRTRPSPSPTSPWKPSATTRSRLPATWPTSAAPTRPSRARCGRKASCRSTRRRS

SEQ ID NO: 19262 - protein, 180 aa, Pseudomonas aeruginosa
RPPTTSAPWPPPAPRSPPSTPASSTPCRPVATTACKPPRPPSRSRRRCRRHAASTTPTAKPASDRASLNGVRVAAGQAGLLVWVRPARRLTVARPAPRWQRKAPRQGQEQSPSSLRGRRTARPDRAGPPLSRAPHAPYPGRRDGRQTRREQDAELGRIRQRRPDRSQGRARRRPGRCPGP

SEQ ID NO: 19263 - protein, 327 aa, Pseudomonas aeruginosa
PQPARPLQVRLGLAEVSGWLRQPLDAAGSQHERRHRPVEEQGRPQRTRAAHRHAQPRLLLHRRLPGRQQPGAGRVPPDHQPRVPPVHPAPGLRRGDPHPRLPVLHRVAGHGRGRDLQHVPRDPQRGEEGLLGPEVHPLDLRPDVPDRHPGNRPPVPAQPDRLLLRAGRHLLLLRLHPDPLHGPPQQDDRHRRAVPVHPPRRVDAPELRYRRDQPDQDREPAPVGRPDEGRGDPDDPPGHPAGDRIRARHHAARGAGDERGDDGGLPEVHRQPAPDPDRPEGRVSGDHQPVPVDVGDHGPEEGEELLRDAGYRVPDGRSTELGLRFSI

SEQ ID NO: 19264 - protein, 69 aa, Pseudomonas aeruginosa
CDCLQEYSGQTVKIEQRQHGTSPVETGLVDGQLTGLKARKPLGSTPFFNFLYNSSWAIFSIFVGVVKKV

SEQ ID NO: 19265 - protein, 132 aa, Pseudomonas aeruginosa
CPFHPQRNPDMDAKALLLGSLCLASPFADAATLDNALSACLTARLGAPHTAEGQLHLPLTLEARRSTGECGCTSALVRYRLLAMHANAKAQVLQEGLLDGRYEGTRTLTLAADAQLAADSTLVVRLGCAVAE

SEQ ID NO: 19266 - protein, 268 aa, Pseudomonas aeruginosa
PSTDPARFAMHLLYPSAPDRSNAVDELFAEEYDAARSAGLACSLFCDEELESGRFRARPEFPANTQVLYRGWMLTPENYARLHGAILVAGGRPLTSPQQYRHCHYLPEWYPLCEDLTPATLFLSRNADFEAVLAQSPWRAWFVKDHVKSLTTQRGSKATNAAEVREVLDSIERYRGTIEGGVCLREFEALRAETEERYFVLHGRAHGRLDAVPPLVEQVAQRIDCPFFSVDVVESTSGELRLMELGDGQVSDRKQWPAARFAAMLAQA

SEQ ID NO: 19267 - protein, 305 aa, Pseudomonas aeruginosa
KPSSAPRQPPRIPHPRRPAALRRLARQEKPTARSASSFTHHRSHRDAPDIPLDPPGRQPRPARRRLVRVRRRGSLRSLERMRQSLRARPQGRRAFQPHERRPGHRRHQRPGRAALLHGPGGRQRRAQAGHRQRPQHHQRRPDHPPRRRRRAEQAGALQLHAPGARQLVAELAGADRPREAFEHQGVHPRTERRQPAQPHVADLHHRDGRRVAGEAGARCHLLRQGAREQRDAADARHQPCRGQRGHGPGPAAPGKALERMGQRQGVVPARPAGRGLQLPRPAALQPRRYLGRQDLPGARRQPGEA

SEQ ID NO: 19268 - protein, 141 aa, Pseudomonas aeruginosa
PGHQAHGHQSSPALPRRRQPGRADRAPGLPPAAGDFHPSSPAARLGTTGAVRLSGAAAGRPLPGGAAVVEPGRPGDPQRPGQPRQRRRPGRSDPRAAGAGPSGPDPGRRRERALRPAGHRQRRGRRGQRRRGEPDLPGRRR

SEQ ID NO: 19269 - protein, 260 aa, Pseudomonas aeruginosa
MRGPGGQRRRPAGAQLSHWRGVPRRRRRHQLQHPRHAELDGGAAAPGAPPTGGARLCVRRLPRHLPRSGAKHRLRRGARAQPGPRRDLARFLYRRRSGAGLRLRPGPGTRRARPDPQRCPAAGLCAALEPAGLLPHRPDPGRAGGGGRGRTADRPSAAAAPGRHYRPRGGRRAPGDHSRLAAGRAHRGDSLGDPHRPAQRRRRPRPVQHPRQGTGDQRPAGLRQPARQTAARGPEVTAATGRLPSQEPAFSGPGPYIRFS

SEQ ID NO: 19270 - protein, 542 aa, Pseudomonas aeruginosa
PASATLSLVPEAAITIPIADEDSPCSPIASVASAFPLPRSARPETAMTDLRDTSRDERLLAAHGYRQELERGLSLWSSFSVGFATISPVVGIYSVMSLGAMSMGPSWVWVVPLCLLLQFGVALVYAELSSQFPLAGGCYQWVRRLVGDRLAWFTGFLYLASALASLTTVAYLGGFWLGLLATGAPPSANGQVLCGALLLALGLAVNLLGINPLKYFVNAGIVAEAIASIGIGVLLLLFFRNHPLDLLFSGPGGTGDADGSYLDGVLTALAVGGWAFLGFDACSQISEETTDARVSTPRAILRSMLVVGFTVMLTAFAVTLSYQDIGAVVSGQVVDPVTPAVVDAFGAWAERPFVAVVLIAFVACVVSVQTYIGRAIFGMARDAILPGSALLRRVDRRKVPMAAMVCSTLLASLGLALGLNATAVGTLIAFGSGGFFVVFLIVAACALWARLVGRWDPDKGALRLGRAGLAVNVLAVAWLSFEALNVAWPRASLAPPDAPWFQVWAVVVVFSALAAFGLLYMLIAKPHRRIATSLSFAAPPAD

SEQ ID NO: 19271 - protein, 284 aa, Pseudomonas aeruginosa
LAHGLPVLGGSGAGGGRAVLLPPAQPSAGRRPAARGGRGRAPRQRAPAKPFRRPAEGAQESPRAGPRPRLLPAQAGALRDPALGPGDHLRTHAGDRQGRLGHRAFGLRGRRAGRADPHRPGLGQAVRRPPHAGLRAQPGGADREPGVVRPGDAERQPVPGGRPAVHDGRHPLRAGLDDQRRCRHRLRYQRSSRYRHRLRQRLRLGRGDPRRPAAGLLRHPHGVLRVHRHRAARQPAAGAVLEQPARRVPRRTEGACRRAAAGGRQAALKPRRTTARRQACRANP

SEQ ID NO: 19272 - protein, 287 aa, Pseudomonas aeruginosa
TPTRRCSGTPARPAGQCWNGAEKARRAIPPAARKHYPVAPPEPQRRSVDMRDEPSRPLTVIYQSLREQIERGLLARGSKLPSERQLSELFSTTRITLREALGQLEDQGLIYREERRGWFVSPQRLLYNPLVRSHFHAMVADQGRVPETEVLGAAMIPASVDICQRLELPALSRVFQIRRARRVDGRLVLYVEHYLNPAYFPGIERFDLTRSLTDLYANHYGIRYGRVRFEMVPTILPAEAAGPLRVSVGSPALQIVRINRDQAGRLIDCDLEYWRHDALQVNVEVPE

SEQ ID NO: 19273 - protein, 344 aa, Pseudomonas aeruginosa
PPGGFPAASSALVDRWARCVDAERLPLTARPAKSGDDIRKCDTTMSDSEKSNSRLFDLDLLRAIVTVADCGSFTTAAARLHSTQSTVSQKVRRLEEMAGHRLLERGNRDVLPTDAGDTLLGYARRLLALNDELAEALSGATVALTVRIGVPDDFAAGRTTERLAAFNRRYPQVKLEVTSGMSRDLSASYDRGELDLVLLKQRRASREALACWPEKTCWVDSARNPCIDLDPLPIVTFPPRGVYRDEMIAALEAVGRRWHISFTSSSLSGLQSAIADGMGIGLLPLRAVSAGHAVLPKNAGLPAVDVFEVALLHRPAADPMVKALARVLSRVLAEDTRSRPAFEK

SEQ ID NO: 19274 - protein, 401 aa, Pseudomonas aeruginosa
SARAAPRRVCSRQSARKTRVSSQFMAVFLMHFRISLMKKRCATTASALLTMRTRSEPFSQEHAMSSTNRFPERMTAIEIARPGGPEVLVATSRPLPTPGPREVLVEVRAAGVNGPDVLQRKGVYDPPPGASDIPGLEIAGMVRAVGSEVSRFAVGEAVMALIPGGGYAQFAVADERTTLHLPDGLGMEEAAALPETFMTVWVNLFQRGGFKAGETLLVHGGASGIGTAATMLGKAFGAAKIFTTISSEAQREASLRLGADLAINYTEQDFVEEVLRGTEGRGVDVIVDIVAGDYVTRNYQAAAMNGRIVQIGVIKGKAAEVDLFPMLSKRLVHLGSTLRSRSHDEKGAIIAELERQVWPHVRAGAVRPQVFRTFPLEQARQAHELMDSGQHIGKIVLTSAP

SEQ ID NO: 19275 - protein, 594 aa, Pseudomonas aeruginosa
GRSDLDIAQAQRPRHRLGGGRRAETAAGGTQVILHGALGNHQDRRHLRLLLAQGDPLQDFPLALAERLRIARRHRAAQALQGEEQDRAEGLGGELATGIQVQPLAGERHRALQTVAAEHRHLHAIDLAEVADPTDDAVGHALGILRGALRPEERLVQFEDVPGDRTVQKIGVALLGAAPLGPVAMDEEQLVDQFVLAGAGEQAADDHPVEAQACGELHHLAADRLGGSGLAQPGDAVEEKAGVVGHGAGIPGFFRMIPGLPAKAHRGKPSGDRSWVRGFPLFRRPATPPIVLVRPPSRRKERAMSNERDTSRTPTPDHAEHNAFFPSPYSLSQYTSAKTDFDGADYPTPYKGGKKVLMIGTDERYILMQNGSMFSTGNHPVEMLLPMYHLDKAGFEFDVATLSGNPVKLEMWAMPGEDEAVKSIYAKYLPKLKAPRKLADLLEQAVADDSPYAAVFVPGGHGVLAGIPHSREVKRLLNAFLAKDRYIITLCHGPACLLAPAVEEKPEDYPFKDYEICVFPDALDTGANLEIGYMPGPLPWLVGENLQKLGVKILNKGITGQVHRDRKLLTGDSPLASNNLGKLAAKTLLEAFAR

SEQ ID NO: 19276 - protein, 159 aa, Pseudomonas aeruginosa
SSSLPAVTVPGLRTKPNPRGPLMSLPPYLKPGDKVVLYDQHCRFCTLWSGFLARRADHRLKLLAAQSAEGLAILDWFGLAPDHFNTWLFVDGAYACDDNDALLEVLRLLPGPWRHLRWLRLLPAWLRDECHEALRRNRWRWFGRQRPPLRRRSWRPRRA

SEQ ID NO: 19277 - protein, 138 aa, Pseudomonas aeruginosa
RLSALAVAGYAACAPACGPILAMALDPSQRRRLRHALSDAFVDTLLEPEDIARRIKGVDPALLERLFFEEVAPVCHGNLLSPAPAVWTAFDEAWLEEAIERRLARQRSCALRRWHERCLVAWLRWRYADTWRAIAGAL

SEQ ID NO: 19278 - protein, 495 aa, Pseudomonas aeruginosa
NPFARDRRKISLGNNVERPARIPDWRTGRIIMTSRRPPALPRPFVEPMNSGSFPCPRWRPRIRISCVRREDPGVSMTSLCPSATREHGPGAKRVLPLLFLTCLLDAAGVGLIVPLLPTLIGSVAPLAVRDAATWGAALVMTFALLQLFFSPVLGSLSDRFGRRPVLVLAMLGFALSYLLLALADSLWMLFLGRALAGLTGASVATAMACAADLGTHGQRTRHFGWLYAGLALGMILGPALGGLLAVHGTTLPLLLAAGLCLLNALLAGLFLEETLPPTRRRRLDPRRMNALRSISGLARQPGVGLLLAVLALVFLGLQAVMVVWPFFVIEKFHWSSAWIGYSLALYGVLAVLAQTLGVNLCKRRLDDARLLRLGLALQGCGLLLFALVDSSFWLVCALLPFALGSLATPAMQGLLSARVPVDRQGELQGVLSSLMSLAAIVGPPLMSGLFHWGSGPLAPVPLAGAPFLAGALLVLAGLVLAWQLRPTGEERSWTG

SEQ ID NO: 19279 - protein, 134 aa, Pseudomonas aeruginosa
TWACWWCCSILATTTWNTLANWRRRFRNCASSPSTTHRTAIRSAMPGCAGKASPCCTTATGRASPAPSTRGSTRCSGVACRVCCCSTRTPVPAAPSSPPSGATCRRATVRPACSAHGSSTGVTGASCRPSISTD

SEQ ID NO: 19280 - protein, 131 aa, Pseudomonas aeruginosa
SSSARPRAEPPQPGNARRNSSGSTSPAGPTRQCSRGWRVRTGCGFTCTTLAPCSSASPGIRAAGCTTPEVPTLSNRSHSQAAAKASRSAASGSASPNQTTPGRTCPPQAGQRGGSIRRPSSGSTESGKASR

SEQ ID NO: 19281 - protein, 621 aa, Pseudomonas aeruginosa
RAQRPPRASRKVGIPLSADTPAPVKITRRRAPASSSTTARISLLRLQRGQRAVFVLGMLVGHAADEILEHAAAVVELPLPLQRVLRHTFHGLQVSLDLLARQAPNQQLRMRRGGLATFGEGLELLGRQAQQRRVEIQQALDDAVALQFQGFHLRMAEHPFHGHVLERLDDGVRQAAVLHQRAAEGAGMNRFEVVDELLGGVLDQRVDHFHPQADEEFADLVDRLPLGLFQRVVDHPLEAHVVRVAGNRCVRRMVDGKLLHQQIRQLTDVEDAFFHRVFDIGQAIGDIVGRFHDVGHRVASARAHAEDLAQFVDEGFLGKIEARLLVQVVVRRCLVRLRLVGRAHVLEQAGGLRVGEVQAQQLHHQADGLGVAFEVLEVGEHALLQQAVALARRYAALEQGVEVAFEPVVDGVLAEMTERRIADVVHQAGHFHQAFQRAFQPVQADLCGTRAQLAEQRADDETPGLLHFQGMGQAAAHRRVALQREDLGLLLQATHGGGIDDAPAVAFQLVDDVLQIGIPGMSVGFPVMRTLAGYPLLEIHGPWHLALFSTRSAANPEPSAWRRFNQGRDNPSHYRSRSPLFPGRRQLAEYPARHQRPPPQNGGAADHACAQRNRNVQGGSA

SEQ ID NO: 19282 - protein, 660 aa, Pseudomonas aeruginosa
HRTAFFPGTSGNIRRTPTTLASRATPLRFPGGNLFAFVAHLAAPRPLQAHPGLPGPGGFLPGRRRPVGGRRTDVGRATQQCGQPGSAGHIQLRALAEGAGGPATLRGRTDRVRRRPAPRHGAGQWQARACGTPRGGQPGPRHALQRDLPRSGRRARAPAGVPQPGRASGPVHQRAWHRMQRRQHVLPQRRRSAHHLRGQSRLHRPQRRTRAPERIETGKAAGHSVMNRRRRYTGSNPSLRRVLYRAHLGVALVAVFTAGLAVTLVGLLTLRAYADPNQQLIARSISYTVEAAVVFGDAQAAEESLALIASSEEVSSAIVYDRQGQTLASWHRESTGPLHLLEQQLAHWLLSAPTEQPILHDGQKIGSVEVKGSGGSLLRFLLTGFAGMVLCLLLTALGAFYLSRRLVRGIVGPLDQLAKVAHTVRRERDFEKRVPEAGIAELSQLGEDFNALLDELESWQARLQDENASLAHQAHHDSLTSLPNRAFFEGRLSRALRDANEHREQLAVLFIDSDRFKEINDRLGHAAGDTVLVNIAMRIRGQLRESDLVARLGGDEFAVLLAPLASGADALRIADNIIASMQAPIRLSDGSTVSTSLTIGIALYPEHADTPAALLHDADMAMYIAKRQARGSRRLAELNDPRILQEEKEIDSATPEAPPK

SEQ ID NO: 19283 - protein, 142 aa, Pseudomonas aeruginosa
NIRLPARHPGRRGPSGNSMKLDKAAAIAQLNQALGMSVLDAGNTLLARFNKSKNVWWFDIPLSQLKAGKFLNLLLANPAGDAVEHLKVPTGFLRQQQDSLELRDKNARRPTLSLELSADPGKRLRDVRPGGAGLDFAPFLQP

SEQ ID NO: 19284 - protein, 152 aa, Pseudomonas aeruginosa
SAMPNWSARSGACRNLPTSSTCWIRSSSAAPPRAAASPTCHWRSASVARHCFACCSGVAAVRACRAMPTRCRRRSWRRMSACNTCVRAMPTNGSSTTCRTSCWPARSAVANWRSKTGSPTTVRTPRRTSPGSTSSTFPERRCWPAEGARATS

SEQ ID NO: 19285 - protein, 114 aa, Pseudomonas aeruginosa
PPRTTCCTATRPSAAFTPCSAATTASSTRARRRASSCSTTRPGPGSACPPSCASTVSARTSCRVPACASWPRTRSCRIWASTRPSGATGSATRPTWSFPGAWTTRPSSRAPRPT

SEQ ID NO: 19286 - protein, 138 aa, Pseudomonas aeruginosa
RSAPCSMDRNGARVTLKTKEFERDVPIPVPDIPRLLKGKPLDMSFTFDNPEARKAFSFHLLAEGRGIIEISDFHVVTAANPEPVESRSQVAEAAKEQPLLSTLKSLFANRPETEEAERADAPRERTVIPEQKALILSH

SEQ ID NO: 19287 - protein, 710 aa, Pseudomonas aeruginosa
ASGRKGHLREPGAERQGRRDERQVPLPPRPVRHGRPRRHAGPAAGLAAPAPALRWRHRLPLPRLRAAYRRAGQAVRGHRQAALKLASAGSELQFRQARIERVLGDQPGMATNGHQPPLVDHRDAVGALYRGQAMGDHQGGTSAHQAWQGLLDQVLAFRIQGAGRLVEQQHRRVYQQRPGDRQALALAAGQADAALAQVGGVALRQTQDELVGMRGTRCGLDLGGAGMRTAVADVFLDAAEEQRGVLRHQGKAAAQVGRVQFDDRLSVQQQPSLLRIEETQEQIEQGRLAGAGRSDQGQGFPRFDGQADVVDGPVFGTGRIGEAHRLQFDPPAHPCRQLAWLRWRADLAARPEQLGDALCGAGGALQFADHLAEGAEGHADDQAVEDERGQFAGRDAAGDHVAAADPEHDADRAEHQHDHHGDQPGALGDALARGVEGAFDGAGEALAILRLVVVGLHGLDLTEGFTDVAADVGHPVLAFPRQAAHAAAEQQDRGDHQRQRQHHDAGQLGVGDEHQQHPADQHQGIAQGHRQRGTDHRLQQRSVGGQARLDLGATVGFVETGMQLDQVVEHALADIGDEALADPGHQVEAHEGAHGQAEHQHEEQQDVAIEQFGRGGEEPLVHQQADALAQGQGDRRGEQQRHQGPEHAPAVRRHEAPGQAQGDTLAGGENGWHAALARRLGFRRLAPGTQRGDACPGRQRDDIDVYIRAT

SEQ ID NO: 19288 - protein, 148 aa, Pseudomonas aeruginosa
PRAWATSVTERPSARRLRASNKRAWVRQREKPRPVCSVNRRARVRPLAPTSRPHASMLQSSAGCASSASATFSARASRGIGRLAACAGALASSSNSARNSVRCGPSNCKSAAQPVMRRISSRISGPTSRTWTLSGSSANAEGSKYRLR

SEQ ID NO: 19289 - protein, 401 aa, Pseudomonas aeruginosa
PSSPSPAAGARPASPAASRRNHPFPRAAGPGQPLATGRRYQPVDHGAVLRRFRPRHLALGLAGRPPRPAPGSARRARPGGPGDLRCLGQYRLFLPACLSPGPGPRPGDLLGDGAGQPARCAARPGVDELFRHARRGAGLVAGSRPPRRPVAGRPRRAPGGVRHPGGAARLAGGAGRPGLAGNPSAAGGHARARDPGDLPTGPGRPPATNARTAGGGAQCAGVLLLRRRAVHGRRPARPGLRLDRPGHRHCREPRCLAQPTPAAHLEQRSPGTPGPGAGGRRRDSADAVGRRRIRRRPVLGAASPADLHRLRRGDSQPAGSGAARLRRLPGTRRSPVRARLLPADRPRTGRVHPATVRPSLAAGRVLEPAGPGRTAAGQAAAGMKAAPGTPVQTGRPARKAG

SEQ ID NO: 19290 - protein, 744 aa, Pseudomonas aeruginosa
WHSAHADPQNVARTTLESIQHAIEVNSSLALPIALENLSRLTHLALLTVPFNLIHILVFSLKDFRPDLGHQLWRQEIMYAHGAMALLFGGIGLLALWLRRQPPKLWRMRLLILLGGAGIIGFGVAIACIDQRITSNITPLLLACFACAMFILIRPAYAVPFYGLAMLAFEVAMDHAQADPQLRLSNQANGLTAFGLGLLLSLILWHGHVRNLRQQRKLELQRQELEEKNRQLEYLAGHDPLTGLFNRREFDQLVLMELARIARQPQPLSLLMVDLDHFKYINDRYGHPFGDEVIRHAANLLRGNTRSSDSVARLGGEEFLLLLPDTAEQQARSLAEKLRERLEGTPLATQDGVLCLTASFGVASLDGGGQASYEQLYSAADQVFYRAKSSGRNRVEVIRLASLAEKPAVTIDRPALTSGRSAARTLVKMVRGALARRSSCPSDLPDLARPHAAALPLASCGKTGAAPLSALPGENHAQAPARAHLCPARQFLGPGPGDGPRPGRFRTQAGHQSDPQHGPGPGHPGQLRQFPRRPRPKPRKWLVHRQLDLQPRPRQAHRDRLLRRLQAPAEQPPGLRNGPDPLQPPGAASQRRSRTLRRPVDLRQPARRGPEQRPGAQRHHPVRRPRGQPAVRFRRHPEVRQPSPGQPGEPQRRGLRERLQRLVGEPLAALAGHRPEPVLQRHQPDRQRLQRLLGTQQLLRHHIHAEGVASVLLSRQSSWRRVRWASSSSCFCSRLSSAWRASSR

SEQ ID NO: 19291 - protein, 575 aa, Pseudomonas aeruginosa
RSSSASFCCAASNCCWHLPSWVAASRSALLAMSTTGASRAARFSMPQRASGLPAGEQARQPRTAFRQAFAFVEALAQELAHDREASDGQVGLGIAAGHVGTDADQIATLLVARPELLEALGVAQVLGLDHLRHHPADRSFDIDGRIVAFLGQPPGQYEVPVEHAASGVGDRVLLVVALGEHGVERGDRAATGFGIAGAFHQLRQLGEHRWRIPLGRRWLADGQGDLALGLGVAGQRVHQQQYVLALVAEVLGDPRAVLRGTQAHQRRVVGRRGDHHRALEAFLAEDLVDELLHLAAPLADQTDDDDVGPGETGHHPQQHRLAHPGTGEQAEALAAADREQAIDRADADVERFADRVALERVDRRAVHRHPVFGAHPALVVEGAAGAVEHPAEHRHAHRQAPGVRQRHDPRAGRDAGEAADRHQVHLAAGKAHHFGLHLHRVVAAFVDHVAAAADRGLQAFGFEGQADHAQQAALDHRLRRQRDSLGVALQAPGETGSLKAHRRLRGRRGRSGCRWPADGSPVRAVARTVASLPAPGASRWSRRCDCARSRCGSRRAATNRPRESASSLRGARAAP

SEQ ID NO: 19292 - protein, 194 aa, Pseudomonas aeruginosa
RSPARPLPPPAAPARVRRPRAPAARQRPARRAARRSSATTRGRRPPRPCRGSVRWDCLCPCRGGPPQIISSPPLPPSTISPDSAMRRAMVRISFCAPSTSLTRTGPLASRSSRSSSAARLDMFLKTFSRIASSEPLSASTSTSEETSRSSAWMPRSSTSARLSKTNIRSSICPDRSSSTSRIESISWPSMELSR

SEQ ID NO: 19293 - protein, 164 aa, Pseudomonas aeruginosa
RRVRGLMPRRSAASLRRPRSVRRVSMITWNSRRRRSSPSAPLASWPAAGDGISTLGGVAGGIAGMGTGTGAASGMPIGAVRHRSAGWIRPPCCRINARWMALSSSRTLPGQACRTRHWAASGPSATAPRFILRLCLRSRRSASGRMSAGRSRSGRQASGKTDRR

SEQ ID NO: 19294 - protein, 524 aa, Pseudomonas aeruginosa
PPSSRVSLRASRTARSSSTSRILAAMGLLLNRRKRRRRNQRQDQGGAGAAPRPRAQLQLPLVGARHGLDHRQAEPGTGGLGGEEGFAQARQGRRVHTRSVVADAEAQAVGAGIEMHLQAQFGPASLDRVLHQVEHGAHQGVAIAQQLAAARLALPTHLEPLDMDFGRRAQAVEQRLRRHPVGQWQLAAGEHQHVAYLMLQFVQALLQAPGEALLLVGRQRLLAEVPGIEQRRRQRRADLVGQRGDHPPQRRQALVARQLLLETAGIGEVVEQDQLPRFAVQRAGGDGQATSVAQGNLVTVILARSEAAGDHLTPEHAHQRLAKQAQGRRVGLADHAMGIDDDDAAGKQVEQALQAVRQALLFRQLLHALRADQGQLPFQLGNALLQQAVGLAELAGHLVEQREGLLEAGAAGGLGRIGWLLGEGVEGWLHCVSLGRRDVMVLSVDGDIAIPVPKFFSFENQSVAKRPVNHPTGRRRAGSCRTCASSPPAWCGGCAGVRRPARPLRRHRRGPAGSGPARGWPGSP

SEQ ID NO: 19295 - protein, 198 aa, Pseudomonas aeruginosa
RRPSRGRTVRFPAVPPGSPRSSPGRRAPRGAWNGNAGCAPPLPCRCRTRRGSARWHRYRRPAASSAAPAGSPGWCRPGCGTGSARGSGRARGPGRTSRGRPGRDAGNRAACCSWAASPGWRAPGGAAPPASRPGPARRSAGSAGTRPNWPVASAALPPRPSTRRCRAARTGLRDCCSGPPLPLANPRCCRSADLRRGS

SEQ ID NO: 19296 - protein, 123 aa, Pseudomonas aeruginosa
PASSCERPSKARPAGPHKPSSQPAWQTRPSAARSLAPTAPTSGRWPWLSNCCSQSLSRMPLPASSQSRNSPRARDAARLRRAPRDNCPSPRSTRTCSTPMPSTASSHSRTSAASPPCSSRRIS

SEQ ID NO: 19297 - protein, 428 aa, Pseudomonas aeruginosa
ASSKASPAVSSNPPVASSGSRRNNQCRDSPAGKLSRRSRFRSGRNAAPSSPSSRRMSSSAYTAWQLSGAASRSSAATSRPLTVNSTPASTRSNQSVSSRASAWLIVGTGPTSGSKSIAPFRGLVPSGANRWLSTRGYKLTCSRLCRVRSTASVSPWASSTSTAKRGPPPCSCRNRSISTFCTASGRRASSQVDSVTLPKPAARLSAASRLTGLKTRASRRVIGATRTKRLSPAWRYQPSSRIARRKSAWPCSPIPGWSRPIWLNCWRETRKRVSGRDRNARSPRCSNCAHMARSPIQSMARPLSIIRRSQICSSASRRAIRQLGSPMKLMVWSARNETSSRPSIRTSPANGKQVARMSGSGCPSSSIRNRRDEARTTFGSRSIAPTNASTHSGSNTSSSWRNLTYSPSARRMPFAVLPSSPRRVSLRK

SEQ ID NO: 19298 - protein, 478 aa, Pseudomonas aeruginosa
TSRRCASLIIRTGHRREIPALCTTPWISPSSAATKAARCSATVRSTWIAWCDKSEIACNASRLAPRRCGSRPLTINSAPIRAQLCAMARPRPELAPVTRMRLPDRLKGLKEVSSFTWLIPRSRHSGFDQIGELRPFDIHQAGTPGQADTEAAEQHAIAAGLEFPVDPRGHGHRQRGAAGVAEVAQGRRHLLYRQAELLADGLVDHPVGLVENEVVHFVLARTGIVEQLFHRRRYALGGEAEYGGAVELQVDGTVPMVVLVLAERHQVLHADRFAMAAHRQDDGLVAAAVAVQVEVHRRRAFAELQRRRGARVGEDRIVDTGAAVADQHKALLHPAGGDQRTQQVEGERIGRATQVDVEGHGGMRQPQAVLEDDRGSRRQVVGRLGHDDQRIDLLALPLQAFQQALGGVEGQVGEALPLLRHAPRLDADVAHQAFALGAQLRLAVGQVGDNALGDAGRHPGETDVLQRGGGHGQSPSIW

SEQ ID NO: 19299 - protein, 503 aa, Pseudomonas aeruginosa
KDFIKQKASFRRLRGQPLARGCRWRQGPCRCPDGTGTPSSAQVDDGLGHRILGLDGLGIGLVVALVDDEVHQFVGDVHVGRFQRAGLQRPQGARARRADRRLAGLRGLHPGGLADRRQALDVGEVRQHHLALHLGLAIGVAGEDHPGVVDFQACQLTGGVAVLDRVALGERGGVLGGLAHVEGDAAGGTGRAIPGVGRRGLAVRGRRNPAGAGSRRIAGGRTELDHVGGRVDAEARPAGAAVRRPNRGHLAAGVEGDVEAHRRLVRRIERIDAVDQHFHGPAVLRNRRGRIRVRLVLDEELAHGVGVALAVIDAQRRGRVVGSGVGRIERRHGRRLQRRVEVVRLLDARGGLRRLIGALDLEVGDHAVLQLAVRPDGIALQAVAVVVDDEILLVGIEVAGAGVADRPVVAGDEEAVAVDGQVQHAVGRVDVALLEHLRDVREQHAAALRVAARTQHRGGVDVGELRAGLLEAYGAGVGDVVAGDVQAARGRLDAAQADVETHG

SEQ ID NO: 19300 - protein, 427 aa, Pseudomonas aeruginosa
LLAGNAGLLADDLYFGQRDAAQACEVEHQLAAVLPQGDAVDVGRQVGLEPVGLAVDRGLRLELVGARRHDVAAAVLAVPHEADAAGSLLAEVDAIDHGALVVVDVDPYVAAGDRQVEGRLEGVLGVHHRLVGRHDDLAPHQRRGLQGLRRLVVGENALHALVQRLHAFHGAELGQLGDELAVLLRRHRVLVLQLGHQQLEEFVLAKVAAALDALPGLGGAAAGGALAAVDVAGVAAGAADVIDAHALLRSLTQGQDLLHHLFGGIHHFRVGLEGTAGGNHVGHFLDHVHIGVIHVAVGIRGRMVRLVARHQRTLVLDDAQHLHAGAGAVLVGEQRAAVALGLLEHGGEHRMAGAVGLVDAGGNRLGVGDVAGHGVQAGALGAHAATGNVEDTGEGHGGYSPRRALTSPLNLLLRKVKDAWKCMAFSA

SEQ ID NO: 19301 - protein, 398 aa, Pseudomonas aeruginosa
RSPGLLRPPRPRDYNNDNTQEEWSTMKKGTQRLSRLFAAMAIAGFASYSMAADTIKIALAGPVTGPVAQYGDMQRAGALMAIEQINKAGGVNGAQLEGVIYDDACDPKQAVAVANKVVNDGVKFVVGHVCSSSTQPATDIYEDEGVLMITPSATAPEITSRGYKLIFRTIGLDNMQGPVAGKFIAERYKDKTIAVLHDKQQYGEGIATEVKKTVEDAGIKVAVFEGLNAGDKDFNALISKLKKAGVQFVYFGGYHPEMGLLLRQAKQAGLDARFMGPEGVGNSEITAIAGDASEGMLATLPRAFEQDPKNKALIDAFKAKNQDPSGIFVLPAYSAVTVIAKGIEKAGEADPEKVAEALRANTFETPTGNLGFDEKGDLKNFDFTVYEWHKDATRTEVK

SEQ ID NO: 19302 - protein, 437 aa, Pseudomonas aeruginosa
SWCCCSDLPASSVVRRWKKYEPVPQARAVQRPPRDPGVLSDPRPEAAHRRHQARGPRRRCADPLDHRRGRPGHVRLAAVPRPHPAQAGSRRRLQGQRQRPEELPQPAIDPALGGPRPGRGGFRLAVLRLARGGGHRHPDPDLRDARHRPEHRGRPGRPARSRLRRLLRGRCLHIRAARRVRRVRLLDRPADRRDDGRAVRLSFLGFPVLRLRGDYLAIVTLGFGEIIRILLRNMTEITGGPNGIGSIPKPTLFGLTFERRAPEGMQTFHEFFGIAYNTNYKVILLYVVALLLVLLALFVINRLMRMPIGRAWEALREDEVACRALGLNPTIVKLSAFTIGASFAGFAGSFFAARQGLVTPESFTFIESAMILAIVVLGGMGSQLGVILAAVVMVLLQEMRGFNEYRMLIFGLTMIVMMIWRPQGLLPMQRPHLELKP

SEQ ID NO: 19303 - protein, 192 aa, Pseudomonas aeruginosa
HDARSWVTQTDCGQAWVSSRLASSNRETASARAVSPSSWLPTRLRISQWRTKISSHGLFNVRLSALTSGNSASARSTSRSQTYAVSSSISRALCSWPASRRSARSFSTQFQISICFSLHQACCEFSYCPSRRFTESASPARAWFSEVAGWPRPCPAMITLNERSSNAAWAASSRSSPTAASSACTAGLSRLT

SEQ ID NO: 19304 - protein, 160 aa, Pseudomonas aeruginosa
ASGRMEAARSAIEPRRGEMFNPPGRSIVAGCARTSRAGNRRVPGCAAAGRPGTDGRGTSACCASGSRAATRPGGRRPVRRGPCMTAAGRCRCRPARLSSTGCSGCWRESRQPVPAPADGGGDRATPRGRCSASSAGTRARPARPGVAARRVAPGRRDWRR

SEQ ID NO: 19305 - protein, 144 aa, Pseudomonas aeruginosa
FPAGRTAAAPPAGRPARPQSGSPGRSPRQPGRAGRCTGPARRAAADGVPGSPPAVHRTGSRPARPGGSPAPVLPLAPASAPPPAARARPAPARPAPRAAARRRRRSAKDGGWCGARGSRRASARGRQCASTVGPCCNRDARRRG

SEQ ID NO: 19306 - protein, 231 aa, Pseudomonas aeruginosa
RGRIFDGVFPMRPARLLVYILHPLFAACQVWKPESPSTSVDTRFQGELVKINGALQFRPCTEKRLFSIEDVANTGLRREADSLFDDGAQGLFVDLRGTMGPAKVRGTDGKLEVSRLYRVQNEGPGCDDPNFKLLTFAANGNEPFWSARVNNQGLRLDRPEHETLALPYVAEELPNGSTSYSSEANGKKVELWIAPSSCTDSMSGAFSSYSAELRIDGETLRGCAYPGALGK

SEQ ID NO: 19307 - protein, 461 aa, Pseudomonas aeruginosa
  UNSURE (192): Identity of amino acid at the above locations are unknown.
WAKSSVRRKLANPSSRSSRSARTARTSPSAMARRCARTPSSGKWFQGFGPWRSNRSVMASISPVSAARKRCISTPSKSSHQQPVGQRHAPLDAGSQRLDQGFQRIALPGQPDRIVIGGRIAFAAVAENRHQRTLLAGRDHLPCGHQGADQVGSAGAADPPPQASGQVMHGRQRPGVRHLDHRVDHFRQEGRXDPRPADALDPRTAIQGQATVAADIGVEEHRTLGVGAEYPGAVLAIAHVAAEGRQGAAGTGAGDQPGRGRVRLVAHLLEDRFGDVVVRPPVGGALGIGELVHEMATALPRQAFGLGVDLGGVLHQVALAAVEGDLGDLFLRGAGRHHGDEGQAQQACEIGFGNRRGTARCLDHRRGRPEPAVAQRIEEQRARQAMLEAAGGVAGLVLEVQFDARQAGSLQGDQMGIGAALEIRFDDADRLAGPLAVVDGHGNSFSSGRRPEAAAERCATG

SEQ ID NO: 19308 - protein, 218 aa, Pseudomonas aeruginosa
PGAPGSATGPGRAAPGTAGSRKRAWEDLLQRRFVALLDLGDQRRLVRHVEAVHQQGLAVVAEVRRHRPRGQRDDAHQHADGEVVLQLDRHLDEGRTQALDRSEGQAGDLDVGDEYVPHHQRQQLQQQQRMPLLAAPDQQAVGQQRNAHAEEGAEQPVANGEGIHQQQPDQQQQDTKHGMRQYAKKRTRQRTADHAVPPRVMIWRYRSRSCNCAAVAWT

SEQ ID NO: 19309 - protein, 615 aa, Pseudomonas aeruginosa
PGVPVEQRLAQDIDQHTANQRHHAHQQWQVETVPDRQAVFRQLPAKAGTGGGGQQRRHGVDRQHADQQAEEHQDLHRYLHVARRLVGRELRQPGRLAVEEHVVDETQRIGHREHAGQGRHRRHQPVEAAQQVLAEGFAEEHLLAEEAVQQRHPGHRQGGDDGQHRGMRQVLPHPVDQAHVAAAGLVVDDPGGHEQRGLEGRVVDDVEHRGDVRQRGVEAEQQGDQAQVADRRVGQQPLQVMLEQCHAGPQQQRHQAAQADQVEEPLGAGQRRIQPGQQEYAGLDHGRRVQVRGNRGRRRHRVGQPEMEGKLRRLGKHAEQDQYQHQRIQGVGADQLASREDLGEFEAAGDVAEQQHPGQQRQAAPSGNGQGHPRTLAGVGTAAPEADEQERGQAGQLPEEHHQQEIFREHHAEHGAHEQQQESEETPHRLLFGEVVAGVEDHQQADAEDQQGEEETEAVQAQAEVDADFRQPGIAGGQGLPGEHRAALSEQQDQADQRRHAGGRRAQGAAATLGKQGQQRPHERQRDDQRQNHGLLLFDGGAPGMPGRRCFPAVVGARPDRQQLEAPSATGRRGATELRLSQSIERTSWIELLQNSGVPTAGKPKKTLQRQRLEA

SEQ ID NO: 19310 - protein, 427 aa, Pseudomonas aeruginosa
QGAAQVVAERSDLQHRTEGAAGAGDQQDRRGRLDAFHHALMEFLALALVLEQGAGQRQADQQGDHRLTEEVQAGEQYALAQRLAREYRDRAKADQQDRYEDRRERLGRAGQLAVAGTQLAEILFGLDDLAVVVQGNVLADEAIGPPHAGHRGDEGDHQADHDHQAKAGVQAEVAGRGDRSRGRRHEGVGGVETGGQGHAHGDGGYLHPRRQGVLQRVEDDEAGIAEHRDRHQVADDRHGQGREAFAEQADHAFRHGDRRTAALEDHPDDGAEHDDDADVAEDAAEAAGNGLDDFRRGYLVGEAGDQRGRQQGEERVQLESRGGQDDKGDQRQQDQDQGHEPPPCCYGCGMGAQGRVIFAPSGPDTPCATARGRRRWKGNILCDCTVNRLIARYPRRGTSNCSPSNNCWRCSRRARSSPLIEAMRSSR

SEQ ID NO: 19311 - protein, 328 aa, Pseudomonas aeruginosa
GRTTSGAPVMPSTPTSRSACSNGRFTPGRTPRRQAAACSSISTTRRLASTSCAPSWRVCRRDGSPLPMIMPWASITLMLCGRIAIARSTMCCASVESSSNMEDSGRQAFAQPAAVLASIVETVVQAARPPLPELDALRQETVAAPVLGTARRLVGETPLGVREQPFQLGAIGDDPALRRGPGAQATAQRTHLVVGVGFLGSDLLDAAFDAHLALQRRPEEGHGRPRIGRQLPALGAFVVGEEGEAALVEALEQEDTAMRIAVGVDGGQGHGVGFDRQALGLHRVVEPLAEQAEGIARGVGLAEAIAGVLAAHIGQGLGHGASPGGNAP

SEQ ID NO: 19312 - protein, 408 aa, Pseudomonas aeruginosa
KLTNGLQTLPRDTRQLLRPRIHQHIRPQGVADKGKSQVALGIGEADRATRPRVAEGLGAESVGRIGHARLVEHGAEAEAGPGQQGPILAYRVFVGQLAQQFIFQQTSLQQAAIEAGERARVAMAIGGRLLHASPFRLVGAGEDRRRIGEGTGGQRQWLAHHGLQHALGGSVAEAALAPCHVGDAAELAVVQADMEIQAQRCRGARHDGLARLAAVDPADHLAEQPAIGNRCIAVRFARRPPGLLGGQCRGHRLPVVECLGRHLLAQRRQAGAMAEQLAHADRCLAGRGELGPVVCHRRVQFELALGHQLQHGNGGEGLGAGEQIEDGVALPGLLAVLVRDAAPEVDHRLATDLQAQRRAALLRIVEKPGEGLGKRGETAVTVALGRHGQVPVGKWSGHSSSPRRPCEP

SEQ ID NO: 19313 - protein, 219 aa, Pseudomonas aeruginosa
PATSARHVFPCGRNRWLRTPAHPAGRRNGRAPVSAVPSRGAVRPRPHRRCATVRRNESFPASRRGCTGHSDRSGRSGCSAPPPSLCVCRNVRAGCSGELAASAGTGSALRPWRGPASPPRVAPAAPAGLRPSVASAAPHACPEPLAKPPATAPAGSAAGLPVARWMPAAPARPARPRSRPPGSCPSSSRSGCAGSRSPLRTSPNGPAPDSCARWAVAPG

SEQ ID NO: 19314 - protein, 539 aa, Pseudomonas aeruginosa
LDKFSVVRQGGYDNALRHNRQRRSPNDPLRPRLRPACPGRPGLGRRHVLRLDDSSSGGRRRAGGPSPPGPVAGGVPPFLPLGLGCGDPAADQRRRHAAPELQRFRRRAALRTGNDGALRRHAGTVPAGAGAASAGTAPRGAGPGLAGRRAGAGEDPPHRRLQPAPRPVADSPGSGTPEPLNRRCAGSRAAGLSSEAHDVQAAVAAVGAVRAVLSAAPRTTGIHRVDPATGGVVRRTRFAGLASSAADAALQTGLQALQRKIARHFQTNPTARPARTAVASGLAVATFQRAAPEAAGGLAGSPVQAIVAWSADATAGVQQQAFHLHRLQAQGQVAAVTGALPEGAGRAGRGNDAAIGQAAADDFDADSLLAWRHADPGVLRHVQFLDAQDADLQRNQQGGILADLHSAQAQLLGPLGQAHHRVRLHLHGSADTLLACRRRLGRKRGASPGQGNDQEQSEHGLTHDRPPCPAVTRWPGSTPATQACGRPRTARPGDDPARDARALSGVLRGRESRSGGSTGSGRRLSTTASSADRRTDAAD

SEQ ID NO: 19315 - protein, 280 aa, Pseudomonas aeruginosa
TPSSGPTRKTSASTGGNHDPTLLPLRQRRPARRLLRPLSPGTSRAYRGSPDALALQRLRPRTGGLSARHHAAGATGRPRSRRHPRLEPRQHLARSGGGKPRGARRPAGACASHLRRALARRRGGTCPSRMFRLRPAQRSLVLPRSDRGPETRPQRPLPLRRRRQAEEMLRSMDHLMHSLASYIRAIHALPSPVSISDAQVEEQQRCEDGVEIHSCEALYRFDNGVRLRQHCERDLLPSSGACEECWIGYEVLDSAGREISPRYKHFVNACQERFWLRMHA

SEQ ID NO: 19316 - protein, 322 aa, Pseudomonas aeruginosa
DAAPGCAVWALTSARVECAAFSSGPHPHAADRALHHRHHRRSHDRRAVGRPAQHGPVRRGADRLRHRPGRRLGTRHAVGPLPADLGPSPGIPGADRSRRAGDSVHRAADAPPALAVPGTRRGWPGGLHPDRLPGQPGNGPQPADRGDQRGDHRGVRRHSPRHPVQRRTLDIPPRTLCQRVLRQRLVLPDLRGAGTAFRAGDADHPVQRLPVPPAGHPLPLGNAQVRLPGRFRPLKQAPAPWPTRSSNPSPVPDATASRRGYPPHALACRRPLPASVLQAQVAGVRSRSRWLGACLAHVATDRGDAEAAQVEFRRLGFGLGVL

SEQ ID NO: 19317 - protein, 77 aa, Pseudomonas aeruginosa
FPAISSQNRSTMSQEPHVHGPNCNHDHDHHHDHGHGHVHGPHCNHSHEPVRNPLKAVGRNDPCPCGSEKKFKKCHGA

SEQ ID NO: 19318 - protein, 862 aa, Pseudomonas aeruginosa
RSASRRDHSRRSPHPMASPAFMRFLPRCGAAAAFGTLLGLAGCQSWLDDRYADSLPPTSGVQPIKGLAQNVSIRRNALGMPLIETGTFHDALFALGYVHASDRLSQMVSLRLLAQGRLAEMVGPGALEIDRFMRTVNLRQAAEIQYRNASPRLQRFFEVYARGVNAYLYRYRDKLPMDLAQSGYRPEYWKPEDSALVFALLNFGLAVNLQEEIASLTLAQKVGSDKLAWLTPTYPDENLPFDEAEKLKGLRLDGQVPGLAGVEGAARQVAALSMLGVAASNNWAIAPQRSRSGKSLMANDTHLPLSMPSVWNYVQIRSPKYQAAGVSIAGLPGVVAGFNGKLAWGMTMVLGDNQDLYLEQLRRQGNRLYYLADGKWQPTRERQETFFIKGQRPIREVIHETRHGPLLNSALGERKNILQPLPLKSGYGLAYRSIQQEADKTLDGFFDLSRAKTIEQAFDATREIRAMPLNIVFADEKHIGWQVTGRYPNRKEGRGLLPSPGWDSRYDWDGYADPILHPSDQDPQRGWLGTANHRTVQPGYGAQLSNSWYYPERAERIAQLAGASKSHDTQSMIRMQYDQTSLFVAKLQAMFDNPGMALPLRQAIDALPEAQRSRAREAYDRLMAFDGKLTASSSDAALYGAFLHESARQIFLDELGPEDGPAWKAFVETANLSYSAQADHLLGRDDSPFWDDTRTPQKEDKPAILARSLAAAVEFCEQRLGSERKAWQWGKLHTYEWQSDSSKMAPYLGAGERAGLGAIKGYLDRGPYPAGGDHTTLDVSAYGWGQDFDTWLIPAMRLIVDFGQSEPMIGVNSSGQSGNPASPHYADGIDAWLKGRYVSFPFQPQNLERVYGNKRLTLTPAR

SEQ ID NO: 19319 - protein, 132 aa, Pseudomonas aeruginosa
LSSTRFSNAWMRSFSGSSICPRRCWLVSAKRCSRSSKIFPASSANCARNSSRADCRSVRRCWWLSCCSRSSAASAARSEARRRTSSSRPWRSLAQRASARDARCRSSPINSASRRSAATSPESLAWRSPSCW

SEQ ID NO: 19320 - protein, 183 aa, Pseudomonas aeruginosa
  UNSURE (163),(164),(167),(169),(170),(171): Identity of amino acid at the above locations are unknown.
ASLLVSNCAFSPSWASCAVASRSPSNAISRSARLALLCSCHARPARGIAAASRPSNRFGRSTGMGHSSGKRRNTRLAGARAADSRFLGKDRRANSAAPNEHSASELCVPHAQDISDTSITEAIALRPSPRGDVGGTLSRETQAPGPGPGQRATPPEQEAFKRXXPGXPXXXEGVHDAPGKGGE

SEQ ID NO: 19321 - protein, 76 aa, Pseudomonas aeruginosa
  UNSURE (62): Identity of amino acid at the above locations are unknown.
RALDEQRHAYRLARSKYRAGALDALELLDSPRSLVADRARLVDAEMRVAERQVELFRAFGGXWQAAPSPSHQENGQ

SEQ ID NO: 19322 - protein, 517 aa, Pseudomonas aeruginosa
SPPWTLANRTEPPPMSADDKVSLRAWVAVTGGLFGCFMAGMNVHVTSAALPEIEGALGATFEEGSWISTAYLVAEISMIPLTAWLVEVFSLRRVMLLGSLVFLLSSLSCALAPNLSTLILIRVIQGASGAVLIPLSMQLILTELPSSRIPLGMALFSLSNSVAQAAGPSIGGWLADAYSWRWIFLLQLLPGIALLAAVAWSIRPRDGDRERLRQADWLGIGAMVAGLGALQIVLEEGGRRDWFESGFIRTFAVLAVLALLLFVQRQLWGARPFINLRLLGSYNFGVSSLAMAVFGAATFGLVFLVPNYLSQLQGFNARQIGDSLILYGLVQLLLAPLLPRLMRWLNPKLLVAGGFAIMALGCWMGAHLNADAGRNVIIPSIVVRGIGQPLIMVALSVLAVKGLDKAEAGSASALISMLRNLGGAIGTALLTQLVSLRERFHSERIGETLTIFDGALQQRLGGGQVRIQLPEQQQALALLDHGVRQQAYLMAYSDAFYLSCVALLACALASLMLRQKD

SEQ ID NO: 19323 - protein, 295 aa, Pseudomonas aeruginosa
SWAIGEDRTGWKAGRSASGGPWRAVGALSFYQPRHANDQSRRSTPALAATRRARYPGRPGVARLPGVSAAPSLPKYRSETSMASYAELFDIGEDFAAFLGHGLGPGTGRGRVVPAEAGKQRAAERADGTPATHRTALSPAGRRGNVVPGLPDQPGRAGFRAAPATEHRAGDHFQGPRRGRPAPAPGAGANPDSAGTGAGRGVQPARTLRRTAAGGARRRSAGACGVQGGRLPGARHRRRPGDHRRRGALRQRLRPLLSAANSPRQGLGTASDVGVRRCRGRASPAAPRHRWPAPA

SEQ ID NO: 19324 - protein, 551 aa, Pseudomonas aeruginosa
QKEFAEQCGRYHVERAANEIARALGGKGRGCQQRAVGAEHRQQGRPLVPPAEEPQGAADQHRQPGSRAVAQGLAVMSMEGRWADVGAGPAVEPGEPPQGGLQVIQLLVETLHEEPFATGIRLVCRKSAPNRRQATAQAREPSRGAGEVELAALQLAAQQAQVVGHRQRQSTLRQAPGPMRLAGEAELHQRGKQRRQATADRRERSAQRPRLGSTDTQQVVYRVDLAGQRPATALQFPVSRTGMPRSDQRQRRRAERDETLAHPPGHGPAAEEHGHQAQAADPDDYRRGAGDDVLEGRLGLDHGRSQRQAHGVAGDHRGGGVEVPDQAHDADAETQPETQGDDEQQHLLGEQRGQDEGSERADQGTHGAPPALADHRSLHRIDQQQHSGRRGKRRIQLQVEPQAERQSGSADAAQHVVQAVGPPGQRQRRVPIAPAGRRRRHQRYSCNQRVSRQCRAVPACSTSTLPVMPAASTTPAGTRSSSMRTGTRCARRIQLKFGLTCGRPLSARLSLRSATPRPMLATWPSSSGSNPISLIVAGAPTCTLRSLVSSK

SEQ ID NO: 19325 - protein, 297 aa, Pseudomonas aeruginosa
GAQATGRGDLQISTTQPENNRIRTTIGPAVSREPQTYLAQRFDPDALGQPALALQLEARHNDTEVPVHRHRKGQLVVACRGGITCTVPDGLWMVPAGFGVWIPGGIAHSNRVTANGKVCFLFVEPGAARLPSDCCTLALSPLVLELILHLSAQPQDYPHDGPLARLAGVLLELLEQAPTEQLYLPLPDNRGLRRIADELTRAPGDRASMAEWARRVAMSERSLARMVRRETGMTFGQWRQQLQIIIALQQLSAGVSVQRTAEILGYESVSSFIGMFRKALGSPPARYVRDSMRRPAD

SEQ ID NO: 19326 - protein, 217 aa, Pseudomonas aeruginosa
PAFLQQRRPGPDHRLLRTGLPRQPEPGRKNPGAGLRRTGRPGGGRAGKRLPGTQGQAPARTPGRPGAETLRRRRDDPRQRLQRAGARLAGRPDGPAVPADPGFRAHPAGRRPATAHRLRRPEWPPVQAGRPLAGRAGPGAEGRDQHEAHPRLGRGQSAAGLRTAGEQSQLRVLQPAPGQRRKSARLAERTADRRLQRGHRPQGDSAGQPDVAVHHPP

SEQ ID NO: 19327 - protein, 141 aa, Pseudomonas aeruginosa
RRQRGGPSGGGPGYRRGHRRRGPRRSVLGHRRRRRRTRRTHEAAGPALAAMAQGGAAARLLKTSGRCLRTRPGRLANATPASARHRRPASTAPGALAAATIQTMNDAAESSVMIAAPAGPPRLAAAARPPETTCPCYPRQA

SEQ ID NO: 19328 - protein, 1096 aa, Pseudomonas aeruginosa
VDGTPYFHNGFSGQGASTLAARVSEPVGGGRLAEPGKTRSPSSRKTKNPSFSRRSRQMDSFFRKKAIARMSQNSLLDLYAHPTVVARFSEMAALHPHREAIRDRFGSVDYRQLLDSAEQLSDYLLEHYPQPGVCLGVYGEYSRESITCLLAILLSGHHYLYIDLKQPAAWNAELCRQVDCRLILDCSTTPTPANGLPCVPVRHLPAAPASVARPCFAADQIAYINFSSGTTGRPKAIACTHAGITRLCLGQSFLAFAPQMRFLVNSPLSFDAATLEIWGALLNGGCCVLNDLGPLDPGVLRQLIGERGADSALAHRPRCSTPWWNLDPGLSRRLSPVAHRRRHPLGAARAPGAAAASATALGEWLRTDGEHHLHLLPCRHRRRPRGRRHPHRQGHRRHRGAPARRARTGDRRARPGRGDRRLRRRPGAGLSERCGAHPRQLRRVALSRPPPACLPYRRPRSLRRAGPAALHRPRRWPGQAERLSPRPPRPGTALPPPAGHPRLRPAGPRAQRRQATALRLDGKSRHQPAGPAPPTAHLAAPACLRPGRGLALDGTRQAGPRRPAAPPGRTAGALRQRARSRPTRLRAAVERIAGLRGRRRRPGFLPLRRQLVARPATGRPLSIGGYGSKPGTRRLAGKLAPRPVQPSPAQPRPGAGASAGTGGDAGAAAGAVEERGMNVGLSAEVRYHWFREHLVVVGDWHRLSPSERDRLRHQPMPDEAAQSLRVYLSPWSCGMVFSELFGADLTRFGICYLAPAEVPASDLTRLGRRLREEFPLLDSQVDSGAEGFELVVHGQPEESPALEVGPFADENALIAALLQRPHSLFERGLLRLFHGRCGGRARWGVWLHHLVADADFASVLLARLAVLNADPTTEAAAPEFGFLQQQWRLERQLRERRTRLEDYWSERGEAFRELANLPWAERASHCEDFRLAATPGGGEAALLTRLACALALALASQGATGKVLALTPVSLRSRRGTAVSGCWLNLVPLLLDAATAEDTFERHRLEAFEHSLLPAEAIAERAGLRYADAQVMINVIDQPFRSAGFIHRPTLKSRLPLTLTLVRRDDGGWDASLASRFGRERTLALAAAMAEALRPC

SEQ ID NO: 19329 - protein, 1008 aa, Pseudomonas aeruginosa
SISSSTPSARSPSNETLSAGGIPAIAPTGAGLDPRRGAAAGPGAGTGIRHRRRRAPRGEEGAQPAPPRPALLGRLVRPLRARRAGPRPSAQAAPAAPRGVHQAPRRRVLHPAAPGHRAMGEALRKRADLLGRPDPVAERQRWDVLLPRRPHDLPPRVRPRLPDVQVHRPPGQRHFPRATGGCRAGRRRRPGLARPHRTWQPQQPQRRAAHRHADRLRRGRRIPPTESRGQHENLDRFQPEKRVPGRSNHRGQPRPLSSAAVRLLAEDGHLPRPFLPPVRPCAEDPRLHQGAAAGDAVGLGRGSETMIRVIDCTLREGCQARQCSFDSAQSVQLAREIAALGVDMIECGHPRISADERERVRAVVAAVSTPVLAHTRARREDIDAVLETGAQVGRAVRLDQRDLAGNQVQGHEPRGGARTVPRRDPLRPRTRPAGPGHGGRRRAHLGQRPGQHDRHRARRRRRSHLLRRQRRHPAAGRDLRRALAAASRVPRRGLRVPRAQRPRPGPGQYPGGDPGRGPVALGELQRDRRTRRDHRHLPVADPAAHQVRRRPLQPEERPRGLRAGRGAQPDQAFTDAPGGRRERLRPCRPPAPVGHAGKPGRLQRLRSGTDQRPRLAATLHADAPPIPVPHAFREVRQRTEVPPPRPRQALRHARPAPARRLAVLLHRPPVPRRRRRRAGPRRQPRTQLRLGVPVPRQRRGLPRPGGGSPARRPAAPFAEPGQRVHPRWRRAQLPLPRRQRHLHQFRPQGRLPREPTGDYPMKQFDKHADAYNVVRGKIAYPDSLYRNLAERAPAREAALDIGCGNGVSTVRLQPWFRYVEGSDLGEALIAKARENYPEIRFSVSPAETFAPQRRFDLVTSATSFYWMDRKQVLTRMADWLTPGGLFCAYKYDFPIAYGPLRDFIEHELVNKWAKHRDPRLTRYDDTLEIMGSCPHLRDCRREVFANIIFLSPEEVALFFLSTSYVTRYIEQEGGEDYADRFIAAVREIESAPQVAVNFDIHAFTALNR

SEQ ID NO: 19330 - protein, 495 aa, Pseudomonas aeruginosa
GAGMSSLPVPVSLDSTLRHLGSADPRRPFLIDAREPERPLEYTWGDADRQVDALAEQIAAHACRSVGVLLDNSYRNLCLIYAVMRAGKHLVLIDPEWGEAAKQAIVDEMRLDALASEHPLEGALAGLRLALDFERSATRRLDRAAHSHMILFTSGTTGQPKGIELSQQAMLHAYRIGRDCLGIGEHTRSGCFYRISGLGILGINFLFPLLYGGSAVLLPLHCWADSEGFWECVERFGISFLYLVPPVVNHMVKEGSPPPRRLPLQRLLCVAGSARLDADLQAAFQRDYAALANIYGLSECGFAFLFGKRRGDAFDNSVGPAVGLELKLTDPDGRPLEGSGERGRLWVRTPSLFSGYVNRPDLTAQVLEDGWLNTQDLAYFDEDRCVHVLGRCDGTINKGGNLFHLNECERALNGLDEVIDVCCLKVDCPLYGENYVAVIHTAPQVEFAFLPWLQQQLGTLRAPQRVVLSHQALPLNGAGKHDRRALAALLQREAS

SEQ ID NO: 19331 - protein, 191 aa, Pseudomonas aeruginosa
PCCATSSASSRCTTATSPSAACWPSPPSRGRCCTCSAAPAPTPRRSPRWSPPACRWKARPCSSRSVCCCPARCCASISPRSVRASASASGWPPPRPARWTASTSSSAKPSNAAARPSAPAPCWSAAGSIPTCSAATWTRSCNAFTCAWKATRKACCHTLGCNASSCARKPSCRCCVARSATSAGRHGCPAC

SEQ ID NO: 19332 - protein, 686 aa, Pseudomonas aeruginosa
RGGSPAPAPASRTGAWKRRAAARFRAAARTRRGRIPAGVPRILPMAGTHRGDQPQRRVPQGSARPRPARRPRRAAARPPDQPGTGLPLRSRRPHGARLLVAGTPGRRLPHPFLGRRPRHPGSRQSGLAAPARPADPPRPARRRRRRLRAGAAAHGNPADLRLALYPQVQRIGDAPRAKPRPAGAKHARRPGRGDRTRRRLCRTGLQQGHAGAGEQPHHPARAHRVQRRRAAAPLPAALLAEQRVHPRTAGKLPAAVPPGSRRQPARRHPSPRPGAPPVSDNTFSVQRFRALPTEIHVMLVGTLLTRGAYFMVWPFLALLLWREFRLSASAIGLLLALATVCGALSGIYTGWLSDRFGRKRLIFFGTSLSGLSFVLLGFSGQPLSYGLAISGVSIGCALLESSCKALIGDRVEDRRSRELALYCRYFLINLGAALGPLIGLTLGVAAQAGTFLVTALVYFCYGLLLWRLLHHLELKRRSLAPRSSTGFLEACLSMARHRAFTLLLLCNMLAALIYATFDSTLVQYLTRSGLPDVVNSIALLVTINALTIVVAQFPLLRLLENTGTGGRLMLGMLLMLLAQLGFAWTPVTLFAGLALATVVLSLGELIVFPTFSVEVDQLTPDDLRGSYFGAANLYSLGTALAPLYGGIMLDHAGSQALYLGLAALCGVIMLLQVGAVGLRQAERAGG

SEQ ID NO: 19333 - protein, 384 aa, Pseudomonas aeruginosa
RSPPWKTAKCCWWKWPDPTAPRPHGRGAAFVAPQPLSTQRRYPPQRLRPCRLGSSQLHASRSHYPQKNSRGSAMRELQPLLENHGLLLLFLNVLCEQAGLPIPAYPALIVAGALAMQGVGAPLGVVLLVVVLACLLADVAWYLAGRRYGGFLLRSICKVSLSQDSCIRQSQNMYLRVGPRALLMSKFLPGASALSTTLAGMTRTHLRRFLAYDAAGSALWAGSALLLGVIFSDAVDHLLALLSDYAAIGALLIAGAFAAFIAWKLWQRQRLLSRSRRIPRISVEELENLREQGQLPVILDVRAHHEDEPSGIPGAIPVELNVSLKDLPGDLRDASIVIYCACPHELSAAMLAQRLNASGFTRTWALAGGLDAWRKAYGQVVANA

SEQ ID NO: 19334 - protein, 251 aa, Pseudomonas aeruginosa
KIGIAPRVRVSSMVSTEVSRAMNGTRWARSTRATIWPMRPTPAITTRGVSSLSMRSISGGGFVASGSFASRRARPSTSNGVRAIDRVMESTSRLCRSFWNRPWSRAILNTTKANSPPAARTTPRRSAEALSRPPEMRPTKYSTGAFRAISSTVRPSTIHGDLSSRLMSALIPTLMKNRPSNRPLNGSICASSSWRYSESASSKPARKAPRAMDTPASSISSAVPITTSSAVAVDMSCSLVWATMRNTGRSR

SEQ ID NO: 19335 - protein, 166 aa, Pseudomonas aeruginosa
RPPTTTAAMLPTTLRVWVSSLPPASLCAPLSSGIMAISGIAAMSWNSRMAKARRPWGWVSSLRSARICRPKAVDDSARPRPSTTALFTGWSKPTRATVPITTPVSSTCSRPTPNTDLRITHRRRGDSSRPMMNSSNTTPISEICATLSGLSTRPSTLGPISTPASR

SEQ ID NO: 19336 - protein, 136 aa, Pseudomonas aeruginosa
RSGCGCPWLAPVRLADRGKPASRAGACARAGSCAESATGRRPGRDCRAPGARRLLSGCAPVAPAPRAGLRPPRCSSRARPRRPRPRRRRRRTPPHPAVRRPPRAATGCAGSRFPVAGRCPASRRPATAPAPARQER

SEQ ID NO: 19337 - protein, 91 aa, Pseudomonas aeruginosa
GCAHRDGRTPVPAVPHRRGARAAAGCTGCPRPDGSTGPRAGVPRRSPGAAAGCSPRSGAHRPAAGSGCPEAGSCRPAGPAAACSAWPSAWN

SEQ ID NO: 19338 - protein, 164 aa, Pseudomonas aeruginosa
SSDRCVAGSGHGRDGRTVPCRCRSRHGSAAAGRWRRKRPGAATAAAGSAPRSGCSGNPPGLRPLRSRRRLRRAPSRRAGNRRARAAGSPGGDTATARRRPPRRPAAYRSTAALRPGNATACFARPPARERSATGAYPTPAAGRDHRAGRWHGCSRRSDRRGRPP

SEQ ID NO: 19339 - protein, 865 aa, Pseudomonas aeruginosa
PVAAGRRKSAPGSPPTRPVHRFAWKSSAPRQAPCSPPRFPGCRNLVSCPIFDAARPSILGVDQPSPRKTRKILRFIKDFQGNSRALAGAWLATTSSSPHEENRHVQAHHRSHARPQPGRRPDLQPPRQAGLRQGPGAAQRLHPRLADLRRGHHPAAAGRTLPRLGVRRGPGALHLALRHHHPPRRRIAARRDRDHRGNRAALLSGQGRAHRGTRHGGSRRHHDGRRPLLHRRIGPHQRRGRPADDRDPGETWPQRLGGAPGKGPAPEDRARLPGTQQPAGRRRVRQQAGVPGLQHHRDPRRGVLRRQLHLGQRKGDHARRLSPDPREDRPPRLPGDRGGHLRISQDRRRRQLHVAALLNHAAADRPAASRRRTPAQAPPAPGATYRMQFRRCHMADSDKGKLGLPALTALVVGGIIGSGIFSLPQNMAEGAGAGAILIAWAITFVGMLTLTRIFQWLSTTRPELDDGVYGYAREGFGEYLGFNAAWGYWISAWVGNAGYLVVLFSALGSFGALAFFGDGTTWPALLGELTVLWLMHAFVLHGVHNAAITNAIVTLAKVVPIALFILCVALAFRIETFHLDFWGSPALGNVTRQVETTMLYTVWVFLGIESATVYASHARHAADVSRATLLGFVVTLLLLVCVSVLSLGVVPQHELAQMKNPSMAQVMAAAVGPWGATLINVGLIVSVGGALLAWTMLAVEMLYLASRGPTHTAPALFGRTNAVETPAPALWLTSTLISALLLVAFLNASGYNALIQLATSMALIPYLLCAGFCLKLVARRPHSGAMLALALLGTLYGVWLIYAAGLKYLLLSMILYAPGLGFFLHARRQRGLPAFGNRAEGSVAALVLILALAALWMIGSGRLSL

SEQ ID NO: 19340 - protein, 194 aa, Pseudomonas aeruginosa
SCTPDERSSRRLRPPSCLRHNRPLLESSRMPEHLNARVEACYRQAEHFFQRSFPRPTVSFRLRGQKAGVAHLDENLLRFNPQLYRENREHFLEQTVAHEVAHLIAHQLFGPRIRPHGEEWQLIMRGIYGLPPDRCHTYAVKRRATTRYLYRCHCPEHNDFPFSPQRHTLVAKGRRYYCRRCKATLVFTGEVLRE

SEQ ID NO: 19341 - protein, 189 aa, Pseudomonas aeruginosa
WPRRSAAGSPPSAPRSRRRACPSPPDGTVRGRCRIRVPAPAPPRVRPAASGRGRWNACCGSGRHDWPRCRRRAAAAPAPGPCARATPRAARPPPCRPAAARRTAPATGSRNPALSTMTTGLSCSLLWVAGHWSGSPAEQPIHPPRGATWPWRQSFMPRLMISFMISEVPAKIRWMRALAYILQIGYSHM

SEQ ID NO: 19342 - protein, 163 aa, Pseudomonas aeruginosa
KKPPLASPSRFSFGTRTLLKNSSAVSWLFMPSFFRLRPRSKPCMPRSTRNRPMACLFAGSVFAATITRSASRPLEMNTLEPLSSQWSPLSTAVLRMPARSEPADGSVMATARMVSPRTIPGNRRAFCSALPYSAMYGPHNAECSGIMKPGSLIRASSSHMICS

SEQ ID NO: 19343 - protein, 373 aa, Pseudomonas aeruginosa
TVAVELEGRHGKYPSSAGLSGAWAMGAAPTGETASAASRTPKKAARLKSLVSPHMLKPRSADEKRSFLQPVYRKTEFMGAVLPLLALRAFVETARHGNLTRAAAAMGVTPGAVSQQLRALQARTGVVLFQRFSHGMRLTPEGEQVYPGLRQAFEQITASLAQLEAINARQTLTVSTEPSFAATWLVPRLGQFSASHPQVEVRVEATALLADLRRERIDVAIRHGLGDYPGLDVQALMAPPLIPVASPRLLAEGPEIREAIDCLAYPLLQESERNDWRMWLRAMGVEDDPRSERGPAFADDLLLVRAAEAGQGIALVREIHARAEIASGRLAVALERPWPSRFAYYAVSLPGAAQRAPLSLFLAWLREQAAAEA

SEQ ID NO: 19344 - protein, 394 aa, Pseudomonas aeruginosa
AHHRQPFRPRRVARGHAPRPGRPRPAASRRHPAGPAGRTAGTHRAGAVHPPDAVALGSAGRRIHGLRRSPQQARHLRHDVPHPDSLPDPGKGPAARRTVLRPVPPGAADPPAARRRPGAPEPRGTPPVGPGSLSRRKPAGDLAPPRQLADRPAHPPGGSHLQLPGAGPPGRVRPAVSLPPAVFRRLHQPAVRRPLPGHAAAAGRTHPQAVPPALSRRPAGAPGRRRQPDQPDPPPARPRLPALAGPRPGRPPTAHEFADPATPPARGRRQLPATQGPPAARPGDLPPGSGRAVDPGHRRAARLFRALGLPSRVQEVDRPHPRRVPAPGGSLKLSPTPGDEARCAVGRAPWRTAAAARPRSPGRNPPRGAPGDRGFPGSRRTRPQSPRPGGGRSG

SEQ ID NO: 19345 - protein, 283 aa, Pseudomonas aeruginosa
HPHLLAVAGLLGELVADPLQDRQRRLQTVRQVAEGVAVALALLVLAAQQAVQRVGQAQQLARMLLAQALALAGFDLVQLGTQPAHRPEAPGQTQPEQPEQDQQGAAEPQVELLAEPLEQALELADRLHGDDAVGRLLAAQQVDLDVEHEELLALRIAGGVEFVAAAVVARRVVDRLVGRRGGAPEQIAILVVDIAEDLGLRQVELLHRQVLGHHQAALLHPRRRDQGRHVGGQALLDGVLQGYAEGPLQGRQQRQHEQHRQGGGAEHQTDAQGTDHRQRSVNR

SEQ ID NO: 19346 - protein, 847 aa, Pseudomonas aeruginosa
PTARYRARPRRQSMNLTRREFAKANAAAIAAAAAGLPILVRASNLVTEADVTSLVWNKAPCRFCGTGCSVMVATRDGQVVATHGDIKAEVNRGINCVKGYFLSKIMYGSDRLTRPLLRMKDGKFDKQGEFQPISWEQAFDIMAEKFKAALKAKGPESVGMFGSGQWTVWEGYAANKLFKAGLRSNNIDPNARHCMASAVMGFMRSFGMDEPMGCYYDIEATDSFVLWGSNMAEMHPVLWSRVTDRRLSAPQVKVAVLSTFEHRSFELADLPMVFKPQTDLIILNYIANHIIESGAVNRDFVERHVRFAHGAEDIGYGLRPDDPLEKKAKNADKANTWSDIDFKAFAEFVKPYTLERTARESGVPAERLKALAELYADPKRKVVSFWTMGFNQHTRGVWANNLIYNIHLLTGKISEPGNSPFSLTGQPSACGTAREVGTFSHRLPADLVVTNPKHRETAEKIWKVPAGTIQEKVGFHAVQQSRMLKDGVLNVYWTQVSNNMQAGPNVMQEVLPGWRNPDNFVIVSDVYPTVSAQAADLILPSAMWVEKEGAFGNAERRTQFWHQLVKAPGEAKSDLWQLVEFSKRFTTDEVWPAELLAKAPELKGKTLYDVLFRNGQVDRFPASDLAKGYANDEVDAFGFYIQKGLFEEYAAFGRGHGHDLAPFDAYHEARGLRWPVVDGKETRWRYREGYDPYVSKGSGVQFYGYPDKKAIVFALPYEPPAEAPDQDYPFWLATGRVLEHWHTGSMTARVPELYKAVPDALVYMHPEDARQLKLRRGSEVKVVSRRGEIRARVETRGRNKPPQGLVFVPFFDANKLINKVTLDATDPISKQTDYKKCAVRIELLNLA

SEQ ID NO: 19347 - protein, 171 aa, Pseudomonas aeruginosa
GARHETSADCPAPRPARRPRSLRRRPRLPAGRARPRRPPPRRHAGRKPPRAAAGGRGKQGPETRAQLPRAAADHSPQHRRLSHRQGQQQVPVLPQPRQQRANPGGDDQHHPLHGPRRPAAGRRLAAPLLLRAVPCAATGRKAAGRQPLREHRPDPRERSRQCGAQTLREAA

SEQ ID NO: 19348 - protein, 190 aa, Pseudomonas aeruginosa
KHSSPGWPVTGGSCVVPACISAWASSPSAASSPGSSSGAASTPPWRRPTPRPSAFPATRCATTCSSNSRTPSTTATVPESAPPVPTATCHTSGPTRSRARCRPPRRSGARSSAPSTPARNSSITAASWPSTNGHDSRPTIRWNAATATTSSSWTSPGRACARGRCTPPPWPAAKPPASTATRGSPTTCRT

SEQ ID NO: 19349 - protein, 407 aa, Pseudomonas aeruginosa
RAGSAARGPGGAAQSGLGALQRLEDLAPGATVGRGQAEALLLGLDRLARAGADQPVGLADVVAARQQRLLQLLALEPADARVVGRPGRHQAAAAAQAVGKQGDGQRVAFRGVVGIDRIVVAIDQEGRALGPGRQEDRGLLVAARQRLAVDPPHLTGDPGRQRLALAAPGQAGGEVGRHLHFIAPRLSRAPASLLQVVGGGTEGIRHAAYQVAATVAVEVHGDPRVGRWHELGMAEGPGPGAGDAGVADVAGLQQLQGGEELALEERLAAPVAGQGRQRGQQRTLAEDPPVVAFHAPHRHHRVLVHAVARGHLVEQLVVLGEHRLAIADPLLVHQTGQVVPQRGGELRLRVEQVEHAEVGLQAAGEALITVGGNALRLGLLLQAGEGWKEARCVGLRHGPGGYHGHRG

SEQ ID NO: 19350 - protein, 339 aa, Pseudomonas aeruginosa
KAGETLLGQTGGGIRMPGVSRPIRRVTSVPERAAPPARPFSGHWPGVRRSKQCSPPPSTSRSRPRRSQTTAGKPGGRHPPPPRAFHPHYTFRSTTLIHWLSDPTFWTALLQIVAIDILLGGDNAVVIALACRHLPAHRRKQAIFGGVAGAILIRILLLFFALHLLDLPYLKVIGALLLLWIGIKLLLPEEENGDDIKGSTHLLGAIKTIIIADAVMSLDNVIALSAASAGDFFLVSLGVLISIPIIVWGSQLILRLIDRFPLIILFGGGLLGWIAGGMLLTDSALKPWLAPYAQWDSYLHYGAAAFGALFVILLGSLLARRQLKQRHAAPADAAESEGR

SEQ ID NO: 19351 - protein, 142 aa, Pseudomonas aeruginosa
EQRGARGRPVLFLRLRYWCSPGSGSATGTRRACGAPGCACEWSPRPPSGVPGSAPAGRRWRSPACPKTPARRGTRSAGSRPGDRGRPNRAGDRCSPSPAPPGSAASSSTNRPRSCRLASPVPAPRSWHRWLVRRSSSKAGEN

SEQ ID NO: 19352 - protein, 197 aa, Pseudomonas aeruginosa
WPGGPGEWSGSRYSGQASRRCPSEGKGLAHRVDERRTLCLAEWPAFERRKAGTEGFPRVPRTSVYLDRGPFHGEMPCACSAPCCSSPAPPAPRPLSRPARCLTGAQTARAWSAISPTTTASRGSALGSSWSTNGGGSTTMPNAAPATSPNSATAPWPSTCTAKASTPSTRRTRWPSCRPRPGMPTPPRRASSPAWNC

SEQ ID NO: 19353 - protein, 285 aa, Pseudomonas aeruginosa
LVGHVGNRHNARHERPSPLLLHPTGRPLAAARRAARRATAQHPLRPGAAATRRLRPGRHPAAGEHPPRGGQAPGRVSRRAPLRTRRPVRPRWPRPDAGRRRGPRTGLAGRDQRLDHPWRPLGRRPGGGARRLARARPGRGNPARSRTGALPAWRDTHRRRAPALRRRPGATHRPAGDPGVLAEGKPVQGALSAGGQALLFRTCGTAGMARRRPGPAAPAHRPVAGVAPRQRAGRPVRRARRTPAQPGGGRRLIRRSPACAATAAARGRPPGARRRGRRRPCRRWR

SEQ ID NO: 19354 - protein, 151 aa, Pseudomonas aeruginosa
HAPPRVQRNIRNLVSSLCLHARSGSTWWSSSPWPPSSPASGPCTTVRSAYRTGRNASPASPSRRSASTRTRRAAATPAPNRCAPTWNWSPGTPTASAPIRSRARSATSRRWPRRSACASAWASGSARTWPATRPRSPAPSASPTSRRAWCE

SEQ ID NO: 19355 - protein, 290 aa, Pseudomonas aeruginosa
STTRACFCGRGAADMKGSLASMIVAVERFVADHPEHKGAIAFLITSDEEGPAHHGTKAVVERLAARGERLDWCIVGEPSSTSLVGDVVKNGRRGSLGAKLTIRGVQGHVAYPHLAKNPIHLAAPALAELAAEHWDDGNAFFPPTSFQVSNLNSGTGATNVIPGELTALFNFRFSTESTVEGLQKRVEAILDKHGLDWHVEWALSGLPFLTEPGELLDAVAASIRAVTGRETRPSTSGGTSDGRFIATMGTQVVELGPVNATIHQVNERVLASDLELLTEIYYQTLVRLLA

SEQ ID NO: 19356 - protein, 79 aa, Pseudomonas aeruginosa
TIRRTMDSPRPCPPEARVRLSSRRRNGVKSRSHCASGTPGPSSSTSTRQRSRLTRKLILTRRSACRSALVSRFCKARCR

SEQ ID NO: 19357 - protein, 95 aa, Pseudomonas aeruginosa
VCAGAFRGRRMAFSSAAAAYGRFLGLTHRRPTLYPQVSPRLSLCKHPISALSCIPIVATPYMLGFERTNGYNGTNRARTTLMAPAAPQKSIFQTY

SEQ ID NO: 19358 - protein, 476 aa, Pseudomonas aeruginosa
RSLVQRHAGSARPLARARNNPLLPSGGEERPGQTVPDHRFRVHLTPHIQAAETAARPGESKMLSWDEFDKEDPTEAKAAPAAAQAVAQGHDKLDDEAAGSVEEARAVSADDSDAVARAKKALNDLDIQEGLDDLEGSAARVQVGDKQMINARADLNQLVPFKYDWAWQKYLDGCANHWMPQEVNMNADIALWKSKDGLSEHERRIVMRNLGFFSTADSLVANNLVLAVYRLITNPECRQYILRQAFEEAIHTHAYQYCIESLGMDEGEIFNMYHEIPSVAKKASWGLKYTRSISDPMFQTGTPETDRQFLRNLIAYYCVLEGIFFYCGFTQILSMGRRNKMTGTAEQFQYILRDESMHLNFGIDVINQIKIENPHLWDAQMKDEATQMILQGTQLEIEYARDTMPRGVLGMNAAMMEDYLKFIANRRLTQIGLKEEYPGTTNPFPWMSEIMDLKKEKNFFETRVIEYQTGGALSWD

SEQ ID NO: 19359 - protein, 208 aa, Pseudomonas aeruginosa
RKCLSPIPYLHPHRFIPPPPRRCAMSDTLLHPSRFTHHHRVLHAVLLDEEGWFVLSDLVRLLGRYLGGRAPAALCDEAPWPLATAEQRERLFALCHALERHLDADQWRIAWLHDERHGPRQDCLVSESGLYALLWLAVPGAARGLRRWVSGSVLPRLRSQSRPNATPQRAVLHWKTAEIDTLHWQGKTWIPLSDCPQLLDSPRPLIRA

SEQ ID NO: 19360 - protein, 79 aa, Pseudomonas aeruginosa
DSSVGNFFLLFVYMSSTNSRNSFSVYSEILDFISLPSLVDFYMTFWRYCNKVPHIVNAASICYSNLVVDFDLYSPASLF

SEQ ID NO: 19361 - protein, 767 aa, Pseudomonas aeruginosa
WNSAMARSPTASNGPPHASRRCWHRHSRNRCNPNPTKLPLIDPEGGSSLAQCLNYSHPKPRNGCPSPRPWIFLPLCNPVHKSHKSPLPLPASLPASLTLDAPPLSAGSPDKKNQPLDQPHPSPITGAIAMHLISHWIPLVASLGLLAGGSSASAAEEAFDLWNECAKACVLDLKDGVRSSRMSVDPAIADTNGQGVLHYSMVLEGGNDALKLAIDNALSITSDGLTIRLEGGVEPNKPVRYSYTRQARGSWSLNWLVPIGHEKPSNIKVFIHELNAGNQLSHMSPIYTIEMGDELLAKLARDATFFVRAHESNEMQPTLAISHAGVSVVMAQAQPRREKRWSEWASGKVLCLLDPLDGVYNYLAQQRCNLDDTWEGKIYRVLAGNPAKHDLDIKPTVISHRLHFPEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAASADVVSLTCPVAAGECAGPADSGDALLERNYPTGAEFLGDGGDISFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTGLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 19362 - protein, 168 aa, Pseudomonas aeruginosa
TSWQSPGCRSRRSTSPGRGPASPRPTRPGSRSGRWSWCSPRWPRSACSTCSSPSRIGASPPASASPLRRRTDPHAPAVPAPPPVVPARWLRARRGPAHPAFTEHRHERPALLELPHRYPLRRRRPGTTAEALRAGGRTPAPAGHRSRHARPVAPAPGARVPVTRRVRP

SEQ ID NO: 19363 - protein, 330 aa, Pseudomonas aeruginosa
RADRSRRRQRPRRGQGNRPAQPRSARPRTLRMDTDAAQLSDPRRLPAARPAAAAGASHDRRHRLGTGTRGGADRHATGHQAGRRPPRAAGRLRIPRPAPDPRVAADAERRHRHGRPHPSPGGAVLAALPSDVGGHRPGRRAPGQAAPGKRRARRQRPRRPGRHAGSLGQRRSGIPEGAWRGPRPGPPAGRSPSPAPRPAERRAAALRSAGQPPGDRSRRRAPGALPGTRRSELRRPAGVDPRTARAHRHPGEPRRPRSGWRGRAMGGRAGAGRPIVLGDQRPAARCPGLCAHLPPGGGRDSRLSAQDPRPWTCSRSSMKARAASLRGRPA

SEQ ID NO: 19364 - protein, 529 aa, Pseudomonas aeruginosa
TIKIPSARLTFASRPSLTGSAPRTATKPSQSISASAGPSRSASTANLAHEKSHGKGIWPRPCIRTALQQHNKNNLPALSRPIGTHMNNHNGTLHRGWQSLQRWRIQIFVITWLAYAAFYFTRKAFSVAKLGIAEDPSFELDKSAMADLDALYLAAYAVGQFMWGVFADRFGTRVVVLGGLLTSALAALVMGTFATLPIFAACMVVQGLAQSTGWSGLCKNIGAFFATYERGRVLGLWSTCYAFGGLVATPFAGWCAYRLTHDWRMAFLSSAGVVLAVAVLFFFLQRNRPQDVGLPPVEAEAAPPANAPRPSHSGALLKALRNPHVLVLGLAYFLLKPARYAILLWGPVIIYERMPEIGKVASAIVPSAFEVAGLAGPILIGLASDKLFGARRMPACVLSLAALTVSLALFVPAMQSGSLYLVVGLLFMMGVTLYGPDSMISGAAAIDFGTSEAAGTATGFVNGCGSVGAILGGLLPGYFDTLTVFFVFTATALLASLLLVPFWNSRPGACRVEPKAHAGGPLLAAGKPR

SEQ ID NO: 19365 - protein, 256 aa, Pseudomonas aeruginosa
NLAEPPPGARRAGPIPSEQGTAYATCPLRPRRHPDRRRLRDPLGALHDRTGLGREDRLPAPGTPPHGTLCRGPAGHGGLHGLQPGAHRRPHPGGDRRRRRGFRRADHSPAHPRRRPALPGTPPPGRRPPADHLRLGALPCQRHRPPAGGGRGAGDRHRGARRPLHRAHPRHPHLPRGQGPSPRSLAGPGGRDAGRRDLLFRLAQRPAAALAGRPAAHGEPRPGAARARPRGRLASAGMALRRRAALYRRRPGSITL

SEQ ID NO: 19366 - protein, 289 aa, Pseudomonas aeruginosa
AGSKTTTRKRSMSKSSYYAPHGGHPAQTELLTDRAMFTEAYAVIPKGVMRDIVTSHLPFWDNMRMWVIARPLSGFAETFSQYIVELAPNGGRDKPEQDPHAQAVVFLVEGELSLTLQGQVHAMQPGGYPFIPPGADYKVRNTTGQHTRFHWIRKHYQKVDGVPLPEAFVTNEQDIQPLVMPDTEGRWSTTRFVDMSDMRHDMHVNIVNFEPGGVIPFAETHVMEHGLYVLEGKAVYRLNQDWVEVEAGDFMWLRAFCPQACYSGGPGRFRYLLYKDVNRHMRLTLNAPH

SEQ ID NO: 19367 - protein, 160 aa, Pseudomonas aeruginosa
GRDRLKGNPAPWRRVFRLRKAPSPSSAPGAEDFRANRTWPSSRFPRRSSDRWRRPRPARGSRGSSGWRSGPGWPASRRPPCPPRPGRRRCFRRSARRCSRPARRGRRGCGRRGRGGRRSCRWPSPANALRRRRQGWRSRPAAGPLRKVCHRTGGLARGRR

SEQ ID NO: 19368 - protein, 217 aa, Pseudomonas aeruginosa
PPGRRGSARRPGSVRAGCANRVRTSPGRGRGNARRAPVRRCAAGSPRKRTGPWANWRVFSGSNRDFPAAGCESRCRSRAWADRPRPKRCRAARGYPGVQGAGGPGRVARSRRPGSRWWTTAPRRTVGGPSRGSAAATPGPSVPSSRPVRRPPRRPGSAGSRTRCAGTGSSPAPPPATPAAGPPWPGRREARGRRRAGCARGRARGRRGCRPNSWRFS

SEQ ID NO: 19369 - protein, 327 aa, Pseudomonas aeruginosa
PALPAGHPSRRTDAQAIVSGRPDDPAAHLVPDLLRLPADPRGLPAPRPLRRGTVHRPRGHRIQPARPGAGRAPVRRPAAGPRAPHRHAQDPPPRRSQPQRDEPRPAAPLLPGAQRPAGPAPLRPVLAAGPAGEPADPDPGPRGAPARTRQAAQAALPGLGPVGRPAGTRRRAGDQPPAPAEAPRRPGRGVRSFRQGQGLVGETHSRIGRLPARREPAAQVADVGLQAMAVRVEEVERIALAAVLLPFAHAMRAQLRGEAGEIRGGDAEGVVRVVRGRPTVLRLPGQAQPQRTQFEIGALVPARFQAKAEKIAVEGDAGRQVGDARVR

SEQ ID NO: 19370 - protein, 351 aa, Pseudomonas aeruginosa
SNRSVPPGALPASVFPICRSISMSVESIRIEGIDTPVSRIGLGTWAIGGWMWGGADDATSVETIRRAVESGINLIDTAPVYGFGHSEEVVGKALQGLRDKAVIATKAALEWSDAGIHRNASAARIRREVEDSLRRLKTDRIDLYQIHWPDPLVAHEETAGELERLRRDGKILAIGVSNYSPEQMDGFRQFAPLASVQPPYNLFERAIDADVLPYAERNGIVVLAYGALCRGLLSGRMNAETRFDGDDLRKSDPKFQQPRFAQYLAAVAQLEELARERYGKSVLALAIRWILDRGPTVALWGARKPEQLNGIADAFGWRLDDEAMARIERILAETIQDPVGPEFMAPPSRNA

SEQ ID NO: 19371 - protein, 291 aa, Pseudomonas aeruginosa
SDGRGGNAPGRWPDGAAEGKMAVFLKDCRISYGKRLQDPGSAPGGNPRREAGAFLRHFPGQDERALPRHPGAVRRVLDVQALEGPATADGAADQPGMAGDLRHLLFPRPRPADPPGPAGRAPGTMEPEQGCDLGGAADGRGEPDQPPHRCGPRAGALLAALAPAAAHAADPDAQHPAPGQPRQRRPAGHGQRRLFGLQPAVHRARRALLAADPDRFRGDPLRLVPGLSRLSRETPGATVRAAPRRPDRRDSVRADGGCAPVAGSHARRWHRVPAPVRVSAPPAAPRRKCRR

SEQ ID NO: 19372 - protein, 226 aa, Pseudomonas aeruginosa
FDTERLSFPAHPVIFAAHRLHWPVVPPRYVFLEETFLPSLPTLQPLDLYRRTLACLVLAVSCLGGGGLWADDARTSVEQRSNAVSQVLLGIFSYVRWPKEPAVLQLCVVGPTEYADGLLRGMVQANGRRVHAERRAVDNPDLGTLCNVIYLGVVDERERQQVFRSLAGHPVLSISERGTECSVGSMFCLNVGGPRITFEANLDSIARSGVRVHPSVLKLARRQATP

SEQ ID NO: 19373 - protein, 169 aa, Pseudomonas aeruginosa
TVLPQRLHPSRLLALALFSLVLGLAGCQTKPPQTGLSAEQIAVLQEQGFELRDEGWEFGMSSKVLFGNNLDRLNPDSRNTLTKIARALLAVDIDKVRLEGHTDNYGDEGYNQKLSERRAESVAAVFREAGMPAANIEVRGLGMSKPVADNKTRAGRSENRRVAIIVPAE

SEQ ID NO: 19374 - protein, 312 aa, Pseudomonas aeruginosa
SCARGLRTAHPYLARPSPGPATTPLPAYVEGRSQQTGVPAAAAADARLNAAQETDNPGRPAACGCSGIHRQGVSTFACSPKEQAVRRWEACHEPALLHQRQPRRAGTARSRTGSQRHRHRADPRPQRKGRGDRPAPSARSLSVHEEGCGPLRPCRPAGRPRPGHRRRGLRLCQRLDGNRRRLDSGDLPRRHALRVLPVGRQLLRPAAHQPRLPSLRRTPAPGAAPVLRRCEERPGADPGQRGQPPPAPAGRRHRPRGLSAAAGLAATLAAVPADGLSGGACAPRRSCGVPPAARISGYPPAIPAGAARQETP

SEQ ID NO: 19375 - protein, 671 aa, Pseudomonas aeruginosa
TLKTFLEHPYQGFSLPLIRSSCASTQPLALILRLASGAGRAVPGRSPRRPLLARLVDAVRLSLGPGPRQPAGAAPASTLPVVRAPGHAALVPVPDRQCRTGRRGRAHAGTFRPQVPAGSAVRQQLHPGRRPRPPATGARPRWRDIALRAALASPRSAPAALCLRAAGGVPGGACRPAIPASERCRPMAAVQPAAQAAGQRAQQWPTGGRRLARRRPSGHPAGRRRAQPARPFRNAAAGRRRARAQRPDRGHGGNPRRVYRRQPRRHQQQLPRSADAQTEWLGRTGDDHPGLRAAQPPDHPRPLRHALRRLQQARLGHAEGRRAAQQPGPGQGVLARPAAPARFQHALPAGCRPALHGQGQGHAAYGLRQDPRARLVPQHVLPGVSLGHGRQGLLRGRRDLREAAAPAEETLDADPAHRRHPPALLGACRLPGPLPERQAGRGGLSRRRDRRLPRRPGETGRVARHPGGAHFRRIPRCRPGAPRLGLGLQPGTGTGTGGAAADQERRLRPRRPRRVRPRLFRLPRAGGDFRALAVPRLRQRPRNDVLHQRHAAPPRRQGHLRRMRFPAGLPALPQRGLHRRRSRVPRSLQRSPGTPGQPARRRPRPLRATGRPVGPGVPVRHPRTHPPEAGNPQRLDRQPDRRAIPGNAEEQQDHGHPEDPRLAVWTATAPG

SEQ ID NO: 19376 - protein, 150 aa, Pseudomonas aeruginosa
SFRTDRAGAARPAAARSPLNPAPSRASKIRKQPGETENGMKHLAFLALGGLLLAPLAEAASFDCEKAERADEKAICANRALNDKDVEMSVKYHFLRGLFAMGGRGAMQDRQQDWLRQRRRCGGDTDCLSRAYAQRIDELDKQYAGIDKPL

SEQ ID NO: 19377 - protein, 70 aa, Pseudomonas aeruginosa
CRDRSPDMAIMKKTVAPKAAKPAPAVETRESIEAQVAAFLQAGGEIQKIAKGVSGQVYGPSRQITISKKR

SEQ ID NO: 19378 - protein, 182 aa, Pseudomonas aeruginosa
PATSRRRSGAAVLAGLGIGQVDQPVLGEPRRQGDVEQSPLAAGEDPGYAFQRRRQLSLGTDETQAAGPLGDQYALVVRQEGDGPGIGQTANHRGDLDGAQLAVVATGVHRLDRRSEQRDGAQQDGIQRQARHAFSPSPSEKHHSSRRSAAPGGPHTGCNKPAPQSKATISLRVTAQVPLALI

SEQ ID NO: 19379 - protein, 265 aa, Pseudomonas aeruginosa
VGTERAPNHSSAPIATTSKLAVFHSSSLAMTDPIRLSKRLAELTACSRREAELYIEGGWVSVDGEVIEEPQFKVLDQRVELLPGARAETIEPATLLLHKPAGWRHDDFEGLLAAGRRWSDDPSPLRALKKHFARQRPTLALDSEASGLVVFSQQHGVLRKLVDDGARLEQEYLVEVAGDLAAGGLERLRHGLAYQGRRLSPCKVSWQNESHLRFALKDVLPGQLRFMCESEGLEVRSIRRLRIGALSLARLPLGEWRYLGLHERF

SEQ ID NO: 19380 - protein, 144 aa, Pseudomonas aeruginosa
TDAPGSARWRRPHVPTPRCSSPARVAPAAPRPPSAPAHRAASAGSRRVPARSPVHRTVRATASGAALPIASRLPSRSCAGSVRALAARLRGPGRCPAARRTPRVRSTGYGRRSGRAGPCDAARRPAARRPGAASIGKCARRNTA

SEQ ID NO: 19381 - protein, 463 aa, Pseudomonas aeruginosa
RYRPPCTATARAGGNASRCGGRCCRPRGRPPGSGRDRDPRPVRRDSAAPCPLRDVFRPDRSILPGAGGLGLALFSGAIMPDRPRPPLLLVLALLALPQVAETILSPALPALASHWRLDDATSQWTMALFFVGFAPGIWLWGWLADRLGRRPALLGGLGLAALATFGAWASTDYSYLLACRLVQGLGLATCSVTVQASLRDVLQGPALMSYFVTLGAVLAWSPAVGPLGGQWLADLGGHPAVFATLAVLLASLAALVVPAWPETRPLLAGTPEPATLAIFRRVLADRPLQTRALLVAVLNVLVFSFYAAGPFMVGDLPGLGFGWIGLAIAIAGSLGALLNRRLPRTWNSARRVRLGLALAAAGATAQTLLAAVGYAEGLYWALPALPIFIGFGVAIPNLLGPALHAYDDCRGRAGALFGLAYYLLIGLGLGASTLLPFDRPWPLAAYWSLLGLVALLLARRLPE

SEQ ID NO: 19382 - protein, 278 aa, Pseudomonas aeruginosa
LAALPALPTCPTSPGPMPRPCRWRRAGRPAQRRCPHYRGRTMLKHLLVLTCALLASSSALAQVMARDLGDFELKLATSPTRSMAQGLVTPGSSGSFHGGLDLSHESGWYIGNWTSNLDPGKPTEIDSYAGFKRPLNNRLGYEMGLIRYSRPEQPANDAAELYGGLSIFGSRLGAALSSDPGRNDTTLFADLGVNPPFGFDVTLKYGNHRLDNPASLSGGGYVSVFNDWSVNLSRPWLGIDLNLSYSGTSLTGSDCSAYSGHNSYCDTTFMLKASRPFF

SEQ ID NO: 19383 - protein, 209 aa, Pseudomonas aeruginosa
RVSESISSNTFLPLSRKYSAIRVQYCAARRRISGASSAGEATTTERLRPSSPRISSMNSFTSRPRSPIRPTTMMSALVKRVIIPSSTDLPTPVPANRPRRWPRPTVSRPLIERMPTSRGSLIGWRLSGLIVGPSIGTQSSARIPPLSSRARPAPSSTRPSIDMPIGRRPVSGSGTTRAPGAMPARLPTGIRYTLLPEKPITSASTCTGW

SEQ ID NO: 19384 - protein, 700 aa, Pseudomonas aeruginosa
ASCGCSRRHRRRGWSGRRPLRRTRPSPARPVRDARCASTPWPRRPAAPLSVPCAAAPAPRRSRRATGAGWRPCRPWSVWRRDDSHSWRLLIGVDPLFHDLGDAARVLCDQVLDRVQLRIIPLRGARQEDARRPADAHPVVGQRAFQATLAQRQVTVATAAAGQRLALAAAGDVAQHRTQYAEHQDQDEQHAEHLLDDVPEPRLRVERNAVDLFGLGRGERRVDHADAVAAAGVVAHRVLYQAGEARQFVGAPGLVADLAGLRVDLHLVVQHHRHRQSAQASLLLLGVADRAVQFVVAGGLVALVGRVRRQLRLAGLRIDDGLAVGVLQRLARRDVVGRRAGGGLLRRAGRARRLVRQRPRHALRAGRILPFLVVALLAAQGRLVRVVHLRGRLDRAEVNVGGHLGLVATVAQHRLQDIVHALGEQAFHAPGEVELLAGHGQLGEFLLVGEQVALLVDHGDLRLVQLRHTGGDQVDDRHHLARLQAATRIQLDQHRGAGLAVVADEHRTLRDRQVHAGGLDVVQARHGARQLAFQAAAVVGGFHELAGAQRLFLVEDLETDVVVGRRHAGGGHLHACPAEVVGLDQQRAGVGFDLVGNVRRGQRFHHTVRVDPVEAAIERLVVRLLGPEHDGEADRHAGGETDQQADLAQHGHLGKVVEERQSREGFLQHPGTAALGGNLAVDQCIGHELVILAPLRPASA

SEQ ID NO: 19385 - protein, 529 aa, Pseudomonas aeruginosa
QYPCLNFFHLKIKALRNDLSIIRQVVVAPAHAVLAHLLHQRGAADAQAFGGPRDHSAGIVEGLLDQALLEVGQVVLEVQAFGRQHRRRVHSRQPGVDRRALFQLFAQAAGELLVLVVDMAEFLRQFADPDHPVGMHDRQALHQVRQFADVARPVVAAERHDGRRVEADRPALLVLHPRDQFVEQQCDVFHPLAQRRHLDGEYVEAVVEVFAESAVLDHLLEVLVGRGDDPHVDVLRLVAADPFEGALLQHAQQLDLHRQRHVADLVEEQGAAVGQLEASGTTGDGTGEGALLVAEQFAFQQFRRDRPAVHRDEGPLAALGMVMQVARHHFLAGAGLAEDQHAGIGIGDLLHHLPHLLDRPAGADQAAEQVRLAGAAALAGLVVHLAVDLGAMQGIEQLVVAGRHLQAGEHPAAQLLRPVGRGRLADQQDRQVLVPTGQLLQQLYRPALRLDAAEQHAQGFATVAQARRYLSPILAVAGQLIFAEEVENDCQVATAIEIVVNQQEFGFAPHFDQLPCIEWVSLDPKEGWD

SEQ ID NO: 19386 - protein, 642 aa, Pseudomonas aeruginosa
DATSAFLHKARQAAKSLGHASAGLVELADQLVHGGELLEQTILQLLDPAIERFALGIHRLDGVLQSIQALLEHTAGLGVRRELVVETLHQAGIAGEQSRNRLELVLQNLVEFLVVDFQGAVFLGGDTHVGEHANIGTLPRLDHLVAHGGEQVAHAAVTDQGTDHGSLVVAHLGHAGQFRSHADQLVVGLDELLDVVLDAATVLLDRDGDRLVGVGDRLQLEGDAVDDLVDRIGRTFQGQAVDAELGILRLGDIAAAAGRGTVQLGQGQLAIGADAADVEVLQAGTALDEHVLAGAGILAGEDQSRGSVSRVVDDVGGNALVLQLRVERVAHFGEGRARRDVYRDTGIVGTLLDGQGSAGSGLVAIGKRRGGHLADAGQLGHFELVDTRQGVLGRGGGGELLVAGTRRALLEQLGLVQFLEDGLQVGDRALELADAGELGGGVAFQTLELRLLRRLLGRHQGGNDVLDIKARVVAVDRRTVRHLASPRQLIDALSFQFQQTLKRRANSAQASALNSRLRASSSRSARRRASSEGICRMTSPEVESVTLTTTRPVESSRLKLRSRRMLWVNFSMEETASSTAARCSLSPILTSPVRCALALAAASPAWPAGRAPSEEDAEPNSRITGAAVELLTLLTSIVATSQ

SEQ ID NO: 19387 - protein, 563 aa, Pseudomonas aeruginosa
PRRSLAQQAQNRLRQLVGLGQDRGAGLLQHLVLGQVGGFGCEVGVFDPAASSRYVLTDVLQVVDGVVEAVLHRTEVGTLGVDLLDRLVDHQHGGLSALRGGDVDLGDGVVGLGESGSGRGYASRGAYAGAAGVSDDNAGNRASDRTGAILASFGNIADGIAVAEGTDADVGVVDRCGDLGSRLLGGFVALHVDLDVHGAAAGDADRDVDGARSGCSSDRAAAVSLEVGAVQRLCAHLVDADADDFVGGRTHLEAGDAEGTVEQLAATEGGGVADTIQFFLQLLHFAVQSGTLGVAVGAVGRLQGQVTHTLQDVGRLLQGAFSGLRQGDTVVGVLGSHVQAVDLAGQTVGDLQAGGVVLGAVDARTGGQTLQRSVQRRGRVVQVPLSVQRSDVGVDGQGHLDALQGRYVCLSLRPRVGIAQAPLKFAFVIFIGASLGSFRFFLTILVFHASAPSEGFAQGLPSAADSDGKPRRPLSPASRHDTRRANARRRASNPPAPVRAGYPLPWPRHPGRGYACGSPPPSRGNGSSPASPADRPGSSARRCRPPGNRRRRIPAGADCSCTR

SEQ ID NO: 19388 - protein, 154 aa, Pseudomonas aeruginosa
NRLRPATKSPGYRRDRVPTTVASARTAHLLPRRSPPSWQAHRATAAHAASIRSGSPPGPPAGRCRHRPSASAPRRNRPIRGTTRGASTGIRQPPPSSSGPPAGAAGNRRPRANALRRPARPVRTNRAASRRGRPVRPPPGAWRLPRRLPDAGHG

SEQ ID NO: 19389 - protein, 420 aa, Pseudomonas aeruginosa
QRRTSWSPSSDGRKLRFPRHLTDPTPPEIPRVHGKSAGGLRPQQSSIAIGKQAVPAFSGKRIERVTLQVEQRGELQRVPAHIRLKGQEARLCKTVRVGQGFHRKAQTPGIISPERRFEGVLRQLLVMPLRRQFQPIGQLVGGPVCRTRILGQGPERQHILGSCNHRFLREVERHVLPGSTQRNRDLPGIAAMREESVERLVKRTMKNVVAAATNSELDPLVRQALYTQACRTQDHIAVHQAEILRLWNQYQLIQPGATALEQFAGLMVPGHHALVGGREMRAVPGQHQRREVERQALDENTHPTGRQIAPHRQTWEQLGDVLHFIEQRHVARIEIDSAYRAEPAMKLTDLVHHFGEVVGHDHDQGVLQRFLFECRRRPNFHAVDALPLIFGIGTDSVLQVQVLAHTRVEILEKLPRPPSD

SEQ ID NO: 19390 - protein, 99 aa, Pseudomonas aeruginosa
LGSSRGILPGNNHSQCRPTRVSASATLPAPSVLPWPISTRRPNCTPASSVLQVPTRQSSSTRTCSSSQLPVPMRARPASTQPAPTNTLPSSRTPSPTMA

SEQ ID NO: 19391 - protein, 94 aa, Pseudomonas aeruginosa
AGSATRPRAGATRWPATSCRWSPVRRRRPGRRSHGCAGGRCQPNGGWFLPGSGCSSPRSCRSCTARSTPAPGPGATGVPNRPGRPPVSGCACRC

SEQ ID NO: 19392 - protein, 476 aa, Pseudomonas aeruginosa
HSRIHRRRTAGEGRRADLAGAAVFGGRLGTRGTGERQLRGILQRRLDIRRATPGRLQGEAVAGSRELVEGQVEALVDAVGILEREGVGTGTADRDLHACVVAQAPRGETGAVEVQAEIAGIQLAGIGDVQVGVDITGVAILRQDPQRGDVRIVDVAEQVGAGLAGQVEALPQLLVDGIGEGDRQLPELVVAAVQGAVAVGQQATHLAAGHQAGDVLYGVAVAQLHLVAGRVIQPGHHAQGRHGIAHHQRLAATDEQADAVVVLGDRGHPDHLGQLAHGFVARIHQVVGHRARRLGLGDGIVVAGHALRQMVDLRSQRAQLLVDQAVLLVQLVVEGIEGLAQPLGLGKHCLARFGRGGIVGGGLQCGEEALHGRADAGGGVGQQAVELLDLATECAQLAVLAGGVAQLAGEEVAGQAAHVDDLAARAHVAGTAELRDLGLLDGILATVARRLDVGDVVPGDGQPGLAGAEAGQAYRE

SEQ ID NO: 19393 - protein, 459 aa, Pseudomonas aeruginosa
VGHGSVPPCSTQRRRAGGGDGLVGLHLSGDLRHLAGVLRIGGVAGALQFLHEALGVGGAVQGVLVAVVALEEADVVVEALLERRVGAERRDFLDRLAAFVFGGESARRGTIPAAAGLDAEQVVAAAAILLADDRFAPAGLQRGLGHQVAGIDADPLGGLLGHRQHGGDELVGRGEHRLALGQRRLGDAPAALAVDAIGGETAAARRRVALRRQVAVLAQALHLAGGRRGGGNDAGEHALGQLARQRQAPLVEQLRVVAAGFRHRQGLAGLRAGVARPATGAVLGDPGERVFAVSPGALLHLRQLAHQHVGQADAAGILRQAHRQLLVVHVLVLLGGLAVHEIAVAQRFVGRTHGFEHLVEEQRFEFLGDLADVRLAVAVLADLELVEAVEIGIGAAVGACADTAEQTGIHGVVLRSRSSRPATRRPASGLRGSPSGRSARRRPGSPRGRCRPGWCRDRT

SEQ ID NO: 19394 - protein, 514 aa, Pseudomonas aeruginosa
TWSSRASSERPQRAEEEAVQPARLTGIGEGAGAGVGDPGVGHAGRGHGVVGGDIVGADQAGDAHQLVAGVQGHPLLAAHGEDAVGQHLGHGHGDRAGQAVALPRLAIALGVARAAVFGAEAEVAAADRVVGGHAATEQRGQPHLGLAVLLDIGVGFLARLGLLVEGDGNDVAHAEGLAVVVKVLLEAGLVDRAVVLRGGQRGARQHRRVVRIVRLRRWIDATAQGGGDAKQGDDHQPVHIKLPRGVQPGPGQGPSKILGDEGQHLVGGGDDLGVHLVGALGGDHVHQFLDHVDVGVFQGVLGNRAEAVETRRTDLRRAAGAGFQEQVVADGLQAGRVDEVGGLDVADHLRLGVAGGGHRDGAVLADGEGLGLVGHHDRWLQGEAVGGDDLPVGVQVEAAVAGVGHGAVRQQDLEEAAPVDRHVQRLLGGLQAARGEDLLGADDAHTGTQLQARRQLAVLGRLAARLAPDLVQQVLELRAVALEAGGGYVGQVVGNGGQVHVLGGQTGLADPQCR

SEQ ID NO: 19395 - protein, 493 aa, Pseudomonas aeruginosa
RPDRRQHLCADRDRLHHGLRHHRHDQLRPRRGVHDRLVHRLHRHHPAGDDGAGQRSADDARRIRRQHHRHQCLRLQHRAGRLPPVARRQPPDPADLRDRHVDLPAERRDALAGLQGKGHPDPAARQLRVRRKQHERRGDLLYADPDLRRHLPGDVRPHPVHLPLPPGPRLPRLRRGPEDDQPAGYQQQQHHRPHLRHRRRPGRRRRGAAGHAVRRDQPRDRLPRRDQGVHRRGARRHRQHPRRHARRPAAGRRRSLRRRRVRRPVQGRGGLRPADPGAAVPTYRHPRSSGGGKSMSQSLKRALFSALLVILVSYPILGLKLRTVGIKLEVLGADAQTLWTIAAAALAMFVWQLFRDRIPLKLGRGVGYKVNGSGLKNFLSLPSTQRWAVLALVVVAFVWPFFASRGAVDIATLILIYVMLGIGLNIVVGLAGLLDLGYVGFYAVGAYTYALLAEYAGFGFWTALPIAGMMAALFGFLSSASRCCACAATTWRS

SEQ ID NO: 19396 - protein, 491 aa, Pseudomonas aeruginosa
SHEPTDSRSERPDHALRRPAGRQRRQPEGRGKAGGLDDRPERRRQDHRVQLPDRLLPAHRRPDPPRRRGDPGPARSQDRSQGRGADLPERPPVQGNDRGGEPAGRPAPPPQHQLPRRPVQDPGIPPQRARGHGVRRALAGGSQPYRVRQPQRRHPRLRPAATPGDCPLHDDPPADPHARRAGRRPQPEGDRRPQGADRQAAQRAQRDGIADRARHEAGDEHFRPYRGDQPGRPPGRRDAGADPRQPGRDQGLSGGSVSMLSFDKVSTYYGKIQALHDVSVEVKKGEIVTLIGANGAGKSTLLMTLCGSPQAASGSIRYEGEELVGLPSSTIMRKSIAVVPEGRRVFSRLTVEENLAMGGFFTDKDDYQVQMDKVLELFPRLKERYEQRAGTMSGGEQQMLAIGRALMSKPKLLLLDEPSLGLAPIIIQQIFEIIEQLRREGVTVFLVEQNANQALKLADRAYVLENGRIVMHDTGAALLTNPKVRDAYLGG

SEQ ID NO: 19397 - protein, 214 aa, Pseudomonas aeruginosa
PGSRGCCAPRPSSRARRAFRGRRRRPRRPDRRRPPASSASNHRSRGRAPPHRWERNACAPPRLPEPDRSGRRRTPPSHRPAGCDCPARSRGPARSPGRCAGRSSRALRHPRCNGRSPSPSLPRSVRRRRRTPCPCRQRPRAASSSRARRWRRSSGPTAPTAAPPACRPDAGRPAPPRRSDPAPSAPYPAGCGLPASREKFPAPIGRRAPAPASR

SEQ ID NO: 19398 - protein, 142 aa, Pseudomonas aeruginosa
AGSRPVAAPRRCGARRTPRAGRWPRRRRSRPVAPRRPLRARRCRRAARPAPGAATALLSPGCAARLRCPAQPASRATPQPAPAAPAAAARHRSPPSTRRATGWRPDRAATVEHAVRPAPGGAWRSIPNRVATRGGWPGWQHR

SEQ ID NO: 19399 - protein, 174 aa, Pseudomonas aeruginosa
CCSTPLPRPSPPSRRSGPAPVPRAPGSAGSPRASPGGCRIPPRRRRGSSSPVRPGRPGHLRRARRRAAPRPSRCSGSGSRPRSGRSAPGSRRTPRCAPPPSPGRRRWRSTTPGPGSRRLTAGRPGCRRDWPVRTGKRRRPGRSHPPVGCRPGYAFPSGGRRFPATGCSTSGSAP

SEQ ID NO: 19400 - protein, 280 aa, Pseudomonas aeruginosa
SGRSPVAPRRRPGVRPASRSRARAVGRGGTTGGCPARCPAPPGASPWPAPSDGGRVPPHSDCHGPPVRPWHGTAFPRSRCRCPAAHAPLRAKGVRKPGGRPGRWVRAGCPSSARTDARRTTPLPAGPRCAAAGPAARPPAAAAPPRRARRSAPRPAHAGSPRNGRHAAGPRGWRWASGGSIRSPRRRTRPRTAAGRGRHRRAACRGGKPRDCGCRWCHRCRRPGSTAGPARRPARPGAPAGSRSARSRARSVRRTPGRGAAVAAGAARRRRPAATAAAPG

SEQ ID NO: 19401 - protein, 474 aa, Pseudomonas aeruginosa
RQPGDAGAGQRGFLQQAVVVAGEKAGNPYPLQPMVAVIEPLLVAAVVRVQQALALGQLGRALRLAVSRQVGGTGAGDFLQDEQRPRHQPGVLLDPRADRQVEALANQVAQAVVQVQLDAQQRMAFLEVLQQCIEQGLAQRDREGHPHPSFRSLLQARHRLPRALGLHQQGLRLGQQRGAGGGQRKTAGGAVQEGHAELLLEDANALRQLALAATETLGGAGETAQVVEYGEGGEIVQVLHDCFPMKTVGCRLTGLSMAKATLHWKPLTFTQREACMKIILIGASGTLGKGIDKELCERHEIVRVGNSSGDFQVDISDSDSIRALFEKTGRFDALVAAVGKVHFGALEEMGEAQYQLGLRDKLMGQVNLVLLGREYANDGGSFTLTSGVLAEQPIRFGSSASMVNCAVEGFVRGAALELPRGLRINAVSPTVVSEALPGYAPYFRGFKPVPAADAALGYARSVEGAQTGQVYRIW

SEQ ID NO: 19402 - protein, 151 aa, Pseudomonas aeruginosa
AIFLRRGGRRSRSANCPAAGGPAPPRGTRPAPRHCCAAGRGRRRAASGCPPERCRAGPTNVPGAPATRRGSVRGSCRRVPDRGRTACAPRWRAPRPSASRPWPGLPCGCRAATAGPPVRAGHRRATPVRIHACIGSLIDSLVAMKSDPDLS

SEQ ID NO: 19403 - protein, 221 aa, Pseudomonas aeruginosa
PWTMKAARTLRRMKLIARLCAGGKDCDGTLSSAPSRSVAAPDRRRFPARRSRPCASFPPTPGSLRDDRYRRPRCLRRPVGPAPPPATRCRAPGRPPPDALPPRRCRPAAHRHAAAGNGRNPRCDGSWRTPAADRRARPGRHVPRRRRWLADAHAPPPPANGSRDSARGAATGRSWPRYRRFRQLANGAYPLLQSPATSSPSGNATPRSMQAASASTRGSSA

SEQ ID NO: 19404 - protein, 144 aa, Pseudomonas aeruginosa
RCLISAISAALSGTSRPCTSKVLRSSLRSDDTDPGVSETMLTSTLMARSFSSSIGTSTKAGRKRSIGPRVRRATWMLATSMSHITSASSFSSSNGCHSWLRPTSRRLVSSGMHTPRKAPSSQWPMAKESTSSNQTSNSRTLSTG

SEQ ID NO: 19405 - protein, 135 aa, Pseudomonas aeruginosa
ASSATSMPTPPASATSRKPRRVEDSAGVREGRKYSASISRTMVTTSTDNWVSARSGAEKRAKARATSRPATLRINSATRRIRWNSAVARPLKASTSMPRAVIPSSGVSPREPVSLASGASSTATTTSAAPSSQAR

SEQ ID NO: 19406 - protein, 331 aa, Pseudomonas aeruginosa
LAVRVCPANTVPRCPSNRIRPISGATPADAAHKVRPPRSASRGNNAPMNGSAMISARIMGYSSSMAEPPACLAGGASPRLSVRGRIASSSKPHRPPAGAARRNYDYRNLSNERHGLNYYKIQAFRLPESRKKLCNGNDLKLSKTTPAVVRRYNENGRRNAGRGITWEESVGDAAGAVDGQDAHALADAEDLALVDLLDIGAGAAVVFAHGDLDALGARQAFFGSRAQQAASDRADDGRDVAALAAAHRAAGDTADAGTGDGTDRGLGAFDLDRAQGLDGAHAYSLHGTGFLTAVGIAGEAGLAAAKSQGHGGEGSNDQGRLAHNGISERDN

SEQ ID NO: 19407 - protein, 214 aa, Pseudomonas aeruginosa
LSVTATGRGQGQQGEAARPAGLAGARRRRLPFPRSLSQAPEPGDLLGARLQFRRRSGTGLLQADRSRRQAERRIDAGVVQALVAVAQAAGQGYHGNAGLARDPRHAHRGLAVQALRIQAALAGQHQVGTDQRIGQPGQLRHQFDAWAETRAEECPRGETQAAGGADARHPAEVLAKGRHDHLGEVRQGGIQLRHLFGAGALLRTEHRRSAARPA

SEQ ID NO: 19408 - protein, 237 aa, Pseudomonas aeruginosa
RVVDVCGDFHRDIHQARIQPAQVETVQASQRGAAGRQFLAVGSQETHAERAQQAGAGIVGSAAAEAEDNLPRPGVQRRTDQLASATAAAARGVAAVARDQVQAAGGSHFDHCGGVVQPAPVRQGRLTERAFDPAFATFAGGGGEYRIDRAFAAVRQWPQQHLGLREDSPPAAGDSLGDVGRGQAFLERIRSNHDFHQSPRRAGSPRPRFNQSSTRLSSHTASIPAIPWTRVARVWAR

SEQ ID NO: 19409 - protein, 165 aa, Pseudomonas aeruginosa
TAGWRGGVRPGSRPADRATGCAHSPAGRARRRPRRAARPGHAPGRRHTGAPRPSRARRRAPASARAYLRGLPAGTRTPGARPAPRSSAPPGRRVPPAGEPGKAADRHARAAPGRPPGAASAWPAPGVRHRPPAPRGRGRDRATGAARLRDAGVASVARPASGAVP

SEQ ID NO: 19410 - protein, 556 aa, Pseudomonas aeruginosa
VLEPVGADDIRTLQRRLQERSVGVAARPLIGRLADTTPERTAIPRAEVELADQHRLVQPRQQGVVQALPGQRRIEVETEEVAIPGAGGDRLGSADGEAAAEQEVVRCVPLQGVAQGLEVSVGIQPEEGAVVLGDGRMPLARQRSRVARRLQGLPGGQLDAPGLGQCLMAQVLGFQLLDEGALRRTVHGQRQGSESEAVARQGRAVAPGPGQFVVGVVAEQPGIVAVVASSDGDDALGGHGEARVEGIGHGSPPVETAADRGVVAGDRQRQAVGHPRLCGERRIAPVAEAVETPCREALQGALAPFAGELVGTRLGSDALAIGTEEIEPAAMPEAPPGLRGDAAAVVALTEECGQRLTLRRQFGEHRLASFDVGPAAVGGHRINAQRPERMSFRSNQPPAPATFFRAEETAGFEHRPTQQAAETVARRCLPFPVAELCGLGRIGAAQLFVGTNLFRPVGAAVLAIAIDQAGQDAPLHRPPCAYAETSEQDALGSLRRAQGQAQRSDPGAVQRALHAWRQQHPLAFDHLWHRRPRTHAQSLWRNRPQRHQQGLRRACR

SEQ ID NO: 19411 - protein, 940 aa, Pseudomonas aeruginosa
LHPGLGKCREFLMRLGREGWRPPAQASASGDFPAERRQCIEDSLAVALGDHAAIQQGDGAAVLLGAQQPPAGLDQPQRSVWHGDLHERIAAARLDPLGQRRLHRVVGYREGNLGDHHVFAIGPRQVHAFGETGEAEEHAVLAVVDSRLVLVQGFLLGQVALDEHPLAPVAVETVEDFLHLLARGEQHQAAARALHQFRQLANDRRGVLGGVARIRLEVGDPQYPGLGMVEGARHHRGDRVARQARAHAVAVEGAQRGQGRRGHQHAIGDVPQVAAQGLGGEDRAGVGFDVVEAAALGEGQPARHRRAVLRVLAGEGGPQFPVALGARQKTTEQRVPLLRLVAGDAAGAFAVHRLLEDIGEAGEQVGQLGEAFLQLDAHLADMLGDHPADETVTRPLATFHVLAGAEIADLFAGGEHELLLGLDLPGQLRHLFDQAAEVARQRVLGEQLGEVLGDLLQPVGGSAQAGEMGEMANRLVRQVMALVEHVEGLARIGQDGAAAQGQVSQDQVVVGDDHVDLGHPFARLVEGALLEVRAMSVGALAVIGGELRPMRVVDRLRPAVAVAVPAVAGQAFDHLVEQLAAGLVDIDVETVVGEQLRRRALRLAFLQQHVELGQAQVAPAALGQGEAEGQPAVAQQVGKILVDDLLLQGDGRGGYHQALATGLGAGDRRQAVGHGLAGTGSGLHRDHRRLALAVPLLVLLDRAEGLGHFGDHQALAIARLQLLGFEKAGVGTLDLGLEFGAEHGIPGPGAQRKTNPPARHSWINFQWFDRAAMITRFVTTASGDRRMTPYALVYALHVLAALVWVGGMFFAWTILRPAAVAALEAPARLGLWLEVFRRFFHWVWAAVILLPISGVGMLHLSFNGFAGAPRYVQVMMGLYVAMLALFLRVQALQVPELRRAVQAQDWPAGGQALGKIRRTVGFNLLLGLLLIALVAARPSL

SEQ ID NO: 19412 - protein, 354 aa, Pseudomonas aeruginosa
GVKTPAEKSASTRPCRRFRLVLANPRRVFSHERTDFSPHPAAGPGRVARPLRAEALAAGRRQPAAGGGGLHPQPSPVPTGAQPGGGIARRTGRPALRPGAVRRLPGTPAAAHRSAVARGRAQPERQPGRRTGRPRGQRLAGNRLLRPRHAEQRTLPARRPDADPVHLRPVRIQAGPRLAERQVLGQPGKLRQVLVVTMTQPSCPCGSGDPLDDCCGRYHQGHPAPTAEALMRSRYSAYALGLVDYLRDTTLPAQQAGLDLDGIRAWSHGSTWLGLEVENHEVLGGQPEHARVTFVARWHDAEGEHAHRECSGFVQRNGRWYFLDPTVALKLGRNDPCPCGAGGKLKKCCGPWIT

SEQ ID NO: 19413 - protein, 217 aa, Pseudomonas aeruginosa
NAQPFHPGPIPMLLTVLYIIAITAEAMTGALSAGRRSMDLFGVVLIACVTALGGGSVRDMLLGHYPLTWVRHPEYLALTAVAALVTVFIAPLMRHLRSLFLVLDAVGLVAFTLIGCQVSLEMGHSLLIAAISGVITGVFGGILRDILCNDVPLIFRRELYASVSFASAWCYLICVELELPSEQAMLITLFSGFLFRLLAIRFHWEMPKFVYQDDFDH

SEQ ID NO: 19414 - protein, 227 aa, Pseudomonas aeruginosa
SLPFVAHRRAGDAPMIDLYYWTTPNGHKITLFLEETGLPYAIHPINISQGDQFQADFLKVSPNNKIPAIVDRQPADGGAPLSLFESGAILLYLAEKTGRFLAKDLRARQETLQWLFWQMGGLGPMAGQNHHFNRFAPEKIPYAIDRYVKETARLYGVLDQRLADRAFVAGDDYSIADMAIYPWIVPHQWQEQDLADFPHLQRWFESIRQRPATQRAYALVERINPPK

SEQ ID NO: 19415 - protein, 136 aa, Pseudomonas aeruginosa
DRRTALPGKPSSRPPTSPTRRKPTTCSGATTVRSGTIPALRRRRTSRQSSRAASPPPWSSANSDWGASARPGNGASCTPTNGRATARKWPPTWAPASAPDSARSRAISIADPIRPAATTPRWTYRPTAGARTSTLG

SEQ ID NO: 19416 - protein, 272 aa, Pseudomonas aeruginosa
AAADAPVPCSGRNARALPAGSFPPPASRTPGCAPSVDRASAPGAAGWSRRNAVRVRRRSFPPVRRTVPATRRGPTAGRSGAAGGFPAAREVPQPAQPVRKPGDALPLPGPGARWPNVPPPGTPVAAPPPSTRLPDAARRPRRRAWHGARRVAGKPPYWSPTAHSARPGPVARSPVARRATPSRAPPGWPFSVAAMPGRPGESRQPAGQATGSVDRRAWGTPAENDATPAWQARVQRILGSWEKTVERIAPRRTSTPLPSCAYPMRRTFQILP

SEQ ID NO: 19417 - protein, 456 aa, Pseudomonas aeruginosa
  UNSURE (62): Identity of amino acid at the above locations are unknown.
VPSTSSATPTGWRAASIAPAPSMPSSCSTAHAAWSPTGRAWLTPRCASPSARSNCSGLSAAXGKPLPAPPIRKTDNEPGNQGTHRTHHWRNHASSHAPAPNLAAGRPRRRHRARRPAGLVVEQRTLPGGHRRCLCTRRLGGGQRAGLRLRRRGSGGRRRRRPGRRPAAAPGPARLPPAPARRRGPRSGGAGGAGSPAREAGDPRSATAGAGADDQPRPRRWRSGASRMAPRRDRLATLPAIGRRACHQSPAPGERRRGAPASAGGGAAGKRRGRPPARRQGRTEEPATRGGGGARPAPGGAAGSRGGARTGAPRPGRYRNPRPIRRPRRPAQGAPAPVRHAGAAAAGGGAAGAGLRGGQLQGDPARTHPSRATGRAGGGHVRPPLARPRRQRGAGLRRGIRAAAAGQRHRQLHQDRPALPGAYPPGRRRRRAGPAASGDVGDRHRGHSRTGRSLRR

SEQ ID NO: 19418 - protein, 244 aa, Pseudomonas aeruginosa
AKTGPGGRQVDQHRAGLGGQWGRCLFTSRAMLTTSPGEARRRSPRRGERATLAAPAWRDYLAYPPRHPSPSTGAKPAWPLTRNCSISEKTSPPSSAMAWAPEQGAVAWFRQKLESNGLPSALTERLQRIERRYRLLVAGEMWCPDCQINLAALDFAQRLQPNIELAIISKGRAEDDLRQRLALERIPIPLVLVLDEEFNLLGRFVERPQAVLDGGPQALAAYKAGDYLEHAIGDVLAIIEGAAR

SEQ ID NO: 19419 - protein, 145 aa, Pseudomonas aeruginosa
ARSNQARSVRIAARRHSPAAARRAPARRACRAASGGSRWRTAMARSARSIHRASAAAGSSPARARHRRRDSRPSCRDTKPRRRASALRGCSMPCSAPNWAMRCCWRACQACASKPARRRSKARVSRRRWSSSDAECRSRSFGSRR

SEQ ID NO: 19420 - protein, 147 aa, Pseudomonas aeruginosa
CRWKAAGRTSARARPSSRANPRRAACRSSSCSSRRSMKSPSRQASAWSVGSPRRIAARRPRKLASRRAAPAKSSSPRSSWPPSRHRSSAIGSASPRSAKRRAQCVSPAKRNSISVENSAARPPRIAGSAALSARDSARPTPSRSSTA

SEQ ID NO: 19421 - protein, 139 aa, Pseudomonas aeruginosa
RCWSGPPPRNRRAARATASHSRPPASATRCAAGPAAPGRAPPRRPRRGRGRYAGRVRRWRPPRAKPRRPTACVGAIARHVGAGFPAPAPAPPRAGARPGDSCADRCGTADRRGPPAGYLRRTPPRRCRRLPAQCGSPAR

SEQ ID NO: 19422 - protein, 300 aa, Pseudomonas aeruginosa
PSASGASNCRSSSPCSNCPPAFRCNAPPRSSATSRSARSSACSARRSAAPRPATCATACGGQPTERRSTERSCSSSAVLPPRLALEDTSGNNAALFSPGGSDGYALLERIRPGSLRARRQQRERLERRRPGQLQDLPAHQRLRPGPGKRRSGQCPCHPHRRCASDRQGRAAAESRGQARRRAAPGPRCRPQGLAGASQRIVREEPHAALAAPRASLSLSGSGTSRRMSARGHIRPAQPNRASPHQARPCASARARPSRAPASISGRWRGSSASSASSDNRCAAVSKAIRRRSRRRPLKRS

SEQ ID NO: 19423 - protein, 227 aa, Pseudomonas aeruginosa
VLPRLSTCPPSRNSRRNSPMHALIVVAHHHPRSLTHALAARIAEGVVRAGHSAETADLAAEGFEPRFGLADHAVHRGQASPPADVLAEQARIDRADTLVLVYPIYWWSMPALLKGWIDRVFSNGWAFDYSIGGDLRKKLQRLRVVLVGVGGADAGTFERHGYAGAMRTQIDHGIFDYCGARVVRSELLLESESADPIRHLDQALHIGSQLFAARGAQGAAQAQPLEA

SEQ ID NO: 19424 - protein, 306 aa, Pseudomonas aeruginosa
SPATGPEPAGDPRRAAHRTQCDARGGTPEFFPTLGERAPGQAAGDLRRSLAASRPARDAPDGAGGGAARAVTPGPGSPGAGGGAGRAVRSDAVTAYLARRRHRLRRVGDPPADPRQSSPPGAGQPPGGAGAGADANRQAGGTRRDRPGLPHPRRIAAGTALSPAVQRALCAGRARRASGAASATDAEAVLPPRAGDRLARRRRLPRSHRPGARRTRRGTPGGVVGAALPVPPRGAGKHRPGGAAAVATGTRARQVAGGRGAPGGARLRPGHALARALAPRSGPSLAARTHRRLGVTRRYASVVAAV

SEQ ID NO: 19425 - protein, 396 aa, Pseudomonas aeruginosa
RASIHHQEVLGVKFPFHPWRRLLLCALPFAALLTACDDGKKEPPPKPAEVTTYNSVPWDALPATSDADLLAGFNAWRSACARLAKDPVWGEPCASATTVAADPTAVRAFLQERMQVYSLRSSSNGDQGLITGYYEPVYHGSLSQGEKTPVPVYGVPDDLVVVALESVYPELKGKRLRGRLEGRVLKPYDDAATIRDNGSSAPVLAWLGDPMDLQFLQIQGSGRIQLEDGRQLRIGYGDQNGHPYKPVGRWLVEQGLVPKEEISMKRIRDWAEANPQRVSELLASNPSFVFFSLRPDSDESPRGSLNVPLTDGYSVAIDRKVIPLGSLMWLSTTRPDDGSAVVRPVAAQDTGGAIVGEVRADLFWGTGDAAGELAGHMKQPGRLWLLWPKGAPLPAS

SEQ ID NO: 19426 - protein, 373 aa, Pseudomonas aeruginosa
SASAEPTAPWLTGLAVQHPGGTSTRDCLGGFRQLLTGGDILSVPHVRRALLRHPRLHLVNGYGPTENTTFTCCHVVTDDDLEEDDIPIGKAIAGTAVLLLDEQGQEIAEPDRAGEIVAFGAGLAQGYRNDAARTRASFVELPYRGRLLRAYRTGDRARYDEQGRLRFIGRGDGQVKLNGYRLDLPALEQRFRRQPGILDCALLVRERNGVKQLLCAWTGKADTSPQALLRQLPTWQRPHACVRVEALPLTAHGKLDRAALLRRLEEPLERCASALDPDQRGCAQLWSELLGCEVGAADQDFFLCGGNSLLALQLVALCQSAGTGANLGLADLQANSRLDQFSRLLRSHGLAPERLLERAATPEQPLVLSRSAA

SEQ ID NO: 19427 - protein, 179 aa, Pseudomonas aeruginosa
RAWDGACAKSSRCSTARWTAARKVSNWSSTGSPRRARRWKSAPSPTKTRSSQRCCNARIPCSSAACCDCSTGAAEDVRAGASGCITWSPTPTSPACCWPAWPCSTPTPRPKRRPPSSASSSSNGAWSASCASAGPGWKTTGASAARRSVNWRTCPGRSAPAIARISAWLPRQEAAKPPC

SEQ ID NO: 19428 - protein, 489 aa, Pseudomonas aeruginosa
LHRPPELLPRAAGTPRRNGLPAGRLPPAGCLRQHRSPRQPGTRRPGGRTGLADRLFLRRPGRLRDGPPVAGQPPADDRQPPALAGPAANAAERAIPALAERRDARMDRPDERAWRTARRGPAAQCRAVRPLAAPPSPRPRQLGALPGRRRPRPGRRTLVRPDRAARHLPLRASAPPGPAGPGGDRFHRPHRQQGVRPMKHYRQVVSPQLRQQALDWILAAAQRPDPALEPEFDIADDERREAKKVRNLHRHDPLFWDDWFARSGLDALVRDHLRKPRLLRHAAFIKRHADESYIPLHQDIALWEKRYESAQTFWVALTPSRNDNGGMFYYPDDRTIFPHEFDLAYPMFKCIDLQANGISREQLVDAELDAGDVLVWPARTAHGSHNNRSGELRIGMPIVFVEDDEFHQLNREDSMKTWIASNLKSVFPDEAITEDNLDHYLPQLCDYSLKMVTFLARFSRQFGHAPKIHDFIREPRLATLSASDAGARR

SEQ ID NO: 19429 - protein, 416 aa, Pseudomonas aeruginosa
SSAATRGFPRTNASGYAPWWRRFPRRCWPTPGRAGRISTRCWKPVRKWVGLFASINAISLETKFKGMSREEVLELFHDAIRYARERGLRVRATVEDAARTSVSDLVSMIATARDAGADRICFADSVGILLPDETFDVLSLLRHEFPDVVFEYHVHNDRGLALGNTLAAIQAGVQWHSASCNGIGERAGITDTFQLLTLLHTKFAADRFNLKNVLAVSELVEAHSRIKRSPMHPVVGENAFVHVARLHQLAMQENQDAYSAFDPELINGRVSLQRYTPMHRQSLFLTPFEKSASELKYHRHGPGKRFVMLDRRLLDGSPFYFIARQFHDVGDGGPGHVDSHVHNCDSVFLFLGSDEDYRGLEVEVLLGGQLRRLQSPASVFIPAGVEHSYRYLGGSGTYINFVHKGDYHESLLEITQ

SEQ ID NO: 19430 - protein, 178 aa, Pseudomonas aeruginosa
SCSPRAPPASRKASNSASRPCSMPTASAATAWASASTRAPVASTGSAAWASSASISSSRCCTAAARCSCRCTAGPTAKASGNAWNASASVSSTWCRRWSTTWSRKAPRRRAACRCSACSASPARRAWTPTCRRPSSATTRRWRTSTASASAALPSSSASVAAMRSTTRWDLPSAWNSS

SEQ ID NO: 19431 - protein, 871 aa, Pseudomonas aeruginosa
TAPASTTAVRSPPCCNGKPRDVRHPRLRRHRFQCLALRRSATPAGPSRPVRRGHRGLAERRHRHDPPADVRRRGGTAAAAGGPAAGRLQRRGLPGRLRNPWRDPPAARRLAARGTAGRHVRPRQLGPADPAIDPAARRVRHQAAVLQLPARARPAGLRLRAAGAAAPARRRPRRRRGDRPGGRRRRAAGRPDPVPAGPSAAARRGVALRSLPGASAPLPAPAAGHRPGQRGGQPRRAARRNPRTLPPDLPPLRPAGQRRGRFQPARQLPGPAVATLSPVPGRRRGKPAATPSAATLRAAPGSLHAAAASRGRQLRRGDTDVQPADVPAPGRRYRRAGLSLRASRRRRRRTVLGLPAPSRTLAPARRTGTAALRRRLVRRVPAQGRAAGGTGGPTGRRADRGTRPRGPRPGPRGGDRPVRSALLAGAAAAPRRPSADVAHHRSAHPLPAWRPGAARRAPPADRRRHRQGTAGGAPGAARETLAGAAETAFPPAVRTLAAGPRGNAPAPRRTPAGAPRPRPGRPGCTERRGAARRPVVHPHHPVALAAGIRSLAMTTIHRRPAPWRGNAVFCASAAFAAGLETLFARLLERRPADSAEALLRQRLHHELEHGSGVLLHDSALLRGLAEDEFQRVFRAFCQWLGRTVAINRNGEYLKEVRDLGLRDARDAPQRGHLTSQELAFHSDRADLTVLACWSPARRGGAFRIRSSADVLATLEAANPAWLPLLGQPIPHDLRDEGDADYALVPLLTETPRTFVLRYIRKFNESVTRHGLSLAPQVRSMLDGLDEAIERADGYAELDFSKGMLVLVNNHTTLHARTEFSDDERQRRCLLRCWLSSEFTRELPESFLPLFHQVAAGSLRGGIRPLAQEPRP

SEQ ID NO: 19432 - protein, 227 aa, Pseudomonas aeruginosa
SCCCRSARSACARPSGPADDRRAAGLGIFPAPLRLVRGRRRLAKLRPSARRARMRPGALAGPGRRHAGRRGAGDTLRPQLRRLPGAMPGGPPGRARRAPVPVQRAGQRGRRRAGKLPGQRPGQSPRAMPPRPARRAGPPGRPRRLPRTARRRGADQRQRTRAIADRPAAAGSSSLPGHLRGGGRRPAQPAAAATYLRPPPGRASAGIPGRAPRRTGGPALPSRPDRI

SEQ ID NO: 19433 - protein, 278 aa, Pseudomonas aeruginosa
RDRRRQRLPAAPAPRHGDHYLCPRRRDHPPGQPGQQGPHRGRRRAGDERRYRHRPFGVQPGSRDHPDLPDLDHPGPPRRPAALGLQTVPEGRARRSFRHSRQRRRAGQRSAAHPRRRRGRRGDPEGRPERRVRPGKRSPRLPGTGHRQHRGQRRARRGPRWPGGTRRTDPEGHRPGRQRSAAGGSGLTRQPLAPTGEGLLSLRPSLSRRSGVIRRNASGPADWVLPSFTLRAHTTRRRIREALPCVNCNPCWRTTGCSCCSSTCSASRPGCRSPPTRR

SEQ ID NO: 19434 - protein, 580 aa, Pseudomonas aeruginosa
RTSPATSGTPASSSIAPVPTNFPPRCSPSASTPPASPAPGRWPAAWTPGARPTGRSWRTPERRPPGSAQGLHRRAAGLPLRRRRGEHQVAVLDLAVAQQRQVEDVVLVKLPGHPVALLGYALGGALDVAGVEVEEGLLAHVAGAVAGGHLAHAGGIHVIDQAAEVFAGEVRFERPTGVGIADHRRQVWQVAQHDAAIAHALVDLERLAVDRQLGAAEHHQVEAGGGDDDVRLQHLAGLQANAPLDEAVDVLGDHRRLALAQHLEQVAVRHRADPLVPRLVARAEVTHVEAFAQLQAGQLEQGLADQAGEGPGEHEEDHLHGHVARPRLAVDPGFRKEAAEEIGDRVLLRQGDHVGWRALQHGDVGGLVGQRRHQGHGGRAATDHHHLLAAVVEVLGPQLRMDDLPGEVLATDEFRGIAGLVAVVAGAHQQELRGHAQRLGLVAALHVEVPARIGGIPVGPEHPVAVADLPVDAVLPCGLLDVAADRRTVGDGLGIAPWLEVVAEGEHVRVGTDAGVAEQVPGTAHRRAPFEQGEALAGAMLHQVVGGADAGQSGADDEYVQVFDRHKVPRSAEASSRLLG

SEQ ID NO: 19435 - protein, 929 aa, Pseudomonas aeruginosa
SGASSPWISISRSGRRAGLAMEAVDVLGQHPTFRLVLLQLGDGFVAGVGSGRQASLAKFREVLPAQRRIAPQHRSGKCRLDRQALFRATVVETAEAAIGGHTGVRGEAGAGDDQDAFGAPQGLGDGSDRAVAVHGWLLSGWRIEGSRQAEPAHAPEQGRARNPQPGGGPGEIAARLAQGVFYQVALLLRQRLAQASDRRAVHRERGLAAHGLGAVVGERHLIQQCAALPVQQQAAPDHVFQLPDVARPVAGQQLRQRPLAKSGDTRVEAARIATDERPCQQFHIAGALAQRRDAQAAHVQTVVQVLAQASLGDRLARRLVARRDQAHIGPLRAQAAQRQVAAVLQDPQQLALHGHRHGIDLVEEQAAALRQGEHALAVLGAGESAACGAEQGTFQQRLGNRCAVQADHRTAASRAQGMGATGEQFLAGAGLAMDQQRQVGGGENVQALQLPQQARRHAQDVRAIRQACGLFGLGDDFAELHRAEQATVAPAQRDRPVAILQQLAAGPHVGLQRIDRRPPFGQATQQRALLGRQPGSALQQVHTQRPLRVETIEQAAGTVVVDEATGGVDHRDRLPQAVENRRQAVHQPGQFTASRGNRRLLDKRHALPLGFPDVEISSVVPSSTQRDRASLAWINQALGKPGKSSDLSRISKAIPGRWLARGLQRPRRPHTRKIVMFKHIIARTPARSLVDGLTSSHLGKPDYAKALEQHNAYIRALQTCDVDITLLPPDERFPDSVFVEDPVLCTSRCAIITRPGAESRRGETEIIEETVQRFYPGKVERIEAPGTVEAGDIMMVGDHFYIGESARTNAEGARQMIAILEKHGLSGSVVRLEKVLHLKTGLAYLEHNNLLAAGEFVSKPEFQDFNIIEIPEEESYAANCIWVNERVIMPAGYPRTREKIARLGYRVIEVDTSEYRKIDGGVSCMSLRF

SEQ ID NO: 19436 - protein, 261 aa, Pseudomonas aeruginosa
PKGCPWCSGIRVFEEKSWLFYAQSDADPSPSRRPMLVLSHDSRPRPPPRPRRADPLPAARASRGTFRIPVDPAAEGPPFDAYPPSRTGRQAGAVPHPFPPVQRALPPARPPLGRARGAPGDQPAEPAPASLRGWHAGAGTGRSAARLLPRPASPGGDQRGRRRAAAAEFLDAHAGQRGEGRRPRPVRAGRRGRLSRHQAALPATGQPAPSRPRRQHRAPAIDQQGDGNTATLLQPAVKLRFALNPRATRARAVPILRHKVA

SEQ ID NO: 19437 - protein, 205 aa, Pseudomonas aeruginosa
ERGGNGMIHHVWGLFTHPDQEWQEIRGEEESISHMYLTHILILAAIPAISAYIGTTQVGWVVGGGDPVKLTQASALQMTVLTYLAMLAGVAVMGAFIHWMARTYDANPSLTQCIVFAAYNATPLFIAGLAALYPHLWLGMIVGVAAISYTVYLLYVGIPTFMNIHKDEGFLFSSSVLAVGLVVLVAMIALSVILWGSGVGPEYTS

SEQ ID NO: 19438 - protein, 461 aa, Pseudomonas aeruginosa
  UNSURE (343): Identity of amino acid at the above locations are unknown.
SCAASTACRRTAATPTRSSAAPPPATCTAAIARSTTTSRSPRNATPWWPRGAATTAGAARRPWCSPAKCSASDSGDGPGRLQLGDPFGGVAQAFEHRHGVGTERRADVARRRQTGGKLDRTGHLRLAAAVRQRHPGDQPARLQLRVFQRLGERQQRLHAGIQGGEHRLPFGEVAFLELHLDLALQRPLLFRLRRQAAGGQFRAADGGAELLHELRFQAAHREPAAIAGAVVVVEAAAVQRQRLHLRLDPGREIAGAGHAVQAEGAVGHADVDELPLAGLLPVDDRRQQAHHAMQRTAGEVRQLYPQRQRATFAAPGVAGDAGQRQVVDVMPGALAVRPGLAVXGDGHVDQPRVRRLQRLVADAELVHHPRTELFEDDVVFAYQLQHHLACALPLQVEADGTLVAVQVGMTGRGAVDVRRQHPHQVHAPGRLHAQHVRPHVGQQQRGERPRQQGREIQHFQR

SEQ ID NO: 19439 - protein, 374 aa, Pseudomonas aeruginosa
AWRITARRAGCAARAWRESATTLVVFRVAPYHRRSNNKDAAMRERTIASHFVRAALRGATRQGLDGPALLRRAGIQPALLDEPRARIAPEQFTRLMQLLWEVLDDEYMGFGEVRSKRGTFAMMCHTLIHCRTLEKALQRGELFYGLFPQAPLIHLRRDGDLVRLSLEERHLSDPDHFLAESLLVIWHRLASWLIGQRIRLEEATFSYPAPDHQAEYDLLFPCPRRFSAGCTSLLFAARYLGMPLLQDERTLKQFLQHSPADLLARPDGGDSLTSQIRRLLGRDCRRWPDLDQVARQLHMSSQTLRRHLREEGGSFQQLKDHLRRDLAIYHLGRDELSIQDIAEQLGFSEPSAFHRAFKKWTGLTPGAYRHQAEA

SEQ ID NO: 19440 - protein, 951 aa, Pseudomonas aeruginosa
SSAQLLATKPAAQLVEHRGERLRPPDRVALGEIHPEARQVIEDFPALDELGHSHRAQAVGDLVDGVDDGLVHRALVQVADEAAVDLDHVDDEILQVIEGTQAGAEVVQRHLAAEVAQLGDDPRSHRQLVHQRRLGQLEVQALRPQRRVFDAIQQVRQEQRVVERVAGQVDADAQALHRGDPRAEVDQRLVDHPAVDAGHQVEALGGRDEGARRSHLAIRIVQSQQQLVVPVAVAAGADRDDLLRLQLEAVVLQGLAQPAGEEYVAVLALHFLMAELVHRNPVAPGMLGRVAGHVGLAHQFAGAARGGGKGGDTDARAHVVEPPFPGEAHRADLLDELARHLLRLRQVAIEQQQAELIAAQPRQGVGGAGAVGENPAQLAQQHVARRVPGGIVDHLEAVEVDEAQRMLGRPLLGVGQGALQLLLELGAVEQPGEGIVGGVIAQLALHRPGLGDVLEHQHGADDLAIAGAHRRRAILDIVLLALAADQRGAVLQVEHPGVLQAASHRAFQGLAGVAVEHVEDQFVGRADGVLQGPAGHRLGHRVHEGHAAAGVGGQHGIAYGIQGHLQAFLFLVQGFRQGADLGDVAVDADHPHRTVVLVARQRGDRPQVANLAVGADDTELAVEFLQPADGALQLAQHAVVILGMQARLPLLHGGLPGTAADAVQVEHAEIPVQAVARQVPLPDADLPGVGGQLDPFGEALALQLGTLATVDILHLGDEVLGDSLLVAHQRHADARPEGFAVLAQVALLHLVGVDTPGEQVAHQVEVQFQVVHIGDLLERLLAQAFGGIAEHPAQRLVDLEQPPLQRHQGHADRREFHGAAELRLADGHLMLLAAAALHDHRDQEGGNEGQGHRQVQQRLAETLLGRLGEEHAEGDQHGDETGVQATDQRGAEHAGAGGGHQQRQEHVDEGVGQARQGHEADHQGHQQEHRVVHSRPPRQSVTPGRQVAGHA

SEQ ID NO: 19441 - protein, 233 aa, Pseudomonas aeruginosa
AFYSRLHRGWANERTTRPGTRQGHGSQALPVSRDLPVPAAVRRTGRRLRFLRLDVPATGRPARAAGLRSGMSSRRELFRRLGGHPPTRRPPWTAADFAAGCTGCAACVEACPEGVLKLGAGRLVELDLSSAGCTLCGECASRCEAGLFDGARPAFPWIATIGEACLALAGIHCRSCQDACEPAAIRFRPAPGGVALAELDSQRCNGCGACLAPCPSQAIQLRALSTKESPRHA

SEQ ID NO: 19442 - protein, 198 aa, Pseudomonas aeruginosa
STRSPWTPPTRFPSRPTTRSAPFASNCSTWPEERAMKPLLTALLLVLLGAPAAFAADLGYPLDAPAPDGRRPGGTLAESRPAPPLAAEENKDLKRERNYPEQPPTIPHSIVGYRIDKDSNKCLSCHSRANSARTQAVMISITHYMDRDGQPLAAVSPRRYFCVQCHVPQQDVKPLVDNRFENIDQILEKEAANAARKP

SEQ ID NO: 19443 - protein, 368 aa, Pseudomonas aeruginosa
MSGARFAWPNGPRLSGARPAPRVFPASRAQASILIGDPFTERCHAPVLRPAAHRLRRQRPGRYPDPRDALPERRRHAHGRLFRLRRQQAGDPPWGHRGPRMVGAQRLCQTPRPRPRRTRLQRPGHRHVRRRQAHRAPAGRDGLHAGRDPGCRRRQGALPRRPGTAEAATADRSQPDRRDRLLLRRQDRPRHGPPGPAAGRRGELPRRPRHRHPGQQGQRQGQDPGGARQRRQPGPGQGPRRPETGTERRRRRLPGGDPGRRQTRLHQPRRRRAQRPRPGHRLRPPGRPALLGRPAGVPQGHLRAGLNPAPTHKKTGVPGGTPVLKGRDRTVSRHQQTTSPAFHRNARRSLSKPGLAVRFPLLRFCNLV

SEQ ID NO: 19444 - protein, 255 aa, Pseudomonas aeruginosa
APRDWWATSGTGTMRAMNDRLPSFCTPLDDRWPLPVALPGVQLRSTRFDPALLQPGDFALAGIQPPANILRAVAKRQAEFLAGRLCARAALFALDGRAQTPAVGEDRAPVWPAAISGSITHGDRWAAALVAARGDWRGLGLDVETLLEAERARYLHGEILTEGERLRFADDLERRTGLLVTLAFSLKESLFKALYPLVGKRFYFEHAELLEWRADGQARLRLLTDLSPEWRHGSELDAQFAVLDERLLSLVAVGA

SEQ ID NO: 19445 - protein, 286 aa, Pseudomonas aeruginosa
SGVPRRAPRRPQRAAVRQALDGAGGGDHAEGGGDHHHRAEAAGAVQLHPFADETLRLAHRAVRLRVAQLFAGEHAGHAVGAPRRAREVVVAAQGGTHLGRQRVVEGLVQVGDLDLRRVDLATGAAGGDHRDLAPLAPGDQRGLGGHAIDAVDQVVEVDDVLGHGLAGDEIGHRVDPAGRVDGPDARRHHLDLGLAHRAFDGMHLAVGVGHADIVEVEQGNLADAAAGQRFRRPGTDPADADHRDVAIGQALQPLATVQPADTAEALFIHLHHQPPLKPNRGLPRAL

SEQ ID NO: 19446 - protein, 937 aa, Pseudomonas aeruginosa
KAAAAASPAFLRLVAQAGLDLQQTRRPGACTPRGVRGSMRRPVFSETSGTWFHLYVFTQDRAQPGGHRRPGRPLHRHLGPVQPSGQRTGLAGTHLRPLLLAVPPQPEPAERPLPQRRTDAHRPGTGRPAHPQHPHLFGPGRARRHPGAGRGVRPARQPGHLARPGPGQQRGRDRPRHPHRQRVAERGASDSRQRGAVPPRGDGGTVDRLPRPGPRGGQGSGDHRRTVARLPRIPGTGATRRPDRRPRPALLGGYAGGRRGGLRARTRARTQGRLPEEAAAARRGRLAEQRAHARQRRGDTRGPGHLPAAPDQRAQRRRLQLLRHRSLRPALEGQRRRLGGRLLGRLQRRPQGQVQLHRAGGADSQVARPGHRLGGTRGTRLHPAADRQFLDAPAREDLPRRGLVRLRLGAGVDRLRVQPAVQHLVQPDRRRVAGRRRAGGGHRAVHRGPRAGRGGLDAQAAPAIPADHRRAGLSAQGVDPRALLQRAAGTAEADPRRPCPPRLPGLRSPGDRQQHPRPGRLAAGRGALRAPGRALPLLPRRPAGRLQGRRAELRPGPRGGGRRGGRGDRRRLLRRPRLAQAHGAALRRPADRRGAVAAGLPRPARERLQAALLRRVQGLLPHRHGHPQRPRRDHRARHHDHDPAQRAGRAEMAGMVHHRGRRAGPAGVREGPVGRLLRAQLRQGGDARYLHRLQEAALPLGLRRDPDHEAAYRRPAARPQSRRQPPDPRPALPLRGRLAAVDRRRPEHLLHPRRAALVGGDDHRAQARRPAAADLRDPAAGPVRLQGRQDPLPLPAHRRRRPARLVLRRPRRPVALAHHCQGGAVRLRHPRHPVLPHAEDALQPRPAGGPGGGPRGSLRDAPAVGRGGRHRGGSGRAEPRPADLGRHAPGAIAALPGGAGHGPALVAAETARGTGRRRRADRRLRSSEASGQPAPLA

SEQ ID NO: 19447 - protein, 192 aa, Pseudomonas aeruginosa
GCSPDADLPALLRRPGRCRQRRRLPRRAPLRPRPPGLPEPAAGAAQEKPRSGRQRRHGRGPSPVPRRRPLRAAGPAPGRTGRRTRAATLAGYRLRRGLLQRPARRSPGRRRGLRPGYLPRGGETRLPPRAAVVLAGGEHGPAAAGRRQLRADRQRVQPDRLERSRARPRPRRRRTAPGPGQRAPAGTAPAAL

SEQ ID NO: 19448 - protein, 212 aa, Pseudomonas aeruginosa
RRARLRRRQAPRRPARATAPAPHRDPRVPPGAGQLRRAGKPPGHDPARLAGQPRAPRANPGRTLRSQRGGALRLAATRLTVPEDPMRQPDIEIYLKDAEHAAVAAWLEQALGPCGPWQEHGQTLKCTARGEHGAVRVTWLPKAVGKWHSLFLESDSTPWDDDLACAKAAHAALGVEIRCAPGGWEENQGEEDADRWLRVDAGGVEEITWRTA

SEQ ID NO: 19449 - protein, 325 aa, Pseudomonas aeruginosa
PAAGPGACRHRCAGRWISSASPRPLSAAVDSGRPGRPRPGPQEKSASALADEQVALAAHGLDQPRVHRVVADLRADPRDAHVDGAVLAVVLDAAQGVEDLLAGENPPGVRRQQPEQVEFGAGQLDGGPVQPGLAHRVVDHQATERQAFAVRRRGARFRRLAAPQQGTDARQQHTRAHRLAHVVVGAHLQAEYLVHIVGARGEHQDRTVELRAHLAADGQAVLARQHQVEHHQVRAFGEDTRRRQCAVGFDVDLQAVAFQVFPGQLGQASIVLDDQDAPGFLLHTASSYRGPGAAVRPPQSGPHCSQYGGRAAAREEHLANTTYCG

SEQ ID NO: 19450 - protein, 998 aa, Pseudomonas aeruginosa
SSRREAGCPALYRFKGMGAPAPASKTITRTWRYPPMHTDTTRENPQASAPQAADSSQDLAATAPGQLRVIKRNGTVVPYTDDKITVAITKAFLAVEGGTAAASSRIHDTVRRLTEQVTATFKRRMPSGGTIHIEEIQDQVELALMRAGEQKVARDYVIYREARAAERKNAGAASDVAQPHPSIRITRADGSLSPLKKAAVNTIISEPCQRPARGGRRPDRARDLKNSTTASPKKDVNTALVMTARTLVEREPNYSYVTARLLMDTLRAEALGFLGVAESATHHEMAELYAKALPAYIEKGAEFELVDAKLKEFDLEKLGKAIDHERDQQFTYLGLQTLYDRYFIHKDGIRFELPQIFFMRVAMGLAIEEKDREARAIEFYNLLSSFDYMSSTPTLFNAGTLRPQLSSCYLTTVPDDLSGIYGAIHDNAMLSKFAGGLGNDWTPVRALGSYIKGTNGKSQGVVPFLKVVNDTAVAVNQGGKRKGAVCAYLETWHLDIEEFLELRKNTGDDRRRTHDMNTANWIPDLFMKRVFDDGSWTLFSPSDVPDLHDLYGKAFEERYEYYEALASYGKLKLHKVVQAKDLWRKMLSMLFETGHPWLTFKDPCNLRSPQQHVGVVHSSNLCTEITLNTNKDEIAVCNLGSINLVNHIVDGKLDTAKLEKTVKTAVRMLDNVIDINYYSVPQAQNSNFKHRPVGLGIMGFQDALYLQHIPYGSDAAIAFADQSMEAISYYAIQASCDLADERGAYQTFQGSLWSQGILPIDSEKKLIEERGAKYIEVDLSETLDWAPLRERVQKGIRNSNIMAIAPTATIANITGVSQSIEPTYQNLYVKSNLSGEFTVINPYLVRDLKARGLWDPVMVNDLKYYDGSVQQIERIPQDLKDLYATAFEVETRWIVEAASRRQKWIDQAQSLNLYIAGASGKKLDVTYRMAWFRGLKTTYYLRALAATSTEKSTINTGKLNAVSAGGNDGLQAAPAAEPKPAPVPQACSIDNPDCEACQ

SEQ ID NO: 19451 - protein, 588 aa, Pseudomonas aeruginosa
RYNETTDLEPVSKGLNMANKTDNLPDFLQDYASLFSHFQGQMDGLTTVQIGDKFASLAEHLIPHTEAGSDFERATKSKKSWDKGVDLIFQHKEINGVELRVQSKYTISSVDDVDLIISKFQEYDSKDATNKQHELDLLGSLEEDSRQTSKYLIITSSKISNIIAKFLESQRPSRFFLERIKKEKRFHYIDGIEILTTIQSIYRSTYIRPQETKLIFQTPHIRVNNVYIGVLPCNELRRVYEEAGDSIFFENIREWLGFQGKKVKSGGVRETVNEAIASTLEDSPEKMLERNNGIVIRASQVEETSNSSLKLRDASIVNGCQTTMSVFFVNPTDGHVLAKIVETEDSWEIAKAANFQTEIERIELELARYLRPQLARSVGAENNFKFDQKEVTKGKSAFALLDQIYKDEICYDELKSIFIGLFSRSANNAISPNYTELRIDVLQNFERDSEKSKFLEALFVLHSKSSTAMESLKDGLLKPEIMDLFKRFWKEDKPSYRAFVTLLAIFSALDKKNRRFEDYNDIKSGIIKLAGQIEIDPGEYIETYIKAFKTIALDVLKGSEDKDKMLQSMYHHIGSMNFENALLSMSLL

SEQ ID NO: 19452 - protein, 422 aa, Pseudomonas aeruginosa
HSLFASRRVTFASRGKSNQKRLPLHPAPVASRLGFPPSIAVPGARRHGPSWTEAAFAASCRSTPYTTIPLGLLMGRTGASDISLEEVGQITHSVIRKMGQSCQAPGGAGLVKSLVSCGFFDRESLSASLIPLGCFVPLVSILCHRRLRNAKPRSGQTAPDSQAAFLSLRYSLALKISATPGVDEYKTRKGNMSGPLRGVFLTPGTPAPRKLVTSRRGNGNAYHQSHISIHTASSHHLPGGAPCLTPSSTPAVSPTTIGSCTPCCWMRKAGSCSPTWYGCWAVTWAVGRRRRCVTRRRGRWQRRSSASACSPSAMHWNGTWMPISGGSPGSMTNATGHARTAWSASPGSTLCSGSQCLARHGVCAVGSAARCCHACAASPAPTPRPSAPCCTGKPPRSTPCTGKARPGSPSPTAPNSSTVHAR

SEQ ID NO: 19453 - protein, 138 aa, Pseudomonas aeruginosa
TPATSSATCRRSTPSRWATSCWRSWRAMPPSSSGRTRATRCSRRSPSAMPGSAWSWPRPSRAGKSAGANGPAARCCACSTRWTGSTTTSPSSAATSTIPGKARSTGCSPATRRSMTWTSSPRSSVIACTSPKAAAWPR

SEQ ID NO: 19454 - protein, 145 aa, Pseudomonas aeruginosa
PARSPPVNARARRTAATPCWSATIPLARSSSATAATSASAPAARRTGRWSGCSRRTANWRSAAMCSSATTAPSSKRRKASSSAGCARAARTSTRSGAVSISPAIRRWPTATPRTRNPTRAAGSATVPCCGSMCRARACRASTAPA

SEQ ID NO: 19455 - protein, 574 aa, Pseudomonas aeruginosa
SPRYLPRRTPAGGPRLSPGTGARAEPVVVLFRRLRHHLAGGGHLLGDVPRRHEHGPLLGLGGAAVPAAAVRRGAGLRRAVLAVSAGRRLLPVGAAPGGRPPGLVHRLPLPGFGAGLADYRGLPRWLLARPAGDRRAAVGQRPGALRRAAAGAGTGGEPAGDQPAEVLRQCRDRRRGHRLHRYRRAVAAVLPQPSARPAVQRPGRHRRCGRFLPGRRADRAGGGRLGFPRLRRLLADFRGNHRCPRLHSPGDPALDAGGGIHRDAHRLRRDPVLPGHRRGGQRPGGRPGHPGGGGRLRRLGRAAIRRSGADRLRRLRGVGADLHRPGDLRHGARRHPARLRPAAPGRPAQGADGGDGLQHAAGQPRPGPGAERHGGRHADRVRQRRFLRGLPDRRRLRSLGPPRRPLGPGQGRLAPGTRGAGGERPGSRLAVVRGAQRRLAAGQPRPARRALVPGLGGGRGVLRAGRVRPALHAHRQAASAHRHQPQLRRSAGGLTRTRRPFRRLLRLFPHAGFAPGGARLILLSRSIAMSDLHYWNYPTDILCGVGALEQLPRRCALAGARRPLLVTDPGMLAL

SEQ ID NO: 19456 - protein, 336 aa, Pseudomonas aeruginosa
RAGFDHDLCHELSSNPSLAEVHGGARRFEAGGHDALIALGGGSALDAAKGIALLSRDPHGLERFEWTQTLRSYPTLADYPLLGLPPLLALPTTAGTGSELGREAVLTDTQLGIKRVVGHRELLAACVFLDPRLTRGLPPTLSAATGMDALTHHLEALFSPLYHPMSAGIALEGVRLVRQHLENAVRDGNDLAAREGMLVASASAAVAFQKGLGGVHALAHPLGARHHLHHGLLNAVLLPYVLLANRPAIEADAARLARYLELDEASFDGLLAWILELRARIGIPANLAALGLDGEDAQWVGEQALADLSSSATNALPLDARDYARIYRQAVAGTLA

SEQ ID NO: 19457 - protein, 330 aa, Pseudomonas aeruginosa
SAALPPSTSVPAKQPVPPPASSTAAARSGRSSAACCRATSTPSRCSSCSPPPRCSPACCWCRSGTAGQARAASNRRRMPAGRCWRPASRVETSPNHRPAPGVPGQSLANKEPPMPLALFDLDDTLIDGDCATLWGRYMTELGWVEKTAFLHQERRLMELYAEGRLAMEDYMDFSLAPIAGRTPAEIAGAVEDFVARIIAPRIHADALRCLERHRQAGDRLLIISASAHFLVSAIGRRLGVDEVLAIDIEERDGLYTGRTRGTLTYREGKVRRLEAWLAQEGETLAGATFYSDSRNDLPLLSRVDRPHTVNPDPALLGHAREAGWPVLEWR

SEQ ID NO: 19458 - protein, 299 aa, Pseudomonas aeruginosa
PPVRPRPAPRHRHGGRLRQLHHCRRAPALDPVDRQPEGSPLGGNGRTPPAGARQPRRVADRRRRYAARLCPPPAGTERRTGRGAIRRHGGADGTYRRAGRLRRRPYHRATGGLQPALSTGQAGSHQRHEPRPQRQLRPRRTGPGAAQAATRQPRGTGLLAGKDMLGGQRQEPLHRPRPAAHRHLPAARGLPRRDDRRPGSGRPALAHQLHQFQPQRPAIGHRRRHGHRPAAAARGERRPCGAAEERRAAGGGRVRSGAAAPAGGGSDGEGAGARAVAGAGGRYPEPPRIRKMNMLDSNI

SEQ ID NO: 19459 - protein, 525 aa, Pseudomonas aeruginosa
KGTRRHGAGFFVCGRRPALRQLRARRTSGRTEHGRPVDSRVALRIGGVGRAQLAVAGVHQVGAVARAGQPAVDHLVHPVLAGGDVFADQPAAVAGQLGAVAGGAAVAVEVVEEVAVGHRPRMRFGGAAKGGVPGQRLGRCVRFATALAGLPAGGVDPFQELLPFRLPIAHAAAQQWPGEDDAPVAVLAADADVDELRVEHHAAEAFLQRLHRRAGIARPGKADRLHVDHRVGGLRHRLLQVAGGIHRQGQARIGGQRRQFAAGLPAAGLHLATVGVDRLDQLRLVGGTGGRCERQSERQYGQTRDAWDCHGNLLDLMAPMMRDSAARRRIRPEPGAGVAGSGRRFGERLHQPLDHRADPRGVAQVLVGNHPHLVWPASLTLRPDPHQSVALAHVQRQLAEPQATRQGLAHHHVGIHRDDHPAVADRLAAQGQFALAVPIGFVHHQVVAAETLAGHRYAVAPQVVRGSEQAHGPTGEFSQDQIGIFRPQGANRDVGLALGQIDHGRSAVEQHADIRVFKVQAGQGG

SEQ ID NO: 19460 - protein, 340 aa, Pseudomonas aeruginosa
HEVDGQGVGGGQPHLAGQSVVHPAGPPQQLQGRAFHLLGQFEGRLAGRGQQVAGRGAQEQGRAQRRLQRRQPPAHRGLVDVKRAGGAAQGVLAAEREEDAGVVPIHGGFPDAFSHQSNEKALRDHGIRAAYHANQVRTIFPGACDEQYEPISRTNDRHRDRPARRPRGTGGDQPAAADARPARGPGRSPRRRRQRSRRASAQGRVRPAARRLGHSRPGDRRHGAGGRQRGQPLRRRRGGDGVDSRRRLRAVRGGRRAHHPAPARRPGHGGSGGAAGNLHDRLGQPVPARWLQGRRDAAGPRWRLRHRHRRDHAGQGLRRGENLYHDLQRGPARGQPAPRR

SEQ ID NO: 19461 - protein, 197 aa, Pseudomonas aeruginosa
PHRKKTLTAHRLVVLPSRRYGSGLAHKAEPKGAPHVTAAVPQARRQGRVVRPALPLLHALERFPGTPRRPPAEAACRAVRRRPGDSRLVRAGTRSFQHLAVRRRRLRLRRQRCPARGAAPVAGPLASPALAAPAASLAARRVPRGATAQPLALVRPPAPTPSSSLLASPSSLTPLRAGRGGLCCLRTSLRTHTCHGP

SEQ ID NO: 19462 - protein, 605 aa, Pseudomonas aeruginosa
PRHARAAHPALRLAVRRPRSGHDPRPRPRWAAGGARHDAAAVAGRRPVPAQRPARRPVPRGNPAPDATPPPGPEADECLALDQRPGSATGGRTPAGGACPGIPRLAGGDGGLAVLRDREVSLEQRLDRLLAGPLRRARGARPDPRREPLQAAPGRRPPAAPGPRPARLRPAAVRPGRLVILAGLRAAALRARQPRHPGHAGAALGPRAGRPPGRVAGRAEQPDEPRRDRRSAADERPVPLGQRSARASAPGRRAIPRRRPSRSGRAGPGLATSTYGRRTIMDRIDMGVLVVLFNPGDDDLEHLGELAAAFPQLRFLAVDNSPHSDPQRNARLRGQGIAVLHHGNRQGIAGAFNQGLDALFRRGVQGVLLLDQDSRPGGAFLAAQWRNLQARNGQACLLGPRIFDRGDRRFLPAIHLDGLTLRQLSLDGLTTPQRTSFLISSGCLLTREAYQRLGHFDEELFIDHVDTEYSLRAQALDVPLYVDPRLVLEHRIGTRKTRRLGGLSLSAMNHAPLRRYYLARNGLLVLRRYARSSPLALLANLPTLTQGLAVLLLERDKLLKLRCLGWGLWDGLRGRGGALETNRPRLLKRLAGPAVASVASGKAKA

SEQ ID NO: 19463 - protein, 290 aa, Pseudomonas aeruginosa
AWGAPCKVWREDDSGTPQPVAADHFHQLAQAGLRLASARIIEAERRAHRGPVGQYQLQPAATQLLGDSHFQAVGQANAVQGRGDRRIAFVDAERAGHVDLDHPLAVAQFPFVERVVAQAHADAGVPQQVVRPLGHAVARQVIGRRGHHPAQLPGQWHRDHVLGHRAAVTDAGVVAVGDDVDHAVLHRKFQLQVRIRLGEAPEDRPQQQPRGIARHVQAQPAHRRGAIGIELAERLADHLETILQLGRQRAAGIGRHHRTAGTVEQLHPEPRLEVAHAVAQRRGTDTQLLG

SEQ ID NO: 19464 - protein, 270 aa, Pseudomonas aeruginosa
TASPTPSAGAWTTRPWPASSGSSPRPSRIRSVPSSWRRPAATPDRTAGAATPLAAGLTERRKAKWRFFSRTAGSVMENVYKTPEAPLVETRGAKRAHFFVTSLGKMSVLFLVTLGLYGVYWMYKHWKAQQPQMERRISPVWRAIFGIFFFHALARRIHQALPEERQALWSPSKDATWAVLLTVAANLISHLTDVVPALEPYSLPSLLLLLTPLIPMRNIQRQANLASGDPQGTGNAGYSGYNLLFIVLGALYWLLILIGSAVILFGSSQG

SEQ ID NO: 19465 - protein, 162 aa, Pseudomonas aeruginosa
PRSRQSVPLPFAIPPLPRAAATGRIPRSAPATPAAERGRRRSCVRPEKQERSGRFRMSITSTDICQAADALKGFVGFNRKTGRYIVRFSEDSFGMDVADDSITPTSEFVWSSVRDDVMRLGREQLQILLEQNINERLNIGEPLLVYLRRQDLPEITAQRQLR

SEQ ID NO: 19466 - protein, 87 aa, Pseudomonas aeruginosa
APSIAARAGRCATHYAGSVRRRPAPRTPSAIRRATQVLRGEVNAMSKGLNAKKETRRKPLKTAQEKRLAKRAKKHAPAVPLGTPSRS

SEQ ID NO: 19467 - protein, 470 aa, Pseudomonas aeruginosa
NWQGGRPLRDEPSSSLYGFQSIAAPGALSRAPGRGAGRGIHRRAGGDPGRPADPARLCRPQPATDRPFHQLYRRSRGGLRRCPGRRGVPGADRLQRRGLQRHRLRPPGTDPGQLASGKHRAAAPAGTATGALAAQRADRTTDPARRPEDRFGGGEGLRRQPAALPAHRFRRHGPVPAAYRPGRLLPVAAAGTRYRRPARPTGEGRAYRAPRTGFREARTGSRHRRAEPTGRGLQRPARRTRILAGAPAGRERLAGAPGPPRQPDQPAQPRLLRRPPEPGAARCQRASRAIGGAVHRQRPLQGDQRPPRPCRRRHRAGQHRHAHPWAVARKRPGGAPGRRRIRRPARTAGVRRRRPAHRRQHHRQHAGADPAQRRQHGEYLADHRHRPLSRACGYPGGAAPRRRHGDVHRQAPGPRQPAPGGTQRPPHPSGRKGDRQCYPRGSTQVDCLPSPCSALCWAWPVARPSRRRPA

SEQ ID NO: 19468 - protein, 227 aa, Pseudomonas aeruginosa
MLRKKPTIPADLPLAGAPGFTDRGYRPLPVRPRNRPSDDGRHAMNRHYYISDNLDELERLEAELEASGIATEQIHVLSEKDAETGQRHLHEVSPFMKKDVVRSGRVGLLVGLVLAIVAVAFAYASGWTETAAGWIPVIFLGAMLCAFCLWEGSFFGLQRTNRAFRPFEERLHQGQHLFFVDVKNAQEPILVNVVSHHPRLQDAGTGPAVSPLLLGWQQRWRQFRRMV

SEQ ID NO: 19469 - protein, 148 aa, Pseudomonas aeruginosa
SGSHRTAQPGLGHVRAGCRQHPARPLQQEQERLVVRYSAQPTEGRQVPQPAAGEPGRRCSGAPEGAHRFPSPAAGQPGTARQERPPADPQPGAERGPRQAPARRPPRRRWPGLRPVPPALSGNLSAAVRCVPDGSGSGLSCRGRRWPS

SEQ ID NO: 19470 - protein, 808 aa, Pseudomonas aeruginosa
RLFWNILIKDSRCRSSGVPVRPLSRWLSSCGSLLALAALFLVVPLAGRYWLGWSTPFGYLSDLALGSLLVLLLHRRSLWFALPVMLLWCLFLIGNAELVGAVGRMPEPSDLKYLLDPQFVSSSTQGGGLAHLPLALGLGGATLLCVLLWRRRGPRLPRYAYALPAAFLAAHVGLQYLRPSDADQWQQYNLPHKLLASALSSGQLAVEDWLADDRPDTPPDVAGLNQLDLSGTPLLAGGGRARNVLIVAMEGIPGAYIAANRAAINSSYHEAPMPRLSGWAERAMTTPDYVLHSHQTIRGLYAMLCGDYSKLDSGTPKGVELLNNPARARECLPAQLRQHGFSTHFLQGAGLRFMAKDKVMPHMGFDKTLGRDWFRNTSYLEFPWGMDDKAFFEGAATYVKQLRQQKKPWMLTLLTVGTHQPYSAPADYLARYPSAKQAAVAYLDDAIDAFLADLEKQGVLRDTLVVLTSDESHGVDQVRLASAWGFNLVLAPEQAALPPIKSGVYGHVDLAASVLDYFGYRVPAGISGRSLFRDYASGREMMSYTNGMLRHHDGKDTFVECDFQQVCRRYRSEGFIADEAEFLGRFSGRQARLVSQRAAVLDHSVQQAGQLGQEFQFATHERIRLKPETHNDWTDNLIGAQYLEMPKNSRTTVTLKIRALQYGPQRRPGDAEDQGIRTRRSHTGTGHPAPAQRQAAGHELHLRQPGSAQGLLLPLARRGPRDHRDQRLPRGHGGQPGTRGKPQPGRRSGEGTAAAEHPEKPVRQPPRNRGSGTRGRPSGAHRHPRAEGPDPFALTAPERPARPPRAPR

SEQ ID NO: 19471 - protein, 187 aa, Pseudomonas aeruginosa
ASSTTSSAACSPWAAAAPCRTGSRTGCASAGAAVATPTASPAPTRSVSTSWTSSTRASTSRSEASVRRQRTAVPPGAHRAGSRRSAGHGYQWPPAAPGRSPRCGRRSVPWPGDGRSPGWYVRSSGLAGPAGSGARFPHPGRWSPRRAAAPARLPATPGRSPGAGAGRRTGRCRPRPGGWRSPAADPG

SEQ ID NO: 19472 - protein, 166 aa, Pseudomonas aeruginosa
RKPSRRKPPSRLPRSKPASPSKRRSPPSSRPAARSRRSPRASAARSTARRGRSPSARSAERPPLAGDYEGDGRPARRCATLHPLFHCLNPEPFMPGHPDPLHGVTLEKLLTELVAHHGWAELGKRVDIRCFRNDPSIKSSLAFLRKTPWAREKVEALYVQLKRNQG

SEQ ID NO: 19473 - protein, 219 aa, Pseudomonas aeruginosa
  UNSURE (164): Identity of amino acid at the above locations are unknown.
RLARQPQAQQLPVLLVGEQVEIAVRALPHVADAHPEIAQQALFVDDPVAIQLQADQFLRRQRADEQIMLPGREALRIVERHAADRRRLLPDMVRRLGTFDGLAPGFGDRQQGVVDSMGRQRPAVVPAGLGYVDLVAAARAVLVGPEPAGPGIQRGALLVAVAIXPNLRPRVGTADEGIVLGNAAVRIQADDLALQLVQVLRGAALIVLAEGDEQVALAV

SEQ ID NO: 19474 - protein, 290 aa, Pseudomonas aeruginosa
KNTSPASVPPLRWTARLRGWWCSASSTAYCASWWTTVHGWSRNTWSRSPATWPPAASSACATASPTRAAGYRRARSVGRTKATCASPSKTCCPASCASCAKARGWKCGASAACASARCRWPGYRSANGATSASTNASERSFEATQGAPRRLPADPPVHGDERAVAGVAQGVGDLGHRAAFGQAPPRFEQTRLGSPAGETQAGLLGEQTRQGPPAGADLTSPRLDAPVQRGLRQQRLGHLQRPRIARHRQARGVCRRARQFIEQCAQQRQVRPFQLQVGCPAGHAQDQFAH

SEQ ID NO: 19475 - protein, 374 aa, Pseudomonas aeruginosa
SASDWARPPCYRSTVPGRWPRTGACWAWSHCCWPGGCRNESGARYARANRTTGPESRIGRPSRRCYAVMAQRPCGPAERGQNDARIDPARHRGEFVPGPSHRPGESLASDPPRAADRPLQPDPHPGVFPQGLPPGPRPSALAPGNHVRPWRHGPALRRHRPARAMAAPPAAQAVAHAPADPAGRRRDHRLRRRHRLHRPAHHQQHHAAAAGLFRLRHVHPDPPGLRGALLRSGDAGLRGGDGPRPGRPATAPVEPGQRPHRVRPRPTAVADPLARPRAQPAPATQAGVAAAGAGGEESPVGVPGRSRPPDRPVQSSRVRPVGAHGARAYRSPTAAAEPADGRPGSLQVHQRPLWAPLRRRGHPPCRQPAARQYP

SEQ ID NO: 19476 - protein, 538 aa, Pseudomonas aeruginosa
ASWRIASISSSVGGLTVSSSTSSTAGGAGAGSATAGTCGAATAGSSRGSSKLGNDQRPKAATSLPRISSLGLSLSLSWGTTSDHLLATLAAQHDIAGLGHAPGNGEDFLLRTFHFADPYRPLGLQVVAQQLGGTLGHVLEDLLADRLVGALERQHQYVRGDFPEQRLDATVVDVGEVVEDEHQVLDLSGQVFVDLADRIHQLAFDGAVEVVHDVRRALDPAHGGAGGVGIAGELLLQDQVEFLQRRGLHGVQRGDAQDDIQAHLVVEMAEHLGGLVGIEVGDHDGLDLRVFVTDHVGHGTRLHPLQAVQAAGAAAEEDAVDQVVGLVLAEGLGEHLADVAVGTDAEAGLVADHFDELAHHLLDLFAMHVAHRRHGHADPLHLFRSHVPQHLRRVGLAERQEQDGGLVDLGQFGGETILTHGAYSSALIHSFTTWATRPGSCATRFLIAFNCASYPSVGLGRRMLDGPPMLTRSSASEPSRPLSPSARSPSRPPPPASDLPLPPPVMLLSTGRSTPNTRTRMNSTPSTCLTMSQNHGCE

SEQ ID NO: 19477 - protein, 713 aa, Pseudomonas aeruginosa
LSSRRSDRHLHDVLVGLDQFVAHLGHGLERHAGLLAGDHHVGQVDAALADLEGVGHRGGGLLGLVHLVHGLGEHFRKARRPRFGRRLSRFGLGHGFHLHGTHFQHQTIELDTLTHDSSSNSRGFFDAARHFAEELATRVPSRPQGPASAFAANARDRCRVRPCSGYRQARTLEQPRATTGGGRKRPARGGPGEYGEHSDGVEIGLHVHPRVAHLGELVAQGPRADAKALGGLLAAAALGAQGIDDHLEFAAAQVVAQRAASVLACGRRRNLDARRGGRWHCRHGHRHRGRERHADRRGEAQVGGLDQAALLQDQRTLDGVVEFPYVARPGMPDQALGGLGAERHRAEVHLAAVLAQQTLGQRQDVRRAFAQRPPGQREDRQAIVEVLAETPRRDFRREVAVGRGKHADIQVDRLARTDPLHLALLQYAQQLGLQAEGHFRYLVEKNGAAVGQLELAGLGGNGAGEGTFLVAEQGGLEHVVRDRRAVDRDERLAGTRRLLVDIVRQDFLAGPGLAGDQHGGIAARDPRGQFQQLPAGRLQGHRTILLAARQLAQRMACHQVEQRPRLERLDQVVGGALAHRLDGAIDRAVGGHQQHRQVRVACTDQAEQLVPVHARHVHVADHQAEGFAGQDRQRRLRRVHGDELVTAQQQGVAEGFAYCAVVFDQQDFGCHGVTPESQKEAPPESAAGSRWRRCRAPAESATAIAPGGRAPRP

SEQ ID NO: 19478 - protein, 64 aa, Pseudomonas aeruginosa
CRLRATTSLPVPDSPRISTLASVSATCCIICRTCWIARLVPTRLRNRFGSRERPRSRAWSYISR

SEQ ID NO: 19479 - protein, 180 aa, Pseudomonas aeruginosa
KTPTDRMESSTGRGFGGYVNFSEKPCAKVTAQSHEKLIRTSGRPWRLASTGSAGSDRWPACAARPGRHRSARDTAPAALPSAPARWLRPVHRASPRRRPGGNAGRVHRWPPSSGWPGQRAGRYRFLQGSVQLHSLLGPSGDASQGAIASQPDLMLRNSSETSSSLPASFFKLASVSRIDM

SEQ ID NO: 19480 - protein, 460 aa, Pseudomonas aeruginosa
LLQPVLVEDAAAGIEPEQEFAARPGRRQVAQSPTGQLPIASQHPHLLDTHAFDGEQPFANVGRFATLFQQKDLVVGIGGILQHGFYATLELRQALPGQHQDADRRLPGVAVVQLVAPRQPASDCRLRVATGTQVAFDRRTLGGAVLQAQRWARQQWLADVSDTAQAPLLDETQLVGQLESLAGGLVESARGKQRLAAEQPVPGQPGGETEQKVEIQVRAQRRAQLAVIQAHEFVGVHRLAALRCRQQVQRRHQQAADSEFDTRFDQEQPVGIKPGKRLVDRRHRPHLWIEEHRSVPRTRAQRREQVALDTWIQIDVLQALQGTLHGLGIAVGIEHQHREARPTTLLLQESIDQHLLHRIRPPRLQPGRQRDATEARRPPQRGEQVDRLEDTGVQAGDRCHPDEAVVAGLAIPTQFADSQAEVGMALLADTGLVAPDLAELLAGDAETGQRPRQERQVATL

SEQ ID NO: 19481 - protein, 115 aa, Pseudomonas aeruginosa
FGRQARDRGYERLRQARMGFAIRKQAYWMAGYAEINQAGVEIRLGIQRDYHWPGTPDIGLEGLAVPDHACASPQQQYFPAFQPVAWGPNPFRRFIIEMTGTDEHVATEALSTLPT

SEQ ID NO: 19482 - protein, 162 aa, Pseudomonas aeruginosa
LPLGTERPGMVRADQRSLAGAFGLDRRQTMRTLVEKGPNAGLGTLHHDRHAGDLAGEELVALAHHRTEADEDPEPAEQPFALQRERLRLGVVRCVQRMASHVHIHNLHLLKITRAGLPTTVCPAATSLNTTAPMPTTASSPILTSRAIIAPELITARSPTFT

SEQ ID NO: 19483 - protein, 379 aa, Pseudomonas aeruginosa
CSPPRHGGGSDQAGDELDVCGGQPGIDRQAQHPRGNRPRHRKIGGRRRGQRMVHGEVADEWVEVAPHQHIPVAQALVQLVARKRKIVFHQDREIGVVGEGLGTRPEALDARDAGQQAPIALGDLPALLQGLVDVLELQQPEGSADLVELAVDAGHDHRDLVDEAEILKVVEALPGVFVRADDRTALEGVEHLGGMEAEDAQVAVAQHAAAGVAHGEGMRGIVDDLQVVDIGDPLDRLDIAGVAVAMHRQDRGGLRGDRRLDPRRVEIHGVLIDVHEDRLEPVPQQRVAGGDEGVRRGDHLAGHPQCLQRGDERQGGVGEEHDVLHPQVFAQGLFQRMVHVAPVGQEAALPDLFQVGDELFQGRQQRAGDRDRLVVHVGP

SEQ ID NO: 19484 - protein, 473 aa, Pseudomonas aeruginosa
RSHGPCSTEGLSLQVVEQAQPLDLHVALLRGIHDGGLQRQPRQRLGVVQVLDLRHHRRIHQLHIVDEGLGAFHGIQARADLALAAIHGGSHGGEVGQGHRRRIADGVVAGLVVGGAFQGLAQVRHHVQQAALLAARLVVDVELVARLRRAVDRHADAGVEHLVDGLRVVVDGALGQLPGRRRIRIVGGPVIARRQALRIVDHILLVADEVDVEAVGCRRRIARRELAVEGQLVLDQADRDATVAGIASRRLGIETSGIDDVLEQYLAAVADRNPRAAGDLHLALALVAHVAVGAVLVAHERLHRALGPGKQVFATRVAAVEQVQQLVLALAQLAGQRLLVVGVQCAVAGLAGDLTDALEDVANRTEDGFFLAQAVLRLGHAGLVLLVQPLLLVQAQQAYRTDRVVRRCQDALAGADLLEGTVQVRVVAGNPVDRVVEGLDGGNAHGGGLAGLGPVERTQRNAPIRVSNRVRAT

SEQ ID NO: 19485 - protein, 410 aa, Pseudomonas aeruginosa
EPLSGPAPIPLSKRESMASSSDHDQVGLQRAGLLQGFEDRHQVARRGADLVHRADDVVQGGAGTELEHRLGLLLGVHPRAWHHRSLAVGEGTGLADDRVLGDAHGQAAVGDGGRRYLDVLADDDGAGARIDDDLGHRLARLHVEVLQDRQVVDPLVRVERRADPHRAAVHRMGDARTEQFVDAVDDALGSGEVRAVEVQRQAVALVEAARHRAFDGGAGRDTSGGRYVDGDLRAVAAFGVEAADHQVALGDRVDLAVDTFQRSHQQAAAAQALGVADGRHGDVDRLARLGERRQVGMHRYRGDVLQLHVADVGRHLDAELRQHVVEGLQGERRLRGLVAAAAQADHQAIADQLVGPHALDAGDILQPLGLGRAGGQEQRGEGQQVLELGHRERPQNGHSGLRKKRSSQPG

SEQ ID NO: 19486 - protein, 145 aa, Pseudomonas aeruginosa
VIRASATRVEDTVLSVAISSARTRPAMRTSSLPVFRVIHFSPRTERMPLGSTSATVTVIEPVRLLLCPAWLSPLASREPPYSALRLRSPPPIGLLVVMPLPNSEVSPILVLLSFWISELAFLLAWVFSLRVMVMMSPTRKALRSS

SEQ ID NO: 19487 - protein, 567 aa, Pseudomonas aeruginosa
RHWRGTWRLLSTQGADQPFEFAVEEGEGRLEVHGVLGVVGLLDLGVDSVLVDRRLDRDAVLQAALAHAETFGGDMPLVGGADGEGTLGGLVLLLGENRGEVQVASLVVRGIGVGQVVGQHFGALGAEAEGLLVDTECSVETDAHGCEPVCRCGFRRQHFSKARAKLLKTFIFNNLSLFKSNPEAASGKPFPLAGKGGKPLERPLRQTKKGPISSISGLSHASGRRGHGSLVANDPLEIHRFAGMGMQLGANILEHRIVFLVHPGDRAELRVQAVLLGDPRGIAGEVEGGIARQLEGVAERLAVDLAVHVEVHIGAGFGVLPHLVADMDIDVLLVEAGQADQMEVAWFEHDESPGGNRNQSSQGRAKENRPGSVQRRFFRAFLNDHPGRHHHRPEGRVAFDEILGRILPDLAQAAAGKPGGDLLAVVPGQGLGDFHQVQRGIDLEQGATGEKRLQLGPGNDRGLAEQLGIEGASLFCHGIYLDCMGAMITPAGSPRQPKGNRAQGGEAGPRRFSIRLCQPGDTTHGSSPCRAFQATKRRSTLYRYSSRGPSMTITRSPPAPAAARLQQ

SEQ ID NO: 19488 - protein, 398 aa, Pseudomonas aeruginosa
QHTRRVEHYEEGYSASIPPVRRDGHCRVRQLLHGRRHHQDRPGWPGHRSGSPVRRHAARRCADGNRTDQQGRRRERRATRRRDLRRRLRSQAGRGGRQQGGQRRRQVRGRPCLLQLHPTRHRHLRRRRRADDHPVGHRPGNHLARLQADLPHHRPGQHAGPGGRQVHRRTLQGQDHRGTARQAAVRRRHRHRGEEDRGRRRHQGCRLRRPERRRQGLQRADQQAEESRRAVRLLRRLPPRNGPAAAPGQAGRAGRALHGPGRGRQQRNHRDRRRRFGRHAGDPAARLRAGSEEQGPDRRLQGEEPGSERHLRPARLLRGHSDRQGHRESRRGRSGEGRRGPARQHLRDSHREPRVRREGRPEELRLHRLRVAQGRHPDRGQVSIVAVRSPRHPPWALF

SEQ ID NO: 19489 - protein, 311 aa, Pseudomonas aeruginosa
RESPMPEIYHYLQQLVNGLTVGSTYALIAIGYTMVYGIIGMINFAHGEVYMIGSYIAFIAITLLAMMGLDSVPLMMLAAFAASIIVTSAFGYSIERVAYRPLRGGNRLIPLISAIGMSIFLQNAVMLSQDSKEKAIPTLLPGNFVFGESSMNGVVISYMQILIFVVTFLVMFGLTLFISRSRLGRACRACAEDLKMTNLLGINSNNIIALTFVIGAALAAVAAVLLGMQYGVINPGIGFLAGIKAFTAAVLGGIGSIPGAMLGGLLLGVAEAFGADVFGDQYKDVVAFGLLILVLLFRPTGILGRPEVEKV

SEQ ID NO: 19490 - protein, 165 aa, Pseudomonas aeruginosa
WPRCSAFFPRLPGAAPARRLPGDRDPRLRRDHPHPAAQHDRDHRRPQRHRLDPQADPVRPDLRTPRAGRHADLPRVLRHRLQHQLQGHPALRGGPAAGAAGPVRDQPADAHADRSRLGSAARGRSGLPRSRSQPDHRQALRLHHRCQLRRFRRQLLRRPPGPGDA

SEQ ID NO: 19491 - protein, 331 aa, Pseudomonas aeruginosa
VLHLHRVGDDPCDRRARRHGFAARRDTRRGGDGAAPGNARVQRIPHADLRPDHDRDDDLASPGTAADATPAPGAEAMSRPILEVSGLTMRFGGLLAVNGVNLKVEEKQVVSMIGPNGAGKTTVFNCLTGFYQPTGGLIRLDGEEIQGLPGHKIARKGVVRTFQNVRLFKEMTAVENLLVAQHRHLNTNFLAGLFKTPAFRRSEREAMEYAAHWLEEVNLTEFANRSAGTLAYGQQRRLEIARCMMTRPRILMLDEPAAGLNPKETDDLKALIAKLRSEHNVTVLLIEHDMKLVMSISDHIVVINQGAPLADGTPEQIRDNPDVIKAYLGEA

SEQ ID NO: 19492 - protein, 803 aa, Pseudomonas aeruginosa
LRAGLGVVAIGQFEQGNGVGQGGLTLQLVADPVTHFPVADEDFQPRVVQRPAQRLDLRQQRLGALHLEVADVRGEFVDQPRTLLLAGLTQVGAELLHPVPDIHMLQSPSGVLRIFLLPQQALHRIGESGQGLVQRGRGLAASLSGDDHFERAQQQRRMGRFVAFLADGREQRLHRRIVEVDVEPARLAIVELAGELPGQAQRRGGNTLVGLVVLQSPLEFGVAVGHHHKRQFLGAEAGDHQLLLGAAQVFGQPAGLALGQSVEAEQLAVALLGAQLHQAHPLGLRPATEEGYHRIAIAMGHRYAHGTEQHFLEAAVVVQQHMHRSARKEFGSREVALGGGYAQAVHHQREQTLVAQRRSQQGLVVPQQDPPPGLRLLPRHLAEPGDQRLGQRMLDRRVMVVTLQVLAAGGGRQAVRFDHPADEPGPGRQQVAGVIVEQHAAEENREIAVVAGAIGAAVLDPQQALHVDPLVRAHRQAADRLEVVLEACGELQVAALPLQRVQRGVGGQPPRRRLRVDRLGVAADVDRLAQQHAVAFEDLAQARGLGQRTVFVLQFEGDLGAYRARRHRRHAVLLGVAGDVAEAQFRLLVGRGPHADPAGQDESGEEAQAEHADQPAVLVAGLAQSAGVADADGGQVGVDFVLGEPGAGVDDAHGVAGTVADHLDSRRPLPVGLLQAATEDRVVGVLHQLAQRHGGRGIEVLAEHRHHAVEVDSSATDLGSVRLRKAALHVPIQAFDEWRPLARERSGAGFCHVPSRSLCNDVPAMSFRPHGSGPECNRAASRRNVQPSRPINCRRLRSNQSSR

SEQ ID NO: 19493 - protein, 174 aa, Pseudomonas aeruginosa
AGLAQVISCRTNSGRATSRASCSTPERIARSKPSPTRSRRPLYRSSSTRSSGWRSWKSSSSASNRVSPSETGRVTRTRPSARSCKRATACRARSACTSKACASGSSAAPAAVSERRRVVRCKRVTPSFCSRTPMRFDSWPLLQPRRSAARVKLPRSWSTAKAARSSRSFTIVSL

SEQ ID NO: 19494 - protein, 249 aa, Pseudomonas aeruginosa
WARSTWYCSAASTPTTGAPSPSPAACSPSSRSASAVRRAWSTAPSRASSAAQPWSCRAACASTPSARPWSARRCPATRPTSVASSRFRRRTPRWVTHAAWKARRPARCTASGKRYFSGEAVGVAGRRTARLLAVQLLLEELGQHHGIVVLLVVGAVEQRQGALPSAVEQAPPMFRVRLQLGAVVFAEAVEECRIVAELLAHLVGGRHVLQPVVHGQGFLADAARPQPVHQYAPAIGGRRRFVYTLALDH

SEQ ID NO: 19495 - protein, 248 aa, Pseudomonas aeruginosa
GQRLAAGSDRLQKHDLAEEPRQWRQTGNGDGADEESPAEQPRILQRRALDQVAGLVAALAGDQVGEQEQATGDPGTVQQVVQRRRQRPLAAQRHASQEGSGGDHHQVGQQALQGPRRQGTDRAQAKGRQGQRPEPGLRQVGQLAGGIAEDQRVDPQDRVDADLGHDREQRRHRRAGRGIGARQPEVQRQQRRLQGEHHQQQEPGCRQQRRALGICHGDLLRHVGHVQGAGEAIQGTHGDQEERRADQV

SEQ ID NO: 19496 - protein, 236 aa, Pseudomonas aeruginosa
DHVVQARAHPLRAAAMQEQRVGGDQEYLEEHEQVEQVAGQEGAVDTEQLELEQRVEMLAQAVVATQRVDQRGAAEHRGGQQHQGGETIEHEHDAERRGPVAQGIDAQVAAGGRTYQQQAQGDQCQRREQRQAALPALGQRQQQQAAGKQGEQDRQDQPMAHGRGSSSSGRPSTWSLPRSPRPRRARTTTKAVMAKPMTMAVSTSAWGNGSPYSPGVPITATLPPSRPMANRNRLTA

SEQ ID NO: 19497 - protein, 87 aa, Pseudomonas aeruginosa
APAEGTAMDYFIIVVTTAAGLYFHWWIYWRIRRWMDRDLALSFAGDDPQKRDYLLQRLAEAKASKVKRRDLPAWLERAAADYPSREA

SEQ ID NO: 19498 - protein, 347 aa, Pseudomonas aeruginosa
PSPRLPARATTGTPAWRAIRATPTGVLPCRLCASRRPSPVSTRSAPTSASASPASSATSSMPGRKRARRNALAAKPRPPAAPTPGTRLKSSPRVATTTLAKCARAASSCATCSALAPFCGPNTAEAPRGPHSGLSTSAATSTATSTRRGSSPPRSRLCRPASAAPPGASSSPSAARKRTPSAPSRPAPASLVALPPRPRIIFRAPASSAARISSPVPRLLLRVASRRSRGTRCKPLAEAISITAVASSSQPQCARVGSPSGPSTRHSRRSPAVAASTASTVPSPPSASGRSNTSACGKTRRQPRAIASATSGADRLSLNESGAITIFISHLAGPGVPGPASIRAAQG

SEQ ID NO: 19499 - protein, 495 aa, Pseudomonas aeruginosa
AASLLLWVWDGRPGAGHFRSVGTGHALCNGQRKTALEGEHFVRLHSESIDRPLPAARNEQLQPQQQLLAVLQASEIEPADRSDALQSVAQAVAMDPQRLGTGLGVPVMGAPGLQGSGQRTLRIVVEQPLQGRQQLPHLPTVALAEQQAGEAVSVQGHDPPTGQPAARIVQQVARGAGRGAQLGQVMRRVAGTQARHAPAARVGALQPVLERICVGYRPAPEHQALAQRRAPVLRPAAECRQQASLARQRIGMLGQLQEDRLARPVHGQPQVFGIGRQRPEAVAGIEQLAQPGFVTLALPVSLVLHLALFHEHFRCHPHQLGIGPDHLRRAGDAEHADQPLGVQQRQVHPWPHPAQAGGGLLVDFHHPPVGQHQLRPFVAGMQARWIAAADDHALGIHHIDVVRQDRHRPIDDVLRQRRIQFEHGGLRAPGVRAASRRPGVDSRDGRAGGSAAPARTRCAAAGDGSRPSARDSSAAGRRNAARCPRAAVPARRDRR

SEQ ID NO: 19500 - protein, 236 aa, Pseudomonas aeruginosa
TKTGASTPPFCSAPPASFALDEDFHPAILGPPFASLVVGDRLAFAQSLHADDDARRHPGINQIVRNGIRAPFRQLLVVGIGTDAVGMPGDTQARTGRLAFQAFGDAVELLAVGGVHLRRIEGEVQVAHDNGFFLDDGRRRRDFLDRLRRRRRDLFAGTVHPAIGGTDATADQGAPAGPAAAFDRAQAGAGNTPPTAAQVGQSLFCNPAQPVSKPLTRIRGKAVLVMLIGTLLVDRL

SEQ ID NO: 19501 - protein, 175 aa, Pseudomonas aeruginosa
SWRIPGECFPMSEPISPRTPQQALAALLARYAPKRLLLVGASRLPAVEAFIHNHPQCQLAHSPAAALPAELAGQRFDLALFVDCLEHLPQRTGLQLLAGVRNLNASRVAVLVDLEASDWQETDFFALAMQNSERFQREGQTLTLYTYDLYEYKQVPDWLNAKFWANPENFGKYWW

SEQ ID NO: 19502 - protein, 181 aa, Pseudomonas aeruginosa
VAAQSLLVKLGRLGGNSMNYQAQMIRIISLIMAWGVLSHLSGCSWMTGSFEDPDVKLLKVEVVKARLLEQEFVMRFRIDNPNDFSLPVRGLQYAVQLNDIQLAEGESGQWFTVPAHGHEVFDVPVRTNLWRHMKYIVKLLERPEEPIRYRLQGEVKTGLMFGRSVHLRRNGEIIPGDFIPE

SEQ ID NO: 19503 - protein, 196 aa, Pseudomonas aeruginosa
RCRRTTRFPPSSIANRPTAALPCRCSSPAPSCSISRKRPDASSPRTCARARKPCSGCSGRWAGWGRWQGRTTISTASPRRRFPTPSTGTSRKPRACTAFSTSAWRTAPSSPATTTASPTWPSIRGSSRTSGRSRISPTSRTCSAGSRAFASVRRRNAPMLWWSASIRRSSESRAGLRTSSRTTAGGACAALRSSLT

SEQ ID NO: 19504 - protein, 1291 aa, Pseudomonas aeruginosa
RAVRPGLRTRLRPPEPDGQPAPAGPGTAGRDGRPRRAGDRPFHAYREPAPGRGDPVQERLAAPATLLRGLRARGQRLPVSLSRQAADGPGPVRLPSGILEARGLGPGLRPAQLRPGGEPAGRNRLADARAEGRQRQAGLADADLSRRKPAVRRGGKAQGPAPGRAGSRPRGRRGRGAAGRSAEHARGRRLEQLGYRAATQPQRQEPDGQRHPPAAEHAVGVELRADPLAQVPGRGRFHRRSAGRGGGLQRQAGLGHDHGPGRQSGSLPGTAATPGQPALLPGRRQVAANPRTPGNLLHQGPAADPRGHPRNPPWPAAQQRPGRAQEHPPAAAAEERLRTGLPEHPAGSRQDPGRLLRPVAGQDHRAGLRRHPRDSRDAAEHRVRRRKAHRLAGHRTLSEPQGRSWPAALPWLGQPLRLGWLCRPDPPPVRPGPAAGLAGYRQPPHRAARLRRPVVQFLVLPGARRAHRPARRCQQEPRHPEHDPHAVRPDLAVRRQVASHVRQSRHGAAAAPGHRRLAGGATQPGAGGLRPADGVRRQADSQLQRRRAVRRLPPRERQADIPRRARTGGRPCLESLRRDRQPLLLGASRPPARARRQSVLGRYPHSAEGGQAGNPRAQPRRRRGVLRTATGERAQGLAMGQAAHLRMAERQLENGPLPGRRRARRTRRDQGLSRSRTLSGRRRPHHAGRIGLRLGPGLRHLADPGDAADRRLRPERTDDRREQQRPIRQSGQPALRRRYRRLAQGALRQLPVPATEPRARLRQQAADAHSRSLNGRRGTFPPRRGSEQPTYSMIIFRASFRTPFFYPPPGKPPFSRKPGHGIEPISLLSGLFHGRHQRPVQPVRRQALAGAGTEQLELLAATDQVATSLGELVARRGIGLVQLLQARTDLIEVLNEEHELVIQRTGTFGDFPRILVLPLLAPEAVDYPQGGQQGGRADDHDILREGVLEQVRLGLQSRRESRLDRHEQQDEVEAVQSFQASIVLAGEAFHMVAQRRYVLLQRLLAQQIVVSGDVLLVGRETDLGIHHHLLVAGQADQHVRLEAFALGTLQADLGLVFPAFFQACMLEHPLQHQFAPVALGLLALERAGQVGRFLAQAQVELLQTLQFLAQGETLARFLLVAFLHPLLERLDALLQWIEHLPQALLAGLGETLFAFVEDLSRQFGELCPQLVAGRLQVGQALLVAFLLLAKFRSQRSPFGSQATHFLFPALALAGPTCLRQGRPLPLLPHQLGFPTQRGDLAGEPGMALAELLVSLPTGLQLRIQPVLGQLRGRQSLAEQRHLALRQAGPSL

SEQ ID NO: 19505 - protein, 245 aa, Pseudomonas aeruginosa
GGLPATRRAPCQALRRGRRAASGSRVDGGGAATGVPGGGTLGQRAPGPGRGSASPGFRTGCAGCGTSRAAGKPPAAPDRPAVGPRRVAGTVRRTGGKDLRRTRTAFRRDQPAAPGADARSTEGAHPGVREAGGGKLPAGSARAFLPEQGTGASAAAQPAPGRGSDQPDPRAQGPEDPGQLGRTGAGAGARACRPGKRPGIRDPGQPEGCRGRTLPAGRADPPARRQAGGGGCQGQSHGLPAVHRR

SEQ ID NO: 19506 - protein, 691 aa, Pseudomonas aeruginosa
LVEEYLPGALVEEGAVQRGVAGAGCQLAVERHQPVVGLPRPAALRLRQGVDGLAQRQRHAGIVEHGLQLGDEQRGLVVLHADHALGVVALAGTGELGDALGALRVVPGIGQLGAVAGLHGAVVGGTQPAPLRVLVGRVEDRVGIAIPVVAAVPARGGQQATTFLAVRIASGDLPADVLFVGEHDVQRHRANLAGGVEGLLDGLGPRQVEEAVQGLVGFLLDAPVGQSVAALQRQRLEDVLALAQGAVEQRAMAGFVDDLADRPLALDEEGFLAFAGWLPLAVGQVIEPVALASQLFQVEILIVAQDHGHAPGQLAVEARHHARQTGDGNARGLVLGRADLHVVPHRRHAQRQVGVVGHQALAAAAALRRDSPVVRGGDPEHAQRCDLPRRALDAREAGNLPVQAQALELFRLVERQVFVGIGRRQPGQLVAADLLRERQRGDFFLQVHRQAEVEQGEDQGRVLGLPVFRTVAGLGQVHRQLVAIAIQVGVDPARVDLEEALQARRGVPVLDLRGLAQVHGTHETVDLQRAGADHLGQPSLGQQAQADHLAQAVGGVYVAQGEQRVMEGAGFDQWHAQRVAPDRYVLRQALDRLYAGGRRQAVGVAIVEPGLATGQAQEGAEGRGGAATGKKTHEGWRGHGVGAPAGVVASRGATLVRSAGLRKLRLRSSARTSAGRLGTRYFGGLMRSTKA

SEQ ID NO: 19507 - protein, 228 aa, Pseudomonas aeruginosa
PERTRRPICRTQSLHAWLSMGTIARRNARAAMPSGPSLGEMPMSRFEIAFSGQLVAGARPEVVKANLAKLFQADAQRIELLFSGRRVVIKNNLDAASAEKYRSVLERAGAIAVVAEMEVEEVVMAPPPAQTTPVEAPQTRADTGTSAPAGRLQVAPRDGYMAAFAEVDAPDFGLAPVGADLQDAKAEAEAPKLDLSRFSVAPVGSDMGQARSEPAAPAPDTSHLRLQD

SEQ ID NO: 19508 - protein, 83 aa, Pseudomonas aeruginosa
RPPPPAAGWRRPAASASARSGRATRPGPAAGCGEKSVRSWENTLLGFAKTSLKRLHGLVLALFSAGVFTPYLSVTTDPRGEFQ

SEQ ID NO: 19509 - protein, 282 aa, Pseudomonas aeruginosa
ARPASYRRTRRTIMRKAMLGLFLVVPLAWAGAAFSAEAPPARQQGIGGTVKVQANSVMRLPKRAQELRLRRVEIGEDAALLIPLEVSVLRIEELHMAKNARIGVAPGEERISIEVVSGRLADGSIISAPGATGTFRQSAGNGRDLTLRLQAVEVESLLLDARGGVGAPGYDGLDGASGKASGCLWGSALKGGDGQSGSDGGPGGAGGRIRLEVPGDFPLERLQTRLQGGVGGAGGKAGKPGAADNATGCWIYSVDAGRAGRSGEDGANGTNGSDGSLDVVRF

SEQ ID NO: 19510 - protein, 188 aa, Pseudomonas aeruginosa
PPTAAGPTSKDASRCSPNCRRRVSRWPHSSVRATTAAASPRRPGGASGMAAGSISSVPIASASLPRRVPTSSPANGASAPWSASRHGVSTASATGAIRRSPHRRGCPTACRCRSPATTPRSAAVSTGGDPCPIPSTRASPWPPSASSPSLLATTATIPGCSATTPTTNWPGPGATARPWRATASLSEP

SEQ ID NO: 19511 - protein, 484 aa, Pseudomonas aeruginosa
TNRPAGVCWTARTAISAWSGSRACRSPASSTRCAEATLPPCRDCRRWPGPCLPSSLCRRARIQPVHERAFTAARLRRTPLMSGFTRPPRAGRMPRPLSHRNLPMTPQGHCDSRFAPLAEAFARLFDNPQERGAALCLEVGGETVVDLWGGVADKDGEQPWQRDTILNLFSCTKTFTAVAVLQLVAEGKLELDAPVAHYWPEFAAAGKAAISVRQLLCHRAGLPALREQMPPEALYDWQAMTTALAAEEPWWTPGEAHGYAPITYGWLLGEVIRRVDGREPGEAIVARTAAPLGLDFHVGLDDSQFGRVAHMARSKGSLGDAAAQRMLKTMMSEPLALTTRAFTNPPSILTSTNKPEWRRMQQPAANGHGNARALAGFYSGLLQGRLLEDELLGQLAHEHAVGEDRTLLTRTRFGLGTMLDQPGVANATYGLGPKAFGHPGAGGSIGFADPERDLAFSFVSNALGPYVLMDPRAQQLARVAGECL

SEQ ID NO: 19512 - protein, 384 aa, Pseudomonas aeruginosa
RVHPRTPRQRIDRHRPRRLLVQSQAPHHADADHPQPAGQGRQDGPGRSAERYPGTRPYRQHRQQGGQRQAELRACPVGGGDLPPQRPERRPIAPEGGRFRHAARGQRQRRRPRPEPSRRSALYPARQPAVPGPGQLSRTGAGRLAPLSRIKREAESAVKLWRISPWRCAMTQSLADMRREYTRDGLSEANAPSDPFSLFRQWFDDAVKTERLPVEPNAMTLATVDADGYPHCRILLLKGLDERGFTFFTNYESAKGRQLAANPRAAMTFFWPALERQVRIEGSVEKVTPEESDAYYQVRPLGSRLGAWASPQSRVIADRAELERLLADTERRFADQPPSCPEHWGGYRLLPQRIEFWQGRPSRLHDRLDYRRQDGGWLRERLAP

SEQ ID NO: 19513 - protein, 240 aa, Pseudomonas aeruginosa
VLHVRTGFDAGAAHRRSGDGDPAAQHQCDGCPGHDHRQRRSIAPAYPPRRGATGAGQPAGGGNRRAGRRLPARGAARGEPAVAARRAAGRRARHHRRAGGGPALCRAGADGSGNAHGTAPDAGRATLATPASRSLAAPVARSRPRPRGAGGRCRTPGAGHALAAPGGLPGAARACRSAALPGSPAGGTRRPGGALERGAGRAPGVLVPAGSPRRYARALAGARRRARLGRGAPVCRRPGA

SEQ ID NO: 19514 - protein, 559 aa, Pseudomonas aeruginosa
RARPGLCPGAGDPSQQPALPTGAHRFDQRARSRSPGAPPAIVAGAAIARSAPRVTGDQSIHCAVAQNVPLPAPSSSGRCTRRVRSRRSENDPPLGAHPTPITTRRRLMTLVLILLALIAFIVLSTTRLKLHPFLALLAAALIAGFAYQVPTAEIVKTVTGGFGSILGYIGIVIVLGTIIGVILERSGAAITMAESVIRLLGERFPTLTMSIIGYLVSIPVFCDSGFVILNSLKNALAARMKISTIAMSVALATGLYATHTFVPPTPGPIAAAGNLGLDASLGLVIVVGLVVAFVTAMAGMWWANRFVGKDIPLDDDGQVVQTEEDFSELRARYGKLPSATQAFAPIFVPILLICLGSVAVFPSKPLGEGVLFACLNFLGQPVIALLVGLALACTLLKDQSKREEFHERVVEGIQSAAPILLITGAGGAFGAMLKITPLGDYLGSTLSALGIGLFMPFVVAAALKTAQGSTTVALVTTSALVAPLLPQLGLDSEMGRVLTVMAIGAGAMTVSHANDSFFWVVTQFSRMTVSTAYRAQTLATLVQGIAGMLAVWLLSLVLL

SEQ ID NO: 19515 - protein, 934 aa, Pseudomonas aeruginosa
PMILALIIALPFMGALLPLLAERGGRTLCAASAGVAPLIGLILLLGQRGTVFAGQTLTASYSWLPEIGINLSLRLDGLGFLFALLILGIGLLVILYARYYLSEQEPMGRFFAFLLLFMGSMLGVVLAENLLLMMLFWELTSLSSFLLIGFWGSRSDARKGARMALTVTGGGGLALLAGVLLLGHIAGSFELTEVLAAGELIRAHALYPLVLILILLGVFTKSAQFPFHFWLPHAMAAPTPVSAYLHSATMVKAGVFLLARLYPALAGTEWFFYLVSLSGLVTLLLGAGMALFQHDLKGLLAYSTISHLGLITLLFGLDSPLSNVAAVFHIINHATFKASLFMAAGIIDHETGSRDMRLINGMWKYLPHTAVLAIVASLAMAGVPLLNGFLSKEMFFGETLSQNLLGSFNWLVPAVATLAGVFSVAYSLRFIHDVFFNGEPARLPKFPPHEPPRYMKVPVEILVFLCLLVGMLPVYTVAPLLAAAASASLGGQLPEYSLAIWHGFNLPLLMSVVALVGGVLVYVLRKPLFNWYAGLPEVDAKLVFEQQVQRVVALAARLTAWLENGSLQRYLAWLLGAALVVVAVELAPLARLTGSRGLTPLDGITALGMLVLAFSGLATALFHRMRLVALLILSVAGLLVALAFARFSAPDLALTQLSVEVVTMVLLMLALYFLPSRTPAESSTLRGLRDVALAGGVGMLVALLAYAVLTRPYESIAGFFVENSVSGGGGYNVVNVILVDFRGFDTLGEISVLAIAGVGIYAMLAGFALHKPTCDPQGRNWAHAKHPLILETLSRVLLPLALLISVFIFLRGHNLPGGGFIAGLVTAIALVLQYIASGSQWVEQRLPLNYAAMAGAGVLIAGLTGLGSWLFGYPFLTSAFGHFELPLIGEIELATAMLFDLGVYLTVVGAALLILSYLGKLSLMPEPVAQEEAL

SEQ ID NO: 19516 - protein, 453 aa, Pseudomonas aeruginosa
MDARTRRSRAHEPLADPADPAPPVCRQPAAVAAGRALAARPVVARGAGTDPPEPAADTYGRQRRPERLCPGQLGRAVRHRAHARSSRRPDAAGHRGARQRRADLRAAWRRPPGQAFPRVVPVPAARYQRRLPDRRPVQPVRVLRDTPDRLLRVAPAWRRRGAGALGLALRDPKPGRLGVLPDRRGYPVWPHRHPEHVRHGAEDRHGRCRARAAAGGSRAPAAGGVRPEGGAVAAVLLAAARLCRGQRAGGGAVRDHDQGRHLLDPAGLHAGLRRCRRRAGQPGAGLALAAGPGDPWPGRDRCLGGADPAKPAGLPGGGLRRNPPGWRGVGQRAGAGGVAVLPAAQYLDRRWPVPARRPGRPPARRQGRRPGPGPGVAESSVARRGFLHRRHRRCRSAAIVGVLRQGHAFAVGRSRQPGAGPMERGTGQRPGGAGGVEPGRQHAVLAHRAYRAR

SEQ ID NO: 19517 - protein, 229 aa, Pseudomonas aeruginosa
RRTGPRPLVRLHPVALRRPVAGVRREAAAGLRPGHRGAVARPRPVSPDHHPRRYRMISRSLPRPLLRVLPHPVLSVLLLLVWLLLVDSFAIGHWLLGAFLGVCIPLLTNRLLVGRSQEWHPLLLLKLLALVMWDILVANIQVARLTLGPIERLRPAFVEVPIELENDLAISVLVSIVSLTPGSVSSDLSDDRKTLLVHGLDVPDKAALIAEIKQRYEAPLKEIFPCSLT

SEQ ID NO: 19518 - protein, 370 aa, Pseudomonas aeruginosa
  UNSURE (255): Identity of amino acid at the above locations are unknown.
TEGVSMTVDHRQWAREAIRIIEADFQRSADTHLIPLETPGLPGVELYFKDESSHPTGSLKHRLARSLFLYALCNGWLRPAAPVIEASSGSTAISEAYFARLLGLPFIAVMPASTSKEKIAQIAFYGGQSHLVEDPTQIYAESERLARESGGHFMDQFTYAERATDWRANNNIAESIFQQMRHEPYPTPTWLISSPGTGGTLATLGRYVRYRQHCTRVLCADAERSVFFDAYVSGDRGLTLDCGSRIEGIGRPRVXASFLPEVIDAMVKVPDAWSLAAMHYLARRLGRRVGGSSGTNLIGALVAARQMVAAGEKGSLVAILCDGGERYATTYYDPVWLARQGYALEPLVEALAACIERGVALPDGLLVAGL

SEQ ID NO: 19519 - protein, 296 aa, Pseudomonas aeruginosa
GHAKQLSAIEHSPDPSRWSRPQRRDVGAQQAPLFHAHRGVARAGAERPRLDPPSPPGAARLARAVANRGDRRQCQQHRAHRRHRRRAHRARNPRLPGHRRRRLHPRTAPVRPRGQRADRHVRPGLPLRFRPGPPGQRADHVLPAAGTGLLLRLQQRRAIQRDADAGAPGRHRDHPRTAGRIQCADPGRAPARDPRTLLRAAARADPRRRRRPVDQPGAAAVAAGRRRRAAPAATAAPRPGVRRTLRARLRADLLPAGAPGRAGRRAGPAVDPGRRHLWHQRQPQSLGFPPRHAARR

SEQ ID NO: 19520 - protein, 312 aa, Pseudomonas aeruginosa
RPLRGDPACAGRGADRRARRGGAAAAGGLAAGPAAAQRGPAGSGVVRRASVRADDGQPARTHLPGRPPGFRTPFARSGACAAGQRQRLRGNAVPCHGRTGGPWQSLCGGTLPPSLGAGQGDAPGGAGHRAGQPPVVPPRPTARARDRLAGRTPGRRRGATGDRPLQPRGIAACDGARPRRRTQAATGGRRGRQAYFHRGVAPGPAVHPQARQSPAEPALRQPRQSGGAGAARGRRRGTRRSGPCGVAAALVQSDHRRTGTRPARDLAEPGPGRTRRFGEAPAGAIRKFATRLMETEAYGYLELGGEAPRRPA

SEQ ID NO: 19521 - protein, 163 aa, Pseudomonas aeruginosa
LGGVRRRPDLSGSGRRGGAQAFRSHLCGGARPRERWLLAELAGGRRLSGRRGLRRLPRNARRARLEGLGAQQPRLPGHRCQQRRGTAGDLLHRRDTRAAGAARPAPGVAGGHRAMAAPHVLAAPGGSGGGRHPAAPGRYRALRPVAGTPRHKKTAREGRFRMR

SEQ ID NO: 19522 - protein, 285 aa, Pseudomonas aeruginosa
RPAGRRSAWSGRSLRESVGSWLQLQVRALHRQQSLGTPDHHHDHGQAEDQHAVFVEPAHFLEQHHHHRGEYHAELRTHAAEHDDRKDHRRLDEGEGLRRHQALAGGEEAAGETGEAGTDGEGGELDDGRVETESAAGHFVLAQRFPGATDRHAHQPVDHEQGQQHQQQGHHVEQDDLVVGVVGDAEELVEGLHAFRRAAFEGQAEQGRLGDRADAVGAAGDLGHVAQQDADDLAEAEGHDRQVVAAQAQHREAEERKPNSAAIIPAIGRAVQKPNPAYSASSAYV

SEQ ID NO: 19523 - protein, 439 aa, Pseudomonas aeruginosa
TFGSRVWGRNAAETRHDPARGGPAGGRGKPRSRPPGVNAAGLRLPLPGRRSRNHAGTKTKPTVGDVGSVLQRCLLDLGPGGVLVPLVDGEVEVLQVALLVEPEVPGGSLEGVGAQGLGDLLRIGLAGFLDALGDHCDRGVGGQDEDAARILVLRLEGVDQGLVLRILLEGARQGRQHAFRSVAGDRGDFAVADPFRAHEARVQPGLLGLAQQQAHFWVVAAEVDELHAGFLQLADQRVEVLVAGVQAFEDGNLDAGVFHGLLHLGGDAFAVLLLVVQYRDGLVLVAFGDELAGHRALHVVQADGAEDQLVAARGDFRGGGRRGDHQHAFVFVNVGGGLGGAGADMADHELDAVVDHLVGDRHGLLGIAGVVVDHAFELRAVHAACLVDLFDCHQRTGALHVAVLGYRTGDRASQGDLDGVGGHGVAGEPGNGHRGEQAG

SEQ ID NO: 19524 - protein, 298 aa, Pseudomonas aeruginosa
SVGDESHTGKQVRSHEHQFRQSTRYPPAGPQLPRPARRSAGQQPGQRRYPELQGSRPGLRRGSRRAEGQGRQGYLRHPHHQRAAYRRRRFRHGRGQPAVPHPGPAVDRPEHCRRPDRAGQLRRERHALPGVLHLPQQQIQRAGQRPAWRVTAMSLASVFNIAGSGMSAQSTRLNTVASNIANAETVSSSVDKTYRARHPVFSTMFQQAQGDSGSLFADQDSSGAGVQVLGIVEDQSSLMPRYEPNHPAADANGYVYYPNVNVVEEMADMISASRAFQTNAEMMNTAKQMMQKVLTLGQ

SEQ ID NO: 19525 - protein, 238 aa, Pseudomonas aeruginosa
SMSIDNVSGTSSNTGNVNGSKRAAGSGATETGQSVKGSSNLGKDEFLKLLVAQLKNQDPMSPQQNGEFIAQLAQFSTVEGVQSLNKSMESILSNYQSSQALQASSLVGRKVIVATDKSVVDTKDTFKASLNLPVSSSNVWVNVYDDKGTVVNRINLGQQAAGSVSFMWDGKDSSGNIMPPGTYKFEAQTSIDGKTYGLQTYLPANVDSVTLGQNGGELMLNLAGLGSIALSKVQIIGQ

SEQ ID NO: 19526 - protein, 471 aa, Pseudomonas aeruginosa
AGVSGKELSMSFNIGLSGIQAASSGLNVTGNNIANAGTVGFKQSRAEFADVYAASVLGSGSNPQGSGVLLSDVSQMFKQGNIDSTNSVLDLAINGNGFFVTSNNGAISYTRAGYFNTDKQDFIVDNNGYRLQGYAVGPNGQLQNGVVTDLKVERANQAPQATSSIQQSYNLNSTLKPPTVTPFDPSDAATYNSSSSLGIYDSQGNSHTMSQFFIKNEPDPNATPPIPENSWTMKVLIDGVNPLDPSNKTPMSFNVTFDASGQMTSVRAPDGSTSGPGFSIDATTNVIQFSPATGNPPTPGTGWIPAASDGKTPPTYAWNGATGAASGISFDMRKTTQYSTAFAQSNPIQDGYTTGQLAGLEIDDTGVIFARYTNGQSKVQGQVVLANFANIQGLTPIGKTSWVQSAESGEPAVGAPRSGTLGALQSGALEASNVDISNELVNLIVHQRNYQANAKTIQTEDAVTQTIINLR

SEQ ID NO: 19527 - protein, 323 aa, Pseudomonas aeruginosa
RRAGAVRAPARPLPPAATPGQGLPPKPPKGGFLFYKILLNQCINCFFEFWHGACWITCKKARRIVPVPGGFDGQDAVRLHERGQPEHPGDACSCQQPGEHLDQRLSSRLRAGAFDAGVRRQLPGAGIRHERAARYRFQPWQPPGNRQRAGHRHRRRRLRRGPGAGWQRGLRAYRRHAYRRPRHAAHRRRLAGARQRWADRRAAGGKGGDRPGRHHQHPRPWREPQRGRRGGPDQTGQPEPEADGEGYRRPAALQAAAGRAGAAGRRQREGGLRFPGKQQRERGGRDDRDPLAVPSIRAAREDDAHRRGRFGGHGAGFANQLIT

SEQ ID NO: 19528 - protein, 510 aa, Pseudomonas aeruginosa
TPATSWCASPAWSAPTISPPTTPCPRPAWPTPGSPTPAPAPSPMPVSRAGWTASSSARCGRSEDARDDQVQAPAGPRRAAPGRRRGPGRAVEGYRQHPGRADQPVDRLWPGGRPERQRRPDHADAVHPADLQQHAGAVRHQGAGQRRQRAVEERRRGIGACRPAAVRQAGPADRRHRVVHRQRQEPARRQPADDSAERYRRPGLRGRPGQPGGRRLRRRRPRRLEDHRQRTVRRTYPGRRHRRTRGAERLRPGQQPDAEPQPPGLHHCQAHRRPHQRTARSGRRPCGGRRLGAGQRAARPEPAGRLPVDPGEPRRAAGRGGGQGHHQFAHRHHRHRPGRQGIAGRRHPRQPDREHHRGPDRQPARCLLQRPDCGGATLAGERRGGDQADVQVRSRHHPGRHRPRGEPGRRRAERPDGDPRSPEAGRRVAGRLDRDLRTTPWIPVCSAVSAQAPTAAPIPISTASTSSRSARTATARRTSARSPRNSNRCSSTRCSNPCVRPTKRWATAIS

SEQ ID NO: 19529 - protein, 302 aa, Pseudomonas aeruginosa
SKAPGETAKTRSPGSPRTAPVAGRATPARRPARPCRCRKPAATTRSCSTRGAWRCRASWPSACSPASFPPPRRPPARCRAWARTATCRRRATRRRAAAVSPPMASTARAAGASPSRRWPRASRCSPRPTSSSPPCCRWPRRPPSGSASMPATWWPRPRWRPAGANRSSASRMAAAATTCSASRPAAAGMVPRRALSPPNTKAARRSRKSRRSAPTRRSSRASTTTSASSRATTATRTPWTAPPTPSASCRNCSAPATPPIRSTPARWRRSPDRCRPTRPSPPPARRLWVEQGGTDPCPTYSR

SEQ ID NO: 19530 - protein, 365 aa, Pseudomonas aeruginosa
RPDQGSHGGRPLPDARTLTMATSTLKNVRFAGMATCVPKRVISNLTDCKPQLRAERERLVRNIGIETRRMAQEWQCFSDLAFDAAERLLESLEWKREEVDALIVVTQSPDYLAPATAIILQDRLGLPHSTVAFDVNLGCSAYPFALNLLGSLIAAGGVKKGLVLVGDRGASVNDPIFSDAGTATALEFCEGAPPMHFDLNSDGSGYKAIILPVGGHREPVGVQHLMPFREDENDHWHRAIDLQLDGTAVLSFSTQRVPPAVEKLLDYAGASKDEVDYFVFHQANRMINETIRKKLGLPVEKVPSTLRDFGNTSGASLPVTMTARINRELEAGRNRVLLCGFGIGLSWGTCLVDIEGAKFPDLIES

SEQ ID NO: 19531 - protein, 254 aa, Pseudomonas aeruginosa
RDRRGHPGSGTPPGGAGRTFAAVHARRLRGAAGAPAPVVSRAGTGGEGMKQTIIVGEGRALERADSTARERGLEHRVLELNAADRHNFDIAPLLERYPAAESEVFVALDERAVNYARHKLIADIRLAGYRLFDIVSPQAIVGEGVRLLGNVFVGAGCVLAGRARIGTGSWLELQVLVEEDCRVGTCSTLLAGVQLGRRVEIGQGSTLGAGSVALADTRVGRHCEWLLPGRIPRELPNYSFYDELMPDGARILNN

SEQ ID NO: 19532 - protein, 292 aa, Pseudomonas aeruginosa
TGSRQHRHADLQAGVLRGCPRQRARADLSGPGADHLRRQQRRADRHAGRAEARLRGIPDPLLPQRDAPRRAGQHGERHPPGGGRVRQVSPRRRRVASRMRRGVGGSDGARAERGPGLVAAVAYRRGRAAAAGHPGDLLPVRRRRPDRRSRAGLVPRRPHHQLHRRTQLSDGPARCAAADLRAPDDAQRPGHRLDRRPGHVCAVATAWRPGVPVAAADPFPRLPPAVQPDRARPARYRRAGPCRLPPGYPRTGLVSPGRRQPLRPGGTDHPPGRPCLQAGQPARRAEAGGGLR

SEQ ID NO: 19533 - protein, 132 aa, Pseudomonas aeruginosa
EVATMDVSNVNNSTAAPVIRLFGSASSSDGARPAGQAGEAAASASAQRTGDVRMGDKEQRAAVEEAVSSIEKFTQSIRRDLSFSLDDSTGRVVVKVTDSTSGEVIRQIPSEEALRLAERLDEARSLLFKAEA

SEQ ID NO: 19534 - protein, 132 aa, Pseudomonas aeruginosa
RTTRASSRKFPSCCATSNPVGMRLPPERHPQRDQAMSAAVQILEETGSALRVALASQNWEAIGELDQRCRQAVDEAMLDVQDEATLRARMEELLALYRELIDVCQGEQRKLATDLIQLNQSKQGAKVYQMFG

SEQ ID NO: 19535 - protein, 428 aa, Pseudomonas aeruginosa
KKFRHGYCYISVDRQNHDVAPTERNAMQPALNAFPEQPADTAEATSRAGLEQAFALFNQMSSQLSESYSLLEERVTELKGQLALVSAQRMEELAEKERLANRLQSLLDLLPGGVIVIDAHGVVREANPAALGLLGEPLVGMLWREVIARCFAPREDDGHEISLRDGRRLSIATRSLNGEPGQLILLNDLTDTRRLQEQLARHERLSALGRMVASLAHQIRTPLSAALLYAGHLSEQALPTDQQQRFAGRLKERLHELEHQVRDMLVFARGELPLTDRVAPKALFDSLRAAAEVHVQGLQVRWQCEARGGELLCNRDTLVGTVLNLVENAIQACGPELRLKVHLYARADSLRLSVSDNGPGMDPATLARLGEPFFTTKTTGTGLGLAVVKAVARAHQGQLQLRSRPGRGTCATLILPLIPAAPLSAIQE

SEQ ID NO: 19536 - protein, 412 aa, Pseudomonas aeruginosa
PHGSQNPAGRRRPRSTRSPQRHPAAGRSRVRRRGLGGGGAAGPGPRSLQPGDQRREHAGHGRAPVARPDPYTLPAPAGVADDRLRRGRSRRQGDAPGRRRLPGQAVRGAGAARPGGTPCAGPVAGQRGGWSGGPGAGQPAVAGTGRAGRAQRFHRADLRRVRDRQGSPGELYPPAIAACRQAVHRDQLRGDPGQHARGHPVRPRERFLHRRHCRPARQVRAGRRRHHSSRRDIGNAPRPAGQAVARIAGARGGAGRCAQADQPGYPRACHDQPRPRGGSRGGAFPRGPLLSPVGLPAGLAAAARTPCGHPAAGRASAAQAQPQDEPRRGGARPRGRPVPGPACLAGQRTGTRQRHPACVDPATGRPDPARRPVPHRADRHAARGPGAGAHAGNATGHPAERRDSVAGRRPGR

SEQ ID NO: 19537 - protein, 350 aa, Pseudomonas aeruginosa
ESSRRQTDQGRQGRHPAPVARRDRRGAGAAAHGTERGAAGRRGHGVDAQRASRTGRAGDGRVRRSGRRPDQPRRRCRRLHPQDAHPGPRRGQGQQPDRPHPPRRQHQRPGQPEVDGAACRGRRDPLRTPADPGHRGRLPRSRPGRRGAQPFRPQGAPGYRPARLLAEHRAALGAEGTQPDPGEAVRRQFQRHPHHHGRGQARGGHHELPRQLHRRPTDGFDPRGRRRPVRTDRGPDVRLRQPRRRRRPWHPGAAPGSLLGRTGAGAQGLRRGDPREGLQEHVQACRRAAARRPGGQGAGTGQRSGRCAEGNPHHCPAHGRVRRYRAGRQGWRGDDLRWSPTTRTKTIPAN

SEQ ID NO: 19538 - protein, 480 aa, Pseudomonas aeruginosa
SNCSSNSANRRPIRWPATSGSTSTPPETSMRLERTSFARRLEGYTEAVSLPAQPVVEGRLLRMVGLTLEAEGLQAAVGSRCNVINESGYHPVQVEAEVMGFSGSKVYLMPVGSLAGIAPGARVVPLPDTGRLPMGMSMLGRVLDGAGRALDDKGGMRAEDWVPMDGPTINPLKRHPISEPLDVGIRSINGLLTVGRGQRLGLFAGTGVGKSVLLGMMTRFTRADIIVVGLIGERGREVKEFIDEILGEEGLKRSVVVASPADDAPLMRLRAAQYCTRIAEYFRDKGKNVLLLMDSLTRYAQAQREIALAIGEPPATKGYPPSVFAKLPKLVERAGNAEAGGGSITAFYTVLSEGDDQQDPIADAARGVLDGHFVLSRRLAEEGHYPAIDIEASISRVMPQVVEAEHLRDAQRFKQLWSRYQQSRDLISVGAYVAGGDPETDLAIARFPVMRQFLRQGLDESESLAESRARLASLLSGGQA

SEQ ID NO: 19539 - protein, 169 aa, Pseudomonas aeruginosa
GALRHGEARGAAGAGGGHGQQGRAGCRDPAGQVPAAIARGTAEAGGAGTLPQRLPAAMDQPGPEGRQRPVADELPALPLATGDRRRPAGQQRDLAPRGGGQGAAQLAGEIRPPGRAAQAGRALPGRGAPGRGQARAETARRTRPAYPPPGRLTTQKNGRDAFSMNVVSQ

SEQ ID NO: 19540 - protein, 222 aa, Pseudomonas aeruginosa
PTARQGRPINCYRRLFREAGQANHFHPVATAALGPVENLVGGAVELLVAGLAASVEAGHAEAGGQAEHAVLRRQRGTFEAFAEFFRKAASLLLGGVGQEQEEFFPAQARHAVAATGIAAQQVGGMADDLVAEGVPIAVVDVLEVIQVDHQQAQRLRLASDTRELHEHQLVELATIEQAGQGVVTGQVLQLAILLLQLLPLQLQLALLAQVAHVAVPEDQRQQ

SEQ ID NO: 19541 - protein, 169 aa, Pseudomonas aeruginosa
ARPWRRRSRPPAARSPATSTRYSCSSRAPSSTSLRSTPCCWLNTTSPEASLSSARVGRWRAKCFFSARKGLGSSLQRRPAASRPSKSSWRQPAGLCNSRVAGSIVSARAPGSSSTRWSSTLNCGSSITSPSTLTQPPSMYSSASRREQAVSSARRLDRRIGSVMARLLE

SEQ ID NO: 19542 - protein, 214 aa, Pseudomonas aeruginosa
GTGEETLMQSRLIDGLEWDLDEDGSGGLCNVHGDKVHLRQGDMDGACGPYCLVMAMLVRGQLRRRQAKGLERVDSRSRYGRLMKALDQHGPLLRVGTTGVDLLELLAEINDTEHFALKGEGRRLVRHTREYLEAGFPVVLGFHGRKGSDIRHWGLAIGMSERAFLLLDPAHDLPRGQAWNAVITSEAHGSRFGYRYINAKGTWAVTLKEMVALL

SEQ ID NO: 19543 - protein, 599 aa, Pseudomonas aeruginosa
PAEPQPPSERRMPAILSSRQRIALRLAWRFMAPYRWRMLGALVALLFTAAITLSLGQGIRLLVDQGFLTASPELLNRYILLFFVLVLGLAVGTFVRFYLVSWIGERFVADIRKRVFDHLIELHPGFYETNRSSEIQSRLTADTTLLQTVIGSSLSMALRNALMLVGGVLLMFVTNAKLTSIVVLALPLVIAPILLFGRRVRSLSRESQDRVADVGSYVGETLGQIKTVQAYNHQAQDRQRFAGTVERAFDTARKRIAQRAWLITVVIVLVLGAVGVMLWVGGRDVIAGSISAGELAAFVFYSLIVGMAFGTLSEVIGELQRAAGAAERIAELLRARSEIRPPAQPRKLAARVSGRIELQAVRFAYPTRPEHWAIDDISLAVEPGETLALVGPSGAGKSTLFDLLLRFFDPQQGRLLLDGQPIVELDPADLRRSFALVSQNPALFFGCVEENIRYGRPHASAAEVEAAARAAHAHEFILGLPQGYATHLGEGGIGLSGGQRQRLAIARALLVDAPVLLLDEATSALDAESEHLIQQALPGLMSGRTTLVIAHRLATVQSADRIAVIDQGRLVAIGSHARLIAENPLYARLAELQFAAGGR

SEQ ID NO: 19544 - protein, 289 aa, Pseudomonas aeruginosa
NAAPSTGGDNMAVIGRFNSLQVVKHTEFGLYLDGTQHGEILLPKRYVPKDQPSEVGDWLNVFIYLDSDDRLIATTQTPKVQVGGFASLKVVEINRIGLFLDWGLPKDLLLPHSEEKRPLQVGDYCVVYVYLDKRTNRITATARLDRQLDNLPPRYSVGQAVDLLVVERTEMGFKAIIEGKHWGLIHKNEAFKFLRSGMREQGYIKELRADGKIALSLQPVGAEAAVELSQQILARLLEAGGSLPLSDKSSPEDIHRLFGVSKGTFKKAIGGLYKKGLILIHPERIELPR

SEQ ID NO: 19545 - protein, 606 aa, Pseudomonas aeruginosa
LSVWPSRRTLSMSTASRARAILVRVLRLSGLRRSRLLPNSTLLDMPNSQPSSRSSKPCSWSTAICSALRPVCGGLVWQPARPSTRLNRARASNLLGWSLWGSTVYLLFFLKDAGVVEFRQAPAAAGLALGDVHRHVGVVEQRRRGIRMLGIEGDADGQRGTHRAAVAEPDRRLHAGDDVVGDAQGVGAGRQRCEQDGEFVAAQARHQVAFAQLPTDAHGDVDQHGVAGGMAEAVVDLLEAVAVDEQHRQLLAMLVGIAQRPAQAAFEEGAVGQAGQAVVVGLVRQRGVLVLQARLPGFEFVEQGVEVLAQLAQLGDAGFRYALLEIPFAAHGMRDLRQLVERADDTAYQPPRQVEGAQGGKQQAQDHAGETGEQEAQQAAAGALHLHRTDLLAVVQDRLFGRRAEQPVRQLLFQQVQRPGAFPMPTGQGLSLAVVDDGAGDLFAGGDQRQGLLGGLGIAEDHRGFDGIADGTGDQLLVGVGIGAQGQQADQGHRQPGGEYRDQRHAQVRAIEHPAQRWIGTRIATTTVHHGVACRLASFNTLGCTRTPLRAMESRLASKVMRGPPTLRQNMLPTLHSVPRSLMDRTGCPARLRNTCWRSRSSTTPR

SEQ ID NO: 19546 - protein, 577 aa, Pseudomonas aeruginosa
CSCGTSLNVPVSLGARMIGGAPVLRRGSLVPSGVFCQLPPPGEEGGSRTVVGRIVATLVKPPPRARLGVRSRPSGEQRQMPGAVDFKERISRQRPHDRETYGHAGNTDLQDIVYQLESDRGRIVNSAAVRRLQQKTQVFPLERNAAVRSRLTHSLEVQQTGRFIVRTLFRQLGPRAAEVGLDGLEGALESLVEMACLMHDVGNPPFGHFGEYAINDWFERNLDALFERRIPPGQGDGLLQQRMLTDLKHFEGNAQAIRLVVKLLRLNLTYTQTAGLLKYVRPAYEPKPDKAAANHYLNKKPGFYLSEEAFVDELRQVLGMRPGTRHPVAYIMEAADDISYCLADIEDSVEKGILDIRQLADLLVKKFAVHHSPDAPIPGDADNMSFQRMVDYSLEKAEREPINKVSEFFIRLRVKMIHPLVQHAAQQFIDNLEAVHAGTLGRALMEDGSLPHAIVQTFKDVAMEWVFCHPEVETLELQGYRIIQGLLDFYAPLLRLPAEEFQALAEGRQAAAPHPQLLVRRLPSQQIKAYLEAMKGVAENPLQRQWEFYHRCRMLQDFVSGMTDQHAQDEYRALSAL

SEQ ID NO: 19547 - protein, 272 aa, Pseudomonas aeruginosa
MWLNAALTSENCQEPWNAGFHPFRTRRPERLHDHRPAPQLPSLSPGAGCQYLGAEPQHAQPRGAARGEAAQPYQPFGGADRCRQRAGGQAGGWFPGDRRGARRARCLSHLAGGPAAPERAARCLAAAAGAGPQALHRGVSGPATGTFGGGPHGRHRRRRLRRRHPLRRHGAPGHGRGAIDRGAALGGGRVARLPGAPRRAPAAGRPVAARLHPHAPGRQLVLQMGTGRRRADGRGRRARPFQRQRKQYGGRRGPGRHWPGLLPGSGNRRGAA

SEQ ID NO: 19548 - protein, 240 aa, Pseudomonas aeruginosa
RPAATGIARLDLDGRAVLPLLSEPTPAATRLAPTDGNDPRRLAGACLNRPPAKPCKEPPMLTGLNHLTLASPTCRPASPSTAIFSAFAWKRAGTRAPISNWVRCGCACPGSRSTVGRPRTTRTTPSASPPRISPASPRSCARMACANGSRTAARAIRSTSSTRTAIAWRPTSATCAAGSRRAGKRPMRECVSPTRPWPCRKLRTPRPGRRGASAGAGGWSPARRRVPAGRPTGPSPGSAA

SEQ ID NO: 19549 - protein, 356 aa, Pseudomonas aeruginosa
RVDQGEQQQAAALQGEAQAQQAGVVQAPLAEVHAEGLGEHREHAVEGQRVADPGAAPVKLLDHEERPDHHHRLQAEEYQGKHRQQESDPRLPSQAADRAQGIHPPRVQAAASRRGQGFLEEQAGEQGVEQAQAGGQQQRQRRAVHRQQPTEGGAEDHAQSEAGVQPAEVPGALPVRAEVSRAGHRGGHAGAGEPGQRATEEQHPEAVGQRQQQIAEGEAEHRQDQDGAASEAVAEAAEDRRKEQLQQREGHHQGGAPGGRVADRQRRHAADQRRQQGHDQADASGIQQAGEEQQRQDAFRAGTVFPRGGGAEAGHGHARILPANTGNPDPGTPARARETAGIHRFDERSRQRRRAA

SEQ ID NO: 19550 - protein, 271 aa, Pseudomonas aeruginosa
RYFPPVASKGISITPRKGKLPAVLACMASLAGCNINPANQGSVSSWFSMRAGDPPSFVTGVVGFENTGSNDPSTRLTLRFRDPASKTHAAHVTTSSYSELFSLALTPRYYELYEFEVRYLSYTVTRETGAYEERCEANGEALEKTVQKRKRSVTHTAVNVESNCRSTPLTKTDYYYETYTSKPFSAPFRAESFATNYIGDFRVQCSYKEKKGKTLVDSCHLNYGAVSRDRVDAWVAQMNEADKDKREPLPPVRQQAVDTKKAGKLIHSVFR

SEQ ID NO: 19551 - protein, 266 aa, Pseudomonas aeruginosa
GFSPMGFCRQAGDHAEKARNARAMTDYASLLFDSVARLRKAATTEAVCREMVEFAARLGFDRVIVCSLFPRPGEDELIDELFFVHGDWAEGRSAQERDAYLLHCPVTRHILELDEPFFWSKSPSEDPERMTYRIVRGVRDLGQVNGMQVPVFGRNGLEGAVSFAGERLDLNAGCKLAAQAFCPILFFALKRLRGPVSAGDAQALSEREREVLQWIALGKQQAEVAAILMISERTVENHLRAARRRLGAASTAQAVARALRLGDIEV

SEQ ID NO: 19552 - protein, 368 aa, Pseudomonas aeruginosa
AASGSGREDDLADVLAGVHQFVGLARLLQGEGAEHLRPDSAGAHVRPDLALQFGDDRAFLVVASRAQGRAKMDQALAQHREQVDFCGLALDHADLHDPSVHRRRLVVPRHIVAGNDIDDHIDPATFGAAQHFLDEILLGVVDRQVSAEAQAGLALGLAGDRGKDFRRAEGLAQHGRGGADAGGATVDQQRLAGLEATALEQVDPDGHEGFRQRRRFLHAQAVGQVQGGALVGHRELRVAAAGNQRHHRLADGEAADLAADRPHHAGDLQAGNVRGAGRRVVHALALKHVGTVDAGGADFDQDLARAGRRQRPAGRHQYLGAAGPGDLDGGHSFGKSVRTAHRMLLGKWFGPGSHGKQRGCRGRAALFH

SEQ ID NO: 19553 - protein, 343 aa, Pseudomonas aeruginosa
APSDRGDFHGNPKHPAFGRTDARTGARSGRQCRRRGATGRGDQRLPWPGAVLRRAGQRRTAAAGRRSAPGLAGECRRRPAAGDGAGRLPDGQRAVDQPFRAARCRRGDEGAAGKLLPRGARPAIRRRRRQPPGPRLAHRPRPAIAARRHGRLAGGRAEAPGTDQRRPRASPPVRWQTLRSGPAAGLERHPWRRRRSAFAGDGQRQLLRPPRPRRPHPRRPRRAGRLQRRADRRKHRRRPGRGGQGGRRLAGQPGPLRQPDEPRLPRAGRGLRHRSEERRGNLLDGHVRFALKSSAPGADEGLGAFRKRKTRRHGAGFPFSLSRPQCGALRVRRMCRLTSLYSR

SEQ ID NO: 19554 - protein, 182 aa, Pseudomonas aeruginosa
RLGQFVVQCQQAAGIAEQRIAGVGRQHVAVAALQQAVSGHFLQAANLLADGRLGRVQARGGSGEAAAVGHRDDGAEQVEVEQAAIRFFTVAHGRIAFSNVVAAFSRPCRQRQPLSVDAACPAVDQCAGSGGKPARRSCMRQEQDRGALLGHLDVDLQRVVAPVLQVAVDQAARLVAVDPHDL

SEQ ID NO: 19555 - protein, 298 aa, Pseudomonas aeruginosa
RRAAHRDPQRSRGLRREDGRDHFEAHPAVADAVVVGVEIGQRASQVEALDAGKVGGIQVVLDVQHQPPVDPPRPADLEHPRQRRQLQALADVDAGRDHRRAEHLGLRHPALVGDHRVEVAAHQRVVQQPLRRDEPAAAFLAVDQALVLQLAERLAQGDAGGREQLAQLPFAGQLAAAREQAALDLLAQGLVDHRQGAGRLVAHIDASPLGLRGGYRVMLPGRRRYSAARLLSAIPALASRPRGRARAAPGRGSPCAAGRPARAAAGRCASRNRRSRRPASRPPGPARLRGDGPCPRGR

SEQ ID NO: 19556 - protein, 378 aa, Pseudomonas aeruginosa
TKSRAKRFDFFEGLPGIGAFSCPGGTFGRDFSTYFQEIGIDQIFDDTPAPLVRRAPPLDGRVSRRSARLRDLAPDRTAMLRNVTDLDLRLLRIFACVVKCGGFTAAQAELNMSQSNISMHIASLEKRLGYRLCERGKGGFRLTAKGRRVLEASRTMFDAIGLFRDQAQALSGRLVGELYLGLADNLATLPQARFGDALARFQRRDQDVQLNLFVNSPTELELAVIEGELDLAISYFSRSRPSLEYRPLYREEIGVFCGDRHPLFAEAQPTLERIAACDWVMHGFLPENLVLPLRPSRSRATAYHMEAVAHAVLAGTHLGYLPTHYAEAWIERGRMRALLPERLSYPVEHSMIVYAGRPLSEAARAFIDDLLQVHGLGS

SEQ ID NO: 19557 - protein, 542 aa, Pseudomonas aeruginosa
AGPRRARSQRAGTTGGGAGTAGACGSVRRRSGEAEAGGDAPMRLGDEHVEQAERGQRGEHHDHRPDLEPGRVGRGEAGPRPGDVERLERQPGDCQDVHRQPRASQAQGALVRVPAADEAGPESAGGDDQEDHEETAAAERDQRADRRGVQPQGQAEAGQQRAADHRRHRHLAPVDPAQQGGAGQDGVARHAEDRPADVGLHRHHAGDEGDQHHCDEWPLGPGAEGVHHRRGDRVDHLAADHRADVLVGQGHGEGGEHHGESHHQHRAQDRPGSGDAGIGGFLGNLRAGVEAEESPAAHRQRGQHAVQVGTVRIACAARAAEQQVERMVAEEQQQQHADTDGGDGLGDDPGIDEVLQRVDPQQVHRQSQRQQQRAAEHLAVGRRRRAGRQQAEPEATEVGHGSQRGQRRSQVEEAGEPGQAVAHQAPHPLVAAAGQRKLRGQLGVDQRHAELQQQAQRHHPDPGGAHAHGAEGHHRVDAHHRRDGGEADGKGRPQAQPALQFLAIAVGRQQAFVAGGIAEISHGGLRASAAGKGKGGCHRCDG

SEQ ID NO: 19558 - protein, 95 aa, Pseudomonas aeruginosa
KSTREGSDMKSKISEYTEKEFLEFVEDIYTNNKKKFPTEESHIQAVLEFKKLTEHPSGSDLLYYPNENREDSPAGVVKEVKEWRASKGLPGFKAG

SEQ ID NO: 19559 - protein, 90 aa, Pseudomonas aeruginosa
MSMALIDLARNFLDGSLSGKSFTKKFFEMWRSEGASGLLKKDDDNLGACLRLMFGMADCFTDGPKDNDGEINEEELKQEVRGLLKKYKYI

SEQ ID NO: 19560 - protein, 320 aa, Pseudomonas aeruginosa
AWVWIASSKAWRRMYWRHSGLVIRRYTASTRLLATRESAVEKKPRLRMTMRRSCSLRPSLLFHRAMSAFMLTSCGIQWLAQPSRYFCQAQSYLKGTSWLRSARALIICLSPTCTRAAEPSRSSRPSWMSRSFRAFLARATASESSAETARASSTEPAASSSSLSWPWATAWAAAGAALASVGSSLSNSSQLSILLSPGLAAVSAAWIWGVRCTRKRWSGTVWPGRSSPPEGRRGLFLALARGLALPAWRWTSDRQAPGRPDPHEESGLPGRDTDAVQRRAITGRLRSRGCRCCMPAAPAPASARRPGRLAGRRCHRPTRR

SEQ ID NO: 19561 - protein, 840 aa, Pseudomonas aeruginosa
CLQDVPRVLPRGPRIGYNAGRSEGAARRLRDRDTRRLCGARSLAHPDRRGRSTPGRADPGIPGRQRPEGRHRSQRRTGGGAYPRRTPGPGGARPDAAGRGRPVHLPPGAPAVRRSDPDAHRAHRRYGRGTRPGDGRRRLRVQAGAPACAAGAHPCPVAAQRGAGSGRPGGGQQTPGVRSPGDRQRDARGLAGRDHHRADQRRIRPALAAGGERRADSLPRGDLQRPARHRVRRPGPLHRRAHLADPPEDRRRPDAPAADQDRAQQGLPVRRRGLRRFFPAGRGAGVPVGQNQQQRTAAGGSPMKSIFLRIYGGMLLALLLVSGLGLLGLHWINEVRGEHYREELARGTFRLMADNLQPMTATERKRALAQWSRLLGIPLQLHGLDELRMDGRSRARLMNGQVLVKQTAEHAVTVYTQASAAENLVLSGEVQQVSEQLARATVYLLMDELVRYPASEQPYHLARIVRDKRFGFPVHLLQVKELDLDDDQRRRVVEGDTVMALGKDGDSIRIFAGILDTPWVLELGPLFQMNPYPPQLLLLLGALCLSFIGLITYLLVRRLEQRLRSLEAAATRIARGSLDTRVEVRGGDSVGRLGAAFNHMAEHIHRLLTVQREMVRAVSHELRTPVARLRFGLEMIETAETDGARLKYLEGMDNDIQDLDKLVDEMLTYARLEQGSPPLTYQRLELGALVRQVVEEIAPLRREVLVSCEEGALVPEELGSWIEAEPRYLHRALQNLLTNALRHADRRVRISFRVSLERCRVDVEDDGPGVPEAQWERLFTPFLRLDDSRTRASGGHGLGLSIVRRIVYWHGGRASIGRSETLGGACFTLAWPRKAGLRDR

SEQ ID NO: 19562 - protein, 169 aa, Pseudomonas aeruginosa
ISVSSSRSLARTRSLTWWMVALTGPSSTTWVPMVAMKRPSEVPPLVEGRVSRPVTALMLAATASSSSPGSVRNGRPDSAHSTCQSRPCLSRIASTRFCRPSTVDSVEKRKLNSAVSSPGMTLVAPVPEFRLETWKLVGGKKALPSSQCSAASSASAGAARWIGFFARCG

SEQ ID NO: 19563 - protein, 217 aa, Pseudomonas aeruginosa
ATWPCTPRMVSLAPREPRRPFFTTSPTRLVLDGSPTMHQSRRSPRAARRSTTALVPWWAGPSSSLVMRKAMAPLCSGWSATKRSTATIIDARLPFMSAAPRPQKHALVVDQGVEGLVLPGLQRAGGDHVGVPGEAQHRAVAAAPCPEVVHLLDAHRLQGEAGGFQAAHHQGLAVGVEGRDGGAADQLAGEFEGRRETRRRGGHGECILSGSSGKGES

SEQ ID NO: 19564 - protein, 890 aa, Pseudomonas aeruginosa
SINAGEGTPFRRAEPAVPTPRSTSTADPLGAAGQFLARFRQRREQGHDQRRQVGQRLHQEHGDPDQQVAARHALNRHDAGRRAPQQEHHEDFLAGLRQGHQQAVAGAHLRRAEERDAAGDEAVQHRLGNGVRERQAGEGGEERVAQVDADGAPVEEEDLADLEDEQGQRQDREDQQRRVDALGHDDHRRRPEQRAEGEEDVQAVGDPRQPAGHEVVALAAGQAAAVGTAAAQQGVGMPLHDLDRAVGPAEALLLEVDEGIGHHPLAVAALEVGGRQALLEHPQAQLGVLGDAPFRPSQLVQHAAPDHGHGAVLDDRVAVVAGDHADVEEALVLGVAEPLEGALVLVAVVLRRLHHGDPRVAEVRHHVPEPVGVDAVVGVDHRDHLDVRRHVAQGEVQRAGLEAFQRGDVEEAEALAQARAVRLDRLPDGRVAGVVVDHQDFVVRVVEAGKGVEGLLQQFRRLVVAGHVDRHLGPIGLRGGDRQEWPAPLARPDRLGQLVGLGEQHDDHPQRADAQQRADGQAEPGAVLLAVLVGDPHQHRGAGERDHGEEGPPALAHRGTVDQQQGEGEYREYRRGDGQGAPLGNRHHRPGEVELGLAVGVVDAPVGAHRAFGADLPGLVEGFDDEVAVAFAVERVGQAPQVDGLVRGCRLGAAAHAPVARPADLGEQQRLPREGGLEFARAFEHEVHRVGHRRSLPVGQDVGGDQVDVLRQFRVFAVDVPLFGGGHRNLDRRADPVEVGDQLFRRHLAAEQRLVADYHSHHARRLVGDADGAGDLGLVAGQVRAEPDAQADAQAERLGQRRDVAERALDRIGADAVGVPGDQFQVGAHLFGAGVAAALRVLVEAERREGEAGDAFRPVRYADRTVVQGPDAGEEGGQGDDDHQVEPDLA

SEQ ID NO: 19565 - protein, 444 aa, Pseudomonas aeruginosa
SRPARPVRGPRRRPASGRGHRGRTGRRVRRGARRETRPGAWPPRGGCSPAAGCRPGRSRRVAAAPGRSGCCAVARRAARRAAASGRPVGCRRRGDGRSWRALCRFPTWPTSHAALTQDCKSATKENGPRGPVLTDCAAHSCGMQVRLFVDDGILSCLDLSRRESLRGLPFFYASAQGSTLPEDVLEERLQVCPGALVGLAVVADVQAVAFVRVGVGVGEAVFGVVLDHHPVVGAGGVQFLFQGVEVLGRDQAVGAAVLHQDLGLDAALAGRGGGAEGAVEARHAGQRQALAGHVEDDLAAEAVADRGDLAGIGLRLPLQQFQAGEEARLGGVGIPGRGLHEGHRVLRVLGVLAFAVHVDGQGAVAEFGEVAGAAFGIVVEPPPFVDHDDPRADPRLAVVVGEIADHARAVCAPVRHLAGLDSGLGAGGAGDEQQGAEQAHGISP

SEQ ID NO: 19566 - protein, 87 aa, Pseudomonas aeruginosa
PGGGAPGPRGVAGGGEERSGRGRQPAAALHGVADAGDRLTDAGRPAGRRYSQERQQPGYPGGAGRRPESLPRGVRHPAPAGGRRQLP

SEQ ID NO: 19567 - protein, 363 aa, Pseudomonas aeruginosa
PFTQLIPRLTSALMSPWVATTWPSRVATITLQPVPQKRQGALFQTRLVTSASVTRLLARTRIGRPAAAAAMAAALALANSRRVRFIDCLLGRARYRAVGHGRRVVAIVVVQDLVVDQHGVEHSWQVLQLAQGVENLFFAFGFQHQDQLALRAFLVDLQAVEQRQVGLHRRQSLGSAMQDEAGDLQGFRHVVETPWWIARAVGWPGSDRAPGRRRSRCSAGCPARPGRRRRGPGGSGSRRVRRRPGNCGSGSRPGPGRLRRSWRSRGRPGARHRTGRPRSGWRIPRTACSRRWRGRVRRADRRRASARLPGRPRRRRRSLCSLRRSRRRSTAGDASAGARRGGGTALGDCSYPTSGRRPGRAGQ

SEQ ID NO: 19568 - protein, 250 aa, Pseudomonas aeruginosa
PRSAREGMLRWPGRKVRPHLIRRNLMKLLVVEDEALLRHHLYTRLGEQGHVVDAVPDAEEALYRVSEYHHDLAVIDLGLPGMSGLDLIRELRSQGKSFPILILTARGNWQDKVEGLAAGADDYVVKPFQFEELEARLNALLRRSSGFVQSTIEAGPLVLDLNRKQALVEEQPVALTAYEYRILEYLMRHHQQVVAKERLMEQLYPDDEERDANVIEVLVGRLRRKLEACGGFKPIDTVRGQGYLFTERCR

SEQ ID NO: 19569 - protein, 819 aa, Pseudomonas aeruginosa
AWTIPSWAAPASAYVSLQSETWRPLPTSEVFPRYAEVCSAGAVPLTQVPGIRADVQWQNRRQGLVGGHPGRCAVLSRRPGLHLPVAPARHHRGDLAAQRDPHRRPAARAAAPVAGDPALLRRGQPGGQPPVWRQPVDERGVPAGQPERSDLRRDAVTHQPGARGLRIQPAFGGSRALGRRADSALARRLGGRGAGQRLRHGAFPGNVGALVRGRCDGHARAAAVMHGQQPGGLASRSVGAGGSGQRDAPAGDPGDQLRGPDAPALRLHLRAPAAAGGRRQHQRVRHRADRLPEHLFHRRADRPRRVPPRVVPAAFRRAAAVPADGLDPHSRLPGLGDHGAQPPRAASGGHRRGAVPRRHGILGDRHGPGVAGGAAVQGQRGAVPDARLFRRTPGRAVVPGDHLCGRPGTGPRPGARPARRAYQLLPDGEALPAPGRRNLLGAHQRVAGARRGGSRPVLRHPGGGYRQSQACRAGARAPRRTDQAGHRRRADRHLGVGPGAQPPALGFPHVRPVRHPQRSRGDRRGAVEGEPACRGSRPRAARAGARRQRVAEIRLRVPYRPPQPRGSPPAGDRHADARRGQPSGADDRHQQRHHRDPHPGGNPARGKGTPAGDPVFHRRCRVDHRRRRPRDLHEPGGRGDDRLDLAGRHRRAPRTGLQRARQRHRRGPGKPGATLPAEHPGVLPGGRRHADQPQGRAARYPELRGAGAHPRWRDHRHRAGVPERHQGPGDAARAELSRLPRCPHRAVQPHQVRGGAATRPGQRPGAGDPACAVLHRPRPLQGGQRFRRARGGRHAAARAEPDSRRPHPRLRHPGAAGRR

SEQ ID NO: 19570 - protein, 283 aa, Pseudomonas aeruginosa
GSGAPAPRHTPRQRAARGPGERPLPVAGAGDRPGRPPPRRRPALRAAAATVRSGWPDDSAGRLHPGRRALQPDGQHRPLGDQRGADQLRRADRRGGGPEHRHQPVRQLAQRPAVPALPAGSHRTLAAEAGAPVLRADRDGVDEPVVGGFADRRQAARPRLQGGAGRLRLRPEFLQLPEEFRRRRDQDRRQLRPQPGQEPGGPGHRRLHQPDRPPPGRGDCGRVRREPGNPRSPGAPRGGFRPGLRGRAAAAVRHGARPTAQRASSPGVGLSFRLPPGAGTRRG

SEQ ID NO: 19571 - protein, 486 aa, Pseudomonas aeruginosa
RKSILAQPLQCLGKVPPRRFTTKNLPSKGGNATGERVPGNWRSAPVRTLPMTKQPFYKSLYVQVLVAIAIGIALGHWYPETAVAMKPFGDGFVKLIKMAIAPIIFCTVVTGIAGMQSMKSVGKTGGMALLYFEVVSTVALIIGLVVVNVVQPGAGMHVDPNTLDTSKIAAYAAAGEKQSTVDFLMNVIPGTVVGAFANGDILQVLFFSVLFGYALHRLGSYGKPVFEFIERVSHVMFNIINVIMKVAPIGAFGAMAFTMGAYGVGSLVQLGQLMLCFYITCILFVLIVLGGIARAHGFSILRFIRYIREELLIVLGTSSSESALPRMIDKMEKLGCNKSVVGLVIPTGYSFNLDGTSIYLTMAAVFIAQATDTPMDITHQITLLLVLLIASKGAAGVTGSGFIVLAATLSAVGHLPVAGLALILGIDRFMSEARALTNLVGNGVATVVVSKWCKQLDEGTLQRELAGEGNASSPASDIPVGGREAV

SEQ ID NO: 19572 - protein, 73 aa, Pseudomonas aeruginosa
TCSPSGVRRMPWLKRWNRTTPVRACRALSCWLTAPGVTPMAAAARVRLPWRAVSTKARSARSGRTAPMNSVFL

SEQ ID NO: 19573 - protein, 108 aa, Pseudomonas aeruginosa
TGCRKDRFSSADLGFSMCGETRDFSLAAFFGVREAAEAVSPVGAAPIAQAPDSPALLGYLPCLPSSSTATVHPTDSRSPSPSKNWGCPTHCTTFASTMASNAARNSCA

SEQ ID NO: 19574 - protein, 863 aa, Pseudomonas aeruginosa
LSMLPAWAPSSASACISRSSPKSGTRRPSNAIGGSPRRFSPPSTSAWPDGPGWPVSNTPSPISPPSAGPIRRGSSTSTSAIIATWTTGTGAWPCGLRCSAGSSCRNRRWVHERPAARRLGAGLRRAPWLSAHVRRRRADPGPVPAVAFLPGRHAGAAGPGAVGRRNRSTGIRRRLGTRRTAVRPTLRRCRTSVRPVHLPWLSGRADPPYRPGHRQRGACPAPTGRPGQGRGERRPVVRRTPGAGPRLRRPAGGVPRLRVGACAARRAVRPGPGLPAPTAARLPARRLAARYAGRRRTVAASAGRRHPAGRHRLRAAAGGLAGTPGGWLADLSGVDCRCVRATSPGREDPRLEDVHRGRRVPPAHDQRMAGPGGRPGVSAYAVARRLRPAHRAQRPDRAARRMACGGRQPCRPGHPVLRQAGSGSHPGTGRGGAAAVPVPPGRAAGEHGLVADRFGQPSLSARVIEGAGRRRLPCGTTDRRESPYMQRQIFETEHNLFRDAFRAFLDKEVVPHQDAWEEAGVVDRAVWRKAGEMGFLLPWADEEYGGAGLKDFRYEQIMCEELARINEPGFMIPLHSALCGPYIAEYGSAEQKARLLPGIVRGETILAVAMTEPSAGSDLAGMRSTAVDKGDHWLLNGSKVFISNGLLADLVIVAAKTDPANKHAMGLFLVERGMQGFERGRNLKKLGMKSQDTAELFFNNVRVPKENLLGDAKGGFFYLMNMLAQERLTNACGAVAGAEAALQATIDYVKERQAFGRPVAHFQNTRFKLAEMRTQIDVAQVFTDRCVMDHNQKKLSPEVAAEAKLFTTELLGKVVDEGVQLHGGWGYMWEYPICRMYANARIQRIFAGTSEIMKEIISRGMKL

SEQ ID NO: 19575 - protein, 274 aa, Pseudomonas aeruginosa
HQLPGVGRRRQLHRAPRTWPVAAGGTTGGPRRRFAAWRDGPAGGGHPPAADRRGAVRRHQHDRLRLQPERHGRRRLSRGRGRAGDGGAGAERRQLLRLLPHPRWPLVLGGQPGTAVHAAILRRHRPPGTGRPRPVAEAGRAAGAEARDRDGVRETRLRRMAGGVRRPGCLRGAAAAALRGAGTPAVAGARAGRPGAAGGRRQPGADGLSDQVFRRSAGASPHRRGARCRHRGGARRPGLLRRTDRRAEGGRGHRLNHSRSTSPVNTRVALQRRQ

SEQ ID NO: 19576 - protein, 522 aa, Pseudomonas aeruginosa
ERPEPASLAGLEQIEASRPAVIALQYFHRLVDRLQARGAAAAVGMVLADQLPVAQLDGGIVDRAFQLEQGEGGGLLLAALHARPETLQQPLDVGLAGLPQVTQVEVVVAQRIALFQRLRAIHVRMQAQAQRADLQVRLALGPEVVAQVVERVEQEEMGAEQHQLVGQFAMGDMRRMAGLQQLDQLVFGKSLGMLAQQAEDLPGEVEAVVEVGSHGTRLASGVGRGWGRRRFVRKIASFSPRTPGFQSTMGTLSVNQNKLQKRLRRLAGEAITDFNMIEDGDKVMVCLSGGKDSYTMLDILLYLQKVAPIRFEIVAVNMDQKQPGFPEHVLPEYLKSIGVEYHIVEKDTYSVVKEKIPEGKTTCSLCSRLRRGTLYTFADEIGATKMALGHHRDDILETFFLNMFYGGTLKAMPPKLLADDGRNVVIRPLAYCSEKDIEAYSQLKEFPIIPCNLCGSQENLQRQVVKEMLLEWERKSPGRTEIMFRALQNVVPSQLADRNLFDFANLRIDENATPRFLDVMNL

SEQ ID NO: 19577 - protein, 369 aa, Pseudomonas aeruginosa
TGLVGGLPGADFRRPAATGHGGRPLRSLRLLQPCQRPARWSRPAAGVGYAPVAERSLAGGRAKHAVALPGRRAAVDRYAAGLRGGRRRAVAVSPPGDPAARARRLPARRDGARRSRRRDRRGRRPGGLPEHPERGAEPAAAVAAPGRFRRHRPAAADPWRDRHRQGTVRPSRPCPEPATQRSDDQPELRSDSRDAAGKYPVRHHTRRFHRRREPQGHVRPGAGRQLVPRRDQFHADGHAEQAAAGPAGRQLPASGQPEPAAGRCAPDRGEQPAAAPGDRRGTPARGPVLPSGRGQPVHPAAARAPRRCGTAGTGVRPSRCAQPQPACHRSWRAGAGAVAGLRLAGQRPATGKRDPAQPVAARGGRRTAG

SEQ ID NO: 19578 - protein, 208 aa, Pseudomonas aeruginosa
DTVVPMLKRLAPLVPMSFVLLLAACASHSPEPQVAKEPTAAKSSIDVERDAIAWQDVEDEGADNSSAGTPALASSILERAFELIGTPYRFGGTTAKGFDCSGFVGYLFREEAGIKLPRSTRELIDMDVPLVSKDELQPGDLLFFNNRGRGRVSHAGIYIGDGQFIHSASRRGGGVRVDSLDSSYWSLSYMEAKRVLEPGYKDALTSKR

SEQ ID NO: 19579 - protein, 218 aa, Pseudomonas aeruginosa
LRRGVVAVADAGMAEDVFDALQRAVPFQVFRAATHYPAAGAQLAGDQRAVLQAGDADRQVVAFLLEVDDPVVQLQDHFQARVARHEFHHQRPQPERAEAHRRHHPQFPAQVVLAQGHAFRGVVQVLQRGLGRLVEEAAGLGRLDVARRAVEQAHAEVALQVADAFADHGLGQAHAFGGGADAAQLDHVEEGLYVFKAQAHGESRNNREADCRMRENSW

SEQ ID NO: 19580 - protein, 269 aa, Pseudomonas aeruginosa
RARGMALFSYREHRFRILPGGKSLSLSLLLMGGVRSRDRPCLPPRRRFVSHRAATDAARDRRNTMSFTYKRLDKNDAAVLFVDHQAGLLSLVRDFSPDEFKNNVLALADIARFFNLPTILTTSFEDGPNGPLVPELKEMFPQAPYIARPGNINAWDNEDFVKAVKATGKKQLIIAGVVTDVCVAFPTLSALEEGFDVFVVTDASGTFNPVVRDAAWARMTAAGAQLMNWFSVGCELHRDWRNDIEGFGAILGGHLPAYANLIQSFGTKK

SEQ ID NO: 19581 - protein, 720 aa, Pseudomonas aeruginosa
RRPPAPAPVPAGSGGRGRSRAEGAGQCPLQHQAERRGGRRQPRHDHRGAGARLAVRAFRLLHPLPAAAGRRTALRRLRQAGLYRHGCGDHRHHPRPVRRQRRQRELSVEHGSSFLQSGVVFLIAAVFMVPLAKRLQLGAVLGYLLAGVLIGPSVLGLVDNPESVAQISEMGVVLLLFIIGLELSPRRLWVMRKSVFGVGLLQVLLTGVVIGTVALVGFDQPVNSAVVLGLGLALSSTAFGLQILAERKELTQPHGRLAFAILLFQDIAAIPLIAMIPLLSGAHSDAGGSELTQTLKVVGSIAAVVVGGRYLLRPVFRIVAQTKLQDMSTATALLVVMGTALLMELAGVSMALGAFLAGLLLADSEYRHELEAQIEPFKGLLLGLFFISVGMSADISLLLKSPWMVLGLTVLLIALKAPVLYFVGRISGGLDKASALRLGVVLAAGGEFAFVVFKMARDQGLFQNDLHNLLVLSITLSMALTPLLVLGLARLLAKEPEATKPPPEMERIDNDDTPRVVIAGVGRMGQIVARVLRAQRVPFIALDTSVETIELTRTLGAIPIFYGDPMRPEILRAAQVEKAEFFVIATDDPETNIETAKRVRKLYPHLKIIARARNRQHVHLLLDAGVEPVRETFFSSLEMSRMVLCGLGLSEEQADARIRRFRRHDEEVLASQHLFYNDRDALIKSAREARVELETLFQTDQLEDRGAVAAETPEKPSRAS

SEQ ID NO: 19582 - protein, 328 aa, Pseudomonas aeruginosa
RRDRRDPGAVADRQGRPRHHAAALAILRDHPAAEGRDLQFPPPLPSGNLDLPPGAGAQRGHADGLLHARQDLPRPGPQGPAQAGQPATGQTLRHASLQPALQAVGRAGLRGAGRRPVQGAAQGQGVGGHRAHRPLRRAGHSPEDRRGAGGGHHRHRHRPRPGDVRRRRAGGRRQAVPGQPEHGLSRHHAARPAKPGGGGRLYQRQLDAQSGPLQRILLPPDQSHGCHRHAPGDRPRQHRRRARGALPQPRLRLHPARRRAHTQAGRPDALEALPELRPRPGAAALRQGRGRLPGVLLAGAAAASRRRGGAGPGLNPVGVAQAFATTCP

SEQ ID NO: 19583 - protein, 275 aa, Pseudomonas aeruginosa
RRCVERGWGATKAAPRPWGRGAVGSGHFHQQHFAVFQGGDLQGRFVAYRQAIAGLGAHAVDLDAAGGRYQVGAATVFQGVLGALAGLQGHRGDLGVGADVQRFAVLLVAAGESDETTVALGLRERFGAPARLVAAAVRDDPDLEDPGGLGFQVVLRMDDAGTGAHHLHVAGLGAALVAQAVLVGDRAFADIGNDLHVAVRVRREAAAGGDLVIVPDPQAAPVLALRVIVVGEGKMMTRVQPAVVGMAQTVEGTTFDHDRISIGPVAARLREGAGG

SEQ ID NO: 19584 - protein, 510 aa, Pseudomonas aeruginosa
RGSVFLLPERQGGEGEQLVAGQRRDARCIQAFQAEVVERRQAFGEVPAHFPEGLRPTFERQAEMPFRLRLPAFLALLQERHQRCLGGVADDPLEAPGALRQGAMQVGGARFDGARHQQMVGAAQQRLQRVVQIELADRRLEALAEGLVGEFLDPLGDPSARRFRQQRGLAPVLAEPGGGEAPRFRCVAPAPEFEMARVAPEQFVGAFAEKHAVIALLADTVGQALVHQQAGHPCRPAEVADRATQQRHEGFLAQLEALQPRVWQQAFLVAFQAQVKALQLRVQVAAEQVGIDPAADQQGAGAEGLAAAFEGFAELLVEAVHLAGRGGGQPLALAEARTLLGEIEAQHLAGQQQTDLLEQGLAFQRHAGGDHLGDRLGVGAGAAEQVQQRPRLGGEGQQAALGLVAVVQRLDAELVAQQGQLPGLRVPAGEGVHAVRQYPALQAVEQQADLAMDFAAGLVDLAVVGDPPLALLRRQRYRRGAGHRQAGHADGAVRQGRDALAERAAMGQQA

SEQ ID NO: 19585 - protein, 145 aa, Pseudomonas aeruginosa
MVAAASAPGAVDAGRRCRALAGVALASRPGRVRRHRPEVFRRRAAAPPWAIAARAGPAASCVRRVRRRRRRCPRTDRRGPRRRWPRRYPGPPPDGPPRCRRQGGWWTATSGCPAESPCGRWPRCSRRSAVRSASRADFRRCPGAG

SEQ ID NO: 19586 - protein, 160 aa, Pseudomonas aeruginosa
LRRVWAGALSCRRRMPSAGRRKGARRAAGGARDGTETSRQGLPGGGSKPASLGKARRCVKPRRRPKRIAALHRGGDEFAQPAMGRIAVRALVPEHGQVVAGHLQGRLDHPQPVALAYQSRRQQRHQVGAFQHRAEEQEVRHRQRHPAFRAEFGERLVGGT

SEQ ID NO: 19587 - protein, 360 aa, Pseudomonas aeruginosa
RLAQLLRPRRRAHPARAGKQQGIVEDRPQLGQVHAHRGLGKIQAFRRARHIVFGEQHVEGHQQVQVQSPEINHPYTWNFGYSFQLYPAMADPAPTFCRRPAMNVLIVYAHPEPRSLNGALKDFAVARLEAAGHAVQVSDLYAMGWKAVLDAGDSLEREASERFDPSATSLRAFENGWQSVDIAGEQDKLRWADTLILQFPLWWFSMPAILKGWIDRVYACGFAYGVGEHSDSHWGDRYGEGRMQGKRAMLVVTAGGWESHYAARGINGPMDDLLFPIHHGILHYPGFEVLPPFVVYRSGRIDAERFAALSEQLGRRLDDLQRAAPIPFRRQNGGDYLIPALTLRDELAPQRAGFAMHLAE

SEQ ID NO: 19588 - protein, 82 aa, Pseudomonas aeruginosa
PRISAVRCTETPADSCCRAMMICNCWRHWPKVMPVSRRTIRARDRSLIATRLAHSAMLARSPGARVSSSAMRRRPRLSGSGR

SEQ ID NO: 19589 - protein, 119 aa, Pseudomonas aeruginosa
SCGCALRCRISSRTSGDRARVQQSLGRRAAPGSTKRKQTLPLAVTRLLWAMPPGIHTPKPAGTIHRPSGTVQVMPPRQATTSWPLRCRCTGTSVSLCRASSCRARAGWPSASGSKRWAR

SEQ ID NO: 19590 - protein, 95 aa, Pseudomonas aeruginosa
VVDICKSPRPVACAPQPDRSGRPLRALDTLVPCMLSEVSVSGLYVPPLFLYLCLAMPLYLLLERLAWRWLECAWHPGLLRFFLSFIVLSVLVLKF

SEQ ID NO: 19591 - protein, 306 aa, Pseudomonas aeruginosa
AEVPMSIVRLSKVAATFACGLLALCLALQLWQAYVLAPWTRDGRVSAQVIRIAPEVSGSVEAVFVADNQRVARGDPLYRIDPRSYRLAVRQREAELEQARETLRQRDEQWRRRMQLAGAVSREEVANAGRALRIARARAEAAGAALDQARLDLRRSELRSPVDGYVTQLRVQPGDYAAAGRTNIFIVDRRSFWVTGYFEETKLRNVQVGAPATIKLMGFDPLLDGHVASIGRGVADLNESRADSGLPQVSPNFSWIRLAQRVPVRIELDRVPAGVVLAAGMTGSVEVLQAGTARHWRLTRWLQEYL

SEQ ID NO: 19592 - protein, 273 aa, Pseudomonas aeruginosa
KDSAPTARQGPPDADRPAFHPVRSSPIAQDYLHGERVELHRHSRAQLIHALSGVVTVGTAEGTWVVPPGRGVWLPAGIEHALRFAGQVRMRTLFIAPQARHDLPRDCRVVDVPPLLRQLIVAAMRIAPDYPPGGRDERVMELILDELRVLPILALHVPQPVDPRLAALCRSLRAEPAADWSLGDAARRLGVSPRTLTRAFQRETGLSFVQWLRRMRLLASLDALAAGHSILEVALDLGYDSQSAFSAMFRRTLGVSPSLYFGRGAAYGVAEGD

SEQ ID NO: 19593 - protein, 440 aa, Pseudomonas aeruginosa
AVEIHEPSSKVAPSAPSISGSAALVTCTFMPAMKQPNRPPVTATQARSDTLSSALIGGGSVRFASVHGGDHRHPRKQPAPLGGVGVQADTHREALDDLGEVAGGVVRRQQREYRAGGRRHAVDAAAPAAAERVHLQLYRLPGTDAFELGLLVVGHHVGLLQRHHRQQRQPRRDVLAQAHLALADAAGEWGADFGIVQGVARQFARRRGFLQLRLALGERRLRLASPALQYVLGGALAAFLGACPPRRRPRSLVRRVGVLQALATGGMLVGQLPVASPVGLGAAPFGSRRFAIGAGAADRLRLLQQLPIEGLQLRALGFQRRLRRRFAGLGGAQALAEVARVQAQQQVAGLDVGVVGHQNLGDVAGDLRADRHPVGAYIGIVGALQEASAAPPPGQQGGERDGAGEAAQQPGSAPARGCWHGFASGVFDGFPDCLVHCPFS

SEQ ID NO: 19594 - protein, 610 aa, Pseudomonas aeruginosa
  UNSURE (12),(13),(14),(15),(17),(20),(21): Identity of amino acid at the above locations are unknown.
SPPLPGASWTPXXXXGXPGXXLLKASCSGGVARCPGPGPGACVSRDSVPPTSPRGDGRRAMASVMEVSEMSCAWGTHSSEAECSFGAALFARRSFPKNLESAARAPARRVLRRFPLECPMPVDLPNLLLGLLAAAIPLAGLAWQLQRRASLAEREMALLGERLATAQLAQDGLNAQLETSREAYQQLGERHARLSGEVAALRREAELMGEERQRASLAEARWASERQGREEEVRRLASERAALAAELREQQESHQQRLTDLQSARDELRAQFAELAGKIFDEREQRFAETSQQRLGQMLDPLKERIQAFEKRVEESYQQEARERFSLSKELERLQQLNLRLGEEATNLTRALKGQKTQGNWGELVLERVLEHAGLEKGREYETQVSLKGAEGERFQPDVLIRLPGDKQVVVDAKVSLTAYQQYIAADDDLLRQQALKQHVTSLRNHVKGLSGKDYRRLEGLHSLDFVLLFMPIEAAFSTALQAEPNLFQDAFAQNIVIVSPTTLLATLRVIDSLWRQERQNQNAREIAERAGSLYDKFVLFVQDLDEVGSRLQQLDKAYAAARNKLTEGRGNLISRSEQLKLLGARASKSLPTDWLDRALVAPVEEAGEE

SEQ ID NO: 19595 - protein, 235 aa, Pseudomonas aeruginosa
CWRFFRLGSLLPICRLQPIHEESSNEHHEDRFTPDSGQRLADRLRRVAEKRLADLCGGRWCVTGAGLGAIESSSWAGWGALIGGGVGAAYCWVHGAGEQVAPPPPQPVEEVAPPPPVVKEETIVVRDLHFAFDSSKVDAADSEKLNGIAERLKGEAASTRLSITGHTDSVGSDAYNQKLSERRANAVANYLIDAGVPSSIIVGVQGLGESQPVADNKTREGRAENRRVEILIKRE

SEQ ID NO: 19596 - protein, 268 aa, Pseudomonas aeruginosa
PPCRTTENLSSYGAPADSSSAARRAQEFHAQRRTQVPDPGCLHPLSRSQGAEASLWPAPDDRRSGQGPRRDQGGRGGAPRGRAGGGRGGGRNRYRQDRGLQPGGDRLRQGQWQAPGDSHRDRRPAGADRPQGSSRPAAQQRAGLQLRPGQGPRALPVPVQARRAAAGRPGAERDGATVRRRRFQHRCRRDQQQAVQPDDRTPGRQPLGRRPRQLAGGDRRRALGAAHHRSQPVHQPTLPELPAVRLLQGARRDDQGRRDRHQPRPGPG

SEQ ID NO: 19597 - protein, 379 aa, Pseudomonas aeruginosa
SFGARPGQLGTVDRLHLRGPAGQPADGALADPRRERQLLRHRSQRQPDPRRRDPAPQPVERRLWRAGDLGDPDRVGHLRPLPHARGPAAQRGHRGGAEPLPPCRGRGIAGPRPQGGSAQRRRAHRGDHSRAAGTGEGRARQPGAVLLAQADAGSLRRSRPRLAQAGVHPGQPVQAGNPEQAQVASRRRRGQRALRPRQFRRRRGPAGGLLRTRGDRQDSLRGTRRPGGGGAGRVDRGARRQSVHGDRRARRFAAVGPGLRAAAAHRAGPRHHHPAGSPRGHPALRQGYPQCIAAVPPGNRLTRWPAREGASLHVRAASGIPGICPGRDGVKENRLHDPFALASSPASRPARGGHAAGGERHPAGTVQLRQANGRGRHHP

SEQ ID NO: 19598 - protein, 255 aa, Pseudomonas aeruginosa
GCRPAQRDGGGHPGGRHSPSRHLQPGATAHLAHESGAGPLGLVRSGLREPAHPERDELGHDPGGRDRGRAGRAGAAGIHRATGRPAADPAGAVAGGFARGSGHACGAADATDGRRPAGAAGATRGGLAGPRQGRSAEPVPALAASSPEHPARTFRHTHREGGGAEHPDRPDRSLWPVQPRRLAGKDSFRRTVAQRLCGRGRTAPRLGTADTGARPFRRPAGWAGVRSQRFLPHGKTWRALVAGYSGRTSVLVAGR

SEQ ID NO: 19599 - protein, 135 aa, Pseudomonas aeruginosa
RPKATVTAVSPRLPRPSPGFSTIRRSAARRCAWRSVARRWSTSGAASRTRTASSPGSATPSSICSPAPRPSPPLPCCNWWPRASSNWTRRWHTTGPSSPRPARQRSACASCSAIAPACRRCASRCRPRHSTTGRR

SEQ ID NO: 19600 - protein, 314 aa, Pseudomonas aeruginosa
PAVEPNVPSGSPSFTSNGPRRMKLLKTSTLLLCMTASGCSYFQTQDASSQPAKAPAEQASSHSWWPFGKDDGQTVAKQATEQKAEAEHVGSSHWWWPFGKDEGGRDVAAKAAEQKAEIAAAKKEVAAAAEPKAANPWWWPFGASSASKASGKPALVQQKVTKEWLDAHEKALREAIAGSEFTLERRDNALIVIAPADYSFNPKRHTMLMPITLNPLGKVAKMAQADPQSGILVLGHTDSTGSKAVNDKLSFERAQSVAAIFRLSGLKGDQLRLKGVGSDMPRADNASAAGRAQNRRVEVLYTQRASLLSLAQGN

SEQ ID NO: 19601 - protein, 490 aa, Pseudomonas aeruginosa
PSSGRRWSARCASKAASRRSLPRNPTPTTRCVRWAVAWAPGPRRRAGSSPIAPSWNGCSRTPSGVSPTSRRAVPSTGAATVSCRSASSSGRGGRAACTTVSTIDARTAAGCANAWRPESSMFELDSTLAQHIVDRAMAILPHNINVMDAQGMIIGSGDPSRLHTRHEGAQLVLANRRVVEIDEQAAACLRGVRPGVNLPLLHAERLVGVLGITGAPEVVRPYAELVRMAAEMLMEQRQMQDERHWQRQRHEAWLRQLLDPGHGLGALAADAEHLGLAMHWPRQAVFLELPEHADPLPCQARLLAALGGRAEHWSAALGERLVFWCRPVAHADTLEHWLERADARGWGVARLCAGDPAHDLAELRASACAARDLLDYARSRLPGRRVVTLDGHRLASLLFSQRDSWQVRQLLAPLQRLLDHDPQGSLAATLESWCAHDGHAQACAQALGIHRNSLRYRLERIASISGLDLARLEHRQQLLLGLQLLVPRRG

SEQ ID NO: 19602 - protein, 337 aa, Pseudomonas aeruginosa
ADPGALGLAGRRHRSDRNGFRQRLAPGPARPPRRHAQQQPWHWRADPCGAGRRGAEDYPRPRRQRYQRCRRRPAGRARRAFPGCRRRGTGARRRRAGWPAQSRPGRAGSAPGGCRGGSRRRRRQPAMRAARRFGGVRSAEGRQRRTGGATGCRPGALRQGGRGDPWRGLQPGAGRRRRRRPGFRREGIPPRAFPPRHRTGGGAGRAGRCAGRCRPGADRRGPPGCAEPARQDPGGRGADRAPGRRSRGSPGRQPGRRLPAPARRRHRCGVQPGAGTDQPGAGLCRSGGGTGGARRADRPALAPGSGFAGRVVGGGALQPGRQVAPLHLAGLGLGQSL

SEQ ID NO: 19603 - protein, 149 aa, Pseudomonas aeruginosa
GSPYRADCTHGHHPGLAPGQDRRHQDPDRFHRRCRRRRCRRQRGGRRQGQLRRGHHRRGRWRPAGRGYRRRPDAHPGRRDHRARRRRQHPRLCPAGRPGPDLPRRRARAHPDRQRHQPRRPLILPTLSRGRHFAGRFRCSAEPLPALSC

SEQ ID NO: 19604 - protein, 78 aa, Pseudomonas aeruginosa
PGPTRASPDSSSRTASPGAAATTWSTSSWWTSVVSIPSARSACWRSPASASTRCSPVSPCTSRPATRRVATGPTPSTR

SEQ ID NO: 19605 - protein, 516 aa, Pseudomonas aeruginosa
PRQRPRRWTPGRGGAAPMSHWLILPILLPLFAGSLLLLPLAERWQRGLSLLAALALIPLSLLLIRTAASGDLSVYALGNWAAPFGIVLMLDRLAALMLLATAVLGSAALIYALRGDDRLGKHFHALFQFQLLGINGAFLTGDLFNLFVFFEILLIASYALLLHGGGAERVRSGLHYVILNLVGSAFFLIAVGTLYGLTGTLNMSDMAQKIAMADAERAPLLAAAGLLLLVVFALKAALLPLYFWLPRAYAAASAPVAALFAIMTKVGIYSILRVYTLVFGDAAGELANLAQAWLWPLALATLGLGAIGALAARTLQSLLAYLVVVSAGTLLAGVALGSERALAASLYYLLHSTWIAGGLFLLADLVARQRGDKAGDLVQGPALQNPRLLGGAFFIGAIAVAGLPPLSGFFGKVMLLQSVAPGSQALALWSVVLGSGLVALVALSRAGSTLFWRTGHTVLGSAELDHGRLFACILLLSAGPLLVFAAKPLLAYVQATAAQLHDLDLYRQIITRGGTA

SEQ ID NO: 19606 - protein, 208 aa, Pseudomonas aeruginosa
RRSSHARLRDPAVPGAARPGPVADPGAPGQGAVPAGPGAGAGHPLRERHRPAGAVRHLARQRPVLRGGAADRGARLRRYGGGGQIHAARRHHRMTGEPLSLWLEIIVSAFLLLGSAFVLIGAIGLYRLPDFFMRLHGPTKATTLGVGGVIVASLIYFSNRQAGISLHELLISLFLFISAPVSAYMLAKAAVLQQLPLEKKTRGKPWEQ

SEQ ID NO: 19607 - protein, 250 aa, Pseudomonas aeruginosa
SAPWWPHGKWSRPARRVRWWRFSATAANAMRPPITIRSGWPGRAMRWNPWSRRWLPASSGAWRCPTGCWWLDFEGVDMHRLRAAETGDIEAMTDLLLRHGPNPWNHLPEEGVRAHLRAIADGEVRAVLAERDDRLLGFASFRRTEDFAHYQPQRADAPRAYICEAVVHPAAAGQGLGSALLEAVLAQLADEGIEDVYIDRHEENLASAGMMRKAGFVELETYADPARRPNGSGRSTVCHRNLSLQRRAVR

SEQ ID NO: 19608 - protein, 171 aa, Pseudomonas aeruginosa
TSRRAGRIGKTPSKMRPRYRASGPSSSPDRTSSQPGSRSMIQCKRVYEPASPADGRRVLVDRLWPRGIRKEALAMDDWLKDVAPSNEVRKQFCHDPALFDSFREHYRAELQAHPEHWWGLLDSAREGTLTLLYGAHDQQHNNAVVLAEFLEEELDRQQPGSSPTCYADRLS

SEQ ID NO: 19609 - protein, 338 aa, Pseudomonas aeruginosa
GNNREGPGRSRRLRRTPRPGQFHPRRRASRLQQGPTVEAHWRPRAEARRDPLAPHHPPSFADRRRRRAAARGAGLAGAGRARAAGGGALAGASGRTGAGDPPGLAGRDPVRCTAGGLPGTPSAAARRAGPVQRPARPGWRGLRPGDPLWGRAGRPAGGAAAVRPAGNHLRQSRLPGATRRAATPGRAGRARVPAELALQRPRGVALSPPPSAGAGTGCRLSRQQPLQPVEESRAGRHRHRPAAVIHGPRRTGRRPPGLVAARLPDAQHADVPRPSVPGRPAAAHPGTRRLPARLVRAQPATIDRPGGLNISPRRGSIALRAASMRPEAHRGHVVAQGT

SEQ ID NO: 19610 - protein, 638 aa, Pseudomonas aeruginosa
RNVAESRTGPLACERTPFIERLDRDMQSSFPQSNTPQIRRAGVDLNGVMSVLSKHLYSTPTVALRELVQNAHDSILRRRLEQPDWQGPSRIEVIGDSASNTVRIVDTGAGLTEHEIHAYLATVGVGYTRGLRQSGHEDSGLIGMFGLGFLSAFVLARRVSVRTTSYQQPELGFCYVSSNAEQYSVTPMPARPVGTEITLELQDEYSALTQAARLREILERYCVLLREPIHVGGDAQSINPEPPPWRLAADAALHPLQRQRRDLEFAARFEHDFEPICCLPVRPDERVDVQGLLWIQDGGTYGTSDNRNLSVFLRGMLLDDDARDLLPSWAGFVGGVIESNRLTPTASREDLQRDDHYAAIQHALAEALIAGLGEVARQQPEAWRRVLLRHNEALLGAALCDERLFALMMDSLRVPTSQGDLPASELLSRGAVHVLLDNDSGFEEMLFRAMGVPVAHGNRYAVVPFLRRWAQAKGMRLVELGTEQGNRQLFRLDRLPERETGWLAEHLGGAEEQLVIARFSPEELPLVMVPDRDAELKRRLEDDEADKRISTAALRLARQFTRKLDNRQPSRLYVNLDNPAVQALLAAVGEERDEAAHAALLLRSFKVIIAGQGRGQPATSLNQALAGLADSVKRLLGQ

SEQ ID NO: 19611 - protein, 769 aa, Pseudomonas aeruginosa
WRLKHMDIWNWVEKLRADLREAGQEQSARLIDELTAYVCDLEVERAEALLPEVKALSRTLNNPWLEIFVRHWEMRNRVGNQLEGETALADAVSLFELANRDDTQACPQSVCVTQDLASCYANVDGPGWVEERIEVCDETLARIDPTWACFHCLSNEKAEALLDDGRGEDALAFLAEQEKKILAAGEEVFDSLLEMRVAILLNLGRAEQALALIGEMEEKVEGAEWNNISQPRRLYKAHGLALLGRDEEALEALLPFSEIAPRYRTIWLRAVYLLLQRTPERNTWDFGGRLQQMLEHYSQKGAHRVVIDVASQAIRLALQRGSVWSARRHLALAEQHAQQLQRDRGASQLLAGLREEIDAAPQQQELPVPAAELLDWLAAQGSEDAPRNPEKEVQWLLQALAERPDDTALREVAASALQACSADDEAIDLLWEYVERHTDEEQQLAYYLLNALLARGEYDQVKRLGRLYADSVPLIALWSEVKLAEKLNDWPELERACQSVLEISPGSLGAHSLLGKALMEQDRFAEAALAYQRLAGKLEEPQSVQWDQMTAASAARDWTMLREVAAGMGMEFAAGDGPIEEDWGWVIVRYIEDGEALDYYARRTGPVTARVLENAPGNRSQRVGDWVVFDAGLIYPAPEDEEERKRFVPTYAVVHVLESGGYSPSWLVDGVYPGDEAFDAFRETLDARGWKVWVHSNRDYQVTDASSGEELRAIYFTVATPAQQAPRDLHQALQEATGQWPHRMCWLRLAEAAEVDTQPHLDAIERYGL

SEQ ID NO: 19612 - protein, 427 aa, Pseudomonas aeruginosa
RRAAPGSCRSRWKPCRNSACSRFPQISLDHVRVVADLLRRPVGQGGALVDHHDMVGNAHHQLHVVLDQQYRHVVLAAQLGDQRLEVVGLLRVEAGGRLVEHEDPRAGHHAAGNLQASLLAVGEGAGAAVGELGKVDFLQPVRGVLHGLALAAAECRGLEQAGEEVGVEVAVLGDQQVLHRGHFLEQADVLEGPHHALASDLVTGQALDLLAVEADQAAGGLVEAGQAVEHGGLAGAVRADHRDHLLFLDLQVDAVDGQQAAEAHGQAAHFENRSAHGFSSRCGRCIGSSPWGRQIIITIMVRPKISMRYSLNPRISWSSTITTAASITPSCEPMPPSTTIARIIADSMKVKDSGVTRPWRAAKKLPAKPAKLAPMVKAESLTMVGLRPRARQATSSSRSASQARPIGMRISRLITNRASSTSSRATT

SEQ ID NO: 19613 - protein, 303 aa, Pseudomonas aeruginosa
GTGSYFFHLRTTEDAGRSEQQHQDQQAEGHHVLVLVAEHVGAEGFGDAQQQAAEHGAGDAADAAEHRGGERLDPGEEADPGVDHAVLHAQQHRGDGGQGGADDEGEGDDVVAVDTQQVGHLQVLGAGAAGAAQAGAGDEQGEAEHHQEGDDEDQDLHIGDHHAVHAAFAEHEVAGQQGRDGLFLGVLREHHGVLQEDRHADRGDQRDQAVAAAQRAVGDPLDAVAEGTGDDDAGGECGEHHQRNAVQPHHRQQGDGDEGDVRADHVHLAVGEVDHADDAVDHGVADRDQRIGAADGQAVNQLL

SEQ ID NO: 19614 - protein, 143 aa, Pseudomonas aeruginosa
TYRKTARTCLTSLGPVSLRLSWATGGRYHGAHAIQVDPMTEQTSTLYAKLLGETAVISWAELQPFFARGALLQVDAALDLVEVAEALAGDDREKVAAWLSGGGLSKVGEDAAKDFIERDPTLWAVVVAPWVVIQERAEKATLH

SEQ ID NO: 19615 - protein, 142 aa, Pseudomonas aeruginosa
SRAVFFRSTLARLIPIPTRRFVMFEPGHLHLVSLPGLDQQDINIHIRYEVRQNAESGAYVHFDMDGEIDGKPFSDSFELPRDTAFNFASDATRVAQKHGLHPKFGAITRVHKEYDAMFEDIRAKLHAHPGEPVDLERIIRHE

SEQ ID NO: 19616 - protein, 156 aa, Pseudomonas aeruginosa
FGTGLAEVLATKATPANRFAAMSISFDRALGIHQQALSFRAQRAEVLANNLANADTPNYKARDLDFAAVLAEQKDKAAKGTFAIRTTNERHIAAEGFGMGEGSLQYRIPVQPSIDQNTVDAQIEQANYAENAMHFQASFTFLNSKFKGLVSALRGE

SEQ ID NO: 19617 - protein, 133 aa, Pseudomonas aeruginosa
TRAWRAFSPTTSRRRPCKPRRWWGARSSWRPTSRWWTPRTPSRRPSTCRSPAATYGSTSTTTRAPWSIASTSASRLPAASASCGTARTAAATSCRRAPTSSRRRPRSTARPTGSRPTCRPTSTASPWGRTAAS

SEQ ID NO: 19618 - protein, 135 aa, Pseudomonas aeruginosa
ASSNPARSSPTSTPPRCWVRAATRRAAACCSRTSRRCSSRATSTRPTACWTWPSTATASSSPATTGRSATPAPATSIPTSRISSSTTTATACRAMPSGRTASCRTAWSPTSRSSAPIRRRRPPRASSSRTTSTRR

SEQ ID NO: 19619 - protein, 264 aa, Pseudomonas aeruginosa
PARKPGGLCRCLEDSMDKMLYVSMSGASQNTLAMRAHANNLANISTSGFRRDFEQARSMQVFGDSFPARVFAMSERPGTDFSHGSLQETGNELDIAIDGDGFVAVQAPDGSEAYVRTAGMHIDALGMLRTGDGLPVLGNGGPIAVPPEEKVEIGQDGTISIRALGENPNVVAVVDRIKLVNPNLKQMEKGTDGLLHYKPQPGEQAPLADANVKVVSGFLESSNVNAVEEMTAILSLSRQFELHVKMMRTAEDDSAAMARVLQIS

SEQ ID NO: 19620 - protein, 471 aa, Pseudomonas aeruginosa
PGGAEQQPDRLDHRDRGRGAAQRHPLRARREVDDPEHRQRAGAHRRPGPRRRYRHRQHRVLDPRGRRPDHLLRHRRLRRCQSAGLAGPLLPQPAVAVLRTLAMTKFKHLLALAALLLAAGAAQAERLKDIASIQGVRTNQLIGYGLVVGLSGSGDQTTQTPFTLQTFNNMLAQFGIKVPANVGNVQLKNVAAVSVHADLPPFAKPGQPIDVTVSSIGNAKSLRGGSLLMTPLKGIDGQVYAVAQGNLVVGGFDAEGRDGSKITVNVPSAGRIPAGATVERAVPSGFDQGNSLTLNLNRPDFTTAKRIVDRINELLGPGVAHAVDGGSVRVSAPLDPNQRVDYLSILENLDVQPGEAVAKVIINSRTGTIVIGQDVKVSPAAVTHGSLTVSITEDPIVSQPGAFSNGQTAVVPRSRVNAEEETKPMFKFGPGTTLDDIVRAVNQVGAAPSDLMAILEALKQAGALQADLIVI

SEQ ID NO: 19621 - protein, 499 aa, Pseudomonas aeruginosa
GRRHGFPFAQRYRRRPRQRLLYRSQPPQPAQGRQGPRRRGEHPQGRPGIRIAVPQRDAQIHAFGQRSAGRRQFHEQPDHQAVPGHVRPATVGEPVEECRRHRPGRRAGAPVVEDEARLQGKRRKPVRPGRRERRRSLAEQPQRAGRQGPADAGSRPRRLEAAQPEAPGAAGQAGRAHARRHRSLRLAGRQPDAEPGPGQLPAGAELPGGEPPRFLHRWRRQPGQPAHRPAAAGQGQVDVRLGRRVHRHHAADGPEGRRADRRRCPLPGGPGRAGDRLGQIDHPPAGWRQQPQPVRHQDRQPLGWCLGARSHHRIRRRQGGQGSRGVPLLLVVRAELPRLRQLPPGQRPLPERPGQRRQPRALHAGTAARRLRHRSAVRPQGGADRQTDADLPGRRRRRHAASGLSKEELTHVRPTLDRPVRPRHQPDLADHHRAQHHQRQDAGLQSPGCHPADPGPAVQRCRLHGLGQPDRRRAPPGQRLPHRPVAQRHQPEQRVERIP

SEQ ID NO: 19622 - protein, 138 aa, Pseudomonas aeruginosa
PDRAARRPVVQHHHRRQPGHAALLRRTAGRRQQSLLDRSARGSACPGRGAGQDLQYPLRPVGQAEQPDQPATGRAGFAGQPSVAERGQLQRCHRQGQVGGRGAQRPDGCARRSRAQAVRDDRGDRGHPGRQQRQPVHR

SEQ ID NO: 19623 - protein, 439 aa, Pseudomonas aeruginosa
ASETATMRISTIQAFNNSVNGISRNYADLNRTFEQISTGKRILTPADDPVGSVRLLRLDQEQGLNEQYKTGMTEAKNSLSQEETILRSVGNVLQRIREIAGQAGDGALDSNDKKSLASELRQREDELLNLLNSRDASGKYLFSGSQGSVQPFVRNEDGTYSYMGDESQREVQIASSTRIPVSDSGKVLFEDIVNAARLDTKAAAGNTGDGRISVGLVEDELAFDSQFPASNPPAATDGFNIHFVSDKEYVVYDPKSLPPGYDWTTYDPNSPPAWQLSKGAIDDDPKTIDKVLYAGVSVTIDGTPKAGDEFNVNYKPGSEKRSLLNVVSDLRKALESSTDNQAGNDAIRDATAVALTNLSAVAAAVDGGQGKIGARLNTVESTETFIDDVKLVNASVMSQIQDLDYAEALSRLSLQSTIMDAAQQSYVKIQGLSLFNYLK

SEQ ID NO: 19624 - protein, 474 aa, Pseudomonas aeruginosa
QSLCGTGPMTPSWAFSFAGTGPVSLEGLFRKVYGNTGEFVRSLTADSRRSACGTARGRATRGFDLHQALWVRALHRVACSGFSPFTRLSIHSSGPYMNNKTIPVTSPLLPPLEEFIPYLEKIWESRFLTNGGDMHHALEEALCEYLGVKHIVLFANATLALITALQALRVTGEVITTPYSFVATSHALLWNGLKPIFVDIDQDSMNLDPSRIEAAITPQTTAILPVHCYGNPCDVEAIQRIADIHHLKVIYDAAHAFAVRDAGGSVLRHGDLSILSFHATKVFNTFEGGAIICSDENTRQRLNHLKNFGFVDEVTVVMPGINGKLNEVGAAFGLLQLKHVDQALEQRREIAERYRRLLAGVPGIQCLRPGTQTFANNAYFPILVEDDFPLSRDELYQRLRDRDVLVRRYFYPLISDFPMYHSLPSAAPANLPVARSISSRVLCLPIYPGLAAADVEFVAGLIASAAMPRRRASS

SEQ ID NO: 19625 - protein, 86 aa, Pseudomonas aeruginosa
QNEQPPHSGRQEMSQAKFIEDFLSATDFQNPVEVSMDTQLEDLPEWDSLAALGVIVMFDMEYGKTITGEDLIKARTVGDLYQMLGL

SEQ ID NO: 19626 - protein, 267 aa, Pseudomonas aeruginosa
SNPECLERGISQVNDETSFNPFSLSGRRILVTGASSGLGLAIAQSCARMGAELIVSGRDPQRLGASLEALQAISDLSHQAIQVDLTVAEQRAALVAALDGEIHGVVHSAGISRLCPVRMMSEAHLREVQSINVDSPMLLTQALLKRNLIAAGGSILFIASIAAHIGVAGVGAYSGTKAALIAMSRCLAMEVVKRRIRVNCLSPALVETPLLEATAQVVGSMDTERNNYPLGFGKPEDIANAAIFMLSDASRWVTGTTLVMDGGLTIS

SEQ ID NO: 19627 - protein, 529 aa, Pseudomonas aeruginosa
PTVRRRGRRSAQSPEAGRMPAGEGRRVRRYPHPLHPWRADQLRPDLLRLRREQRRGLPYRRLRFHRPANHARPRRGHRRLCTHRPALPAGWLREGGRSRGDQLRGDDRPRRQYRRRRRGGHGRGGVQGRGGRTDRGRQSGPGYFQQVKVVDVDMTRHALDAAHYTEPQTLALERERLFGRLWIFVGFSSMVRERNQFFTRKIAGVPVVVQRTESGIRAFLNQCPHRLSAIQTECTGQRPLVCPYHAWSFGAEGQLQGIPNSSLYQFSAEERARIGLRKLHLEEVGQLLFVNLADDPLPLREQFDDGFLETLREVSSHLDTRLIYSCHKVRYNWKLNMENVKDYNHVPFVHPKTFLPVMTAPVRGLAREAAVPSEVLRLLQEGETPELRSLSFPTKAPIQPYKSWFSDLCEGYGDEHAYYNWFIYPNVNFCSVRGEHFLLQQYDPVAPGETDYHLWMMTARRKDPKTDFSALLSTLIRGERNVIGEDTLVLERLQEGLGAHSPPFMHGDYEVQLVRQHLWYRAQVLGERA

SEQ ID NO: 19628 - protein, 385 aa, Pseudomonas aeruginosa
TIEGWSMVDGGSIAQADFLARCEQSGYLMLLVPSSYLGRIYRPHIASGLARRLPDVRLVAVDDVLFREGTTVDGFDEVIPTAHLSDPRHAGRPAVNCAYSLSAWLTLDRLSSAAKCATLDLPELLYLLDIPLVYQTGALTRELAVKYHAEFVSLRERLADEPSRKTLDAIMRLRLDGNRSALLDVVCPGEQEYFSLYRGAGHPIDLRTDEHYVDIGAFDGDTVKKFMLAARHRYASIHAFEPDPANYQRMHAALNGHARLKLHNLAVADDEGYLAFAAHGTMGSRVQADGAVQVRCVRLDDVLDRMSLLKMDVEGHEARVLRGAARLIGECRPRMAITCYHHVADLLEIVAAIDEIAPGARLRLRHYSMFFYDTILYVDWPEYSA

SEQ ID NO: 19629 - protein, 273 aa, Pseudomonas aeruginosa
GRLNVAENAVSAHRMRDSMKYAVVIPARHASTRLPGKPLLDLCGVPMIVRTYRQCIQAVDAEHVLVATDDERIRAVCEGEGIRTLMTSSRCLTGTDRVAEVAGQVSAEIFINVQGDEPLFNPDDLRKLIDAAQASPEAIINGYCGIADETTFRNPSVPKVVFRPDGRLLYMSRAAIPTTKQGEFSRAWRQVCAYAFPREALRAFAARPTKTSLEEVEDIEILRFLELGWEVKMIEMSDQSISVDNLEDVERVLDAILQRKPRTASVGGDQHAP

SEQ ID NO: 19630 - protein, 371 aa, Pseudomonas aeruginosa
AERLMSESPYVHSAAEGVVESSMGLYSVPAYVSFLQQNRTREQALAIYEQRIADALAIYTEFSHAFVERCCPCCGAQERADLEPFQGIYRVAKCMRCTTAYVTPCPPPAVLGHYYSQCRCNGMLGDLLKARQRSGDRIISDRVRFLLTLIDEYLLGRARIRILEVGCNSGGLLSELKAALHASDLLHRCELTGIDIDASAIARNEDRDLTLHAASAEEFAAGSGGVFDLIIHFELIEHLFDPHGFMVATKKLMSDGGLHHFHTPNALGMDNQALGYNSFRALAHGIFPPMHLQAFTPQNIGHFAMRSGYSIVQMDTPGNFDVDMVANWLPKDAMDSPFIHIHQLPREHLAIFQQWLKVLGASSHMRCTLRS

SEQ ID NO: 19631 - protein, 539 aa, Pseudomonas aeruginosa
WMVQPLSAITSKVLDCTLRDGGYYTAWDFPTTIIERYLDAMRAARVDVVELGFRFLRNEGFKGACAYTTDHFIRSLAIPEGLALAVMLNGADLLGEMGLEAALQQLVPESAETSALKMVRIACHFHEFERVLPACDWLKRRGYAVGFNLMQMAGHTREEVSRLASSASDWPVDVLYFADSTGSMKPADVCETVAWLREGWSGALGFHAHDNMGLALQNTLTARTEGVEWLDATITGMGRGPGNVRIEELLIELAEPRANLVPLLALIGEYFAPLKVRHGWGTNAFYYLSGKHAIHPTYVQEMLGDPRYGEEDVLAAIDYLRRQGGQSFRRDMLVSARHLYDETPKGIWSPCDWLEGREVLLLGAGTGVVRHRQALESYIRRTRPVVVALNTQSDLDASLIDLRVACHPVRLLADCETHARLPQPLITPVSSLPTELLMSLHDKQLLDFGLGVRSGRFEVFPQGCVAPNSLVIGYALAVAASGRARRILLAGFDGYPPGDSRNQDMQELFNLFCARQSVPGMVSVTETAYDIPCTSIYGM

SEQ ID NO: 19632 - protein, 1206 aa, Pseudomonas aeruginosa
RHTHPDSSPRLWMIPKGKARQRLAWRIDALQFRQRSMNMGEQALVSIVMPTYKLEYFEDALDSVLGQTYPALELIICDDSSDERIATLVEQKRASAAFPIRYFRNETRLGELGSTAKGIRLAEGEYVKFLHDDDVLLPECVEALVGAMEREPNVVLASSRRLRIDEEGQPLPDILATCFPFAGDVLIDGRELVSFLADHTINFIGEPSCLMARRDALLQICERLMMLNGRAIDWIGDLAMCAQLLQRGDLAFLSRPLTRFRVSRQQFSQIGRDQPGIGEQGHADFRLAIRELGWYRQAGDNRFVRVAPITRLDARVFKPVNLLAALRRAAGFGSVTLSTWLEARRPDAVQKVLIDRFLQEQGGGPRFAVLVLDAHGDTEAVERTLQSLEHVNLYPRVESHLFAPLGTSPRNGAMLFDPEVGPVPTINQALARLDTDWLLLVEAGVEFTVSGLLVAALDLLAAPESCQAVYADELMRLDDGELGAALRPDLNLDLLLSFPAGLSRHWLFRREPLLATGGFDETAGEAFELAYQLRLVEQRGLGCIGHISEPLLSGPALRLQNSTAERAAIEGHLRARGYAQATVGSRLPGRYELDYGHAGQPPVSILVLAGERLAQLQRCVETVLENTAYPNYEILLLEQGGEAADVREWLLAVEGMGVEQVRVLRGDGQLSRGALRNLAASRARGEFLLWLDAGSGILDKDWLQQLLNHGQRPEVGAVGAKLLAADGRVCHAGWLLGLCGPAGRAFEGRSHEDAGYLQRLQVDQNYSAVAGECLLMRRELFLELGGFDEALTRWDDVDICLRAVQAGYLNVWTPRARLLLDAPATTAASVEEEDALYARWLPLLARDPAYNPGFSLQAEGGFKLADPQLAWRPLQGWRPLPTVLAHPADLFGCGHYRVIQPFSTLRESASIDGALSIGLMHVADLERYDPDVLVLQRQVGEERLEAMRRMQAFSRAFKVYELDDYLPNVPLKSAHRQHLPKDILRTLRRGLGYVDRFVVSTPALAEAFAGLHPDIRVIENRLPVGWWQGLRAQRRRGERPRVGWAGGSSHTGDLELIADVVRELADEVDWVFFGMCPPSIRPFVREVHAGVPIERYPRALAALDLDLALAPVEQNLFNECKSNLRLLEYGACGFPVVCSDVRCYQDDLPVTRVKNRFRDWVEAIRMHTRDLDAAARAGDNLRERVLADWMLDGEHLRAWYRAWMPD

SEQ ID NO: 19633 - protein, 142 aa, Pseudomonas aeruginosa
QPAWPCEEKLMSRPIDTYRQVGSAQDVPPYQVVKLLLDGALERIALARRAVLERNPALRGEAVGTTLSIIGALQAGLDHQQGGEIAGNLDALYDYMTRRLAGVALDDTPRPLDEVEALLGQIKQAWDAIGSAEAQGEDSERR

SEQ ID NO: 19634 - protein, 63 aa, Pseudomonas aeruginosa
VQLYRSLKKPVAPCALPWPARTGRPSVNSTSVAARPSTRRCSMYRTKPPCGRGWKSCWRCIAS

SEQ ID NO: 19635 - protein, 478 aa, Pseudomonas aeruginosa
RQSRSQSRPGSHSQLPRRRSADLQQRGLARGSGGPEQQSRSPVRAARQRRVEGRGGRAAEATGQLGRVPADPADRRAGPGRLAGGAAPPGARQPGDAAQLQQAARFPASRPGLPRDVRPGPRARPLPRAEPVPQPGRHQPGDPAGAADDAAGRRYRCQRADPRRVRHRQGSGGAQPALPFQAPRGALRPGELRGDPGGTAGKRTVRPREGRLHRCHHQSCRTLRAGQRRHPVPRRDRRHAAADAGQAAARAAGAHLRKGRQQQDAERRRADHRRDPQEPREDDRGRHFPRRPLLPPQRIPHRDGAAARAGGRHRTAAQRTDLADGAREARVDPLQLGGHHVALPPRLAGQRPRTGEPGGAPGDHASLRGDRGRRTAEEIPPCRRRGRATRQQPARRAGRARGDQRRAAGNGRAGDAAGRRPGPQGLPGQPRAGPDPAGPRRCRRSGRAGRRTPAHPPHHAGGEDAQVRHEPARRRPVG

SEQ ID NO: 19636 - protein, 486 aa, Pseudomonas aeruginosa
FRRRLFLRFRSNPMAAKILLVEDDRAVREALSDTLLLGGHEFVAVDSAEAALPVLAREAFSLVISDVNMPGMDGHQLLGLIRTRYPHLPVLLMTAYGAVDRAVKAMRQGAADYLVKPFEARALLDLVARHALGQLPGSEEDGPVALEPASRQLLELAARVARSDSTVLISGESGTGKEVLANYIHQQSPRAGKPFIAINCAAIPDNMLEATLFGHEKGSFTGAIAAQPGKFELADGGTILLDEISEMPLGLQAKLLRVLQEREVERVGARKPINLDIRVLATTNRDLAAEVAAGRFREDLYYRLSVFPLAWRPLRERPADILPLAERLLRKHSRKMNLGAVALGPEAAQCLVRHAWPGNVRELDNAIQRALILQQGGLIQPADLCLTAPIGMPLAAPVPVPMPAMPPATPPSVEIPSPAAGQDASGALGDDLRRREFQVIIDTLRTERGRRKEAAERLGISPRTLRYKLAQMRDAGMDVEAYLYAI

SEQ ID NO: 19637 - protein, 128 aa, Pseudomonas aeruginosa
LLCKVPGGVKKAAAVGGRVMSQGVEFNRLMLEMRSMQMEAMAKAKPAQAPAEAGAPSFSEMLSQAVDKVNETQQASTAMANAFEVGQSGVDLTDVMIASQKASVSFQAMTQVRNKLVQAYQDIMQMPV

SEQ ID NO: 19638 - protein, 291 aa, Pseudomonas aeruginosa
LVHGRCTDRQPGSRQERRCRDAEEILPGTVVPRQPFRDDHAAPDRPAGRSRRQRGDRLRRRALVPAAGLQAALWQPQRGRREPCGGSADRGGHSLQGRTQLRRAAGQGRRPRPGTHEGGLRRRGADRQQRRFRDPRQGTGAGHQPVHGSHQLPPRPGRRAGAHRVEPEQRQGRPRAPGDPEEFGVRPRRPQAQRLGAGRAVSGSQPGAEPGDGDRQPGRHQCAGAGQVAGHRGRPEGQPALRPAGTLRADHGRQAVRLHPAHGRPAHPARAQYPATGAGQRSLQGRGVRRR

SEQ ID NO: 19639 - protein, 243 aa, Pseudomonas aeruginosa
LQRGRVDLGDVQPGPTGPAQRATQQRGTAEFVRPAGRAGGAVEPAAGPGQRAAAGHRQRAGRLRRAGPAAEGRQRPDHHRSEDRQAGAGAVPDRQARPDHPQLRTGPLDQLHQAAAGTLAPTVGGGGAGRPDEGRREDRRGQPPALERRRTGALHPPGTGLGGLRRQPRRQRQRDQRAVRPGPGRRDRQHSVLLAAVVLGHRQAGARRAVHPGPGVRRTASGAEQHHRRRQGQVAGRRRRSRR

SEQ ID NO: 19640 - protein, 341 aa, Pseudomonas aeruginosa
VSAMSENRLAAKLTKVDKAAILLLSLGETDAAQVLRHMGPKEVQRVGVAMASMRNVHREQVEQVMGEFVEVVGDQTSLGVGADGYIRKMLTQALGEDKANNLIDRILLGGSTSGLDSLKWMEPRAVADVIRYEHPQIQAIVVAYLDPDQAAEVLSHFDHKVRLDIVLRVSSLNTVQPSALKELNLILEKQFAGNSNATRTTMGGVKRAADIMNYLDSSIEGQLMDSIREVDEDLSGQIEDLMFVFDNLADVDDRGIQALLREVSSDVLVLALKGSDEAIREKVFKNMSKRAAELLRDDLEAKGPVRVSEVEGAQKEILTIARRMAESGDIVLGGKGGEEMI

SEQ ID NO: 19641 - protein, 148 aa, Pseudomonas aeruginosa
GMEKRAARLAPVVDMASKAERDAATQLGRCQQQLLAAQQKLAELERYRNDYQQQWISQGQKGVSGQWLMNYQRFLSQLETAVAQQANSVTWHREAVDKARLNWQERYARLEGLRKLVERYLEEARQAEDKREQKQLDELAQRTRRQDD

SEQ ID NO: 19642 - protein, 288 aa, Pseudomonas aeruginosa
WLRKKEPSLGRLRLAECCGQDGKHREEDKVPRYPYERVEDPDLARCPVVGLEVDSTGHRSDWHCHRRAQLLYMAAGSVTLYFAERICQLTPLQAAWLPAGVPHRTVLHGRFAYRSLYFEPSAFAELPDSVQVLEVGPLMRELILRMTGWAADLQLEGPHLTLLRALFDELASAPAHAASLPMPRDARALKVAEALLAQPALDWSIEAWGREVGASGRTLARLFTEQTGLGFSRWRTQARLFEARRRLAEGRSVTEVAHALGYASDSAFIAMYRRVCGQSPGRALRGLE

SEQ ID NO: 19643 - protein, 393 aa, Pseudomonas aeruginosa
  UNSURE (232): Identity of amino acid at the above locations are unknown.
SGVFRLGKERTHAGPVFECHPAERRRAARSVGRGGGRRSPRQRAGRRRGHPGGWRSGLSLGRRLPAGQPGHIGHRAARQLAFRQSRGTVVGAAGRRTQGLRQRPGGTARRRLVAGVRRGPAGLPDLCRGRRGRPRRNGGGKWPVIGGQATAGGLPRDLPAVAEAIQRPSLRLAPVLDGKGHLFIALGENNQRSTSQDLDKLQGKIVRLYPDGGVPKDNPFVGRADARPEIWXYGHRNQQGAALNPWTGRLWTHEHGPRGGDEINIPQAGGNYGWPLATHGINYTLLPIPEARGKAVEGTEAPHHVWEKSPAISGMAFYDAQRFPAWQHNLFIGALATQELIRLQLDGDRIVHEERLLGDLGVRIRDVRQGPDGYLYLLTDQKDGQLLRLGLAR

SEQ ID NO: 19644 - protein, 158 aa, Pseudomonas aeruginosa
AGGSNCRRCASPIRPVPNTGPSTTSAWPSNRGKPWPWSDLPAPASRPCSICSCVSSIRSRDGCCWTDSRSSNWTRPTCAAALPWCRRTPRCSSAASRKTSATAVRMPAPPRSRPQRVPRMPTSSSWVCRRATPPTWARAASACPAASASAWRSPGRCW

SEQ ID NO: 19645 - protein, 851 aa, Pseudomonas aeruginosa
RSSRRPCRSAPGSRRWPFRPLAQPFRNRSWPLRPGAPAGVRRGRGMPGASCRSPFRLVACESSTPATALGSAGSARRPGGPLRRGQCERIRAFCSGMTVRSRGASARSASSVSGRLANRLFRVLSSGCSFAASATWLRLSTGSGLAAVTTWKSLISMIPRPSASKWKEKALRASGLSKVKLMSSGLPLSRRGMSGTGMGTSRSNSLVFSVTRAPLRSILQGADLQGDRGPAVLRHFQVLRADQVVGPVVVGFRLQADAFVGGELELLAQLAGLLHGVVEDGGALADQACLATAEATEELGFVGDEALAAVAPADLLEIAFDEGVLAVVVAQHAVGVGHHFAAAGVVAEQRAPGNPRRHAVAEIVEDGRGEVDVAVDAALDRRQRRLFRCQYQVEAPGRGEAHLVDTVGFVGSEHHQGVAQHALFLQVGEEGVDRVVEIGHRGLLGARVAGQVVGRRRVGLVGADGEQGQHPGFLLLAQLLHVGRGALEEGLVVHAPGKLQVGRVAEPVAPEGLVEAHMRHDLVLGHEAQAGTLQEVRAETVLAQLGGQALPGPGRVVEQLDALRRARVELAVVAAEHGVKAADGLVAVQHVVRGGHRPFGPATQSGHRRFVVAAVDGGAVGGDIRAGDSLHGHDQDVARAPSAGQQRRSGKVELVEPGDVRRGVRTVVGEPVFDRQLATAERAGQQLVRQVVLLPLVGIARTQVLQADMRRQERRRQRVGIARQARTAATPEQHAKQCRATEAERQWQVGEAAALGGAADELRIQQVLEVGRFRHAPDRADQFGIADQEQAPEQHDREREPQGASMQEQHQQAAEGQVREIAERRRPAEPVAAGEGNDQEQRGQRQKRAAR

SEQ ID NO: 19646 - protein, 202 aa, Pseudomonas aeruginosa
RAMPMVSEVLTVLPSLSRIGACMLAMMLSAMRRASAPDASGASRTANSSPPRRATRSLSRNCPRMRMAMLTSTVSPAAWPRRSLISLKRSLSMNSTANCSRCSLASRSARLRRPSKKARLGRLVRLSWWAWCASEAFSSCRRACQDSSSSSRALKSSPSWLSSAMPASGTRFSKSRSRRTVCATFASWSSGPTIPRTSRRDR

SEQ ID NO: 19647 - protein, 185 aa, Pseudomonas aeruginosa
PLSGGGMIREILKMGDERLLRIAQPVPSELFGSEELQRLIDDMFETMHHVGGVGLAAPQIGVDLQLVIFGFERSERYPDAPAVPPTILLNPRITLLDDEMEEGWEGCLSVPGLRGAVSRHRRIRYQGLDPQGQPIDRSVEGFHARVVQHECDHLIGRLYPSRITDFSKFGFTEVLFPDLDPAADD

SEQ ID NO: 19648 - protein, 270 aa, Pseudomonas aeruginosa
PTSMPRTNTARCPRCKRRSEMRAVVELLAGARRLVIFTGAGVSAESGIPTFRDALGGLWARYDPAALATPAAFADDPALVWGWYEWRRLKVLGVQPNPAHRAIAALSGRIAGTRLVTQNVDDLHERAGSRDVLHLHGSLHAPRCATCAAAYRDALPDSVEPEEGRRIEPPRCPACGGQVRPGVVWFGEALPEAALREAFAAACECDLLLSVGTSGVVQPAARIPGLALEHGASVVHVNPQPVRTRHPREHCLVGPAGEVLPELLRRAFPG

SEQ ID NO: 19649 - protein, 312 aa, Pseudomonas aeruginosa
PPRTARSPGMPAFTRSELADLNVFMTIVRRRSFRHSAQELGVSTSALSHSMRNLEARLGVKLLNRTSRSVVPTDAGSALAAKLEDGFQVIGEALGELDAYRTSPVGRLRLNVPRDASRLLLGPVLRRFTEAYPDLQLELSVEDRMVDIVADGYDAGIRYGGTVPQDMVAVPLTGELRWVVAASPDYLARHGVPQRPDDLLRHACIRMRLGDNSFYKWELGDGERMVEVDVPGPFSVNESNTAVAAALDGIGLAYCLEVGIAEELRSGRLQLVLPDWTSMGAPFCLYYPSRRQPQPGLRQLMEMIRGDWLGRA

SEQ ID NO: 19650 - protein, 411 aa, Pseudomonas aeruginosa
PWRRRPAGQHRLLPRSSRLSPGSALGPGRLSRTGFAVAVPVPGAAVRWAGRGLHALRLRHRRRGFRPLRRAAARAWRARMEAEPQRGRFVLLPRPGRPSPGGPRRRPAQPARGVPASALCGNAFRRLGLGLAGSYGRHGRAGEALQQARAVGLQRAAASPQAVPQAPAQAAQLEQLVAFEQEHREALGQGRQVRQQGQRRGPGVAAQDQQAVARQVVAAQRGVVHRAEAETAEAAGLARADAVLEDQPRVDVQGHVQRLGAQAVFGVHVVDEQFLVEVAEALVGLAGQQAAGGDQERGALRGRQAVQRQLPERQSVEMDGRQEAPVTPVEDPWAEQAGLTVARLQVAPLGGEEGAAGTGVLVEQQHTLHATPEQRVEPLVEGAGDALPVAVVQHGDALPAQPGIALRIAVR

SEQ ID NO: 19651 - protein, 155 aa, Pseudomonas aeruginosa
NFSITKNGQTTITACKPRNTRASTASRSPTPGCRARPLIERKAFIRLGSRRRRRVGGRVSSRNRPASRALSRHRPAASNSGSVVPCTASSPPRAGPRIMPRARPAYSQPKCRVRCPCVPRSAAQAIAVATLAPVSPASARPRNSIQRLSASASSR

SEQ ID NO: 19652 - protein, 166 aa, Pseudomonas aeruginosa
TRQTRTSASRCRRYASRRSTRRRPASSSIRYFAEALAQRAPAIARQVSAYRHRSQATRQRSCQRRRAQLLCRARRRSMASSSQASSKAVHTAGAGLSRLPWQTGATSSKNNRSSNAGSTPFIRRAISSGSRRVSTKASDSAWRSRRRWLGSRAMASMGPQAGAQAA

SEQ ID NO: 19653 - protein, 384 aa, Pseudomonas aeruginosa
STSGPLTPAARTSTRTSRGPGVGSGRLVATSTSGPPGRAISMAVIRSGNRFVLLIACSWENGSDLVRMVSSADAVVAQRFFIRLMRKCIRKTAMNWDDTRVFLALCREHTLRGAARALHVDQATVGRRLASLEAALGSTLFLRTSSGYLLTPAGEAAFELAEKMERSALELLRRTRGMDHRLSGEVRLSTTDSLAVDFVLPALARLHLEHPDIRVLLDSASAVVDLPKRETDIAIRTLRPENPDLILRKLASWPMGLFASADYLRRNGVPVPGERFRGHDLVMYEPYWHSQRELTLGGEPIRDGRVVIAVNSNMMVRQALARGLGLCELPLYMGERDGLVRVWPQRERRRPYEVWMVTHKDLRHTARVRAVIERLVEAFAEAPA

SEQ ID NO: 19654 - protein, 312 aa, Pseudomonas aeruginosa
ACNAGAGFRSNAAARRGIAHHRRHQIEEISMAIPSIPRLAVLTLGLALAAAASAADEAQLVEAINAYRGQVQSCGGQASGELPPLAADPRLALPVNAAGDLQQAMAQAAYPMVNVQSISLSGPRDAGAAMKALQESFCRVVLDPQFVDVGVSRQDRDWRIVLARPLLRGGMGDWQAEGQKLLERINAARGQARQCGGKPYAAAQPLAWNATLGGAAEAHSRAMANGNFFDHLDRDGRTPGDRAELAGYSGGLIGENIAAGQDGVDKVVDGWLASPGHCANLMNPGYRELGAAYATDPKSDAGIYWTAMFGSP

SEQ ID NO: 19655 - protein, 196 aa, Pseudomonas aeruginosa
PSSVSPASVGNTSRLPRSSRRCPAISSKRRTFWLTVDWVECRRAAAVVKLPQSATVTMARSRSRSNRRLFDFSLSLMVVSHFRMSSPLLAGRAVSGNRSASTQRAQRSTNALEAAGNPPGGHACARNRTAERYSGTSTLTCSASWRQYSRSQSIRRPAWSRLIRTICSAGLPTETRSGPAASAGRMVGTISKRTRP

SEQ ID NO: 19656 - protein, 237 aa, Pseudomonas aeruginosa
CFRAAGGIARRAFSAPFQHWPAGLAGVPEQRRVGVHRVRPVDPREQRQVVARVGIEGRAGQRLALLGQPGFEATDLALAVGEGAAGAPGVEAVALLDVDRQHLVHPQPAADGADKEVRRGGDDQQAVAGLAVAFQAAQGVGVDARGYDPRDEILDGAGDLRRGAAGDGRQAEVHVVLHGQPALGIEFHEAAFLVQEGGLLDPAQFGHVAPPEGRAVAVDQGVVEVEEGKWHRRFLVR

SEQ ID NO: 19657 - protein, 138 aa, Pseudomonas aeruginosa
APSAGRRNGLAGARWRGARPRPPRAAGRRPADGCAGGRRTARPPPAPLPPRTGRPCASHASTGRRTSRRTASPPARRRRSRYSTGRARGLARRWRRRRRCSCTAPTSRWTAPGPGPPCRRRRSAGWRRYPSPAPPAPR

SEQ ID NO: 19658 - protein, 368 aa, Pseudomonas aeruginosa
VGQRLLAHPLRVLAIQTEGGEVRRDADARAQFEDPRQQAVEARFVEFQVARQARGVGFYRRAVGQQNVGQQHGVQQAVVQVMASAQRVGQGVDPAKPLLECHCGAGRGYQHAFPGGEVVAVAHGVFQVLPDQAHAFQGDARRHRMVERREQRLQVMGEGVHAGGGAQRRRQPAGQARVEEYAGGQQLAVADDPLDAQLRVGQHRLASQFRAGAGGRGKRQQRRQAEQRVVGEGRIAAQRLCPFEAFEAVRIAAEQGDSLGRVEGAAAAESDQRVMPASLEAPGAAVDFSEAGVARQFVAQVMVEPGALQALAHQAQGLQGEHAGIGDQQGPACARQRATPRQLFQGADAAEDIGGVVPVMQVAHGDAP

SEQ ID NO: 19659 - protein, 148 aa, Pseudomonas aeruginosa
SRPNAASAENTTTTAQTWNQGASGGARLARGQATLSASNDSQATARTFTASPARPRRKAPLSGSQRPTRRAQRAQAATIRKTTKKPPLPNAISVPTAVAFSPRARPRLASSVLQTIAAIGTLRRSTRRSRAEPGRMASRAMPKIARPM

SEQ ID NO: 19660 - protein, 134 aa, Pseudomonas aeruginosa
CRRRRRGTPRQWDSCAPAGRRRCPPGPRIHRRRPGRSGSPRRRWPRRPRRCLCPAGRSARSRRRPGSGPDGPAPAARGSLRPGRRRCRGWPGRCGSPGRPGSTTAAPPGRGRPAAAPDSRTAPVVPSRAAGDDG

SEQ ID NO: 19661 - protein, 68 aa, Pseudomonas aeruginosa
RALHVGQQPTSPYWKVRSITLVPRKDGRSYWPLIRQAATADRVANLKGHNPQERASLKKRLLRKWMSK

SEQ ID NO: 19662 - protein, 1002 aa, Pseudomonas aeruginosa
GARESGGPARSGRAVLLPRREEGDCSWPWRGALRCQRGAGRATVRRRAGRTHTRSPACPAATRTPFSDARSLAGFAVGVVDAACLRHRRRLRLGGRGGLQAVVATGRHGVELAGVDGGLLGAGGGQGAEVVGGLQAAEPGHAVGHVELLARGAGDVQVQRLGLVDPLLATAGGFDDPAGLDFERGGVEVLEVLRDALDLLHGTVVVLQVVDHDRVPQAAGLEVAHQVGVDHGELAGEVRLHVQVLVGRLDRLRDAGDVGDGRGRRDGHDVRVADAFLYALAQRRPVEGFRQVDFDVLGAALFDQLLLRVDRQDALRPQRALEGLVGAALVGQVAGSLDRVVADGFHGLVGEGDGRVRTVGDVLQVQGVLEAHDAQADRTVLEVGVLRLRDRVVVDVDDVIEHAYRGLDGLLQLGGVQLAVDDVVDQVDRAQVADGDLVLVGVQGDLGAEVRAVHHAHVLLRAAQVARVLEGQPRVAGLEQHGEHLAPQVLGLDDLVQLQLAVAGQGLVVLVALLEGLAVEVVQVGDVGRREEGPGAVVEDALHEQVGDPVGGVHVVGTTTVVTGVLAQLEEFLDVQVPGLQVGADRALALAALVDRDRGVVDHFQEGHDALGLAVGALDVGAQRAHRGPVVAQAAGEFRQHGVVVDGAVDARQVVRHGGQVAAGELRTQGAGVEQGGGGTHVVEGRQQVVELDGTCLAVLLLDGQAHGHAHEEDLRQFEADAVLVDEVAVVQGLQAEVSELLVALVIDGLAQFLQVEFLQLGIDQLELGAFLDVGRQGLGVQLGHLVMGGALGHAEEAQGFGAQGVHQQAGGDVGVVRLALDQGARGHHQGGVDVLFRRRRRRVFQVSRSIRAPSTSGRPLAGFADDGVHGGLFQRRQAAVGAGDADARVRLGDVAGGAGVLALGGAGFAVDHVVAGDLLLAGAHQGQFDLVLDLFDVDGAAGRHAALEGGGDLLGQAAHGVMDTRRGGGGAAFHGEERLGDGHGDLVIGVGDYGAVALDHA

SEQ ID NO: 19663 - protein, 314 aa, Pseudomonas aeruginosa
VLGSVRRPRQRWRMPFVALGKHRRRPTPQPFGARTLPTICSVCKMFLACCRAAPVLATMRAALRGPHGGSGTAIRGGCVEQEAWRILIVEDDRRLAELTREYLEGNGLKVDIEANGALAAARILAERPDLVVLDLMLPGEDGLSICRQVRPQFDGPILMLTARTDDMDEVLGLEMGADDYVCKPVRPRVLLARIRALLRRSEAPEAGAPAADSKRLAFGRLVIDNAMREAWLDGTTIELTSAEFDLLWLLAANAGRILSREEIFNALRGIEYDGQDRSIDVRISRIRPKIGDDPMHPRLIKTVRSKGYLFVGEG

SEQ ID NO: 19664 - protein, 116 aa, Pseudomonas aeruginosa
WNAIRNARSNGILPGSDNKNSVAQPNRRSLPGLGRPLIKNCKLESVVMADREVGTVKWFNDAKGYGFIQRDSGPDVFVHYRAIRGEGHRSLVEGQKVEFSVIQGQKGLQAEDVSKV

SEQ ID NO: 19665 - protein, 140 aa, Pseudomonas aeruginosa
GRRWHPCAPGGRRRSARRRRSSTPGCLSCPPRRARRSMPWSSIRASKGWCCQACSGPVGTTSVCPAKHSTGPSPPRRAQKLSTSSMRIGSRAKPAASRRRIIRAWQSASRGVTEGRRINSQASSRVGERLGEEAVMGSAS

SEQ ID NO: 19666 - protein, 284 aa, Pseudomonas aeruginosa
CARQSAIRFQRWLVMQVDEQRFGGIGRLYGREGLQRLADSHVAVVGIGGVGSWAAEALARSGVGEISLFDLDDVCVTNTNRQVHAIEGSVGKAKVEVMAARIRAINPACRVHAVADFVTRETMAEYIVDFDYLIDCIDSVAAKAALIAWCKRRKIPVITTGGAGGQVDPTQIQVADLNKTFNDPLAAKVRSTLRRDYNFSRTPGRTYSVPCVFSSEQLRYPKPDGTVCQSKSFVGEGVKLDCAGGFGAVMMVTATFGMVAAARAVERLADGRALRPSRRTPGNA

SEQ ID NO: 19667 - protein, 227 aa, Pseudomonas aeruginosa
DTVWMPDLSTWNLTIPQGRPAITISTSQLQRDYRSDYFQRTADGIRFWVPVNGSHTRNSEFPRSELRETLSSGRPYNWRYARADNWLEATLRIEAVPSTRRMIIGQIHSDGSNSGQAAPLVKLLYQLRLDQGRVQALVRERPDDGGTRAYTLMDGIPLGQPFSYRIGVSRSGLLSVSVNGSALEQQLDPQWAYQGLYFKAGLYLQDNRGPSSEGGRATFSELRVSHQ

SEQ ID NO: 19668 - protein, 692 aa, Pseudomonas aeruginosa
CIDGVDDMKRRSVLLSGVALSGTALANDSIFFSPLKYLGAEQQRSVDASRSLLDNLIPPSLPQYDNLAGKLARRAVLTSKKLVYVWTENFANVKGVPMARSVPLGELPNVDWLLKTAGVIVELIVNFVASLPASAAAQFERIATGLSGDLEAARQVHEALLEEAKNDPAAAGSLLLRFTELQTRVIALLTRVGLLVDDILKSASNLVTQGGQGDGLNRFRAVFGTLRLPEVADSFRDDEAFAYWRVAGPNPLLIRRVDALPANFPLGEEQFRRVMGADDSLLEAAASRRLYLLDYAELGKLAPSGAVDKLLTGTGFAYAPIALFALGKDRARLLPVAIQCGQDPATHPMFVRPAESESDLYWGWQMAKTVVQVAEENYHEMFVHLAQTHLVSEAFCLATQRTLAPSHPLHVLLAPHFEGTLFINEGAARILLPSAGFIDVMFAAPIQDTQATAGGNRLGFDFYRGMLPESLKARNVDDPLALPDYPYRDDGLLVWNAIRQWAADYVAVYYASDGDVTADVELAAWVGEVIGSGKVAGFRPITGRSQLVEVLTMVIFTASAQHAAVNFPQPSMMTYAPAICAMSAAPAPDSPGGKSEADWLKMMPPTLVALEKVNIYHLLGSVYHGRLGDYRQTGFPYAPVFSDRRVTASGGPLERFQARLKEVEATIRTRNQARRRPYEYLLPSRIPASTNI

SEQ ID NO: 19669 - protein, 186 aa, Pseudomonas aeruginosa
AGAHPPGACRPARRAPPCTAPGPARSCSRCASVRAPGRWRARTGSPGPAPRPAARRAGRRRSPSCPDSHRTARRCPCSRRGRSPRGSASGSPCRPPPASAGRAPRGRRRRGRGRGRGRDRRRRIPRTDPSGYRSRMRRPRRWRSPWPGRWPGSGRPGRCGTARRRGSCPSARGPSPAVPRARLRRW

SEQ ID NO: 19670 - protein, 513 aa, Pseudomonas aeruginosa
RAQLDGLARTGRQAGAAAVAALAVQLGQGDAAGGRAEADRGGFAGVLATAAVDPGQGQAGFADRGDPGEGRARAIEQAGLAAAGAFPAQRAAGAGEVEFDEPTGAELQHAFRAGLDAGGAACAACGEVGGGPRRATRRRVPAEAAEQLSATAHTRPQAGGPGGPASSWYIQTQKPKPPTSATDSSGNRQITRNRKSLASMPLTRPWSGCSFIGPASMQATVESLDPTCSTGKNLAEPARGSLETERSPANASRSARVQQAFRGGSVPCPYSASRERHDSRRTEKDHESTQDSLHRHRPAGFRRRRPGRRQLRRPDLGRDQQQHPEIQVAEPQPEQPEPRQGDRQHRHLGHPRRPAVRAGPLLRDLREHLRHQQRQQAAPAEPARQLRRLPADRRQQHQAVRRCHPRPGQAGTGRQGLQARQRCRLRCRAAGRYPAGAEQECLDRRRLSLSAHQRQHRDDPAWRQQAGLPGPAQQLAILPGRQLQVLNDRAAPARACFDGRAGRSGRISSGGTS

SEQ ID NO: 19671 - protein, 524 aa, Pseudomonas aeruginosa
WNSSTPTTRSATPTSSRCWSAACGASWRPAAASSRSIRCAARATCSPSAAGDPFPAHPSDARRRRPGGAVHAGAAAGPAAGLRHSPGEHHRAAPGRRRGDPGLGGAGGEGPPGDARAPAGGGVQPAGGQGPRLYLRPEWRSALALHLGGRRVDQLHAALRRPRQRIPHHPRCEGRGVLRVRRRDRPAARQAGGLQHRHHAIGQRVREPAQGVPRAALPVARRRPAGLARAALAGSDLGLPGDARVEFRAGPDRIRRAREPERGASARAAAPDPLAEPPVAQRAQAARALPPLPRRPGAQSEDAAGGLAGGRRPARRGARQPRAGAGATGPDRAHEPADRLSVAARQPAQERPGTPSRATGAAGGDPVRRAGQGLSRQAGKPAAGLLAVLQRAGGARRAAGTARQPAGERLSPVPGPGPRGRPAGAGLLGAVGRGRRSRSACRTARTNHPPRRARRYPAPGAGHRPGRGAGHHRELRRRTEPGRFRAGRRLLPHTFRYSLRLGGRYLRLRCFRATLKSVRLAQFL

SEQ ID NO: 19672 - protein, 1128 aa, Pseudomonas aeruginosa
RRYRGFERMFSGKTDDRGLWAGIQAGVLFFLAALACIYLSRQPATIAAIWLPNAILTAALLRAPLRQWPAILLCSAVANLAANRLYGDSLWMSAAFLPANLSEAIFAAMLLRINRVREDFEFNLHSAVRVLWAGALIPPLLGASVGAVLVSVFGMGRFPEMWARWYVGDAMGMLALLPLCMASNLAAWRHALSGRAGVDNAMLLLVTLVISFVALTRLPYAFIYVLLPLLVAAASTSVFGTALIGCLNTCFIAVLIALGVFLPESSQQRFGEPLLYLPMALTLIPAFLVSVIMERSRREQHQVAIGEAQFRGAMEFSAIGMALVSLEGRLFKVNEALCRMLGYSAERLGEQSFQEITYVDDLELDLDLVRDLLAGRINSYQMEKRYLRQDGETFWARISVSLVRDEEGVAQYFVTQVEDIDSRKRAELERERLAERIKLATDAGQIGIWEWDLARNRLHWDFRMFDLYGIRSGPGETAVEQWKASLHAEDHDRVLRELERAVSGLQKFDCEFRIVRPNREVRHLRAIATLTRDEDNRPVRMIGINSDITEIRTLAETLHEEKERLQVTLYSIGDAVLTTDAGGRVTFMNPVAEAMTGWTLQDAIGAPHELVFNVLDSDTGEALESPVRRCLQNTRVFYLEDGATLISRKGEQHDIQNCAAPVRTRDGEIIGTVLVFQNVTKARAMQRELSYHASHDALTGLFNRTKFEEELQRALANAQERATQHALCFIDLDRFKVVNDSAGHAAGDMLLRELSRILADRTRASDTLARLGGDEFGLLLFDCDLAEAEQVASKLIEQICSVRFPWEGRLYDVGASIGITALTATSRSTSELMSQADVACYAAKHAGRNRVSVYQFGHEEVERQHRDILLASGLREALENDRFQLQAQEIVPVGPRRDGDRHYELLLRLYDPDGQMTPPGAFIPAAERFNLMASIDRWVINEALINFGARIAAVEGLSIGINLSGNSLNDPLFLPYLLDRIEHSPLRPERLYFELTETALMNQLSVASRIVAKLRDLGCKVALDDFGSGLSSFNYLKNFVVDVIKIDGSFVRNLDKSPVDQAIVDSINQIAHRLGAVTVAEFVESREILDHLARLGVDFAQGYAVGRPQPFATVLDQLRSGLRRQELG

SEQ ID NO: 19673 - protein, 233 aa, Pseudomonas aeruginosa
WFPSGASSSTRAPCSANWPARATLRRLPAIFRWAAAKRSKLKPVRQGEVKSSLPPFEPALVAGFFMPRRRPARAARRGTARGALVAPLLAGSPRNRRSGSARAARGRPPGGRWRSRRGHGSPVPARYPGRPRRREPAAGRRRKPDLSRCAGRPPPPSPAATCASHCAPTPATAGMPGNRSLRGSQGLPPAGAGWPPGSAAGPSAPARRVRGSRRARGGWRRRFVPGAGRRAVP

SEQ ID NO: 19674 - protein, 394 aa, Pseudomonas aeruginosa
AILHRRYRHLRLDPYGADRRLRLQPLSPPGRLAPAHGPAACGAARDPPAGTGGGSMSALLQGASAPAFVGHPGYRRMFAADALTLGLFLPLRFYQGDMRVLLGQARLVEEIDRLGFAAVWVRDVPLFDPRFGDAGQVFDPFTYLGYLAARTRRIALATGSAVLALRQPVDLAKAAASVDRLSGGRLVLGLASGDRPVEFPAYGLEHAQRGERFAQGLDYLRQLLHGCRHVASPLGTLDDAELLPRPPAGAIPLVVTGSARQPADWLARQADGWLTYPESTVDASGPRRLAGKIRAWRMSIADGGFRPHMTNEWLDLVDDPAYPRTPLHGGYVLRTGRNGLIELLGEWRAAGVNHAALGIQFSARPAAEVIQELAEEVLPLFPSHPGVQPASMDW

SEQ ID NO: 19675 - protein, 410 aa, Pseudomonas aeruginosa
  UNSURE (142): Identity of amino acid at the above locations are unknown.
AARQAIPTNARRPRGGSMKGPLSSLKVLDFSTLLPGPFASLLLADMGADVLRVESPGRMDLVRVLPPHVDGTSASHAYLNRNKRSIGLDLKRQGAREVVLELVREYDIVLEQFRPGVMDKLGVGYEALKAANPRLIYVAITXYGQTGPYRERAGHDINYLALAGVASYTGRRERGPLPLGVQLADLAGGSLHGVMGLLAAVIHRQQTGEGQFVDISMTDCAFSLNGMAGAGYLAAGVEPEMEALALNGGSFYDYYRTRDGRWFSVGSLEPQFMQQFCAAIGRPELAARGLSPKPEEQRALKREIEMEFEKRDFAEWQAVFAALDACVEPLLPLSEALEHPQLQARGLVARVPLADGGSQAQMACPIKFSAGLPAPRHIGAALGADTVAVLEGLGYSAERIAELKAAGAIA

SEQ ID NO: 19676 - protein, 307 aa, Pseudomonas aeruginosa
GVRAFGKTPAAGDYAGDRRAGAGVGTTARPGCRIRQARRRARKNRAAVARGPVVRCVRWTSAGVFRADPAAPEDHRQGDHRHQHHQAHRQHRAGEQEAFVLVDVHEGGNPHVEQVDRVADRRHPDDHSQPEVRIQRRQPGDEQRRGVVGGEHDALGQARVGVVGPRHPVDERAHHRHPGEHRQVGEDRHLQRAGLGQLDRIAAADHPADLGRADIGGNRRNGSQDQDVGQVHVADAFFFATDFLPFLIGMGEEPPYMMDHAVSSSFLCGRPPAKRRARMDSATRCSADLCDLMSQYRNGPSPRRSRV

SEQ ID NO: 19677 - protein, 241 aa, Pseudomonas aeruginosa
TSEPRRGSVLLSGLQGFPMRDYAWMYEYCLNRFGSREALEARLPQPKSAAELRAVGDDRYLSLISLRIFRAGLKHSLVDAKWPAFEEVFFGFDPQKVVLMSAEHLERLMQDARLIRHLGKLKSVPRNAQMVLDLAREHGSFGNFLADWPETDIVGLWKLLSKRGNQLGGLSAPRFLRMAGKDTFIPSDDMVAALKAQEIIDKPPTSLKDLAAVQAAFNQWREESGRPLCQLSVMLAHTVNH

SEQ ID NO: 19678 - protein, 478 aa, Pseudomonas aeruginosa
RDFDIRETEGESMALVEEPTISTRSGELAWLVDCLAPIFDGLRQPVTVVDPSGRFVYYNRASGLLDGLDPQRALGMHLLQSAPWLAAEQSTLLRCLAEGRPSIDTLQAYVGAGGELLQYRHRAIPLRGRDGCLLGAMELGEVVAETEEAAGLADCPNILSVAPSLLRQLQRLDVFAATDLPLLIHGETGTGKELFARRAHALSPRRSGPMISLNCAAIPETLLESTLFGTTRGAFTGAENRKGMFALAQGGSLFLDEINSMPMAMQSKLLRVLQDGSYLPLGSLSPQRADVRLIAASNQPPRQAIAEGRLREDLYYRLDVGSLCIPPLRERPGDVELLARAFVRRDARSLNPRVTALGERALAQLLACDWPGNVRQLENVIRRSLLLHGEGGALLDEVAFADDGAEAVGGEAALSMNSAAVGGLREALAQQERNLIEDALRQARGNLSRAAARLRIPRTTLLGRMRRLGLPASLDPPA

SEQ ID NO: 19679 - protein, 261 aa, Pseudomonas aeruginosa
QEPTMDSHSPIATVAQALRRAERILVITGAGLSADSGMPTYRGLGGLYNGRTEEGLPIEAALSGPMLRRDPALCWKYLAELGKACLAARPNAGHEAIAELQKHKPECWVLTQNIDGFHRQAGSPARAADRDPWRTGAALLPVPAVPRAAAWRSICTASCRRVGAACGGVLRPPVVLFEEMLPEEAIDTLYRELRKGFDAVLVVGTTASFPYIVEPVLRTRQAGGFTAEVNPGVTDLSERVDVKMTGRALDIMPQVVSHIYR

SEQ ID NO: 19680 - protein, 198 aa, Pseudomonas aeruginosa
VLRLTPCRSKVEAFLTRKASTMHALARFSILAFAALLTACASKAPPPAPAKQVVFRPATNFSPAADDVLFRALGLVGTPYRWGGNTPDSGFDCSGLINFVYRDMTGIKLPRSTREMISMRAPSVPVQALQTGDLVFFATSGGRTVSHAGIYVGEGRFVHAPRTGGTVRLDSLQNSYWQRAYLDAKRVLVAPSPLARVP

SEQ ID NO: 19681 - protein, 141 aa, Pseudomonas aeruginosa
WAACAPETAHACLPGGASFHTARRRTPPETGETPCPSPTSDSTRTMRRCCSSTTRQACSPWSAISARTSSRTMSWHWPTSPGSSTCRPSSPPASRMAPTARWCRNSRKCFRRPRTSPAPATSTPGTTRTSSRRSRPPARSN

SEQ ID NO: 19682 - protein, 711 aa, Pseudomonas aeruginosa
SRASARRSKPASPLSRTQGTPTIGCLVSFSVQVFSSERRFAGTRGSGTPPHAQEKPHGYPGRQRFPRHHPLSRDPRRRQPPVAERRAGRPRRRRQRSLAARDPALGAGRLHGDHRGDVRAAQGVAAGGYRRATEHRRGTHQAGALHPYPPRHPPGRRSRRRAAPASAGDRQCLPDPSCTLRRGQRQQPATRLNPHAQRGARHERRHQGIGHFRQPAQRLLQQRGAAGGDWPGPAGHEHRAGGHLRHPAIQRGRLRPRLPARGGTLPRADPRGGRAAVRHPGIQLFDGRGAEECHRLGLAAAGAAVLRQAGGDPRCQRRAFRHRAGAVSLAPDAGVPRRSSAEQAGSDDLQRAERLRRPGPAARRQGARADPAAVAGPAAMGAPPARLNASSPESLNMSNTEERCDLSSSRDCPERHEHLLQRVTARAAEIGGGITVSRLMPSRQRRMIGAWCFLDHAGPAEFEPGGGLAVGPHPHIGLQTFTWMIQGEALHRDSLGNVQVIRPGQVNLMTAGHGIAHTEESLPDERHAHAAQLWIALPYEQRDIAPAFDHHPDLPRWQEQGVTFTLLAGALDGRQAPCRLYSPLLGADLACDDASTLQLALDPHFEYGLLPLEGGLEVGGEHFAVNELAYLGDGRDGLQLQLDPGARVLLLGGAPFGAEIFMWWNFVGHSKGEIARAQKAWEEGDARFGRLDALEGPRLSAPPIPWKIDAE

SEQ ID NO: 19683 - protein, 210 aa, Pseudomonas aeruginosa
GRCAAGGPGGVLECLSAIVADLRSGDSPAAGKLSAPIAGQNSPIACTEQEVSHMQFEHLVQVNDRTLVDLPVLDRLQLWEGLVCRAREPQYFVVGLERFEILVDDGDRLHRRLYLPGLVVEDEVVLKAPDSAHYSIKPSAEVAGGSLDMTIEEPEPGSLFVRFAYCTRYLQPLGDELPYDAFVKQAYIAMDVETIATIRDRFGASAASGS

SEQ ID NO: 19684 - protein, 543 aa, Pseudomonas aeruginosa
FPRLGPYFADIAVRRLGYPRGIPSVGWRASAQQTAGRFRRSRNLMPVEHLDVLIVGAGLSGVGAAYHLMKHCPGKSFALLEGRAAMGGTWDLFRYPGIRSDSDMFTLGYNFKPWSDPKAIADGPSIRRYIEETARENGIDRKIRYRHRVLRADWDSANARWNLDVQRGDEPEPLRMTAQFLLMCTGYYRYEAGYTPEFVGREDFAGQVVHPQLWPEDLDYSGKKVVVIGSGATAVTLVPSLTDKAAHVTMLQRSPSYVITLPQKDAISNFLRRFLPETWIYRQARARNVAMQMVFFMLARTFPGLVRKALLKLASLQLGKRFDMRHFSPRYKPWDERVCAVPDGDLFKVLRKGKASVVTEHIDRFVERGIRLKTGEVLEADIIVTATGLDLVMFGGAELAVDGKPFQVNQSMGYRGIMLRDLPNLAAVVGYTNASWTLKADLSSEYFCRLINHMDATGMRQVTARDSTGDVREEPFLNLDSGYIQRAAERIPKQGDRMPWKLYQNYVLDLALLRYGKVEDGYLVFSSPAPQRQAGGAAVQALG

SEQ ID NO: 19685 - protein, 139 aa, Pseudomonas aeruginosa
RSPPAAARNRPRVPSRRRRRRGSGAGGCGSCRPGWWTTHWRRAGTSTSAAPSDRPAGTCSGSGGCNCPGTARPCRCCAGGSRRSGVRPGTRRRPPAGRRAPPPAGPRPAARRRPAWPARRRRSAPGRRGSAARPARRAR

SEQ ID NO: 19686 - protein, 263 aa, Pseudomonas aeruginosa
TLDPAVRLDQLGDREDVLQVEAVGGELGVQQGQQLEGVGDPGAFADPVAARRVPLDPGLDRRQGIAQGQAAVVVHVVLEDHVGELVTQQREHVEGLVRQQDADAVGEADAIGAGVARGGDHADQVADRGARGVFHRGPDPQAAFAGVADRVVEQFEHLLAAHALELGFQRDRVDRGEQPDPLAHRFPAPRRYPPGAPGCGPAPAWKPPPPRRVPARVRPRKSAGGRTRSYPPPAPRFPVPAGPTARCRSCTGGPGTPRAGCSR

SEQ ID NO: 19687 - protein, 454 aa, Pseudomonas aeruginosa
RPSRRTRATGRRARTARPHPASVGAAGGRARRGTGGANRRPPPGARGTSGSAPPRRDRRSCRAPRQHQRLLRRRRPFQQTLRRQAVAAQETAELVEARVCLQVGESQVCSRTRRLTEGDQLQGEQRVAAAEEEILVGGADLATQQFAPQLRAAALVGIERAGAALQRFFQAAQQGGAVQLAVCRQGQGLDPDAGMRALPGGQLAEQGLRAGVGFSRPGAEQLLDAVALADQQGAVEDARLAAEALFQGGEVEAIAVQLDLAIAAADEAQPALLVVASAVAGTVGTQEAAAIGQLDEAGAGARRIVPITLRQAGAEGDDLPGPVGLGDLLSLLVEQEHRGAGDGLADGDVVFLEVVVGDDMAAGEGGVLRRSVAIHQVQSRMPQQRPAHVRHREDVAAGEQLAKAAETVPGRGSTRVLNSEAGEPRRCRLRARRSTGAVRPGRGGRGRSARSSRR

SEQ ID NO: 19688 - protein, 434 aa, Pseudomonas aeruginosa
QPEPARLLHVSGEFAGGVAGAPEQIGADLADDGPAGILGRHRTDHRAAVVRAGGGQPHQAAQRNHLAVDGHAVAVGQRYVQRAARTFVAVRAQAEEHEAGIARQQFGDPLRIGLGPVADALHADLFLRHQALLDQPAADRLVRVAILVAVADAQLPAVFQLDAPGTLDLQELQVHRVAQPGEHRRAGAVVADRRGVVVGFQHPAFQASAQALALEFRVDAFQRDHHQVVRYAVDRHRGFFALAQAAVVDRFVVAGDQALVAVAGGTQAIDLHPLLEERAHRRRIGGDRRGARTGLAPYRVLGQPRAGRAPGIEAGEQVGVAGGRQGVPGHAVVGGDFGGFGRGLFLAVVACRQQGGERERAEQQAAPGMERKLHAKDFLVVDRSPLAWAKRDGASNRGDDRSVSPRYTEAAMSSRSQRWAGSRCERSCQSMARS

SEQ ID NO: 19689 - protein, 134 aa, Pseudomonas aeruginosa
SVAATRQVCRDCVGSNGAAGATACSRASRARRNGSRSSSARAVGRIPRGPGSSKGSSKIARSLARCTLTEGWEKFRRSAARVTLCSVSSTSRVTSRFRSSRRRLIIHIPGISDIHFNYIRRWPILRPPFAGDPP

SEQ ID NO: 19690 - protein, 185 aa, Pseudomonas aeruginosa
VTFSRLSMSMHSPDDPSPRRRLSRDERQRQLLEVAWRLVREEGTEALTLGRLAEQAGVTKPVVYDHFGTRTGLLAALYQDYDLRQTALMEAALEASEATLEGRADVIARAYVDCVMQQGREIPGVVAALASSPELERIKRDYEVLFMDKCRAVLEPFAGGGPLTVAALRAMIGPPEALSHAAATE

SEQ ID NO: 19691 - protein, 221 aa, Pseudomonas aeruginosa
IAPEEARRELFEAILRWSRGIVGEGTACPGGISPGDSGGLSGAGGRHFRHPGLGLAFHGGGGRRALGVQVSARRGGRGGAAARGRRATPGASGGEPAGAGAAGVCGTAAVFPPRETAWRLPPGRGLPAPGRTRTAGGRRCVGALLRRAASTATGAHAGGWSLAGASLGVACGDAQARLAAAACGLARTRGTLGAGICQAACRSAGFDLRLLRRPWLEHGIR

SEQ ID NO: 19692 - protein, 425 aa, Pseudomonas aeruginosa
PAGRPAGVRPARRPGPRRRPPSGLPSTLPRGLAQRRASLAGDAGRRRPVVPQRVGPGADPAGGARPLLHAAGSLALSRRGHAQFHSRHALRDTCRIALQIPSATADQRFSIAAAVPRLLLVVRYPGHHSAQAGVAGNRLPDRLQHPGRHRQSRPLRFRRLRQPVLRLGAGALHQPAGLPPAAEGPGTAFGVAARPSAPRDPRLAASSRRFRRACLAGPPAASHRPVGRAAWHGTSAQRAGPAPGLRIPATRPRVAAPVARPGRARPGRRGCAVDRARTASHRRPPSRSAARRAARTPCRRPPGGRRRVAPGRDPHRPRLVAPGLFAKRLVRRGAAWRKDLMKTSFLLALLLSCWSQVQAADDDGKELPPIERYDYGMPLDIERVLSVTPVPATCGVVPLVMLYRDSAGRLHRLQYRGLGAGCSRH

SEQ ID NO: 19693 - protein, 205 aa, Pseudomonas aeruginosa
PAPSSAKPVSASSSGCGACACSPASMRWRQGTRSSRSHWTSATTARAPSAPCFAGPWAFRRASISAAAPPTGWPRATEFSPSGAASARPGRRPGAPRRKGRRRRSRPSGRPAGAPRGRAGPAPAAAPAVVSAPGHRPGAAAGRRRRSSGSRRSARSGSARAARPVASAARCRSRRRGCAASRSAPRPSRPRPCPGPSPPVPRARP

SEQ ID NO: 19694 - protein, 288 aa, Pseudomonas aeruginosa
RLARPWGGGSCGSGRVERRYVSEERRAAQAPPAVVREDVRRPARDSLLRRIDALHQSIGALRRRTLANALEPALQVREVGEILLLPLVRDDPRIDGHVGDAVVVAGDEGAVRQALVENAVQARGFLDVPVDGVGNLLRGEAVEMVVLPCHRPQPAHLPEQPLQGFLARAQVLGEEASGLFREIEQDGAGLEQRQGSAAVGRLAIDDGGNLVVRRHLQEIRLELVALADVDRMDGVGQAGFFQEKSNLVAVRGGPVVQVDHRCVSGSSMGYERKTLRQEPRFDANRCRA

SEQ ID NO: 19695 - protein, 312 aa, Pseudomonas aeruginosa
RHGPGTLRASGSGSGHQPPAPAGLRRAAACDKPGRGADNRVARPWHRGQARGWRNASARGQALASVVEIVLVDELGHFPVEADGQQAEQEAAEQGDQHRLLGRQFQLHADQVAPGAGEGHAGIEFAAEYQGYVVAQDVAENAAEHPGDHPADRRDQQAVAHFQADLAADQGEGHQANRVEYQEQRAQVAHQRRDEHCHQRGDCGQRQVFRVTDPGQRVMAQQHVAYRAAAQGGDAGDQHHAEQVHAAPAGRQRAGHGFGGDGDDVEHGQQHGDGARMKRLRILPERSSTPKPRSLAQHLRRACATRSVPGRR

SEQ ID NO: 19696 - protein, 182 aa, Pseudomonas aeruginosa
LMPGCLRASSSACRDWAKASRSPTTRLAKGGPRIAGWKSSSSANDAGGAEQNGGVEAPVFVHGWRRGGLASMFPRTRCLGGSSMKAFLGLGKLVTLVFWGAVLVNLLHPFAYPLNWLLSIAGGLILLIHLIEILVLGGRLKARAHPWLDRLQVLLFGVFHMLALPALSPASELPQDKEDDHA

SEQ ID NO: 19697 - protein, 1067 aa, Pseudomonas aeruginosa
RPRPDLAPAGGGGGKPAAGRPRWRRRSRLRWPGRGFRQGLRLPLGQRAERWRRPIRKRRRSGRGGRSDSSGSAGRFSSGALANPSARRRRRRWRQGRQTGCGGQRHRLLDLLGGCRSCGAQRRGRRERHQRQRRQPGRRALLRRGRQHGFRRIAGSEARACRYQGYQQQAEEQVEADGAADLPQRLPACRPVLGLHRAAQFRHLQRLHPQEQCQHGDVEPHHYLYVARRAGETVEAQVQHADAADRQQDHRSPDPMEETAEHLQPQAQAGWGLQRGDGRRTKNRPGEEHASDPDQGGQDMQGVDEGVGGHSAISAGGCDEARYHSRPVEPLKIYPAMARRRIRLPLRAGPRNSMLSAELKSQIQGAYTRFLEAKELKPRYGQRLMIAEVAKALGAIKEDEEGHREGEPAVVAVEAGTGTGKTVAYSLAAIACAKASGKRLVIATATVALQEQIVHKDLPDLLRNSGLAFSFALAKGRGRYLCLSKLDVLLQEGQAQSATAQLFADDGFNIDVDETSSKLFNQMIERLAGNRWDGDRDSWPEAIDDAHWAQLTTDHSQCTNRHCPNFQQCAFYKAREGMTKVDVIVTNHDLVLADLALGGGAILPDPRETLYVFDEGHHLPDKAIGHFAHFTRLRATADWLEQIAKNLTKLLAQHPLPGDLGRLIEQVPELAREIKTQQQFMFTACEEIGDFRAGEDMEGRERPRHRFVGGVVPEHIREMGIELKKGFSKLTDLFTRLTDILKEAMDGEGAGGIASHQAEEWYPLFGSLLARAQGNWELWTAFTCEDPQDSPPMARWLTLAESGSFYDIEANASPILAAETLRRNLWNVAYGVLVTSATLTALGTFDRYRMRAGLPRNAVTAVVPSPFHHAEAGVLRVPDLKADPRNAAEHTAAIIRELPELVKGARGSLVLFSSRKQMQEVFDGLDRDWRKRVFIQGNLSKQETLNKHKSRVDDGEDSVLFGLASFAEGVDLPGAYCEHVVIAKIPFAVPDDPVEAALAEWIEARGGNPFMEIAVPDASLRLVQACGRLLRTEQDRGTITLLDRRVVTQRYGKAILNALPPFRREIA

SEQ ID NO: 19698 - protein, 783 aa, Pseudomonas aeruginosa
RAGLRGRAPAFTSEPHQEFPAFAQAGMELRKTGFMIRSRWHLPLLLGLLAVATPLAASDIQQVLFNFVKPMAVVGITLEDADLPSATAEATPEGDILRRVTFSPAQRPTLRMSPALGRWDWSAADYVSLRIQNAMSWDMTLEVAIEGEQGAPGLQASIELPAGPPQTLLVPLRAVSPEALGMRAGPPMPQMVEGQRVLLAPRVEGSLDRARVGALSLSLRSPQAPQSILLGRFGIRTGRAVERSILTGLIDRYGQYSRADWPEKIRSDEQLRSAYAAEAAQLRDWERQTPARDRFGGLLGGPVFEASGFFRTEKRGGRWWLVTPEGHPFWSLGVNAVTADGSRTYVEGREPMFAELPAEGEPLAAFFGEGDDRRGVAAQAGRRFGHGRWFDFLGANRQRIAPQASADQLAGEWRQRTLERLSAWGFNSLGNWSDPALAAQARMPYSLPLSIAGDYATVSSGFDWWGPMPDPFDPRFAMAAERVIAIAARDHRDDPWLLGYYADNELAWAGRDGSALARYGLAFGALTLSMDSPAKRAFVKQLKAKYLGHEALAEAWGIELAAWEALEAPGYAAPLPGEGHPAIAEDYSAFLRLYADAYFKTLRDALQWHAPNHLLLGGRFAVSTPEAITSCARYCDLLSFNLYTPLPGQGLDDSLLARLDKPVLISEFHFGSRDRGPFWGGVSEAANERARGDSYRTFLEAALKSPYIVGAHWFQYLDQPASGRLLDGENGHIGLVGITGLPFAGFVDTVRRSNLAALSRLSAMARSMPAVEPLPPREDSAGS

SEQ ID NO: 19699 - protein, 220 aa, Pseudomonas aeruginosa
RSLQPVPPVVRRRGEDRAPAGRTQRHDPGHRRRRRLSALPYPPAQGPRRARLHLLHQLRKRQGPATGGQSAGGHDLLLAGAGAPGAHRRQRREGHSRGIRRLLPGASAGQSPGRLGLAAEPGHRRSRRAGTAARGHRAAFRRPAAELSRALGRLPSPAAAHRVLAGAAEPPARPSRLSTPGRRLAARTPGALSPPCSNWIRRWRSTSSIGRWRSCRTTSM

SEQ ID NO: 19700 - protein, 382 aa, Pseudomonas aeruginosa
LMKIVIAPDSFKESLSAPDVAEAIARGWRRVFPQAEVLLRPLADGGEGTVDAVLAATAGERRECRVEGPLGEPTLAHWGWLDDATAVIEMASASGLHLVPRDRRDATRSSSRGTGELIRAALDAGARKIILGLGGSATNDAGAGLLGALGVRFLAADGEELAPGGAALAGLHSLDLGGLDPRLVDVAVEVAADVDNPLCGPRGASAVFGPQKGASAEQVAQLDAALAHFAKVVVATLGEDFSRVPGVGAAGGLGFAARAFLRARFRPGIELVAELAGLADALVGADLVLTGEGRLDAQSLHGKTPVGVARIARQAGVPVVALAGSLGDGYQRLHDAGIDAAFSLAPGPISLEQACAGAAAELEARAEQIARLWRLAQASREG

SEQ ID NO: 19701 - protein, 165 aa, Pseudomonas aeruginosa
YSSVIPFGDAVMRKSALIVASFTAMALALGGCQSSLTGDTYSREEARTVQTVRMGTIQALRPVKIEGTKTPIGSIAGAGVGGVAGSAVGGGKGSYVAAIIGAVAGGLLGAATEEGLTRTQGVEITVREDDGSTRAYVQQVDQGQIFRVGERVRILTVNGTSRVAH

SEQ ID NO: 19702 - protein, 630 aa, Pseudomonas aeruginosa
PEGAAGLLDDQPPGPDHPAVRPRLPAVERRRGVPHHQPRDLQGLAVHGRRDHRPRDRQPRHAPDQRDVEVPAAYRGAGHRRLPGDGRGAAAERLPQQGDVLRRNPQPEPAGQLQLAGAGGGDPGRRVLGGLFAAFHPRRVLQRRAGPVAEVPAPRAAALHEGTGGDPGVPLPVGRHAAGLHRGAAAGRRRQCQPWRATAGIQPGDLARFQPAIADERGGAGWRCAGLCPAQAAVQLVRRVTGGGRQAGLRAAGATCGGPGRAPDRLAGERVAAALPGLAAGRGAGRGGGRAGTAGEADRLARADPAGRYHRPGHAGAGLQRPGHGAVPSYAPGRAIDPQRRRPAGGPGLRSLLGPGPGADPVVGGSGDHGPADAGAVFPALAHSGGVLHPARLARRGAGRRGRHAGGAAGLRGADPALREHRRILRREQRLRGRRLQRGQRHPGGLPWFRYPRRDQRAGDRRRRHLRDARRFRPAQADLRPAGSQLGPRQAPADPGNPVAGAAAAGVADLGVHLPARPQPAGRRFHRRPGDCHRPGAAVHRQRLAVGRAAPAAELCGHGWRRSADRRAHRARQLAVRLSVPDFRVRPLRVAADRRDRAGHGDAVRPRRVPHRGRCRAADPVLPRQAQPDA

SEQ ID NO: 19703 - protein, 121 aa, Pseudomonas aeruginosa
TRRTRGGALMEALFAITLGLLTASGVYLLLRARTFPVVLGLTLISYAVNLFLFAMGRLGGSVAVIGTPGEYGDPLPQALVLTAIVIGFAMTAFVVVLALRGLGDLGSDHVDGRPDEEEPRP

SEQ ID NO: 19704 - protein, 239 aa, Pseudomonas aeruginosa
CPAVAGLVAAGGFLRHWPLAARRLPRRVHSAADQPPAGRAQPGVASVAAAEAAGAGDVGHTRRQHPGRPPDPRTDRALASGLRRGADRAGERPRHQRAGEHRLADPGVGVVGPQRRPQDLAGARPRRAGQGGADRRDQATLRSAAEGDLPMLAYVIPLCLALLGLALLLTLARLVKGPCLPDRALALDTLYVNAIALLVLYGIWRDSDLFFEAALLIAVLGFVGTVAVAKYMLRGDIIE

SEQ ID NO: 19705 - protein, 377 aa, Pseudomonas aeruginosa
SACSSSSAPRSVPTCWPRPLCCSSCRWRRRLAASPGSSEARRNSFARFLCLSAQLAGCLYWESFFRRRAAPVVEIPLTRTRWFALACLILAMALWGSSYVVLKVAFRELPPLWVIFGRMALGSLVFLVAWRWRGRIDYRPGDWKYLLGLAVCEPCLYFLCESFALQYTSAAQAGMITALLPLLVAVGAWLLLHERIGRMTWIGFGLAVLGSIWLSLAGEPDLHAPQPLLGNFFELLAMLCATGYTLLLKHLSARYSAFALTAMQAFVGTLFFLPLALASADLPSQPSALGIQAVVYLGVVVTVGAYGLYNFGVGRLPASQASGFINLIPVFTLVFAALFLGETLNGPQMLAAGLVFIGVAISQWRSAPPPPPAGVLN

SEQ ID NO: 19706 - protein, 203 aa, Pseudomonas aeruginosa
RCSTAPTTSSTTMPWCWPSSSRRSWTASSRAVRRPATPTASPEKYRLPDAVHLAGLRAFHAACVTQRGVRRRNRLEATEVGRVAGQRLADHGRADGVDAQAARQLQGCAADEALDGAVDHARRTAEADRLLGEHAAGEGEGAPVVGVLAAEQYQVDLAHQLVAQAELVLRLAHFLQGAEVHLADRGDQRVEATGFLEQGANGV

SEQ ID NO: 19707 - protein, 318 aa, Pseudomonas aeruginosa
SCQSTTYRFHRETIVKDLDDLAAFAVLHDLGSFTRAAERLGCSKGQLSKRIGVLEQKLGVTLLHRTTRRLSLTAAGAALLPEAQALLVQAERARQAVARLQERAEGRVRVTLPVSLGETLFDALLEDFQERHPLLRVELDLYNGLRDLVGEGFDLAIRSGVEQDARLVARPLFVLQEITCASPAYLARHGEPQRPAELAERECLLNSHYSGHEEWLYHRHHRLERVRVAGFLASNHYSLLKKAALAGTGIARLPSYMVHDELGDGRLAWLLRDYQTRSTPMFLVHPFQGGLPRRTQVLADYLLDWFERSRRQLIGLEG

SEQ ID NO: 19708 - protein, 120 aa, Pseudomonas aeruginosa
GRRSMPRRSSRSCRCRLRSCSTGWLRRAAKTRRATRRKKCSGCSRRWPSGPTTPPCAKWPPRRYRPAPPTTRPSTCSGSTSSATPTRSSNWPTTCSMPCWPAASTTRSSASAGSTPTACR

SEQ ID NO: 19709 - protein, 254 aa, Pseudomonas aeruginosa
GPFSYALKSPAGRCSAAEVGVAHLRVGQQGGAGVVHDDPAVLQHVGAIGELQRLVGVLLDEEHGDAFATQLLDDLEDLLDDDRRQAERRFVQQQQLWLAHQRAADGEHLLFAAGHGPGALFVAFLQAREEFQHLVHLHLVVVLVGEEAAHRQVFFHRQAGEDPAAFRDHRDALAHDGGGGQADQFLAFVADAAAGRLRRAAERHQQGRLAGAVGADQGDDLALLHFHADVVQRLDLAVVGGNLVETQHAHASPR

SEQ ID NO: 19710 - protein, 183 aa, Pseudomonas aeruginosa
SRRSRGSRSPGSRRAGAAPGSRGKKAEQRGHHPGDRQGGPKAEPGVLGEQRVCVGTYRVKADVAEIEQAGQADHDVQADAEHHVDQDQGGDVHRPARGEERPDESHHDQGEDRPALGRWQAEEVLQAAAVDLVADAATQLERDAVAEQLPDEHGQGGRGDGPEGLRIGAEDLELDADGAQLQA

SEQ ID NO: 19711 - protein, 175 aa, Pseudomonas aeruginosa
DRIGHQDHEEGAEQRALEGLAHTFSTSGRPRMPVGRNSSTRISRPKATTSLYWSPNTSAPKASATPSSRPPSMAPGMLPMPPSTAAVNALIPARKPIPGLITPYCMPSSTAATAARAAPMTKVRAMMLLLLIPSRLVIFRSSAQARQARPRREREMNRVRPNITRKVTTKIRICI

SEQ ID NO: 19712 - protein, 214 aa, Pseudomonas aeruginosa
FRFPPGDSSCSNQATSIWSACPASTSRTSISISATRCGRTPNPAPMCTSTWTARSTASRSATPSSCRAIPPSTSPAMPRGSPRSTACTRSSARSPGCTRNTMRCSRIFAPSCMPIPANRWISSGSFATSEPCPRRPEAWERPDIDDIGPFFVCRRGRSRGLPPLPASGNGLPLAASGLLLNKLKLLNIKVFNNLARALLKCWRRKPHRQTGSQP

SEQ ID NO: 19713 - protein, 147 aa, Pseudomonas aeruginosa
ASVSTEHSVSTSRPSASAPSAPKCWPTTWPTPIPRTTRLATWTSPRFSPSRRTRPPRVPSPSAPPTSGISPPKVSAWARAACSTASRSSRRSTRTLSTPRSSRPTTPRTPCTSRRPSPSSTANSKGWSAPCVESNRHVPRQCLQHCR

SEQ ID NO: 19714 - protein, 256 aa, Pseudomonas aeruginosa
RQRHQQQHRQRQRQQARRRQRRHRDRAERQGQQQPWQGRIPQAAGGPVEEPGPDVAAAERRVHRPTGPVQHRGRRAVAEQEHGEHSLQLPVVAGPASLVAGGAQGHRGDRQVGGGHQGHLQGVPQPAGLQQQRMGQRLRRQGHRGQSHQPRPAGCRQRQLHVGRQGQQRQHHAAGHLQVRGADLDRRQDLRAPDLPAGQRRQRHPGAERRRADAQPRRPGQHRAVQSTDHRPVSRRFRQGAIHEFQHRPERHPGGL

SEQ ID NO: 19715 - protein, 269 aa, Pseudomonas aeruginosa
NRHPRSTTMLSALWVSKTGLSAQDMNLTTISNNLANVSTTGFKRDRAEFQDLLYQIRRQPGGQSTQDSELPSGLQLGTGVRVVGTQKIFTPGSLQTTEQPLDMAVNGRGFFQVLLPDGTVSYTRDGSFHLNSDGQIVTSNGFALEPAIVVPNETQTFTVGQDGTVSVTTTGNAQPQVIGNIQTADFINPAGLQAIGNNLFLETGSSGAPQVGTPGLNGLGTVAQNTLENSNVNVVEELVNMITTQRAYEMNSKVISTADQMLSFVTQNL

SEQ ID NO: 19716 - protein, 233 aa, Pseudomonas aeruginosa
LDMNRLMIVSLLGIATALGGCVNPPPKPNDPYYAPVLPRTPLPAAQNNGAIYQAGFEQNLYDDRKAFRVGDIITITLNEKTQASKKANSDIQKDSKTKMGLTSLFGSGMTTNNPIGGGDLSLSAEYGGSRDAKGDSQAGQSNSLTGSITVTVAEVLPNGILSVRGEKWMTLNTGNELVRIAGLVRADDIATDNTVSSTRVADARITYSGTGAFADASQPGWLDRFFLSPLWPF

SEQ ID NO: 19717 - protein, 405 aa, Pseudomonas aeruginosa
SEDDAMDSRLLSGIGAGPDSGSYTDLNRLNQLKVGKDRDGEANIRKVAQEFESLFLNEMLKSMRSANEALGDGNFMNSQTTKQYQDMYDQQLSVSLSKNAGGIGLADVLVRQLSKMKQGSRGNGENPFARVAENGAGRWPSNPSAQAGKALPMPEAGRDDSKLLNQRRLALPGKLAERMLAGIVPSASPAASQMQSLGQDSYLPAQSYPAASRRGFSTDGVDSQGSRRIAQPPLAKGKSMFASADEFIATMLPMAQKAAERIGVDARYLVAQAALETGWGKSIIRQQDGGSSHNLFGIKTGSRWDGASARALTTEYEGGKAVKEVAAFRSYSSFEQSFHDYVSFLQGNDRYQNALDSAANPERFMQELQRAGYATDPQYARKVAQIARQMQTYQAVAAAGTPPLG

SEQ ID NO: 19718 - protein, 683 aa, Pseudomonas aeruginosa
PMSDLLSIGLSGLGTSQTWLTITGHNITNVKTPGYSRQDAIQQTQVPQFSGAGYMGSGSQIVDVRRLASDFLTGQLRNATSQNSELSAFRSQIEQLDGLLSNTTTGVSPAMQRFFAALQAAANNPSSTEAREAVLAQAEGLGKTFNTLYDQLDKQNSLINQQLGALASQVNHLSQSVASYNDAIAKAKSAGAVPNDLMDARDEAVRKLSEMIGVTAVTQDDNSVSLFIGSGQPLVVGNTVSTLSVVPGLDDPTRYQVQLSNGNSIQNVTGLVSGGEMGGLLAYRNSALDSSYNKLGQLAITLADTINKQLGQGLDLAGKAGANLFGDINDPDITALRVLAKNGNTGNVHANLNITDTSKLNSSDFRLDFDGTSFTARRLGDDASMQVTVSGTGPYTLSFKDANGVDQGFNLTLDQLPAAGDRFTLQPTRRGAADIEATLKNASQLAFAGTARTESTTENRGTGKIGAPTLTSGPSPVDPTVLQGAFGPNGISLGATLSADGKTYTLSSPLPAGWSYVDKDGNALTGSPTLTSGNTNTVRIAFTDPSGQKYSYEFELSGVPQNSDSFKLGFNDKGISDNRNALNLLALQTKPTVGGTDNTGSTYNEAYGGLVERVGTLTAQVRASSEASATVLKQAQDSRDSLSGVSLDEEAANLIQFQQYYGASAQVIQVARTLFDTLIGAFR

SEQ ID NO: 19719 - protein, 169 aa, Pseudomonas aeruginosa
TCSTAATRVANTCFPGPRARCSRSCATRTAPTATWATRASARCRSPAARGFRSATAARYCSRTSSMPLVSIPRRRLAIPATVASRSAWSRTSWPSTASSRRAIRLRQPTASTSTSSATRSMWSTIRRACLRAMTGPPTIRIRRRPGNCPRAPSTTTRRPSTRCSTPASA

SEQ ID NO: 19720 - protein, 188 aa, Pseudomonas aeruginosa
ASSASMPPRCSTPSRAVRSSARTKTPGNASTTLRISASSTRSRWSCPASTASSTRSALPSGCCNSSTSTRPWSSAGRSPSAIGACWPASLASSASGLVPRPSPTTPISRSWWKTIFRFRATSCTSACATGMCWCGATSTHSSATSPCTIRCPRRRPPIFRWRGRFPRGCCACRSIPGWPPQTSSSSPA

SEQ ID NO: 19721 - protein, 372 aa, Pseudomonas aeruginosa
SRLARWATSTRCSDSDHGHLHAEERPFRRDGDLRPQARYLQPDRLQAAVARRARTPGAQHRHRDAAHGAGVAVLLRPGLRRRRAPAGKPGVEARGGRCADRRDPVSRLPGAGYRDHPPGPPGAAAFHRGLRRQPGLLGLSVRPQPAGFADRRRRGEEGPCAGRRPRRQCQRSDLLRRGHRDGAGVLRRRAADALRPEQRRQRLQGHHPAGGRPSRTGRRAAPDAVPRGRERPLAPCHRPAARRHRRTQLLHPARTAGGGKAARLCRCEQGRSGLLRFPPGQPDDQRDHPQEARPAGREGAFDPARLRQHQRRLAAGDHDRADQPGTRGRPQSRVALRLRYRPVLGYLPGGYRRGEVPRSDRILSALNAESAK

SEQ ID NO: 19722 - protein, 217 aa, Pseudomonas aeruginosa
PSVEDDAMKRIIILGAGGLGRQVLAQLQVDYSHGIDWVIGGFLDERGPEAVAESLYYPWLGYPESFVAEPDQLFVAAVGDPLSRQKQVACLLAKGAEFVAIRTRCTLGVRTSYGPTFFGYDVSSGVDCRIGAYGFIDQQTMLGHDVVIGDYVHIGPRCLLAGYVKVGDRAVINSGAMIARDVSIGEDAVVGMGAVVFKDVAAGQTVVGNPARVIFSK

SEQ ID NO: 19723 - protein, 428 aa, Pseudomonas aeruginosa
RVLNMSIVTGTLLRARLKYPDLDLSKVRLVGWGAGQFFQDFYPCVSEYLNLQYTICPYPENQGKRIHGVEVRAPSALEQESLEHTLIVVMANHFPEVMNQISQFHGRFRTVRAIDFDPGNVALLDEMQDVAELLPSLTMRRDLPSSRMGIFVQGLAFDFTPLVLAWNRSHFPSAYQCMVTWDHQSSELLERCRPWLDELILVPQPENLGLMNRNVILRSARLGVQRLADKGIEFAVRCRSDNILHGSLHQALNGLFSHGRNAGKIAVSLGASWQYMPFHFSEKAMIARTEDMLALWSLPEDPRPADWAADELSDRLELSPERHYQELSQYTFESALWRDYARRLGFPVESLADSYRFAQARLLALEPYMSWYSLKFTALFNLERDTFYSFSAESWNRLFSDSDGALLRAEAASRLAMNSRDFWRGRVG

SEQ ID NO: 19724 - protein, 200 aa, Pseudomonas aeruginosa
ATSPSQWITSRMWSGCWTQSSSASREPLALEVTSMPRDDSAAYSSRCGTFEWCDADYARSYLPRRFCEQLASSIAPTILGIDAQPGESLWFSKLVDLGCRLDSLESGLDSVEDCECLRNAHIDMHGYECQEMEAVSPGQVDYIAIEASLFGFCGRSDISAKAFQQMDDIGFALWDIANLSKSPKRLPTDWDELVYRRSDS

SEQ ID NO: 19725 - protein, 417 aa, Pseudomonas aeruginosa
GCLGDAHPRSQAQANISSLEGIKMALTVNTNIASLNTQRNLNNSSASLNTSLQRLSTGSRINSAKDDAAGLQIANRLTSQVNGLNVATKNANDGISLAQTAEGALQQSTNILQRMRDLSLQSANGSNSDSERTALNGEVKQLQKELDRISNTTTFGGRKLLDGSFGVASFQVGSAANEIISVGIDEMSAESLNGTYFKADGGGAVTAATASGTVDIAIGITGGSAVNVKVDMKGNETAEQAAAKIAAAVNDANVGIGAFSDGDTISYVSKAGKDGSGAITSAVSGVVIADTGSTGVGTAAGVTPSATAFAKTNDTVAKIDISTAKGAQSAVLVIDEAIKQIDAQRADLGAVQNRFDNTINNLKNIGENVSAARGRIEDTDFAAETANLTKNQVLQQAGTAILAQANQLPQSVLSLLR

SEQ ID NO: 19726 - protein, 480 aa, Pseudomonas aeruginosa
SKMANSTTINGYNSGLDIKNIVSTLVAAEKAPKEAQLKRLESDTTAKFTGIGQLKSAISDLQTILKELNKPELFQKRSASTSDEKFATATATKDALPGIYKLEVTQLASVSKVATASFADGYKTTSSGTLTIKQGADDAGVTVNVAAGATLAEVRDSLNAQLKDKGITANIVNNPGDGTSRLVFTGKDSGAGKDVFVQGSSGLENFNIGSVGADGKLTLSQLDGTSSSSSGYITQAKNAKFSIDGLTLESPTNTVDKVINGVTFELKTVTDTNKPITISVEQDRGGVKDNIKKFVEAYNKLVGVTSELTGVTKVGDDKAPVVGALVGDSSVRNLLTTMRNEMVQPGQGTDVRMLADMGITTKKDGTLEIDDKKLDKVLKDKFESVSALFTGDTGLMKRLDDKLTPYTQTGGVLQQRLDGLQDTIKSVDTQREALNRRVEQLQDRLLKQFTAMDQLIGQLNQTSGRMAQALSSLPGLVKKS

SEQ ID NO: 19727 - protein, 141 aa, Pseudomonas aeruginosa
PTDIERISHRTRQPSMNAMAAMRQYQNVSTQAQAIDASPHRLIQMLMEGGLTRMAQARGALERGEVALKGELIGKAIAIVGGLREGLDFEAGGELAANLDRLYAYMSMRLTEANLKNDAGKLEEVSELLRNIKSGWDAIAP

SEQ ID NO: 19728 - protein, 511 aa, Pseudomonas aeruginosa
ALVPALFRVERDPFDARQLIKMWRETKLLLIDDNLDRSRDLAVILNFLGEDQLTCNSEDWREVAAGLSNSREALCVLLGSVESKGGAVELLKQLASWDEYLPILLIGEPAPADWPEELRRRVLASLEMPPSYNKLLDSLHRAQVYREMYDQARERGRSREPNLFRSLVGTSRAIQQVRQMMQQVADTDASVLILGESGTGKEVVARNLHYHSKRREGPFVPVNCGAIPAELLESELFGHEKGAFTGAITSRAGRFELANGGTLFLDEIGDMPLPMQVKLLRVLQERTFERVGSNKTQNVDVRIIAATHKNLEKMIEDGTFREDLYYRLNVFPIEMAPLRERVEDIALLLNELISRMEHEKRGSIRFNSAAIMSLCRHDWPGNVRELANLVERLAIMHPYGVIGVGELPKKFRHVDDEDEQLASSLREELEERAAINAGLPGMDAPAMLPAEGLDLKDYLANLEQGLIQQALDDAGGVVARAAERLRIRRTTLVEKMRKYGMSRRDDDLSDD

SEQ ID NO: 19729 - protein, 323 aa, Pseudomonas aeruginosa
RSRDFPARRTSPVHRHPLAERRTGATDPAQRPHRYPPSPGATGAPRAPVGAGADGRLAGPPDPHAVVGGVALCRAPQRAGAADRPAATLRRAPEGAPARTGASGTRHAGVRPRRAATDRPGGAEGAVRQPARGGRSPCPGAPGALAVRGARRRAAVQSRHPGGHRAQPGGERDPGLRARTAPEGASLCPRRQPAPQRQRQRTGYGPGDPGAPGRTLLHHQDHRYRARPGGGQGRGARPPGAIAVALSAGARHLRHLDPAADSGGASFCDSGVTPWQPKSCWSKTTAQYAKPSATPCCWAVTSSSPWTRRRRRCRSWPAKPSAW

SEQ ID NO: 19730 - protein, 167 aa, Pseudomonas aeruginosa
SPASPGPARKSWRTISTSNRRVPASRSSRSTARRSRTTCSRPPCSATRKVPSPAPLPPSPASSSWPTAAPFFSTRYRKCPSACRPSCCAYCRSARWSGSVRASRSTWISACLPRPTATSRRKSRRGVSARTSTIACRSSRWPGGRCANALRTSCRWPSVCCASTAAR

SEQ ID NO: 19731 - protein, 599 aa, Pseudomonas aeruginosa
FMADALIDSQVPAKSGGAGMLKKSFPGLSFLDNLSEMTMLRQIGLLVGLAASVAIGFAVVLWSQQPDYKPLYGSLNGVDANRVVEALTAADIPYKVEPNSGALLVKADDLGRARMKVASAGVAPTDNNVGFEILDKEQALGTSQFMEATNYRRGLEGELARTVSSLNNVKAARVHLAIPKSSVFVRDDRKPSASVLVELYPGRSLEPSQVMAIVNLVATSVPELDKSQVTVVDQKGNLLSDQQELSELTMAGKQFDFTRRMEGLLTQRVHNILQPVLGNGRYKAEVSADVDFSAVESTSEMYNPDQPALRSEQRNNEERQNSSGPQGVPGALSNQPPGPASAPQQATASAPADYVAPGQPLKDANGQTIIDPKTGKPELAPYPTDKRDQTTRNYELDRSISYTKQQQGRLRRLSVAVVLDDQMKVDAKTGEVSHQPWSADELARFTRLVQDSVGYDASRGDSVSVINAPFAPAQAEEIDSIPFYSQPWFWDIVKQVLGVLFILVLVFGVLRPVLSNITGGGKGKSLAGGGGRDGDLALGESGLEGSLADDRVSIGGPSSILLPSPTEGYDAQLNAIKNLVAQDPGRVAQVVKEWINADE

SEQ ID NO: 19732 - protein, 98 aa, Pseudomonas aeruginosa
CSSSTTSPTSTTVASRRCSGKSPRTYWCWRSRAPTRRSARRSSRTCPSVPPSCCATTWRPRGRYGSAKWKVRRRKSSPLPGAWPSPAISCWAARVARR

SEQ ID NO: 19733 - protein, 270 aa, Pseudomonas aeruginosa
SEVVPHDKDKDNPSELIRGKDVAAFGLWSLPSFDEPRDEPAVAAPQVPAVAEPAPAPPAVEEVELETVKPPTLEEIEAIRQDAYNEGFATGERDGFHAGQLKARQEAEEALKERLQSLERLMTQLLEPIAEQDALIEQGMVNLVNHVARQVIQRELHMDSSHVRQVLREALKLLPMGAANIRIHVNPQDFERVKALRERHEESWRILEDDSLLPGGCRIETEHSRIDATIETRLAQAVKQLFEQQREQATHPLASDIRIDLDAPGDVDAP

SEQ ID NO: 19734 - protein, 519 aa, Pseudomonas aeruginosa
ANQFRQAPGGLHRGCLAAGAAGGRGPPAAHGRPDPRSRRLAGRGRQPLQRDQRKRLPPGAGGGRSDGLFRQQGVPDAGRQPRRHRARRAGRAAAGHRAPADGHVDARPGARRRRPRPRRQGRDARRRLGADGRPDDQPAQAPPDQRTSRRRHPLDQWPAHGRPRPAPRPVRRYRGGQVGAAGDDDPFHQGRHHRRRSDRRAGPRGEGVHRRDPRRGRPQALCGGRLAGRRRAADAPACRAILHADRRVLPRQGQERIAADGLADPLRPGPARDRPGHRRATGDQGVSAIGVRQAAEAGGTRRQCRSRWRLDHRVLHRALRGRRPAGPDRRRRSRRARRALRIVPAAGRGRPLSGHRYRSFDQPGDAAGGRGRAPARRPALQAALVALPAESRSDQRRCLRGRRRSRDRPGHRSLPGHAPVPAPGPRRKRKPGGKPCAAGEPALRRAGLRRAEAWRSARRGWRRWWTWPARPSGMPRPSWAGASSNCSRHSRSWRSWNATATTTSSNGSARARRASAASG

SEQ ID NO: 19735 - protein, 609 aa, Pseudomonas aeruginosa
PAALVGEAVAQALEAAGGQVAGDLDQVFLLQPCTVVHQLAQYAVLLAEHHQPRSLAVQRKGGTLAGEVFFQRSQGTGVIAPAPPRSEQAFEIVVAPAGRLVQQQGGRFNRFRAGARQQLHALVEHLELWLLDHFAVDADPAALDVQLGFAARAGGEFGEAFGQADRVGHGEATGMKDRQFTRCGDGRRGMIRRPLGPNLRNRRGDPHAVTPDRWPGMGPGRGWQRRPVQRPWRQGPSAPGRHGRRLRALLPGHGDAGPRPTAPAPGQGPGAGRQSQSLRAPDEGAGPARPAAARRHHRRRPAGAAGRDQRYRAFRPQGRGAQVGPAHPRIPGGRLSGSARFPRPQGQRYPPLGPGHRHERARLPAPRPGPRPAARAGLERGDHQRGAWFPVRLSLYQCQGHLGGDSQGNGRLALRGGFVTARVRTARRGGSATRVVFFAWGRRERMPGLSLNAILLSAVALLAPSVEAVDAGRHDSELGAVEVTPVVGGLAYPWAVAFLPDNQGILVTERPGSLRFVSPEGQLSAPLEGVPRVFASGQGGLLDVALSPGFAEDRLVYLTYAEAGEDGRAGTAAGSGRLSADKRRLEGFHVIFRQLPKLSSGHHFGSRLY

SEQ ID NO: 19736 - protein, 354 aa, Pseudomonas aeruginosa
NPRSDQDRAGLQPPGAGSPALRRHRRTRLRHRAQAHRPARLADHRGDRAGARRGRRHALGRRPRRDRRQHLGRRTGRVRLLQPDRRHGLRHPQRGDRRIAARRRRRRAHRRAAQGAQRDPPASATTQAGGTGEREDRIAGGALRLSDPSRTLGHRRHQPGRRTGGNPGPGRTFRRRQVDPVRSAPAFLRSAAGTAAAGRTADRRTGPGRLAPQLCPGVAEPRAVLRLRRGKHPLRPSACQRRRGRGRSACRACPRVHPGSAAGLRHPPGRGRHRPVRRPAPAPGDRPGVAGRRAGAAARRGDQRPGCGKRAPDPAGPARPDERTYHPGDRPSPGHGTERRPHRGDRPGAAGGHW

SEQ ID NO: 19737 - protein, 264 aa, Pseudomonas aeruginosa
NIVVLTASRQSAFGKCPRGSGCFGANGRQGDERRRRTGKNFRPHAWRPVKCRPFDRGRQHGGHRAFQFTAGGQAHGVRALSRRYPARRDPPAQALCAEGPAQRSGRLAQRVHLPGQRRPPDRHHPDAQGPGRRFRQPEGRGDQPDRPVPRLGPAQGPAAAAFGREASVAGRRLLRGLRLPGQAHQPHHRHRTPGPPAGQPAAALQRRPGGRPAGGGAYRDGLQGDHRGQALGPDPQERGVQVPPQRHARTGLHQGIARGRQDRP

SEQ ID NO: 19738 - protein, 262 aa, Pseudomonas aeruginosa
CRFMACLPSSDGLFLGRTGKGRYPLSVNPGAPASGRSAGIVGFLRSIQSSIRGSGGRYAGLLASSFNIGRKRGSGGAGRWTGQVRVGRTQPASAGLLGGNDDGDAAVLAAAGAGLVIGHGLAHAKAADLDVGRRHAGFAEYRGHRFGAPFGELLIVAFVAVVVGVAFQADLVDVYREQGAGDLGQGVAAVGIETVEIVAEQHLARHAELPAFVAEFEALLLEHGDLLGAQAGLRRLGLATGQAQHKAEQGEGKQSTWVEPLG

SEQ ID NO: 19739 - protein, 500 aa, Pseudomonas aeruginosa
QGNLRTCREYRSARHRLPVGKRPRAHRQFRRRASLAAEDPGLPAGAQRGGAQPPDPFPGSAADRAFHRPHAVPPTGPACRRGRPGRAGRRAGKPGGNGLPDARRRQSAVRSFRRVRHQRLVRTQPRRPVRAPHTAGPGRRPVAAAHAHRPQALRRQRPGHPPGGEAAAPEPHLHADRRPAQVRAPGLRAEAGQGSGEPLPEQEAGLLSFRGSLRRRTAPSPRHAPGHSPPCGLHHGSGRRYLLLPGRYRRLGGKRHPRHPSIGGSAGEEVCRPPFAGRTDSRRRGQHELPADGRLLAGKGRAGADQQGQRILHPPAGENDPPAGPARRPAVHRQPRSGSCRHPRPRADGGRQPAARHRPDVQGRGHGMGVLPSGGGNPGIAGLPHHPGPAGFLRAAAAPAGRGVPGPRRRSPGRRAASATAGSAPAEPADQGLPGGHERCGGEPVAAAVGVLPPLPHAPGFRQRHDRPACPGRIPRVVRAVSGGARCALSSNCSPAPAAW

SEQ ID NO: 19740 - protein, 421 aa, Pseudomonas aeruginosa
TFSITDPAVLEKNRHFAFRRSVRPAARGVAAPAVRSGVAAGRRHELGTDRILDGLGEDPLDAGHGLVVQAPAEGVGDAVQLLRLARPPQRHRRAAIENPADGQGQHRLAIALASQFLQLRDRCQVLGEAGLLELRVGLAQVVAIEAGLGVHPSGKQAAAQRSVGQHDDAVTLGVGQHVGVDGALEQVVGWLHAGQRSELAEPVHLFRRIVAHADGEDLAVAAQALQFAGGFLVRHQRVRPVNLVQVDTIGFQPPQRVLDLPADACGGGVAVDARVAPLQRRLGGDHRLVAQALQGLADDLLGMAEAIDRRGVDQVDPGFHRTPDGFHRRRVVSAAPHPAADGPGAEADARDRRVDTLDANAFNTHGNTPADRENACRQCARRHGAITLDHPRLNVAQCCIDLRELPGALECRLSPVPNSPT

SEQ ID NO: 19741 - protein, 156 aa, Pseudomonas aeruginosa
SAATGWGVPESSSRQTLQGAPHAHRSQSPDPGVADLPASIAFYRDLLGFRLEARWDQGAYLELGSLWLCLSREPQYGGPAADYTHYAFGIAAADFARFAAQLRAHGVREWKQNRSEGDSFYFLDPDGHRLEAHVGDLRSRLAACRQAPYAGMRFAD

SEQ ID NO: 19742 - protein, 191 aa, Pseudomonas aeruginosa
VEVARPGPARPEREGRRRGMARRPGALARADRCPSGTGRSSAADRRSRRGSSGCSARPATRPGGRPARGPRAAPAWPGWRGCRARRAAARRPARMTSRPGRTAAGRSLAGRGPGAAGGRRPGAACRGSRRGSGRAPRARRRGPASSRSRRCSSETSRSRRTARPPSPPASRGIPGQAPPAGVRPPVAEPGR

SEQ ID NO: 19743 - protein, 187 aa, Pseudomonas aeruginosa
AAVSPPGCAECPPARRGRRERTPRRTASRRRRPAPGGRRASAALSAWAGTSRRCSSPPRPRRASPTSPASPGCRRAWRHRTRSRPCPGGTSAGAFPPGGCRWRTCCRSASGCSVRRYRSSAPSCRPCTGSGSRRRRSRSSPRCTGSGNRARERTRCARRGRASGFCWCRARCSWLVPFCVMEVAPRR

SEQ ID NO: 19744 - protein, 162 aa, Pseudomonas aeruginosa
SARSVAPGCPPRPAAVPRPPPGGWSGPFRSAPGRSGCRSGWRRDRSASESGRSARCRESRRDSGSARRTAPAARRPAAPGGSGTPATAPAAPGAGRCRRWPGSSPRRAPRSPAPGPGRRPSRGSGCAPAGCTAAAAARRTSRGVPRGRSGPGPPTGRAPRAG

SEQ ID NO: 19745 - protein, 542 aa, Pseudomonas aeruginosa
RPQRVAQSPSIRVSSRSKRASGIGGSLFARDWPGTPGAGRWFGEVSTRLAGRQQRPAGMRLRFDAARAWPAVPERHQQQAGEQRGGGEHEEHREGVEVARQQAAEDRPDRAAAVDEAGGGTGCFAGTEVDGGSAADHRVRPVEGDAHHEQQADHQVQAAALHRRDEQRQAHGQRRQAEHAGRHAAGAEQLVRGQADEDRPGQPGDLEGRRHDGRGDLADLRHAFVDDHRAPEQDRVARRLEQEVGEAEDQHVGIPERLQQGAGMAWPGRVGGGRGLGLHGRQADVLRTVALEEEEQHGHRQHHSRRGQEGHAPVMRQPVGAPAGERRRHQPAEGVAGTPQAEHAASLVGGEEGADVLAQPRPAGGLRQALDHHAGGEDRQGGEGTHHQRRQRRGEQTAEHHHAGAEAVGEHPPHELAHGVGGQVEGIEIGHGALVELEGGVFGDAELGHREGLAGEVEGGVGQPGDDEDLDAPALERLPATVQGTVVVVHVGPYGSRQCGEVVLVVLLQSCPDAWSRPDAFPMTFFVRKVGCRRAPARSCRG

SEQ ID NO: 19746 - protein, 146 aa, Pseudomonas aeruginosa
APRTTARRLPGRSPPAPRVPGARRPCPGPSGRRGGPRERRRRRSGRPRRNRRCRTRSACRPPWRSAPGPGRGWPAACCRPSPPSAPCAGRPGAAGRSRAGWRRAPCRRSPGRCRSAPTPRRRRRRSAPLRRMAARPRRRRRPPPPG

SEQ ID NO: 19747 - protein, 172 aa, Pseudomonas aeruginosa
TRPGGRPPGAAPTGSSRRPAETARTARRRPAPRRTAAAGTAAPPRPRRGPCSWRRGTSPSRCPPPARWWRSRRKRTTTGSARAPVPGDSRGPPAGVRRGRYRGDQSWRSPGERCGEGERRMPPMRWVSMESPRRLLELLWPLPGRAKAWQTQVRRITYQDEFIFHWAGIRKT

SEQ ID NO: 19748 - protein, 666 aa, Pseudomonas aeruginosa
CMGQAPRRPAPAKGAGRSRQLLQVLARRFAGLAGVVRQGADRLFLVGDAGRVEVAADVARVGGDRRGNHHGALGQRPAENGLQAPAFLLGAGNGVQAQRQRMADQPFDLARRLRRGQGQAGAVEARQARARHIDPQQGTVADPAARVGFLVLGVAVGQRRIAGDIETAPDRVEVLAARAHPAEDDALRRFEEGAVVADEHIAALLQLAVRLEQPLHRPVLRAAGAEADVAAVAEELRASGIVALQQGVAAVRRARAFTGGDRAGQAHHVGAGRAGLVVACALPDEALALGGGQGQGQTGLLRLLADRFAQVAAAAGAGQGVADHLVDLVPRQPRRQVEGDQPLHRIAALLQLFPAARLAMTGESLQRQVAGLVRGQRGQAAAFGEVQAMTDDRGLDVQVMLRRVAGEHPVDLAFPGIVEVAALLGEVVVDPVQRVEQAQHLAAGPFAPALFPARLGLGHDHADPGMADGERRLHLVALVRPDEEGGIARQLRQQLVAHLDGVDRRHVAELVAGVQFVDEHLDVRRLLVADRHQPVQRPTAARLARVAVAHRLVRLDAAFEADGQAVAGDAEGVVDGQLERVVAALQDHGVVQHALAVGVGDGRVDAHAAGTHAVLEVEHAGFGAFVPEIEGFLGGGRGRAAGEQAEAGDQGDPMGYQVHRDGSCDG

SEQ ID NO: 19749 - protein, 621 aa, Pseudomonas aeruginosa
EIHMARPIADLIHFNSTTVTASGDVYYGPGGGTGIGPIARPIEHGLDSSTENGWQEFESYADLGVDPRRYVPLQVKEKRREIELQFRDAEKKLEASVQAELDKADAALGPAKNLAPLDVINRSLTIVGNALQQKNQKLLLNQKKITSLGAKNFLTRTAEEIGEQAVREGNINGPEAYMRFLDREMEGLTAAYNVKLFTEAISSLQIRMNTLTAAKASIEAAAANKAREQAAAEAKRKAEEQARQQAAIRAANTYAMPANGSVVATAAGRGLIQVAQGAASLAQAISDAIAVLGRVLASAPSVMAVGFASLTYSSRTAEQWQDQTPDSVRYALGMDAAKLGLPPSVNLNAVAKASGTVDLPMRLTNEARGNTTTLSVVSTDGVSVPKAVPVRMAAYNATTGLYEVTVPSTTAEAPPLILTWTPASPPGNQNPSSTTPVVPKPVPVYEGATLTPVKATPETYPGVITLPEDLIIGFPADSGIKPIYVMFRDPRDVPGAATGKGQPVSGNWLGAASQGEGAPIPSQIADKLRGKTFKNWRDFREQFWIAVANDPELSKQFNPGSLAVMRDGGAPYVRESEQAGGRIKIEIHHKVRVADGGGVYNMGNLVAVTPKRHIEIHKGGK

SEQ ID NO: 19750 - protein, 169 aa, Pseudomonas aeruginosa
ANEYIQHPGIGQHWAQLAKEAGFRADYDSTSTPETHLACGVTQEWIREHIVATNDMRLFGLLHLLGQASLRMEQALWPEDYERMTRKVKGVQREAEGDNAKSYIYEEVMQIRQERFDKARHNLQGVCHRYQGSNYFTVLILVLWLFSKRMECFCQGGILSQEADRKKLF

SEQ ID NO: 19751 - protein, 568 aa, Pseudomonas aeruginosa
PKSRISIPAQCSARLVLDNPRLEEVLLLLQVHDLRHPRERVGGPRILFLQADLGQAPVGDELQVVLHHRRVHPQHPARHGVARVFDLQLGALEDHLGRLVLHLGVPQVRVLDLDLVDHVDTEVQVHRLVAEDVLELLGGAGHLVAAAHGEDLGEAAVEEDAFQHAVVGDQVAQELAVGFRGAGLEHRVGDRAGVLQAPGGLLRHAGDLVVHVEDLALVHAQRLDAVLVGVGVDRLFEGLAQDVLAALGVGDQAVHGQHQVVGDQGVGGGEEAEVAHDDAPLVFAEAVLALPQGDVGVHVDFLRHPVVGATIQILLPGPVVLEGDELVEVSAGVDHLLVADLHARGGAFEVVQAFLDVEVVQGLLGAGDGVGVVGGNGARFFHRAGGFVVQLVMALGNGLGGGGRGLGFGRVFFVEFVPAQHLALSWSGGRLGGLDMGREVHAKAVVRHGLAGPFFSPGGKKGIVPGPGEGPCAASVALDERPSGAGQAGPTRGVRLARPRHGRRSATRDHWQASQSGLSMLHACGTGAGFGSAAGAACRPSLPPADTALSLPVLMVDFSVLVAARARR

SEQ ID NO: 19752 - protein, 329 aa, Pseudomonas aeruginosa
AADGRTQPRALDERPGAGEADRRARRHRLYPGQRRREPGAQRRGAAGQRATGAGHGVPADGRTGALPGQRTALPPCADRPRQALRLPGAPAPGQGAGPRRRPAPASGGGRHGDGAGQGRRLDPHLRRHPRHALGAGAGPAVPDEPLSAAAAVAARRAVPELHRPDHLPAGASSGAAPAQPGGGRHADRPRQPGYSRRGARWRLGGTPGRGLQPYGRAHPPAADGAARDGSRGVPRAAHAGGAVALRPGDDRDRRDRRRPPEVPGGHGQRYPGPRQAGRRDAHLRTPGTGLAAADLPAPGAGRAGAPGGGGDRPAAPRGAGQLRGGRAGA

SEQ ID NO: 19753 - protein, 511 aa, Pseudomonas aeruginosa
TRWRSARNWRRPAAAGPCSPPARTTAARGGRRVSPPRGRYPGRSPRRRPGLRRAGRCSSPRRSRYPASVAARVRRPVRPGAGPAARSGRRRGTGDGPRPWRRCRPDRGFSCAAPAAGSGSPGGRGRSGARRGRRRRCRHRPGRRSRAGRSASGEQPHQGLVVDFGEQLQVAGQDPLVDLVDGGVDRAEFDHLGAHGGDEASVGGAAAGRGPGLAAGDRPDAGGHRIEQFARLGEERQAGQRPFDVPVQAVLVEDRLDAFLQAFDGGFGGEAEVEQRGQFAGDDVGGAGAGVQVGNLEAGRREEGIAVVPVFRRQFGQRRGGQVDRVLRQVRVGHMALYAADGQLGSKGAAAAVLHHVADQAGARRFADDAPVQALAACGEAFDHRLGAVVGRAFLVAGDEEGDGTLVLRVVGDEALDGDDHRRQAAFHVRRAAPAEACPGRRSGRRRVGAARPAAGRWGPRRCARRSTAPGRRRRAVPRSCPPPRCASAPGRSRRLPGGASSGPGSRRRGA

SEQ ID NO: 19754 - protein, 70 aa, Pseudomonas aeruginosa
AAGRRTGAWHLSVKGSPIKIDACARDAGKTLGAGLAPLKRGPFGQAKRAPLIYPMGESLPLARTPSGCLT

SEQ ID NO: 19755 - protein, 167 aa, Pseudomonas aeruginosa
LLWITIVPGFSCQLCEASAYCRFFLSLLLSPRSEEVRAYRFLCCFQREPFVSTIRICGDSEMKNQVNALAVLSVGEIEQVSGAGTFLGDAIINGVYAANSFLNSPLFSSIGNAASAIGLNRTHELVDLLAFQVPSVAAITVGKILGGTDNHNVPLHYNKESGEGLYS

SEQ ID NO: 19756 - protein, 435 aa, Pseudomonas aeruginosa
RRSRRPFARATRRAAGPTSTCCRAGSRRAPISEPEKEDGAPPGAPLLLAAFAFGGVRRRGMPLLQLAARQEAAEEDHEQRAEGRRAVVQVGIPLRVGRQPGLQGAVGEQHAAGDPAEQAAAEEDDQREAVDQAQDQLAAPDDDRDADQHAQGDQEEIPGRGGGQGDDVVQAHHRVGDDDGLDRAEQVGAALDVVAVLLLRQQQLDADPQQQERADYLEVGQVEQVQGEEQQQDADQDGTGDAAEDRLLAPVRRQVPAGEGDDYGIVAAQEDIDGDDLQQGCPERRVAQPVDQGCTPKRVVRVESPGRWRVAAARLSCGGLGPSGPAPACGRRRGTLLGPANARPVPGKRTRGWRSAFGHGCDAADRPRDTRHAYSAASLPEQGFTRLSGRRWRRTRRDGRLVARVADSTSRTPITESTVQAARPSAPGEARRCHG

SEQ ID NO: 19757 - protein, 406 aa, Pseudomonas aeruginosa
PFTVQGNPMRSLLLSSVAMIPAWPVAQPDASSFLPSFAGLQKKAQAQGISADSYERFTSGLQADLSVLDLLDAQPEFTTPLWDYLAGLVDEQRVSDGKAMLAQHDKLLDQVAARYGVDKYTVVAVWGVESDYGRIFGKRPLLTSLSTLSCYGRRQSFFQGEFLATLKLLQAGDIRDAGITGSWAGAFGHTQFMPSTYARIAVDFDGDGRRDLVGSVPDALGSTANYLKKAGWRTGQPWGYEVKVPADFPASLAGRGKRQPLSAWVAREVRRVDGQPLPGGDEKAAILLPAGAQGPAFLVYRNYDAIYSYNAAESYALAIALLSDRLRGGSGLVASWPTDDPGISRLERKQLQKALLARGYDIGEADGLIGTSTRKAIQAEQKRLGLTPADGRAGRKILEALKGAQP

SEQ ID NO: 19758 - protein, 896 aa, Pseudomonas aeruginosa
PRSAAKAAGAPSRTRSRAVSRGFMARSSGQVEQFDANGALLVVGLLGNRVGGVQGDLVDQLVGVEERHEHQPLGRLVAPAGLDPRADLAAPAHHLDLAAAAQLELARILRVHVDQRVGHRLVQLRDPRGHAPGVPVFEHPAGGEPERVVLVRRLGRRLVGQGEDDRLLVRIAIELHAAALAHVGVVALAVAPAGLLAVHHRPAQAARLVVGVEGGEVVAVAATEGGVFLEQTLLDIEAECVDLVVGVALGQVAGREAVDLAVAEQHVVEGLALQLGGLRQQFRGPDFVGGEALGEFHQLPEVGLRFARCLHQLVPELRAALGIAEGAFLLHPHGAGQDQVGGLGRDGGVDVGDDHEVVRVAPAGQHFLHHVGTGLHVVADLGPVDVEHAVLEHPALLHGVEADLLLDGAGRHLPNLLRGFPVLRVGHHQVGGEPVGEGADLARGAAGRGLAGEREGAVARFADLPGEQVDVVDQVVRPDPAGVLVEAHGPERHHLALGVGVEFGEGLQPLGRHAAFARGALQGIGLDELGEGLEVDIAPGVGLVGVLRLLLQRVVRAQAVADVLGAMGEAHVALDEVAVHRAALDDVVGDIVEDDQVGLRLEHHGQVGQLEAAVLEGGQHRDLDLRRAEPAVGDPRPEHRVHLGHVRAPEDEAVGGLDVVVAAHRLVHAEAAHEAHHRRGHAVAGVGVDVVAAQAGLEQLVRRIAFPDRPLAGAEHADRLRSLGLERGLELLGHDVEGLFPTDRLELALLVELAVLHAQQWAGQAVAAVHDLRQEVALHAVDPAVDLGLDVAMGGYHLAVAGGDHHAATGAAEAAGGLVPNQAGDVRLGHQVAGADQDRQAGRRRGDGGGVGLGEFTTGEVHRLSPRASTVSRGRSWPPRRCYRRRAGSRGRPARR

SEQ ID NO: 19759 - protein, 261 aa, Pseudomonas aeruginosa
TLLAVRAKTSPSRRAAAWKQNVRRQTRVVQPGFSKRSGAVQYPVRTLQAVNDTTLAERRKTMKALKTLFIATALLGSAAGVQAADNFVGLTWGETSNNIQKSKSLNRNLNSPNLDKVIDNTGTWGIRAGQQFEQGRYYATYENISDTSSGNKLRQQNLLGSYDAFLPIGDNNTKLFGGATLGLVKLEQDGKGFKRDSDVGYAAGLQAGILQELSKNASIEGGYRYLRTNASTEMTPHGGNKLGSLDLHSSSQFYLGANYKF

SEQ ID NO: 19760 - protein, 651 aa, Pseudomonas aeruginosa
TGARGGRGTGCRGSPLPGQRIPPRPGGDRPRPAGHERPGPDPRAAFAGQVLPDPDPHRPRQLAGQGRRPGRRGRRLRGQAVPVRGTGSAPERVAATLLGVRPVDHRGRPPGPRPEPQAGAGRGATGGADRLRIPHPRIPHAASPAGGGQGTPDGTALPRRRGARRQRHRGAGRPPAAQAGGLRRLQADRYGARPGLPVHRALPVIRSLRIRLMLGAAALAVLFMLALLPALQRAFGIALENTIEQRLAADVATLVSAARVEKGRLVMPEHLPVEEFNLPEAKVLGYIYDQNGDLLWRSTSAADESINYTPRYDGRGNEFHTTRDAKGEEFFVFDVEIDLLRGKQAAYSIVTMQSVSEFESLLKGFREQLYLWLGGALLVLLGLLWLGLTWGFRAMRGLSSELDQIESGERESLSEEHPRELLRLTHSLNRLLRSEHKQRERYRHSLGDLAHSLKTPLAVLQGVGDQLAEEPGNREQVRVLQGQIERMSQQIGYQLQRASLRKSGLVRHREQLAPLVETLCDALDKVYRDKRVSLQRDFSPSFSVPVERGALLELLGNLLENAYRLCLGRVRVGARLGPGYSELWVEDDGPGVPAEQRARIIRRGERADTQHPGQGIGLAVALDIIESYDGELSLDDSELGGACFRIRFATV

SEQ ID NO: 19761 - protein, 238 aa, Pseudomonas aeruginosa
SWSAAAASSIRWPSARRSSAAPWNSRRSAWPWCRWRGGCSRSTRRCAGCSAIPPNAWASSRSRRSPMWTTWNWTSTWCATCSPGVSTPTRWRSATCARTAKPSGRASACRWCATRRESPSTSSPRWRISTVASVPSWSASASPNGSSWPPTPGRSASGSGTWRATACTGISACSTCTASAAVPGRPPWSSGRRACMPRITTACCASWSAPSAGCRNSTASSVSSAPTARFATCGRSPR

SEQ ID NO: 19762 - protein, 461 aa, Pseudomonas aeruginosa
ARSRELAKRPREDSAHDQTTLLQEPVRAGSGRHRHRYRARPLVPGNGGGDEAVRRRLRQTDQDGHRADHLLHRGHRHRRHAEHEVGRQDRRHGAAVLRGRLHRGPDHRPGSGQRGPAGRRHARRPEHPRHQQDRCLRRCRREAEHCRLPDERDPRHRGRRVRQRRHPPGPVLLRALRLRPASPGQLRQAGVRVHRARLPRDVQHHQRDHESRPDRRVRRHGLHHGRLRRGFAGAARPTDAVLLHHLHPVRAHRPRRHRPRPRLQHPALHQVHPRGTADRAGHLVFRVGPAADDRQDGEARLQQVGGRPGDSHRLLLQPRRHLDLPDHGRGVHRPGHRYTDGHHPPDHPAAGAADRFQGRRRRHRQRLHRARRDPFRRRPPAGRRPGADPRHRPLHVRSPRADQPGRQRRGHGSGFQVVQAARRGHLAARTGRRGQRFVACQRYSGGRPRSGLSSNLFGRGK

SEQ ID NO: 19763 - protein, 217 aa, Pseudomonas aeruginosa
SSAARILAMPSLQLYSDSSPNGFKITIALEELGLPYALHHVRIDHGEQRRPEFLRLNPHGRIPVLVDRAAGITLFESAAILQYLAETSGRLLPDAPRERWEALTWLTFHASSMGPILGQRVHFEIFAEERYPPAIERYRRLSEEVFATLDQRLAGRPWLAGEQYSIADIATFGWTHTARIVDFDFSHYRHLDDWHRRMALRPAVQRGILLPEPAVGP

SEQ ID NO: 19764 - protein, 316 aa, Pseudomonas aeruginosa
NSQLFSSNTRIPEHHGHPFGQSEQTAEAPAPPGRRGHHRLQHDRGWRQGHGLPVRRQGQLHHARHPALPAEGRADPLRDRRGEHGPEAARFSRACPAGVPEVDRRGVPHRREGHLLGGQGEDPGRQDHLLAVLAPAPWHAVHLRRRDRRDQDGPRSPSRRHPRDLLPQHVLRRHPEGHAAEAAGRRRAQRGDPAAGLLQREGHRGLFPAQGVPDHPLQPLRFAGEPAAPGGQGNAAGMGTQIAGAYRDHVPRPAERGAVATGRPQPVRLRQPAHRRERHAALPRRDEPLSRAAGQFFSPVCKDSRCATTPGCTNTA

SEQ ID NO: 19765 - protein, 521 aa, Pseudomonas aeruginosa
RRQREDQHQRRDAAFGAIAERRQAALATGMQEEAQAWRVEDHRQQQVFQPGGVDQPDPVERPQQRQRQHRARVRAARHQLQAEAGAEQVGDQRHRGGQLDQRVVARGVEEGHQQQRRDQRAGQPQCRRRGFHRIGAAEQCRRGVRWATAGQVEHFHREHGPGQQRAADRDDQPDVDQRGAPGAHRRGHHLGHRGVLHLRQFVLRHHAQRQHRDADQQQQGDHEAEQGCAADIGRVPRVAGIDRGALDAEEYPDGVEHGGFHLAGDVAQGRAAPEVQVKGLDAEGQGYAEDEQGDRHHLGEGHDGVGDRRVVHAVEDEGMHQPEHRQFAEQRRPGGSVAEEGQRAERAEGAEQHHQVAGVADPGGNPVAPGGIEPQVFAEAFAGVAVDAVVQFGAGGRQPLEYPRQGQHADEGDRPGDQDRAGACAFGHVLRQAEDAAADDAAHHQRGQRRQPQFSLVRIGHVAPPKLHPVCRARRRRSLRRGATAGGGGSVRRGMVQKRSDMQLTPPSILRYSEVSTSITR

SEQ ID NO: 19766 - protein, 70 aa, Pseudomonas aeruginosa
TAQRFPRRCWKVPCSAPHAALSPAPRTARACSPWRRAAACSSTRSIPCRWPCRASCCGSCRTAATCLWAA

SEQ ID NO: 19767 - protein, 281 aa, Pseudomonas aeruginosa
AMPASTSARVVSCMRRAPAARCAWTACRTATGNARTWTPSACWSRRRRWRGCPEAGRSGAIMTTRTLNLDDNLYRYLLDVSLRETPLMTRLREETAKLPNARWQIAPEQGQFIALLLTLIGARRALEVGTFTGYSALCMATALGEQGRLTCCDLPGDYHLTARRYWREAAVEERIELRLGPALETLRALLDEGLAGQFDLAFIDADKANYPEYLEAALALVRHGGLVLFDNVLWSGRVLEAQPKSADTRGIQQLNLALKNDARVDYSLLPIGDGLSVCRKR

SEQ ID NO: 19768 - protein, 173 aa, Pseudomonas aeruginosa
IAVAVTTLDGRRALPRPPMLASQEALRFTPRGDGRRPRPEKHHVLHLQATRQERCGGAVRRPPGRPALPGPRFQPGRVQEQCPGIGRHRQVLQPADHPHHQLRGWPQRPAGAGTQGNVSAGPVHRPPRQHQRLGQRGLRQGGQGHRQEATDHRRRGDRCLRSLPDPLGAGGGV

SEQ ID NO: 19769 - protein, 257 aa, Pseudomonas aeruginosa
RIRRHRRLRHLQPGGARRRLGAHDRRRRATDELVQRRLRTAPRLAQRHRRLRCHPRRPPAGVRQPDPELRHEEVSRLRRCPGHKALRPSGALCRFPSRCFHRNAASPEPEVPARPPMHRRNPMATQVVNASLGTTPYRVTLGDDSHQWLSDVPAALGGADSGPSPHEILLSALGACTAITVAMYAQRKEWPLEGIDVQLNIVEERTKPEPFTHIRRDIRLAGDLDAEQRQRLLEIANACPIHRVLSGEVSVSSQLRD

SEQ ID NO: 19770 - protein, 194 aa, Pseudomonas aeruginosa
TRTHNEEHGMSDDIKVLGISGSLRSGSYNSAALQEAIGLVPPGMSIELADISGIPLYNEDVYALGFPPAVERFREQIRAADALLFATPEYNYSMAGVLKNAIDWASRPPEQPFSGKPAAILGASAGRFGTARAQYHLRQTLVFLDVHPLNKPEVMISSAQNAFDAQGRLLDDKARELIQQQLQALQLWVRRLRG

SEQ ID NO: 19771 - protein, 254 aa, Pseudomonas aeruginosa
PSRSRSPARCSCVSPTAPATCSRWATNCPTTPSSSRPISPWMWRPSPPSATGSAPAPPAGVERGTRKQFSPVRRGLPDRGGVHGAAGQAPATGRGARLPAGRRADRSQRAGPGGQPGKRRADLRDGRGIAAVHHRPGAVAAAPVGDAQVGVRRRPAAGAADRRGDRHRGPGRLRPTGEQRGGARPGPGAVVHRLRPADPRRAQGTDPAPWPPGLRHPAVPGHRGDPADRHDPAAQRCAQRRRRQRTDPDPQGGR

SEQ ID NO: 19772 - protein, 106 aa, Pseudomonas aeruginosa
SIAPARASPCSKGARRWAVPGTCSATPASVPTRTCSPSATTSSHGAIPRPSPTVRRSAATSRRPHGRTASTGRSATATGCSGPTGIPPMRAGTSTCSAATSPSRCA

SEQ ID NO: 19773 - protein, 113 aa, Pseudomonas aeruginosa
SPCRRRTRSPISSAASFRKPGSTARRGRATWPCRWSSSCSPGPSPAWSARPCSSWPACNWANASTCVTSARATSRGTSGSARCRTATCSRCCARARRRWSPSTSTASSSGAFA

SEQ ID NO: 19774 - protein, 410 aa, Pseudomonas aeruginosa
PPATAPATCARSPSSTSTPATSSAPPSAYPSRATGCPGSFTRTTSSTWRCCATARSRTATWCSPRRRRSGKPAARRCRPWAEPGGRRSGVRHDLPVGLAPGVQAAGQRPGAGEAGGVEALGEHRGGKFVGTGAIDDDAGVPEVAGEVLQRHVQLHRDGSRNAARLVFVMGADIEDHRQLPLFAKVFQFLHADSRNPPAARQQALALPELPGDEGGEGAGDQQRADGRVVAEQGQQVVYRIAEDHPQQQRGTGPECRAGGVVGEEAAQVGAGHAGQGGGQRTGAGQELRHQQRPRTDPQVHVLALADATVLGQRDLADAAQEEAAVAASGQVPGDVRQQAGEHHHQQDHAQRRADALHGQRAGDDQRRVGGDRQPGLLAEHVEEQQEQPVVLQQGLQFTHGRASRILLRVV

SEQ ID NO: 19775 - protein, 189 aa, Pseudomonas aeruginosa
TGTGARRARPGGPPGIAPGSRRSCGRRVSPAPRRPAWRRPGPANAPGRIRARRADGRSFASRRLPRTRRSGAGKIPRPAARRSSAGPLGLAQADRADLQQHDHPAQRGQAEVQRLAAGMVEHDPAVQRCQRGAEAVEIGRAEIAAAQVVGGQLVDLHAEGREHDQFAEAEHHRGQRQAGEQGHRGPGEA

SEQ ID NO: 19776 - protein, 379 aa, Pseudomonas aeruginosa
LGQEHEQHAEHQAAAGAGVFQQAEEGKLGDHYGQRVDGHQQGDAVDHVGQTAAGEVLHEGRIEGGVDQRGQHVAQQQQGEGAMPGHAQAGFEEPRRGSRGKAAPLKFEVVQQAPEQQAVAEVDQRGDQEGAGLGGDAESQADQRAEGGAEVDQEVPAVERQFPRAAILDAVADQRLATGFEQGAADAHPGDRQSVGQRLAAEAQQHEGKPAEAGAEEDQALAPETVRQPAGVDAAERAADGRQRQQQADGAGGQPELAPQQQCQERPDHEVGAAGQQRTDEHHVDFRRQGAEALHAEGVVAHGRGSWARGRMPPRRLPAATWWNSGRKLSGSSRVNSLLSQQRSRQRRCRSSSLNSVRACRVVWLFTSTSMPLLKSSSA

SEQ ID NO: 19777 - protein, 232 aa, Pseudomonas aeruginosa
TTGRRAAPRRSVHPGLPGRGRGAPAGVRRGAGAFPRGPAANVRTAGGNAVSAAPASVSRAAPGAPPAVPWRCRRRSAGGARRAAPGRHAGRGCALRWCATSADGRRGAAAAPASSADRTGRSPPRGPGRGPRGRVPRSARRPVGPPVPPAARPCAGTRRTRRRRSAAVPVRRAGARVRDGAGSPRTVRRRLRREARSDSPARRYRRPGAGTSAGWTSVSPRRSCRPRDAAAA

SEQ ID NO: 19778 - protein, 765 aa, Pseudomonas aeruginosa
NRCRRNRGCRTSRGFPLQQGGERTAVVLAGAVQRQGLVRQHHALWRAEGAELLLEPGQEGELDLRRGVDHGDIVFAIERAVDLQAADVDHLVQAVERPFAFIQVEQVAALVDGAVATAEDVHAAVLVEVGEVLGVQPAVLEHLGGQVGAVDVAGEQARRAHPQAPAFAAALQRAAVGVGQLEFQADGRSHRVVERIAATLAEEEGKAALAEAVDVRQRRVVALEGRLQVGVQARRAGDAEQALQRQAARRRGAFLDHVVDHRRHQVEETDAEAFHAFPEAFAVGPAVQRQEHRAAAVQQREEEIDAEDAQAADPVEATGARVLADAQAVAADAVGMEHGLLAEFDAFRLAGGARGEQDHVAVRGAVEPARRAALEVQRQAQPGQRALERMFAGQRVQAHLVDDGLLRGLPPLGIDQHQMLARAHDRIDQAEVAVAVVEQHADTAAGMRGDLLGEGIDLAVGVAPGVFQRSLRLAGVDQERPPRVGAAEMAEGAVERYGYGEAAHAGSSAIQRGEGVDVEVHRHLRRALDLAHRGDEAVGVVFAAFLLDVAGHVAGGEEEQRDLLRAEEDDVGEHFAAAVAQVRATAHDLQGVVIAGQARITVFGPLVHQFVLDEVAQRPVGDREVVLVGAEQPAGGQPVGHARQHLLAVHPVEGGGAGDQVEAALRREGFRRRHAEADLRVVLAGLGDQRLAQVAAFHVAEPGLQADGRDAVAAADVQRRFACRGAFGEVAVERIRIGDLAADHVVGVCVLVELLHWVISSRLSW

SEQ ID NO: 19779 - protein, 184 aa, Pseudomonas aeruginosa
NRSPPGPAGPGGADARRGRCRAARSGRTSVRRPGRGRRRPGSAPSWRGRGDGGAASGRTARHCAAGPLRAVRQARSSGRSIRASRRSASAGIARSAAFAAGPARAGGCRSSAGGWPATGGPSRSRPGRRRNSRSASPVLPPGRRVPGWRGLRCWRRHPAGGSRPAGSPLRRGVPAARGSSSGGR

SEQ ID NO: 19780 - protein, 470 aa, Pseudomonas aeruginosa
RLGHGRRQRQGPFAAEAAGQAGVPAAVVAPDQGQGQRQAALQCRPVDEPGAAEWLVDDIDHHLGVGIAQPGPFGDGLRRQQAVLEGLEPVSFEGVLGGRGVQQQRHQVQPATGNRRASATAQADRGQRQDLAGGALAGQGESQGAGEPGQQGGFAASWRGSQAEILAMAGALRPGQVRQFTERLAALAPVVFQPGPALAQLALQAPLLLEEAELGGRRFGRGVGVEHGQAGQQHAGEVGVGDQVMQPDAPARTSSAAPVEQSQQAALEQGMRALQQRCDERVFVGEGADFQRRALLGLPVDDQFETFRAAVHLAVEQRELFAQAPSQARQVGCRHLGRSQVADAETGQVGAEQLAEDHPAGPGRQVDAQGLRGLIRHRLVPQAVALGGGQAVPIADHHQVLAEPVVAHLRGETDVHAALLDSTSGCSGVAARSSRRSGARPWLRRRRLNWSRREFACKSASPRFAPVPAD

SEQ ID NO: 19781 - protein, 133 aa, Pseudomonas aeruginosa
AGQAALGRYADPAIPALVVQHAGDPQGLDRSRLCLRLRLRGRRTFRQPLGRPLRRGPDAGQAGDAGSHRRRLGVALRRARYQRTDGRPAVPHPPRHPALPRLRGIAAVRRLSQRPDRRGAFRRAERAVGPAPR

SEQ ID NO: 19782 - protein, 333 aa, Pseudomonas aeruginosa
SAPPKPCRTRPPPNRSPRKKPGGNCSRRSCDGRAESSVKEPRALEEYRRAIVAACPELADATFAILASGWHSTAVEVGGRWVFKFPRGAEAEAALLREAAVLRLVRPAVSLPVPAPQVFAGPPLFSRHEKLPGGYLLGEDYRRLDEPARQAVGDALGRFYAELHRLPPARMRAVGALPVRPWESPAAMRRRALPLLPAAWRERAERLVREYAKLPADPLGSIFGFFDGHGWNMAFDSEAGRLNGVYDFADAGIGPLHQEFIYSAFIDADLTERIVAAYERFSGRRLERRRIALLTAAHRLSELAELADEPRHLPEMLAGALDGLALAEAQGLA

SEQ ID NO: 19783 - protein, 484 aa, Pseudomonas aeruginosa
PSDPPGEKRAALFPEVSSSASLGGRTADELQDLSVDLRSVGWPPHAVAHVAGRGAAERLAEHADERADRLVAEDLGGALHRNAGGQLLQGDDDLQLLAPLAEGHAGLPAHHPRQGPLAHRHSPGPFGHAGAVAGGAGQFVGDAAQAAVVRQRQVELFGRRLFQEFQQHPGETCERAVVRIVLRLRAQVQDQFEDQRRQGQGAAVARQACRPRLDEEEADLAVGGDPVAMGDAAGNPHTETGRHHPQAIGHRAGDAAAAGHHQLALAMPVHRHFGVVVPGLQLQGQGRLAERVGIEALGEVGLRFTAHGRSYGCPNSIIFWLSSRYLQIATTRSLCSSTRQERPTAPRPRYPGALHAERSLRFRPLRAAIVPLPVPGDAALPAAGAPRLALAGMRLASRPAAFLPVVHRAVRAGAEVLSRGPHVHRSSFQGGCDLRLRPARPVPGVAVVASLRAGALDPRRAGQRAGDPHCAGSLRQRRGGVRRR

SEQ ID NO: 19784 - protein, 879 aa, Pseudomonas aeruginosa
RAMAPTHAVGRRGFARGGRQRRTRPAYRPRPRRGRRGGARPGAAGPAAQRVALAGGRLCDAVARAARRLRGGGPDQHLHRRSAKLLGHRLFRGNQAAQCTGRRAGDDQADGVRSAARRPCREHRSRCRRPQRKPCRQRPAAGQPELQLDTPGAARAGAHRTRPGTGGRGACRWHDRQCRGAAGGDRAALAADPLVAGVPLMAASASGGRDWYAALPLPWRTDSLDYVLRSIGAAALALGLGLYLQLDSPFSAASTVLLLINPVQGAVVGKGWWRAVGTLVGTLAAFVLTALFAQKMLLFVVALGFWLGLCVGVMSLVRHFYATAAVVAGYTVCLALGSAMVEPEAAFEHIVTRASAVIVGVCCLSLVTVLFSRRTVSGRVRQRLVSLCAATLALVAARHAGAADGELERRRRTLAGEVYAVDDLLGVGRAESRALSAALPAIRGGLAALFSTLMEFRFAGETHWARRLAERGLALPMADDLCLLGGQLERGELDFAGAARRLASLRGRLAAIRRGLPTDQADACREGLFMERLDEQLDDLQAALRGFARLDGRARADVRPAAFHRHYREALRNGARAWLAMLVGGALWFLSGWDQGPTLLAVLGPYCTLLAASPFPAEGTRNFIRGTLYVIPAALLCKFLLLPLINGFPLLLLCLAFFWSFGIQATTVPRRALQGIAYLIAFNTLVATGNLARFDFGDFANQSCAWVLALCISLLVYRLLPKDLERHSASLLDHLRRETLALLRRRAGFDAHAWQARQQHRIAQLGALHGMEHPRSALALRLGFVSLQLGRESRRLWRALAGLDPAAADARWIERALRAIAVRHRDPPLAARHARRAGARLAAAGEWRLAAILTDLAWLLRAYSQSVSSDGAQHGEKTS

SEQ ID NO: 19785 - protein, 676 aa, Pseudomonas aeruginosa
TAGAADPRPARATAGRSATGGAVPQPARRAGRRLEPGRCRASPGRQPADPDPRLPARNRSQLRPVAAAHAPARQPRCAGGRALDPRGRTGPRLRQPERLQRHVSPDPGRFAEPLFRPRRRLRGGRGRLSSVLLAQHQRGQGAGQERHAGKVEGVGVGHQVGLLAHPVVEQGQRLLLLRQLYPHLATAQALLQGAVEDRQGLADPLGVEALAQRDQLRQQRGADRAAEVAQHRDQRRGRAGLGLVQALHRQYRERDHDQRLADAAHDDGGDDHVTSRVGVQVRAHPAAQGHDREAAGHQQLGVQPAHQARQQRRQEQLHEAVEDQAVADLPGVETLQLGQVVGHQEHQAEGRRAEHRHRQAGHAEVVAAQQAQVDERPRAPQLALYEEQQGEHGEDGEGADEAGLEPVAAATFLQHYLQRAEAGDHRADAEPVGLAQAFAVAVAGADRPGHRGQQGDPRQQLQEKDPAPGIGIRQPAADRRAGGLGHAVGKAEQRHAEGYPAGRQLGEDQLHRQRDQHRPRSPLDHPDQDQRRQVRRQRAAQRTEQEHQRAEEHHPAQGEHFHQPGGKRDHADFRDQIGGGDPRALLEGGSQRAFYLRQRRAGDVHVHAGHEAAEQAAGDGDPGTQRYLVVSAHRRRLRPVRECPRWRSPTSPEAAGPARRRRRPGGYAPGSAGRSW

SEQ ID NO: 19786 - protein, 201 aa, Pseudomonas aeruginosa
RGCLRTVPAEKHRHTCRSLACPEAGRIAPRAIRPVRRRLRTAAAVPRPAPPVVRAAPAPARPSNVRCRTRGSSAGTPGRPSAARARRCSASGGGCAGLRAAVAGAGRSRGTRCSRRPVRQSAPGVRGARRRASSTGPGGPGPCGSRRDRPCGRHRRGTAGCLDGSRRAGGSAGRAPRRTGRRGVSAGRGRPTRRPAAGSWG

SEQ ID NO: 19787 - protein, 312 aa, Pseudomonas aeruginosa
SRPQFRHGRRLRPMDHRRWRGRGDHAADQQRQHRHRFPCRRPEQHAPHRGDGRRAWRGHRRPSGLPRPGRLRASAHRRAGHRAGQRHALPAWRTARIRPAAGPVAATRQAPRRALHAPGAGRGRRAPVRRDPATPGTGTAALLHARFGHLAHRPGTGPAAGARVLRRPRLRPQRLHRLHPAGRRPRSAAGRRQGPARLPRGQGAHRRGRGPRHRLRLGVHPQRYPRCPGAGRQHPCAPGGRRHPHQGAALSAARLGEPRDKLFCHFLQRSNNEDSSWPNITCSPPCPAPSIARPAPTRRPTRRSGRRSRPAA

SEQ ID NO: 19788 - protein, 516 aa, Pseudomonas aeruginosa
GTPDRPCAGRAELPGYRGDSHGGAGNRCRLDPSRLRFPLREPRLRRSGAGGRPGLRRSGGADHPPHGRQGRGAAYRDGRRGAGGAGLARRAGRPRRGAGLRRRGRLSAAGQGLRRRRRAWHPYRPRRRRTTSGIPHRPARGAGRLRFAGGVLGALHPPGTAHRSADPRRWRARGASVRTRMLAAAAAPEGLRGGTFGGAGRRAAPGPLRERGAPGAESRLSWRGHPGIPVRRAQRRVLLHRDEHPYPGRASGQRDGHRHRPGPGHAAHRRRRGAALAPGGHSPERRGAGDADQRRRPGAQFLPQPRHRGAPGMAAGRGRASGQPPVSRLPGAAVLRFVAGQADRPWSRPRRSVRPRAPGAGAHRAGRHGHYPAAAPLAARRCAGTGRAVRYRYPGNLARRADRRRAGGLRCMPTSATASAATSTCSPRSPSPCRWKPSSAAWRSPAPSRPCNCPGCSTYAWPTPRSRSASTPTGWPRRRCWRRCAAWRSRRSPRAASRRVSSKCRCCTTIPGPTRP

SEQ ID NO: 19789 - protein, 347 aa, Pseudomonas aeruginosa
VSISTRSLPIREAARNICRRCCMSIKVLKPGLATSVQDAGREGHYHLGIPPSGALDQYALRAANLLVGNAPTAAVLECALLGPQLEFQRDALVAVCGARMTPRLEGAEMPLDTSFRVRAGQVLGFDFIRAGARGYLAIDGGIAVPEVLGSRSTYGLGAIGGLQGRRLAEGDLLPLGPASPSAVEGLALPRSLQVEVGGEVSLRVVPGLYVHRLTPDAVERFFAETWTVGSEADRTGYRFKGGTALRFEPREQPFGAGSDPSNIVDACYPIGSIQVPGGLEPIVLHRDAVSGGGYATLGTVISPDLNRLAQMQPNQKARFVAVSLEEGLEARRRYNWQVQRLQHFFLR

SEQ ID NO: 19790 - protein, 69 aa, Pseudomonas aeruginosa
NPYRVLESGWSEWSNIFFVILPLRFEWLYLGWLVAFMVQVWITCFRCAPLGWQEIQCFSMLETCQGIYK

SEQ ID NO: 19791 - protein, 393 aa, Pseudomonas aeruginosa
SCVLGWVDSVIQPLMMPLSLTPGVPGLPDKRRHTSVEGIFPMSATASVATRHDWSLAEVRALFEQPFNDLLFQAQTVHRAHFDPNRVQVSTLLSIKTGACPEDCKYCPQSGHYNTGLDKEKLMEVQKVLEAAAEAKAIGSTRFCMGAAWKHPSAKDMPYVLEMVKGVKKLGLETCMTLGRLTQEQTQALADAGLDYYNHNLDTSPEFYGNIITTRTYSERLQTLAYVREAGMKICSGGILGMGESVDDRAGLLIQLANLPEHPESVPINMLVKVKGTPLAEERDVDPFDFIRTLAVARIMMPKSHVRLSAGREQMNEQMQALAFMAGANSIFYGEKLLTTKNPQAEKDMQLFARLGIKPEEREEHADEVHQAAIEQALVEQRESKLFYNAASA

SEQ ID NO: 19792 - protein, 436 aa, Pseudomonas aeruginosa
PYWKGGRRRPFVAAADVGPAWTGAPASVQQHERPAMSFDLASRLASRRAEDLYRQRPLLESAQGPDVVVDGQPLLAFCSNDYLGLANHPEVIAALRAGAERWGVGGGASHLVVGHSGPHHELELALAEFTGRPRALLFSTGYMANLGAVTALVGKGDTVLEDRLNHASLLDAGLLSGARFSRYLHNDPASLAARLDKAEGNTLVVTDGVFSMDGNLADLPALAAVAQARGAWLMVDDAHGFGPLGASGGGIVEHFGLGQEQVPVLIGTLGKGFGTAGAFVAGSEELIETLIQYARPYIYTTSQPPAVACATLKSLELLRRESWRRQHLAALIARFRHGAEALGLTLMDSFTPIQPILVGGSRQAVALAGMLRARGIMVGAIRPPTVPANSARLRVTLSAAHSEAQVDRLLEALGESWRQLSSSLLAEIEAEEGDDA

SEQ ID NO: 19793 - protein, 200 aa, Pseudomonas aeruginosa
RCLTIPRRCWRPMALPRCPTSARSPRRFPARRPDTTRWPNSSAASVRACCRHCRKASRRAAGSISAAAPVISAGPWNDASVRPRAWPWISPKACCGMPARAAAPAISLAATPRGCRCATAVATCCSPAWLSSGAPTSRRSWPRRGGSCGRAACWRSAACASVPWASCATVGGWWTASSTSIASAPSPTTCNTRPAAACCR

SEQ ID NO: 19794 - protein, 101 aa, Pseudomonas aeruginosa
PSRTAAPTWACCAPRPSRRPTVATRSPAPRSSSPPASTTWPTTSSISSWPACPTPRRAPRASRCSSCRSSCPTPKATPASATRFPAVPSSTRWASTATPPA

SEQ ID NO: 19795 - protein, 399 aa, Pseudomonas aeruginosa
RGRAQCGLLWLHRAQDGDQGLGHLCDELRRRHRLPDRRAEQGPALHVHHDEPRPPGHRHAGPVPWRDQLPGRRALRPGALADALADRAEGAGQAGRPDHRAPRRTAHAADHEGVQRRQPRAGLLHRPVARHRAPVAGRRRARAGRRPAGLPDTDLQGLHDRDRAGGDQPRHAGLRRPRLHPRVGHGAVGPRLPHRTDLRRHQRHPGPRPAWPQGTGQPGQAVARFHQTGPPVVPGPGRASATEGTGRATGGAERAVGRTDPAGGPGGDEECRRSGRRLGGLPDVLRLRDPGLFLVAHRPGGAREAGCRQRRGRVLRSQAGHRRLLLQSPAAAHRGARRGDPGRRGGPDEPVGGAVFALAAAGAGARRFFPRFLPHPPGPSDSRRTRSSPRKAGFLMPVA

SEQ ID NO: 19796 - protein, 620 aa, Pseudomonas aeruginosa
TRPRHAFRASILLPLAPGRRSVRSRIPHMADYKAPLRDMRFVLNEVFEVSRLWAQLPALAEVVDAETAAAILEEAGKVTAGTIAPLNRPGDEEGCQWNAGAVSTPAGFPEAYRTYAEGGWVGVGGDPTYGGMGMPKVISAQVEELVNSANLSFGLYPMLTAGACLALNAHASDELKDKYLPNMYAGIWAGSMCLTEPHAGTDLGIIRTRAEPQADGSYKISGTKIFITGGEHDLTENIIHLVLAKLPDAPAGPKGISLFLVPKVLVNADGSLGEKNSLGCGSIEHKMGIKASATCVMNFDGATGWLVGEVNKGLAAMFTMMNYERLGVGIQGLATGERSYQSAIEYARERIQSRAPTGPVAKDKAADPIIVHPDVRRMLLTMKALNEGGRAFSSYVAMQLDTAKYSEDAVTRKRAEELVALLTPVAKAFLTDMGLETTIHGQQIFGGHGFIREWGQEQLVRDCRITQIYEGTNGIQALDLVGRKVIGSGGAFSRHFTDEIKAFVASADEALGEFSKPLAAAVENLEELTAWLLDRAKGNPNEIGAASVEYLHVFGYTAYAYMWALMARTALAKQGEDDFYASKLGTARFYFARLLPRIHSLSASVRAGSESLYLLDAEQF

SEQ ID NO: 19797 - protein, 540 aa, Pseudomonas aeruginosa
WRLARASVRGSLRIADLVADVVLARRLVHRQSLHFLQAVRVVDHQRAVAVPDAEQGVAAVAGELDVAGDLARAGAQAMGDFQGLLVDQQDLVVFLAKEGIGPGVGRVGMAAHEEAGAVGDDFLQRLPVLQVDHRDHPAADVRRGEYPAPVALPVDARAEVRHARQRDRGDPRAAVQLDHLAAPGLPRAAQQVAVVGAEGEVVEVVGHRQPFRRDRLAVGIGQLPQLVDVLQGDHEAVSRRCRVYRADPRGLALGVGRRDDLHQGQVAGVQQHQVAGQVVAHQDPAPVVADRQVARVEAGADLGDHLQVVQVVEGYPAVARGEEHQAPVRGELRTSVQGVARGEAGDGLEAIAVEDGHVVVAGLHHHEQVQRVGLEAGPGRQGGEGMRLNLAGPDVLGAPLRFARRRLVEIGDQGVRRGVVQLTGKAGHLGCRATVQDHFAGLRRLQPRKAFREQGRAAAAEPPGAVAGLAVLAVERFPRRFAGLCEGAEEQAEGEADQAHATASRLTGEPAPRYEGCAIARSAKSATTWPTTISVGGFNW

SEQ ID NO: 19798 - protein, 302 aa, Pseudomonas aeruginosa
TASGAVSGAGRGAPAGPRSGVPLRRARGRGSCKTGCMATSAGDAGGGNRARRSFRGRGRGRRRRPPRGRRPAPAWRWRYSPGRGGGGSLRSGGTGRLRPSGGPVPALRLRRRRCVRRAPGRAGWPAAGPVPAGSAGVAAAARRGVRRGSSAGLQGKREVDAVGFLHRQVEGLQAGVGGDLRQYPVELRAVAGGEHEPQVVAVFALVVVVDLGVLADALGDPLQTLLGHRQGSQGAGPGALVAEHRADPRQRAVGFQATQPFEHLGFAATQGLGHPPIGFRADRQAFLVAGEEAAGEVVHGAS

SEQ ID NO: 19799 - protein, 303 aa, Pseudomonas aeruginosa
DRSLRARLAARPAGIAQGPHRLRQDPLRPVHGAAPGTAAVQRRLPRRPGRRRPARPPSDRRRRHLVAGRPADPRGARRRYLLPGRSGGGAPGHHGRHPPAGRRPPRAVPGAHRRDVAGAAFVHAGGVLQPRLPEPAQGPEAQHPAAFRRVALRLPGGAAGGTHPGRRERLCRGPGAAPGAVGPGAAAAGAARPGGSRLDPPADLRRAPHRRRHGPARGVPGGAGRTALGRPGDGGGADGHRRSPCRLIPSSGACPATWRCGSSSSPNSACSACCCWRSPAPRPGSRSCSVPAGSNWIAAGACC

SEQ ID NO: 19800 - protein, 134 aa, Pseudomonas aeruginosa
SSAGWRRPAGAGVIRRRLARDWSRECSTGTWSTWSGCCCSRWSTSCNEVPMRTLTLCWLALLALAVTGVLLGGAGDSPWLLAAVLALRGGQGLADRRALHGAGPCPGAMAPPAAGLAAADGPGGGRCAVPGADE

SEQ ID NO: 19801 - protein, 177 aa, Pseudomonas aeruginosa
LSKSFGNLDCHQAGSPPPLPRIAAPPIPGGRMSETFTKGMARNIYFGGSVFFILLFLALTYHTEKTLPERTNEAAMSAAVVRGKLVWEQNNCVGCHTLLGEGAYFAPELGNVVGRRGGEEGFNTFLQAWMNIQPLNVPGRRAMPQFHLSEGQVDDLAEFLKWSSKIDTNQWPPNKEG

SEQ ID NO: 19802 - protein, 622 aa, Pseudomonas aeruginosa
ASGAARRPPEMAFAVELEEWVGAHWHRFITRHASGEFEAARVTLESMRRPLGMLFRALGGAPGVALEATPARRLLLRRTWLQRVAGTCEQAPVSWFNGDSLRLPESLAVYPQAELNRELYRWLALLAASAGPLRHWAQDNQRWARQLLDAYPALRPRYARLVAAHLRQRPSLDDCPAADAELEIALRRALAEPGSVERFPRVERAPWPVPLWLYPGERWTPSASAEDGEEAAAGAGKRQVARSGARKRAERIEERNSERNLLLFRLESLLSWSEHLALDRCSDDEDDPDGARVAEDLDYLSLSRQRTQKGGGLRLDLDLPAADYDDLPLGPGLKLPEWDYRQQRLLSDHVLLQPMRPRGATSASLPAHLEKTALHLRRQFACLRDGRQRLRQQPQGDEIDLDAWLDFQVERRRGGSTQPGLFLEQRPRRRDLACLLLADLSMSTEAYLDDQRRVIDSIVDSLLLFGEALQALGDPFALYGFSSVRRQQVRWQVLKDFDEGYGGEVRGRVLALSPGYYTRMGAAIRRASQVLGGQPQKRRLLLLLSDGKPNDLDRYEGRYGIEDTRQAVIEARSQGLVPFCITIDKEAADYLPYLFGADGFALVERAGQLPERLLQLYRRLRR

SEQ ID NO: 19803 - protein, 246 aa, Pseudomonas aeruginosa
SSCIGGTSGGRGAMEQIVVNGVFIGKVEETWGGLVSAIDKLPVEQEFWLGHDGLPGDEQADIRHHGGLERALHHYPAEHYRYWRKRHPLNRWQLPAFGENISTYGITEAEVCIGDQFHWGDALLEVSQPRSPCYRQGQRWNLPELPDELQSGGRCGWFYRVLRSGMVTPGDELKLVQRHYPELTVARLLQWYFGDPLEPLGLRQMMACDALSQRWRKTAAKRLSSGVMEDWGPRLRGPSDYREHAS

SEQ ID NO: 19804 - protein, 390 aa, Pseudomonas aeruginosa
KMADALDSLRLMRTQERPEQVFVRGQGSWLWDSDGRAFLDFTQGLAVNCLGHSPSVLVQALARQARELVSAGPGLLNRPVLALAQRLCLATGSDQAYFLTSGAEANEAAIALARKWGRLHRGGAQRIVSTVNSIHGRTPGTLTACGKPAQHGLEGLARVPFNDLDAMAAAIDEETVAVMLEPVQGDAGVIPATLDYLRGIERLCRQRGVLLILDEVQTGIGRCGALLAEELYGVRADIVTLGKGLGAGVPLSALLARGNACCFEPGDQLGTHHGNALMTAAGLAVLNTVLEPGFLEQVREQGTHLRDGLARVARRYGHGPLRGQGLFWGPPLIGQRAPAVVRAAFGEGLLINAPQPHCLRFSPALTVSRANVDEMLRRLERALARVANRH

SEQ ID NO: 19805 - protein, 654 aa, Pseudomonas aeruginosa
PPGRRGVWASRPDIASCIARVGVPPLSFRDANALAPLVQSSRVRGQGGRASLLPPENRSIQEEQHERPGTAYPDRPPPVAADHRRPYRRGDPDRAGPAHPLGQRGGPGDARRPFAGMPGRRYRRVSRTLSPALPQQSSAAGGAVPGRAPGGWRVLQRRGGGSVSRRRRGHPLGAPRARVGADDPRGQARLPGADPPRRHRVGQRRAALREDLQCQPGAGGDLPAQRLPLREGQCRFPGNDRLCPRPGDRPFGVRAGRTRPGRAPRTGGGASGRRRDHPADGGEPAGGGGRTQVRGGRRAADRGRRGGLHALHLHRSRTAEEGRGGPAQERGALRQGLPHGTGAEPGAVRRRPAGAGHQPGLQRNLRLPGRGTARRVHRRLRAVAGRRRRAPGRAAGAERQRAQRPAAPAAQGSQRPGLPGLGRGGEPQRAGLRAGGLAGHQRPAAHRNGAGARHRDGDAGRFLVQPHPDRKARQRAPRQRAGHRRRTGRPDRARARGVRPHLPGPGGQGDRQGTGPGAEHRAQPRGDHLRQARCPQPWRGHRLGTRTRIRAGAAQRQRAQINEEGTNAPGRLVHSYLSPAPVGADTGAARPACPRPWSCTFSPRREPRRPHVCSPRQFRSGGGLPASFRIFAPLPLLVRDGILPAVCECSGLVS

SEQ ID NO: 19806 - protein, 348 aa, Pseudomonas aeruginosa
KKPEAQASGFSSPASGGAAAAAGAAATAEDAATAAAASPTAAATIEDGAENGHQHFAGKQEQGVDEQGRGQYAETVVRRAVDVLPQAHAQQPGQAGDRRAAKQEAADAAPPHPLQRQQASEQGHGEQDRHIDTEVDRIAPELSAQAALLLRLRRGAVIHLTLVDRCRQGPRRRGLGNRRQGVDGSAGGSAVRVLLGIDQLHQAVHAGLDAAIEVALAELRRDLLADDPPGLDVGDGPFQAVADLDAQGAVVLRHQQQDAVVDLLLAQLPFLEGTHRVLLDGIVAGGRDQQHSELRAALGFQGGELLLQLLALVAGKRRGEVGDPRRQRGYRRHIGPGDQAGEQQPGAQ

SEQ ID NO: 19807 - protein, 157 aa, Pseudomonas aeruginosa
KKSLAMKLKSLLVVLLAGVALSGCHRMDPNSPEAKRQAIFKEMLRTSEDMGGMLRGRLPFDAEKFRAGSAKLHQLADQPWQYFPSPKAGEEGEDTRAKDEVWQRQQEFKAATQVFIDAMNRLQDNTRQATPTPDGVRKDFAAVEDACEACHKKFRAL

SEQ ID NO: 19808 - protein, 157 aa, Pseudomonas aeruginosa
RSRACAGITCSTCRRACPRERRCWWCCTAHGATARRCAASAATASTGWRRKKVSWWPTRTASRATGTIAARPPAIRRGCVTSMTWLSSARWWRGWPRNTASIRSGYMSPATPMAARWLSAWPPKRRGCRRRSQRWRRACRPRGTMPVGRSSGRPRRC

SEQ ID NO: 19809 - protein, 84 aa, Pseudomonas aeruginosa
PVPARSGPSDSAGRKTAIRRWSCSACMAAATCWRSRTIASRGFSARATRNWTRQWKSGASSASCRAEAQTSKTNSGRNPPLSWG

SEQ ID NO: 19810 - protein, 489 aa, Pseudomonas aeruginosa
RAPKDAGRASGSAVRRGWPTACAAICAGRACRCGCSTRKPSACAEPAGNEKAPPKRGFLSRGRSEAGGVAQESGLVGLLPGERGEGIAVHGQLERMTTEVAVGRGRLVHRVEQVEHLGDRVRAQVEVLADQLHDLLVADLAGAEGVDRDRGRLGHADGVGNLDLATLGEAGGDDVLRHVAAGVGGGAVDLGRVLAGERAAAVAGHAAVGVDDDLASGQAAVADRAADHEVAGRVDVELGVLVQQLGRQHLLDDQLHHAVAQVVIGDFRVVLGGQHHRIDADHLAAFVAAGHLGLGVRAQPWQQAGLARLGLALDQAVGEADRRRHQHVGLVAGVAEHQALVAGALVFRLGPVDALVDVHRLLADDVQHAAGGTIEADVGAVVADVDDDLAHQLFQVDPGGGGDFTGDDRHAGLDQGFACHASVLVLGDDGVQHRVGDLVRDLVRMAFGHGLGGENGIFAHQSVPTLPVGEAAFGCIPGEVPDLDLEAIA

SEQ ID NO: 19811 - protein, 742 aa, Pseudomonas aeruginosa
YRVRTPAMPVSKIFDIDDGWPSRNCNPAAPGFWQNRSAATYCPPADLSLPLGPSVGENGALFFTPGLPTSNPRRRIAMPSRRERANAIRALSMDAVQKANSGHPGAPMGMADIAEVLWRDYMQHNPSNPQWANRDRFVLSNGHGSMLIYSLLHLTGYDLGIEDLKNFRQLNSRTPGHPEYGYTAGVETTTGPLGQGIANAVGMALAEKVLAAQFNRDGHAVVDHYTYAFLGDGCMMEGISHEVASLAGTLRLNKLIAFYDDNGISIDGEVHGWFTDDTPKRFEAYGWQVIRNVDGHDADEIKTAIDTARKSDQPTLICCKTVIGFGSPNKQGKEECHGAPLGADEIAATRAALGWEHAPFEIPAQIYAEWDAKETGAAQEAEWNKRFAAYQAAHPELAAELLRRLKGELPADFAEKAAAYVADVANKGETIASRKASQNALNAFGPLLPELLGGSADLAGSNLTLWKGCKGVSADDAAGNYVFYGVREFGMSAIMNGVALHGGFIPYGATFLIFMEYARNAVRMSALMKQRVLYVFTHDSIGLGEDGPTHQPIEQLASLRLTPNLDTWRPADAVESAVAWKHAIERTDGPSALIFSRQNLPHQARDVAQVADIARGGYVLKDCEGEPELILIATGSEVGLAVQAYDKLSEQGRKVRVVSMPCTSVYEQQDESYKQSVLPVEVGARIAIEAAHADYWYKYVGLDGRIIGMTSFGESAPAPALFEHFGFTLDNVLAVAEELLED

SEQ ID NO: 19812 - protein, 252 aa, Pseudomonas aeruginosa
LEQVGVVHFVVVIRLVAVGYPGDLDVADIADVATQGGGQVALDDLAVVAVELYLQVVRADLAADGLGVVLAGEEEARHVAVVDRLYEHRQPGAGGFAGGMGEVVEVGLAVADAVGAGRQQSGHDMDVAVAEDLGIVDGLGDGAAEFGLAPRQAGQAALALVPVAGCGIEQHLAQAVVVQPGLQFGRRVGIGEQVLHALEAVRRGGGEAFEEVVAGVEHAEVGGEAGHLALLAVGGCGRALHNGTRSRQPGVA

SEQ ID NO: 19813 - protein, 396 aa, Pseudomonas aeruginosa
STSTQGLIVMTVLKMTDLDLKGKRVLIREDLNVPVKDGQVQSDARIKAALPTLKLALEKGAAVMVCSHLGRPTEGEFSAENSLKPVAEYLSKALGREVPLLADYLDGVKVKAGDLVLFENVRFNKGEKKNADELAQKYAALCDVFVMDAFGTAHRAEGSTHGVARFAKVAAAGPLLAAELDALGKALGNPARPMAAIVAGSKVSTKLDVLNSLAGICDQLIVGGGIANTFLAAAGHKVGKSLYEADLVETAKAIAAKVKVPLPVDVVVAKEFAESAVATVKAIAEVADDDMILDIGPQTAAQFAELLKTSKTILWNGPVGVFEFDQFGEGTRTLANAIADSAAFSIAGGGDTLAAIDKYGIAERISYISTGGGAFLEFVEGKVLPAVEILEQRAKG

SEQ ID NO: 19814 - protein, 90 aa, Pseudomonas aeruginosa
RRRGKPFAVLGGHTFEDDEKRRCPMRSVTLPLLMFCLGLAACSGDGGRRPSTCEVISPPDVMVPTEQNRQRVEQQSSGDPTAGQKPVECP

SEQ ID NO: 19815 - protein, 141 aa, Pseudomonas aeruginosa
QARPAGRRAGRLRPGEVRRSVPHGWRMDMNYSRIALFGGFAAAALLAGCSASSGKPGGKDWTRWTCDSKAVIEWRYIDGSKNIVDLRLKDEDDVVHHLEQEPAAVGAFYSDGRLGFHLENDEGLVYWVETDDLIGRGCKAR

SEQ ID NO: 19816 - protein, 295 aa, Pseudomonas aeruginosa
TSTPTCAWPPPVPSAASWRRTRASSTRASTSPRPSRPCATSASLATKPSAPPATLPRSSRSPWKACSSATLAASWIRRSTKRLRSNGSPAGRGSCTSAPGKSDAPLAPYPAVPAAGRLRWPARAVPRRRGGRVAERSARSRRPAGLPGAQRLHDQDFAHPAVRLRLCRGRRRTGGARRAPTGNPAGAATLHLAGVAHPTGRAGQRSLRVREPLPAQERQGLPLQPGYAAEGLPQLPGRQALLAAQPSRSETLRRPGGDRRAALSQGCRSNSALPSMSNGAEKCSWITFQPSPCLR

SEQ ID NO: 19817 - protein, 302 aa, Pseudomonas aeruginosa
PLPREVHEAPDQWLRATLRKALNRSSGIRRKTAVLYLGLSLPPRRSLMSSVHSAAQQGFSAEAQRYAQGRPEYPEALSDWLRDALGLRPQTVVVDLGAGTGKFTRLLARTGARVVAVEPVDAMRAQLAEALPQVQALAGSAQSIPLANGFADALVCAQAFHWFATVEALEEMRRVLTAEGRLGLVWNVRDESLDWVAEITRIITPYEGDAPRFYKGDWRRPFERAPFGPLRLSTFAYEHVGPPEQVIVSRFLSVSFIAALPETEKNAVAAQLRELVASHPALKGREQVALPYRTEAYLAEAR

SEQ ID NO: 19818 - protein, 275 aa, Pseudomonas aeruginosa
RASADLQKCGLRERKLAGSVYRLVKLQRPPPDMRIFLPALLAWSSTRTRRPRPAAVIAHISPAAPAPTISTSVLATVPLRSSETARILPEAAVGRRSSRRGTLGVFREPPDPCMIPLKYLQAYPASLQDQVRQLIAENRLGEYLERRYPGRHDVQSDKALYAYTMNLKQEHLRNAPGLDKVLYDNKLDVVQRALGLHTAISRVQGGKLKAKKEIRVASLFKDAAPEFLRMIVVHELAHLKESEHNKAFYQLCQYMLPDYHQLEFDLRVYLTWKSL

SEQ ID NO: 19819 - protein, 151 aa, Pseudomonas aeruginosa
QRIAEMCAGSAFSERSRPGGGNGPAIRRRPGGNCGKTPPPTGSRSRRRYPAGSSAFVAAGREPSPCGCGSAGSTARFRRGRRRRGRNWPATSPPAGQAVPGSRHAPGVPAWPAGLVPGGRRPAGRTGRRPAVGGPGRRAGPGRTARWPARR

SEQ ID NO: 19820 - protein, 73 aa, Pseudomonas aeruginosa
REKTPAHAPDTVSTLDQGVPFMDLIRILIAILLPPLGVFLQVGFGGAFWLNILLTLLGYIPGIVHAVYIIAKR

SEQ ID NO: 19821 - protein, 464 aa, Pseudomonas aeruginosa
GPCSGVVPWFLHGEVPPRVFAVEGADVEHLAAPDDPFHTVFAVPFAVQRQVDHRFVALFRVGHDQLARLDPFQHPARRRDFLRRLAQPPQARGAVAQAGGTKPLDHGVIQFVEGSGAAPGVGVVGLVLDEQADVAPVQAPIHFAHVRIVQVADQFHAWSPCSAAFGEGDATAVAEAIVYVQPQRDRPGPAAGLPPALGEPGLQRIGEQVDAAEAVGEVGFVEIRGMSQAERQVQRLAGKQARVAGVDPVVGAIQVQPRFRCVASVLAEEQLDLAVAQSFLQGLPEQLAQALDHARRGALQVAAVALAEFFGAEAERNHGRFSVIRAGRARLPARPPGWVPGVRSSPASSRHGRPGTAPAGDRPGPSPRRGRRCRRLWPGSRGSRERFRRPGCVPATRRRRRAAGPARRGGRRAAPERRRRQPAAVVRARPLGHPIQASSGSSRANNAWWRAWASRRSPSASARA

SEQ ID NO: 19822 - protein, 630 aa, Pseudomonas aeruginosa
REGWPLVALGQPGQAEQQVVVAVRAAGIAAVSRALGVGAVAEGSLVGVPVGLVHLALVQVEQGPDVPTLQRIVLQVGPVVHPLGIEGHPLAVQRVGARVFPQALVYACQRIGLGASGDDQVVGVAVVDPRIVEVLPELAEHAPVLVQREYLVGDLARAPAVNLQSIHLQVVAQLMAFAPATRVQAPGLVVGVAAATAAALGVLVDVDVLGAGQLVQGLAVAVPAARRAFLLDCRSLRLVGNGEAGQGVGVVDEHLVQLTDEALDVAAIVLVDRATDLLHLGVDLHRAAADLQPVGLVGVQRLDEVGNRLAAVLARLDVEERLAGRAGYLDGYRLTRRGAAVDQLQQAAVGRYQRHRLVCLELDVRALEEARTVILAGIPQPRRADALGVQADRQAGLASVFDADAQALARRRHAADGGEALGRRQGEGQGFLRARYRHRLLALAGVAAQFLLRRAGFAHVADDGVGDEGFLEARRVGGLVHRVADVLPHRVGPQQPEPQRGGAGQGEEVLRLLVVGVEGAFQYIDALAEVAQSRHVVAGGATDVGGAFRPVVVRAPATVDDLLHQRRVLAIGAAQLDRTRPGAAGWHPVLVPVVTAVGAFLQAQAGEDLLAGAALVPAIGVHEEDRQPGL

SEQ ID NO: 19823 - protein, 220 aa, Pseudomonas aeruginosa
PCAHRGAQASGAGAVAQYQQFAGAGATGVGQRVAGGVRRLQAGALQAVEGGGLVHPDHADLEVLRSGRARVAVHQPLHRPLQQRRVGGIGPAQLGEHVGAIGQPAAAGLQAQAGEHAPLVADEEGQGIVRVGRQDPHAGGARIIGLAEVLVETVEQLGAGLADALDLLLQAQGDQVAVGQLRGIPADQCRIEDFFLGGSLGGQRASQAETDQQRSVARDG

SEQ ID NO: 19824 - protein, 67 aa, Pseudomonas aeruginosa
MVFAYVMVLTNPNIARWQGFDQYAPASNLTHESLLQSEVVCRRQELCFLCNQLMSSDEYCLMAKPFP

SEQ ID NO: 19825 - protein, 258 aa, Pseudomonas aeruginosa
  UNSURE (18),(19),(20),(22),(23),(24),(247): Identity of amino acid at the above locations are unknown.
VLCSNRLSYRPPESGGDXXXLXXXGSLFFFLLVWCLFWPLSVFFLPVAPLSLLPPCFFVSAFLSFLSLPLFVCLSLFFLSSCCSSLLCLVVCLFVLFPLCLAFSRLFVLSPLFCLFVCSLFRLPVPFCRFSGCFLRLSSCPCFPCFGCLSRALCLCCFGLRLRFRCFSLCIVVELFLGLWFGRFSAFPFFLRLLPPYPSPLALPSRLSFCLWLLATFCAFSYCAALLICVSALPLLRLLALYFLLSXRAVLLFSLAIR

SEQ ID NO: 19826 - protein, 276 aa, Pseudomonas aeruginosa
QDQRRCQVLQEAQSGVGQVPCRSVEADQRNQRHRARGDHPQGFRGAPESRFAGRPVGEKQQPDQRQRQQQPGFHHQSGQRGDRCLFADQAVQAEGQGQHQRHPGQAAELPDLLRHAQRSQGHRQPLQGTQAFLEQQHAEHHVDQRIDVVAQAGFQHVAVVHRPDIGHPVAGDQQSAGGQHDEALRILAQLAPPARVFPEQQQDGAEQGRPDRALDDDFHRGNAFEQFEVEREQPPDHISRQAEDIAPTEVGGRHGESLKRQAGKNGRARHARADDL

SEQ ID NO: 19827 - protein, 377 aa, Pseudomonas aeruginosa
PRLSTASRTRSGVSWSKGWDMTGHPRLERPLVYASRRGPAGSQRRAEQDLGRIEGGDHLLTLLQPQAGQAFAGQQRAEGKTAAQGDAHLAGTGLGREDFLQGAVQLVRLVLARFQPDVQPAGLDQRQYRAAATEFELLGAGAGDQRLDALLAWQLDGDAVVEAFAMDRQDPPVQLVACAGAEHQAADQVEVLGVFRGLQHLRLQGFQAPVESQQAFALGGQPGAAAALAADASLDQRTLGQVVQFVDGVPGALVADAHGLRRTGDGAQFGDLREQGDALRATGDVLGESGECGHGGFAMSGRIRRRLQQPWAKRKGVTRRPGTDRTRRRRRPGPRRGPSRLQPLPAERLSYNSLPTPKAREKLRPKRAWRAPRTPRS

SEQ ID NO: 19828 - protein, 256 aa, Pseudomonas aeruginosa
GLRAMTEVDLNSDMGEGFGPWTIGDGVDAAIMPLISSANIATGFHAGDPSSMRRTVEMAAEHGVAIGAHPGFRDLVGFGRRHIAAPAIELVNDMLYQLGALREFARLQGLSLQHVKPHGALYMHLARDEVAARLFVETLQRLEPELLLYCMPGSATWRIGRELGQPLVREFYADRDYDRSGSIVFTRRVAALDPQQVADKVLRACREGKVRTVEGEDLDIAFDSVCIHSDTPGALELVASTRARLEGAGIRIKAPR

SEQ ID NO: 19829 - protein, 453 aa, Pseudomonas aeruginosa
TSCWWPIAARSPCASSAPAQALGIPTVAVCSEADRDSLAARLADEVRLIGPARAERSYLDIEAILMAARETGADSIHPGYGFLSENPAFAEAVQAAGLVFVGPEAQTIRRMGDKAEARRTAMAAGVPVVPGSPGELGDLDAALACAEEVGYPLLVKASAGGGGRGIRIAHDADELRREFPIAQREAQAAFGSPAVYLERFIRQARHIEVQILGDGERAVHLFERECSLQRRRQKVFEEAPSAALDGAQRQALCESAVRLAQSLGYRGAGTLEYLFDAHSGEFFFIEMNTRIQVEHPVSEMVTGIDLVQAMLRIAAGEALPWRQEDIRLNGAALEMRINAEDPARNFFPSPGTVERLEWPQGEGVRVDSHLYPGYRVPPYYDSLLAKLIVHGRDRDEAFARARQALERTVLAGMATTLPLHRWLLADARVQAAQFDTATLETWLAERTAAAQEV

SEQ ID NO: 19830 - protein, 328 aa, Pseudomonas aeruginosa
WTASRRSSRSWSAAAARPWPWPACFEPVASWSARSARQPCRPTARGCASRCPPRTAKRRSTACSKPSAKAGDSCRLAFWQRSKPRRETMRDHLILLPGWGLGSAPLEPLRDALHEREPHLNVLIEPLPSLDDAADWLDELDDNLPRDSWLAGWSLGGMLAGELAARRGDDCRGLLTLASNPCFRVREDWPNAMPAETFEDFFEAFLLEPHLTRKRFTLLVSQGARDPRTLARQLQVALPQLEREALVAGLQLLGQLDTRAALENFRGPQLHLFAEADALVPLAAAEALLEWLPDVEVSTLAASHGLPLECPDEVAGAILRFLREGDDA

SEQ ID NO: 19831 - protein, 477 aa, Pseudomonas aeruginosa
EPAVGIAGRLLAAPLGRSRLRHRLFQPGPGTTLRCGRGPGRGYRRRHAAACPRARRRQPFHWRRRREAAVARRQLRPAVLQPGYPVVRRPPGGPGRGAAGPAAGRRAGVQQPVRRYPGRVARQLAGGGRLRPRQSLPRLRRLPATRGRQRPAAADPAPRGPAPAFPRPAQPDPRTQGAGRAQPQPRAARRPDRAPAHPRAGRRLRAFPPARGAARYLPRRLRRAAQGFLNHAGVLRHRYRHRDRQDHHRRRPAPRGPECRPEHRRGEAGGLRLRAHGARPAQWRRVGVARPVLAGAGLRAGQPAGLRTGHRPAPGGARGWRRTERRTLARGGARGAGATGRLHPGGGRRRMARAVAGPREPVRPGAPAGAAGGAGGRRAPGLYQPCAAQRRGDPGRRPGAGRLGGQRRRPGYLAPGREPGDPRRTPAGALPGSGTAPGGSHSRGRGRTPRPAAPGYRAINSGPSITNGRYPAPAKSA

SEQ ID NO: 19832 - protein, 140 aa, Pseudomonas aeruginosa
  UNSURE (96): Identity of amino acid at the above locations are unknown.
IEATCYRSGACASPGVEGGNFRQRFRQWPQRGAVGQRPRRPGRQRDRPQYRGGPFAPGRADGRTDPRQARGAERRPGHRGSRRDPRYPDRYPRLIXWRPAAAAPTLPFPTVTRRPLKPAGRFAMGFTERDESALEGRGCQ

SEQ ID NO: 19833 - protein, 614 aa, Pseudomonas aeruginosa
LRGIRACGAPLPRRTEMPEYKAPLRDMRFLIDEVFDFHGRYQALGASDATPDMVAAILDEGSKFCEQVLAPLNRSGDEEGCHFDNGVVTTPKGFKEAYAQYVEGGWNGVASDPAYGGQGLPHSLGLLLSEMIGASNVSWGMYPGLTRGAMSAIHAHGSQAQKDLYLARMTAGTWTGTMCLTEPHCGTDLGIIKTRAVPNADGSHAISGTKIFISAGEHDLSENIVHLVLAKLPDAPAGTKGISLFIVPKFLPDAEGNVGARNAVSCGSIEHKMGIKASATCVMNFDGATGYLIGEPNKGLHCMFTMMNHARLGTGMQGLCLGETSYQGAVRYARERLQMRSLTGPKAPDKPADPIIVHPDVRRMLLTMKAFNEGNRALAYFTAQLLDTEHLSQDAAERERAADLLAFLTPICKAFMTETGQEVTNLGMQVYGGHGYIREWGMEQLVRDCRIAQIYEGTNGIQALDLLGRKVLGSQGKLLRGFTKLVHQLCQAQAEHPQLKGQVAQLAALNAQWGELTQQVGLAAMKNADEVGAASVDYLMFSGYVTLAYFWLRIALVAREKLDAGSGEAAFYEAKLATADFYFSRLLPRTAAHAAAIQAGAAGLMSLSAEQFSL

SEQ ID NO: 19834 - protein, 281 aa, Pseudomonas aeruginosa
SLRRCCCRPGSGACRCAGPAGRAWSGRRRDRIRRRSAGRGRTPGRRGTGRRGLRPAPARSSPCRRGSARCRRRVRSARRGRRCRARAAAGYSRRAGRGKAARGDAGSWGDLSFDQAVHQPAGVVFAEQAGPGGHRGLRTAHEHGGDQRFARLAAQGLGGQRRAEAAGQAQAVAGSAVLQQQVTQLGLATGIGMLVGQARKRTGERQREGQPQGVAGGAPEVRRGVHFCDRTHFARVCASSSLTAFGGIGIGPQTPWLPFLIRCASSASAPAWPANLAATSL

SEQ ID NO: 19835 - protein, 261 aa, Pseudomonas aeruginosa
DMRDATPFYEATGHEIEVFERAWRHGLPVLLKGPTGCGKTRFVQYMARRLELPLYSVACHDDLGAADLLGRHLIGADGTWWQDGPLTRAVREGGICYLDEVVEARQDTTVAIHPLADDRRELYLERTGETLQAPPSFMLVVSYNPGYQNLLKGLKPSTRQRFVALRFDYPAAQQEARILVGESGCAEALAQRLVQLGQALRRLEQHDLEEVASTRLLIFAARLIGDGMDPREACRVALAEPLSDDPATVAALMDIVDLHVA

SEQ ID NO: 19836 - protein, 69 aa, Pseudomonas aeruginosa
PVCCWVAPATLPGCWRRCWPCAVAKGWLIGERFMELAHAPALWRRLLLAWPLLMALAVGAALYLARMNN

SEQ ID NO: 19837 - protein, 541 aa, Pseudomonas aeruginosa
TCRAAAPCRSSISARARSTTWPSSSSGARRSIPTNGRRTRRVDDVAQWLPEIRLAGGRQTLLRVRPDPLRRADPVRPDHGPAVRGRRLPVPGDPLQRRAHGAHQPADRLAAVRLHGRCLLPGAGGERLRAVQPEAGLDPVLGIRRRRRADHPRLPAGALRRPGQAHRQRTVADHGPRVPRTADHQQGGHRDRRPGLPVQRRHDRAARAQDRHQHGPDDRPDRPRPAVPVLLLQPGKPHPRQVLLVVGGAPVGGRRVGTDHGCDPRLRAGEDHRGRPRGDREVALRDHRHGADQRHHRHRPPLLLDRRARLLAVARLGILGAGAAAVLRHGAVRLQHHQPPPPPRLSEPRGRAVGHGHHSDGLPRRGSVGLHAYPGAGQLLHPRHPAHRRPRPHGLLWRLRDDRDDHHLLRHAAPARDRRGDGQPLAGPGDVGLLADDRGDGVHHPVPLRGRGAAGLAATDAGGRRGDDLHGHPGPAGDLLLAARRRRGGVPHRPGRLPAELPARQGGRLRWPSPSSWRNGSAPTGTASSPAMPAASSRRRG

SEQ ID NO: 19838 - protein, 217 aa, Pseudomonas aeruginosa
TANCIAGWRCWRPAPGRCGTGPRTTSAGRGSCSMPIRRCARATPGWSPRICASARRWTIARRQTPNWKSPCAARLPSRAASSASRESSGRPGRCRCGCIPASAGRLPPVRRTARKRPPAPASARSPAAERASAPSALRNATANATCCCSAWKACSVGRSTWPWTAVATTRTTRTARASPKTSTTCRCRASARRRAAACAWISTCRPPTTMTCRSAPG

SEQ ID NO: 19839 - protein, 256 aa, Pseudomonas aeruginosa
NGGEAGLRQAVENPAHVVQFRLHPRPPADRGELLLPDLARAELFAEQQHRQLRGLGQGHLSELLQRVFLGDHQLQFVLVQLDAVQARLARRQEADADIQVAGEQAPLDVDSRQFVDLHPQVRLRGVQAFDHVRHQAGVDRLQHADRQAARGLPAEYAHRLAGPFQSLQQRYRMVVQGVGGDGRQQALAAALEQRDVEVLLQLADLLREGRLRQGQAFGGAADVAFLVERDEIAELAKIHKLFLSMKLENRNGVGPA

SEQ ID NO: 19840 - protein, 73 aa, Pseudomonas aeruginosa
RREDPPGCRALPRGGAGAVPVARLPGASAGGDRTPGLIARKIPLSSHAPPDVVLVLWGAFFILGCVLSQPGLQ

SEQ ID NO: 19841 - protein, 523 aa, Pseudomonas aeruginosa
CNRHACAVRAGGHPCCPRKIAPSKRNSMNDQVLRTQTDRRQLQQIIAGLTEGVILIEPDQRILWANEAALAMHGVHSLECLGADTGEYRERFRLRYRNNHPLQEGQYPAERLVAGECFSDVVVEVFPAADEDTRWVHRVRGLVLTTPEDKPDCLVLILHDATEWASAEQRFEKTFNANPAPAVICRLSDYRYVKVNVGFLEMTGYARDQVIGRSVYELDVLDQAERRELAVERLGAGETIPQMEASLRVAEGGRKCVVVAGQPIEVGEEACMLFTFTDLEPRKKAEEALRKSEERFAKAFRMAPVPSLVLYGDDLQALDINQAFSETFGYQAEELLGESTVACGLWQDGGAERLGELLAQSGSVRNVQLRLQHKDRNGLDCLVSAEAVSLNEQDCVLVALLDISDRRRTEMELVHAIETVMQDASWFSRTLIEKLANVRRANAPGTGAELADLTAREREVFDLICQGLADKEIAKELGLAPNTVRNHVATIYAKLDVHSRGEAIVWARERGFAPEPRNGNGRK

SEQ ID NO: 19842 - protein, 353 aa, Pseudomonas aeruginosa
AARRGTGEVVAAAQLLRDRQPVRPRLLPPDPGLPPAVRRRLHLPGRHAQRHPRRHPALSRKGVPAVARGGAGVRLGRAYRLQHAAYPGPRPAGQPLLAARLLRPRRAAESGGGQGGQRRAARRRRDPGALPAPAQSEVSRRPALRRAAGSPGQSVLPFARPVLRGPGAEMSEVADDLAEIASLVRELRKRKGITLQALADGIRRSVGFVSQVERGLSRPAVDDLVAISQVLGVPATYFFCSPKIQASPWVTRPGERRTLAYARGASDNLVSPRLGGAFFMLETCLEAGADSGERDLLDSSEQGGYVLEGELTLWLEDEELRLQAGDGFQIPSHMRSRYANRSQAPVRVLWVYA

SEQ ID NO: 19843 - protein, 180 aa, Pseudomonas aeruginosa
TILVYTNKARHASHQPGAMRRRSPRHLEHPGQVQQRPLAGGRLHGRGRRALRHPAVALRQPAAGRSLALAARRHRPATALPGTVDRGLQGRRPGPGLSADARAVAAGGAGPDPGVRRRAAQRPADPRHPVDPLRHALPALGRRRFAAALADPAGGAADRPVHRRLHLERRQRLEALAVGA

SEQ ID NO: 19844 - protein, 272 aa, Pseudomonas aeruginosa
RGFPPRAGGAAGPGIPRRFAAGICRRLLQWRPDGFPPGRRSAGVAGGDRSGGGEPADHGERCLSAGRAADRGVADQRHARSDQSLSRRQGQPVRLRRPGRGTLDPGLGTLVGRPERHRSAAGRGAADPSRPGLDRATALAGRRPSAGGAAQRAWRRPRAGAAGLSLPADSRQERPGTGRASGNLALLQPVAALRLRPRRRIPDGTRLSRGDSRPDWPAPVPGRCGSRGRRGRDRAASSRPAPPVRRGWKRRLATVGCRRTAAGSTAHWARGG

SEQ ID NO: 19845 - protein, 226 aa, Pseudomonas aeruginosa
RLSPGVSPAASAHWARSSCSKPNQRSPQASLAQPWLCRHKSVTSRLPPGWTRRANCFSASAGAAKWCRTMFSTTQSAGSAASCRASANSRRTLPNPSSLQRWRASSSIAALLSSAVTWRKRLASSGRNPPSPGPTSSAVAPGAKASASSKANTLSRYCGSPAIRSCWAWNLSAARAKKSWLTAARWACTASIRARTSSGSARSSTSSSSAACSAPPVRSARGSERR

SEQ ID NO: 19846 - protein, 367 aa, Pseudomonas aeruginosa
LAPFTGPLPELSLPMSTPPFRVALNGYGRIGRCVLRALHERPEQLGFEIVALNDLADQASVEYLTRFDSTHGRFPGEVKVDGDCLHINGDCVKVLRSPTPEAIDWQALRVDLVLECSGQYTNRAQAERFLRAGAPRVLFSQPMASEADIDATIVYGVNQQDLSGRETLVSNASCTTNCGVPLLKLLNEAIGLEYVSITTIHSAMNDQPVIDAYHHEDLRRTRSAFQSVIPVSTGLARGIERLLPELAGRIQAKAIRVPTVNVSALDITLQTSRDTSAAEINRVLREAAESGPLRGLLAYTELPHASCDFNHDPHSAIVDGSQTRVSGPRLVNLLAWFDNEWGFANRMLDVAGHYLRAAVPDQQVPKD

SEQ ID NO: 19847 - protein, 427 aa, Pseudomonas aeruginosa
RRQDPCRLRLQRPRDPADRGVRPCLRRVRGRRAGLPGFPGNRHGRRGRRRRRGRRAGPQPVADRSGRSRRLREEDQGRRPGHRHRHQPRRLQVHQAADRGHPVDPAHQGNPRAHPGHPPGDARLFLGTAGLAGDHQRVRRRDQRDLRRAGRGNRRGHQVRRAQGEHRHRPAPGLHRCHPPLPGAEPERVRPAQVLLQDRRGHARHLHRSLRSLRHRRQRFQDQADLPGRHVPALRSRRAGSEGQLSAFVRTGAPLVGALAHPPRGNPMRRWLLTLPFLLLAGCAGLHAPSRDVEEAASPSVARDPADPQDCLARSDCTTKTSRTLLFVFDYAEAGGELVVRDGRQLETPPAPQRSTWPALRIQLAEPVNGRFEFESPCLRKSGKGCRYSQATLLKVYRSYLVGKPCSLLSPRAVKRCVDPAATAARR

SEQ ID NO: 19848 - protein, 398 aa, Pseudomonas aeruginosa
PGRVSSGCYKDEFSMGSASQRSVQDLYEDVGDHYRIFIRAPFFQLLKHRDYWVPLLYFFFVLITMFWDLYCHSGQYLYEARSLLPFYLFPFLIAALRIGDIVVDTRCRNVENLGGFERSAESSRYVQLSLYERQWFRLRYRAYGGNLRCLAGDLVENWRLWKEVNSKAAKDIDGAVMLRFFLPPRDLARLVTLLAALIAVIATLIITLGADRQGYFEFVDNLPAYLKLYWGVVFIIAFSGPYMIFLGMQARLVLRAMIDALSISQPSDKLFYQFIQRLIWADGVKPANPSANSRVLRAVDSMVDFFYEEWRSAIGKLVLWLVALLVLLLCTLLHCLLRVFSSARTLGEALMRILLAVLGGVCWIVAAIQRLNLAVPFHWTFFVLTGTGALFATLCGQP

SEQ ID NO: 19849 - protein, 521 aa, Pseudomonas aeruginosa
PRCRPGRRRSRKSVRRWGGAWATSLRALAQGAGVGARHSNPGQGREGKQGEGERRAVRPGGKESGDALRVLAVLVLAGVAVLGQQVDQVQADDRDQRDQHPPAALVDVVQTPGGDAQGRQQHGERVEIGDRQELFTDQAEHDAQRNGDDDVHQGEHPVFLATGTPVEVEVVFLHAFQKPFHVCLLGVLVKRESGCRDKYPRASLPGKHSVAVLSVNSYRMLRKSFTLHSSGSPKCAPVALSASGVGLAAETARRYAEGLAEIAGKRRLRLVAGLGGDIQQALLRLSQQAASLLHADAGQQVPRRGSAEGGEGADETGPRHRRLLGKLFQGPGMLRAFQHGPQGSSQAGVAQQAEQAVAQRLAVQVGAQGQGEQRGGQRVDDRAGAAAGALGFLAHQPDQRAQGLLGRLVHMHQQALGERAEQAGTGVIAVAAAKHVEGLARAVQLVQRDAAAVLYGGFAGLRRAVAAQEVRGAAWQQNQVAGMQVEATAIEEFAIAGAGHDDMEGRLAGHRLRVLQRPAAL

SEQ ID NO: 19850 - protein, 142 aa, Pseudomonas aeruginosa
RRMGRRRGPDWSRLVTRRATPGAKATENITMLNNWTEFVPAVKKAFGALGKQHPKMLAAYGALEEASAEGALDAKTRELISIAVAITTRCDGCIGVHTEAALKAGASEAEIAQTLATAISLNAGAAYVYSLRALEAYDQFKK

SEQ ID NO: 19851 - protein, 120 aa, Pseudomonas aeruginosa
PAARLAGATVETYRQVPETCRQHCCELRLAPAYDIVNTTAYIPQDVLALDVVGNKSLFASRQGLLEFAQVCYVARPKEVIREQLQALERVLARSTELSEQAPHVVAAIRQCAVPFMQTFG

SEQ ID NO: 19852 - protein, 504 aa, Pseudomonas aeruginosa
PSSAGLRRARQAVDVDPRGARPAQQAGKALGGGPGGEHVVHQCQVQPANIAGGRQGEGVAQVAPPHRRVQSLLGRSIQHSPQAVRIAAHVQLASQSLGELLRLVEAATTFAPWRQRDRQQACRARQAFGVALPQVFRQQLAEQPPQRPGRLVLEAVDQAVERKGVAPGRDRLFIGRRAAQALAAHLAVQRQGQGAAPALLARPGQVGGTGAAQWAGRLVAAGGAEQAGRRRQKPASERTKRERHGGTSWRMSHHATAGARRRPAVASGFGTRLWITETFLRSLRKRPTRGSVDEPAHDDQAEHRPDHPADYRAAHEGAYTAVEQQQAEHQEDEAEQRCVHADGPGQAVEEVVHGVPDAAQQAGEQVHHEADRPAQHLAQSVEKAFCTHECPVLSVPSVGSEISRRVQRRLLLCCGARNDWRKYSRNARIPALASVSRRQARPTLIDGTGSTSDSVSMRLPSSDQGRYTRSERMATPEPLATMLRTASTELVWRITCGRWPLCCQ

SEQ ID NO: 19853 - protein, 243 aa, Pseudomonas aeruginosa
SAAPTSPPVSMPATRAACAAPWRWPPSMAWPSAPIRASATWSASGVGTSPRRPSSWSTTCSTSLAHCANSPGCRACRCNTSSPTARSTCTWRGTRSPRACSSRPCNAWNRNCCSIACPVRPPGASAGNWASRWCASSTPTATTTAAAPSSSPGGSPPSIRSRSPTRSCAPAARARCAPSRARTSTSPSTRCASTAIPPVPWSWSPAPVRAWRAPASASRRRVERRSPRRASRQAFLPFPTTFE

SEQ ID NO: 19854 - protein, 85 aa, Pseudomonas aeruginosa
GFVMAEHNVQSPLPGTFYRKASPDAPPYAEVGQAVEAGSVIGLIEVMKQFSEVQAGQAGILQAFHVEDGEAIEPGQVLAVIASAT

SEQ ID NO: 19855 - protein, 359 aa, Pseudomonas aeruginosa
SSMVATATKRSPARARRWSAPCWPAWPLPCRCTAGCSPMRGYRPRSSIPLPWKPGSPSGPPPRRRFEMHANIRYSFGGDEHLFAEVAESMSLEAFFRGMAITRAIETLQLPGVLDVCLANASFQVRFDPDRLAPQALLETVRGLEVEAVAARSIETRIVEVPVLYNDPWTHETLMRFRDRHQDPDSTDLEYAARINGYADVQAFIQAHSGTPWFVSMVGFVAGLPFMYQMVERERQLQVPKYLRPRIDTPKLTLGHGGCFGCIYSVRGAGGYQMFGVTPAPIFDPRQGLPYLEESMVFFRAGDIVQFRPIERTEYERMAAEVEAGTFDLRIRPVSFDLDAFLADPRGCTQHLQEVLYVD

SEQ ID NO: 19856 - protein, 260 aa, Pseudomonas aeruginosa
GAQARPRHLGAGRRPRRPLSPGHPAVRRARPVCPARCQLAGGQRTDRRRVGVRAAGAAAGVPARRLGGRVRGAHDASPGGRGDAAGYFLPGSRRPGPGVRFHSCRRPWLSRHRRRHRGTRGAGQSFDLRSGGDRWLAGTTAGGGRPAASGACLALCRGGLGAAAFAAGGGRRRGELAGGSRTLRPSPDPRRGRAFLRRDLDRRFGGGPHRLPLQGRHGAPVRAARTAIRRRLGPVQHRRRLLSHRLDPGTGRARTHRPAS

SEQ ID NO: 19857 - protein, 406 aa, Pseudomonas aeruginosa
CRPCVDGCACVRPATRATCHVLRSRFPPRQPARGRPLPPAAAAGVGPGPGRRGRRPAAAGLLFQRLPRPGQPSRGDRRAARRRRALGRGRWRLAPGGRPQRPAPRTGAGPRRIHRAAPCAAVLHRLHGQSRRGDRAGRQGRHGAGGPPQPRFAAGCRIALRRAFLALPAQRPGKPRRAPGQGRGQYPGGHRRGLQHGRQSRRPAGPGRRRAGPRRLADGRRRAWLRPAGRQRRRDRRTFRPRPGAGAGADRHPRQGFRYRRRLRSGQRGTDRDPDSVRPALHLHHQPAASGGLRHPEEPGAAAPRKLAAATPGGADRPFPPWRRGAWPDPDGQLHADPADPGRRQPPGRGPGRHASSPWHHGRRDPPANRAGQQRAAARHAVRRAQRSAGRPLARSPRRKLATAVV

SEQ ID NO: 19858 - protein, 281 aa, Pseudomonas aeruginosa
DSFARVTMPDDSSPLLAPHGVAALPDKRQVAASFSRAAARYDAVAELQRGVGESLLSALPEGFSPRRWVDLGCGTGYFSRALERRFGAAEGLAVDIAEGMLRHARARGGASHFIGGDAERLPLRDGSCDLLFSSLAIQWCADLPAVLAEARRVLRPGGVLAFSSLCVGTLGELRDSWRVVDGFVHVNRFRAFADYLQHAAGSGLLPLTLRHEDRLLHFPDLRSLTHELKALGAHNLNPGRPDGLTGRQRIRALVAAYERFRQPEGLPATYRVVFGVLRKDS

SEQ ID NO: 19859 - protein, 229 aa, Pseudomonas aeruginosa
TMPAFFVTGTDTEIGKTTIAAGLLHAARSAGLSTAAAKPVASGCEPTAQGLRNGDALVLLGQCSLALAYEQVNPLAFAPAIAPHLAAREAGVELSAARLHEAVREVLALQADFTLVEGAGGWRVPLLGRENLSDLARLLALPVVLVVGVRLGCINHALLSAEAILGDGLALAGWVANVVDPATSRLEENLATLAERLPAPCLGRVPRLEEATPAAVAAHLDLRPLGIGL

SEQ ID NO: 19860 - protein, 77 aa, Pseudomonas aeruginosa
RVEISGNAFVSGLNAVQSGSARVAQAGSEIARNTVEARSPQAEQMVELTRAKLEAQSGARVIEVADETLGTLIDTHA

SEQ ID NO: 19861 - protein, 605 aa, Pseudomonas aeruginosa
RLTAMPDYKAPLRDIRFVRDELLGYEAHYQSLPGAEDATPDMVNAILEEGAKFCEQVIAPLNRVGDLEGCTWSADGVKTPTGFKEAYQQFVEGGWPSLAHDVEHGGQGLPESLGLAISEMVGQANWSWGMYPGLSHGAMNTLHAHGTAEQQATYLTKLVSGEWTGTMCLTEPHCGTDLGMLRTKAEPQADGSYKVTGTKIFISAGEHDMADNIVHIVLARLPDAPQGTKGISLFIVPKFLPNAEGNAGERNAVSCGSIEHKMGIHGNATCVMNFDAATGFLIGPPNKGLNCMFTFMNTARLGTALQGLAHAEVVFQGGIAYARERLQMRSLTGPKAPEKPADPIIVHPDVRRMLLTMKAFAEGNRAMLYFAAKQVDIVQRSQDEEQKKAADSMLAFLTPIAKAFMTEVGFESANHGVQIFGGHGFIAEHGMEQNVRDSRISMLYEGTTGVQALDLLGRKVLMTQGEALKGFTKIVHKFCQANEANEAVKEFVAPLAQLNKEWGDLTMKVGMAAMKDREEVGAASVDYLMYSGYACLAYFWADMARLAAEKLAAGTGEEAFYKAKLQTARFYFQRILPRTRAHVAAMLSGANSLMEMAEEDFALGY

SEQ ID NO: 19862 - protein, 217 aa, Pseudomonas aeruginosa
GRRGPRRPPSGCTGRRGLPSRRARRRTPGARPGRTSDLRAGRSARGSGRWARSDRRRGWSRGGRRTPPPRTGSAGRPRSGAWTAGWRGDAAEPGWPGCPRRSTAVRAAAPGRDRRPGRPPRRRPIDRQSRPSGLPGDRAGSLRGPAPASAAKGFPGAGSGRCRRAARRRGRPGSAGGRALPPALRRPVRGRRGAGRGRGRSGACDGLAADRRAGAQV

SEQ ID NO: 19863 - protein, 281 aa, Pseudomonas aeruginosa
RMRHRALGEERHHLADDDQRRRLQLVASRQRRQLGKGAAGHLLARLGALADQRRRGVAGEAVLDQARGDLGEVAQAHVEHQGLLATRQAGPVEVEAAVVLQVAGDEGAGLGEVAVGQRDAGVGTATGGGGDAGDHLAVDAGFEQALQLLGAATEDERVAAFQADHPALLPGQAHQQLVDFFLRQAVVAAALADVDALAAFRQKGDQLAGDQAVVDHHLGLLQQGPCAQGEHARIAGAGADQGDAAGREIDIEEGRRNPRSVHEAFLITGAARCARGRFPDL

SEQ ID NO: 19864 - protein, 553 aa, Pseudomonas aeruginosa
CARRPVADAPRAPPGQPGCWPRRVGGGAPGRPATTRRRLPGDAAVRAPRLRCNPGSRPSADRVPRRSAGLSGSGRGGGGRGRPWCLLESDVLGAVAEEYAARAAGRKAADALQAVRVPDLQLVGVAHRDPYLVAAPAEFHVQYAGARAQGFDHFVGLAVDDLHLVVVRVGEVDPHLPVVRSSHDEHRLAGDVDGVGLLPVARVEHQHLVMADRRDEGLVAGDGPALQVRHLVHRQLALAAAVVAEYAPDAALRVPEVELGHAVLAEQPGHVVAPVGADEGVVGLLADIAEAGQVRRVALAEVGDPDLAAVEQAEHEALPGRVDQADHPGVPVLAGEAGGGNLGDQLQGAAVEHLDPARLVAGYRDQPTVLADRSADAVAALDQALVDALGQQVELGQAAVATEYVGVALVAGEHQGGVGQVAEAFDPRQRGLRRAVEDLHAAVGAFDQHAEVAAAAQGRLLATAGEQGEEKRREGTQVHGAISPSIRRSTSQPASSSLSRPAQGGIGVCGRPMSTVATSDSRGLPRRASGVSAGPRPPVRRRPWQDPQSCNSR

SEQ ID NO: 19865 - protein, 452 aa, Pseudomonas aeruginosa
FGDFLPGVLRMVLRIGADQRDAAVAQVAGAPHRAVLGMHEVGATPRVRGLADVDQGRQATVLGVDHGNLVGVVGGGHEVAVAAVPAAVVEERRRTDAGDGEVVDILVVDQQDLAGLLHVDDELGVLVGGDDRRHARFRVVGLGVYGHAAGGDDLLRLQGLAVHDRELRRPVGAGDGVAVLVALELGAFHRARLDADLDLGDLGRLLGPQVDHVDPRVAADHQQVAAGSGHPRDMHGIAGIDDLDDLLAVAVDQGDLPGVAQGHREQVGQVEVVELFLRPVLRLHQHLPRFAHLRHAPLRRLRRGVLDVLGHQGDLFLAQLAGAAPVRHAQRGAVGDQRFQVLLAALLGDVRGQRLAGGALAQDAVATGAALEVDLLGLVELAFTHVGGTVGAHHVSGIDGGSGTLVLLGGFHVVLGVSGGQAQQRQRGEQGARQWLAKWHGLSPQEPCEALP

SEQ ID NO: 19866 - protein, 196 aa, Pseudomonas aeruginosa
WTSSISMSPDTVERRLPGDLAMWFFILAELSVFSLLLLAFAGAQAWQPELFRAGREQLDSRWGLLLTVALLSSGWLAALAVHAVRRGRPRQASGWLLAALLLALVYVGLKLHEYGRLADLGLDIEHDTFFTLYWCLTGFHFLHVLLGLLILGWLAQACWRRCYTPQACSGLESGVLYWHMVDLVWVLLFPLVYVLQ

SEQ ID NO: 19867 - protein, 623 aa, Pseudomonas aeruginosa
NRRTTHSRRPHVRDLYQRHGQEHLFRRECVLHPAVPGPDLPHREDPARAHQRGRDERRGGARQAGLGTEQLRRLPHPARRGRLLRAGAGQRGRTPWRRGGLQHLPPGLDEYPAAERAGPPRHAAVPSQRGPGRRPGRVPQVELEDRYQPMAAEQGGLMMSPNGSLKFASQAVAKPYFVFALILFVGQILFGLIMGLQYVVGDFLFPAIPFNVARMVHTNLLIVWLLFGFMGAAYYLVPEESDCELYSPKLAWILFWVFAAAGVLTILGYLLVPYAGLARLTGNELWPTMGREFLEQPTISKAGIVIVALGFLFNVGMTVLRGRKTAISMVLMTGLIGLALLFLFSFYNPENLTRDKFYWWWVVHLWVEGVWELIMGAILAFVLVKITGVDREVIEKWLYVIIAMALISGIIGTGHHYFWIGVPGYWLWLGSVFSALEPLPFFAMVLFAFNTINRRRRRDYPNRAVALWAMGTTVMAFLGAGVWGFMHTLAPVNYYTHGTQLTAAHGHMAFYGAYAMIVMTIISYAMPRLRGIGEAMDNRSQVLEMWGFWLMTVAMVFITLFLSAAGVLQVWLQRMPADGAAMTFMATQDQLAIFYWLREGAGVVFLIGLVAYLLSFRRGKAAA

SEQ ID NO: 19868 - protein, 242 aa, Pseudomonas aeruginosa
DGLRRRAGGMGRRPLAPLHHPPCQRRVRGGAGDPGEHAASARHALPGARRRTGGSPRGDPGAPPAATPHLVAAGRRDLRAGPGVLVQRRQPAPAGIPRGLSAGRAEPRTVSLAGAAGGQRRAAAALGPGQPALGAAVARCLSGAAPALRPAGRRASAPAPVAGRLPGGRRRTGNRPAPRACRAGQRRALPASRAGALAGAAVAVSRRALDAFRQCGGRRGSGRRRRQAPGRPQRSAQARRAH

SEQ ID NO: 19869 - protein, 760 aa, Pseudomonas aeruginosa
PAARPRAEAARVGLSAAAPAERPRAAATDAAARRDQRQPAGAPGEDRAASAPPVRLPARRPPTPAPAAARRRDRPRCLARLPGRAAARRFHPARPVPRTAAAPARPRLPVAGGPVDVHRSLPRRPAASDRQHRRQPAAVRRGVAGTGRPLRAVRVFLGAPAAGALAGAEGLRRRLRRRGPRSRAGALAGLLHADGRGDPPGQPGARRAAAEASPAVAVERRQAQRPGPLRGPLRHRGHPPGGDRGAQPGTGAVLHHHRQGGGGLPALPVRRRRLRAGRARRAVARAPAPALSAPAPLRCLREHRAATRASCPGRTAPARRRTRRSAAAGDPGAGAGKRWAVACRTVRRRFPRLRFHGGNTGIGAWAFSRARPRQLAGGQAVARLTAIKRRGCSLEALQAFAVEDADFAAVEADDALVAEAVHDPREGFRLDRQVTGHQLLGHRDFHPAVLPRRVGGEGQQVAHHAVGGVLQGKRLDLVDALVQAGAELGQQGQGQRGVVLQLAQVGLVGETEQLAGHHGLGGGHVVRGVHEHHRLGEGVAFVGHFENLLLAFRGQPVDLHAAGNQVVEGVRRLALAEHVGALVEVDQVAAGEQFLELDGRKRFEQVVALQQLLVDALEFHAGKARDDEGTAHCSGPGAGHLDARQARGGWALPSVRRAELLQRVSQGLQTAVVLAAFSPSRRCVIFKPSGHCAGSAKDNTETQGIHHGWWRSTDVRIEVCKTPPKRRGFLLPAKNRVAQTTPSSSERSSSTLACWRCASR

SEQ ID NO: 19870 - protein, 142 aa, Pseudomonas aeruginosa
TDRRPPVAVVFRRSPGASRVAPDDGLRRAIPALAQDSGETPVQRRDGRLGAAPARTVGLPGACLLSDYLITLSQSGRLLASMTVSAARFAEVRELMRQRFPAGDGFELRIETRRESRRLLEQGPQGVRLLAVEYMTEELKDG

SEQ ID NO: 19871 - protein, 625 aa, Pseudomonas aeruginosa
PAPDAHPGTARTGVRPWPGLVAVGQRRTRLPRLHPGPGGELPWPQSQRAGPGPGPAGAGAGQRRPRPAQPAGAGIGAAPVPGDRQRPGLLPHQRRRGQRSGHRPGAQVGPPASRRRATDRQHCQQHPWTHPGHPDGLWQAGAAWPGGIGQGAVQRPRRHGRGHRRRDGGGDAGAGAGRCRGDPGDPRLPAWHRAAVPAAWRPVDPRRGADRHRPLRRAAGGGTVRGTRRHRYPRQGPRRRGAAVGAAGAWQRLLLRTGRPAWHPPRQRVDDRCRAGGTEYRAGAGFPGAGARAGHPPTRWPGPCRASLWAWSAARPGTVLGAAADRPARAGGGSRGVRRRAADQRAAAALPAFFPGADGEPGQRRRNAAATGAGPGPGRQPTLGGGLMRALVLQHVPFEGSARIGDWIGRHCEHEHVCYLYADAHLPALDSFDLLVVMGGPMSVHDEAQYPWLVAENRLIRAALDAGKKVLGICLGAQLLAQALGAAVRPGRQAEIGWWPLHRYSQALGSPLGERLPERLMAFHWHGETFDLPAGSMPLYGSAACANQGFIWNEQAIGLQCHLESTAESIEALLDACPQDLQREGAVHSAGRIRQGVAHCREVAPVLFLLLDYLAHRPAEIARRA

SEQ ID NO: 19872 - protein, 166 aa, Pseudomonas aeruginosa
PRASARCSTSSARAWRTRRSPRNWAWRRTPCATTWRPSTPSSMSTAVARPSSGHANADSRRSRATATGANKRRGYECTRAAGAFVPVARSRRRRHWRSTPGMPPPVVVHLFSAARAAPSARLFPSPVSLWRGASRLLSNICPSASAGARRHPAGRLRMLGTGVVKF

SEQ ID NO: 19873 - protein, 445 aa, Pseudomonas aeruginosa
VLFFMKNNQYNFTEVAMFLQSNEHVGTYYAAVNPELIQPRQALEGDLDCEVLVVGAGFSGLHTALRLVEGGRQVCVIEASRIAWAASGRNGGQALPGWSSDLPPLEADLGYEGARRLWDGMLWAAGEMRELPQRHGFDCDYRVGHLWTAILPRRVGLLYDWQAEANRRWGYEGLRFVAKDELPEWIASERYLAGLYDPHAAHLNPLKLAFGLAAAIERAGGRIHERTRALNYREEGDGYRVRTEHGEIRCAALVLACNAYIDGLDSELSQRMLPVGTYQVATEPLGEERAKSLLPRNCCVTDNQFVLDYFRLTPDYRLLFGGGCTYLGGMPSDIRAATRPYLERVFPQLRGVALEYAWGGHIDCSMRRTPDLGRQGNRYWLQGYSGHGVLPSLAAARAVSDALLGDDETLALYQRLRNPKFPGGQRFAAPLEALGKAYYRLRDLF

SEQ ID NO: 19874 - protein, 544 aa, Pseudomonas aeruginosa
ESSIVDQPMASTFLVPARISALSGGAAAERQLGRQGQQAEHEQRQRPDRHGLAEQGPDHFAAQPLGLEDLRQPGVQRYPFGEAHEHLATAHALGSQFLFRDQRPGVVDPAQAGGEHAQRGDAAGDPRTRGEAADDPGEHQAEHVQANEDAQRAGREAAHVLEVEDESEDQQAADGDRGPEQAVVEGLEESAQGRDSCVVDKGGRAGTVRRWPMVVHQDCPKIKPFDVTMSAACFSAFVGAFREKRRNEASIWSLRRDRLSWSIPIRPVMLATSLVLCAAVLHATWNTLVKFSSDRLLVVACMDVVGVLCAILLLPFVSLPPAEVWPWLLGATVLQLLYRVLLIEAYKVGDLGLVYPLMRGLSPLVVLGLTLAFGGEQLSGRQILGILLIPFGMLCLLWGGGGSRLPWRTLPVVLLIGLCIGGYTWSDGNALKRWPLALDYLVWLTLLSGLPFPLIAVGARTRAFARFWALEWKLGLAVGVCVLASYGLVLWAMQLGSIAEAAALRETSVLLAVLFGMRFLNEPFGLPRLLACGLVLAGMLLMKL

SEQ ID NO: 19875 - protein, 138 aa, Pseudomonas aeruginosa
VAVPQLQGTAMTIAFWCVLIAIFLPYVCTSIAKFGGEGYGGRANADPRAFLGSLEGFRRRANNAQLNAFEVTPAFAAAVIIAHLVGNASQATLDSLAIAWITSRLLYVICYLADWGPLRSLVWFVGMLLIAAFFVVSA

SEQ ID NO: 19876 - protein, 373 aa, Pseudomonas aeruginosa
QRRKCASKRHGCGCPGAKYAAPGSLEKGHGSGIPAQPGLTLSEDTENGRTAMRTLIRLVRTLILLLVLALLAGAWWWLQDEALRPPALAGHSEDSSLKVAGLRRHYLLYVPPGVSEGAPLLVVLHGSRGDGAQMRRISGYGFDRLAAQEGFLVAYPDGFEGHWNDCRKAASYSARLRDVDDVAFLRALVARLAQEYRVDSQRVYVAGYSNGGQMAFRLAAEAPGLPAAIAAVAASLPTTGNDACRPVERPTAALLINGTRDPINPYLGGKVSLFGFGDRGAVRSTLDSARWWAGLNGIAAPPDVAPLTRPGPVWTERQRWQEDGHPPVELLSVHGGGHVLAQPDYRFPRILGKSDPELDAPVEIWRFFSQLPR

SEQ ID NO: 19877 - protein, 457 aa, Pseudomonas aeruginosa
GTIKTGRAGFIPAIRAFCLGVVPMKLLWGVLAAALAAWGLTLAVDPPASLDIWVVRKQAILLTGVASFALMSLIMLLAVRPVWLEKPLDGLDRMYRLHKWAGILTIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 19878 - protein, 109 aa, Pseudomonas aeruginosa
ALRRRPTGPGPPVRNPTRGRRRPPWPSPGCAGTSPSPAGCRPDGPGGPTVSAPPPARRSGAGPCSAPRNRPVRRRPAGHRPIPGGRCPILLPCSAGAPVPASPRCCPAP

SEQ ID NO: 19879 - protein, 668 aa, Pseudomonas aeruginosa
DHRQPQGQPERAERLRPAAAGAARRFRRPGRLQPDLVEGLQGRQRRRRRRQLRVLRRARIRHERDHEWRRPARRFHSLRCDLPDLHGIRAQRRAHVRTDEAARALRVHPRLHRPRRGRPDPPADRTTGQPAPDPEPGHLAPGRRGRVGGGLEACHRAYRRSVRADLLPPEPAAPGARRRPGGRHRPRRLRAEGLRRRAGTDPDRHRFGSRPGRAGLRQAQRAGPQGPRGIDAMHQRLRAAGRVLQAVRAAGGSRRAHRHRGRPCRLLVQVRRSRRAHHRHDQLRRVGAGPGAVRALRLHPGQRPGGSRGAAGRLMHTLYWRDLESPANGEWLGLAVQVEGAHRAPSFLHLQSGGQARIRLMRGDQPLLWATQLPYHDGIWLVKSLVAASPAQASVPPIDSPTLEALRGLRGEARYKAWSRYFVETLRTSPGSCLEAGRWLLRLSLAEQVPAWQPPQSHDPRERVLERWRYRSVGRDALLPDWRFYSLEKVLGDDWVQWLDWWGRDNDALIALRRVEDDEGRVKWWRKKAREGELPPVLALRLNCLDACVILDGHCRLRAGLLENVAPEILVLCAYDEQPMPVDTAQRERVLQSLAQRVDAPVRRGRRPLDSEQLNQVLLRLFDDRPWPRVLTRARAVLKEEQWCAEVRDWLAARERLDALEPIIRRVE

SEQ ID NO: 19880 - protein, 156 aa, Pseudomonas aeruginosa
RAGAEVRRAVRRVRDGCLRYRPPRRGVDPRRGQVRQGRRRRPAAGRRTGRAGQGAGQPGAADGGDRRRLQGFHQARRAEQPGRHLRPTDRRRRHRQHLPRRGRTQGRQVTVRGRPGRDRQGHRRQGQGAAAGGRGGGQGIRRERRGDRQGHRRGRR

SEQ ID NO: 19881 - protein, 364 aa, Pseudomonas aeruginosa
TTPRLGDTRTMALISMRQMLDHAAEFGYGVPAFNVNNLEQMRAIMEAADKTDSPVIVQASAGARKYAGAPFLRHLILAAIEEFPHIPVVMHQDHGTSPDVCQRSIQLGFSSVMMDGSLREDGKTPADYDYNVRVTQQTVAFAHACGVSVEGELGCLGSLETGMAGEEDGVGAEGVLDHSQLLTDPEEAADFVKKTKVDALAIAIGTSHGAYKFTKPPTGDTLSIQRIKEIHARIPDTHLVMHGSSSVPQDWLAIINEYGGEIKETYGVPVEEIVEGIKYGVRKVNIDTDLRLASTGAIRRFLAQNPSEFDPRKYFSKTVEAMRDICIARYEAFGTAGNASKIKPISLEGMFQRYARGELDPKVN

SEQ ID NO: 19882 - protein, 585 aa, Pseudomonas aeruginosa
RVAGLGRRDHSHHHPLRRRRAALLQGRLASAVRARALRTAALVHLRLRACRPAGAGDRLALPFGELHRRLAGDGKERRGGAIARAGRQPSGAQGEGAGSAALSHRGLSGRGALGVLPRRITRGPGPLEVEAAEVAADVQYFADEIQPRRALRLHGLRRHFVGAHPAQGHFRGAVALGARGRDPPGRKLPGDTRQFGRGVLLHRLGDEPAVGQQSGELLGEQLGEQGLQLAVGTLALLLRQPFAGVVVRQQVDFQGIARLPVGGNLQHRRAAEAAMGEQQVLAEHLAVAAHPAIHGGAGKLGTQLLQLVGDGERHQPGAGRQHLVAELARHLVAETAGAEGRDRQAAAGDHQRLAAHLAGAGTQVVAGVVAGDLFDRGVQQDFRSGLGAFAQQHLEDVAGLVVAEQLAEFLLVVRHLVLGHQADEVPLGVAGQRRLAEVRIARKEVGRLGVQVGEIAAPAAGHEDLLAGLVGVVEHPHAAPASGRRHRTHQPGRPGANDQHICTCHCPTPLIGNGAHLTRSGGRPPELPTRYTGRFPRTAGPVHDPPQVPPGLSRIAAGPGPPADRREPPGRVPRAPLPGASRCAE

SEQ ID NO: 19883 - protein, 134 aa, Pseudomonas aeruginosa
MPAPPMSIRCARWKPTTSSKSEAVQALQVEQQPQPGHQGQPAQPQQALAQQRRGPAVEQVDQAKHAAEQQQAEQRLGVLGETRRQRLVAVGGIVVQVPGADQRRRQQRQQRAEPAPADMQEEAREQADQPGTQR

SEQ ID NO: 19884 - protein, 483 aa, Pseudomonas aeruginosa
SSRPGSTRRPPCCSRAATKAAGSGRPSQASRASNSGFIGLVQGEQCMVAGMGQQAFAQRVGQGVEARVQRIQGRFAVAVGFIGPGRHAQLAFGLGDWHRTVAEQQGGGSLQQGQGVLRLQFAKTRARRLVLVAGGVAEVLVEAAVVHFAAEHAHCVVAPFGRRQPGESLAAIVDAIHQRAPVQRLRTRQVAPSLRVEALAILDVLPVAALAGHAQSVVPRRRGWKDEMAAGAAGKAVGHERSLLVEGAHYCAGSFSLNDSLACQPGTALPAGMADPLSLRGEGHEDRRGARSITPRQPPQLRLTETATPATPGSCPEASPCCIRWSGCWHRRTPAARRNRRPPPAPGPLPRYGCPIARRLAAGRAGSARTGRATGCRCRPCCWHRRCFPGAGRRCRSRGQPCWRPSRTCPPGAGAGRAGSRCPNPAADRSSGRPSSAPTGYRRPSARRSARRCPGLPTGACIRLPADRPRRVRRRSGCRRCGS

SEQ ID NO: 19885 - protein, 191 aa, Pseudomonas aeruginosa
  UNSURE (167),(168),(169),(171),(172),(173): Identity of amino acid at the above locations are unknown.
KEWECREPTEPQTKKELDHNAQGETAETKAKTEATKAESTRETTKTRETRTRRQAQEATREPAERHREPEKRADEETEERRKDKQPGEGQTKREKDKKTHNKAKERGTARRQEEQRQTDKERKRQEGQKGGNEKTGRKKRQWGNGKKKDRKGPEQTPNEKKKKERAXXXKXXXIPTRLWGPIAQSVRAEDS

SEQ ID NO: 19886 - protein, 843 aa, Pseudomonas aeruginosa
QAMSAQAASIDSLLSILLLADHRVLELSWSTPFNEPLEWSNWREPVYLAYQPWAARYPDHVFSSAWRFLSERQPAHGALLTALSALAIEFVELRHGVTRIRRDLFGAWQQGLASRLSTLPIQAAAKVSLGSPLLSLTPTSFTEEESSNKRTAAWRRQVVPLLHPEEAPVADYITREGLHESHLHLNGSTHSEICWLRALRNIRAETREFVTTWKHEKGVLSVRDLIGQINPRLTPQVFHQHLLAASRLRTWLVGAATGQIGAGAQLPFSCESMCAAGEDDWSEGLALPMPSWRSEPDIQDELSWMEALIGQLMQQPSTQISRMFHTYLLLLNQYFRLLVQSETQYGFDQFQKLTLTKLRDPSERDFRTRFNSMHGLNSTISTIGYLEGRFSPKVDLRKAEHLYQAVLGGYHGYLRDTTGASELSSTTPRSLSRLLTELDSFFARQALPHRRIHRLTLVAHFIKRDWSPKANGKAGPFRHYPLDVDLRHTVNVLLLSLDRWPRLRTWVRGIDAAANELHAPPDVFAPAFRVCYRAGLSRRSYHAGEDFRHLLSGIATMWEALEFLQLRDGDRIGHGTAMGIRPSLWLDRMPRKISLPRGEWFQGVLAAWQLLRDEPEMQGCANRLQRELEGVAHEIFGRTLSALDIERAMALRGLSRLDVMRQLTSCGAFHHETLNDLWREETEQVKVAYHNQRSALELLWEWLSHEAVLIRAHELVAKEAQFLAPTDYLRLQQALMCQVASRGVLIETLPSSNVRISQYHHIGEHHSLRWMRVPGFVEHGDPEIMVCLGSDDPGIFANDLETEFYLMYATLRQAGLSDSDALNRLSTLNERGRTYRFHHPLLS

SEQ ID NO: 19887 - protein, 77 aa, Pseudomonas aeruginosa
AWEGTYQALPKALPDDIDSIANAVTSKYLNLHETATSNSIDSSGNTSSVFSKTLTKVWIVSSQETLERLFQSASNNR

SEQ ID NO: 19888 - protein, 935 aa, Pseudomonas aeruginosa
QYAALHGPIAPVVSLSTTAFPSLQGENMSRSPIPRHRALLVGFCLAGALSAQAATQEEILDAALVSGDSSQLTDSHLVALRLQQQVERIRQTRTQLLDGLYQNLSQAYDPGAASMWVLPANPDNTLPFLIGDKGRVLASLSLEAGGRGLAYGTNVLTQLSGTNAAHAPLLKRAVQWLVNGDPGAATAKDFKVSVVGVDKTAALNGLKSAGLQPADAACNALTDASCASTSKLLVLGNGASAASLSATVRARLQAGLPILFVHTNGWNQSSTGQQILAGLGLQEGPYGGNYWDKDRVPSSRTRTRSVELGGAYGQDPALVQQIVDGSWRTDYDWSKCTSYVGRTTCDDVPGLSDFSKRVDVLKGALDAYNQKAQNLFALPGTTSLRLWLLWADAVRQNIRYPMDKAADTARFQETFVADAIVGYVREAGAAQKELGSYAGQRQQSMPVSGSEETLTLTLPSAQGFTAIGRMAAPGKRLSIRIEDAGQASLAVGLNTQRIGSTRLWNTRQYDRPRFLKSPDIKLQANQSVALVSPYGGLLQLVYSGATPGQTVTVKVTGAASQPFLDIQPGEDSSQAIADFIQALDADKADWLEIRSGSVEVHAKVEKVRGSIDKDYGGDVQRFIRELNEVFIDDAYTLAGFAIPNQAKTPAIQQECAARGWDCDSETLHKLPGTQHINVDQYAQCGGGCSGNPYDQTWGLNPRGWGESHELGHNLQVNRLKVYGGRSGEISNQIFPLHKDWRVLREFGQNLDDTRVNYRNAYNLIVAGRAEADPLAGVYKRLWEDPGTYALNGERMAFYTQWVHYWADLKNDPLQGWDIWTLLYLHQRQVDKSDWDANKAALGYGTYAQRPGNSGDASSTDGNDNLLLGLSWLTQRDQRPTFALWGIRTSAAAQAQVAAYGFAEQPAFFYANNRTNEYSTVKLLDMSQGSPAWPFP

SEQ ID NO: 19889 - protein, 185 aa, Pseudomonas aeruginosa
RRTASNPWHPAWRPGWKPGPACPNDGETPMIPFGLSPEKFRERYRRDLQRAAPGVIQRLRELLRQPLEEGLRDGEIQLFLGEDGRDAAEAWLYLNGANNRVDASDPRLFPGKALDLALGLGHAPDFDEAYFADGFGGVDLLADTLQAWFAECWWKAGGWAWPIPLWLHVHDGFGDGRGIALTERC

SEQ ID NO: 19890 - protein, 157 aa, Pseudomonas aeruginosa
TGRPRMELIRNLDDANMGEVYWRLYRRYISLFIENEADDAYAWRCARALDELDDAVIERLCAASLRYRAARLGRLGESAEEVAPARGVLERIEPGELIVPDPEQGDEAVIHLSLNCEWDREHGMEWIVRGGEVLYVGPFHGEDPWRDFTVKEPWNYA

SEQ ID NO: 19891 - protein, 339 aa, Pseudomonas aeruginosa
PGLECLAPTPAPCANARSEVAHAPPHRRTDFRLRRRPGRQRGHCRARDVRGAQRLRAAGGAAAPAGRHLRPDQPRHPRSRREALRPAHPRQLQPRGAPAQRGDGRPGPTHSRRTRGAAGPGPACRGGLQQPPPQPGALAGARRAQRTDRRTPGQRRYGRPAQARTRRLPARRQPARRRPRALPGGGRQQHRHPRRPRRGDAGDRLRRRRAHSRRARRGTARAGRHRHRRAHARTAGDRGAPAPDSLSQGCPQRVANKAPVPVSTKKVQWKGTARFKRWIAATIQQTPPRTAKRIRISASPNVLAEEKTRSRQCKSVQRSSTSRATSHSTSLPMALLHSS

SEQ ID NO: 19892 - protein, 190 aa, Pseudomonas aeruginosa
QPLETLPGQVHPQVELQLVIVRQHVLAELVERLVVLAFLQVGEFVDDDHPQELRGGVLEQGSHADFLLRLELAALHPRDRGVQAEGTLDHVELVVVEHLVQARRVAQVFLLEVHGVGVQRLVTLHIVTPRVAALEVLAQAVLGDQLADLVLQRCGIGLEVLEGDHARVRRFAENAQCTASGAPAADRRFG

SEQ ID NO: 19893 - protein, 664 aa, Pseudomonas aeruginosa
AEWDSGKYRCADRWRRGGRADVCDDGGRTRAPRAGARPRQQGRQEDPHVRRRALQFHQPVHRAGQLPFAQSALLQVGAGPLHPVGLHRPGGQAPGAVPREETRPAVLRQQVQRHPRDAAARMRRGRSGNPAGHLDRRDRPRRRRLPPAYQRRRDALRVAGDRQRRPVDPDPRRQRFRLPGGAPVRPRGAADPRRAGAVHHHRPVEGAVCRAFRHLRGLPGELQRPSVPREPAVHPSRPQRPGDVADFLLLATGRYPGNRPAAGPRRQRMAGAATARASQQRAEDPARRAAHQEARRTAGRPLVRLQADEAVHPDRTGGYRRAAFGLAGHALGHRGLPHRGSDPGRGEHRRSVVEDHGVAALAGAVFRRRSTGRQRPPRRLQLPVGLGLGLCGGAVRLARLGQIGLGAIGQRYLLPPLERRMAGDQLAQLRRHGVLFRLRQGGDEAHRKEARDDHLLRRADMLVGEGGQAQRSEGRALERPTPVALVEARRVAFVGGDDASDLGDPIQRLVTHVPHQPQPAFRRQHAAHFLQRLHGGEPMEGLCAHQGVGEAVGQRNRLGATGQRLDLRQGFGKLGAHRIHRFHRDHSRAGTGQQAGELAGAGAEVHHDGLRTQAKGIAQPVGERFRVLGPALGVTLGLGAETLLGGAVYGRHEGPPGRQGKPEV

SEQ ID NO: 19894 - protein, 456 aa, Pseudomonas aeruginosa
VPWFSYLPIAGSFSDSEACRRGRPGSSSLRGAVAAPRPCRRDSARLATATDEVVGFDPVHQAFVVLQVEAQASVAIESADGRRFLLQMVDHVVLVLQAQVDDVLAAVDIAPFDHRLAVAGPAGPVLAARLAGGSGAAGQQRRGGEAAEQGDTRVVHVHPPSVRNAPPHLAGPQAARAAAGWPCLSQERRNATAYAGESPALSVETGRKALRAFHRLLSGGRIAAALLLDPLAVLLGRHHHVRRTDHLAGARASTAIAATGGQAQAEHQEWQGYGTHGAPPFFVVLKGVTPEDGEWFAPSASALGALLQDFHGRQDLALDELEERAATGGNIGDPLGDAVLVDRRQGIAAAGDGERRAIGDGIGQGTGALAELVELEHPDRTVPQDGLRGLQQLGELRGGLRADVEDHVVIGDLGDGLDGRHGALGEFLGHHHVHRQRHLDLGGDGLGGLDQVGLVQ

SEQ ID NO: 19895 - protein, 239 aa, Pseudomonas aeruginosa
LADLVSGRGEEGVGDAAADDQLVADAGQAVQHVELGGNLGAGDDRRHRPRRVAQRLAQRVQFGGQQRAGGGDLGEPGHAVGRPLGAVGGTEGIHHEHVAQRGVLLRQLVSVLLLALVEAHVLEQHQVARLDLDAVEVVGQQRHFAAQGLGQVLGHRLQAVLGGELALGRTAQVRADHHRRALLQGQLEGRQGGLDPCIALHLAVLHGHVEVLADQHALTFEVEVSHLQHGHDNQSLGTC

SEQ ID NO: 19896 - protein, 293 aa, Pseudomonas aeruginosa
NDSCDTWLARPRSVVQGSPASTDRQERQMPRFAANLSMLYPRHDFLERFAAAAADGFEGVEYLFPYAYPAAELKARLDDHGLRQMLFNAAPGDWDKGERGLASLPGREAEFRRAIAQAIDYAQVLGNRHIHVMAGLLPAGADRIRHRETYLDNLAHAAREAAGAGLTVLIEPINNRDMPGFFLTRQDDAQAICREVGADNLQVQFDCYHCQIVEGDLATTLRRDIGNIGHVQIAGVPDRHEPDDDNEVNYPYLFELLDRLGYQGWIGCEYRPRGDTSAGLEWLRRWRATRRDG

SEQ ID NO: 19897 - protein, 902 aa, Pseudomonas aeruginosa
PAPRHPRPGAGRSGRRCRAPTSRATAPSRRRGPSPGCRSASPATVRRARRCGSASVPAPVRADRGSAVAARRAPARRATGAATSARPPGNCPGWYAGSRRNSGSRPCSGPRRAGRATLPGSASRWAARWPAPGSPRPGSSPARCHRGTATGWPRAAADRHASGECGPGRRIADEGKRAPDGRPPPGPRGPAIRHWRGFRGPASRACASVFQQLLGYRQDVVQGEAEVLEQRRGRRRLAEAGHADDAPVETDVLVPVVGMGGLDGDARADFHRQHGLLVGLVLLLVDAGAWHRYHADLAALLAELVVGLHGQADFRTGGDQDQFRLAFAVLQHVAAAGDVGHLGDVARLVRQVLAGEDQRGRTVGTLDGMLPGHRRLDRVGRAPGVQVRGQAQAGQLFDRLVGRAVLAEADGVVGEHVEHALLHQCGHAHGVARVFHEDQEGRTVGNETAVQGDAIHDRAHAEFAHAVEHVVAGGVVGADALAALPQGQVGAGQVGGTAEQLRQQRAEGVQRVLAGLAAGDGLTLVGNIGDVGRGLLGEVGRQLALQAAQQFGGQFRMGSLVGGETLVPLGFLGGAGFLGVPLGVDLRRDLERSVLPAQRGAGRGDLVGAQRRAVALFLALLVRRAETDHGLAADQGRLVALARGIDGGLDFVGVMPVDVADHLPAIGLEALRGVVGEPAVDLAVDGNAVVVVEGDQLVQAQGAGQRGDLMGNAFHHAAVAEEGVGVVVDHRVAVAVELGGQDLLRQRHAHRIGDALAERTGGGLDAGGVAVLRVARGARVELAEVLQVLDAEVVPGEVQQGVDQHRAVAVGQHEAVAVGPLRVARVVLHVVAPEDLGDIGHAHRGARVAAVGFLHGIHAQCTDGIGSLTTAGHRNSPTGVAGRKTRSEKKGAIFAHRRPKGQ

SEQ ID NO: 19898 - protein, 348 aa, Pseudomonas aeruginosa
YRHCRGSDPVLDCASMSLRVPSIRPDDYDPLAALCKAAGDSLRLNVLRALANDSFGVLELAQIFAIGQSGMSHHLKVLAQAGLVATRREGNAIFYRRSLPLAERTGGALHAALLEEVDERALPDDVRARIDAVHAQRAAVSQDFFARAADKFQAQQDLIAGLPQYRESVLALLDALAFAPGATALEVGPGDGGFLPELARRFRQVTALDNSAAMLELARQRCKEEGLGNVRLELADALQDAAEPADCVVLNMVLHHFAAPAEALKQLARLVHPGGSLLVTDLCRHNQGWAREACGDLWLGFEQEDLAQWADAAGLTPGESLYIGLRNGFQIQVRHFARDASESRLTHR

SEQ ID NO: 19899 - protein, 401 aa, Pseudomonas aeruginosa
CRNRLMSEYSVFTSESVSEGHPDKIADQISDAVLDAIIAKDKYARVACETLVKTGVAIIAGEVTTSAWVDLEELVRKVIIDIGYDSSDVGFDGATCGVLNIIGKQSVDINQGVDRAKPEDQGAGDQGLMFGYASNETDVLMPAPICFSHRLVERQAEARKSGLLPWLRPDAKSQVTCRYEGGKVVGIDAVVLSTQHNPEVSYNDLRDGVMELIIKQVLPAELLHKDTQFHINPTGNFVIGGPVGDCGLTGRKIIVDSYGGMARHGGGAFSGKDPSKVDRSAAYAGRYVAKNIVAAGLAERCEIQVSYAIGVAQPTSISINTFGTGKVSDEKIVQLVREHFDLRPYAITKMLDLLHPMYQPTAAYGHFGRHPFELTVDGDTFTAFTWEKTDKAALLRDAAGL

SEQ ID NO: 19900 - protein, 213 aa, Pseudomonas aeruginosa
ACEPGGSAYASRFSRSRCLRTTLGRVVPECPNHGPSPETPGRRTLLPDNHNRAVCWHTCAFVTPAAACLIRLPGRSAEPSSGNRTGRSIKEPTDVHSSFTAAGRAAARRRPAALCRPAGRRQRRPTQRLRRQAGRHRGEAGNGPLVRQRRPGGRLGKGPLRGQGTLHRSRPAEGEQAEGDRQRARGQRTREGFAQGHGQGRSGEDRETQGQAG

SEQ ID NO: 19901 - protein, 141 aa, Pseudomonas aeruginosa
GSACRTAPPAARWSRATLPLRRSTPAAWPTAPGRSWPTRRPRPPGRASTPAPRSGRRRGFARQRRSAGTAGRKAASARPGSQAPTASASRRCRRSRCSRRCTGRSAAPPAGSARAAANRRRPRAGKACRRGSTGCRGSAGR

SEQ ID NO: 19902 - protein, 170 aa, Pseudomonas aeruginosa
KPAWSEVLNQYQRRADLVPNLVSTVKGYASHEASVLTQVTEARAKVGSVQLNADQLDDEQAVQRFQKAQGELSSALSRLLVVTENYPQLKADGLFKDLLTQLEGTENRIAVARGRYVKSVQEYNVLLRQFPGVITAKLFGYKPKANFSVENEAAISTAPKVDFGNPQPAQ

SEQ ID NO: 19903 - protein, 342 aa, Pseudomonas aeruginosa
AMRRLLLGAGLLLASLVTRADVPPIPALTARVTDLTATLSGDQRQQLKQQLAALEAKSGAQLAVLLVPTTGDDSIEEYAVRTFEKWKLGQKKVDDGVLLLVAKNDRTLRIEVGYGLEGAITDVQAGRIISEQITPQFRQGNFYGGIQAGVDSLVQLIDAEKNPDSATASAPVDALPAVPEATPPRALPAPVDEGEVYDSAPPEPKKKSGLSGQLWGNPVYLGVYVAVLLAVALLGRLLPLQWMRRRSIGRFLLCSAAVAGLAWLLSMGLWQNVDRAADDSLGVLAPTLFIYALFLLPGEVLMAILSAILNSRGGGGGGGSGGGGIFRGGGGSSGGGGASGRW

SEQ ID NO: 19904 - protein, 192 aa, Pseudomonas aeruginosa
PPWPPPDSAARRGRSSLAASSGCPAGRGPGYAACCSRYARPRRTPAPPRATAGTPFRDRAGWRRGCRWACRPGRCSRRRTAGGSPGSGGSSRGRTGCRSRSSCAAATTSPVPRRAAQWRPDRCPPAASVATARCPARRCRRCRPAPAPRSGSRRARYGPGSRRPPRDSSGPGSARGYARRRARWRRPGRTPA

SEQ ID NO: 19905 - protein, 252 aa, Pseudomonas aeruginosa
SPGWRRQPNHRAACCRLAGRRSRRASGTPSAVPAGARPAASPAPGCTCAAATSRSPPGVPGVPQPPAPGPAAARRGRCRGPSCRHPAPRGSNGSPPPARDIALRRGRSSARPSPPAGRSCPAQAGGRRRRGSRRARARSGGRSSRRSARCLRRERVAIPGRASGHLLVSVGDPGQGPLQSPQHFVDVGPAHRQRRGKTQAMRLRRVDQQPFAERRANHRRRALADQRRPPEQSLAAQRTMPIATRDTGQAIA

SEQ ID NO: 19906 - protein, 373 aa, Pseudomonas aeruginosa
VGALLAHLLQETRLQHGIQYRQPGSGHQRVAVVGAKLVARFEAAGVATRQQRRQRHPGAEALAEGNDVGAYPVQFLRQQRAAAADAGLHLVEDQQDATLPAQPLDATQVVEGRRDHPGIALHRLQHHRHRLFVDGRGHGVEVVERHPGQSLQAMLRRLATSRQGARGASMDAVDSADDPLRAAAMQAAPLARQGDGRFVGLGAAGEEVGLVAAGRQAQALRQCQHRPVEQAGAGADQLPRLPGQGLDQHAGTVAKAVHRQALGEVEEGASVAVPQPRALATDEHLFGPFLGAHQAQAIQRISHLSVPRSCTPPPASARPAAPVPAAGGFPGAFRCAVRSRRRRGSAGASARAPRQSARRSPSCWPTAGRTGSG

SEQ ID NO: 19907 - protein, 398 aa, Pseudomonas aeruginosa
RVAGHHLAQPERLQGIAEIPLQQAGDGQFRVMPLDQLQLVPGSHHAAAQDPIEPAAAAAALQFVGQLGKIPALALAIAGRTRLADFQQGIAPMELVADADLGFGDAVGRDVLAERRQLPAVQRVALAPVAVVLGGIVMKSALEAAVVADVGLFVAGQAIVAQPELLLDRQLVDRADQSAPGFFDFTYENTVYDYLLHCSATTRCTANAARLLPHAGPTPFRFSSFIDKNSLWIFANSAISSRSTRKATSAAPPNAWPCRNRPSRSRSASWSRTSTSRCSSAAASACCRPSPPTPCTTMRYRCWRDWKGPARRCAYSAGRPRAAWRSACCRRSTPAWCRTWSNACTPRSRTCGCRSTNCRESTSSGACSPATWISASASCRRASRACTASSCTRTNCSW

SEQ ID NO: 19908 - protein, 298 aa, Pseudomonas aeruginosa
RLRISARGRKQPKPPPFVSLGLHAVIVPLAGPTAAPTRRELAVHQDDLRRARYSGQSPHHREPSQHGIPARPPAVAAKPPPVRTAFSRPAPGTARQQRPGQPRQGRLRVPPGRAGARLLLPDFRLREDLPADPGRPGEDSRSDQRTQHLRRGDDVHGHPELRGHRPGRGAQPAVPFLQQGLPAPVAGQHPVGPGPAGQAQHPPAPAHRRDRDAFPEERHPPRGALPADPRRPRAGGELPGGNPGGQAIGGRSPVDPAGNLLADHAPPRRRGHHPPRRPRNQHPRPRTPGVLRVNSPAA

SEQ ID NO: 19909 - protein, 549 aa, Pseudomonas aeruginosa
GISAAQAPIELEQALGQLPGALDQREAVGAEQVGQVVRRLLVDGDAERHQSLAARLDHRLAGVLDAVAALVAVQVVGLAVAQQQQQATLLRLPAEHLAGPADRRAHPRVVARRERQHATADLAAVAFVEVLQHLPAHLLPAHRGKPVQREGVAQCLQRLAEQQQAVDDAVDHSPLVVEVGFGGHRQVRQQQAGEVAPARPLFEEQAWLGGTAAPPLDLEVEPGIEVDLVALRLLAQALAAVAQAGELAAQMQRGLLQVRRQAGAGRAARPHRLQQHVVAQQALLPIVPLGQLQPGAERQVIVVGGRQVEIQAQAAALLRALARQRQVVEVFGDARAVRVVLVVATAVQGQVLRPTEQAFQAEQQQVAFAVAFLNALGALARSAAGDLALAGAGGRFLAVLRTGGRRPALAGIQPQRHRPGRPLDSREALDAARLGKRAAQGDFQFGVCRRAIVQRRALAQMRGDQPGVARAQRRIGIEQLPRPALVVLGPVPQRPGAGRQQRQPAIQFAVQLGLRIDREGFRQAQAVAVEPGHRGLLAGPGDPLQPGAA

SEQ ID NO: 19910 - protein, 367 aa, Pseudomonas aeruginosa
SGRTGSARRRGSGRTRSRVWRPPARRISGSHWATSSTLLVRRPLVGIDLRAPLEELGQVVDLALAEMELRHGAAARHVQRLDIHPGLEEGVEALLAATASDHVAQLRREVGALAEQGVAADAVVLFPDQLAAHHRGAHRGLVGALGQGLLGVVGQGQEQQDEEHTPAEIDVPGHAFGKGLGHAASWNGWCGDSRKRRRRTRLMAIKIPERFTQLFIRARYSAAPTARAISSGQASSRRRHSAGAWASSMKRSPISQPLATAQGQHRRQQPGRVAGATQQHTGHGQRQQRQPAEGQGSHRHLIAGRRPAGTAAPRPGRPCASRALPTPVPSKPAAYNTGASRPAPASRGSAGRAGRGGNGSRSGTSRG

SEQ ID NO: 19911 - protein, 458 aa, Pseudomonas aeruginosa
KRVQRGQADLLPTLRRLPRRPAQGRHRQAADPGHHPATRPAIPGSADHLRHPAGHAELGQLRRAEQGTDHPDGQVHPAHPAATAGVGHAGDARIVEGAGEAGGPAEETAQRPRPAQPVLGDPARRRADRPGRRRQQEDRQGHRYRLCRAYLADVRFRPLPAGDRPRRADRHDRPVGQGADQGRRDQDRHRGALGGKLQVQGLRGPLHHRRRLLAAAVRDHGRRDPGAEADRLHPRHDRRHPDLPPGTARGGDHRLPRAPRVHRQREGDRQGPAGQLQGYRQPHRHQHRCGAVPPRRRLGQQPPLLHDRRQQLQQGCRDRLQGPSPVGPGRRRQDPAPGAWRQLRASQVRPGVEHQPPGRRQHLADRHRSEEPSAVRLEESRRTTGPGRRLAVHQDPSEVLAPLRRHHLQPRRQDQPERRGVRPEEPRRQVPGAADRRMGRSRRRRQAGGAARVQQARR

SEQ ID NO: 19912 - protein, 133 aa, Pseudomonas aeruginosa
VQRLQHPARRVLRPACGARPARSPLRGTVMKPYALLSLLATGTLLAQGAWAEDPEVLFKNKGCVACHAIDTKMVGPAYKDVAAKFAGQAGAEAELAQRIKNGSQGVWGPIPMPPNAVSDDEAQTLAKWVLSQK

SEQ ID NO: 19913 - protein, 528 aa, Pseudomonas aeruginosa
PAAALARQRRPRRADRTRRRQRADPRRHGEDLAGAGRRPRRPVPRLPGVLPRPALRLRIRSRRRPDQARPAGPAHRQAPDPGRQQHRRSDQPGRSAGRGIQLRAGRGQGVRQPHPGAGRRDSRHPPPRPGQELPGGRPGRRARAALRVQPVRQRRDLDRRLQPGRHAAPDPLPRYRQATLRRPHQPRRALLHGRAVRRGRHGPARPLAPGARRQARTRRLRPRPTQAAGVQDAAPGGLDHRQRPGLRPGGRPSPGAGARRARLEADRRHRRRRPAGVRHDSTGRPADVGQLRLPGQRQGAGHRQRDPRSDRNPAPWPRRTAHGIQRARRPGMDLGARRRPVAGLGPVPPEAHRQPSGPQPERHILQPPRPAHRTLGGTMDDLSRRLLARYQKGLPICAEPYRRMAETLGCSEAEVLERLRRLEADGALSRVGPVLRHQRAGASTLAALAVPEERLQRVAERISQYAEVNHNYQREHRYNLWFVLTAGDRAQLDRVLAEIAADTGLQPLDLPMQEAYCIDLAFPLEASR

SEQ ID NO: 19914 - protein, 200 aa, Pseudomonas aeruginosa
STAASAAKWNARSRPCWSATPCARHRTAGCSACAPTSSAAAATPRRRPTWSAAMDEFDRRLLNRLQHGLPLEPHPYALLAAELDCREGDILRRLDDLLDDGTLTRFGPLFDIEPLGGAFTLAAMSVPEARFEEIAALLAGWPQVAHNYRREHALNMWLVVACDSPAEVAETLARLERESGLAVLDLPKEATYHVGLHFPL

SEQ ID NO: 19915 - protein, 548 aa, Pseudomonas aeruginosa
RPARPPPDRADPGRPAAGRRPLGVDRRATAAERGGDPGAAEAPARRRGDPAHRRGAQPLSPWLPAQRHDRLGRRRRTHRTPRPAGRRAVLRQPLLPAPAPSAAVALQPVRHGSRPQRSGDRRLSPADPPAARRGLSRRRDAGEQPHPEEDRPAPGAEGGTSMLRISHYLRSLAEDAPTPRRAGGRRAPVVIWNLLRRCNLTCKHCYSTSADSDFRGELETAEILRGIDDLRAAGVRVLILSGGEPLMHPDLFEIAAHARQAGMFVALSSNGTLIDEGNIQRVAEARFDYVGISLDGLRETHDRFRQKQGSFDAALAAMRLCREADIRVGMRTTLTEENAAQLPALLDLMRELDVQKFYLSHLNYSGRGRRSRALDAHHRRTREALALLFERADEDIRQGRDSDFVTGNNDADAILLLDWLKRRRPQQLARLCELLLDWGGNASGEGIANIDNTGEVHPDSYWWHHSVGNIRHQRFADFWFERPDPLLLQLRQRPRPVVGRCSQCRWLDICNGNTRTRAWAGGELWGEDPGCYLRDQEIGLERIALHPL

SEQ ID NO: 19916 - protein, 773 aa, Pseudomonas aeruginosa
GKPHEHYGDSAVLPRCRFPCRQRRPGRRRPRRSGHAHPARMGPAATGRGGGLRPPGRPRADRPSAGKLPAHLRRQALRPPQPAAGRNQRAAGAPGPAATPGGPPERRRPVHLRSRRRGAGAPARSRRRLPGGPRRHRRLRLQYLRRHPADPPRPRPVLHLRHRPPAERRPPRPRLGRPGAWQADPGVLHGPGQPRRDRRAPGRARPRQRHPGGAGQPGHPGGPAGDPRRPCRAAGAGATLPVEAADADRRRPGGGALRRARDGASFIPGRRLAGQPRGRRMRLIGLALGLLLGALAQAGEAPGEALYRQHCQACHGAGRLGGSGPTLLPESLSRLKPAQAREVILHGRPATQMAGFAGQLDDAAADALVAYLYQAPPREPQWSAEDIRASQVQPHPLATLPSRPRFEADPLNLFVVVESGDHHVTILDGDRFEPIARFPSRYALHGGPKFSPDGRLVFFASRDGWVTLYDLYNLKVVAEVRAGLNTRNLAVSDDGRWVLVGNYLPGNLVLLDARDLSLVQVIPAADAQGQASRVSAVYTAPPRHSFVVALKDVHELWELPYANGKPVAPKRLAVADYLDDFSFSPDYRYLLGSSRQARGGEVIELDSGARVASIPLSGMPHLGSGIYWKRDGRWVFATPNISRGVISVIDLQNWKPLKEIVTDGPGFFMRSHADSPYAWTDTFLGKKHDEILLIDKQTLEIAHRLRPSPGKVAGHVEFTRDGRYALLSVWDRDGALVVYDAHSLEEVKRLPMNKPSGKYNVGNKIGYAEGTSH

SEQ ID NO: 19917 - protein, 717 aa, Pseudomonas aeruginosa
PQADIPPTRPARRAPGAQKKAPHRGAFRLRRQASELLGVQQVQRLAAGAHGGAQGMDARQQAGEVEARGTQLAGVEVVLALLGQRGARHQCPHVGIGGVAEHMQVFDRRRADLVGIALGAVEQPGGQLFQVLHGGRQRLAELAQGLVGGSDEGLDLVGEVTGEGAAAADHLAPHQVERLNAIGAFVDLRDATVAHQLLLAPFADEAVATEDLLAMDGGFQPHVGEECLGHRGQQRHQLFRALAGDRVFAVLGGVQLHRDVAGEGAAAFVQRLHGEQHATHVGVHDDRVGGLVLGHRAGRRAALDTLAGIFDGALVGALASGQALDADAKALVVHHGEHRRQALVDLAHQPTGSAVEVHHAGGRGLDPHLVLDGAATQAVLLAQRAIGVDQHLRYQEQRDALRPGRGVGQLGQHQVDDVLGQVMLAAGDEDLGPADLVGAVGLRLGPGADDAQVGAGMRLGQAHGTGPDTGVHVRQVLVLQFVAGMGIERQAGAGGQHRIQAERQVGRVDQFLDLRRDHLGHTHAAVGRITADADPAAFGVGPVGLGEAGRGAHRASVPLAAFLVARTVQRGDGTGGDLAGLFEDRRGGLGVDHFGQRRQLRPEPGDLEHLIEDEAHVAQRSFVISHVGNPRSYRSPAGGQRQQNGGTKGVPRPSLHHQHFGLVASRRDLKVYIGLLCDRHEKARFSRARASSPGVRRARRVREKPGEEAPRPCPGSR

SEQ ID NO: 19918 - protein, 153 aa, Pseudomonas aeruginosa
PRGRKARMQRIAGMKKPAEGRALSHLGNGPPAARAISNRGRNLPRPSPSGCWRRTAWRRRGRGYAAGCAGSRSARSAAWPCRRLPRRCRRPASRRPGAPCRPRSRPGRRSRSTSGSPPKRRRLPRDPSWRPCRPSWSGRPTPCSAVPAERRIP

SEQ ID NO: 19919 - protein, 1049 aa, Pseudomonas aeruginosa
LAARVETSTSGSHSSRASAAASGTSASASANRCNCGPRKFSRAARVSSWPSNCRPATSASRSSCGSATCSCRARVRGSRAPWLTSRVKRLRVRCGSSRKASKKSSKVSAGIAFGQSSRTRKHGLLARVSSPRQSSPRRAASSPASMPPSDQPASQLSRGRLSSSSSSQSAASSSDGSGSINTFRCGSRSCSASRSGSSGALPRPQPGNRIKWSRIVSLLGFDLCQKARRQLSPAFAEGFEQAVDLRFAVRGGQRDAQPRAVGRHGWRADRADHDATGSKHAGQGHGLAAAADQDRLDRREAVHQGQAKRLGAMAETGDQRRQVLPPPAFAAQQLQALQGGAGHRWRLAGGVDVGPGVLNQGLDQFLAARYEGAGGTETLAEGADQHRHLLLAEAEMFDDPAAAGAQRAEAMRVVDHQPGAAGLRDGGQGRQVGEIAVHAEDPVGDHQGIALGLVQARGEACRVVVQVARETRAGEQSGIQQRSVVEAVLQHRVALADQRGHRAEIGHVAGGEQQRTGPPGEFGEGQLQFVVRAAVADHQVRGATAHAPALGAGAQRGDHLGMVGQAEVVVGTEGQQRLAVDHDVRALGRLQQRPLAVEVFRAPAGEAGSEIEGHGRSLVLLDGRRRTRPRRADISGCNEGTAAPSLPVWSGGSGVIEQLRFALFHQRLLDGGLVHFVGVLFALFRLDAETGEQLHVLFGLRVLRGQQLFAVEDRVGPGHEGQRLHLLVHLLAAGGQAHVGLRHHDPGHRQGADEVEGIDVPLFRQGRALDLHQHVDRHRLRVLRQVRQLDQQAGAVVHRLAHAEDAAGADLHPRLAHVGQGLQALAVGAGGDDVAVELRRGIQVVVVVVEAGVRQRLGLFLGQATEGHAGLQAELLHALDHLQDVGHVLGRRVLPGSAHAEAGRTDGLGLGRRLEDLLHLHQLLLVQAGVVVAGLRAVLAVLGTGAGLDRQQRRDLHAVRVEVRAMHRLRLEQQVVERLLEQGTDFGEGPVVTGGDGSGCTHGEDSFDACMAPFVGEPRHAGGQAQGHHKWLYDAVNPTQDTGLHLINI

SEQ ID NO: 19920 - protein, 363 aa, Pseudomonas aeruginosa
PFKAQRKYNEKYIRPFRPTTFQNTIRVSFGHIQEYEWKAPLPGPKLASDGSCIDIRLAVHVRPCRSLFRRPEPFRDERQAPADHAGQRGQGAGPGGNLPGLGYRRQGAGAALRRVQAAAPPGRRPAGQGGGALPGPGPAHRPRDLPAVERAGRAARAQYSRDPADRPTPSLQAVLSAAPGSHRRAGERGRDVDARHQRQSEGTQSFALPHHLQPVGVPRRIGAELRRSHRTPDAGALLQSPVRHRRLPSRQSALRDRQRRREPPPLSRRIEIRRRDQRQTPMRPGIHHECNYPNTTCGNAGCVGAERLCADLRKSGQQGNDRLCQHRHEHRRAFGSAQGHRALALSNLRFLRQVLPGARKHRT

SEQ ID NO: 19921 - protein, 257 aa, Pseudomonas aeruginosa
GVRVHSLRPNPDDGDEELSRPTEVDDEQTHSRPVQRHRRDRGLLQVTARPHLQQARHALQKQESINNLQKNPMNAFIRYMLVAMLLVLSQKSFALMCWKSDNKQTEDYVYIDTSIAVPSVLPKDTVLWRSPNYSISITCFQDRDWGPEQVYFYLSPTGQGALGSDLEVGINLNGEDLRCSTLDKCRKEIGMHFDGCWTGRGCEGRAKKMTVNFNFFLSKRAGPSTGKEGPITGVNAYPIFQFDGESAINNIGGTTSA

SEQ ID NO: 19922 - protein, 477 aa, Pseudomonas aeruginosa
RSTTSDRPGPLRRPKRPGIDDSAQEEVLKSLHLPVVTATRLETFLQADGDETRLLVRLHLRQPVQVGADHRAQRGISPTGHRITMQDDGFEPARYLDRADGIAGVDDVGRVRACAEWLFARLEPERRAALEAVAGAVRLRTDGPGLGEETLDRVGGQAMDVESGNHPQAHLAADLHLQRTRQRQALHGRGRGRPQRQQVALRQPSSLQATDRPQTVGRTTAQHLGYRDAAVDGEIATGAGTNEIEPQDLAGANPEGSIQRHLRALQARRHARPAHGHQGVALELQLRPQQRALQHGGGRCVAHQQVGSAQGILVERAGRRDAQVIVAFAAGVLHRGGEAGLEHLNRHTAPPADVACSLADRQGTRRDRNSPDGCAGRMCPLRLRPPCARTRSARWGGTGRCRQRGRTPSIPRDRAGPGGDRRSAPESRRTSDSRRHRAPNRCSRSNRRGRGSASACRCADAGTWAPATAARARPSGT

SEQ ID NO: 19923 - protein, 364 aa, Pseudomonas aeruginosa
  UNSURE (221): Identity of amino acid at the above locations are unknown.
TGDRALALRLSARQPDQPLQAPGGLAAGAAARRVAGGTPAATLRRRPAAPGTPAAGPAGATARTSSRLQPGATARRATGWRAGHALRSAQPAASAGYSGPAGTGRDGAAAQPAPRLRPGARQRCSRAAPGTGGRRAHHRGHRRAPFPPVAPGGRRAGRRLLPGAHAEARLSWAKLPRNRYGRGSMRALLVAACLLLGGCSHFAEDDWLGEDKALHFASSAXLAAAGMQMAHDRGVRGARQARFGLSFSLAFGVGKELYDSRSAGSGWSLEGPRLGPGRRRRRVRSVPGRRVTPLRFAHGCWSLRRIRPLIAKPPCPHSPLSPSTSPVARNASPCSRRSPNWAPSPVRRRPWASATRAPGTPSTN

SEQ ID NO: 19924 - protein, 215 aa, Pseudomonas aeruginosa
SPPSIRPRSCSARRCEPAGPRRLAYTRGLSSLGCPVMSHPFDQLTPDLVLDAVESLGYLSDARVLALNSYENRVYQVGIEDGEPLIAKFYRPDRWSDAAIREEHALSARAGRNARCRWWRRCRATAKACSHSPASASPCSPGAAGARPSRAISTSSTASASCSAACTRSAPRGRSSTARRSLWITSATPRWPPCWKAISSPGACCRPTSRSPATC

SEQ ID NO: 19925 - protein, 212 aa, Pseudomonas aeruginosa
  UNSURE (198),(199),(200),(202),(203),(204): Identity of amino acid at the above locations are unknown.
EKAQNVARSQRQKERREGRARGEGYGGRRRRKNGNAENRPNHKPRKSSTTMHKEKQRKRRRRPKQQRQRARERQPKQGKQGQDDRRRKQPENRQKGTGSRKREQTKRQKRGERTNNREKAKQRGKRTKRHTTRQRREEQQEDKKNNDRQTKRGRDKKDKKAETKKQGGRRDSGATGRKKTERGQNRHQTRRKKKREPXXXSXXXSPPDSGGL

SEQ ID NO: 19926 - protein, 81 aa, Pseudomonas aeruginosa
WPHKRLHGQKVQNRYSTGSPVCLWSPYLMATIAPPSRGPQNGLADQRKTFRTKRDAEDWARRTEDEMVRGVYIQHCGSERM

SEQ ID NO: 19927 - protein, 376 aa, Pseudomonas aeruginosa
ISLMNDPLWIWQQPDWPQFNWQAEALAPLLRSCSQAQGRLLGMLGAVGSDTEVQSSLDAMLQNIVTSSAIEGEQLNVGSVRSSLARRLGLQEEGRTTSRSEGLAELLLDATHAHQEPLDEQRLFTWHSWLFPTDDQLLARPLHIGALRGEEPMQVVSGRIDRPTVHFEAPPCAGLEAQLADFLAWFESSRSDANLDPFLRAGIAHFWFVTLHPFDDGNGRLTRAITDLALAQGEQQAIRFYAMSASILDDRAGYYRILEASQKSTLDITNWLQWFLATLLNSLEQALARIDRVLVKARFWQAHRSQTLSAEQVKVLNRLLDGGERGFEDGISAAQYQAVAKVSKATATRHLSDLLEKGCIERLPGGGRSTRYQIAR

SEQ ID NO: 19928 - protein, 287 aa, Pseudomonas aeruginosa
NQLAIIRISARQLDFGTSARPAIKQLCSRKKMDYSPIVAQAWGMLTWFIPAALLISLLKSPWAKGQIGELLVRLFAHWQLDKQTYRRLHNVTLNTPDGTTQIDHVFLSPYGIFVLETKNMSGWIFGSEKQAQWTQKLYKRTFKFQNPLRQNYKHLKVLEATFGVNPEHLHSVITFIGGSTFKTELPTNVTQGIGFIRYIQSFQQAVFSEAEVEAMLQALQTGRRAPTLATHREHVQNLKRRSDPTAERQCPKCGSALLVRTVKSGPKAGQQFWGCSAFPKCRTMQSL

SEQ ID NO: 19929 - protein, 911 aa, Pseudomonas aeruginosa
LKHTPLIQKINLSPFLIPTAHHRRKKLNSVVPIVNNVEVLIDLNQGDSAKALEAREMVQRSHYDHLHQQISKHLHSPDALSLEQNLPTGSGWTHFIDGSRGAGKSTFLQSVRRALNDDSDLRTKLAFIAVIDPSRIEQSEIILLVMLQRLSQRVEEVLKVMRSTEQEELRIRWRKAFKSVAGGLSLFTQGYHPLNDLDPELFLDWGMERTSDSTSLREKLHYLFETACKILGVKLLMFGFDDADTDATHAINLLECIRKYLDTPRLMVLVTGDMELYSLLVNQHFAKTVAGKRDAAFELVRDSKPGDRSGQYLRMIDHLEEQYLLKLFPVNRRLQLQPLWNIAKGNEKCEAEFIDWGTKKIPVERLMRNIVQRGLRIKSEPDVTLYTEFLLKQPLRSALQILSNCAPYLDKRSIENTSDNWSKELSEALNRALQALALTSFYKHSINTDALAAKDLDVLTQTVFDLSLEDGDLDTAPYLRPMSARQDIKAGFTALAAEVPCLCAQQPGTALRYLLRAPGSVSLYNLASPHLINKDGDKGSENSQASVYHFKSYMGIGRQEDSLDWARRATAVIALPYSGGQQQRVVLPGVIGIMNQKGKKGEISAQTAIGRAIASQSVQALPVLALGMITVVNQPNSRTYASIFTLLGLIEKLLSAGSNSTLNAKTVFYRAYPTLTISGPNWMRKGVDSTDEFNNDRLPDEEDKKYKEKQEALWSQIQRWLESLSDLTPETTPSGVFLGKVWTRLFFSLQNAADDLRSNATLDTVMEIFALCAINAFWVEESEQHLPASSPKSESRATVDRKNPKNSAGWFVDKLTSSQLQRKNLPYTAIMATCPLLLGLLDSKLSYAEALKPFFPEGTQLDDIRVLLCPSDLKKLMSNVSVTGKSRRRAQNSAGETKNGTEDAGPGDDRQ

SEQ ID NO: 19930 - protein, 265 aa, Pseudomonas aeruginosa
LRGLARGDASRSAPVLMPLSPKGERVGHASGQCRARLASQTVVQAERSCAIMSPFHQQGPLMTDRLPCRACGHLILPTTAARNDGLCMPCKGGYRQNIEDGKRFHAERRRYLASPQALYWSALVNRVYDGREGFAGLSPAERSYYAVSVLSGEVHNGGFDQYFGNSSGDQYQAARAGLRELEAEDALALLERAAALLFGDGPVPVSQAERQLRMPTWADEPDRDCEAALDALDTRFYALADALGERLLAHARHHALFALDEPDEA

SEQ ID NO: 19931 - protein, 218 aa, Pseudomonas aeruginosa
AGVFSRHPMTDSRHSRRVQPQRYSPPVTRSGTLEPTLMRADNPQGTSMSDLPPRPAFWPYLPGYALLLLSVLLCASGSYRFVTPMALADGVDLVYLSQGLALLPLGTGLVGLLAGFLLHVRGRWLGALLALLPATLICAWNLYNYAAHGDEALSPSFAQYTQALLGLLLLGGVLSLVDLLHGRPSTLLRKGLLGLGWLALVAWLGLLFYLQRLYGLTF

SEQ ID NO: 19932 - protein, 356 aa, Pseudomonas aeruginosa
YSPLLSRREWRVGLPVSTSLDRAACPCVSTFDLIGSSHGPTRPAHPARQPAGPPRPALPATGQLGAGAPASGARRGDLPYRHGRHLLLRIPRWRSPRPASRRPDSVATRHPAPPAQRQPGATLRTHRRAPRQHPAVPVERPWRGPRHALRQLPLSRRCQPVRRAPRAPAGAYGRVDPAAPARADRVDARGSREHPQRRPLDHRRAGHRAVRPGPARLPGPPTAGRRPVRPAGRRPPGTSPAGHAGTPGACLDPGTACPAGGDVAGQFRPRLLRPRRNLAVEPADPHPHGEGSRPAATNAEEPAGYRRRDRLPVGGGVFPQFPPGLRRIAGPFPPPGRLRSLKALPAHISAIRCYAM

SEQ ID NO: 19933 - protein, 225 aa, Pseudomonas aeruginosa
PMPHPIDALISDCDGVLVDSEVIAERVMYEALSAYAPLEELQRLLEGTFGLTSRDILDRVEKHFGLRIPDSFNREVRQRSEEMVAQVQPIPGAREALLALDLPVAVASNSRRHSLERSLARAGLSELIGERLASADMVALPKPAPDVYLHAASLLGVAPERCLVVEDSSTGTRAALAAGMRVIGFVGAGHIPAGHAEVLRELGAIAIVEHMRELPETVARLRRTV

SEQ ID NO: 19934 - protein, 438 aa, Pseudomonas aeruginosa
AWRYLRGIMHGSGGSRKTPSVPRRELRRPTAASGKMRAVSDERSGTVASTDVLIVGAGAAGLMCAMTAAGRGRRVRVLDHANKAGKKILMSGGGRCNFTNLYTEPANFLSRNPHFCKSALARYTQWDFIGLVAKHQVPYHEKKLGQLFCDNKSSDILEMLLRECAEAGAEILLDTSIEEIARDDAGYHLRTSAGEMRCESLVIASGGLSIPTLGASGFGYQVARQFGHEVLPTRAGLVPFTITDQLKELCAELSGTSVDCRVSCNGQVFRENLLFTHRGLSGPAMLQISSYWQPGDTLEIDLLPDHDASEWLAQQQRERPNSELKTLLAELLTKKLAGLLADRWFVSKPMKQYTPTELAGIAGQLSAWRVTPSGTEGYRTAEVTLGGVSTDEVSSKTMESQRSPGLYFVGEVLDVSGHLGGFNFQWAWASGYAAGQYA

SEQ ID NO: 19935 - protein, 235 aa, Pseudomonas aeruginosa
RWASALKPCWAALCTDDMRDLLGGRESPRYSTAVFLRIPDERFKALRSVARSHWSGASWTSRGRGYCRSEGPPDDQGKSIPAHAGVPRHNQESAMSSEVSAIRQLIEDWRAAVRASDVPRIVSYYAEDIVAFDAILQLQFKGRDAYQKHWQACTEMCKGPMTFDIAELQIHADPQVAFAHYLCHCGGTGPDGQPHSSWMRVSAGYRKHGDGWKVIHEHFSAPFDMDGKALFDLQP

SEQ ID NO: 19936 - protein, 455 aa, Pseudomonas aeruginosa
GASGASDFPGADVQEPRPAGLPFERRRLVDLRIQLAASVALEHAFQGDRLDLGSVAGGAEGFVASDADVAHGLDGLGEVLARVELARVLRQEAADGTGGGQAQVGVDVHLAHAVLDALDDFLDRHAVGLFDLAAVLVDDRQPVLRYRGRAVHHQVGVRDARVDFLDALDRQGVPGRRLGELVGAVAGADGDGQGVDLGLLHEVGGFFRIGQQLAVVQHAFRADAVFLAGHAGFQGTQAAQLAFHGHAAGMGERHGLLGHADVVVVVGRGLAVFTQGAVHHHRAEAQLDGTLADVGTGAVILVHDHRDVREFFDRGEDQVAQEGRAGVFASTGGSLDDHGRIGLVGRFHDGAHLLEVVDVEGRHAVAEFGGVIQHLAHADECHGSRISQSRGRSVIQKPAAGAGPVQVPCEERSRRRAPAGATQRALQPRPMRSSVSTQYTRPSSFSRWKPRRPSL

SEQ ID NO: 19937 - protein, 262 aa, Pseudomonas aeruginosa
EIRSAMPYLSIAARVSPPPAMENAALSAMALARVRVPSPNWSNSNTPTGPFHRMVFEVFSSSANCAAVCGPMSRIMSSSATSAMALTVATALSANSLATTTSTGSGTLTLAAMALAVSTRSASYSDLPTLCPAAARKVLAMPPPTISWSQMPARLFSTSSLVETLEPATIAAIGRAGLPSALPSASSSAASSGPAAATLANLATPWVDPSARWAVPKASITNTSHSAAYFCASSSAFFFSPLLKRTFSNSTRSPALTLTPSR

SEQ ID NO: 19938 - protein, 442 aa, Pseudomonas aeruginosa
TTPTCSSYSTGSATRAGSAASTVRAATPRQAWNGCGAGALLDATDDRLQRVQTLAGGQPVAHFRAPLFFLQHRAGTGQHSRPGTVVEQAQQHLVELFAIQRPASTAHRRVDPLRQRLQHPFALRRIHRHRLLVVGTEHQDLRRDVLQQAGAQPAVAIEDHAGIQAVQAQRQHRRQLAFAGLLAPPLDPPLVILDPAQGDQGVVVAPPPVEPLHPVVAEDLLQAVEAPVRQQCVAPDAAVAPAFQHPFARIVALRWLPGGHLLGERQAQQPAPGLQATARAGTQGLDEIAAPGLVAGLAAQAAQRFQGRRVDGRHAGLRRARRDQALHQPDAIVVRQLGGPEQRLIATHQANAGLAAGLQMKERGRPMGALHLDREAQPFAIGGAFEVPPVERVHQSSSSSSATARTLSRVKPKCSNSAGAGADSPKLVMPMMRPSRPTYLYQ

SEQ ID NO: 19939 - protein, 120 aa, Pseudomonas aeruginosa
SRQRTSAISAMPIGAPGWPLLAFCTASMLSARMALARSRRLGIAILLRGLLVGRPGVKKRAPFSPTEGPRGNDRSAGGQYVAADRFCQKPGAAGLQLRDGHPSSISKIFDTGIAGVRTRY

SEQ ID NO: 19940 - protein, 477 aa, Pseudomonas aeruginosa
PWTAIPSPRSPGRRPTRPLSCATPPASERPRDKKPRFGGAFSFPAGSAHAEGFLVEQPQRHALPAQIAAQAVGQPLRTAEPDARPASFGALQHAQLRRLRLALLVAIADVQGHAGQVFAKLAQAPGEQRFLGIAHAIVQLHRWRAFRRGLQRLQPGDERRHADPGGDPDLPPGQATAEVEAAVWPLHLDPGADLQVVLQAPGVVAQRLDAEAHLAAAAVGAGDGERMGTLQAVAGEKGELPGPVRPVALQPAGHLEQAFAVPLDGGDHARMATRATDPPAQRQQCAGRTEQCAGRHQPTGRLAPVAGRGEHHGMEGQYQVDQGQRLVHITPEVIREALPESDQQHPAENPRRPFTQLLGRATEDIEEGFHPRAFHRFADDTRQPGAGQLQQVVQQAEDDGQDARPLVQAVHAVEPVQRLLQPDRTHRQQHDQRHQGEGRYPGKQDRLLAHHPDVQARRRIDGQRQAPGRQRGGENSP

SEQ ID NO: 19941 - protein, 274 aa, Pseudomonas aeruginosa
PASIVVGLQPRGGRSYAGPPRLPPSRAMKIRLLSDLHHEHFDGRRQLPEVEADVVVLAGDIHSHLEGLHWARETFADSEIVYVAGNHEFYSSEMTDLTQAMRNIARALEIHFLENDEARIGPARFLGATLWTDFQLYGADGYAPAHELALQSMPDFSCIDWFGGDFTPEQSIALHQASRDWLAEQLARPHDGPTLVVSHHAPSALSIPPQFVGNPLSPAFASNLDELVAQADYWLHGHVHDALDYRIGRARVLANPGGYPHERGGFRPEFVFEV

SEQ ID NO: 19942 - protein, 248 aa, Pseudomonas aeruginosa
ASARQLAEEAPDFHWRVQFRVALAENPREAIVRLRQHVAAAMHAEQLHRRMAVFLPALSLGPDRAGTGQRRHVRRRCDAVQAGPPACRVQGRAYRAPVAEAEQADLAAEIGIDRIARAVDQQRRGRPLDRPTGIVPRGRQARRHRCDRRRQPRRFGGQAESHLAAIGVAGDIYPLRIDAVFLGQPRHQRAEESHVIDVTQPRRIAGGLAAIVPVALEAVRVGHQETFLRRQPVEAVAADAAHLRAVAP

SEQ ID NO: 19943 - protein, 209 aa, Pseudomonas aeruginosa
AGLCRNARTMALLQRPRGGVLCSRTTTTVPFAGTLAPLSRRLPPASSACQDARPSRRPATAPAVRSRSQPMSIRPSLPLAGLLLAVALPLSAAQPGAAKGAPLSGCAAKQAAIEAKLETARSFANEGQVAGLEKALSEVKEHCTEAGLLRENKQKVIDSEREVSEREKDLRKAMGKGDPEKIEKRKAKLAEARAELEEAKKGLEQAQAQ

SEQ ID NO: 19944 - protein, 287 aa, Pseudomonas aeruginosa
LWNCNSSWRRSFCKGTAPSELHQQHSGQHQAARQQAWQSERLVEEAHAEQHRQQHAGLAQRCRFGDRPQLHGPQHQAVAGQHADPDRQAELPLQRPEAGEGAGSRANGDQRERQAGKQRQPDQVVKRQRPALQGVAVAPGVAADAQADQQHHRQGPPGQPRTAAAPEQAKHAEGDQQDAEDLPAAELLAAERQGQAQHHQRRQPAHQRIDQAQVADLVGLDQQYPVEQLQDGGAEQPGPDFGRRQADEGQQQDGAEHADHVHAGDHQQAVAAELDQGVPGGVENGGA

SEQ ID NO: 19945 - protein, 235 aa, Pseudomonas aeruginosa
SIPAEAPNARLVAAFFPESSYESGETCSRHRYVKRLNLRTILMDYHRPAPHSAGPASLINDTGIPALSALLKPLDNRLFWPAVAIGGLLILAFVLYLQHVRGFAPCSLCIFIRLDVLGLVLAGIVGSLAPRSRIAGGIAALGMLAASLGGIYHAWSLVAEEKLAAQGMGSCKMFMGFPEWIPLDTWLPQVFQPEGLCGEVVWTLLGQSMAVWSLALFVFCLLALAAKLAFGRRTA

SEQ ID NO: 19946 - protein, 301 aa, Pseudomonas aeruginosa
CPCACAIRAPGWRSPPGRRLLRSSRLQALSEQVAQTVIRFAQGFQRRGEALAAGKLRIAQALVERQGLVVAEQRVADRPGRRQTRQHAVAGVALQPVAVALPAEVRGTPHAAVDMPAPGVLQRHPAQLREHPFEIGPGGGADVAGHAAQVGAAAAEQQAVVRGQAEVVEDELVVGHAAVARQQRLRPFLAERLSGDLIGAHRQHPLRQLAVQPVDVGVAGQHQRRAADLAVLGTDPVAVALLAIVQGPGPLVDTPAGALDGGGQAERQLERIQVCGVGIVETGKVALAGDPFGQLVLRHEA

SEQ ID NO: 19947 - protein, 143 aa, Pseudomonas aeruginosa
VADPVVAVEAMSLRQLAHLAGRPEHAVPETACAFVAEVGLKRRQIAGPAGQRLPAVAPGGRPGDPAGFDDAYLASAFDQPQRRVQAAETGADHQHLAVEVALQGLARLDQFGIDGGVVSADMLVGLQEHRDLREIILVIFHEK

SEQ ID NO: 19948 - protein, 119 aa, Pseudomonas aeruginosa
RRATRARPSRRWVPCSRTCSRKPGSSTVFSTASPAAVINALPWWVPSWSPGSKQQALPRASSADSGTPAPRPLPRVTMSARTPYSSSASSAPQRPMPVCTSSRINRTPRCRHSRSMPRR

SEQ ID NO: 19949 - protein, 266 aa, Pseudomonas aeruginosa
FRSPDRRQRPPAASLPCIKMTCAGPATVGSPLIIASLPSMEFQRVHQQLLQSHHLFEPLSPVQLQELLASSDLVNLDKGAYVFRQGEPAHAFYYLISGCVKIYRLTPEGQEKILEVTNERNTFAEAMMFMDTPNYVATAQAVVPSQLFRFSNKAYLRQLQDNTPLALALLAKLSTRLHQRIDEIETLSLKNATHRVVRYLLTLAAHAPGENCRVEIPVAKQLVAGHLSIQPETFSRIMHRLGDEGIIRLDGREISILDRERLECFE

SEQ ID NO: 19950 - protein, 140 aa, Pseudomonas aeruginosa
SRSSATRAPSGSSSSSLQRSRARCSDQLSRLSRRNSSRLRSLLRSSMRSARLRAPLRATWRLPAPAAASSPSSALAEGVQRSPGYSHSGTGQGARSTRGKRSTLPGSASARRRAISSSASAAGQSSSDGRWRRCAATSRA

SEQ ID NO: 19951 - protein, 640 aa, Pseudomonas aeruginosa
TARDSGRRRLSPLNQDTGACSQVPATRCNQVRRSSRRRAGVASRATPGAPPSARKSMPSGRRMLSRVTRAASNSPLAWRVMKRCQWAPTHSSSSTAKAISGGRLAAPEAQQVGDQADEEHHPGAFAQPVEDRQLVLGGHEGHRRAVRRHPLQPDLQHPGRGEEQGDEHHRHGHQPEAPHLQDLRAVVHRLADPAQARHGVGDDGHHDHRVGAIEGHVAVGGGELGAVGVVVDRRQGMHEAPHSRAEEGHHCGAHGPQRDRAVRIVAAAAAVDGVEGEQHHGEERQRLQRREYRAEPQPVAGHADPEVVVAGADDAADQRHGDDHVEPLLDHLAVDPGDLHQHEGEDRTHDQFPHAFHPQVHHPPPVELVAGEVFRVVEGEQEQQGEADQAGHQDHADGGLAPAQHGHADVEQEAQGDDHDARLADGRLFEELAAHGRPQFVAGEPGQAGVGHQQVAEDGQHAGGGEYPEQDPGQLRAVQLAVALLRHQVVGSAHEAEQQPDDQQVGVHHARDVEGDRREQEVADHVLQAHDQAEQDLPDEEDQGEHEVGFGDRLRGEFQGAIGRHHQPSLFGGHWLVSIFELHLRNSARSSTWPSLRWNCGMARRPGTFSGWIFIQAWRKVLKPSSPPRRPTTLPSSGAK

SEQ ID NO: 19952 - protein, 277 aa, Pseudomonas aeruginosa
SARRSANPWPPRRASTAASSQGESPAPPSSTPVTASASNASQQRVRVRIGTSLQDVDQREQQHPDQVDHVPVEHSRLQSRASLRRITPAPAGLRQPAEDQQAEQDVEEMEAGQAPVEGEESVVLDVQAEIGEPPVLVQLQADVDQRQQQRRQQPAARLARPSAAHRMHRQRGEPAGAEQGHGQQQAPAAIQLLPAGTEQLRLPGLGAGERQQQQAEHAEFGEDEEPHRQVAGQAPLDGIRRHGDRRCPSAPPPSPGRPRAVRPAPPGTPRAGPCRRR

SEQ ID NO: 19953 - protein, 99 aa, Pseudomonas aeruginosa
AIPAGRAARRARRLRSHGRWPRRRVSRPACPTPALGIRTARYSQLEGATSAKQRNLDSGQARVKTLLSMILSRHEFPGVPDAATPKTLLRERLAGLLRR

SEQ ID NO: 19954 - protein, 569 aa, Pseudomonas aeruginosa
TMPFGKPLAGTLLASLTLLGLATAHAKDDMKAAEQYQGAASAVDPAHVVRTNGAPDMSESEFNEAKQIYFQRCAGCHGVLRKGATGKPLTPDITQQRGQQYLEALITYGTPLGMPNWGSSGELSKEQITLMAKYIQHTPPQPPEWGMPEMRESWKVLVKPEDRPKKQLNDLDLPNLFSVTLRDAGQIALVDGDSKKIVKVIDTGYAVHISRMSASGRYLLVIGRDARIDMIDLWAKEPTKVAEIKIGIEARSVESSKFKGYEDRYTIAGAYWPPQFAIMDGETLEPKQIVSTRGMTVDTQTYHPEPRVAAIIASHEHPEFIVNVKETGKVLLVNYKDIDNLTVTSIGAAPFLHDGGWDSSHRYFMTAANNSNKVAVIDSKDRRLSALVDVGKTPHPGRGANFVHPKYGPVWSTSHLGDGSISLIGTDPKNHPQYAWKKVAELQGQGGGSLFIKTHPKSSHLYVDTTFNPDARISQSVAVFDLKNLDAKYQVLPIAEWADLGEGAKRVVQPEYNKRGDEVWFSVWNGKNDSSALVVVDDKTLKLKAVVKDPRLITPTGKFNVYNTQHDVY

SEQ ID NO: 19955 - protein, 613 aa, Pseudomonas aeruginosa
NRTHCFRCSPPAPCSPRAPGPKTPKCCSRTRAAWPAMPSTPRWSARPTRTSPPSSPARPAPKRNSRSGSRTAARASGARSRCRRTRSATTRRRPWRSGSCRRNERPSGLPARRQPRLVAGPRADVRLSSSGPGRRASRCPSPGPVASPAVAGLRILPRPAPDRRPRPGADPRGPARQAARIAGRHRAHGPSANPDAPLGRPAQRRRRRLAGGPPDRRRDRPMNLRPLAPLFLALLAGCSQQPPLRGSGDLGVLIERADGSVQILDGTAKTSLARVEGLGDLSHASLVFSRDQRYAYVFGRDGGLTKLDLLAQRIDKRLIQGGNSIGGAISQDGRLVAVSSYEPGGVKVFDSRTLELVAEIPATRLPGQDRNSRVVGLVDAPGQRFVFSLFDSGEIWIADFSQGDTPHLTRFRDIGKQPYDALISPDGRYYMAGLFGEDGMAQLDLWHPERGVRRVLGDYGRGQRKLPVYKMPHLEGWTIASDQAFVPAVGHHQVLVLDARDWKQTDAIDVAGQPVFVMTRPDDRQMWVNFAYPDNDKVQVIDSETHEVIETLRPGPGVLHMEFSGRGDQVWISVRDADQLQVWDPYRLKRIGSLPARSPSGIFFSHRAQHIGL

SEQ ID NO: 19956 - protein, 333 aa, Pseudomonas aeruginosa
EAPWTTSPAASSPATRKACRSARNPIGGWPRPWVAAKPRCSNGCVAWKPTARCRGSARCSATNAPGPAPWLPWRCPRSVCNGSPSASASTPRSTTTTSANTATTCGSCSPPATARNSTGYWRRSPPTPACNPSTCRCRKPTASTSRFPWRPADEPRRTPRRAAAATPALPAGTGPAAGQPALPGARRTHRRRRRRSAGTGPPLGRRRPVPPLRSDPPPPRPGLYRQRQAGAGRRPRGGRRRRPRPRPRNDRLALLPPPASPADVAIQPVLHDPRPRARRSGTPDRGPAGAPRPAPDTAPLAVQPARLQAVRRPLHRAAGRPGAPPWMSSTGAC

SEQ ID NO: 19957 - protein, 209 aa, Pseudomonas aeruginosa
TCGWWSPATARRRSPRPSHGWSARAGWRYSTCPRRRPTMSACISPSDALLARRLIELTQAGLPLVADPWAWIAAQLRLSEAETLALLKRLRDAGVIRRIAAVPNHYRLGYRHNGMTVWDVADERIERLGRLVGGLSFVSHCYRRPRHLPQWRYNLFAMVHGRSEAEIEGYRQQIRLLLGEDCRADEMLVSSRILKKTGLRLAQKEERPC

SEQ ID NO: 19958 - protein, 483 aa, Pseudomonas aeruginosa
CANSTCRSSTSRTSTTVAAAAAAAPSTPTTGAPARPSRCSSNGPTRTSGRGATATSSPATTTPTRSFSSTGSSAAARSNWRVSASCCWTGAATPRARASPTSTTPARCIRTATGGTTASATSAISASPTSGSSAPTRCSCNCASARDRWSGAAANAAGWTSATATPAPAPGPAENFGAKTPAATSEIRKSASSASRCTRYKESLMNTTGIPPSFLDVDFPAGSVALVGAGPGDPGMLTLRAWALLQQAEVVVYDRLVARELIALLPESCQRIYVGKRCGHHSLPQEEINELLVRLARQQRRVVRLKGGDPFIFGRGAEELERLLEAGVDCQVVPGVTAASGCSTYAGIPLTHRDLAQSCTFVTGHLQNDGRLDLDWAGLARGKQTLVFYMGLGNLAEIAARLVEHGLASDTPAALVSQGTQAGQQVTRGALAELPALARRYQLKPPTLIVVGQVVALFAERAMAHPSYLGAGSPVSREAVACA

SEQ ID NO: 19959 - protein, 704 aa, Pseudomonas aeruginosa
KSPPKGGLFLTWGTGRQRPVPSVTEGEIFLGHLHQAVGAGQHGGDVGAGTRQDALEVEARGLQLGLVEGFLAGAGGQLLGGQARHVGPEVGQAGVAGVHQVVHRSGADFLAILHGGHADLHGQVAPLLVQLCQRSDEFLDGFVGFVGLAELVHDLGEALQRLALGHQHLATQQVEGLNAGSAFVQHRDAAVADVLLHAVLGDETVAAEDLHAVVGGLEADFGHERLGDRREEGQHRVGGFLLLFVLAALDDVDLLGGEVQHRAVAFGECLHGQQHAAHVRMHDDRVGGLLGRLRTGQRAHLQTLASIGDAALENDFGMGQALQRGTQASGVHEGEHAVQALVRRADQEASGGVEVHHAGGVAVDAHLVLDGTAGNRVALAGVAFGVGQELRHDEQRDALGALRGVGQAGQDDMDDVVGHVVLAGGDEDLGAGDLVATVGLRLGLGAQHAQVGAAVRLGQAHGAGPLAGDQLGQVGCLLLGGAVGMQGVHGAVGQARVHAPGPVGLADHLADGQAEGFRQTLAAVLDVMGQARPAAFDELLVGLLEAGRGLHAVGAPGAAFQVADAVQRSDHLFAELRTFLEDGVDHVGSRVFGARQALVVRFVAQQLVANETDITQGGLVIRHSSQPLRRVLVNRRPDGCPESAVAVRDRSRSPCRTHSCVPALKQAFETYVYANPLSSIRTDRSVMPEITGSHVLPKHFRLSQ

SEQ ID NO: 19960 - protein, 489 aa, Pseudomonas aeruginosa
RQHLAHRLVQACGAQFDASLARRQVRGDGRCEGQRVDLLVGQRQRALAEQHQRVAIAQALRRGLAAGGHRLRRGGAQAGTPGRVEQAGGDGGLADLGVGTGDEERRHGSGILAQHAEDDAVGSGQPLGLAETLVGGDQRADALAPGQAVGPPGVEVVRAQRLEFVGQAAQVGEMQEPVLVAQGQRQQAAAGRVLQVVGEGAEAIDVDEAVHHPPTVAQLAQGTDAQAAERQHAARPQDPPRLGQDRREVGAPLDSQAGEQQVATAVAQRQPLGVAANEMAGAAARAGMPQHAFGDIHGQALGRTEASFQGPAEITGAAAEIDPAARREAFRQCRQQALTDAALEFGHRVVSGRRAGKRRGDLALVGQRGNAMGRQQRRGIVRHRHPREGISGLRRPPRPGIPAAGRDWPPGSRPRRPAATRAGPRRRPAAPAHRLRRTGAIAARGSFPGRPGYPVGRATAGRRPAPRAPAAAAPPAVAAPGSEGRAHPG

SEQ ID NO: 19961 - protein, 263 aa, Pseudomonas aeruginosa
NACGSGAVRAGKPRRSPRRFPPASRSASPRARGSTDCWPGSAVPGNRRRGAPPVRRRACLPATSRPASYRAAGYRRVRRASRRRRPATAAARSTRSGAARARAARRAAVPAVRCPGPSPATGSSGHASSPSSASISARRLDDSCRQLSPRASSKRSTCASLCAADSVTRSRALLAGTVGGRIAPTMMPRARSMPARATAWRLPPTRIGWIGVKLSIRVRPSASAPWRKRAISAARCCRRQLSRRSSSRLFRVAQATAGGWLVV

SEQ ID NO: 19962 - protein, 292 aa, Pseudomonas aeruginosa
TMNATNHPKYSHSKRSGSITKNIFDHSDQPLSKTRYGFHSGTFRNMNGKRLFQVRSWLRMVLASIFAWLCMSAHADLSFDGQNRFVMKGKRLPITLVNEGKEPALAEISLDWGTDGKGQALPFAVSRPLLRLGAGQRAKVEVLYQGQGLPTDRETYLLLSVLDVPHAPSTPETLQIALRHRFKLFYRPPLEATVEQANEGVTWTLGTSGNPKAHNPSPYHITFSQLEFLDASERSCGEAIEHLMLAPFSNHQFDIAACHPDKVRYAIVSDGGNLHPYHGALKSGVETNAKHP

SEQ ID NO: 19963 - protein, 340 aa, Pseudomonas aeruginosa
GPEYTMNAITRTLLVGMLVALAQKGYALTCERADNKATIDYVNIDTSIAVPSALPKDTVLWRSPTYDFSVRCYQERENTGPEDVYFYLSPDGQGALGSDLEVGINLNGEDLRCSSLPGCRQKIGMHFDGCWTGGRGGCEGMAQTKQVRFQIFLSKLAAPTPGKEGPITGVNSYALFQFDGVGGINNLGGRNLRMYALGMNNLRYVACTSTLSISPKTLNFQILQSQFAAQNLVIKELPFSITANKSCNSAYGLNAMFIPASNTTLSSTDTLLAKDNPTVGIRLLNEDRSVISIGKEFEFIPYAPTQTTVTKNFLAQLRWMTSRPILGPFNATAAIEVYYK

SEQ ID NO: 19964 - protein, 359 aa, Pseudomonas aeruginosa
GRLQSLPAGLICLVVGWSHGKSRKRYWVDLLFDRLVSEKQIPPPDAPHGPDPPPGSLLHRHRRVRPDIPGRHPPEHLAVGGDQRDPGTGGHARRRPVHPHGPGHEPDRQRPALPQPRLFDPAQRRRRAQQPATGHPGRRHPEGRRQLYRDGLFPPPPPATPGAVVPGTGAATVRGRARQHRARPPRRSLRHRRAAHRQSHRARDRRRNPVQLRAPVVAAQPPSAGREGRPGPCRRGRRALHHAHRRRGRAERAALLATERPPATGDPPYQFGGSGAQHGRQRLRRGHPLRPGVPALVAGRQTHRDAIAGRPGAVDERRPGLAPRHRSERRDARVPRILPPVVPRSAAKQQPALNPAANL

SEQ ID NO: 19965 - protein, 108 aa, Pseudomonas aeruginosa
SNAGNTQDRTLMGTEGFFDGLGEMLGRAIRFVVDLLSGLLGGIWDAMDDFLHGLARAIGMDASLFSFVFLVLGLLLLYSGIRAFMRRSIVGGVIWTVLGLIVMSWLIH

SEQ ID NO: 19966 - protein, 287 aa, Pseudomonas aeruginosa
STRRPFPQGAKEGFGYPQASSEPAGNGWSAARACGCMVRHPPGSPAMSFPLRPLTRWLLPPPACLLCAARSDQPPRPLCRACAADLPWSRQQCRRCALPLPLDGQVCGECLRRPPAYEQAIAPWRYAFPLDSLINRFKHQAAWPLGRLLGELLAEHLRQRYAEGLPRPARLLPVPLAPRRERRRGFNQAQQLAERLAGELDMRCDPHSLRRVLDTPAQQGLDATVRRRNLRHAFALAPASDVRGLHLALVDDVLTTGATAERLSRLLRRAGAARVDVYCLARTPKPG

SEQ ID NO: 19967 - protein, 284 aa, Pseudomonas aeruginosa
RSLHVRTLHSRPARHPSPATHRPARADRRTGLHHPCGEGRGHQLQGRLGRHRRTEQPGRASAGRAKRRRQGRRRRPADRRGRTPAGSLPAPGSLASAGVAGRGRRRGPQPDRPPDAPHQRTQPIARAGPVDPWRRLPRPHRHRAARPATHRGADHPRQHRATRTRSRPPGTGADQGRLAGRRAGTARGPAEPVARHPGGNPRGQGRSQRGAHRPGQRSYPLRAVVRRTPGQPGAEEGSEGDRLLRSGPGPARHAAVNLPARAGLRTLGVFRALDAPSCPIPSTN

SEQ ID NO: 19968 - protein, 568 aa, Pseudomonas aeruginosa
LRPRLAGHPAGRQFHPQEPAAGLRVGRPRPAETPRRPVRRGALPADPPARRLPSRQPAVPRRCLPHGRSRRLPHGPGPPGPVDDARRRAPRTPGADCRTGRRLQRVPRLRPAPATAARRPAQPPPDALQRLARAALGRPGVPAELPLVRQRTLLGRAGAGAARTTGGAGRGTAAAVLSLLRTGRMARGAIRPASGQARERQVCRCFSAGTVRRQPRHPLLEFTGHPLVHAVHGHSYLPDVSRILHGDRQPPSGLCPRPDGLCDLGAVPALLQTARTHSRGGNHRPARGLVGPVRRRPAAVLETPGLVARAAPESAALRRAGRQRTADRQQLDDLCLGGEQRPHAGSQPGLLHQSADQRDARHVAAQGTPASPAMAGGGPGFAGRGAAGLATRQPALGVAGAGPDLRLVRPDPQKGTGRRAARTGGGNLAAAAAGAGLVAVFRRRADQRNGFLEHPGSPVGGRRGPGDAGSAGLLQRCGKAPALRHSGLPAIPGTDAGPATGDPAVRRAPGLQPPDRLRFHLARPGRLQLRRLAQPAPPAATGLTLSPGLRNSASLAKKRAILPSPCQY

SEQ ID NO: 19969 - protein, 210 aa, Pseudomonas aeruginosa
  UNSURE (192),(193),(194),(195),(196),(198): Identity of amino acid at the above locations are unknown.
QEAKDRRKGEREEPEAKDTEEGGVERMGMQRTDRTTNQERARPQCTRRNSGNEGEDRSNKGREHERDNQNKGNKDKTTGAGSNQRTGRKAQGAGKESRRRDRREEKGQTTGRRPNKEGKGQKDTQQGKGERNSKKTRRTTTDRQREEETRRTKRRKRKNREEEETVGQREEKRQKGARTDTKREEKKRESPXXXXXTXPHPTLGAYSSVG

SEQ ID NO: 19970 - protein, 230 aa, Pseudomonas aeruginosa
ACSAAKCTTAASTSTSATPPATSTRRRARVFANWRRRTPWPCWSEPPPCCSATVRCQSPRPNANCACRPGPMNPTATAKRPWMRWTRASTPWPTRWANACWPMPATMHCSPWTSPMKPELDALEAWLGRPLPAAFVAALEQHGGRLVEPGLLLYAADELLERNRAFETSLYCPGYLAIGDDSGGRAVVMALDDHRQALFLVDHGAMTPDCFEPLAPSLEAWLEAGPCLPE

SEQ ID NO: 19971 - protein, 226 aa, Pseudomonas aeruginosa
SAPGTCTTMPPTATRRCRRVSPSTPRRCSACCCSAACLAWSTCSTAGPRRCCARACWGWAGWPWWPGWGCCSTCSACTASLFELVVGFQRAQRIDIGGAGIQGDGGSQGLGDFRLAGAGLQRGLGVHADATVATGGNGHGDGDQFAGLGIQGALGAGFLQRAIGGEHLRVLLAQGTEGFFHGGDELGPVVQHGDILRCFRAGSGASGYQSRPVWTAPPAHASLLST

SEQ ID NO: 19972 - protein, 307 aa, Pseudomonas aeruginosa
SAHPMDPLDRLIQLANLQGRLDQRCQLQGSWALEHPQAVPGEATFHIVMAGTCYCEFLDGGRLDLHPGDLILLPRGTPHLLRSDSPAQPCEPTVEHRGSIPLYQLNGPGEALDMLCGSYRYHAGASLFGALPERLLVHMDESTQQPLRALIGLMREEAESTRSGARSIIDALATALFALALRAYLDRQPLGDGLFGLLGDARLGRALRAMLERPEHAWTLEQLAQQAAMSRASFVRAFSALGGTSPWNLLTRIRMEKARGLLRQTQKSLLDIAAETGYQSEAAFSRNFRQAFGVSPGRFRRQADSAR

SEQ ID NO: 19973 - protein, 149 aa, Pseudomonas aeruginosa
QYGYTVLSRQGGAGVLVAAPTLPLYQYAQEANMEWFLKCVKEHYFDFNGRARRKEYWMFTLVNIIISVALSVVLGLISEKLLPIANLYSLAVLLPALGVTARRLHDINKSGWWMLIALIPIVGLYLIYLLAKDSDAGQNQYGQNPKGIA

SEQ ID NO: 19974 - protein, 135 aa, Pseudomonas aeruginosa
RRPDAGAACGCSTTPTRPARRSSCPAAGAAISPTCTPSRPTSFRAIRTSASRRWPATPSGTSSAWWPSTRCRTTRRNSASCSATTSPATSSRCCCANAPRPERKSCWTPRSKRSPATTPATTCVPAPARCAASRW

SEQ ID NO: 19975 - protein, 95 aa, Pseudomonas aeruginosa
SRRPNPATRHARSTPAPACLPPSARGAFPPAPPRWRTNGRPVRTPGRRRSRWPAESTGRYRPAPGPAARLRQAGRASHPPVPPRPLARRYGPAGG

SEQ ID NO: 19976 - protein, 172 aa, Pseudomonas aeruginosa
SPRRCSGVDRHRRYRRPGPGRTSGVARLRNAWGTSFFRRPQRCDPRGRRMVCPVCVSPWRAAPGFPRPAGPCPRRTRGTRRHRWKYRRSARRCRTCRSPPGYRRRRRWRTPRYRRWHWPGYGCPRRTGRTRTPRPDRSTGWSSRSSAARRTARRSAGRCRGSCRHRRPRRWP

SEQ ID NO: 19977 - protein, 358 aa, Pseudomonas aeruginosa
QSVLGYLLIRHGGAQVVSGDVEHTVGESPFVVEPGQQVDQARPGNAGLAAIDDGRMGVVVEIATGVRQLGISQQSAQRAAFGSLAKHPVDLGGGGVAGSLQGDVQRRDVHRGHAYGFGLDAPGKFRQQAFDAARQTGGHRDHRLERRTGTAQVLMVVGVDHRLVVHRRVDGGDRHVFQADRLVQQLEQRHPAIGRAGGVGDQRFAAAEVLLVDPIDDGGVDVRLARHRLREQHPRRAGAEETLGLGAVGVLAGALQHQVDPQRLPVDGLRSRATQHLHAIAVDVQAVAVDLHFAGKAAMGGVEAGQVLDAGLVGQVVQRDDLEAQLLRALVQRAQDAAADTAIAIERDAKRRGGHRQG

SEQ ID NO: 19978 - protein, 282 aa, Pseudomonas aeruginosa
LRQGASERRQLCGGWARLGTVRDPRGAACAAATARVQALKRFMRHLAGATAFRCARLARIHRPPGAPDAPLRRQPQHALPPPRLPRTLRRRRGGRLRGRGVPVPLCLPCGRTEGPAGRPRPAPDAVQCRTRRLGQGRARPGQPAGARGRIPPRHRPGHRLCPGPRQPPHPCHGRTAAGRRRPHPPPRDLPRQPRPCRPRSRRRRADGAHRADQQPRHAGLLPHPPGRRPGHLPRGRRGQPAGTVRLLPLPDRRGRPGHHPASRHRQYRPRPDRRGTRPPRAG

SEQ ID NO: 19979 - protein, 138 aa, Pseudomonas aeruginosa
RQRSELPLPVRATRPARLPGLDRLRVPSARRHLGRPGMAAALARYSTRRMIGSSASRRSRAASQSRTSAHHCSSFSTARARVSTRGQGRSSNRRSSTWLSCSLSSGRRPRRTGASTRCASDCSTRSRCAVSTGIGCSS

SEQ ID NO: 19980 - protein, 170 aa, Pseudomonas aeruginosa
RPCSPSTRSGWSRPGRRNRRAAPAAAGRRRSARSGWPCGWRWSHPCWQHRRRRPRPSRRSRPAARPSGGAAIRRPVPDGQPGRRRNACSTRLPGRRRFPWRPTRRRSAPGSRTERAPSPARRGSRRSRRRPAARRGTLPCPACSASRNRSRSCSRSGSAGRSCARYRWRS

SEQ ID NO: 19981 - protein, 183 aa, Pseudomonas aeruginosa
ERVGLARRTGLRPRRHGAGGRPGGRRIPAGTRQAFPPGHGAGQQRGDAGTGAPALQGRRIGQRPPGIGRCPAGRRRTGRLRGAEHGPAPLRRAGGGAETVGPPGPSGRQPAGDGLVPAQPGLGQGGLRRPLVGFRTGGPGPVGRRRRAHARRESLHWFTQWLPDPGPALRQGCIRKPPHPPVM

SEQ ID NO: 19982 - protein, 208 aa, Pseudomonas aeruginosa
PRRCAISPGRWRSTSWKTTKRGSARRASSAPPCGPTSSSMARTAMHPPMSWPYNRCRTSAASTGSVATSPPSRASPCTRPRATGSPNSWRGPTTARRWWSATTRPVRCRSRRSSSATHCRQPSLPTSTNWWRRPTTGCTVTSTTPSTTASAGHGCWPIRAAIPTREAGSVRNSSSRSEPQRGNWLKKRQISTGASSSGSLLPRIRGKR

SEQ ID NO: 19983 - protein, 78 aa, Pseudomonas aeruginosa
SGCASTWPPPCTLSSSTGGWPSSCQRCRSVQTGPGRVSGATSGGAAMPFRPAHQRAESRVERTAPRSPKPNRLTLPPR

SEQ ID NO: 19984 - protein, 774 aa, Pseudomonas aeruginosa
NFTTPVPSIRKRPAGCRRAPAEAEGQIFERRREAPRQSETGEGNRRADGAARAAEKRCTTTGGGMPGVLRQCRRRRERATGTNAPAALVHSYPLRLFAPVAVARLRRESAFACPDDGLATAVDIELGVDGRHVVAHGVRRQAQFLGDLLVRQALADEVEHLALARGQVGQFGAGARRVGAAHVGELFDQGAAEPGSVLHHRLDGVHQLHFGAPPVADVQQGHQHAVLLVEAHRLGRDQAVQAVAILVLQAQLDVAHAAALRQQLAQALGAAVLPQPAGDGGLAEQFLGLVAEGFAEGLVDVQRLQVVAVQHQARHRCHAEGLGEALLALAQGLLGLLPRFEIGEGEEHAGLLADLYRLPGDHHALASALRHPQARLHLRDGLAGAQTLHRQFAALGLVEYVQLVHRTADHLVAGIAGHFQETDIDLHVAVVAEPADHRRRRVGIEGLLEALLGAGPLGGVVEDQHQAVGLVLGGRQHQPAHAVHPAGVLVGGGKHFHHHVAEALASHQALGRVLPLLQRMIVAVAQAKAFAILAGIGAQAFQRMDAVHRQGRLVGPEDALVRLDQDHPFGKAGDDLLQLAAVGLGTQYLVVHAVPLGWSDFPGAARMPARPDRARVTIALAVLVHLHRETIAEAPLPWRYRKQCPGGKPRRRAGREATPPLGPEVVDASTRLALHEKKAPSPCMSDAMSKNKHPDLGEIQRSLNQALEGYDCQCRMHYDGTVSINVAAREHDETFTFVGIQPGELDNPTRLHLFAESLRRDLALLEPWLGKHAA

SEQ ID NO: 19985 - protein, 295 aa, Pseudomonas aeruginosa
EQLMDFRQLRYFVALYEEGHVGRAAERLALSQPALSQQIRQLEQNLDVSLFQRSGKRLLPTVAAHTLYNHAVPLLEGLERAREAMRVFRGQTPRSLAIGVLQTVNASLVPYMVERLHAAQPHLRVQIYELSGIDIERRLLTGNLDIGIGFLPPRQPGLHSVELYEDELQLVIPEEHPLKEFRKVSLAQAAELPMLLLGEEFRARQIWQEQLAAIGRRPRVQAELNHMSGILDSLPQTRFATVLPGKARQMHSNQRLLWKPLSEPRIPLKVGLVYRDAQRQHASVELLRSLLEGVV

SEQ ID NO: 19986 - protein, 310 aa, Pseudomonas aeruginosa
CRTAPVPGCAPRSPPGGCPRCRSGPRSGPGRWACRRSTATAGDASAAARRAPGWPGGSPRPSACSSPARAPARDRGPRRRSLRRSPSAPASAPAAGAPRKTRTARRGRPVPATPRRTAAGCRRCCRSLAAGRRGRLRWTSTGPPATGRRGRAGAAAVRGTGLAGWNRRAAARPGSRARHRGRSRRLAAAGAGVGGRRAGRRTGGADAARSSPGAPAGWRWSRRAAASVAAARGRSAGAAADSPTRAASARGRAAGHRSRRPAGRDPGAGRRPSACAGATATGSRGLRRRARRPGRPRRRYSGPGPGAPTN

SEQ ID NO: 19987 - protein, 173 aa, Pseudomonas aeruginosa
AGFPGGTAAGCVRCCVPQCARRACALRCGRPGACRRRRPLPRRPPHWRKASSARRDTATAAPARAPARLAGSARRCPARQARGAGRFPVRRLPPGNRPATGAGADARRPAGRSAGAAPDRHRATAAPSAGCPGPSAAAARRWPPAAPASDTVRGSARPADRPRGIPAGAGCRR

SEQ ID NO: 19988 - protein, 257 aa, Pseudomonas aeruginosa
SPRPVSSTSTTPSTTCTETRVRGTPRTLPPTRNRDETVRTAFAARHRHPARPGRLGRRPRSAVQEQGLRGLPCHRHQDGRPGLQGRRRQVRRPGRRRSGTRAADQERQPGRLGPDPDAAERGQRRRGADPGEVGPVAEMNAPPDFRRAASHALWLALALTFACPLPGLADEHPDARRQAQLRHLLLQDCGSCHGLRLTGGLGPALTPEALRGKPRESLVATVLMGRPQTPMPPWAGLLSEDDAGWLVDRLIEGEIAP

SEQ ID NO: 19989 - protein, 352 aa, Pseudomonas aeruginosa
SASAAFRPAARAAYSSATAPSTSDSRRHHGRPLPPPPRPLPERPADLRGTLSADGRDPGLQRSRGARTAASPGSRRRVVAGRPGAPPPTRRGQHPGCPGGARGASATGRRAHQPVRRGQPQLPARTPLQPVVRAHRRRPRATRPGTGGDRRRHRPATPRPADAGSLLHRPRVSPGGQPMNPVEPLAAPQRQHLRYLLEQGLPLASRPYRVLAERIGAGEDEVLEQVRRWDEDGLFRRFGVILHHRALGYTANAKLVLDVGHAEVDAVGRALAHETIVSLCYRRPRRLPMWPYNLFCMIHGRERGEVERQIEALLERHALRQTPHRWLFSLRAYKQCGGRYTAPPADLERRHG

SEQ ID NO: 19990 - protein, 405 aa, Pseudomonas aeruginosa
RRPACAWRRRRNVHAEDQPLPAQPRRGRADAAPRRRQARPGGDLEPAAALQPDLQALLLHLRRQRLPWRAGDRGNPSRHRRPARRRSARADPLRRRAADAPGPLRDRRPCAPGRDVRGAVEQRYADRRRQHPARRRGPLRLRRHQPRRPARDPRPLPPEAGQLRRRAGGHAPVPRGGYPRRHAHHPDRGERRATTGTARPDARTRRAEVLPLAPQLQWPRPPQPRPRRPPPAHPRGPRAALRTGRRGHPAGARQRLRHRQQRRRRDPSPRLAQAPPPAATGASLRAAAGLGRQRLGRGHRQHRQHRRGASGQLLVAPQRRQHPPSALRRLLVRAPRPAAPATAPAPATGGRALQPMPLAGHLQRQHPHPRLGRRRTLGRRPRLLPQRSGNRPRAHRAAPVIRKAS

SEQ ID NO: 19991 - protein, 787 aa, Pseudomonas aeruginosa
SSSARWWRSSPSARWRILHTWAPARRSAARPSHAPDRPRPRPAPRRPRTGRRSAGGSALPPALPGLPRRRAARRQRPDPAPGKPFAAEAGAGPRSDPARSPGNPDGRLCRSIGRRRGGRPGRLSLPGAAARTAVERRGHPGQPGSAASPRHPAVQAPLRGRPAEPVRGGGVRRPPRDHPRRRSLRAHRPLPLALRPARRSEVLPGRAPGVLRLARRLGNPLRPVQPEGGRRGPRRPQHAQPGGQRRRALGPGGQLPARQPGAAGRPRPVPGAGHPGGRRPGPGLAGQRGIHGTAATQLRGRPEGRPRAVGAALCQRQAGRAETVGGGRLPRRLLLQPRLPLPAGQLAAGQGRRGDRAGQRRAGRLDPAVGHAAPRLGHLLEARRALGIRHAEHQPRGDLGDRPAKLEAVEGNRHRRPRLLHAQPCRLALRLDRYLPWQETRRDPADRQADPGNRPSPAPQPGQGRRPRRVHPRRPLRPAQRLGPRRRAGGLRRAQPGGSEATADEQAVGQVQRRQQDRLCGGNLALRLGRDAINGYPRILRDGPRQPCPITAREKPGEWRITASGYSPYRPPCARSRRAHNANGVIRRSPCPITAPRKPREWRITASGYSPYRPPCARSRRAHNANGVIRRSPCPITAPRKPWEWRIAASGYPPHPSRAPSPRRPEKSPASRGFPSQAPGLRTARRPAGTATRCRRARRRSGNGCAAAGGRSRSARYPACWRRSRPRPAWPARCAPSMPTCRHRRCSRTHAGIRPTPRRSRWDCPWRGRAARRSALPGSPRRPPAAC

SEQ ID NO: 19992 - protein, 400 aa, Pseudomonas aeruginosa
ESPLFAGSSEFAGSPTGPAGAGETGGRSAAPLPRQPLERKLLRRQAHQARRAGLDRRGVRRGARQQATEVEVGGGQLGFVERGLAAAGIQLLARHQGDAQPEIGQGHVAGEHQVVHRGGAHFVGILHRRQAHLLGQFAPLRVQRRQLRDLSLQLRMLGLGLAQLVDQFGETAQQLALAAQYLAAKQVEGLDAVGAFVDLCDAAIADQLLHAPLADVAVAAVDLHAEVGHLLPGLGHEGLADRCQEGQQVGGPLALGGVLRQVLGVEQLGGEVGQRAVAFVERLHGQQHAPYVGVHDDRVGRLVRRLRPGQRAHLQALPGVAHGALVTGLAKAQALHAGAQAGVVHHGEHAVQALVRLADQVAGGAVEVHHTGGRGLDPHLVLDGATGDRIARAHVTFGVG

SEQ ID NO: 19993 - protein, 390 aa, Pseudomonas aeruginosa
  UNSURE (115): Identity of amino acid at the above locations are unknown.
SGIAVNLYEGFWLIGDRTDVQSLRSQCGIAPGRLAGRTHASRLSNRRLKHTFTPIPCQASEPTARSCPKSLAATSFQSTFVSLSKAHGEAPGRLQGPPGDSRKRKGRGGRCRPPXNQAWVSIRVPRVSSATSMTRAPLCASSLARVSSTICSAWGERASTVLRAISLPAWATRALPDCTALRPLTKALPEISTLYSWGRACATAIASGFYSSRLGRRWVPPVGYGRPAVYSPIPRGRRSRCAATAAGVASSRRGTRPRQGAGRRSARVARFSSRREVAGSTTLATQPASARPSPRIASALSSAWLIQPRRTPTTSTTGSASRRARSDRFSRPSNGTRHPPAPSTRVKSACSASTSRTASCKRAALSSTPASRAARCGAMAGAKASGLTCS

SEQ ID NO: 19994 - protein, 139 aa, Pseudomonas aeruginosa
SCPSGSGQAPRRHGGNGRSAPPGVAAASFRGAAAPGSSGWRRPPLAAGWWCRCRAGRTESGSRSVPRCPLRRRRRYRNPCRGCRSAPAPAPGRGRNVRRSRRRWRPAGRSHARRRPSARRRGPARRRPGPAGRRDCRPC

SEQ ID NO: 19995 - protein, 155 aa, Pseudomonas aeruginosa
HRGYNFRMTLHGLNNLRYVACASTISLSPKTVDFQSLQAYFASRDQILKELPFSVTANKNCSSAYGLNAMFLPSGNTSLWGSDTLLDNNNKSVGIRLLKQEDRSIIDIGKEFVLVPNSQNQLVVIRNFLAQVRWMTGTPTPGPFNATAAIEVYYK

SEQ ID NO: 19996 - protein, 285 aa, Pseudomonas aeruginosa
RMLACISNLLRGGGPLGEPGFQGSGIELRGLYPRIGEQPAVQRQGSGHAGQHGALQRLARAGERFVAVATMDDQLGQQRIVVRRHPVAGIQVAVHSHALALRPFQALHGAGAGEEIARRVFGVDPHLQRRAVQANVLLAPGQRLAGGDAQHGLDQVDAGDHLADRMLDLDTGVHLDEEELAAVRVEQVFQGARATIAETLRQAHRALAEGLALRAVQRRRRCLLEDLLAPPLQRAFAFEQMHRALAIAEDLHFDVPCLADEALQVHRRRTEGGLRLALGDGEFPT

SEQ ID NO: 19997 - protein, 159 aa, Pseudomonas aeruginosa
FVGVVGDTDATPAAAGGGLDQQRIADLFGASQRRVEVAQLAGRARHHRHPGGHRGTPRLGLVAHAADGLRLRTDEDQAGRLHRFGEGGVLGEETVAGMDRVGTGFPRRHENRLDIQVAPLGPRRADQAYLIGQPRGQRIAIRLAAHRYRGNAQCLRGRG

SEQ ID NO: 19998 - protein, 314 aa, Pseudomonas aeruginosa
KVPGKGDCTLCSAMTNPHYSNVVGNGRKACREARRGERRSTRRLDADAGALQARTGAGDQLQGTGGIAVDAHRVEGDVEVLALDGAHLALAAGAQDLVGDLLRIEGGDPPGEDDGAAAVVVAVGVELAHQRLAQFPADAPGGRTGHAIEQQFRFQALQGLDEQARGDLVPRQVHVERAVGLDVLQRQALQPGEFAQCAKLVEHVVDQLDGRRGDVPTPEADQVAEARMGADGHAMLGGHLHGAAHAARVAGMETGGDVGAADQRHDRRVHAIADGPWAEAFAHVGIEVDFSHCPQASSVLLLDGATVKAGKGIG

SEQ ID NO: 19999 - protein, 324 aa, Pseudomonas aeruginosa
IYYSIDWFLKNRYLLRMLPMALTLRQVRYFIATAEFGQISQAAIHLNISQSAVTSAIQELEGMLGVALFTRTAQGMNLTDSGRHFLNHAYSIQRSVDDALNSPQPDTRVEGTLKVAASYTVMGYFLPHHLQRLAQWYPELELQLFEDERASIERGLLDGRYDIAVLLTGNLTEPGIAAETLFNSERRLWLPSRHPLGEKADLGLADVAGEPYIMLTVDEAGQSALRYWQQSGHRPQVILHTSSVEAVRSMVANGSGVAILSDLVYRPWSLEGKRIETLSLVDPVPSMSVGLAWRRDTEASAGMRAFREYFRQSFLAPQQSSSRR

SEQ ID NO: 20000 - protein, 138 aa, Pseudomonas aeruginosa
AGSSTDPRVGRFRKERRKVSVIHRRVPNPLATAGRRRAPAVAWCDIRQEVPPCRSRFVLSLAGFCRRRPACSAPPAATSRPAHCAAPVPPTCPGRASSAGAAPCPCRWTARCAASACAARRPMNRRSRPGATPFRSTA

SEQ ID NO: 20001 - protein, 392 aa, Pseudomonas aeruginosa
  UNSURE (47): Identity of amino acid at the above locations are unknown.
TAAQPIRERIHARTAGRGLPVARRLQPFRRRRLAGRRQSPAFRQFRXPCRGGHADGSRPRRARRSPGTLRPELLPRLRRRQGVVRQPFRRQRLEPGRTSPGTWPAPPPGTVCTRPPSDALAFCPWLLEPSPYTSAHSEASMSALSTLAQHVTRRPQRIALLAQIAELGSITRAAKAVGISYKGAWDAIDELNNLAERPLVERSVGGKGGGGARLTAEGERLLALYRRLEALQAQVLQAAEDAEDLNLIGRLMLRTSARNQLHGRVLSIHGEGFHDRIAIELPGQQRIEALITRASTEQLELGRGRPVLALIKAGWLDVGLEPREDQPNQLHGTLEEILAAKAGPSEVRIALGSGLTLCALLSGERLASLGLKKGQKVIASFDPAQVLLGTPL

SEQ ID NO: 20002 - protein, 334 aa, Pseudomonas aeruginosa
GSFEPWMPRHVPSLRPTDPRPRPGCRGKPRLSQRRTGAGAQQLRKPRVPGRHRRRRAADRQVLPTGPLERRGDPRGARFIRPSWAECEVPVVAPLSRDGESLFAFSGFRFALFPRRGGRAPEPGNLDQLYRLGQLLGRLHAVGATRPFEHREALAVDNFGHASLATLLEGNFIPRSLLPAYESVARDLLKRLDALFAEVPYQPIRLHGDCHPGNLLCRDDVYHMVDLDDCRMGPALQDLWMMLAGERHERLAQIAELVDGYNEFHDFDPRQLPLLEGLRSLRLMHYSAWLARRWDDPAFPPSFPWFGSERYWGEQVLVLREQLAALDEEPLRLF

SEQ ID NO: 20003 - protein, 322 aa, Pseudomonas aeruginosa
NSQVIRSCMPCTAILTCLTFQGFSMATANLRRGYVLGLTAYVIWGLFPLYFKLLERIPAVEIIVQRAVWSALFGAVLLLFWKHPGWWRELRQNPQRFVVLAASGLLIASNWMTYVWAVNNGHMLEASLGYYINPLINVMLGMLLLKERLRPLQWLAVALASLGVAQQVWQLGSLPWVSLVLALTFGLYGLIRKKAPVAALPGLVVETWLLLPLALVWLLFFADGPTSETAFWSTPEALWVVAAGPVTLVPLVCFNAAARHLPYATLGFLQYLAPTLVLLQAILLFGEHLDSSRLTAFAFIWLALAVYSFDAWRSLRRLPQPG

SEQ ID NO: 20004 - protein, 113 aa, Pseudomonas aeruginosa
QSIFSRQLLTSFLAYVLGQILDIQVFDRLRRSRHWWTAPVASTILGNLLDTFTFFFVAFWRSDNPFMAQHWVEIATVDYGVKLSISLLLFVPLYGMLLNGILKMLPGRPQSNA

SEQ ID NO: 20005 - protein, 80 aa, Pseudomonas aeruginosa
VCLRLSCFYPLLSSSYCLQCSLSFLSPYVCDVTSPHLLSFGLSNCGRSVQFLSALLLFSLSPSSFSRHPFLLRSVSCSIS

SEQ ID NO: 20006 - protein, 71 aa, Pseudomonas aeruginosa
QASSPMCSGRSSTSRYSTASVVPGTGGPRQSPRPSSATCWTPSPSSSWRSGVATIRSWRSTGWKSPRWTTE

SEQ ID NO: 20007 - protein, 80 aa, Pseudomonas aeruginosa
HIRKGYHKEIKRMAEQGRIARRQADNDDRRRTVTNRERKEGSKGGGRKESNEEETPFLQIASISLKRCSAAAPAASSGCR

SEQ ID NO: 20008 - protein, 371 aa, Pseudomonas aeruginosa
GYGRRSAQETGVRGRRPRRERAGGARGQHTQGVGADCQGETQAPTQQTPPERRRDAGLSAAATTQHATPATNARDGWRRGGARRRHGRRRAPGGARGAGAGAAARGRGSQAPPKGERAARAAGFGNSFSAHVLGDDQLAGGLRHDLHDADPGGALAEDEGAVLDLQVGQVGEHLANAAATGQRQGAVRQQLGLAVLGGVGHGDDDVLGAGHQVHGAAHALDQLAGDHPGGDVAAHVHLEGTEHGEVDVAATDHGEGLRRVEDRRADAGGHGLLAGVDHVGVDFRLAGERAHAEQAVLRLEHDVDAFRHVVGHQGRDADAEVDVVAVLQFARHALRHLFAGKCHLGKPLVVVAAAVRRAACVSRCVSRSDPG

SEQ ID NO: 20009 - protein, 306 aa, Pseudomonas aeruginosa
MTVKQLRAFLAVAQSLSFAQAGERLHLSQPALSLAIKSLEESLGGPLLERTTRSVSLTPEGETLLPLALRLLADWDNTEELLRQHFTLQLGKVSIAAMPSFAGNLLPLVLKTFRERHPRVNVAVHDVINEQVLEMVRNRRVELGIAFEPESLENLEFTPFYSDRFVAVVPAGSPLSGQERVSWRELLGEPFITLQRPSAVRLLLEESVAAEHGRLPVAFESHQLVTVGRMVAQGLGVSAVPTLCIQQMQELGARCLPLYAPQVQRRVGLLRLSEHKLSTAAQALSDVLLHGTDWRSLALPQDQSTE

SEQ ID NO: 20010 - protein, 570 aa, Pseudomonas aeruginosa
CPGADRGERRRSPRGAQPRRTGPSRGGPAEAPRRPGHRPRRPGRRADAEHLADRGRHARHRQPRRDLVELLAGLRYPGRDRPLRPDRTARADRLCRLPLRRQVAGPDRQAQRGARRPARPGATAGGALRPSAGAAAGLPLPGAGRAVGRVLPGRGRAGLHPGALRAAAVHPLFVGHHRSPQVHRPCHRRRAPATSQGARPAHRPGRRRPAVLLHHLRLDDVELAGLRSGGGRQPGALRRLAVPPRPRAPAGPHRRRGHRRVRRQRQVPGGAREGRHAPAPQPPPGQPEDTALHRFAAGPRKLRLRLPRAEERPLPVVDLRRHRHRFLLRHRQPGAAGVARRTAMQGAGHGRGNLGRQRPPPRQRQGRAGLHPAFPVDPAGLLERPGWHQVPRRLLRQLSRRLGPWRLRRGNRPRRAGHPRPLRRGAQSRRRAHRHRGNLPPGGKGRGSPRVHRHRPGLAGRCACAAVRPPARRRATRRAAARTHPPDHPRQRHAAPRTGEDHPGRRYPAHPERQDRRACGAQRDPRPPGEEHRRTGQPAGAGALSRPRRTARLKPRRAWARMRVPSYRKR

SEQ ID NO: 20011 - protein, 405 aa, Pseudomonas aeruginosa
FHARRHGPPHPGQDRSRGRATEAAPGQGRGLRHAGEEAFDLPVRQARRRPRRGAPGADGQVHRQCHLQETRGRAPGSAEEPVRLPSPGSVFPRLNRHRSVHDRRPDRRLLPATARRPGRPQVGFEPGVLGGRQQDVRHPRLRRQGRRPGLQGRQRAVPRLCRPPRHPSGALPGARALDRHGPPLPDEGGGVARGPGPFPSTGGGAPAQAPAPRPGTRRMSRDRLYTWAGLWRSPSSSWEALRLEDDQAESQLRAPDERSGLPYQLDYRLRWDADWHLREAVFHVESETGVRKLHLLADGRGHWQDGDGEALPAFDGCLDIDIWPSPFTNTFPIRRLGLADGQRAEIRALYIEAPALEPRSMRQAYTRLDASHYLYENLEGSAFKAVLLVDEQGLVIDYPGLFQRL

SEQ ID NO: 20012 - protein, 315 aa, Pseudomonas aeruginosa
RRAPRVADSPANPLACFHSSSATVIMADRDNPLRPRFPHVRRYPPHPAGAGQRPAERHPADRLGGDVHLHRLPDHRHPAGGAARLRARRPRLRLGAGRPGDQPAVPRHPARPAVRRARHRRPRAEARGALRHGRQRRERAVHAALGGDPGLAGAEPGQPAGRPPGTRRGGKPGRLGGDRLGHRPGRRAAHRQGDFLERHRQLRRHRPRGAARGAAGAVAGAVEHGRVHRPARGARLRPGLAEVAGAAGARRATAVPPCARPGHPARYGPGAGGDRLRHHRHLHHPLLRQPWLGQRTALPECLRRLLHRRPAVVRQ

SEQ ID NO: 20013 - protein, 145 aa, Pseudomonas aeruginosa
SSRSGRIALWSSRAISSRSVSKVSAPSRARWVRSTSCSSAAGRPRSRRVSTSSRAALSGCSRSWLAAARYLSLLWLAASAASRAWRNWRLSSSSSWVRSATRRSSSSFMVCRRCWAWTRSVMSATKPSTNSSSSCLSSRFINTSM

SEQ ID NO: 20014 - protein, 551 aa, Pseudomonas aeruginosa
WLLRAEWLPRPSNPARASCCCSEGLAIDHLDIALARLARVGKDARVLHRVAREERNVGAADPVQGEALVETHGVLEGDQVVHQALADLPLGQTAAIDAEGLGDHLEAFRRGAVVERHHVFDQRRVAQAVGQVEIAAEAVRHGMHRAEDGVGEGQPGLHAPEHDLLAQGDVAGIGDHLYQIAIDQAHRFQRVGIGQRPVAGGDERLDGVYQCIDAGTGRKEGIHGQRGFRVDQRDVRHNRLAHHGELHALVLVGNDHELRDVRRSPGGGRDQDQRRTRHPQPVDAFELEDAAAMGGDDADALGAIHRAAAAHRDDHIAALAAIELGAEHHLVDPGVGRNVGIQAVVDALPLQACLDVGDPAGGEHAGVGDQQDLARTEGLHVVGDAVPAAGAEDDLGRDEFTQLAEVVAHLTDHSYCYRTLPAAYCIRRLLQCDLGGPFNPPAGPGRSAIPPAAHGRDWPAGGNRGAPADSGGTPRARRCAAGRRPSPRSAPAPPPRRARPGRTLPARGYARPEAPGCAPGSDGAGAAGRQSASRGSHPRTCGCNAPVPTDR

SEQ ID NO: 20015 - protein, 224 aa, Pseudomonas aeruginosa
PHRDWRRRAGHRGKPGRATRCSLRRWRHGRRPGRGRSVPPRPAAPARPRYRATPGAPTGRASAADRRGRSRCCPGSSARPRRNRAGSRTAGRHRTPANASRSVRHAATLAAAVVVGDRRGGGHCAADRRNRGRFRRCPAHRRRPADATGRPPPAVARRHAAPRHAARRDGSPAAPAGARPPPRCSRTPGHPRPVRRTGSSPRPGAARCRPLRAGTVARRRPRRD

SEQ ID NO: 20016 - protein, 246 aa, Pseudomonas aeruginosa
AAAFPLPAAGGCKRPIARARQRGRHRRSGRPTLPRRRDATSRRGRSASEGGRRDRSVVAGSTRRLRLRPGSAYAHSPPGPGGSRSRAGADGPIRSRPAAAPGRRHAARRRNRHPRPAPGARHRRPGARCDARPRSAHGSLPPPAGHPRHRRRPGRRSDTAPRRPALGLRGPLASGVPAGRFRRPRPARRASRSRRRRRTRRPGCAPSRPARWAPPARRRATGTGASAHWPDRIPPRPARHGPPSAR

SEQ ID NO: 20017 - protein, 230 aa, Pseudomonas aeruginosa
NRVPALSRSSTTQADVVARMGVAAMRGIRRRAAAQGDRGEAQARTGRNGERLAIEGDRPMAQAAVPVGKHREQREAFAEVLVDHLRAPDFVRAAFAQAEQAGGVVDLAVEQDDRADRRIARPTRRLEGREGGDLGTDVGRGVAEDPALAVVGQGDGGLRAWLGRYAAVADPATVAAVAVPLGEAAAGGRTENTDVHGSAPRAGGRPRKTGAERISGWRSRGSLRNRDAGR

SEQ ID NO: 20018 - protein, 154 aa, Pseudomonas aeruginosa
EGEGRAENGQAEREANTRRASGPTARERRRRRHSRLRQSGGATRGSARRRQRSTRRPRRTRATAGGAAGRGAATGGDGHRAARGGPGQAQRPAGEEARHHRKGSAPRGPRVSEIHFPPTCSGTISLPAVFATISTTLTPGARSRRMKAPSSISR

SEQ ID NO: 20019 - protein, 141 aa, Pseudomonas aeruginosa
ARSVSTLRMQPQPVSGRVQYGSSLDSPSLEAWVMVTMMFSAPATRSMAPPMPLTSLPGIIQEAMLPRTSTSKAPSTVRSTWPPRIMAKDCAESKIDAPTRAVTVCLPALIMSASTSASLGNAPMPSRPFSDWSMTSMPSGT

SEQ ID NO: 20020 - protein, 251 aa, Pseudomonas aeruginosa
RPPSGAQRAFLDAFLEATLDDPVDVDAGGVDLRRVQFAGLDDLLHLDHRDAPGGGDQRVEVLRGVAIDDVAEMVGLPALDDGEVAGDGRFEDVVAAIELARLLALGDRGAVAGGGEEGRDAGAAGADLLGQRALRGQFDFQLATEQLLLEQGVLADIGGDHLADLPVFQQHAEAETVDAAVVRDHREVPDPAPADFRDQVLGNPAEAEAPGEDGHAVGQAFEGLFVSAYSLVESAHAAVPLPALVIVRAAV

SEQ ID NO: 20021 - protein, 708 aa, Pseudomonas aeruginosa
ASTSCPPPPRPSATCCCMAPTGARWRCRRTSPRSEAGSGGSGYASCMSRNNNKDGHAMPAPLWSPSAERIAASRMEAFRRFVNQRHALGLVDYPALHAWSVQRREAFWQAIINFFEVRFQQPPRAVLEEGAQMPSARWFPGATLNFAEHLLRRRDDAPALIAVSEDGRREVLSHAELARHVAGLQKRLAALGIGPGDRVAALMPNTWQTVVGMLATASLGATWSSCSPDFGTQGVIDRFGQIEPRVLIACAGYRYAGKSLDLTAKLNEVLAGLPGLEQLLVVPYDRPQAQPQDYRCQAQVALWDGFYQAEGEPVFTPVPFEQPLYILYSSGTTGVPKCIVHATGGVLLQHLKEHGLHTDLGDGDRLFYYTTCGWMMWNWLASGLAVGASLVLYDGSPFHPGPERLLDLIDAEDIAVFGASAKYLAALEKAGMRPRHSHRLDSLRTLLSTGSPLAHESFDYVYRELKSDLCLSSISGGTDIVSCFAIGNPVLPVWRGELQCKALGMAVEIWDDNGRRLASGKGELVCTRHFPSIPLGFWNDPDGTRFHDAYFASFPGVWAHGDYAEETVHGGLVIHGRSDAVLNPGGVRIGTAEIYRQVEKVEEVLESIAIGQDWQGDVRVLLFVRLRDGVRLDEPLRERIRQTIRANATPRHVPAKIIQVADIPRTLSGKIVELAVRNVIHGRPVKNTDALANPQALELYRDLAELRD

SEQ ID NO: 20022 - protein, 111 aa, Pseudomonas aeruginosa
SRGEPGLECAFRPTAKGNSMPVAMARHILVKTEAEAAQLKQRLAKGEDFATLAKKHSTCPSGKRGGDLGEVRPGQMVRSIDNAIFRKPVGVLQGPLKSQFGYHLLEVYFRD

SEQ ID NO: 20023 - protein, 124 aa, Pseudomonas aeruginosa
TATGASMTADQIAAFCLQLPGAREDLKWGSNRVFSVAGNKMFAILDFVDKDGGLAFKVGSELFLGYVDRPGIRPAPYLARAHWIVMARPYPMKAAELREALVRSHQLVVARLPKRQRLGLVLDA

SEQ ID NO: 20024 - protein, 175 aa, Pseudomonas aeruginosa
VATVCTPGPACGARRRPVGRPCAWRTTRRKASCARRTNAAACPTNWTTGCAGTPTGIYVRRCSTSKAKPGCASCTCSPMAAATGRTATAKRYRHSTVAWTSIFGQAPSPTPSRSAAWAWPMASARKSARSTSRPRPWSRVACARHTPAWTPATTSTRTSKAARSKRYCWWTNRAW

SEQ ID NO: 20025 - protein, 426 aa, Pseudomonas aeruginosa
PAFIRHLQRSSWRTATTHCDRVSHMSVDIRPTPPAQDSARQNVTLQIVSVVMFTFIGYLTIGIPLAVLPGYVHDDLGYGSVLAGLVISLQYLATLLARPYAGRVIDGLGPKRAVLYGMAGSAASGLFMLLSVAIQGWPALSLASLLVGRLVLGAAESLVGSAAIGWGIGRVGAPHTAKVISWNGIASYGAIALGAPLGVLLVQWLGLWSMGASIVLLGALGFALAWPKLPAPLVHGERLPFHHVLGRVTPHGMGLALGAIGFGTIATFITLYYASRGWANALLCLSAFGGCFIGARLLFANNINRLGGFRVAIICLGVESLGLLLLWSAPNPWVGLAGAALTGFGFSLVFPAFGVETVNLVPASNRGAALGAYSLFVDLSLGITGPLVGFVANLFGFRSMFLFACLASLGGLALAVALHRRSRRPG

SEQ ID NO: 20026 - protein, 138 aa, Pseudomonas aeruginosa
AAGSSIPRCDCRPCARGASRSRTGRRARAAARGSVASRPRRRRTVARPCPPATRAPVADRRSRASAPAPDWRRAAPGRGWPGRCRAPRARTAICSGCARPPAPPGAPAAPGSGSCARSGCPGRVTRPGPPAAAQRASP

SEQ ID NO: 20027 - protein, 187 aa, Pseudomonas aeruginosa
PPRLCDMACTAPRMALEKASPACMLPSMIFSRRAMSPGLAIICTRLPSIRRIASSAWGSVSGPWPVETNASMACTSASMPVQAERKGSMVNVVSGSISETSGTTALLTTENFMRSSWLEMITNCETSAEVPAVVGIRISGGLGTRSRSTPSNSRMLRPWAATMPMPLAQSIGLPPPTATITLQPSLR

SEQ ID NO: 20028 - protein, 438 aa, Pseudomonas aeruginosa
QRRWSSGIDAAAGIARRIEETVAVFAVAQPIDEGLRMRQVVLRQRSLAATQHLDTQLVAMDRQQRRQAPGRRRDAVERPGIRGQSGEPVPVRGQAPLAAVRFAQEQLPAAGLDATEQQPSLSQRQVAASAQLPGRASVVGIGEAAGQRYLGAGTPPAVAVAQPVKAAGGIEAWLLDRLAASGSGQAARTPILRQAQAGLGPGLVRTVPFDPGQPPPLAGGTRRGVEIGTLDQHPARAIGVQAHDAMHDPGRPMALFHRQQGIPGIDVGQVAVATLRPAAQHLGCAARSPAAYLLVGFVDPGQPVERHAAGAAAVLVDPAAHRAVRRGGLLQHAVAPQVQARARTGRIEFHPGQPAMGRLQLAEIAPGGHRALGAPVARPVAVVDHCLRPCRSGVTRAGCARSARPGQAAPPRPGDGPRGSGRAVPTWRRPGRWRRHRR

SEQ ID NO: 20029 - protein, 148 aa, Pseudomonas aeruginosa
SGWCRSPGRALPRSVRRGPGAAPARRRRNRAVRRPARGPGGTPRSIPRYSARRPRGRIPAGSSSTGTATDSDRSARPAARAAAPRFHCSSIQNCAWATSRNARMSSSMPGTSGKRSRSAATMAATSRRPSTSLRISPALSLSLTMPSG

SEQ ID NO: 20030 - protein, 342 aa, Pseudomonas aeruginosa
APCARPAPSPAPRACRPARSAPGAPSAGRACRRPRRPASRHRARAYRPPAGSRRGASIRAAPRPPRRGPAHRTGYRRYRGPRPPRPMLSPGWGSPRCGEYGGALLRRGIAVKRRRGQAGMAKGSPSRAIGRWRRPPFQWESIGNSGKPSLRSWWTICVHQTSCGQPSRRLSRPVVWSIWLSSRTIAPIAVSRGRRAGWRAGKAAIWARMSGEALQRIQRSPSSDRAMEDCVRGWAATLPSRTPRQLRQLQFHWGKPPPAAEPRIRMCMGLPRGLEGGPGRPGPNGSAVGEVEGHFETETQVGEAGLGPHGVDPLWWGRAIPAGRVKHQRGSLRMRLSKEFSP

SEQ ID NO: 20031 - protein, 198 aa, Pseudomonas aeruginosa
  UNSURE (189): Identity of amino acid at the above locations are unknown.
SMQGRRRGEKKDAARAASRQNPPWGKPRRDAGRAHPQVPWRKGRGSERSAAAEDRSEEAQRVDVVAHQQVLGLLVVVEHHLVRLATDAGLLVAAERGVGRVQVVAVGPHATGLDPAAHAVGAVDVAGPEAGAEAVLGVVGDGQGLGFVLEGGDADHRAEDFLLEHAHAVVPLEQGRLDLVAAGQMRPSXCICGRGAAQ

SEQ ID NO: 20032 - protein, 145 aa, Pseudomonas aeruginosa
EKRSGDRREREKAAQRTGRRSERPTHAGRRGRLPGRDAGADTADSARAAARRGAQRGGDNAARDARDERARRLAARRGAAPPRAATGTGRREGGRGRRSGPRARKPGTTERGARRAGRGFRKFIFRPRARGRSACRRSSPRSPRR

SEQ ID NO: 20033 - protein, 420 aa, Pseudomonas aeruginosa
EKQINDRQAVARLPRRGAEPQLRPGRRTPAPLPAGPEPGDQEPGGKPRRSAAGTYHPQRQPHPRGRDPAAAGAAPAGRLGQYRGIAAPALHPATGQGLHRRHALLRRQPAAAGLEDLSRTPPAGQRGGARRDQRAGAGDGPQPTRRAGHRLRAGVPGKPRVHPVLQRPLRRRGAGRLAAVRAGAGQLARTARRALHYPATPLGGAPAPGRKRGRRARPLAGGVREPPTGHGRADGRPGTRCQRRADPVHPADAGTRRALPAALRAAGAATGRPAAAERAQAVHRRPGPQRRAAAWHRLALAGAAAGPVHGVRQAAAGPVMLPACPGTTTRTDTPCPHRSGALPPNASPPVAWRPSDASSTSGTPSAWSTTRRCMPGACSGARRSGRPSSTSSRCASSNRRVRSSRKARRCPRRAGSPAPR

SEQ ID NO: 20034 - protein, 201 aa, Pseudomonas aeruginosa
RATSACRRSPAAPTSFPASPSATRCCRCGAANCNARRWAWPWKSGTTTAAASPAARASWSAPGISRRSRWASGTTRMAPGSTTPTSPAFPASGPMATTPRKPSTAGWSSTAAPTRCSIPAACASAPRKSTARWKRSRKSSSPSPSARTGRAMCVCCCSSACATACDSTSRCANASARPSAPTPRRATYRRRSSRSPISRAP

SEQ ID NO: 20035 - protein, 443 aa, Pseudomonas aeruginosa
RESRSRCPPPAAGPSRQRITSRNPRNRLAGCWPRRLADQRHLDGEQRASAWSRMHLDAVAEDAGDTVDDGQPESDATALGSAPGVQLVELEEDRLQLVGGDAPASVPHLQAYLAATPARPQQHAAALGVAAGVAEQVAQDPRQQARIGAHCQSRDPRTQGQAGGTRDFLELRGQRSEQFVEGIVVQVRTDRALVEPGDFQQVGEQGLGTFQGQVGALHQLQFGGRQAPFAQGVDQQPRRVERLQQVVAGGGEVLVLAVVGGFGGVARLAQLAVELFQLVGALGYPPLQLLVHGLQALLGLDPLGDVGDETFDQFFLVVPEQQVHQYLDVTAVPAPEARLVAEQAAALAQQRADPSHLGLAADEQLPGHVLQRPEHLLRIVVAEHLRQRRIGGAQPLAEAGLEDAVHRVLEQPFVAVALGLQLLQARQQLRVVALARGVAAQAE

SEQ ID NO: 20036 - protein, 138 aa, Pseudomonas aeruginosa
SRTARRPPKSRRWSGSGSAADSAPAAGRRLRTRGCCGHGRRRCRCPWRNPSGCRRPPRRSHCSPRCDRTRRRASPRRPGGWAKRRYTGSSRCPAPPGLPGCRRPSRRRARRGRRPAGPCAHRRSSRSWRRCAGSRRRR

SEQ ID NO: 20037 - protein, 238 aa, Pseudomonas aeruginosa
RALVAPGQRVQAKRRLLGLATGREDQVVPCRLGADRVGGVGIAGEEERLAAAAAVVPLLLLAGTAGFGHPGVAAVTVEAERFVPDVAQAVLAHVGKLHRQLPRAVTRQRGAVGGDVEEYAGPAAHAGLRPFLVVVGGDEDQLARVAFGGQPLAVFGGDPLGALQLGAGRQQPGTVQRGPAVELASGEFDVIGFQLDAQLDDPLDVVDVVPVGDEVEHHRIAVRLHRAGHRQFLGEGLA

SEQ ID NO: 20038 - protein, 172 aa, Pseudomonas aeruginosa
AGEQVVHFFVGGLEADLHVVQPGLGEARQACLVEADAGGDQVGVEAQAAPCLDQFGEVLAQHRLAAGETELCGAQLAGLAEHLDPFRGTQLGALAGEFQRVRAVRALQRTAIGQLGQQPERRPHAFTAARSRIAHGPPRGTPGCLRLCRGLRGNARAAPRRWPPRRGGHRPA

SEQ ID NO: 20039 - protein, 400 aa, Pseudomonas aeruginosa
CQPPMPDPLAGHRVVRRAFEFVGHAHRVEHAPQHVQLELQDIQHAFLCLAGPIVLQGDPQAVLDVAPGLGQATAEILVAGRLDPRIVARPAVQPRLVDLRGEEFGQRTARRLLPTGATGEVDVGVDGEAHAGQHPLLGQHLLALQAHRFRQTQPGLDAARLAGGAVVVEDTLDPLAADLAVGTVGQDRRVLQRDVDLVVETVRHPALDLFATGTALVHRDMERMVDMVVASLVAQRPFEFGAIHGGTAHVGPLQLDVHAIPGHFDATGIQFGAFGRSGVEDGIGVVDVDEHLARGRHLRQHLEHAARPALRQVPHLPAELVADLADQHLVIAPERTVHQQAVGAAHPFEQRLVHLAEARRIEQGTGAIEVLDHPGRCCRPDGGRRDAGNTAARCCAGGSR

SEQ ID NO: 20040 - protein, 215 aa, Pseudomonas aeruginosa
PSTSPTADPFGPGLPGPPSSPRGRPMHIRILGSAAGGGFPQWNCNCRNCRGVRDGSVAAQPRTQSSIALSDDGERWILCNASPDIRAQIAAFPALQPARRPRDTAIGAIVLLDSQIDHTTGLLSLREGCPHEVWCTQMVHQDLSEGFPLFPMLSHWNGGLRHRPIALDGEPFAIPACPRLRFTAIPLRSSAPPYSPHRGDPHPGDNIGLGGRGPR

SEQ ID NO: 20041 - protein, 422 aa, Pseudomonas aeruginosa
RDAGLRGRRQARPADGAPGAERAGRHARGAGEGAGRAQGAHPHQQHQSHPRHRFGRTRRTGCQWHRSGLGWHAHPAVGGQHEPCRHGSRRIRTGAARQGTLLPYPPSVPCRDVRGPCQSRTDPGLGGEPFLLPGQHPAEGRGDPGQLSRPRGPPRVDPAYPRPRRRPRRGGRHRGLAASGGSGGPGARAGAVRGAGAARRALRRRRLRQLRPSRQLAGGGEQFADRTLRPADPPVAAGQLAAPLSVDRGGRLRVFPQSPGPGPARRRARPADHPGALSDPRGTGTHAGYPAIQAGRVVEHARRDEHGLRTRTPAVPHGDPRAGLASGAGIMSLPSLDSVPMLRRGFRFQFEPAQDCHVLLYPEGMVKLNDSAGEILKLVDGRRDVAAIVAALRERFPEVPGIDEDILAFLEVAHAQFWIELQ

SEQ ID NO: 20042 - protein, 399 aa, Pseudomonas aeruginosa
KRGAAALAAGRADLSLSVAVPVLLEPAGIRPRGRRAEYRGMDRGVPPGPRAGRRTARFLRRRAGAAPGPRRTDRGRARPGLLHQPDHLRHRPRRGTPGALRRGRAGPRADQLPGRRRRSEQPARRLTQGLRPETGDGPRGEGARLSDGAQLRHPPAQHRQHRADHPAVHRAGSRLRRTRHLPVLRLGRAEPCRAAADPRPTGARRADHRRIPPAAGRRRQPVQADLRHPRLLRGTAEGLHGRLGQRIPRHHPRRHRAAVSQRAAIAGAVSQRARAQPAPHLVRIVRLQPLPRRRLDARTLPFLRGEGEGPRRLPLPGVPPHRRCRRHRPGLRQVGTARPDPRGPSPGRGGAAWPGRADLAQPARVTPDLQGLRQWSTTATGRATGAPSARWPPGAISAS

SEQ ID NO: 20043 - protein, 406 aa, Pseudomonas aeruginosa
PTNAVGCRQCPITIRMVCQMSHDLSQLRKFVSPEIIFGAGCRHSVANYVKTFGARKVLLVSDPGVLAAGWVADIQASLEGQGIDYCLYTDVSPNPRVDEVMLGAEFYRSEGCNVIVAVGGGSPMDCAKGIGIVAAHGRSILEFEGVDRLRVPSPPLILIPTTAGTSADVSQFVIISNQDERMKFSVVSKAVVPDVSLIDPETTLTMDPFLSACTGIDALVHAIEAFVSTGHGPLTDPHALEAMRLIDGNLVQMIANPGDIALREKIMLGSMQAGLAFSNAILGAVHAMSHSLGGYLDLPHGLCNAALVEHVVAFNYSAAPERFKVIAETFGIDCRGLTQGQVRQRLVDHLIAFKHAVGFHESLALHGVGSSDIPFLSRHAMQDPCILTNPRESSQRDVEVVYGEAL

SEQ ID NO: 20044 - protein, 433 aa, Pseudomonas aeruginosa
AAAGGPGRVTRPGQPLRAQEPLPGAAGAPGGAGGRAQPLQMAVRARGARHLPGQPRPGAARRQSGAGADARLRRSATGALVAGGHGRATVRRRRGRDATDPRAAARARRPVRLRDAPLAQGRQSHRGIDEPAAQARRGRIGRRFRRRHHRAGPGPAAPADHERGAGAAGSRAHPRAGRAQPPVAPGARRRRSRQPQQGQVPRRRQPRPAATAQRGAAAGRHPARTGPAGRRTATGGAHPPGPGRCRDLAHRPAGNRPARPERDPSGPGRLFPRRTARSAGLGVRGSRACRRPGPACADPATGSAHRCAPAVADPAQLAQQRLPLHRARQRAAGGAPAWRQGTPGGVGHWPGHPRRPVAGDLPRVQPTGRRARFRAPWRRTRAGHRRPYRRHPRLPHRGAFDSRPRLAVRHRGAAGPQAGAASTRRGDCAGFGW

SEQ ID NO: 20045 - protein, 125 aa, Pseudomonas aeruginosa
SAAGTGRLLVVDNETEILFSMSALLGQWGCEVLTATDLEGARKALDGRAPDAILVDYHLDHGATGCQLLGALREDYGAEIAAVMITADRSDDCRRALARLGVPLLNKPLKPGKLRAALSALLGEL

SEQ ID NO: 20046 - protein, 99 aa, Pseudomonas aeruginosa
APSAAPRLEAGTRFTVSTPNAGNTREKPKPVRAAPARPTQGFGALHSNSRPRLSTPRQMIATRKPPSRLMLLANNSRAPMKQPPKALRQSSALAQPRLA

SEQ ID NO: 20047 - protein, 71 aa, Pseudomonas aeruginosa
LAMPFQEITLAVCGAPTRPMPQPIAAEPTRLSAAPSTRRPTSRLARLSAGQPWIATESSMNSPLAALPAMP

SEQ ID NO: 20048 - protein, 327 aa, Pseudomonas aeruginosa
PDPPLPASLRGLVLRQRQRAPVGAMQQHVAEGLGGGGQLVLAQPQQADPSLHLRRVERQAARAEFLHLLDAQGRHGADTESLGDHPPDRDQLVALERHRQAAVLGGHAFFQEQAHRRGALQGNEGLAEQFAPTDPLLPGQRRAGRHHGDEAVAVERGELEVFQGLRLEGDAQLDASVADHLQHLLVDHVVHRHVDPRVAFAKGLQDQRQQVAGEGGHGGDGDLAQLQGEVLAQQFLGIVPVGQQAQRQRQQGLALGGEADAAGGTFQQRTAEAFLQALDRQAQGRLGEVQAFAGLGEAEALRHGEEGAQLLDGHLFVFLINELEKQT

SEQ ID NO: 20049 - protein, 360 aa, Pseudomonas aeruginosa
PRKARWPRRSAPAAPASRPSSPPPATAPRSPRARRRASSMAATTSSNRPSPATSPSSRAGRPTISATSSIATPRRTSTRWSPPPGASRWSRWRRSSSPANWTRRRSTPPASTSTGSSRVASRNASRNARCAPDGGRYNDKRFPQMALTREQMAQRVARELKDGYYVNLGIGIPTLVANYVPEGIDVMLQSENGLLGMGAFPSEAEVDADMINAGKQTVTARVGASIFDSAQSFAMIRGGHVDLTVLGAFEVDVRGNIASWMIPGKLVKGMGGAMDLVAGAENIIVTMTHASKDGESKLLPYCTLPLTGCGCIRKVLTDLAYLEIEDGAFILRERAPGVSVVEIVAKTAGKLIVPEHVGGK

SEQ ID NO: 20050 - protein, 246 aa, Pseudomonas aeruginosa
  UNSURE (10): Identity of amino acid at the above locations are unknown.
IELLRGRIYXNSDASDQRLLDPADPAQGAQRHARVPGGNLRPGGRRHHLQGRSRGPGHRQRHRVRPRRRPLDPRHQPRLPHGPRDQGRSRVDQLLPPVPGPRRVRRLQEVRRRSRDAQDDARPLPADQEPAGELRHQPAGLLLSGPQPPRIAPTRGLSAKAPAGALVPRPDAAFPMAGSGATRPWPRLFFRLAAAPAWTRLLPCTRANQGGATAFSRRTLGGTGSPYQIRGKTPSKVSFGASPADV

SEQ ID NO: 20051 - protein, 272 aa, Pseudomonas aeruginosa
RPSHARNPPSPCPTTASAGSSATPRPTSVPRSPPSRPSSRRVGRAIRRSARSSCSTARSTTPPACSACAKAARTKSGARRWSTRTSAKASRCSLCFPTGTAACAIGRSPSMASLSPFRPVRACASPRSPCAAARRRIPRIAATPIRATTSAWVVEDLDSAGTLFYAPGLGEVDEALLEWMRRADCLLVDGTLWRDDEMLVCEVGDKLGRQMGHLAQSGPGGMLEVLAKVPAARKVLIHINNTNPILDTASAERAELDASGIEVAWDGMHIQL

SEQ ID NO: 20052 - protein, 253 aa, Pseudomonas aeruginosa
GANMSRAAMDRAEFERALRDKGRYYHIHHPFHVAMYEGRASREQIQGWVANRFYYQVNIPLKDAAILANCPDREVRREWIQRILDHDGAPGEAGGIEAWLRLAEAVGLEREQVLSEERVLPGVRFAVDAYVNFARRASWQEAASSSLTELFAPQIHQSRLDSWPRHYPWIEAAGYEYFRSRLAQARRDVEHGLRITLEHYRTREAQERMLDILQFKLDVLWSMLDAMSMAYELERPPYHTVTRERVWHRGLAS

SEQ ID NO: 20053 - protein, 392 aa, Pseudomonas aeruginosa
TKTSWRSSRWPMRNSGSSCSESVGPPLWLLAELTYRCPLQCPYCSNPLEFAREGAELSTAEWIEVFRQARELGAAQLGFSGGEPVLRQDLAELIEAGRGLGFYTNLITSGIGLDEARLARFAEAGLDHVQISFQAADEEVNNLLAGSRKAFAQKLAMARAVKAHGYPMVLNFVTHRHNIDNIERIIQLCIELEADYVELATCQFYGWAALNRAGLLPTRAQLERAERITAEYRQRLAAEGNPCKLIFVTPDYYEERPKACMGGWASVFLDITPDGTALPCHSARQLPVQFPNVREHSLRHIWYESFGFNRYRGDAWMPEPCRSCEEKERDHGGCRCQAFLLTGDADATDPVCAKSARHDLILAARRQAEEAPLGLDALTWRNQRASRLICKA

SEQ ID NO: 20054 - protein, 511 aa, Pseudomonas aeruginosa
GNGRLRRLAERLERRARGGRRARFQRAEGGPWRAGLGGIRSGQCALAPVPVARRRAGGAHRAGRLGAQPGLRVRRRRLLRDARRAGLGRRNRPAGTPLASGPRSPSAGRRGAVSLRRPGLRRCLGCPAGGGREPWADRGRASHRAPGRRWRAPGAGRGCRFLRRAACRRPGAAAGLDRMGPSAPALDRDPPGPGGEWAYALPGRSRRRRVDPATTLRSRRPPSLAERPRRLVASLRRGSVGRPLRRCRPRWRALAIGRLQPPAAGRGKAAAQSRRGRRRATVPARSGRQRAAPGRGLEPVRRTGRGCPGVLLHRGGGRAPAGAAGDPSRRAACRGAAWRRATAGGGRPVASAGLRLWAGQRRKRPRFLLSAAQCPPPRRSPTTTAAASVAAWRTDLDAFAGVRCRPAVLDPARFRRGRAELPGQQRLRPRLSAALARPVGAPGVARYRGRAGAAGRGGTDRPRPGLRPWRQRRRLQRVARPGLPRWPARRRQSLWGQRSVGTGALHPQVRG

SEQ ID NO: 20055 - protein, 71 aa, Pseudomonas aeruginosa
SPIPATSPCARRSCSGACRPGWPSPTPSSARCMPCRTASAAISTCPTACATRRWSNTWWRSTTAPRRNASR

SEQ ID NO: 20056 - protein, 573 aa, Pseudomonas aeruginosa
SPSSTPWVSTRASPCTGSAAPTFLSSRATRCRTRASLPTRASRASAMSRWSMARPSEQQQEALAGLLGLGSHSARKSHYPELLARLEELEAERNRYKWLFEHAVHGIFQASLGQGLRAANPALAQMLGYDDPQQVLWSLEDMAGQLFVGGEAEMRRIRALLRERGGLFGYETRLWRRDGSHIEVLMNLLLRHDEEELVEGFVADITERVQAQQRLQTMNEELERRVAERTHELEELNRQLRQARDAAEAANHSKDKYLAAASHDLLQPLNAARLLVDTLRERGLPAAELQLVERTHLALEGAETLLTDLLEIARLDQSAIRPDLDDYSLDELLAPLASEFEEVARAAGLALRARIPRLAVRTDARLLSRILRNLLSNACRYTERGSVLLGARRRGGKVRLEVWDTGRGIPADQLQAIFLEFNQLDAGRASERRGVGLGLAIVDRIAGILGYRIEVHSTPGRGSLFAIEVPLVRKPARPAPGEAIARVSAGDPLPGRAGCWWWTTRPRFSSACPRCSASGAARCLPPPTWKARARRSMAARRMRSWSTTTWTTALPVASCWAPCARTTARRSPR

SEQ ID NO: 20057 - protein, 463 aa, Pseudomonas aeruginosa
NGVNSRFSRDSGSKAMPSSTRRLRTISSTCSLITSCTATLTRGWRSRKVFKTSGSRLPAKEGMAAMETLPSCRVKCWRSNSSVLSQSASRRSASGSRVSPSGVRLTLRVVRSSSGPPRLSSRLLIARLRAGWERCRRSPAWAKLRLCATARKARNCLTVIYLFFSSMNWKNKLNKSVRSGEALCDPAVRLPHAQSQEPEEAQQHERTRQASRHLRRGPRRPDRRHDRPRRGLRPLRDSREPDRGNPPARGQGPHGGLEQLRRRRFRPRRAAGRPADPQDDRLLCRRERPVRATTAQWRAGSRTDPARLAGREDPRRRRRHPGLLHRHRLRHPGRRGQGGARVQWPPLHPRTGHHRRLRHRQGLEGRPFRQRRLSPHRAELQPAGRHRRAHHGGRGGGDRRARRTGPDADPHPRHLRRPDHPGSLRETHRETHAARLTAAATTTRGFPRWHLPANRWRSAWRAN

SEQ ID NO: 20058 - protein, 122 aa, Pseudomonas aeruginosa
IQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 20059 - protein, 142 aa, Pseudomonas aeruginosa
AVLSRRGSLRPAAFPPRHLRVRSSRVPTRLSPWRVLARRGPGRVFFFASPPPLHGLGFCPAPGRTRGAQRRSPGEPWAGQAVPTKSGGKLLRKSHSERAPLMFNSTCRNRPAPPERIDPMWTKPSFTDLRLGFEVTLYFANR

SEQ ID NO: 20060 - protein, 614 aa, Pseudomonas aeruginosa
SARPEAMVDYGDWPSDWSAERAVAAGRDFSELKAAHGGLAWVEFDPASARSRLYLWRDGVLEEPTAPDGSVRSRVYEYGGGACCVTLDGLAWVDETDQQVRRWRAGRAAQVLGGGAQCRYGDLAYVDAWDALLAVEESHGPTGVVHRIVRLDADGARRVLVEGADFYAAPRAAGQGRRLAWIEWDRPHQPWTETRLGLAENGRTRCLAGAGGGESIQQPRFDPAGRLHWLSDRDGWWRPCAEVALAGRFADADHAGAPWQLGACSHLPLGEGRLLLSRVEAGGGQLFLREADGSERRLAADWNRFAGLAADARAFYCIAAAAGRLPALLAIHRDELRVEVLRGGERPLAEDDLSHPQAFVYGLGNGENGHGFFYPPRNARRRVDPRRPPPLLVWLHGGPTSMHSPAFDAGLQFWTQRGFAVAALNYRGSSGYGRAYRQRLRGQWGRLELRDIEAALAQLDAEGRIDRARVFVRGASAGGYSALRALACLDGLRGGASLYGVSDPLALARCTHKFEGDYLDWLIGDPLRQRRRYLVRSPVLQVGRIRAPVVFFQGGLDAVVVPEQTEAMVAGLRRSGVRVECHRYPQERHGFRQPANRAHALLAEWRFYLGLLED

SEQ ID NO: 20061 - protein, 164 aa, Pseudomonas aeruginosa
IRLARDHLRRRLPAQRRQLREDLRCAQGPAGLRPRRARRRLGRRHPGKPGGAGHRLLPVYRRFAQPPGRRGDARRRVLSQRGLQCDRRGGRRQPDGLRQGHRHRRRPWPQHPRVRRRRPAAGAESAADPDPDHRRDFGGRLAVRDHFQPGRAHEVLRGEQGGCA

SEQ ID NO: 20062 - protein, 341 aa, Pseudomonas aeruginosa
RLADRPGNHVDHGSLPFGLYRHRCTGTRHRGVRLHRPRAADRSPRAGSDAPDRWQSGTDDRQSRRHRPAREDHAREHAGRAGLLQRHPRRGACHVAQPRRLSRPAPRPVQRGAGRTRGGVQLQRRAGTLQGDRRDLRHRLPRSDPGAGPPAPGGPPDRLQARRGFPREPRPARGRQLRHSFPLAPRDAGPVHPYQPARVEPARCRGGLWRGPLSSSRRPWPGYSAWAATPRARATTRSCWRAWRSWRPSATATNGCSSTRCTASSRPASARGCAPPIRRWRRCSATTIRNRCSGRWRTWPGNCSSAARPRCDGSARCCASAAACSATRRASGAGTAVTSRY

SEQ ID NO: 20063 - protein, 631 aa, Pseudomonas aeruginosa
PSAPTSWKSSTASCARRATPPKPPTTARTSTSPPPATTCCNRSTRRGCWSTPCANGACRPPNCNWWSAPTWPWKVPRPCSPTCWKSPGSTRARSVRTWTTIPSTNCSLRWPRSSRKSRVPPAWPCVRGSRDWQCAPMRACCRGSCATCSATPAATPSAAACCWGRAGVAARYAWRCGTLAGASPPTSCRRSSSSSTNWTPGALPSAVASDSGWPSSTVSPASSATASRCIRLQAEARCSPSRCRWSASRRGQHPARRLRGFRLVIRCRDGPAAGGGQRDRDSLQHVRAARPVGLRGAYRHRPGRRAQGARWPRAGCDPGRLPPGPRRYRLPVAGRLARGLRRGDRRGDDHRRPQRRLPPRAGPPGRAAAQQAAEARQAARGPERLARRALERVPPPGTVHALARPAAAPVQCDGQGQPAERGQAGEEEHRAEAEQVGDEAHQRPGDAQRQVDEQRVGAQRRATVGSRYQVHRFHAERREHQGEAEAGEGRAGQADPGIRRAPQQQQAEAFDAEADDRHAEAAEPVDVIGEQQPGADEATAEGTQAEQCVGPATAGVVKGDEGGDGAEADRPQRQAHTVRGDPAEHMVERQSLAVHQRRRQLRPGQGEAERPEQDDGRAHAPQPQPLHQQHP

SEQ ID NO: 20064 - protein, 185 aa, Pseudomonas aeruginosa
RRPEGDGAVAGDAVPGNHLGGVRRADPADAPADRRRADQAFRRAEYQAADQQAGQAQRRPALDRHREQHEQPARGAAGHAVEHRALRPEAVDDAPGVRPGEQGGEVLQADHQAGQHRAVAEVVVHVAGQHRQRDADGQVADEGEHHHRDDLQGDVLPGAVLRRRGGADIDGHVGNAVAVGCRGPP

SEQ ID NO: 20065 - protein, 703 aa, Pseudomonas aeruginosa
PRLAAASVAQFGEVAIKLQRLRVGQCVGVLHRAAVDHVAHRKLDDLAAQGARDIGDLDDLRRYVARRGVGADGLADAFAQRLVESHAVAQADEQQHTHIALPVLADGDGLEDFLDLFHLAVDFRGADAHAAGIEHRVGAAVDDQPAVDGFLGVVAMGPDAGKAGEVGVVEPGAIRVVPEAQRDRREMPGADQLALAAGEAAAVVVPDFHGHAQRLALQFAAPHRQHRVADGEAGNDVGAAGDRRQAEVALQLAVDVVEAFVGQRRTGGEQCPQAVQAVAVARAHAGLLERRQVLGAGAEHGDVLGVDEVQQALGAGVERRAVVEHQAGAHRQTGGQPVPHHPAAGGVVEQPVAVAQVGVQAVLLEMLQEHAAGGMDDALGDSGGARRIEDVQRLLEGHRGEDRLALGLVEPVPQRDLRLAAVVLRLRLRTVVGHHQQLLQAGQAGEHLVELGGQVQRLAGVAVAGTGDQHARFDLAEAVDHALGTEVRRAARPGRAEAGGGEHADHGLPGVRHQRGDPVAGAYAQGGEALLQARHVTGQFGVAEHLAATVFAHRDQRRGIIAAAQQVFGEIQRGAGEPARRGHLRAFLEDRTRRLLEAHLEEVDDGLPERLAPLHAPGMQRRVVDQAEGVPLVDEASEGLHATGGDAFGGRAPERCGHGVSVLVVVPGHAGSITGPAAACLTPWTGPAAAPASASRCHAAARR

SEQ ID NO: 20066 - protein, 268 aa, Pseudomonas aeruginosa
IGKTNLTNQSAAEKLCATRQSDCRTHNHKSRKRHSSMSGLDKRVGTYEEALEGLTDGMTVLAGGFGLCGIPENLIAEIRRRGVRDLTVVSNNCGVDGFGLGVLLEDRQIRKMIASYVGENALFEQQLLSGELEVELTPQGSLAEKIRAGGAGIPAFFTATGYGTPVAEGKEAREFNGRHYILEPAITGDFAIVKGWKADHFGNVVYRHTAQNFNPLVATAGRITVVEVEEIVEPGELDPTQIHTPGIYVDRIIQGRFEKRIEKRTLRA

SEQ ID NO: 20067 - protein, 296 aa, Pseudomonas aeruginosa
RRPLQRQEVSPDGTYPRTDGAARGARIEGRLLRQPRHRHPDPGGQLRAGRHRRHAPVGERPARHGRVPQRGGSRRRHDQRRQADRDRPRRRVDLRLGAVLRHDPWRPRRPHRARCLRGGRARQHRLLDDPRQAGQGHGRRHGPGGRRREHHRHHDPRLQGRRVQAAAVLHPAADRLRLHSQGAHRPGLPGDRGRRLHPPRARPRGQRRGDRGEDRRQADRPRARGRKMNFRNPRPARRAPLSVVPGFLARGPLRLPRPPSRRPVPVAARGGAAPRRAASRRARSSRASRAALSPPR

SEQ ID NO: 20068 - protein, 127 aa, Pseudomonas aeruginosa
EQSEGWNMTYLQQHARSIAEPAAFWAEQARSLAWYQAPANILESLPDGTHRWFADGRLNSAYLALDRQIEEGRREKTALIYHSPVTGTQDRLRYLAAAPPNWAPWPAPLRPSGVRKGLPGESLPSRW

SEQ ID NO: 20069 - protein, 109 aa, Pseudomonas aeruginosa
VGAHKIGLDPAVKSEVMKQSSGGNWALNLYNPWPGVMPQAPASNGYAGGFQVRLMNKDLGLALANAQAVQASTPLGALARNLFSLHAQADAEHEGLDFSSIQKLYRGKD

SEQ ID NO: 20070 - protein, 90 aa, Pseudomonas aeruginosa
RPALPPTKKLPSKAVRAVAPYLQSQYREFFQLSPKAQKKTRRLTGPYSWGWWAMEVSALGVLYGWDDGVLRASPHYLGDLVDYARARGDA

SEQ ID NO: 20071 - protein, 283 aa, Pseudomonas aeruginosa
  UNSURE (217): Identity of amino acid at the above locations are unknown.
ATGRRSCPPAAGDERGGQVEAGAEHEVEQGDEHEDLRRVDHHPVAHLGGDEGQLADADHVGQGSVLDQRHPLVEEGWQHHRQRLRQDHQAQYLPRPQSERAGGRPLPGGEAVDAGVHRVGEVGAADQRQRADHGGQRRYVDMEDDRQQEVCPENQHQHRDRAEETEQRHQQQARLAGQHREGHAEDHAEHRRSQSGERRQQQGQRRSADRAVRVCAXQQVRQVVPHDRQIHLRHLPGGNGGSAATPGRKLPSRPWRPCTKRVANPNALEGLQRSRFPPCPQNL

SEQ ID NO: 20072 - protein, 198 aa, Pseudomonas aeruginosa
  UNSURE (95): Identity of amino acid at the above locations are unknown.
APPISDSAQTTVASAGTSTWKTIGSRKYVQKISISTGIARKKPSSATSSRRGLPGSTARATPRTTPSTAEASPESDASSRVSAAPPTGPSGYAPXNKYDRLSHMTDKSISGTSLAVTAGLLPPLAESYHHGHGAHVQKGWPIQTPWKVFKGLGFPLAPKTYEQPRPGPMGHPPAKEILPPPFLFLPPSPRGKKPLRQG

SEQ ID NO: 20073 - protein, 152 aa, Pseudomonas aeruginosa
  UNSURE (144): Identity of amino acid at the above locations are unknown.
GRMAASPAAPAAGSPGAIPATAAVRARGRPPTARRGGCGCRRTPSGRGRRRRSATARRPRWPAPVRRHGRRSAAGSMSRKSASAPGSRGRNRAAPPAAGAACRAAPRGPRRGPRRAPPKPVRRATPAAGSAPLRRPGRPGMRPXTSTTGCPT

SEQ ID NO: 20074 - protein, 243 aa, Pseudomonas aeruginosa
  UNSURE (33): Identity of amino acid at the above locations are unknown.
LSARGGSRPAVTAREVPEMDLSVMWDNLSYLLXGAYPDGPVGGAALTLLLASLSGLASAVLGVVLGVALAVLPGKPRLLLVALLGFFRAIPVLMLIFWTYFLLPIVFHVDVPALATVVCALSLIGGAYLAHSVYAGIHSLPAGQWAAARALGLRPWQVLRLVILPQALPVMLPSFLNQWVSLIKDTSLAYVIGVGELSFVATQVSNRVMVHPTEIFVFVALLYFVLCTSLDLAAAFIARRRRA

SEQ ID NO: 20075 - protein, 326 aa, Pseudomonas aeruginosa
  UNSURE (15): Identity of amino acid at the above locations are unknown.
DGFVGHVGQPVVLVXGRIPGRPGRRSGADPAAGVALRTGFGGARRGPRRGPRGAARQAAPAAGGAARFLPRDPGADADFLDILPAADRLPCRRTGAGHRGLRAVADRRRLPRPLGVRRHPQPPRRAVGGRPRARTAAVAGIAPGDPAAGAAGDAAILPQPVGVADQGHFPGLRDRRRRAVLRRHPGEQPGDGPPDGDLRVRRPALLRALHQPRPGRRVHRPPPAGMSGGRWLRRRRAPARSRPGRRGNAARRAGRHRPSRRARPAPTPPWPTSPRSRGRSGGGSSSAPWGKAGRTPGTGFAGKAQLPERPWMEVSSLAAVPVFNHE

SEQ ID NO: 20076 - protein, 321 aa, Pseudomonas aeruginosa
  UNSURE (10): Identity of amino acid at the above locations are unknown.
RGVTMSFPKXFLPPPPPGNPPFFFPPPPFFIFSPPFLGGAPPQKKKPPPPRKKNTPPLFWGGGEKKKLPPRAVKPKVQRNGRRQPPRRYLVAGRLHRSDNPYPLRAAAWPARKRGDQPGRVPPVLLPERAERGAHLSAGHRPRGLGFADREHPHHRQDQGPGLVSAGLDPRRARRRWRSAADRGAAGPGQSAGTVQADPGCAGLPDPWFEQEVRHRHPHQPWLLPHVQRRRDPPVLYDQRRHQRAYHQRALQVRREQRQGLPGGAYAAERPWRPVGGGQAHCGDQHPAQARRPGQAYPVELGRGPRSGGLGGWRAGGNRPG

SEQ ID NO: 20077 - protein, 248 aa, Pseudomonas aeruginosa
NQRYSEMVAANPRVDTWLPGVCTEVIIPTRFVLPPGPRESVVINLAEYRLYYYPKGQNVVHTYPLGIGREGWGSPIANTRITAKTKDPAWYPPASIRAEHAADGDPLPTVVPPGPDNPLGPYKLTLGVPGYLIHGSNKKFGIGTRTSHGCFRMYNADVTHLFSMISVGTSVRIINEPYKFGVSNGKVYLEAHTPLNDHGDPSVVDKHTAVINTLLKRDDLAKRIQLNWDVVREVVASEDGVPVEIAQE

SEQ ID NO: 20078 - protein, 168 aa, Pseudomonas aeruginosa
  UNSURE (92): Identity of amino acid at the above locations are unknown.
GLSLRCRRPATRYRRGGWRRPFRCTFGFTARGGSFFFSPPPQKRGGVFFFLGGGGFFFWGGAPPKKGGEKIKKGGGGKKNGGFPGGGGGRKXLGKDIVTPRQVSPGGLRPTRTGAPRAFRLPVVSVNRDTAAGRADAPVPAAASAAGPAAACPTACVSPKWPSSPSIW

SEQ ID NO: 20079 - protein, 362 aa, Pseudomonas aeruginosa
  UNSURE (37),(126),(151): Identity of amino acid at the above locations are unknown.
YVALGLGHLLALTVAHQAVDIDGLERDLRGAVGVLHXVHGEHDHPRDPEEDDVEAGDQYVGGVEGLEELGLLRPAEGGEGPQAGAEPGVENVFVLAQLDLVAELVLGAHLDLVAADVNVAGLVVPXRERGVAHGEIGEYGYAHGDDGRHVXGRAPVAEQRQAEQEQRADQAAADVVGDVPHRDHAAALLLRPPVDHGPSARRPAHALGPAVDEEQDEHDGDAGGSPVRESENEHHRRRHQQAERQEDPWVGTIRDQAHDEFRQAVGDGDGRHRDAQLTAAVAVLDEVGHGQGEVLAQQVVTRVADEDTGEDLPAQAPVGAVHLGIGQWRLVWRGTKDSEHRELRLLLCRAFLRGCEHYIFRK

SEQ ID NO: 20080 - protein, 380 aa, Pseudomonas aeruginosa
  UNSURE (219),(244),(332): Identity of amino acid at the above locations are unknown.
HFRYFFIYEKCSVRNRVKRRDTTTSGARDVRNLSSRATPGATARCRGGQHLPAPALADLRRYLHRLRGLLPAAQELLPGHALPHRGRLQPRSTGRRDVGHRHRLRPVEIHHGPGLGSFQPTGLPAVRPVGVGGGDVHFRIRALGYLQRRHHVRPALHQRLGPGHGLAAERTDHGPLVVAEGARQRGLGVERRPQRRRRPDRPAVPARPGAVRRLALGLXRAGHRRRGRSRIRLFRHARHPAPGXVRRGRQRLRRPRRGRGAHQAQARQRGRVAPGRRRSRHLVQLRPVDLLHPRLAAADRVPQDLPPHRRTGHRLRHHLLLGRADDHAHHAXGEEPRRHPADPVQDRLCPRPGARRSGPEDVQVQGQRTRPAGHRRGHRP

SEQ ID NO: 20081 - protein, 371 aa, Pseudomonas aeruginosa
  UNSURE (201),(226),(315): Identity of amino acid at the above locations are unknown.
KGATQQQAELAMFGIFRPAPHQAPLPDAEVDSTYRRLRWQIFAGIFIGYAGYYLLRKNFSLAMPYLIEDGYSRGQLGVAMSAIAIAYGLSKFIMGLVSDRSNPRVFLPFGLLVSAAVMFIFGFAHWATSSVAIMFVLLFINGWAQGMGWPPSGRTMVHWWSQKERGSVVSVWNVAHNVGGGLIGPLFLLGLALFGDWRSAXYVPAIVAVGVAVFAYFAMRDTPLPXWYDEAGNVYVGRDEVEVRTKHKLGNEVELRQDEDVLDTWFSSGLWTFSTLGWPQQTEFLKTFHPTDVLVTGFDIIFFWVARMIMLTMHXVKNPDGTPQIPFKTVYVHGLVRDGQGQKMSKSKGNVLDPLDIVEGIDLDTMRKGAI

SEQ ID NO: 20082 - protein, 84 aa, Pseudomonas aeruginosa
  UNSURE (47): Identity of amino acid at the above locations are unknown.
TPSAQRRAGRQGCGWRFADPRRRGVWLPARAEKGMAGGSDTPAEAHXVRSFSHMKAPVSDRGFFISDQCTQPVTFPLFFHLRKM

SEQ ID NO: 20083 - protein, 219 aa, Pseudomonas aeruginosa
  UNSURE (173): Identity of amino acid at the above locations are unknown.
PRRTAGRPERPGTADLRAHVEMQQAHALVETGLAEALDHRQQLGGGKAELGLLATGVCPLRRSQRGQPHAQADLGLHADVGGLLDHQLHLGFLLDHDEHVVPELLPHQRQLDELAVLVAVADDGAALRGQRQHRHEFRLGACLQADGDVLGGDDVLHHRFLLVDLDRIQRGVXVLVFEALDVRVEGAGELAHAVLQDIREAHQQRQAQARLAQLADQLV

SEQ ID NO: 20084 - protein, 166 aa, Pseudomonas aeruginosa
PRRIRVVKTIGETGVHQLVGEDDGVLQTHHAIAVVDQLGDRLLLHRLVDHVERQAGRNDLEQQICEPMWKCSRRTPWSRPAWRKRSTTDSSWAAERPNLAFSPPVSAHFDEASEDSRTRRPTWGCTPTLAASSITSCTSDSFSITMNTLCPSFCPISASLMNSRSL

SEQ ID NO: 20085 - protein, 71 aa, Pseudomonas aeruginosa
  UNSURE (7),(14): Identity of amino acid at the above locations are unknown.
KEVAQRXGTGDAAXGGIFKGRRGGDPGRASRTGDGRTLKGRFQGEEVRGLTAFSPAESGQSRHREAAPALS

SEQ ID NO: 20086 - protein, 375 aa, Pseudomonas aeruginosa
  UNSURE (8),(24),(155): Identity of amino acid at the above locations are unknown.
ADFLGFPXLPPSVAVNTATSHPPXSLHHRRAGPGPSGDPGARPTPNIEEITAHGRSTDSQRRWQQLDRGRQPRRIRHPPLGCGLFRHQRWRQCRSASAGCRLDAHRSIRAGRPTARGGPEPAAAGALPGYPAGPRAQAHRRLRREHRAPRIPEPXHRAVSDQGQPAGSGGGEHHRHRERLHRPGGRLQAGTHGGAGAGPEGRHHRLQRLQGPRVHQAGADGAEARAQRVHRDREGIRGAAGDRGGRQRRRAAPGRPARAAVLAGFVEVGRHRWREGQVRPFRRPAAVGGRALPPGRSRPGRAPAAFPHGLADLLFQVVPAGLPFDVVNQSMKKKAISKLINHCYRVVGLKDTVIFADQLMYTGFAYRLHHANAAR

SEQ ID NO: 20087 - protein, 361 aa, Pseudomonas aeruginosa
  UNSURE (39),(55),(185): Identity of amino acid at the above locations are unknown.
RRSPLQRAGSPGTGRPRQPFPRMGDCGYPHERISSAFLXYRPVWRSTRQRHILRXASTTGVPAQGHPEIPAPARPRTLRRSPRMAARRTRKDDGSNWTVADSRGVYGIRHWGAGYFAINDGGNVEVRPQGADSTPIDLYELVGQLREAGLSLPLLVRFPDILQDRVRKLTGAFDANIERLEYQNXYTALYPIKVNQQEAVVENIIATENVSIGLEAGSKPELMAVLALAPKGGTIVCNGYKDREFIKLALMGQKLGHNVFIVIEKESEVQLVIEEAANVGVQPQVGLRVRLSSLASSKWADTGGEKAKFGLSAAQLLSVVERFRQAGLDQGVRLLHFHMGSQICCSRSFRPACRSTWSTSR

SEQ ID NO: 20088 - protein, 149 aa, Pseudomonas aeruginosa
GHPVAMAVKETDFAAAWIGRVESRLASPCCQAPNKSRRIRVTPCRSSTNSMASADCRELNRLLQVLEHRLNVVEEVSSLDMMLTLVGAGYGIGFMTATKIPISQRPDVVIRPLAQDTAVITTYLLRPESSNSSVSLDRFIERLRGPPDD

SEQ ID NO: 20089 - protein, 86 aa, Pseudomonas aeruginosa
FLGDGLVGQFASPCLEASNSPNNLTTLRLTQTSYHEDFPSLSYRFLGPLMHDATSPRPQLRLAIAPGVASSYLAALLALQRAEEPE

SEQ ID NO: 20090 - protein, 119 aa, Pseudomonas aeruginosa
FELNVTWLNCLDCSTLPSMEKRTVRRGRPPGTTTFDAEPALAFGAAVRVARLTQGVAQEELAAKAGIERSHMGKIERGEHMPTLALILRIAAGLKLSAAELVSAAERNLRAAAHDSDRH

SEQ ID NO: 20091 - protein, 111 aa, Pseudomonas aeruginosa
ASDSALVRSPISGPASSSTIAARAEPLCPPKVSMAPRNAALASVVGSPCSSTPQPSGIGLPARSCNWISPRATALVAKSKTNGGPSGRGQPKAIGLVPKIGLRPPAGATQA

SEQ ID NO: 20092 - protein, 172 aa, Pseudomonas aeruginosa
QSCKAIPNSPAAPQETLPRPATGPSTFPQPGRRPPHASSSYRHHPTRRHRLRHPRLAAGGARPLRAQPHGFAEPRRQGYRRGLAAQRRSLGPAQRPDERTAPRRDEPRAAARRHAHAPAGTTDGRGHRYPRQGGKGIPPLAGPGRGARVARPVRPAPAGVPRRTRRPARAVP

SEQ ID NO: 20093 - protein, 164 aa, Pseudomonas aeruginosa
DRRHDRQRPRGHRHRGVRDARERPARPADARRGRGRRPRPGRDRRARHADQRAHPGDRQRCRGAGPRRPRGRSQPGEHPRRCRADHPGRRADPRRQPRAVAPGQRPQGHDRSLRGLTRKRARASRGAAPTARRRPSAPGSRPRPGDRGASGSGRRVRAARSRPG

SEQ ID NO: 20094 - protein, 943 aa, Pseudomonas aeruginosa
PLDVPVDPAMANDAGGVVRPYAKSPSRSRAPRTKSSPDSAWQRAERLERPGAPSRPAGLNASAPTALLYSMQPTTSTGTEQDSADMAQPFTIEPDPNTLDHPPAFLANGGAVGKLLLSLDAAGSPLGPPDAWSASLKTTMATLLPAKAQIVLFWGAEFVALYNDAYAPSIGDKHPRALGRPAIENWRELWDDLEPLLRGVYETGETFAAKDRPFYIERHGRGETVYFDVSYSAVRETDGSVGGVLCIVTETTERVRFERRQAFLLELGQTLPSLADPLEIEATALRRLGEELGASRIFFGEDNGDGMTFQVHRDYLHDGRSAVGRHRYLAFGATLSGELHTGRSVAREDLAGERGMSLDEAASRARLGLGATLHVPVLRHGRLEALLAIHFAHPQALGEDSRRLAEEAAKLAWTSLTHARAELALRTSSAQLAAMFDQASAGIAVCDRNWRFTRVNDRYCEIAGRSRETLLGLRMQDILDPADFALPAAPGGATGAAFEMSGRYVRPDGDTVWVQNQVTPLVDEQHAASGLLCVCMDISARVRAENELRELNESLEERVATMLAQRESALAQLHEARKMEMVGQLTGGIAHDFNNLLTPIMASLELIRRRLDDARSADLIDGALQSAERARNLVGRLLTFARRQTLKPQAVALRELVEGMHDLIERSLGPTIEVRIEIPERLPAVVVDPHQFELAILNLAVNARDAMGEGGRLEIGARTDLVIDGAVDGLGAGRYVCLEVADNGGGMPAEVLARCMEPFFSTKGVGKGTGLGLSMVQGLVAQSGGGLGIHSEIGKGTRVSIWLPITAEQTQSTAESCPDAPEALRPTHVLLVDDDRMVRYTTALLLGDLGYQVSEAASAEEALGEVERGLAPDLLVTDHLMADKTGVQLAEELRQRFPQLPVLVITGYANLRPEQLNGFEVLTKPFRHNELAERLARLLEASP

SEQ ID NO: 20095 - protein, 408 aa, Pseudomonas aeruginosa
VRCRRSPAHAPAHRGGGTRRGTGTGPRIRRADRPGRAAGGARRAAIGVPGARRGGRCGAVAGQRVAGRVNRQRGRPRGRAGDGAKARAGVQRPLAPLRVDPRSLRSISPAETDMTSLTQHSAAPVRMERLALPATDGYPLSAYRYHAPGHAHGNLLVAGATGVAQRFYRRFAEHAARQGFDVLTLDYRGIGESAPASLKGFAMSYLDWAYRDLAAAVELLGREERPLYWIGHSFGGHAIGLLPDHGRLAACYSFGSGAGWSGWMSRREALKVRHACGPWCCRRWWPGKGYMAWSLLGMGDDLPLGVYRDWKRWCRHPRYYFDDPAMRHLHQRYAAVRTPCLFATALDDPWAPPRSRDAFVEAYRNAPLETLDLRPDGGPLGHMGYFRAGAEALWDDALRWLRRHPENA

SEQ ID NO: 20096 - protein, 610 aa, Pseudomonas aeruginosa
KTSESAPCTRCRCPFACSPSHSGWAWSPWSSFSNAAAPKAATGVSPGDRHQGRQLCRDEPLLPADPPHLPAGHPGRAAGPGLRPVPDAATLKNPPTVHFATMTGAFAGAGRLRLPYRSPLFQTREQGNAACQSSALRGAGAGDLHRAGLREPQPTRATRGKPRPWPVEGGGNPRRRAARPVVDALPGPWAEPPGGRRAAPQPRPGRSRCPCPRAPRPSARRTGRTLATDRGRLWLPVWARRRRPDPRRSHRRGPAQPVETHRPPRPVLPVGPVGRSPRPHRRGEGGCRSGASGARPAQGQRGQPDHPRLRPRLRPGATGRGTTPIGRSARREPGAERTPARRRPFQRAAATPAAGLARADPRRAADARGAAARGTLRTGAAQRALAAPVGRSCRDLRRHTATAPCPAHRRQVEPAGAPPGRPRGRTPGRRRRRPARAGRSRAVTAHQFPRSAPKHTAETIAGIGGSGAMAYAAGPMMSWRFPNRESARGRLDSAAAERDAALARFDGAVLGALREVERALALNAGERQRRADLQRALDEQRHAYRLARSNYRAGALDALELLDSQRSLVADRARLVDAEMRVAERQVELFRAIGGGWQAAPSPSHQENGQ

SEQ ID NO: 20097 - protein, 611 aa, Pseudomonas aeruginosa
GGLPRQPSLDLNRPGACRKRHNRLEHIENLQKIPSNHVRQFQIAPQPLKKPFRAPLQDQAPSHSPVGDHPMLLRRIAITPRAVIGFAILASLLVALGLFAHNRMGSLNRAAKDIGEVWLPSVEASAQLSGLMSELRLGEMNHVLLHDATRMRQQEQRMDEVIATLARVEREYRPLLVLDEERALLDQFVQRQQEYLEGHAALLALSRDNRTDEASVLMGRAQLQRYEQVQRTLKQLIALDREAARASTAEAADVYSRASTAILAVLLVALAASVTIAWLLTRSIVVPIRQAVSCADRIAARDLTGEIASDGDDEPAQLMKAMRSMQASLHDTIEQIGDSAALLAAAAEQLNAVTEEGNRSLARQNDEIEMAATAVNEMSAAVEEVARNASSTAEASSLSERAAGNGRARVGQTVRSIRQMNAEIGQTARLVEGLASQAQDIGKVLDVIRAIAEQTNLLALNAAIEAARAGEQGRGFAVVADEVRALAHRTQQSTHEIEGMIASVREGTDTAVSAMRENDQRARQMLDEAEAADHALGEIAEHATRINERTLVIASAAEEQAHVAREVDRNLVNIRDVAVQTTQGAEQTRGASHELSRLANDLKGMIGRFVV

SEQ ID NO: 20098 - protein, 741 aa, Pseudomonas aeruginosa
PASELGRRAAQHQLPAVALLHPVVALALATEEHQGQAAAFEQRDPGRGRPPGARLAGQPAREAGGIAAQVVATGFRHFAIAQLQVADRGRLVLLQGPLPGEIGSAEKNQTAGHTDTCAEKTAEQANHPGELRACRHREISFKPGTSDNTANAARHPRFERQRAPGAAGLRSSARPPAHGRATVHNFAPVEDTYQFEQCPAGRRAAVRTAAPNRARFSASDDDVGLGRLADQIDREIGMGVPAEVDRQAAGLARRVVGQDRLAGLAGEGVDVLQHQPAVDEGIQPGQVDLVLAADEVAQGIRRRRGGLGDIAVDEGVGPRAAPQLVRAEAAVEDVVAGAALEHVGHVVADQQVATRAADGVFHGDPGSDRHITLQPADIGQRLLVEVDLLVLAEAGEVQGVVAAGVPHREHQLGTGRGGAVEVALGVGVEAVHRVAGAGGQVGPVELLDRRDVVQQRCRGIGALEVLAGVLLFPVAHHRIGAGVLGVGSVGVGGIALAGVVVAGVAQAQGMADLVGQGLASVVAVGRIDVGAVAAVDQVPGLPLERIRYIRQEGERRTADTTAEVAEGQVALVALAGVDEVDIGDVRPGLQRQLGLGLLLRGEGAELAQRVDIADILPRRIEEVVRFGQERIGQGQHRVARRFLPRRLFAEDLLRRLVDGIGRMAIDQFVPTPRIGMQEVVYLGIRIATTFQCKRIAGHCHIPLSCKGNNSDTIIGWIIAVIGQIRPKSKLTQLIFQCPQVS

SEQ ID NO: 20099 - protein, 155 aa, Pseudomonas aeruginosa
GSRGPCRPGRNGSSPCDAWPGASPPGSRRRRTAERSTGCRRCRSRSAGCRCSPNRTWTCRCWRTGPGAAGSRRGSARPRSGPRPPRGAARPARDSRPAPGRARRCSWRGSAGAPGSVRRAAPGRRSPAAPRPAAPARAGRHPGCPAPRFPGPGPG

SEQ ID NO: 20100 - protein, 149 aa, Pseudomonas aeruginosa
LPCGTPPRVGRCASAPRRCSGGSARSDRCSPIAGRSPRPVGAPVRATGCAACSLPRRGRAHRSTGCSTGVVAGAGCPRSGATLRAGRAAPRCSPAMRRVRWPARSGGCAATAAATPGARRGSAAGPARPAPRASPGSAGRRIRPAGAPG

SEQ ID NO: 20101 - protein, 143 aa, Pseudomonas aeruginosa
VSTRRRAARAWGWAPRCTSRCCATAGWRRCWRSTSPIRRRSAKIRAAWRRKPPSWPGPRSPMPARSWRCAPVPRNWRRCSTRPARASRYATGTGASPGSTIATARSPAVRARPCSACACRTSSTPPTSPSPRRQAERPARRSR

SEQ ID NO: 20102 - protein, 641 aa, Pseudomonas aeruginosa
PSRSATTNSPNASPGCWKPRREAPGRRNASAHALAALHRQVQGFLHVQPRRAADVAVVQAVAALRGQDRCGEVLGIGRLEIVVAADGHGAAPEQHADLLGSQPRVEGKHGGDRAGDHRRGIGGAAVHLAPRVPLQGRGMGTGGGGDIHPHVDVRGAALDRVGRVVHRQALALAALVAAHHQQLLGDERGRQAVFVGTGVGRAVAGGVDHQHVRMLLAQPEEELLEQLLVAAHGNPRAHQRIHLVAVDVASADAVDAPAPVEHPHAILHQVHRSGDVGRDASVGIALDDHFETLAGAVQPTQEATVAALVPARGEDAGDRRTVVVGTFGIARVEAGTRRGRLAGTEVVGEVGGVEVDVALDHPDAHRAGLQRGLAGADPTLVIVHRVHETIGRPLVGVAVRLVHGPARRLGFLALLRRGLLHHHGVHAGLAADAEDQRVALDEVARRQAQLVEVQRRDRADHPRAIFIGQAFGLPATVVVLLDQQADQVDVGGQAIHVLRHLVGTGGEHMAAVQGQPYRIAAAPALLQPKRTAGVATAVQAEPQAVALAPQGGGRQFAAVQQQARQAGAQAAHAQAPLLPLAGQEIAAALQALQAQGCFGGYQRTAQGREKDGENGTAQRHGLGFRNGDLLFRPPGETLRSG

SEQ ID NO: 20103 - protein, 281 aa, Pseudomonas aeruginosa
LEEVSAPPTQAQERGIMSEANSGPGRVTREQRGHLFLIGLDRAGKRNAFDSAMLADLALAMGEYERSEESRCAVLFAHGEHFTAGLDLMELAPKLAASGFRYPDGGVDPWGVVQPRRSKPLVVAVQGTCWTAGIELMLNADIAVAARGTRFAHLEVLRGIPPLGGSTVRFPRAAGWTDAMRYILTGDEFDADEALRMRLLTEVVEPGEELARALEYAERIARAAPLAVRAALQSAFQGRDEGDDAALSRVNESLAALIGSEDVREGVLAMVQKRAPAFKGR

SEQ ID NO: 20104 - protein, 202 aa, Pseudomonas aeruginosa
RASPCPTWTGPTGTSPPPSSCSAGRSGRCTGSATPSAATPSACCPTMGGSPPATASAAAPAGAAGCRAAKRSRCAMPVDPGAAAAGGLEKATWPGACWAWATTCRWGSTATGSAGAAIPATISTTRRCATSTSATPQCARPVCSPPPWTIPGHRRARGTPSSRPTATHRWKPSTCDPTVDRSDTWATSAPVQRRCGTTPCAG

SEQ ID NO: 20105 - protein, 98 aa, Pseudomonas aeruginosa
DGIRRTPERPARARHAPVAVVPSPVRRRILAGRGRRGVPSRTQPRRKPRPGFRRETATKADSFAGMNRCSRQIHRISLLAIPAGLLAQGCGPYLMRQR

SEQ ID NO: 20106 - protein, 373 aa, Pseudomonas aeruginosa
LALLPAQAACACLTVPRSFRHGSKAMPLASHLRCVALALGISTALGCANRNQPAPRAESLDPGLSRVAGTRGDALPAQWWTLYQDPGLNHLVAAALRHNRDLAAADAHARALLGHLRGAQGERWPRTEVGYGYQYGRDGDDQTLAEATDEDLHSQWKHTVRLDLSYQLDLWGEVRARIAAAKADAEAAQAARDLLRVSVASQTTLAYVRACALARRAEVQRRSVGLLDASLALSERQLAAGLSSELQRRRLLALRERTRAALPMLEARRRAALYELALLSGRSPRQLDAPAATCAGIPQLRRALPTGDRWSLLARRPDVRAGERPVAAADARRALAEAELLPRINFPGRRRNIPQRPSPASAAAARWHMRPAR

SEQ ID NO: 20107 - protein, 731 aa, Pseudomonas aeruginosa
IAPYWKNNSMRIVRPLSTRPGHRLHARRTIACTSFAVSMERAPVFLRIGLRQGVQRRRAIRRRAVAAARRRLAGNEVRRHQFQVGFVQHPGVETQACPGREVVVLGLGQLVHRAVQRLLGVQQVEVDPHPGGDALARGHHQRPRRIHGHLVGADLRRAAAALVVHLAHLVEGLADLVVQVVMALLHAMRGLARRRQGLAAGEQRNAQLDADAVGLVALVVGVLRTGLGLAGAGVQAQARQEVGAVLLDLVAGHVHRVAQRGQLGILGQRQVAPGGVAGGAQRAHLEAFAERRQVGDLQRRPDQPLQLAQGGILAVPRLDFLGLGQVEAGLGLQGVGAGAVAALELALVELELLAVGAFLRPRQFDLVLGQQRAGIGFQDPDQQFLALAAEALVGQQRLGHALAVAAEGLVVEQRLLQAEGGDVAVVVAVFLEIAAGGGLGHIGPAAPTVVAVHQARQQRRAAERTVLPAGLVLLDRGLELRVVLQGQVIAVQQAEGEGVLAQQQQEGAEQPGHQAAHGHRSVLRQRHVGAVEQGLEQVIEQRALAGADEHLHRHPRADLQALQLTHRGRVDLGAQRVVGLLVLLVEQAVGADHGHLAGDPRGLALVEGGEQHLHRQPAVDPVDQVHRELALHFQAVAVGHDVHQQFAGADHPAIGEHLQAGHVAADRRADLGVAQFVARRGQLLPERPRIDLGFRQLPVDFLAVLLLALGDAHLRLGDALADLPEATAALR

SEQ ID NO: 20108 - protein, 372 aa, Pseudomonas aeruginosa
  UNSURE (92): Identity of amino acid at the above locations are unknown.
DVLDHPAQRMLHRLALAGDDHRGRHRHALVERREGGPEQRAAEAEQDQQPAQSRIGVLVAFHRAGHSTPPWRGAATTWRRAVAGHPVVRALXRRRRGALVVQGGEHLVALAVQVQLAGVQRRPAVGATQQRGPRGEISRHRAATRLERLDRRQQRMLPAVVEVRVGFVEHHQGRRAVQRPGQGDALALAAGKPGAADAEHGVVAHAAGAGPVHGPRPGAPPPPPCRPAHRRSGRCFPPPCRRTVRCPAAGSRCAGRGSRARTGGSRRRPGARCRAGSARCPALPAPGSTCRSRTDRSRRPPSRPGSPGSGHAGCAPRCRAAPRPAIPAAGGHAARAIPCAARGRGIRRAGRSAGDRHRAPRPTASTRRSVGR

SEQ ID NO: 20109 - protein, 112 aa, Pseudomonas aeruginosa
LFRNGVPSMTKDEKEKTHVDAIIERYKDLMVEIPPADRQPGLSLLWPVPAQPAIDKGVRQAENWLADQIEGQLWTAFAFGRDSLPTPMQKTAFEVAFLTRLQQRLVAARRSG

SEQ ID NO: 20110 - protein, 333 aa, Pseudomonas aeruginosa
TPPGVPPGTGPDPAVPGRSPGNRSHRPAPARRGAGRVADILRRGQRRRHDLPGPSRLSPRRPLGGRSASLPGVRRHPVRRTAYRTQRGAGRPRRGARHESRRGGEPRAPGAGRHAARPGAAPRPAGGAAGDPLRPSAGARRRFAPPGGGSRQAGLDLAHPCPRGAGAAHQFRATGGDVRPGQRGHRGMRPELALHPGQRSLLRDRRPFARDPARPAHAGHPRPRRLRPPRGARRSDRRGVRDERPIRSPRRRYGVGAEPGHAAGGRAACRQRPALRVHGHQRAGTRRERAARTQRKPGRTCRDHARPARKRPGAASRGTQDGDGRPVDRRHCP

SEQ ID NO: 20111 - protein, 391 aa, Pseudomonas aeruginosa
LQQPADADHGLAGTDPPAARRRPLRRPHRRRATVRRTGAESRRSPAHLRPPANPQTAGGGPARAGRRHARPDRALARPDHRGPHRDPGTPTCGGGGSAPVRTGHPQPRGERPRRHGRRRPPGNRRADRPGDRRRSGRSRRRPLRVPGSRRQRRRHARRGAGPLHGAVLFHQGRGQGHRPRPVDGPGPGRPVRRRPGHPLGDRQGDPGEHLAADHRGADAIHRRKLPGRTGGVAADPRAAGRRRQDGALHHRAAARRSRLPGQRGGVGGGSPGRGRARPGARPAGHRPSHGRQDRRAACRGTAPALPAIAGAGHHRLRQPQARATQRLRGVDQAVPPQRTRRTPRPAAGSLAVRPRAGGTPQRTRSRLFTARSRAFCMSSRAERPTSRWSRR

SEQ ID NO: 20112 - protein, 357 aa, Pseudomonas aeruginosa
VVRPSMFFATSSGPAASTWLPFRVSHTGLLLRPPCSSQSGPLAWPRRSRRSRRPSPSRRRAVAGSSRPSSNRRGRPEPRPRTRRHHSCRSLARRSPQRSRRSRRRGVSAATKGLPRDAKRMAKTARRSGMDSASGTGTCCSDRLAKRFVQVEGGRRLARQLLQRSPGDAIDIARLAIDARQQDGAFEISHQLPAALQRLRLVEGRAVELGEGLRPVVEETADRRHQLAATIAGVDRDHAHQAADAVVLEQPGGLAAEFFQALAGRQQRVVGDAEERLGEPLVGPFENVAEQGFLVRVMVVERGLGQAAGAGQHVHGGAVVAVATEGAGAALEKLVAGDFQRTHGRFLLSIKGVDSMP

SEQ ID NO: 20113 - protein, 397 aa, Pseudomonas aeruginosa
SAARTSARACWRWCKSARRRSKAASSPAGRPPVAPLHLSCGNRHDFVDSTFRSAGADGTPGPARDRRLSAVRLPLPRAGPRPWQPAGGRRDGRRPALLPAFRRTRRAPGLRRTHPGLSRHRRIRAGKPEGLRHVLPGLGLPGPRRRRRAARPGGAAAVLDRPLLRRPRHRPAARPWAARRLLQLRQRRRLERLDVAPRSAQGAPCLWTLVLPPLVAWKRLHGLEPAGHGRRPAAGGLPRLEALVPPSPLLFRRPGDAPPPPALRRSAHALSVRHRPGRSLGTAALAGRLRRGLPQRTAGNPRPATRRWTARTHGLLPRRCRGAVGRRPALAETASGERLKDQRERAMHPLPLSLRLFAVAFWLGVVAVEFLLERSRAESRDRGFAGRPPPRPTALPG

SEQ ID NO: 20114 - protein, 144 aa, Pseudomonas aeruginosa
TTWWPPRCATTATWPQPMPMPARSSAICAAHRANAGHGPRSAMATSMGATATTRPSPKPPTRTCTASGNTPSASTCPTSWTCGAKSAPASPRRRRMPKRRKRRATCSGSAWPARPPSPTSAPAPWRDGQRYNADRSVCSTRAWR

SEQ ID NO: 20115 - protein, 300 aa, Pseudomonas aeruginosa
ANASSPPAFPASCSDAGCWPCASGPAPRCRCSRRGGARHSTNWRCSAGARRASWTLLPRPAPAYRNCAVPCPPATGGACWRAARTSARANARSPPPTPGARWPKPSCYRASISPVGAETYRRDHRRHRRQRRDGICGRPDDELALPQPGKRARPLGQRSGRARRRPGAIRRSGARRPARGRACPGAECRRAPAACRPPACPRRAAPRIPVGAQQLSRRRPRCPRAARQPTQPGRRPGAPGRRRDARRRAPGRTVPGYRRRMASRSQPLPSGKRTMNQAIREPIEHTTGETSAAPRTQTGP

SEQ ID NO: 20116 - protein, 447 aa, Pseudomonas aeruginosa
LASGIALLPCLKERGTVRQAQAACAGKSASHRREMDSRRIFQRCRIRYGPQPWASSPAGMASREMRWICREQRFIPAKLSALVAVSRRNPGRGFRRGCVREGTPRRPRPARMRRRTGEGTTATGAWRALAGLSGVLRMPSQPAQGVVPQRLCTGAEVAHVSERSTVGSQVEGFQRCVAVGLDEGVPRARRCPGIVQGGGEQTGRAHCGVALVEVAHRRVVEIVAGMAAPALPVAVDPQRQVVAHAQQAPGHVAFSRPPAAAAPGSTGMAHLERFAARHPAAPAGAAAEAVAGGEPPMVGQQADGVAAEGVADPVQRPLLPAEQLDGGGEVPVGPVQVGHGEALQACRRGFADAAIVQGEYVEALARGVFGETPVEALGDARRAGHQQVAMGVARRVVAVGGQRIAVGRGQGQAFHPHRRCGMLSQRSHVGFRRRDGAERPGVDPQGS

SEQ ID NO: 20117 - protein, 143 aa, Pseudomonas aeruginosa
AATRSCSRSSSSGCARSIRTCWWSTPPATARPTPVPTNTACRPRSSPSSCWWWAATSAASAKAWRWTTRPTRSSAAPRTSTCGWMSPPPPVPMPRPWSGTRGARCTAAPPMPRRWSPARSPPCFPSTRGCDPRRSACCSGAAP

SEQ ID NO: 20118 - protein, 277 aa, Pseudomonas aeruginosa
RAASACAEAFRRPGASRRGFQQPGEAFGEFVVAERLGQHLEAVELLGPEVGVAGDDQHRQLREALAQFLGKLHAGLVGHEMVGDQQVGRQAALDLAQGFLRRRRLADLVAEIAEQQRGGVAHHPVVVDQQHVGRPQRLRCVRAAFCGGLRLLRGDRQPDAHPGPLADLRVDAQAAAGLGDQALDHRQAEAGALAHALGGKERLHAAGQHLGGHASAVVGDFQAHVAAGAETVHCAVDHQVGPRAYFQAAAFAHGVAGVHREVEDGQFELVRIHHHRR

SEQ ID NO: 20119 - protein, 547 aa, Pseudomonas aeruginosa
RAVDEVGGAGVVEPPADQFQRGHDRRQQVVEVMGNAAGQLADHLHLACLVKLRQGAFALGEHGRDTFFQAFVEFAQLVLGAYPRADVHAHAEQAAGGMLLVHQRRDLVLHPHRIAVGANVSAAHLERRAGRSAWRRGEGEVGGVEDVLHAQAEQGLARTAGDLAVAIVDPGEAPVPVAYRDARAGLVEHRRQLRGTGAQRQLRAGMGERGPGQLGGFLRQAARIFAERLRMGEVDRQQRLQPAVAQHRDVQRGAQPQARAARRLVETHAALPGEVFPRHAASGMQFAGQGGAERQVAMPTDRRAAVVEIVAMDLEGHAVAVVLAEEYPRRAQLLAEPAQGGGFDFQGIGQGRQGLAQFQEERLAAFKTHPLGGLGDDAQHAADGTVGFPHRRIGHVEIDRLAAPVAFDVEGPILCREGLAGLVHPAQQRFEVIPQLPPVLYRRPTEGARMLVADARRVGIVVQGDEFRAPEQHDLRLGRQQRGHRRLQARRPGVRRAEGRTGRVEAEQQFPDRSSVGQEGRWMVEGVRVRFDGERLCHVCGVLLGSG

SEQ ID NO: 20120 - protein, 526 aa, Pseudomonas aeruginosa
ARSMARLGSSVTNEIKQALAASRGALRSVAAFSGVINLLMLVPSLYMLQVYDRVLSSANEVTLLMLTLMALGVFVFMGALEALRSFVLVRVSERFDGQLHGRMYAAAFERNLRAGGQEASQALHDLTTLRQFITGQALFALLDAPWFPVYLLVIFLFDPWLGLLSMVGALALMALAWFNERATRAPLAKAGELSIKSGQLASNNLRNAEVIEAMGMLGSMRGRWERLHQAFLDQQSLASERAARINALSKYLRIALQSLVLGLGAWLAVEGRITPGMMIAGSILMGRALGPIDQLIGVWKQWGAARDAYRRLSGLLDEFPARERRMELPEPHGHLLLESLDAAPPGSEARTLRGLTLAIPAGSVVGVIGPSGSGKSSLARVVLGIWPTLHGSVRLDGAEIRQYERETLGPRIGYLPQDIELFAGTVAENIARFGDVQADKVVEAARLAGVHELVLRLPHGLRHRARRRRRRAFRRPAPAHRPGPGAVRRADPGGARRTQLEPRRQPGACAAGGDPGAQGAWLHGAC

SEQ ID NO: 20121 - protein, 459 aa, Pseudomonas aeruginosa
  UNSURE (46): Identity of amino acid at the above locations are unknown.
SPPGARVAGLRRPPAGAERRPVAPVRRARPGARRLEQPARRVGVAXARGLPGGRLRRAARWWPRRAREVWNDPHGETRRERLCATGLAAGPVRLRRRAALGRLRAARPGRGGAGHGDHLRPAQVGAASAGRGGQAHPSARRPACGGGRAADPHGTDPGPGQRRFAAQPVRQRAAQPGAPAGRIRRPADPGDARGAGRAGPAADPRRAPGVAAAVAAQPPDRAGQRTLRIAGEHRGAARPARRVAPDRGQPAPATTPVEQPVERCARPRRGRLHAAQPVARTGAPTGRGERPAIGEQRSLRADPPEHRRGADAHRPTRGGVPQGSQRATGGNPGQCADALGGAVLGALRTAPRRDPRAGQRLRGRLEGVHRWRGDRPRRIADVHRAQQRQPGSGGPARGEPGRPDPQRAAGGDAVHRLQPEQDPAGHRRGDHGQRRPPARRAEQAALLRAARPGRRGRDG

SEQ ID NO: 20122 - protein, 565 aa, Pseudomonas aeruginosa
AEGPADPPGDGGAGVRPHRRALAAQLPVQAPVRPRPRGAGGELTDDHAPPDDLAVRRLPVAAARGRLRPRPAGRLSPGPGERPAVPGRDPGARGRQAIPCARPRGAAAAPGVQLQPWAQLVRCDPDHHPRRFQGRPRLRQLRLHPQPATAVVRLRGLQPLPQGRGPGAAVRRALPQPEPGTAGPGPGSLYRRAAGPGPDRTGAGAETLLPRAVPAQPAPVRARQRHPHRHPGDPGPLQPGPGPGNRGAGQPGCRPARAGAAGRGAAGDRRPGAARRTLPGAPAEPRQLHRLARPGAGRESRAGLAAPRGGRGPLRGRAEPRRLPAAPGPVRQHRQVQVRFGEHLQPALRDRQRRHPVERSAVLRRRDPGGDAPGHASHGEEPLRPGRQGPRDPQPGAQDVQPEQQQRGEDPRLRDDRGFGADAGDGHAQEHRRRGAGQPRPAERRAGAVQRDERAVQGQVRLPHGLGTPAFLRRGAGRSRPGTGGGELRFRRDAGAPPRLRDDGLPGAAAHPVEDRYGGKPERAPLRPRRTCRQLFAWREVDVPGGSTEVEQYAWNCFSNKALFI

SEQ ID NO: 20123 - protein, 390 aa, Pseudomonas aeruginosa
CSSVARARATTGCRRATAGSWCCAARRPSSLAGQTTKRPIMPLRSLARRDSSWLAPRVCSAPWVVCTATSRMFTRLRSTSRATWACSSAALAITRVRSLIRVACSAISPRAWSAASASSSICRARWSFSRIADTAVSVPSRTLAIMPSISWVDCWVRWARARTSSATTANPRPCSPARAASMAALRARRLVCSAMARITSSTLPMSCAWLARPSTRRAVWPISAFIWRIERTVCPTRARPLPAARSERLEASAVELALRATSSTAALISLTAVAAISISSFCRASDRLPSSVTAFSCSAAAASSAAESPICSMVSCRLACMLRMAFISCAGSSSPSLAISPVRSRAAMRSAQDTAWRIGTTMLRVSSQAIVTLAARATSSTARIAVEARE

SEQ ID NO: 20124 - protein, 216 aa, Pseudomonas aeruginosa
KLNKHSVTVKLRRQGLWHRINAFDREQEPSVRPLKISRDELLQRCAGTFRRYGYHGTTMDMLSSACGLTKASFYHHYPNKEALLRDVLEWTHQRLAETLFSIAYDPLLTPRERLEKLGRKAARLFQDDSIGCLMGVVAVDASYGRSELMAPIRSFLDDWAQAFAQLYRPAFDEAQALERGRQLVADFEGAILLARIYGEPGYIDGVTRRALEQLAG

SEQ ID NO: 20125 - protein, 480 aa, Pseudomonas aeruginosa
IWRAGGRRDPAVEPLPVAPAGARPRPARRAGPPHRQRDQRGRRGGGGVRAGAGRGNRGGAPARGQAGQRLRRVGGQSFHGRGELLPASGPRPPGPAGDPPGAHRGDRARRRLRRPRLRRLPRSLQGARAAYLPLRARCRTSRQPRFDGRRHPRRALGPGRQQWLPAWAGPRQPGFRSDRRAQFRRWHHGQRRRFGEPGGGWRAGAQLELGHPPRRRSRRRRRRGGFAGALGDCHERLRGVARGVLPLAAQGASGRAGGQLRRQRLVLLRYRRIPPAVLVRHRAVAGGGRPRAQRAPRPGGGRPGLRGQAQHLERRHAGGCHRRRLYPCLDPGAGRAGRGALRHLLCHADGRRHGRRHAFPQPAAATRGDPHAAPAQRHDHRRRLRFRAGRCRGPHRTDPALGARLPPGPPRRRPLGAAGHAESPGPGGEEPRARALRRSAGPGPHGEASSSRARRSASSLWRNGLVNTSKPLSCSGLRLA

SEQ ID NO: 20126 - protein, 160 aa, Pseudomonas aeruginosa
RPAPRPSTAPSITRSVRAPISRRPPSPMASRAFTARLRMASSNWCGSTTTAGRRSGISMRTSMVGPSERSIRSCMPSTSSRRATACGLRVCRRAKVSRRPTRFRARSADCSAPSMRSAERASSSRRRISSSEAMIGVSRLLKSWAMPPVNWPTISILRAS

SEQ ID NO: 20127 - protein, 438 aa, Pseudomonas aeruginosa
PVRSVNSDLRRKRDNRDNSIEEQKMGLFNAAANLFGQVYERATQVAATAVTAVADVARTLVGSTVDAVEQQVHEALTSVHDAVASVEQALEGTVGAVAGTLGEIAGDALDTVGSAVGTLGGLAGNSLAIADDLLHGRVEPEDYLKLVGDLGQGVGATVGHAWEFGSDSLKAANDLYHAAYQGGSLSLGNSDGLLGVNVIGSLLGGNHDQGVIPDSRGILGPLPINVSFTEQGLTFGGETPLTPLVTAALALNPITAPLVPVLAPLNLGGLGVVGSVDKEGFSAKFYGIAGPSYNLGVANLGGTLELGSYNEVKLLSWNEVTLKDLPIVGGILGYVPVVKDIGVSLPTLDLHFDSKLYAQTIAGVDVAGVGPKGQIELVHDLDNDLSIVAGIAGDTAHSALDGAGKVLAALLGHGGEAAPPTIQLIGADPAPEHQALAA

SEQ ID NO: 20128 - protein, 648 aa, Pseudomonas aeruginosa
  UNSURE (191): Identity of amino acid at the above locations are unknown.
CWASGRPCTAACAWTAPRSASTSARPSARASATCRRTSNCSPARWRKTSPASAMCRPTRWWRRRAWPGSMNWSCACRMGYDTVLGVGGAGLSGGQRQRIALARALYGAPTLVVLDEPNSNLDDSREHALLAAIQALKARGCTVPADLPPGPALLGCADRRPALNAGQLHLYGERDQVLAALNNQRAASASXQRADYRVAGYGAPPGGGRAAPGRCGMTRTVKRDENAYARLGWLLVLFGFGGALLWAAFAPLDQGVAVPATVIISGQRKSVQHPLGGVVKHILVRDGQHVEAGEPLIRMEPTQARANVDSLLNRYANARLNQARLQAEYDGRRTLEMPAGLAEQAPLPTLGERLELQRQLLHSRQTALANELSALRANIEGLRAQLEGLRQTEGNQRLQQRLLNSQLSGARDLAEEGYMPRNQLLEQERQLAEVNARLSESSGRFGQIRQSIAEAQMRIAQREEEYRKEVNGQLAETQVNARTLWEELSSARYELRHAEIRAPVSGYVAGLKVFTDGGVIGPGELLMYIVPNSDSLEVEGQLAVNLVDRIHSGLPVEMLFTAFNQSKTPRVTGEVTMVSADRLLDEQNKQPYYALRAQVDAAAMGKLKGLQIRPGMAVQVFVRTGERSLLNYLFKPLFDRAHVALAEN

SEQ ID NO: 20129 - protein, 482 aa, Pseudomonas aeruginosa
PMTMRRLMTWLFGAFLLLLREDAFALGLLDGYHLALENDPQFQAAIQEHEAGRQYRALGRAALLPRLVYSYNRGRSWSDVTQTTTRGDFKEDRDYDSYVSTLSLQQPLFDYEAFSRYRKGVAQALLSDERFRSQSQELLVRVLEAYTGALLAQDQIELARAQKRSYREQFQLNQRQFERGNGTRTDTLETQARFNLAQAQEIEARDSQDAALRELERLVGAPLEIADLAPLGERFQVRPLSPASYTAWRDLALAENPELASLRHAVDVARYEVEQNRADFLPRLGLYASTGKSKSGSENTYNQRYETDSVGIQLSVPLFSGGETLAATRQATHRMEKSHYDLDDKVRETLNQVRKMYNQSSSSAAKIRAYEMTVDSARTLVMATRKSIAAGVRVNLDLLNAEQALYSAMNELSKAKYDYLTAWARLRFYAGVLDEADLELVAANFVSGETPARRRDCATTDCPAPLHTLSKTDTEENRSALH

SEQ ID NO: 20130 - protein, 136 aa, Pseudomonas aeruginosa
RPVDRQRRGQRAQGRRRQRHPLRRPRRGPVVGRRGGRHLRLRRYRRVLRGGAGYPARLRQRPGQDRPVRAGCLRQRRAGAAIRRRLRRQGRPGDPVLRRGEQGRQPGDRLQRGRPCRFRDQSDRPGDPGRHRRLTR

SEQ ID NO: 20131 - protein, 138 aa, Pseudomonas aeruginosa
PRWRPSRSHRSAGPATGCLPRSPRSVARQRRPAARRNRRSARWCRAGWPACCAWPSSVAPARRRRRWRSRRSGRGPRCGRRRTPPGGSARRCCGSAARRSSRWPPGPPAAPRGSRWRPGSRHRRLRRWRRGRPRGRGR

SEQ ID NO: 20132 - protein, 354 aa, Pseudomonas aeruginosa
GQEKAVAAGHPRDWSNKEKPVIRMTLDEVRELAVRILRRHAFSEAHVQAVADTLVAGERDECASHGIWRLLGCIATLKAGKVSADAEPELHDIAPGLLRVDAHGGFSQCAFRLGLPHLLEKARSQGIAAMAVNRCVHFSALWVEVEALTEAGLVALATTPSHAWVAPAGGRKPIFGTNPIAFGWPRPDGPPFVFDFATSAVARGEIQLHERAGKPIPLGWGVDEQGEPTTDASAALRGAMLTFGGHKGSALAAMVELLAGPLIGDLTSAESLAYDEGTRSSPYGGELLIAIDPRRMLGASAEEHLARAETLFEGIVEQGARLPSQRRFEARERSARDGVTIPEALHRELLALLE

SEQ ID NO: 20133 - protein, 581 aa, Pseudomonas aeruginosa
QLGFGQRAPGVGGGDRAFARADVRAARQQAPPVAGGQGTAQLRYAGAGRGRSVQLARRAPAEQRQFVECRAPPRLEHRQRGAGPLAQGQQPASLQLAGKAGGELAFAQRQARVEQTDRSALYLCPSRQGAGADVGEGGLAGHADPEQVARRLRRFGIRLRRGDAGADFAPQVQLVGQVEADGVFPLAVQVLVGGFGEGLVVAVAPILVAIADLGPWPAFALCAAQMAEERAGMGIGCGQVAVVAQRGGHQVVQPRVLVERPPLGGQRVAAGSRHPRQARVEAFRAWRGLVAVRAAQRGGDPQRQRHATQMTGKRHCLAPVSERAGNGKAGAGGLRRQKRQSSSRNGQSADFSALPHQVRAAALGQQPGRDGQQGDAVDLPGAAVHPGKAVGLGGGLPAKPRSRLSARLRSRRNSTATTPSQNATANRRRDNGNGCMARSRWSFRRSPDAVSASAGRRPTAPLHRRGSSPCVRAVHRRVAGRGFPAVRCGRPRRRRPASAAVPRDRPGRWRTDRACALRRSAGGGGASPGRRNSSGDGGTSASSRGRPPAAGRRPCPAGSRPCSLFQATSGGSTRVHRHGAP

SEQ ID NO: 20134 - protein, 609 aa, Pseudomonas aeruginosa
TKRFARRSEQQVPVPEAESMPLRRAVFAILFASLGSPLVAAETPLRLERLERCGDLLASERQEWCLRVRGLGSGLPRLLLDGRELPATALRREGDGLRLRLDRRGHASGPLWLEQGGRSSNPVWLTLNGSHVLAAGPDEVAKNMDGLTTYVDLVSLLIEENHDGRREAERLADKYGARVVGAIPPLNLYQLRLPARDLVQRDALVLRIGSETSVDAVVVEESAPEQGEETEAARRPVDKPDSDSDEWAANRFMDAVNYYQRRVRARQAPLETRPVRIGVIERDVDFDAPDFADYLGPCKAPAPRTCLYARDAERPDNHGSTVAGILAARWDQGGNSGFLRGLDRASQGFEVIVERNSDAGITANVAASVNLVEDGVRVLNWSWGIHRVGARDVDGDEVDSLVRSGIAMSGYEELLEEFFLWLRKEHPDVLVVNSAGNGSSYSGTDEYRLPSSFVTEQLLVVGGHERSERQGLAVDDPAYAVKRSTSNVDMRVDVTAAACTHASTLERDARGEVHCGTSYATPMVAGTVAAMLSLNPRLRPEEIRMLLRRSAMTIGGDYDFEPADAEDLTAPILPSERGYRLDHRDVGRSARLDMQKALDLAVKSRERVR

SEQ ID NO: 20135 - protein, 167 aa, Pseudomonas aeruginosa
ARSRPAWRLPPPGGANLRRAPADGRSGSPAAPPAGRGAAPGRAAWRPAPGARGSPPRRDSCRAPRRGLPAPRCVRYAVRRTGWRRTPGSDADRPPSGRRGDSRDGPGRSCRRRCPRRRISATRPAPRRAGAGRWLRFPGDRPGTAGSGPVPGGTPGGVQNAPARWSR

SEQ ID NO: 20136 - protein, 491 aa, Pseudomonas aeruginosa
SAPTRRRSIRPWPPDGEGTPGTGRCHPGSFGIPAAVVAEVSALDGKARFQRYQRNQTGPGGQPRRIAQRGGVLRGDQPADAGALAVHAAGVRPRAVLGQRSHPVDADPDGAWRVRLHGRAGGAAQLRPGAGQRTLRRPVARADVRRRLRTQPARRRPGGQPGAARPDHPAPVHHRPGAVRFIRRTLVPGLPAGDLPLRPLARPALDGRRAGPDGPRLVQRTRHPCAAGQGRRVVDQVRPTGQQQPAQRRGDRGDGHARQHARALGTAAPGVPRPAEPGQRARGADQRAEQIPAHRPAIPGARPRRLAGGGGTHHPGDDDRRLDPDGTCAGAYRPTDRRVEAVGRGARCLSPAERPARRIPRPRAAHGIARAAWPPAAGIAGRGAARQRGAHPAWPDPGDPGRLGGRRDRSVRLRQVEPGAGSAGHLADPARQRAPGRRRDPPVRARDPRPAHRLPAAGHRTVRRHGGGKHRPLRRCAGRQGGGGGAPGRGP

SEQ ID NO: 20137 - protein, 106 aa, Pseudomonas aeruginosa
SAWNRPRPGPTSIRCSTGTPTRGSTRRACRPNTTAGGPWRCPRGWPSRPRCRPSASAWSCSGSCCTAARPRWPTNSPHCGRTSRGCAPSSKGCARPRATSACNNAC

SEQ ID NO: 20138 - protein, 159 aa, Pseudomonas aeruginosa
PRPPPAAISRKTATTTATSPPSACNSRCSTTRPSAATARAWPRRCCPTSASAARARNCWSGSWKPIPARCWPRTRSNWRGRRNAPTASSSSSTSASSSAATAPAPTPWRPRPASTWPRPRKSRRGTARMPPCASWSGWSGRRWRSPTWRRSANASRCAR

SEQ ID NO: 20139 - protein, 483 aa, Pseudomonas aeruginosa
RDMTMSSNSLALKGRSDAYTQVDNFLHAYARGGDELVNGHPSYTVDQAAEQILREQASWQKAPGDSVLTLSYSFLTKPNDFFNTPWKYVSDIYSLGKFSAFSAQQQAQAKLSLQSWSDVTNIHFVDAGQGDQGDLTFGNFSSSVGGAAFAFLPDVPDALKGQSWYLINSSYSANVNPANGNYGRQTLTHEIGHTLGLSHPGDYNAGEGDPTYADATYAEDTRAYSVMSYWEEQNTGQDFKGAYSSAPLLDDIAAIQKLYGANLTTRTGDTVYGFNSNTERDFYSATSSSSKLVFSVWDAGGNDTLDFSGFSQNQKINLNEKALSDVGGLKGNVSIAAGVTVENAIGGSGSDLLIGNDVANVLKGGAGNDILYGGLGADQLWGGAGADTFVYGDIAESSAAAPDTLRDFVSGQDKIDLSGLDAFVNGGLVLQYVDAFAGKAGQAILSYDAASKAGSLAIDFSGDAHADFAINLIGQATQADIVV

SEQ ID NO: 20140 - protein, 213 aa, Pseudomonas aeruginosa
RAEAGAVRCGGTNRGPSAGRALFELIGVFHRSEVVNCGAPVGRRPGGRTEARGAWRALAFEARMAGGVRRVIRCSRLEGDLSMSASAKLSRMVCLLCGFFSTGISMASSLILLSASDLAGQWTLQQDEAPAICHLELRDSEVAEASGYDLGGDTACLTRWLPSEPRAWRPTPAGIALLERGGLTLMLLGRQGEGDYRVQKGDGGQLVLRRATP

SEQ ID NO: 20141 - protein, 560 aa, Pseudomonas aeruginosa
LACGSDHEATDHALEVVGQARQLVAGAAGLLGALGGLHGNVADVHQVAIDLAGDVGLLLGSAGDHQGALVDPRGVLGDLAQGVVGGLGLVEHLPGALVVLAHRGHRGVGALADAGDHAFDLMGRLLGAVGEGAHFVGDHRESAALLAGAGGLDGGIEGEEVGLLGDGADHVEHLADVLRLAGQAFHQARGLADLGVHLADRADGLSDPCAAVAGGPFRETGGLGGGAGVARDLLDRRAHFVDRGGGHLDLIVLPGQRPVAFLGHRVQLLGSGGQQRGGIADLLDGVVQAGLHAAHGLHQLRRLVVAVAGDLAGQVAGRDAVGAGHRLADRHDDAAGQQPGDRHAGRQGHQQHREDRGGGPGVDIGGFGGGGAGGLAVEGDELLQGPLHLLVALQLGPAHQHAGFVGTVVTGQREQGGVSFEVLLLALDELVEQRALLVQDQQGAVFPFHPGEGSDDLVHPLFLLAHARGVVQQHVVHLAEAQFAHQAAELGRGFDAGQPDLADILGGAVQRTHAVVREEAERHQQRGEDGEADDGAWGDGDTTKKHGVVSDRAVGRCLVL

SEQ ID NO: 20142 - protein, 135 aa, Pseudomonas aeruginosa
  UNSURE (67),(114),(119): Identity of amino acid at the above locations are unknown.
LKKISAPPTQAQERSIMSEANSGPGRVTREQRGHLFLIGLERAGERNAFDSAMLAELALAMGEYQRXKNPAVPCSSPWGAIHPPGRTDGTGTKTPPSRFPYPDGGVQSLGLCSXAFEPXPWWSPVHGNPLETPGI

SEQ ID NO: 20143 - protein, 67 aa, Pseudomonas aeruginosa
  UNSURE (44),(51): Identity of amino acid at the above locations are unknown.
KLNKHSVTVKLRRQGLWHRINAFDREQEPSVRPLKISRDEFLQXCAGTFRXYGTTAPPWTCCPAPAA

SEQ ID NO: 20144 - protein, 192 aa, Pseudomonas aeruginosa
  UNSURE (21),(28): Identity of amino acid at the above locations are unknown.
SRAGTFRASVENLPRRVSPAXRRHLPSXRYHGTTMDMLSSACGLTKASFYHHYPNKEALLRDVLEWTHQRLAETLFSIAYDPLLTPRERLEKFGRKAARLFQDDSIGCLMGVVAVDASYGRSELMAPIRSFLDDWAQAFAQFYRPAFDEAQALERGRQLVADFEGAILLARIYGEPGYIDGVTRRALEQLAG

SEQ ID NO: 20145 - protein, 352 aa, Pseudomonas aeruginosa
TSTMYRCIARLLNSSQAQAPPPSATRPDVSPHGHAQHRQVGQLQHGLDLAFLGAIEHRGRHRYATAQVLGQREDLVVAQLVEVFLTTADLVVDLVQELTQFGDLALLFEHAVDLLAQPLGREAQVGFEDLTDVHTRRYAQRVEDDVDRGAVGIVRHVFHRHDHRDHTLVTVTAGHLVARLDATLDRQVDLDDLQHARSQVVALLQLTLLVLELVVQELATIADVGLGLLQLFVQGVVGHAQLEPLAALETVEVVVGDLRALLQRRATFSLGTDQGGTQTLKGRAFDDAELFVQVLADLVELHLLDGQRAGIALDAVAGEDLNFHDRTLGSRSAHAGKVSFPSDAFPPKYPPP

SEQ ID NO: 20146 - protein, 74 aa, Pseudomonas aeruginosa
SWPTCRCCAWPCGETSGLVALGGGACAWLLFNSRAMQRYMVLVYAQRLYRAQSANRPGSAQRRLANQAAYRERK

SEQ ID NO: 20147 - protein, 402 aa, Pseudomonas aeruginosa
WGGIFGWEGVGREGHLPCVCRPGPKGTVMEVQVFTRDGVERDSRALSIEKMQLDQIRKDLNEEFRIVEGATFERLRAALVGAKAEGGPALKKGTEITDDYLDGLERGQWFKLRMADDALNEQLEKAQAYISDRRQLLDDKFEDKKRKLQQGDDLAPGVLKIVKVYLAIKRRIQPGDKMAGRHGNKGVVSVIMPVEDMPHDANGTPVDIVLNPLGVPSRMNVGQILETHLGLAAKGLGEKINRMLEEQRKVAELRKFLHEIYNEIGGREENLDELGDNEILALAKNLRGGVPMATPVFDGAKEREIKAMLKLADLPVLRVAMRRDVGPGGARRRRLCLAAVQQPGDATVHGTGLRPAPVPRPVGQPPRFGAAAPGQPGRLPRTQVTRAVRAILSQNVSDHGVG

SEQ ID NO: 20148 - protein, 524 aa, Pseudomonas aeruginosa
LLEQRSLDNSQTGAISGKGAVEIRTGNLNNSRKASIGSDAGLTLVAARVDNSQAGRIAAKGAIDADLQGLDQHDRGNLVSDTGITLDLNKGSLVNRAQGLIATPGTLLLRQLGVVDNSGGEISSDRAFTLATSALNNQEGRLLSGGALTLRIAQALDNSLEGIVSGAGGLDIQAFVLDNRSGSIGSKGAIDIGVTRLENDAGTLIAERGLKLAADEANSSKGRIAANGSLHAKVGTLSQKGGELTSQDSLTLDLGILNNNAGRIAGNQGVDITARQVDNSVGEIASQGVVALNLTEQLDNRGGKIVGDSGLDITTPRMLNQDKGVLASRDGLRLSATELFNGAGGLLSSQKGIDVSLAGAFDNQAGSLDSRGFLTVKSAWLDNQGGTLSSAGALAVTSQGALNNQGGRLASDAGISLSSASLDNSQTGAISGKGAVEIRTGNLNNSRKASIGSDAGLTLVAARVDNSQAGRIAAKGAIDADLQGLDQHDRGNLVSDTGITLDLNKGSLVNRAQGLIATPAICTV

SEQ ID NO: 20149 - protein, 70 aa, Pseudomonas aeruginosa
  UNSURE (60): Identity of amino acid at the above locations are unknown.
SSRKNSYESDSANCVDRGSISFRLLYPRFKGSKLCPLFCNLFFYFFISAHCFTSIPASRXAFTISARSRC

SEQ ID NO: 20150 - protein, 166 aa, Pseudomonas aeruginosa
DRKDHRSSSGRSQAMTDINKLKELAERYIANPSGEYCSVLDTLLMARERHPGQRNNLDALCKRYGVDNSGRDLHGALLDAEILADVYLAMTGGQTSLSLAGSGAEGDGSGRPMVSPIRRLDPARVATPVLRANAEELAAHAARLAVIEKSAGGPSLWAQLEAPVGE

SEQ ID NO: 20151 - protein, 149 aa, Pseudomonas aeruginosa
SSRDLHSWRYRTHSCSCDCFSRKTKTQKVVGIIMIDNAELRRLAEEVIRIEQNEDEPISAAWELFDSAANPNTILALLDEIDRLKAENEALRGALHAVQAEVDGNLRPLTRDLVNMVSGLKNGCHPNDIYEHCDEIERIIEVALEGAKP

SEQ ID NO: 20152 - protein, 84 aa, Pseudomonas aeruginosa
LAPQMVVKRHILSMEREAQKLLAPLTGQNPPQETPPPAAESPAPSVPTPPPTSTPAVPPADAAASPAVAASTPPAPPSDTPRFP

SEQ ID NO: 20153 - protein, 212 aa, Pseudomonas aeruginosa
PSSGLLPEGTSSISTDVRSPSSAPVKLTMVVALFLAMPVILAHVWGFIAPGLYKHEKRVALPLLVSSIILFYAGMAFAYFLVFPMIFHFFASVTPEGVAMMTDINSYLDFVLTLFFAFGVAFEIPVATVLLIWIGVVDVEYLKNIRPYVIIGCFVVGMVLTPPDIFSQTMLAVPMWLLFEIGLLFGRLVRKRGEHPDDQSASDGEQPPATRQ

SEQ ID NO: 20154 - protein, 138 aa, Pseudomonas aeruginosa
GRGNFGQGQEAAIGQDRTIRRHEVGVLEEQQVHWRVAGGCSPSLADWSSGCSPRLRTRRPNSRPISNSSHIGTASMVWEKMSGGVRTMPTTKQPMITYGRIFFRYSTSTTPIQISSTVATGISKATPKAKNRVRTKSR

SEQ ID NO: 20155 - protein, 210 aa, Pseudomonas aeruginosa
NRMMLDTSSGSATRFSCLYSPGAMKPQTCARITGMARNSATTMVSLTGALLGERTSVEIELVPSGRRPLDGHANAGVEHLVDGNRLVVDGAIGQMPGRRRIRILVSPMTSRKSVFAVWELRIFRLSWKTGRVGRWRRGSGGSDCRRCRGVRGRNRRRAGRRRRGYARRRALGRRRRGFLRGILTGQRGQQLLRFALHREDVPLHHHLRGE

SEQ ID NO: 20156 - protein, 276 aa, Pseudomonas aeruginosa
KRQFPRVAFSRRRGFSRATFPNPNPRRRPNPQGFAVLGAGQLRTGAGGGDRAGPHDPPTRSRRPRGAAGSLAGGRRLFAVAGRLVVRMLAALAYQAAEQQADLEQQPHRHREHGLGEDVRRGQDHADHETADDHVRADILQVLDVDHSDPDQQHRGHRDLEGDAEGEEQSQDEVQVAVDVRHHRHALGRHAGEEVEDHREHQEVGEGHPGVEQDDAGHQQRQRHAFLVLVQPGRDEAPDMREDHRHGEEQRHHHGQFDRRAARRADVSGDRTRALR

SEQ ID NO: 20157 - protein, 144 aa, Pseudomonas aeruginosa
TPPPTRSSLSSMNSAPRASPPSGSSSPVSRRAARWSCIPPSAATPSRSAGCWRYPPTRRPSTTWRWTSATSGFRSCTCTAARTTWSTRRLAARPMTPCRRRAWRWAGTTTRWATRCPWRKSTTSAPGCASASDARSFSQTACSR

SEQ ID NO: 20158 - protein, 159 aa, Pseudomonas aeruginosa
PPSSSSSAAWRLSSSAGTCRWASWPWRSSATTSTRISSAILRLSSSSTRRIASRRSAGLKVLPTAVTGMLSISQISLGTAARSGTWRLACSSSSSSLALAPGLSWIYATGSSPALASGLPTAAARATAGCRCSASSIICGSMLWPPRMIRSLLRPVSQM

SEQ ID NO: 20159 - protein, 584 aa, Pseudomonas aeruginosa
VGGHSPDRSGTVPKMPPPSSPYRCLFVARHRSRARVLPKAAPGASRSPLQAPSGQGWRAPAKHGFLPAGNMLYTGARSFLNHYEIAVLKALKKIFGKADGTQPQSGSSPVPQGPAGATAKGTAPTGEKPTEKRPRKPRPPRAAEKAEKGEKPAKPAGKEGRDAKPRSDKPRRERKPKPVDNWKLEDFVVEPQEGKTRFHDFNLAPSLMHAIHDLGFPYCTPIQAQVLGFTLRGQDAIGRAQTGTGKTAAFLISIITQLLQTPPPKERYMGEPRALIIAPTRELVVQIAKDAAALTKYTGLNVMTFVGGMDFDKQLKQLEARFCDILVATPGRLLDFNQRGEVHLDMVEVMVLDEADRMLDMGFIPQVRQIIRQTPHKGERQTLLFSATFTDDVMNLAKQWTVDPAIVEIEPENVASDTVEQHVYAVAGSDKYKLLYNLVAQNNWERVMVFANRKDEVRRIEERLTKDGISAAQMSGDVPQHKRIRTLEGFREGKIRVLVATDVAGRGIHIDGISHVINFTLPEDPDDYVHRIGRTGRAGASGTSISFAGEDDAFALPPIEELLGRKITCEMPPAELLKPVPRKH

SEQ ID NO: 20160 - protein, 166 aa, Pseudomonas aeruginosa
SPEWTNCLHPFRRSHERRHSPDRPAGRSRATARPYRRPPGHAPAVPRPGRRPGAPAGPATGGVPRRSRRLHQLPRRARPGTGLRSQDFTLHRSRTGPVGHRLDPADVDADRPALAALRCRPADHRAHRRHHRRGGGCPGSGRSRPPSADRQRTGSPCPPAIREGPA

SEQ ID NO: 20161 - protein, 248 aa, Pseudomonas aeruginosa
SKRITSSSVPASPAHPPATGCRPTAGSWCWSARRSPATTPPAAPPRTTRWPTAHPRCARSPPPAGPSSTTRRPASASIRCSARVRKWWSTSATIRKNSAANTKAARRWCRRCACWTRNRPARSCRCCVATRSSAPPTTPPAPTSIPTPCTRATCAASAATRGRSCATTKRWRSAGSTAPGKSAATPATTARRCWSTPQAPGATPSPGWPASARWACSPSAAQPSSSPRRRASTATTGRCWSASTNPST

SEQ ID NO: 20162 - protein, 423 aa, Pseudomonas aeruginosa
RRAQHRPLREAQLGRAEDPLGQHRAARLRRPAAGGAVHQPEHQPVRERQGGTRPVPLAEQADPATGRAVPRRLAGAHQHLPARLAAAAPARLEPADPRAQARTGPGPARRGRVQGQERRQLCGQRAEHGPGDGLQAPQGAEGRRRLTAAAAGERSVAVDVALEVLALDALVGPVGTNRVDRRVELADQLGVPLAHRDPGALAEVFRVLELRPDEGVALAARGIEEAGLQRDGVGEGGVEAAGHQVQVDLVLAGVAHHFSTGLGQHRAGEAVGGSAALHADALAGQLAEAVVELGAFLHHQAARREVVLVGEVHRAPALLGDGDGGQRGVYLANFQRGNQAVVLLLDPLALHLHLRAQRVADVVVEAGQFAFGGLEGKRRVGGLDADPQVAIGGDGGSAGEHAEQQASQQVLGVQRLDHGRLQG

SEQ ID NO: 20163 - protein, 213 aa, Pseudomonas aeruginosa
SSNDFSLSKFTYAAFRAFLNEIMLIGYVRISTDDQLLDLQRDAMAKAGCERVFEDTASGAKADRIGLAALLANLRRGDTVVVWRLDRLGRSIKDLIYLVEQLEDAGVGLKSLQENIDTTSTGGRLVFHLFAALAEFERNLIRECTHARLSAARARGRLGGRKKRLDPAKRKVALKLYHERQYTVVEICRMMGIGRSTLYNYITEAERNAHQQA

SEQ ID NO: 20164 - protein, 468 aa, Pseudomonas aeruginosa
AAHRSDQGKPRVLPQAELERYCELIAALKLRTTNKQGRHLSTHRAIELLEEYGVETDRGLIVAPRGVLHRPTVNRYLSHWRLRPAQLSREPGATRFQAEHSNDCWQFDMSPSDLKHIEHPRWIDPAKGEPTLMLFSVVDDRSGVAYQEYHCVYGEDAETALRFLFNSMAPKADPSFPFQGRPKLIYLDNGPVAKRRVFQSVMRALGIEWQTHIPASKDGTRTTARSKGKVERPFRTVKEAHETLYHFHKPETEAQANEWLLRYLVRTYNQQTHRAEPLSRIEDWITHVPTEGIREMCSWDQFCRFAREPERRKVGPDARITTDGTAYELEPEMAGDYVVLLWGLFDDELHAEFDGERFGPHYPVSGPIPQHRYRAFKRSKADERSARIRSLADQLGLPIAALSGEDVRLEPGSADSTLPIQPFVFEPQESRIAAKLAIAEELAMPLAKLSMDDRAFIDQVLSETLATD

SEQ ID NO: 20165 - protein, 417 aa, Pseudomonas aeruginosa
VASAAAHVHEAQHLHLAGGAEFMARRLALERLADRFQQRSVVQWVAAQQRAQVERMLVAEAQQQAALDGQAQAVAGGAEVVRVRRDEADACLRMLDQAHVARRPAALLGAVEQGVALGDQRAYFVAGAEALATFAADLAKRHLLDEADIQAAGDGEVHQRRHLIGVAPLHHHRVQLDPAETGGLGGVDAGQHLVQLAVAGDRPEAQRIEGVEADVETRQAGVVQRPGVAHQLRAVAGHAQFAQPRQCRQALAQADDAGPHQRLAAGQAQLAHTAGDEQPGDPLDLLQGQHLLARQEAHVLGHAVDTAEVATVGDRQAQVVDLSALAIDPVGHVLGTPFDLREGEGNIGAEGYCTSAPSAPSKAKPSIQASPASTPMYCPTARCNTCTCRCAAICARAASKSSGSPPSRASSSTTCRP

SEQ ID NO: 20166 - protein, 164 aa, Pseudomonas aeruginosa
RLSSGCSSSPGARRSRRFSNSGTVCPGSIQPRSPPASFDGQAEKRRARSTKRSGCPRNSSSSSAACLRAVSRPSRSSGAQASSTWRNCRRQGPSKRPGLAAYQVRQASSSASGTCTSSSSNWRMRASSGVSPSSQRASMPSASARCRSNWRTISARQAASSASA

SEQ ID NO: 20167 - protein, 153 aa, Pseudomonas aeruginosa
SSPGFPPRPGRWPPGCRRAVPGPGRDATRRGPGARRRVPATPRKSPHRRCRVPPGAAPAGRGCAPLRRALRWPPRTAAATGIRGTAAGSPAAPVRRFAGRPRYSGRAGRPSPGHGRGSRRGRARRAAARPSGRARRDRRSAPGRPAGRPGRAR

SEQ ID NO: 20168 - protein, 613 aa, Pseudomonas aeruginosa
AAPRGRRAALPAVRRCGSAHAGRGSPRAARRVDSRVAGRAGGTVGCDRSWRSLLDLHDLDHVAAVGRLAAEQVDGGVAAAGTAVAEAEATAGTLGEGIGKRFLAVRAGDHEAILVVGDGQVAVHLLHLLHAQPDLGQHLQVLAAFDVLGALVGAHRQQALERQQHRRGVAGGEQVGQVLHGDAQRLDVRDHPVAADVPLGGGVLDRRQRRHVPDHRQRAVFRVQRQGQLPVHRQLVHRRLLRRLDDAVGHPILARLGDHRRVERIEEDLQLLLVQLALVLATGHFVDTVGVVEQHAEVADAPDAGLRADGGLAGLDARVAEDALLGLAALPVEVDLLVRAAGDAHPPAAALVLVDQDDAVLLALVDRPARAGRHARRVQAVLAEARQVHHEGVLVLTVDVRLDLVEVLVLAPLGELGAEDLLPVRAPLDLLHALPGDQRARARHRLVLGLGRGMQVLVVEVERFVVVVDLGQVRVGEDVRQHAELAADARADRTVCRAHPAALPLLLVFPFLRVADPGFGLDVVEPGVLHAFAAGPDVLAGDRAGVATDAFVEVQHHADLRTNFHGVSPQMSWGSGCGRASPPSPPWRGSSSQSTLLILRTTTNSSRLQPTVP

SEQ ID NO: 20169 - protein, 143 aa, Pseudomonas aeruginosa
ISQSLLASQAGSVAADSGWMKGCMSEVLRSSFSYQVAVGRTMSEYMQVEDMRKSRVVTRSSLPSAPSSTQSTSVGRGPPALPRSSFITPFFAPSRYLSMYSCPLPEEPSRLERQMNMLRGKFCGSSGDSLAKRRPPLFSSRTT

SEQ ID NO: 20170 - protein, 114 aa, Pseudomonas aeruginosa
RAPSALPVMCSEVPNAFGMKNPPKAPMAAEKPITAADSMLALRAAPVLSAWPSRTRRAHSLRKITGIMRKVEPLPMPAKKHSRMKAPRKPKKLPWPPSPGRKAITANTPPIISA

SEQ ID NO: 20171 - protein, 358 aa, Pseudomonas aeruginosa
FHRVIRAPPNLSASQPPRGRLRAPTSGPRKAYCSGLTSGNWVLAEHREAGREADERAEGGHVQPAHQPVVLALEDHRLVAERGLGVGDVVHPEPGRDRYHGDERHPDPAGVLQPQATAVAELLRLAAEGAEQAAGHRQRHGELHHRDAEVAEPGIQAEGGALLALRIEEADIGHARGEVAAAEAAEQRDQGEHPVRGVRVLHGEAQPDARDQHRGGAQGGPATTAEDRHHERIEHPQGGAGDRRQRREQEQLVVAEGEAGAVQAHSHRAPDHPHGEGEQQRGDRDPQVAAGDALAVARPELGVLGAPVEQQRSPCGFQLGIGDHAHDGIPQEWVGRVGGRSTSAEAAWPSMRRCCLIA

SEQ ID NO: 20172 - protein, 172 aa, Pseudomonas aeruginosa
STTPARCACSPTGSPWSPAWKAARRCSGPSANASTAATSAACCNARTPTTRSASCTRSCARASRAWTRARCPDAPCWTPTSATSTVSSASSRPRPSAARNCSARCRACACSSACWWCSSPSTTSAITSSARCANSPAPPAAWAAASWTRGSPTAARTNWRNWASASTRWPAS

SEQ ID NO: 20173 - protein, 292 aa, Pseudomonas aeruginosa
ASPSRTMASALIRSRTVAAIMGLPSCRSAARPSAASCASKRARPTARECSSASCRPPCNPPPPRSRPHDGHASHRRRTGSPAAGGRPSDDAQGRRPVARTGRRPQRGRRGRQRRGSPAPGRRAGPGHDPAGPEHEGHERPGHPARVARGRSRRAHRGVHRVRRQGRRGQRPARRRRRLPAQGHGAGAPARAHPPGRHRTDDPQPAVDPDPRPGPAGRRPLEEPRRADRARTADPPPDRPRLQQQDDRAKAGHHRRHGEGPCQAGAAQARHAFAGRGRGVGGGERPGVSRARA

SEQ ID NO: 20174 - protein, 213 aa, Pseudomonas aeruginosa
FRSRNPPRRCVDTGGFLPRGARHDVRTQPRRSPSPGLRLLRLLQRGATGQRSRAAPGSRPAGGDVLHRRSRRRRPAAGPPGPLRATDPGPRRLPAALRERLPGAPRGSPDPAPDPQRTRPEEALRRGLRGAGRRAPVRRAGASADAGRQAPLRMTGEAGGGGYPQPAETRIPDFRPPLRISRRLRRVSVPVPPAIRSSALGCPLGFEERTFQC

SEQ ID NO: 20175 - protein, 185 aa, Pseudomonas aeruginosa
RTAATVRCWSYAGGSPPTAPATASTWPTPASTARATGRRTPCSAATAGTIACRCRRCVRAIAPAPWNSAPNAWTGVSATDRGRTRWKPAVCSTRAPLPTPAPARVIPMRSTAISPGSAASAGAPGTAPPVPARPRSAWRSTSAKSSPATPARSRSNTPLSIRVSATACRTPKPPTIPTPPSTWSA

SEQ ID NO: 20176 - protein, 365 aa, Pseudomonas aeruginosa
PRPGTGSTIRASTASCCACCVPAACSPPGATAGSASTRRSMPPSTRNTCARSARTGRNRTACCGTPTGMSSCRWANSPLRPSSSSNNGAWPGCSTTWPPGRPAACAARRRATLSCARPCNGSPRSGASRPRHAGFACRWRCGSRARTPDRAFGRFSAAGQSSTVGRPPSNSQPRNAAHEPTRRLRHRLLQRHRPRPLRRLPARRLPGLGQRAQGGRRACPGRGRLPGGATGRQRRRRAGPSGRGTGSRSRRPRRAGQQRRLRRHGSAAGRRRRRHAPAVRDQRVRRGRRDPRAVPATEAQVRPGGERRQRLRRAGHALRRRLLRLQGRGACAERCPAPGAGTVRRRGAGSAAGRHRLEFRRQRQP

SEQ ID NO: 20177 - protein, 223 aa, Pseudomonas aeruginosa
DGQRGRRTLAQVAVAPADPGARRGIPGQSHVRRRLRPPVASRRAAPSAPAAGAHRQWQPGPAGAGPLATARPAGAAAEEALRSRHAPLKPPGDTAMGDRLAVPIRYYALAGIAAAILLNVLLRGVVRFGGLPASLLIAALVAGGLAWWFARAQRRWPTWGERLRLVALYGGVLGVLYLLLVGLASLKGDPSPAALLIVVLHYLCYPALLLVFFSGRVYGFFLR

SEQ ID NO: 20178 - protein, 562 aa, Pseudomonas aeruginosa
CWPPTARGRHAPFTARLAPPAPRRRAQRLPARRPAACRRDCRHAFASLGASGRPVDQPLPHEPHPLSQRAAQRTERRAAATPAGEDGGQLHQGRRPRLAGPGSGAGAQPADPRRPGRRRRGAQRPPPVAGSRARRSGTDALQARQQPHRTVRRHVPHRRAGLGQAGRAGGNAARRFRRRGRHARRQRLCARRRRRRPAPGDGQRRMQPVALRRLPCARVDGPGARPAVNTRRAERLGPVTQVWHPWDSPPHAAAHFDSRDETPMSDAPTSPRFSAATSTRLLDHAQLEALCADYDGFLLDLWGVVMDGAEAFPGALAWLARRHAEGRPVWFLSNSSSSVAEMSAGLERLGIRRDWFAGITTSGQLTIDALLQTAEYRRGGIYLAGVGLAQQSWPAEIRERFVEDIAQAALIVGVGSFPQDELEQRFAPLRGATDLPFLCANPDRVVVSGGRTVYGAGMLAELFSEEGGQVSWYGKPDPAAFRIAQRQLEARGARHILFVGDSLVTDVPGALAARIDTLWLGATGIHREALGAEFNGALDEERVRSLLHGYPIRPHFAAPGLV

SEQ ID NO: 20179 - protein, 689 aa, Pseudomonas aeruginosa
NTYPKRPIREPWGANVWKSPRKFRNPHHNRRKALDVQRTDTVHGAPPTRQRHYRPLPRGKFLRSPPAQARRRLRPLAQARSWHKHGRFVEPPRTTNGQPFQGREFGAHPKPLISGLFPRFDEAPDSVANAHSEGSPDHGENLWQGPARPLRRSRRTGLADPLDHPRDHPPLPRGPAVLLAGPPGAGLQFDGGRPAGRRAGRHPAQPSRHAGPGRTPDAGVQRRQHHPTAGGAGHRPGDHRHRQRPGNPRPVPRLAAADRAQHLRGPAQCLAGAEGSRHRHRHDAQPGAAEGGTAERGADHRRRRARGPGAERRLRAAGVPDRRQQPGQPDLPRHLPEQPPATAARRRLHGAPRPATGRPGGAVQPHVPGTRPDRQGGLMNRLIRSLCLACAGLFAAGLAQAETLRIGGKTFTEQRILTAITAQFLQKRGYDVTVTTGLGSTLARAAQESGQLDIVWEYTGSSLIVYNHIDEKLDAAASYRRVKQLDEAQGLVWLKPTRFNNTYALAMPEEQAEHLGIQSVSDLARVLAEQQEAEPGSTHLFAMDPEFAGRPDGLGPMSELYGLHFTRNDIRQMDAGLVYTALKNRQVFLGLVYTTDGRLKDFKLRVLKDDKQYFPFYNAAPVVRKEVMQRHPEFATLFDPIIERLDDATMQALNARVDIEQQTPQKVAADFLREHHLLDDGQAGQGGSQ

SEQ ID NO: 20180 - protein, 460 aa, Pseudomonas aeruginosa
SCRRPNRSGPRPPGGYSPPAAANRSVFLASGALFRPAETKKPGIRRASPCPFHSTGPPRRLRRRGLVVAPLRLDDHRAGDPRREQHAVRHFVDVYPHRHALGQAHPVESGVDVGGQLAAFRVVAVVDAAGDAFHVALEVFAAHQLHVHRVAFADVRQLGFLEVAVDPVGVLVDHRHLRLADPRVVATVHVEVGNVPVDLRHHPGALQVQARGVELGLGLLVVGHRRGGGVVGVVAAFAGDHHLIHFRAPPGVQLAHLQGRLARGNQRLGLLHRNTVVVGVDLHQQVAFLHQLVVAHRDVDDDPGNVGGDIDHVGAHATVTGPGGVHVVDPQGPPDEYGDQQDQQGRQQADYGFQGHGRLTITKRCATASAVDGQGQAAVQAGEQADPEQRRVPGEAIQANRGEDPVEPPGERRGDHEQQRQGRHVDPMDGDFTRHGRYLGRSSGRPVRSVARSARAGKNG

SEQ ID NO: 20181 - protein, 534 aa, Pseudomonas aeruginosa
WGRTKNSPRKAQASPAGHGADAHLHGDLLRVRRRRSQRRDRHRVEGEGAAAGPGAVDPETAEQQDHQPGAHPRHCRRHRVGLGGEGVLPLLALVAVGGQRGMGQGVVVHFLSETVEQLGGGIEVQPRLFARLPRQQLAARLADTRHQAFAAVGEALGEALGVMVGDGAATDLLEQPGDFLQARLERIQHLGGALRAQAFEQLVEGVETGIHGHELAAQANQPAIAQAHVRILEGARRAHRLQAHGLGGEGHVAAFEALAPADPAQAVEDERGEQAEAHVQRIAHRRAGGLRHDHRADHPRAEDRQADFQDPPDRLHEGAFRMAGGGDADQRRGVAGEHAGVGAEVTVAGGPGGAEADPDRRAEQEQHSLLGEQGDQGDHHAEADQGAEDAVEALGEHLAALRLHDDEHGDGRRARLRQFQAHRQPEGQEGRAEHLEHVDPGRPVAARPLGQRAPPLVAAGQGETSGAATHREDTALTGTFSGASFRCAGVSAPAPTPPPRAVSRLAWAASRAACTCSWTSCCWNSRVCALSTLR

SEQ ID NO: 20182 - protein, 341 aa, Pseudomonas aeruginosa
CEIIRPRNNLTHFCACLGGPVDGHPAKHASLRLRGGNRKLHRGVPAAQHHHRLCFAGGGQPRDAPAHPPAQPYHSSHRPHRGRPALPAALRADPRLRRGSRGRSQRRPCPTRRQAEAAFDDRHRPALRDPRHRRLPPAVPRRDLRPDHGQPRAGPARRGLRRGHRGGLRAARFRLHFPAHRRDLQHSLRLAGVPAPERHAERAFGAGQPRLPAPGQPGGAAGSLAVRRSQRPGNGLHRRLAVPGQCRRRHDRGNPLRTGHRHPAGVFGHRGPGQGHPGAGPAATPPATAQRLCAVPFAAVSRREDQDLGGIPQGKPARPAPARRSGAGGAGPGTRKTLLSR

SEQ ID NO: 20183 - protein, 124 aa, Pseudomonas aeruginosa
PCRTSARPPTRPAGPWPSGRCRTSRRPCAASGRWTWSIRRCGDAAERASLSARSSAPARPAPAPSACGTPRRCRASPGPARPAPVRSSGSPRRRPRCSAPPPGTARCSRRRDPGPCARPGSGRR

SEQ ID NO: 20184 - protein, 342 aa, Pseudomonas aeruginosa
AGTAKDSWRLRNDRMPSVCGRGRARPLSILALFIRRLSRQRPGAGSMAGMHQPSDFQVFRTLDRTSNARLLRSSTLSDGLALAHWYRDEAEILGYSDPGHHTLSLYLQGGWQTFRRDRPGLYGGPDRFCVMPAEHHSDWAVTRGLGFMHLYISPERLAGAAVRTLDCEPRSLQLEERTYIQDEPLAALCRTLERQDWNEPGERLLCTSLAHQAVDHLLLTGCGRRTDVRWQGGLAAHVRRRLADYIESHLEQPLELGSLAELAALSEYHFARMFRVSFGLPPHRYVLERRLARARDLLAYSAQPLQEVSLACGFASPSHFNRRFREAHGATPGQYRAALKGS

SEQ ID NO: 20185 - protein, 502 aa, Pseudomonas aeruginosa
NDNYYHSLILLLRECPGVERRPRPCGRVAYPLQRPPPLAHGLAAAPPRLPAERRRPGPGHLRQGPGFAPGRAHRRTARLPHHHRPPRAVQPLPPPGRRARLPGSPGQPARAGSPQRRDPRHRPGDPGRAGPSARRSAAAGQGDLPAGPTRRPGLRRDRHAAGHLPEQRQALHAQGCATLLLRRAAMSLPAAPKVPPQVAEQAVRWLVELQGGADDERLRQAWQRWRQAAPEHEQAWRHIEAVNQRLAGIGTPLALAAINAPHSPQRRRALKTLLLVLAAGGSAWGLRESGSLQRWSADYATGVGERRRLALADGSRLELNSDTAVDVRFDAGERRLLLLRGEIQLSTGQDPRPLHVYSAEGRLRPVGTRFDVRQFAGRTRVAVHEGAVQVENHAGQGLLLPSGRQLDFDRERLGAPQPLPVGSGAWTDGMLVAAGMRLDEFLAEVARYRPGRLGCDPRIGGLRISGSYPLDDSERILATLPAVLPVEVRRVTRYWVGVHPRE

SEQ ID NO: 20186 - protein, 1098 aa, Pseudomonas aeruginosa
AERYFRAPEPFSPPRVTEEESQPRKIHWSVPHVPVTRPVAAQPRPAPRLPRRSRPGFRRQRLRRRDPHRYPPVLPAARRAAGAGAEPPRPPGRRADRLQPGTDRRAAQPGAGRRVHPGGSPGRPARRLRPGGARPRRRRLYPGGAAGGRPGQPAGAHRGRRLAGRRQRRRRLRASRCARRGPPRAVPGPRRGQHPRSAGAHSRGQRAAQQRHRQPRPGIELRHSRPQPAPGVALDGADGRYPGALRPLRPATVVAGAGVHRQHGRGGRGPRRRRGALRAAERRRHRQLRDPGDPRGLRHQARRAQRTQPQLQPGRPEDHPQRADRRHRRQRPRRRPALLRHPRRRLARAQRYADRRPDPQGPLPAQRRTHVFGDDPVLRRRGRHARRPRHRGLPRRPVPVDPSLRQVLGPPYPGQRQLRIHPQRQPEAQRHRLLHQDPAQRLPRPGPQPHPVAARVLGTRPGNPFQPGLRAGRKSPRSGHRPPLRQRSQPRAALLDPRRQRPATQHRQPQRPRHPRQHRSQRVLHRRSHRHRQLDHHPRHPLREDRFRTEEPAEEQQGQRPLQRLAAGAQRDLPPHAELEPLRQHRGLVRHRAVQPDGQGGAQRRHRAGEGPHLGTRQPLRRRHPARRTGRLPDQLRQPVREQPADRQRDRPRQDPAQGHRGGDRLRPGRSRPAALRLRRLCQLRLRRREHSRRRAEQGQPSAVLLEAQGHPWRQLSHRRLELQPRRQLPDQPVRRQRQHRERKRRRQHRADRRLDGLERARHLRLRPATERPLARPGGEEPVRSPLLHPLVRRQQQGPLRRPAAHPVRTGLGRFLKKDRGSAWRNGGRSPAIIRPPRRRAWLPSGPASLPVRIALQLFHQQLADLPGGFAVPAIGGVLARRLHDFGGLVRQAHLQPVGGTLVAAERHQQAVVAAIVGFATVGQDVGLALQAQAGGRGTRAAGVGNPFRHVALALEHGMPGGLVAGLAEQFEQPRLLLGLRRRPVQRRAQQRQGEQSGYSVHGDFLRSGEMKAVYPAVAAAGCLERHDCDKFAVHRQFHRSPDDRHPDAPRFTAIIPRFSGPSRAHANGFQQARIHDHSGRRSREAPYLRDHFPPRRR

SEQ ID NO: 20187 - protein, 526 aa, Pseudomonas aeruginosa
DHHHREAPADGQGDRRRRYREVAQVRPPRHVRLDGDGKAARHLHHHLGDAVPLPRAHDQPARHPRPRRLLRRHLPHPDRGGLGADGARRRQGRRTADHRPDGSLPAARHAHRQLHQQARPRHPRPHRAARRDRGGAEDQGRADHLADRLLQGLQGRLPPGRRQDHRLRPRPRPRAHRDQGHRKARLRRSPRPPRRSLRQFRRGAGAGAGRLPRIRQGRLPQGRDDPGVLRHRAGQLRRRPGPRLHRRLGAAAAVARHPRTQRGADRGEVLRLRVQDPGEHGSQAPRPHRLHAHLLGQVRERHEDAPRAPGQGREDRRRADLLLLRARATGRGLCRRHHRPAQPRHHPDRRHLQRRRELRFHRHPALRPGTVPPRAPERPAEIQAVAPGPAGTGRGRCDPGVLPRAQQRHHPRCGGRTAVRRGRQPPEGGIQGRVRLRGDQRLVGTLDRVRRREEAQGVQGQGLREPLRGRRRAPHLPGTDPRQPQPDGRTLAGHPLPRDARASLIAREEPGTASLSPPAAVSAQGG

SEQ ID NO: 20188 - protein, 238 aa, Pseudomonas aeruginosa
PGNGADRRCLNWMPANWIACSGSATTKSSSGSCWRYAGRLPPGSNDAACCPPSGNSASCARRRWNWVSKSPGRSNAFFCTAWPSPLSRTRRRFSHTCAGRWRTARNNASRTTNGSSSFAWPARNGARTKPRGDRHERHRRAFPTAAPHGSAAALRTTRAAPAALADAGAAPAAATGPRRAAQAGTASDAGSAAPAQDRDRHAEPRPDPGSRARLQQEPGPRQGLRGVPAVPGRNGHRQ

SEQ ID NO: 20189 - protein, 395 aa, Pseudomonas aeruginosa
RQGPQHVGPVRALPAVGDQFPVSPRMVLERHLVGRLRRAALHPAGGEGQLRLPVRPAARRAQALGAGQGEVGPAAEGRGSQRQGPTDPAGVRRMALPAADRLRVLRRGVPAHGTGQPEGILESDAGNGRARRLPGNPREGTGRDEKVLRREPGVLRMTDAKAFRRYIFELYFDPARLLALDDDQHLQRIERFLDALAPLHPVLENWYLCGDSLRDALSHNVTEHRQDLAKALSRDRRTRAVELVLWNGEEDPLKGGLSLDYEASGRAVSSRLQLEDAGSLLQVFDAPASSFVAIFLAALEIWPETTWGMLAPHAYFVHQRTFPDRRSIGWIGFCPHPLRATDFPAATELVDIPGRGTLLLNGREPMDETRREHFERVGEADIKLMELGYLPPLRG

SEQ ID NO: 20190 - protein, 136 aa, Pseudomonas aeruginosa
RRCRCRRRRRRCLRRSPGRRPPWHLPAARRSPSARWRSGSRRPPRPRWRPAGSPADFRRRRPAPRGSVAGRPPRRRRARQRHAGRGWRRCRAGSPAIAPPGRRRRWDRCRRRGCRPCAPGSGRGSAHRRCPRSCRG

SEQ ID NO: 20191 - protein, 175 aa, Pseudomonas aeruginosa
GRRNGGRWCRRGNRRRWHRRPVAGPTSRRAGCPPDRPVAWGCSSGEKRAPRQWATPGHRRHTLERRSRSALDRDQEGLRPSVRRTAESRSHHPRPGWRRARSPPARPPNWRQAASPSPAAGGFPPAPVHRAAPAGTGDAPAVAASRRPPAAPAAAALRRTVPAGEAGTDAPPAMR

SEQ ID NO: 20192 - protein, 136 aa, Pseudomonas aeruginosa
AHRGWPPVRRRALPRRAPRSPDRAARRRCSNGWRCRSARPTVSGRARAIRRRCSAGRCASADAPRPWRRRDSPAGRVPAGASAVRHAAPARHDATPRRAGAHAGRRSPAATARARRRPRRVPAAPRSRRRSAAARR

SEQ ID NO: 20193 - protein, 360 aa, Pseudomonas aeruginosa
RSAPPGPAAGSCRGCRRRRSARRPSGCRRCAAGRRSTRRSRPSRCCPNAAGPSAPAGPRRALVPAPAPGPGSRRLAGAARAPAVRPAPRRAGAVGRHRRRKRSRAAPAAGHRRHGWRGLQVRDEIARAGAAVQLRQENLVPGGATGARRAGQAAHQGTVAEPGQRPRLDGGSADLALRDLAEQFAEALDIALEQRPDRLRGVVPRGEAGAAGDQADLYLGVGDPGRDHRADLVDVIGLQAPLVQAMTGGQQRVGEGLAGSIGFQGTGVADGEDGDVQRLEGGGGQVAHGRGPRNGRCLSLNRGPPAGYSSEEVSRRREEVDVTPPSAARRPGRCSGLRPSAGLRRCLPSSRTARGSSGSP

SEQ ID NO: 20194 - protein, 569 aa, Pseudomonas aeruginosa
GRPAQGASSRSGNDAGPVPGPGLAGCISRPAFSTGRDIGRRLPPATSHVRLGVLRQHRARHPLQGHVHAVGEVLEAFGEVGQAGAGGGQVGRVDLRQVAQADHLRTAAGAGDDGLHLVRREVLAFVDEDQALLEAAPADVVQRLELQRHLAEDVVDAAMGAFVVHVQRFEVVGDGAEPGLHLFRLGAGQEADVLVQALHAAGGDDAPVALADHGLLDGRGERQDGLAGTGGTGQVDQVDVRVEQRVQRQRLVHVAWPQAPGFLVQERLLVQVEDGQLVLLDALDPADEALFVDDELVDVHRRQVVGELHAMPGTAVVLAGLDLAHAVPERAGEGMVAARQQGHVVDQLVGVVVLRVHPAGARLQAHVDVLGHQHHAHAAVAALQLDQLVDDLVVVEVLRQPGDGLGTLAHEDRQAAAGAVLATLDRYPSLYLLGRGLAEYLVDQADGLAALGGDGVLSGLQLVQLFEHRHRDRDAVFLEVQQGIRIVDQDIGIEDVQGGLGGAGTSVVIHTRSPSAKGLATECRVGAPPGGEPPSLFRWGEPDSRGEGRGRHLCCRVRRSTVPQIPQKI

SEQ ID NO: 20195 - protein, 363 aa, Pseudomonas aeruginosa
TWRQISPAPPRAPAMPLLSIPRRTHEQRHANRARSAGQRHDLRVLRRPCRTSPEESARGRGRLGQPGQRAGPRTGPGGQPAGPGGGGRAGRLPGSGAQPGTVHRGHDLRQLRRPGRAGAEEGARRTRGQRQPGQRARPPRAARRRGQPGLATGGGTGRLQGPPARRGATTPGRCRAPPAPRTLVGDRRAVAGVAAGAADAGGMGRPALDAAAVGAVPPGDPGAVRHRRALLCLRLARGEGRCRQHGPAGRPRHQRRLRPQRLPLADRPAWPHAAPLLRSLHRGDRPDPPRQVPGKPRQAPDRQRHPRPLGRCARSARCACATVARKRWRSPSCASATRWWCVPANASRWTARCSTAAATPTRR

SEQ ID NO: 20196 - protein, 549 aa, Pseudomonas aeruginosa
PDAGQFGLALGQPEFALDQGDRRQVVDRRDIPGMHQPLDVAKPGERRRVVAQAPFQAGQDAIADHQADIPAAAGFLDSLLDPLARFVRLQRQAAQVAAVQQEPPAHRVAALRRQVLEAFQALAHLLLGARHLAARLEDAGAVVMDQCLEQRVAVALGELQGVAVVVARLPEVATGHRQVAQRRQALQAGAIALPGEVLQGLAAVRLGLVDIAAAARDHPAQGLPLGQQVALRGLVRRRQETRQLAGQFFRGIQLAGQRQRPAVQQDQARRARQEAVRQVHLPAQQGGDVLLRQQLLFRQVLHQARRHVRLAGAQRLLHRLVEQAMAAEPAAGAQVQGAGGRTEVGQGTRQQQVGEQVVVAEPLAVFVQRHEEDLVLLQVVEDRRAVAGLAHGIAELGAEALEARGLGEERLDLGRLPLDHLLQQVVADQFVGAVYPGADLLLWIAARQQPEAQPGDPAFAALEQRVQRVLVEFEAAGGHQRPALLGGQAQVLFAEFEQLPRQAQARQVPVRPLPAGDQQHQALGQVIEEELQATVEHRALGQVVIVQHQ

SEQ ID NO: 20197 - protein, 628 aa, Pseudomonas aeruginosa
PGGRENAETKRLLGLRAFQRCRKAPSDGRQEGAAGFLPLGDLDTDALLVQLADAGLGNIGNNRDLRGDRPLVDVALLDERLEVLLQATGVQLLALAHHQQGERALAPLRIGHPDHRHFAYRRMAADQVFQLQGGQPLAAGLDHVLDAVADLDEAHAVQGRHVAGVHPAAAPQLLAALGFAEIPLGQPWRAQHQLALGFAVGREEAALFVHDRRIHQRHRHAGLDPVGGALVLASGQQFVVEVGAGNQRTGLRHAVGGGQLDAARLGRLVERAVQRAPADDHLPALEVHALGSPGVHHHLQDGRHAVGEGDLLALPQFDQQFRIVTPGIDLLDPEHGRHVRSAPGVDMEHRGDRHVHVAGTEQADAVQAADGRSHRQGVQDQLPVAEIHTFRIAGGAGGVEGGGDGVLVEIGEVVARAGRGQQRLVFADQAGQFRALLRAVGEQDGPLHRGQLPRHRLVERDELAVHQHEAILGVVHGVEDLLRGEADIDGMQHRPDHRDGEHAFQVAMAVPVHHRHRVAGLHPGLAEYVGQARDALVEGGVAVAHLVAVDDFMTLFVTTAGKHQALDQQRILISAGGGRDETGLQHGAYTWERVRCQDEADSRAVGGLCSSVKRVICPVTFRSLPVTR

SEQ ID NO: 20198 - protein, 412 aa, Pseudomonas aeruginosa
NPPTESFRPYPEQEVTFHVRYRHRRRRPYSHGRLPGQPGRRFRGRPGCRRDPRSGAARRHRRRGRTGSDHGLRPARRPEAGPGPPGRAGGRPARRHRLHHHQQAVRLGDEGGDAGPRPAQGWHQPGDGRRWHGKHVQRALCPGESPQRPAHGPRRDQGPHVPRRPGGRPYRPFDGFVRPGDRRQVRRDPRGDGRLCHRIAQARPGRHRRWLAGGGNRPGHRHQPQGRERGEGRRATADRQPGEDPEPQAGVPQGRYHHRRQCQLDLRRRLRAGPDDRRGSPAPWPEAAGANRRPCHPEPGPERVHPGADRRDDQPVRQDRLEQGRRRPVRDQRSLRHGHHARHARTRPRSCQGQCLWRRLRPGPSGRFHRLADHPHPDQRPAPERRQARRRLAVHRRRRSHRRGARTALIRR

SEQ ID NO: 20199 - protein, 428 aa, Pseudomonas aeruginosa
AIGARPARAVRAPSSSGAHRGAARRTRKHQRRGEGQRGEARQYQVQPQQPLPWLQVGDHRDRRRAGAERQEIAQGEDPRLPLRRDEVGDHRIVHRHLAEHREHEQRAEQHHCAAVAVGQGQQQRHLAEGEEDERQLQVQAIDQAAHDQLRYRAEGIGQADHHAEGLRRRQQVAQALLEQLRVGHGAGVEHHPAGGGDQRQHAEHPAHRQALAVLATRRGLGRQVRRWLLAHAEEKADAEQDGHPAGQDERRTPTEVRGEKAGKQRGEGDPEVTPHAVDADLAAAVLRVCHQHRGANRVVDRGEYPDQGQPGHQHRYAAGQPGEQCGGADTEEEQQHHPPPAPGIAQPAGRQRTGAEGDETAQRQADQTGVVEVEAAGHAEHGGGEDQHEHVVDDMRGVDEADNGSRSVHGVRPEWSVRNGRHDPGMIG

SEQ ID NO: 20200 - protein, 271 aa, Pseudomonas aeruginosa
TQRRTSPYKDRRMKKLLLLTALASVISVSANAAEKLLVAATPIPHAEILELIKPTLAKEGVDLQIKVFTDYVQPNVQVAEKRLDANYFQTLPYLENFNKGKGTNLVTVVGVHVEPFGGYSRKYKSLAELPDGATVAIPNEGSNSGRALLLLQKAGLLKLKDPNNALATPKDIAENPKNLKFKELESALLPRVLDQVDLDLINTNYALEAKLNPAKDALVLEDHDSPYVNYLVARPDNKDSDALKKLSAALTSPEVKAFIEKKYAGAVVPAF

SEQ ID NO: 20201 - protein, 382 aa, Pseudomonas aeruginosa
PQPVPTPTLGAVAAPLVHAGVAWLAPAFLFPQRPPPAAVPAVVAAQALEAPRAAKELPMSEKPRPAPLTFPDADRSPLSIRAKALVFFDPRSHRVREELERLAPQGQPVLIEGETGTGKELLARQIHRHSERAGLFVAVSCSALSRNHAEAELFGYAPGAHNGPVGSRAGWFGSANGGTLYLDEIADLPLTLQARLLQTLEEREVLRVGAQQPIPHDVRLVTATSVDLDQAVRAGKFLAGLQQYLHDGRLSLPPLRERPGDILPLAEYFIGVYAQRLDLPVPAIGVETQRVLESYPWPGNIRELENVVHFALLVSDKEEILPQHLNFGGATPDPSLAGLRRLLGQAGAPSLEQVQALLLQLATEQAGGDEEAGRRRLGLAAN

SEQ ID NO: 20202 - protein, 678 aa, Pseudomonas aeruginosa
GRGDQPVLTDAQSPSATPSTPTPIRMNPPVFYGAAILILLFAAVVIGFPQRAGEWLLAAQTWASQTVGWYYLLAMTLYLIFVVVTALSGYGKIKLGADHDEPEFSYLSWAGMLFAAGISITLFFFCVSEPLTHFLQPPQGEAGTQEAARQAMELLFLHWGLHGWGVFALVAMALAYFAYRHNLPLALRSALYPLIGKRINGPIGYTVDCFGIIATVFGLGADMGFGVLQLNSGLDYLYAIPHTHPVQMALIVLMMGAAISVAVSGVDKGIRILSDINMLLACSLLLFVLFAGPTQHLLNTLVQNVGDYLGHLPGKSFDLYAYGGPSDWLGSWTVFYWAWWIAWAPFVGLFIARISRGRTIREFVFGVLFIPLGFTLAWMSIFGNSALEQALGGASELGRVAIEQPSMALYQMLQNYPWSRAVITVTVLVSFVFFVTSADSGTVVLSTLSAHGGSADDDGPKWLRVFWGSVTALVTGGLLFAGSIDALKSAVVLTSLPFSLILLLMMWGLHKAFYMESQRQRARSHSLAPLMSGNGKRSGGWKRRLSQAVHFPSRDEVYRFMNDVVRPAISEVSEVFREKGLAVDAQLDPGNASLSLEIGHGEQHRFLYQVLMRGYFTPSFARAGMGGLHLKNRRYFRAEVHLAEGSQDYDLMGYTKEQIINDMLDQYERHLQFLHLVR

SEQ ID NO: 20203 - protein, 353 aa, Pseudomonas aeruginosa
  UNSURE (261),(274),(281),(305): Identity of amino acid at the above locations are unknown.
KLSKQLDPPSLGESGTPGHDSECRRGDLFESKSWRNAQLPARAAGGSPRAASSEGLVAEDGGAMHDPPLWPVIVHRVVLRHAVVPERHVVFLPAPAHGEFRSRGMGEEELQQRIALGRLQFVDAGGEAIADEQALAPGDRMGAHHRMRARRILQAGLLQARQVGLGDAEALAGEGLADVVGRREAVQQTPQRRRQRLVGRRAARPEGVAAVRRQLLGGEHGSQRRGLEEGHVGVPDGIVAHVGDRGVEDDDLRLLRHAGVXRMDVQVAEAGGEXRLAPGFXRLVAEEQHLVFEQGLLDGPLAGVXQRRAEVDAGNDGAQGRADGLDGQAHVVLLVGQVAGAPCAPSLRPSPRE

SEQ ID NO: 20204 - protein, 356 aa, Pseudomonas aeruginosa
ATDCSAYSWRPTSCRTWRARAVRSALPRPRMRRPRATLSRALSQGIRASSWNTTPRSPPGPSSVRPSICTRPWSGFWKPARMFSSVDLPQPEGPSTTSDSPLARPRLRSRRMARRWPRCSNERLIASAVRRLMCSALRRVRKPPLRQAGAESRNSALADLDLLRLAHEVGADVGRVVAEDGRHALLFLEEFGSAGDSLGGAAAEQVGGQLRLAFREGRAGQQFGDVPGIGAGQPGDLLHRFGVGGPFGLVRVVVGEGIEADAGEAGDDFRMLLGEVLARHPHLECRRTPLADFGGVGEDLAAFLDLAQRRRPDEGPVDVAATPGGSDLGRVEVDDLHLGRFDLPVLEGAEQAVVGG

SEQ ID NO: 20205 - protein, 174 aa, Pseudomonas aeruginosa
SPTITSSAGVTFQRRAMRSKPSGSGLGRASPRPRMCSVGKQPPRPIASRVISANWWSLRVRMPRRTPRRCNSRTSSSAPGAGRAASARARSCSSSQACLAAASASGRAARCSRMSSCSGMSSARRIAGKSCTARVRVPSMSNTQWRMSASLTPSPHACGSGLPGSTRRPAGRSG

SEQ ID NO: 20206 - protein, 172 aa, Pseudomonas aeruginosa
PRKAPASAPAAACAARPAAARHRCRRARPCAARYAADAAAVAAAGRGLSLPGSPGATLHGRAGRRGARHSPCIRCNSGQSRYSRDSRFGAPANGRAASPSHRRGEREGSCVSAGPIQNSASTLSHSAKPSRSRPNRPSSALSATPRSRRISQPWIAAAIERQASAWPRSCWQ

SEQ ID NO: 20207 - protein, 496 aa, Pseudomonas aeruginosa
KVCAAGPAVVWKGNASGARPGVRLEAAEARAAASGSGAIVEKVLFRHRPGEQVALGYGATEFDQAYPLFVALHPFHHQGNSQRLRQRHDTADDGATPGLGLHLLDEGSVQLDLAEGKLAEPVEGRIAGAEIVHRQAAAHDPQTHEVLQAAGRSADQPGLGDLEHHRTGRQVELGQQRRDVLGQGTRTQLRRMDVERQVDRLPQLRQLPARRQPLAEQLPEQLVDQVVGFHHIEEMRRRQYAEMRVVPACQDLGADQAAAIQGHLGLVVGFELAVVEAAHHVRHGGQLGDFDLSRQVLATSVVASQQGGDPLQAEWLAKVAEKIEAQALDHRNGGLAQDGIHLAAEDHRMDLAAQACVAKERQAVHAAHLQVADGDVDVSAGLQDRHRLLAVRRLEDRSGHHFLQGCDGYQALKRLILQHQNIQIIHHGPHRVSRKYRRYTAVFPLLDLWDKSPCFVGIFLLIWRFGWISMVPHEKPSRPALTGYSGRRSRPSAQHG

SEQ ID NO: 20208 - protein, 179 aa, Pseudomonas aeruginosa
RATGRAHESSRRLPRELRAAPSRPRPARAGGRRPSMDFSPLATCFTLAPVHSLTTTRSPCSKHSRKSSARPTEPSRRAVPPRSRKALPALPRKVPPPPAKSRPRNAHANRAPRAPLKRPRKAKSPPNPPAKKAGTPSRAATSRAANASRSRWTTGSWKTSWSNRRKARPASTTSTSPRA

SEQ ID NO: 20209 - protein, 437 aa, Pseudomonas aeruginosa
STSPCRRTRTTTCTVSVVPAAPAPRAPRSASPARTMPSPCRRSKNCWAARSPARCRRPNCSSRYRASTERRRGEKRRSHPASPFSFLRHAGAAAGHRGGSALARQYLKVQNGQIVYIHSGDRMSAATPLIVQQAEAEQLLARIDVLQAMRQLFLDLAAGQALQPAQQLVEFPAGRGDFINYLGVLAQEQVYGVKTSPYIVREQGPLVTAWTLLMSMQTGQPLLLCDAARLTTARTAATTAVAVDALAPAEAGRLALIGSGPVAHAHLQYVKGLRDWQGVRVHSPCLDERRLQSLRAIDPRAEAAGSLEEALDEADVILLCTSSARAVIDPRQLKRPALVTSISTNAPRAHEVPAESLAAMDVYCDYRHTTPGSAGEMLIAAEQHGWSPEAIRGDLAELLSGQAPRPEYRRPAFFRSIGLGLEDVALANALYRLRQAG

SEQ ID NO: 20210 - protein, 614 aa, Pseudomonas aeruginosa
SRDAGEQHDRSGLPRHRCRHRRRIHRLLAVGPRPGRGAGARGAARLPLHRPLRRALHGGLRHTPGARAHRRQPGLLRQPAGRLLRASAAQPASGNGGRLQRRSGRTPPPIRKRQGAGAADAPAGRGTGLLDRAGAASRQGLRRHLRPHRRRHRYRRPAPGLPARHPPQPGAGPVQPRSAGDPPGRRRLGSPLRRRQLPRGGAGQRRRRLVRRHRRAGRRPPAGPAAQAPLSLHLRPAAGHRLPRLADAGQPRRILLPEAGRRHAARLAGQRRSGRSPRRAARATGHRHRHVPDRRSHHPHHSPPGTHLGRAALVRRRRRPGGRLRRRCGRLLLGRCPGRLRYPDLGGDGRGQRRADPPPAAAGAPARARPGRGDAVAAPPVPLMTRRRVCGTLASPAVPREFLRMSPSQDPSLENYRAIADGIATLFFPHAEVVLHDLRSQRVDYIANNLSKREVGDDSALEDMLEGDSDERNIGPYEKLNWDGQKIRSVSTVLRDSAGQPLAVLCINLNISLFESAKAALDLFLSPSKLIPQPDALFRDDWQERINTFLHGWLRQRQLGLNLLTREHKRELVLALHAEGAFKGKSAANYVANVLNMGRATVYKHLKELKEGGD

SEQ ID NO: 20211 - protein, 107 aa, Pseudomonas aeruginosa
RLAIENRRARNQRDFGLRLSVTDGGGGLTLIASELAIHAVGLQSITAGSRSLRLTLIPVIRRSRCPSFPMKQMTFADAEYAGKRKQRRVCNGGMAAARCSRRLKTQK

SEQ ID NO: 20212 - protein, 141 aa, Pseudomonas aeruginosa
HLLEEEKKVTESRSMAIEKHNIKLATFIAALFYDLSTQKQVRIPTQIEKRDRELYELVKKSKRPVALLVDETHDLNGHTLTGLKRLLELAEDDSGRRRLSIVLAGHPKLCNDLRRPTMEEIGYRTDIFELQEKMQSAGLPV

SEQ ID NO: 20213 - protein, 284 aa, Pseudomonas aeruginosa
SICRPWPSIQSVMSWVLRLIFGKERETSAPKAIAPAPHPHPRRRSPRYRRLPPARRCTVPPLAATPAPAGARRSVRGPRRSRAARRLRAPAVPPHAGHSGFPADARAARARGAAGASRIRGRSAPARSSRGRRPPPSTDRRRNAGPGRRSARDARATRRAAPRPACAPSRGLPGRPARRPAAHGAIAGARGRASAPDWPRTRSGRRLRRLPGPAPLPPAIGGCALPPASRRLRSGPRCPARRPVAGATGGRSAHGRRPPAPARSCPPGGIAARGPAGLHRWPRR

SEQ ID NO: 20214 - protein, 275 aa, Pseudomonas aeruginosa
ASGWNRPSRCTARGRSAPSCRPGRSAARHRDRSRRTEDWSTCSDSFAGRAVLHLRYRLGDPLQWLFGGRRWTAAAARRATAGGVGEAHRGFLPGPVDGLQAVVALFLGLVATQRAEVRALAAEFQQRLENRRIGAAAFLQAQRQQAEDVRHFGEPFAGRRERQQRQVFEVQRQVVRQLRYVDLQAGPGIAVEQVDHRLATVAALAVDVLEEQQRDRAAALEETVVARLDVQQVALAELVEQRREAVAQRFRQFAGADQRMQAEALLAQLGAWIVE

SEQ ID NO: 20215 - protein, 65 aa, Pseudomonas aeruginosa
KKLILDMLEAKLPPPKPQSSAIRANTQYGVFGSCTAKPSQMHGISIEAVLRAVQRRPPKIGTMNE

SEQ ID NO: 20216 - protein, 312 aa, Pseudomonas aeruginosa
QGRKADPAPLPGSPLRLLPHPAGIAGADRDVQRPALRRLHAPGRRGDQPRRLVAHAHLPGRPGAQPGRPPGAARDPRRTPRQRRHPPPAATPGRRRPDPPVAPGAARGPRAPGPARAARTRRAGRLRRRHRPFRRHPPGQGRAPLATAQHGAGPVPVPQPAGGVRHPLRPQLSRHRPAARTHQHRPPPGPRRAGRAGHLQRRGRTGATGRALQPDGRRAEEHLRRPGRARGGQDPRPLAEPPAPRTALRQRPPAGREPLRQPHPATAAEPVGESARRRPRDPLPEQGRGRARLQFADHHRAPGGLLPAGRLR

SEQ ID NO: 20217 - protein, 232 aa, Pseudomonas aeruginosa
LPRAGQRLRPTLVPGPAIADAALVHRRPPFRRTVHRKPQRPPGELAAATDRDLLRQHRPHLRPVPATGTGKPPGPVRRARHHRPRTARLAGTVAVLPEDPGQPPGHPAQARGAGGEDRGHPRRTARRPQRRLPATARTAHHLPPQPRRAEPGSRAGERRGRVRRARRGDDRTGQPPATRAAEPQRGNPRPADRPRGALQRGSPFAGATGLGAPEQPGRRPGEHRRRGRWRRL

SEQ ID NO: 20218 - protein, 269 aa, Pseudomonas aeruginosa
RPLWAYHHAGARPDPRQPVALRSARAPRHASALQLRADRPATLRRQGADPMTDMPATADEPVRLLLVDDHPMMRKGVAQLLELEDDLSVVGEAGSGEEALRLAAELDPDMILLDLNMKGMNGLDTLRALREAGVDARIVVFTVSDDKGDVVNVLRAGADGYLLKDMEPERLLEHIRQAATGQMTLSPQLTQILAQALRGDDRSKSLDELTERERQILRQIAHGYSNKMIARKLDITEGTVKVHVKRVLHKLGMRSRVEAAVWAVENDLV

SEQ ID NO: 20219 - protein, 159 aa, Pseudomonas aeruginosa
AARGLDSGQEIHRGAASILAASFHEAPVMMFERSPDDPLPLVYACSGCSNVAQLANDLALRLDRARLAEMSCIAGVGGDVPLLVRRARSGRPILALDGCPLHCVKGCLARHEVVPTLHLTLSEHGLKKRYGEDCEAQDAERLFVELERLLTPGGKRRCE

SEQ ID NO: 20220 - protein, 436 aa, Pseudomonas aeruginosa
DVPSASKKGHFNADRCAAGPHLGHPPRPIPGQGPAGLPGGSRRAGPGGGLGDLAGQRRKPPPATPGTAPELCAGTLSGGPAAGGRTEERQRPSVAGATLEDRRLPPRRQRQPGRHQLRQPALPGAERPARRRQLARLPAAAAAASGLSRQHPGIPRRTPGRAFRQLTEGGPDGNPPSVRPGLRCLRQRPPALSRCALPPSRRALRPAPARLGLRHRYRPGRARPGAVLRRSPRQRHQRAADRTRRCPSGYPLQRAGRRSHRLSRRRLRPGLRSPGLALVRPFALQPRAAARAASRRRVRRLGLRLVQHRRADRCRHRRGIPAPDRPVLGATEPPAVERLPGCRAAAGRTPRSGLRHRATMEPGPVVRLHGHLVGQPPVPRGAGQRFRAPGPATGRRALGRADLDTQGSHAAGAADLAQGRLTEPSGGFPRPANPVR

SEQ ID NO: 20221 - protein, 289 aa, Pseudomonas aeruginosa
AALLPTPSQGTLPMSQPVAFVTGCSSGIGRALSDAFQRAGYRVWASARKEDDVRALAEAGFQAVQLDVNDAAALARLAEELEVEAAGLDVLVNNAGYGAMGPLLDGGVDAMRRQFETNVFAVVGVTRALFPLLRRKSGLVVNVGSVSGVLVTPFAGAYCASKAAVHALSDALRLELAPFGVEVLEVQPGAIASNFGASASREMDSVVDVRSPRWPLRRQIQARAAASQDNPTSAEDFARQLLAAVQRRPRPPLVRIGNGSRALPALARWLPRGLLERLLKKRFGLDTRL

SEQ ID NO: 20222 - protein, 247 aa, Pseudomonas aeruginosa
GCLNEFFTFSSARLDPPSPSVGHPPHEADMHRSPLAWLRLLLAAVLSAFLLGGPLHAAETAATRSPAWAQAVDPSINLYRMSPTLYRSALPNAQSVALLQRLQVKTVVSFIKDDDRAWLGQAPVRVLSLPTHADRVDDAEVLSVLRQLQAAEREGPVLMHCKHGNNRTGLFAAMYRIVVQGWDKQAALEEMQHGGFGDEDDMRDASAYVRGADVDGLRLAMANGECSPSRFAVCHVREWMAQALDRP

SEQ ID NO: 20223 - protein, 250 aa, Pseudomonas aeruginosa
PTLIPKGVPTMVKTCGKALLGLCAAAAVLALLIHWITPATILHYREDLLFYLQAHLVLVFSSMAAALLVGVPAGILLSRPGMQAQAERLMQVFNVGNTIPPLAVLAIALAIIGIGNGPAILALFLASLLPIVRNTYEGLRNVSPALKEAATGIGMTPNQVLLRVELPNAVPIIVGGVRVALALNVGSAPLAFLIGANSLGSLIFPGIYLNNHQQLLLGAACTALLALLLDALVVLFSRMFLERGLTAKEA

SEQ ID NO: 20224 - protein, 515 aa, Pseudomonas aeruginosa
RTTSSTSPSTTPPRWCVRRSCSAIRSSPRCSIRSSSGSTTPPCRRSTRGSISSSRRHRRSPPTSSANTTCSTTARPAREVASNGLLQRAFPSRLVPGRPAHPPAPAAGTGRRRPGDPRRRAAGRADDPLHVAGRPAAGRRHGDADHPLDRPVRPADAGLLGIRPGPRAAAGDHRGVPLFAAADPAQHLPRPDRRRSGHPRGRQGHRHDLLATPADGRHSPRGAGDPRRRTHRRGDEHRRDDHRRGDRRRRPGRADPHFHQPEQHADAGGRRGTGQPPGHRRRPAAAMAATHPHPQGTARQRALTGAEHDRTGQAQQDLHPEERQGVPRRRFHQPDRGERRDLRLPRPLRLRQDHHPEDDQPDHPADLRPRADRRPGHRGPRRGHPAPPHRLRDPADRPVPEHDHRGKHHGRAAPARLGQGALQGEGPRADEHGQAGAQAVPATLPARTLRRPAAARRGNPRAGGGRAAAADGRAVRRGRSDQPRVDPERVLRNAAQARHDRDHGQPRHRRSHQAG

SEQ ID NO: 20225 - protein, 211 aa, Pseudomonas aeruginosa
PGQGPGLRATQGPAPPGGHLRAVRHPVPGHRQPRRAPAHPVVADVRVQQLLAAGARPRPAVPRRGHPGIHRRLPQLRPLARRQGPDRVAGRTGRGLGRRVDIHRRQPPTAAYSWRVAPSSAPPKRKSPASAGLLPAPSTQPARPGACAAEAWSSRPCGLTITVQVIPAESSTPSGTSSMCTRTGTRWARRTQLKVGLTSAVSSRLSGLSRS

SEQ ID NO: 20226 - protein, 101 aa, Pseudomonas aeruginosa
GRAGRPGWRYRRSSARKPPIARRSPSGCPPNAGGSTGRKCSSAHPPGSGCIAPPPRRSRPPPRPTANAGGRRRRSAGSPPGRRCRCTWRCGRTPACRRRRH

SEQ ID NO: 20227 - protein, 321 aa, Pseudomonas aeruginosa
EAPSMDTLQNMRAFVCVAETGSFTAASQQLNTTTAYVSRAVANLETHLRTRLLNRTTRRIALTEAGQRYLLRCEQILAYVEEAEAEASDAHARPAGKLKLHSMTGIGQHYVIRAIAGYRQQYRDVTFDLTMANRVPDLLDEGFDVAIVVASELPDSGFISQRIGETYSILCASPEYLRLNGTPSEPSELASHDCLRLVSPVVPLDRWLFDGPNGQEMVSIGASPFQVNVGDAMTEAIRSGLGIGILPVYSAIEDLGKGTLVRVLPQHRLQQLNVYALYPSRQYLDAKIKTWVEYLKESLPGLLQRDEAALVELGLELGRPS

SEQ ID NO: 20228 - protein, 512 aa, Pseudomonas aeruginosa
GRAGRRPAGEAHPRRRPGCLREGTAGRIAAVRPGQRGDPAAHRLGHPRDPPGHGRAGAAELRGGPARRAAAGPGQSAGVATRLSAPPSPLGRARRPGQRRRLRLAEHQDVAEHHQDQPGQRRCGPAVALGEGRDVQRHHREQHGAVGGAIRAHAPDQGQVGGEADHRAGDRQVQQRADVARAPVEIQRHALEQAQRQEDQGAVEHAPGIAGERADAGLLLQAGKHVAGGEAQRAEQGQAEAVEGFRGGLVTHQFRPEQQPQAEQAETATSHHVRRDALAEPQAGVQRIPQGGGGEHHGHQAAGNPLAGGIEADEIQAEQAYALSHAQALAPCVQPLQAAAEQQHGEQHQRRQGEAVGDRQGDRHRAHLQLDGDPGGAPDEHGEQVQRKIHGDSATTGCRQSAGEAGRDHCPFLRFSSAASRGSVRARVAWPACTNPVISRYSAPSTGPPMRACCAAARSATAWRSPIGTATKRRSSATATPAITPCRSTCRAAGRPSAAIVPGSMAAPTASA

SEQ ID NO: 20229 - protein, 177 aa, Pseudomonas aeruginosa
SFCSGNVQVSSADLAHAAALHTLYSDHHHWLTGWLRRRLGCPQNAADLAQDTFVKVLVSRQAARIDEPRAFLTTIARRVLCNHYRRQDVERAYLEALASLPEREVPSEETRAIVLETLVELDRLLDGLPPLAKETFLLAQLDGLGYAEIATQLGISLSSVKRYMLKAAQRCYFAELP

SEQ ID NO: 20230 - protein, 199 aa, Pseudomonas aeruginosa
TATRRWMSASMPANGACSCCAGKSSSAPARTRARCTCTARKAGCDRWAPGSTCASSPDAPASPSTKARCRWRTTPARACCCPAAGSWTSTASDSALRSRCRSAAAPGPTACWWPPACAWTNSSPKSRATAPAGWAATRASAACGFPAAIRWTIASGSSPPCRRCCPWRYGASPATGSACTRANERKDISAHLSLFPHLA

SEQ ID NO: 20231 - protein, 757 aa, Pseudomonas aeruginosa
QRRKANLERSTGVSLMSPSRALSPLSRALLLACLGGPVLVSAGSACAAEIRTDTRQYYRLPAEPLEQALNHLGRQAGVLIAFSPEQTAARRSQALDGEYTLEEALAALLAGSGLEARARGDGAYTLEALPVEDPANLQALTVVGDWLADASAADVFEHPGARDVVRREQFQAQGAASTREVLERIPGVSAPLNNGTGSHDLALNFGIRGLNPRLASRSTVLMDGIPVPFAPYGQPQLSLAPVSIGNMDAVDVVRGGGAVRYGPQNVGGIVNFVTRAIPEDFATKLDVHSELSPSSSQDGLKTTHNVLIGGTGANGLGGALLYSGTRGGDWREHSDTRIDDLILKGRFQPSDEHTFSAMTQYYDGEADMPGGLGTAAYRDDPYQSTRPYDKFWGRRTLASASYEYTPNASQKLNVTGFFTKTLRSGYLDQGRNLTLSPREYWVRGLETRFSQGFELGESRHEVGIGHRYVNEASHELRYWTRADSGQLPSTGSRNDRDTRGSTEANAFYIDDRIDIGNWTITPGIRYEKIDSEQKNLLKNSKDSGRYNASLPALNVIYHLTPSWNLYANTEGSFGTVQYSQMGKAVRSGDIEPEKARTWELGSRYDDGILRAELGAFLINFDNQYESNQQTDSVTARGKTRHKGIEAAIAYDLADLDPLLSGFDVYASYAYVDASIREDGPNKGNQVPFSSKHKGTLGANYRTGAWSYNLDGSFQTSQYADNANTESESADGSTGRIAGWMVWSARGTYDFGPQLNDL

SEQ ID NO: 20232 - protein, 547 aa, Pseudomonas aeruginosa
SRVFPGRPAPTPTDSSRHASMTTQAAEVAKRRTFAIISHPDAGKTTITEKLLLMGKAIAVAGTVKSRKSDRHATSDWMEMEKQRGISITTSVMQFPYREHMINLLDTPGHEDFSEDTYRTLTAVDSALMVLDGGKGVEPRTIALMEVCRLRDTPIVSFINKLDRDIRDPIELLDEIEAVLKIKAAPITWPIGCYKDFKGVYHLADDRIIVYVPGHGHERIETKVIEKLDSDEARAHLGDLYDNFVEELELVQGACHEFDKDAFLKGEMTPVFFGTALGNFGVDQVLDCIVDWAPQPLSRATHERSVEPTEEKFSGFVFKIQANMDPKHRDRIAFMRICSGKYEKGMKMRHVRLGKDVKIADALTFFSSEREQLEEAYAGDIIGLHNHGTIQIGDTFSEGENFGFTGIPHFAPELFRRVRLKDPLKSKQLRQGLQELAEEGATQVFFPERNNDIILGAVGVLQFDVVASRLKEEYKVECAYEAINVWSARWIECDDEKKLKEFKDKAFENLSVDGGGHLTYLAPTRVNLSLMEERWPDIRFRATREHH

SEQ ID NO: 20233 - protein, 234 aa, Pseudomonas aeruginosa
RRHPRQPGGRRGGHGADRQQRRRRTRSRPRPTEAVPAMPAAGGTPQPGPGAPGKPRRRTVSRLQPALAAPTPDSRLFALADGARYLTLDTRLEKAAGEIRSRWLLAGSELDEIAHAGPVLIEFMDSAPLSSSGEFLGWLRDWDRRSPMASWLWSRASFENLAKHFAGLLFTRMPDGRRALLRYYSPEVRRALEQVMTARQWTQVMAPLERWQVWQPLQGGYLVYDRETERTADA

SEQ ID NO: 20234 - protein, 385 aa, Pseudomonas aeruginosa
TGCRPTGSPAAGPRRRSHRAGPAGGTPGGSRLARTTRPAARHPATRRAARDGAGTGYRRARDDRTLSSARPGLPRFPGHAGVSRTHAPAAGGQPGTTLPGLRTDRRVSPGQPEMARVRNLGETGMSGIGALFRPLPRMGPRLPFELPAPPRPHLPMPAPRPLPRPAPGALPRPVPRPMPVPQPLPRTETGTLSRDRTREAERDCSKSQGRDKDCVECPPSRGEMAIANNGKGHSMSDLSARYQQWVTNFPFPHEWFWSGTWWDGFDEPRCTLLEAKANYAFLFVPLLGVPRPWARAKVKSDLLQKAEVHSDKARPTPPVFVEWHFLQRIVYEYCAAEYLRMGLANLKAFWNPMPGTDEHDDYQETRAKEQEEMKRFCEENPGYCA

SEQ ID NO: 20235 - protein, 148 aa, Pseudomonas aeruginosa
SASSMPSRPSIRCWRTGTCAATPCAMPSATTSPSTARISPRPCRVTDAPGRWNWCYGTARRIRSRAGCRWTTRPAAGPSRPGSSWKMPAACCRCSTHRRPPSSRSSSRRWKSGPKRPGACSLRMRTSYTSGPSRTAAASAGSASARIR

SEQ ID NO: 20236 - protein, 409 aa, Pseudomonas aeruginosa
WNWATCRRCAADDVRTWWGLRSVGRIRHRRYPRPPAATADNRRRLFALPGPRSTQQGHPGVTSVPWDEYATGVIRRHPAATADNRRRLFALPGPRATLEGHPGGGSVPWGEYATGVIRRYPAATADNRKRLFALQAHVPCRKATRGWPFCMATNATGAIRCLPAVLLHRHPAQVDTDHHRVVVGGPVRLGVVQAVLLPRGLELDVVVQHPGLVGVDVPLHRAAYLARQAGVGEGVVKVAGLPGEHVGIALSCARLTRHQVGVAGAADDVHRVFLGIGIEVADDQAIRLLGARRIARQPVHQGLGGARPGQVAVALAVAGVRVAVAGRALRLQVVHRDGQAFAAIDLLEGLGQGRTVAGVVELRVHRTVEHRRGSIGADLVAAIDQPHGNFVAAQLRPVRVDEGIALALG

SEQ ID NO: 20237 - protein, 1388 aa, Pseudomonas aeruginosa
AGVEAVDQVGDGAELAVAVVLDLHQADDVRLRGEDRRDDLRFLPLELLGRVGSARGGETAALAIAVEVVEHVEAGHPQAPFHRRLGRTRIGCLEGRRLQRLDTVAAGRVVEHAVDGAGTVADAQAVVGAQFRCRVADRVGVLPAAAVVEENPVEVVARLHGLGLFAGSHHVGRSHLAAAGGQQDLAVAAEVVDLVDGQRLAELHAHAFVALQRIGAGQRQADAGRRRQRHAARQDADLQRPDQLGEAVELADLAGHPDAVAELDVAAVAAVVDEDAFGGRRVAVHRGIFLLHVEALQLAGVLEVADHHALDGDPLVHQRTFGAGALHLVDRSQAGLLAAAGLASAMLAEVGEGVARVAQPLRRRVEGVAGIAVAVADVGLAHQAPVEGLHIAAAPGRAGVEADLAEAVEDLAAAPAQQHRIVAIEPAAFHPLAGQRQQRRVGHAVGEDEGLARRQAAAQVDAAARRAGAVEIELDAVGGEVEDLAAAVVELQRLVVAAAFDILGDDQLGGVGHRQAQQGQAAQQGGVTQGVHRDTPLSEWGRRGSGAVGLQFLGKHRLAVEVAQGDGERAALRIDLHLAEELVAGEGGTVLDQRGLLEHHLRAERAIQRVGSETTGIERPGDEFPERREVLERGTLRAVLVGCAVMHVGGQPDGVSHLGALDEAQQVGDLQLAAEGGAVVAVGDGLPAVAALGVLAIGHAEADRHVGGDHLPLRARTAQLALEPLQLFTAEEIGGGAAPRLQVGAVAAAVAAHVEDEHVEQRAVGDLAVDPPVAPLALEAQRRVFEERLACTGRQHVDVLHLVALVELLAGGPVVGGLVVVPLPDLRHLGVEAAQVVVEQVVAVVAAELVEGLGDLALGLGHPVAPDAPALGLDAFGDRPIGIDGVAAVQEEIRLAPAHGFVDTHAADIRIDPETLPAGVAAPDETDIARLARRTAQVAEPGLAQAAVAGILEAHPVEDRLVGRQATQVDARGVVEALVGDRRDQPTRLAEDATGVPFDDHPRRAVGAAPDQRAVALHIAGLHAIGQLRPRPGRGDHRRRAQRRQQQSSAQALHDAAALEVHPTHTGVLRRLHEGPVYRGKLTGALRGQTGYPFGQGKRPFAPRRPCGNEPGVASLKRASVSFRLQGIHPIGGARPATLASLYAPFHRPQPPRAPWTGPWGASPRSSCTARPARSTAFHNQGGRCSGSRLSRRFLTARPSSVSPSITRRRRKNRVSGSSCRLASSRKSRQSPRMVTLARGRSTRRRPPGTRVTHQPTPRSLTSRRSQRPSSRSKAPSSSGWANSRLATRCRTRCWSPRGTFAASGNRRPATPRSRRWRFSITLPPLPAASPAGRASSRCSLPRRAAERHPCIPGRRPRSPRPCPAPEDSGVAGQRRYVPASGSRPAGC

SEQ ID NO: 20238 - protein, 222 aa, Pseudomonas aeruginosa
RRAAGWPSRRRNRISAACPSRTAAVPGSVSSRRSSLPGTVIGAQGGLVPFGKSGQRALPLRLHAIGARRAGVAVQRLAPDPGDLLDVGRAALAAFDLHRRHADFRQLRDQVQGVQAGRFLQRMEALAIDQETALAEGRVAGRLAGGVAVDEHFVEARGQPLRFLAPAHRPGRRTDAAEVRRLAGDVGGQVAAALGHDAQAAEGEHLHRHRATGRHLAYLRQR

SEQ ID NO: 20239 - protein, 166 aa, Pseudomonas aeruginosa
HAGQDRATDAVAFVIEGQGRGIGCRALHRQMQVEPRMTLRGIAEHRHVGGDQRIDAEVGGLVHRALPALPALRAGIGVDRYVELPPGLVDSPQAFLQLAFVKVEAGEMAGVGVVAETDVDGIGALSQGRLQGGQAARRTDQLHGVAPLAKNALRGSGQPRGTGATL

SEQ ID NO: 20240 - protein, 551 aa, Pseudomonas aeruginosa
KDAPGRRLTGIKKASGHQCGERQKVDRITHAQGGAALDHRQPVRPTGGKQHRRALLRVDFHPPPFIEPRPQVLATRPRLRPVEGRRQRQRPRHYVEQSLLAKQERTRHQQCGDQRRRRVAGQPQPGLAGHGAEGERLARLDRQAPQVDLAKLGDGALEVVFLAYRDTAAGDQRVPFGGRQAERIAAGHQFVGEHFLVVHLEAQTAQQGADAVTVGVVDLPGQQCLAGLAQFVAAAQQADAQAPTHRDRGDAETRQQAEFLRAQALSGTQHRRATTQLLAAPAHMLAGAHRRQLHALAVDHAEFLRHHAVGAGRQRRAGEDPRRLAQRQAHAAGVAGGDPRADRQAAAAARQVGGAQGVAVHRAVVPMRQVHRRQQVLAEHSSQRPLQGQALAGWRARRARQQFGQRLVERAQLAAIAGASAHERHPQPATGATAGGVFRCGTKLHGRVRLSSCARRISFQAVRQAPGEPGRQHTRVPLLSPASARDWMVEVPISRCETWRNSSPKPSTSRSNSGPTACGVLSRAVKPVPPVIRPTCTSGSAIQAETTARIW

SEQ ID NO: 20241 - protein, 157 aa, Pseudomonas aeruginosa
TSLLPALRGGLVAAAAFDPARAFGGVFLLPERRAGLQVVHDEVAGVERRLPVGAGATDEDDRLARLQAADAVEDLQAQQRPALPGLGGDLAEGLLGHARIMFEEHPADLATVVEVAHVADEADHRADADVLRMQGVKLLPRIESCLLDADGHGFNLR

SEQ ID NO: 20242 - protein, 268 aa, Pseudomonas aeruginosa
RWGRRRLRRRPATARRGRTVPDCARTSGSARRGYAPRPRRAPPGAGARRRGSPARRPSSTARRRCPELRGNGRNTARGSCLPFLLFAVVAALAAELLQQLDLLDDHPAVHRLAHVVDGQGRDAGGGERLHLHAGLPGQPATRADAHGVRRLGLQFELDAGEQQRMAQRDQFVGALGRLDAGDPRHGEDVALGMATVLDQLQGFRAHAHHGLGRGFTGGHGLFRDVDHVGAALGIEMGQHVGAPGRGYWPVIVSPGGHDAMPGGGSEGG

SEQ ID NO: 20243 - protein, 314 aa, Pseudomonas aeruginosa
HDVKAEPGDRSHRRLPGRLRCHFCPFQGGLMNSATLTELDLPVSGMTCASCAGRVERALKKVPGVAAASVNLASEQARVQAPADSLPALVAAVEQAGYQVPARSLELSIEGMTCASCVGRVERALKKVPGVREVSVNLASERAHLELLGAVDSQALLQAVEQAGYKARLLDAGQPRQDDAERRLRRERWWVIAALLLALPLVLPMLVEWAGLHWMLPPWAQFLLATPVQFVIGARFYVSAWRAVKAGAGNMDLLVALGTSAGYGLSVYLWLTAPPGHMPHLYFEASTVVIALILLGKYLESRAKRQTASAIRAL

SEQ ID NO: 20244 - protein, 149 aa, Pseudomonas aeruginosa
AVAPGARGAPARRSRGRGGDRRVALRRRGGGASRRTLPGGRRGARRQQPRRRGADHRREPAGAQGSRRQGHRRRDQRRRPPAPAHHCARRGNGAGEDHPPGGRRPGRQGADPEAGGQGQPGLRPGGDPHRAGHPRRLAGRRGRPGAGPG

SEQ ID NO: 20245 - protein, 369 aa, Pseudomonas aeruginosa
RRGGAGDRLPLRPRPGHPDRDHGRHRRGRAPRHPDQGRRVPGSRPCGHQRGLRQDRHPDLRATADHPPRRRRPGATAQARRRPATRQRAPAGQGRARALRRARPGGSAGERQPGPQRSRHPGRGRGSPAGPGQPPPARRAGTQARRAGECRRGLGGRGPHPVLAAGTGSGETRARPVRLRRQPQGRRRRSGGGPARTGYPQPPDHRRQPRQRGGGGQGPGHRRRTRGSAAGGQGRHGRRAERPGPGGGDGRRRHQRRPGAGRRRRRHRHGWRHRRGHARRRHHPDARRPAPGAGGAGHLAADLREDPPEPVLGLHLQRDRHPAGGLRPAQPDGGGRSDGLLQRQRGRQRPAPATLEALSQHARHMGWRA

SEQ ID NO: 20246 - protein, 152 aa, Pseudomonas aeruginosa
AISSSTASSRPLSTSPAPPAGSAGGSGNSARMRWAPGQAGKRCNCSRNHSGCCTSNSWSGSKAPPTAPSMACCRVASASRSRPCSRCSAASWPRARRAGSNAPFSRVERASRSRRRAASSGRPSRRSRPAWSNSTCSGSSGLHSGGVAACPP

SEQ ID NO: 20247 - protein, 248 aa, Pseudomonas aeruginosa
SLESVICAAQPLWLAPLRRMENDRAVAKTRRPSVCLASGRFSGVGKPRQTVDRKALPASCHWAISIRMRFLSSLPTLVLGISVTTAICEGIAHLLMLPCSTKGLRCSFRPRASSCWPSRTTSRANGRSPHCGSGTPTTATSRTAGWRLIRSSSSREDSHSPPVLITSLMRSRISMKPMPSRVATSPVCIQPPRHNSSPRSGSRKYPWVSHGERNTSSPWDSPSAGRKRPCSSMIAASTSGTGTPALIR

SEQ ID NO: 20248 - protein, 393 aa, Pseudomonas aeruginosa
RSMSDIVIVAGARTPMGGFQGSLAGVSAVDLGAVVIREAVQRAGIAAEDVQEVIMGCVLPAGLKQGPARQAALAAGLPAATGCTTINKLCGSGMKAVMLAHDLLKAGTNQVMVAGGMESMSNAPYVLEKARSGLRMGHGEIKDHMFLDGLEDARTGRLMGSFAQETADKYGVTREEMDAYAIESLKRAQAAIADGSLAAEIVPVTVTSRKGESVVKDDEQPLTANLEKIPSLRPAFRKDGTITAANASSISDGASALVLMTAEEAQRRGLKPLARIVGHATQSQDPSEFTLAPIGAMTNLFARTGWSKDDVDLFEINEAFAMVTMLAMREHGLDHAKVNVYGGACAQGHPVGSTGSRIILTLINALRQKGGKRGVASLCIGGGEATAVALELL

SEQ ID NO: 20249 - protein, 913 aa, Pseudomonas aeruginosa
LGVRTICGASSVIAIAVLHLAAEHVVAPGGVAEDEGNDEQRADQHEALALRRRRGLPDAHRRRDDVRPQADPQAAVAEEDQHQGEHERLHVVVVGHRAQQRIEGHQDQDRHRQEPEQVRQAEPACGDLGMGQRRPQADHPDDRQQHQRQRARQVVHALLQAAFGLHDQPGAAEQGVGDDQGQAAEQRERRDPVQRTAGEAAVLHRDAFDEGAQRHALEEGRHQRTADERLVPDVLLGRLGLEAELEGDAAEDQPDEHEDQRQVERRQDHRVGQREGPEQRRAAQHQPGLVAVPDRRHGVHHHIAVAAVLEERIEHADAQVEAVHHHVHHDAEDDDDRPDEGKIDTHVSVPLVLVAVGRLRVAVVLFVETFAGGRQRPCRRALLPGASRVGLASLMGDRALAHQAHHVADTDAEQREVHHHEGQQGQAHLRHALRRGGVGGAHQSVDHPGLAAHLSGEPAGEDRDQAGRSHQQGQAQEGLRVEQLVLAAPAQPQAPDADQDHQHAEAGHDPERPEHHGGVRPVFRREVLQRRDRLGQAVLEDQAAEHRDLHLEAGFLALHVRPAEQDQRGRLAAAVVPVAFHRGDLRRLVLQGIEAMGVPDQRLYRGDDQRHPHGHREHLADPRVVAPAQQDPGGRGADEEGGGEERGDRHVQQAVGERRVEDHRQPVHRDHPAVDDLETLRGLHPAVGSEDPERRDQRADRHHHRGEEMQARSHAVPAEQHDPEETGLEEERGEHLVGQQRTGDGPGEVGEMAPVGAELVRHDQPGHHAHAEVDRENLRPEMIEVAVDLFVRFQPEAFQYGQVAGQPDGDRREDDVEGHGERELDAGKVDSLQSEHGNSSSGSRPFRLTCGFGRASSRATLRKVLEHILQLSFLSLESDRSPGWQECGKGRKQIPGPPALMQSNSVRKSYPLA

SEQ ID NO: 20250 - protein, 107 aa, Pseudomonas aeruginosa
SSRPWRRKASTCRSRCSPTTCSPTCRSPRSAWTPTTSRPCRTWRTSTKARAPTWSPWSAYTSSPSVVIRGNTSRWPSCPTAPPSPFPTKAATAGAPCCCCRRPACSS

SEQ ID NO: 20251 - protein, 79 aa, Pseudomonas aeruginosa
SKARPAPARSCSPGRSTATANAPVCSSRSVAAPSVATMPKPSCSATLPAPITARSAAAPAGSVRPMAAPCTWTRSPTCR

SEQ ID NO: 20252 - protein, 167 aa, Pseudomonas aeruginosa
WARRSRWRSPGSTRASASSPTSTCCWLAACCCSCCSPVRPSTCSTPWCRTSATTSATCRARASTSTPTAAPATGWARGRCSTGPGGSPGRPSSACSSRASRAAGRSANSSSACCSSRSASPWRGCRSSATAPWSRPSAAPANSAGWPSSSRRWPSTRCSRTTPGAAR

SEQ ID NO: 20253 - protein, 207 aa, Pseudomonas aeruginosa
WATPRSRSSTTCSTSTSGTCSSCTWCVERRKRGRAGRPFPHPPSLTAGNDASGNIPSPCSCESLSAPALAGRTARRSRRIPPVPATGRCPRSRRRPAPAARPRRWRRSPRRAGCPSGSRRRSAPKPAARRVASALRHKPLRRPRPPPHASSGHFPAARKSAHRPPGSCRWSAAGRSPGPPPAPAGRPCRYGAGAGRRGSGRCPGRRR

SEQ ID NO: 20254 - protein, 373 aa, Pseudomonas aeruginosa
  UNSURE (62),(75),(83),(106): Identity of amino acid at the above locations are unknown.
AAVLLAQRVSPPYGGNCLAASTAPSAGVSRKVTSVCQMALSRTSVTAVSRTMTSGCSGTLGXIGWMCRSPKRAAXRAWLLGSXDWSRKNSTWCSSRACSMARWPVXSSGAPRSMPETMAPRAGLMGWMVRLMSCYSSGRLRARPARPRSGLRRVSEGRFGNDSGLSRSTPGGEAPLGPAQPQFEAQGDGGDQQDADHHQVGGEELRGGLDHEAEASVGRDQLGGDQGRPADAEGDAQAGEDLRQGTRQDHVAHHLPAAGPQAAHRLHPRSVDATHAGGGSDQQRREQRQVDQQHLAQLADAEPDDDQRQVGQRRDRPVELHQRIEGRSGQGIEAHQHAQRDRRQHRRAERQEHPQQAGADVLQQAGIEVAILP

SEQ ID NO: 20255 - protein, 223 aa, Pseudomonas aeruginosa
PTVMSAAWAATERLAKARAATRRCREFGRFIGRTSEATVPRSGGERTRDGQWVATASPVVRCDADYRYKKLDINNILELVYERECAPGCPSALAPCPRPYRAAPSKRASRACRRRQASSPARATASASLASSDAAALSRNVSAPPRANAAWKDSAASSTRRSARARRRGASPCPATSPGTRAAWPRSRLAWANRVKPSRSCPHGVGGRPGGTRMSSGCSRSRW

SEQ ID NO: 20256 - protein, 436 aa, Pseudomonas aeruginosa
SAPTGGRCGSGCPGARRAAATRAPVPVRPAPAARPRPGRARVRAARRAWPPPRPRAGRRGAAGCRPARGCPALGGSPGSRARPGSGCRPCRTPSGGCRPASRPVLTLADQAFLARRGDQLAALVEDAAAHETACVAGPGAVDGVEQPLVRAQVAVEPQGVVEAGDLHGLLPHRNGMGLHRGGKETEIRGVGQQVLVQRRDVRQLAVGTEPEVLHRFVGLRVVGVVLGDRTNLDGLRIQQLVADALGNPLGALAGQLQFRRQIIRANHLGHLDLVVETFLVVLEGAAQGEDRLAFLDRGDPAGAEAAAVAHPVHLVHHRHAGVAGTQEVAVHGVYVAIVLHRLAGRRQRLPQDLAAIELAEAEILAHAPEQVLLDGFQAQQSHQVVQYLGHGVFPRIRAVDGLVAAHGRVRGHVAKTSVPHRAAEGEMVETGHGLIR

SEQ ID NO: 20257 - protein, 142 aa, Pseudomonas aeruginosa
APARSRTVRRRSRTRRSRPGQGRTGRPVRFRRRRAAGASPSPGSPRRSRGRPARGRGHAGSSDRLAHRISRPRARARWSMPGGSRRAASSHPAAKPAAPAVRRAPPGHACRDGSGRAAAPAPGYRREAAGRLRWDAGCRSTD

SEQ ID NO: 20258 - protein, 598 aa, Pseudomonas aeruginosa
PMKGSPPLTCSAHQPKPCSAKCASMRRSNASLWARSRQDGKNSITSGSAFSSANLARSCTSQGRRIRRWVYSRGERRCSMLRLVRSAIAWFLSFNALQKDYLTAGIGWGAREGGIPIFGQAPRKRLPNRSVVFSAPGHARSSGKAMTIGLPPGQRARAASIRALFHQAFVQGEDRQFHPNGALFHPGERGVRAEAGILEAPAAFHQLLATHHPRRALDPMRQLGQFAGLLALHQSLEGLQVLAVAGQQFVEQPPEHRRLAAGQRMQGIQVVETGGRRYGDGFGIDGDGQLVGGEAQGQQALLEDIEADGLDQALVHSSLDAALDLLRLGVRGEADDDHRLLAILALLLADRAGKVGAAHQRHVAVGDDHVERLPMPQVESAQAVLRFLHVMTEEAQLLMEDLPVDRMIVHHQHLQPPRLATAERDRPHVLDDRFQHLQAQLDVDPRTLPQLAAHHQAPSHHFAQRARDHQAEPGALGVLQVAVDLGERPEQLLLVAQGNTDAGVFHTEIDLQQRRLHLAAIDADADRALVGELDRVADQVGEDLLEAHGIQQYVAVDARIDLQHQAQALLPGQAFEYPCHRFHQLAQVGPFRRQAEAT

SEQ ID NO: 20259 - protein, 618 aa, Pseudomonas aeruginosa
LDAGDVENIADQLQQALRRGIGDLDAGTVHPTGLGTLERQFEDTDHRVHRRADLVAHGRQEGGLSPARFVGQILCLFQLIDQLAVLGDVQPATDDTADGPAGIAERLDPVVDPALPTAQRHRVDRLDGPALAHGPQVAAMELRSGLEVFHGQFEHGAVHHLLGTQADALQVAAVAGQHPSIDIAHIQRRRHAVGQGLDEPQLVAERLFDPRAHPDLPALISDPAQAEQQQGRCDRQDLGDHQDVVDPGLAAHSRRRAPAIDDIAQVVRRDAQQGLVENRLEFGVASANGEVGGGRTDGNQVGDRQPLAEQPDDVVASGDQRHHRRVGPSFVDQVHGIQRDADLHHRGLRIALAHLLHAHMAGGNRYALAVEAPGALRASLVVRPGDEDVRGGQERAGETQHFLALAAAAHDRQVRLLPGQYADLLGEAATARRDLEMQAGAAGNHVQQVGGDAREGLVGIEEGQRRQVVVDDQPHHRVASDPATLLRRQRDTLARWQGTAADPAPGDAFETVLVDRADGRVDDAQQVRVAATKEEAVAPFQAGIGKPLEPHVAVIGPIDPVVGTEHIVEIQVGMSESHRGNGLVMAAEDHETRPRETLAQFPDMLPGHRHAESGEILR

SEQ ID NO: 20260 - protein, 258 aa, Pseudomonas aeruginosa
QSASAGNWRMHDLRQSGRLASGKAPVVEWSSHSERICPLPGAVMSEPLILDAPNADACIIWLHGLGADRTDFKPVAEALQMVLPSTRFILPQAPSQAVTVNGGWVMPSWYDILAFSPARAIDEDQLNASADQVIALIDEQRAKGIAAERIILAGFSQGGAVVLHTAFRRYAQPLGGVLALSTYAPTFDDLALDERHKRIPVLHLHGSQDDVVDPALGRAAHDALQAQGVEVGWHDYPMGHEVSLEEIHDIGAWLRKRL

SEQ ID NO: 20261 - protein, 726 aa, Pseudomonas aeruginosa
RPELLSDGVQPVVQRVAAEQLFQRRLASFVKRGNVQVGELAVALVGDHLHADILGDPPAFLLQHPADRVQAQRRLEGLAHRGDRHALDQPDILGHRRALRYVAAGVLQQLFLAGAGAGLELDIRHRQLAGLGVRLAHRRRQGHGRMPVQRFFDHLWVDVVATANDQVLAAPGEPDVAVLVDTTEVAGIEPAIADPDIAVPVLLQVALEHRRALQAEVAHLVRRGIAQVIALAVEHRDLHLAVRQAQADRTRPALAATRVATGAAGTFGEAVALDHLEPGTRLELADQLHRHRRRAAQGETQAGQVAAIAGDLQQRRVDGRHATEAGDPVAFHQLPEVLDQGRIAVALGPGQEHLGAAMEGRQAGNHHAVDVEQRQAAEQHVVHPVVGVQAHDLGHRHLVEVAVRRQLRRAGGAAGVEIGSDVVRMDRPSALQAVCRAVGDQRIEVQHALRQRPALGLERLALRRRQQVGRIDHDDRIQLRQLCAQAGDLLPQVGAGERRQGHQHPGVGGADQLGDVLRLQQRVDRIDDPGGLAAPDHVVGLRQVGQQEGHRLVAFQAQPVQGVGGLGDAGEQLGIADPQRFFGGAAMQQAAQGDTLAVALGRALQQFVGAGRQVALFQRHAFQGFDIAQPDDRWGRIHGFLVLPLVSGRTLAGSLRHRPEDATPVVALPLSFCSAPPVARTSPPEGCPGSFAQPPPGPVRPGLEGAGQAWISPRWQHALHWRPFIP

SEQ ID NO: 20262 - protein, 426 aa, Pseudomonas aeruginosa
PRLPLLHPDPGAGTGLHPARPGRHRPRPDRHRQDRRVPHLDHHPIAADPAAERALHGRAARADHRPDPRTGGTDRQGRRGADQVHRAERDDLRRRHGLRQATQAAGSALLRHPGSHPRPSAGLQPARRGAPGHGRGDGPRRSRPHARHGLHPAGPADHPADPAQGRTPDPAVLGDLHRRRDEPRQAVDRRSGDRRDRAGERRQRHRRAACLRRGRQRQVQAAVQPGGTEQLGTGDGLRQPQGRSPPHRGTPDQGRHQRRPDVRRRTAAQAHPHPGRLPRRQDPRPGGNRRGRPRHPHRRHQPCDQLHPAGGPGRLRAPYRSYRPRRRLGHLDQLRRRGRCLRPAADRRTAGPQDHLRDAAGRTAQAGTAQALNAGVEKKGEAIRLRLFRFCDTQVPPPVIEAGRRLPGNTLKSRMDKLFTSIPEIA

SEQ ID NO: 20263 - protein, 396 aa, Pseudomonas aeruginosa
PWPTPSTACARQADRVMQESSMIEADYLVIGAGIAGASTGYWLSAHGRVVVLEREAQPGYHSTGRSAAHYTVAYGTPQVRALTAASRAFFDNPPAGFCEHPLLSPRPEMVVDFSDDPEELRRQYESGKALVPQMRLLDAEQACSIVPVLRRDKVFGATYDPTGADIDTDALHQGYLRGIRRNQGQVLCNHEALEIRRVDGAWEVRCDAGNYRAAVLVNAAGAWCDAIAGLAGVRPLGLQPKRRSAFIFAPPPGIDCHDWPMLVSLDESFYLKPDAGMLLGSPANADPVEAHDVQPEQLDIATGMYLIEEATTLTIRRPEHTWAGLRSFVADGDLVAGYAADAEGFFWVAAQGGYGIQTSAAMGEASAALIRHQPLPAHLREHGLDEAMLSPRRLSP

SEQ ID NO: 20264 - protein, 87 aa, Pseudomonas aeruginosa
AYIVCSPCKGLQANSAPRFPPLFSGGNCYNKSIMPKRSIFLCTLFRSSVIIIDIIRHFYWIDKPFKYGIKSCLEPPYILMPDESLNF

SEQ ID NO: 20265 - protein, 622 aa, Pseudomonas aeruginosa
SSGRRGKHRRRRLLHQRPIRTLEGEALDTGVSRQHADVLSHRSLQHLHLQVRGDLCAGRVEVERLAAFARQQFHHMQAIAAFQRMLEQPGRAAQQALLEFGDGLPRLDPAEVAARLLRRTGGETPGQVDEALGMPAQLVEQLRGLLARRLAAFQVVRRAGQQHMAQLQAPGAEQAPRIGRVPGPAGVFVGFRDLHLFLQQLADARFLRRLAVFAAGLDAQRVGPLQEQLADDQRTAGGLQRQRVAVRRVVLQLAGQQVFTDGHAVDLQLRQFDLLDAFFVVGATHDRSPRFGGPAPDAPAAQGSGRTFLTHDLVAPAQVPHRRADDVHQAGEGEQHEQGKAQADVQLVDQAHRRDGLGRRQRTQGDDGLGPVGEHHHHRAIHVMGRGDDGGEAEDQLGVEHQQDHQVGGVASGAHPCVGQAAQDQSAQADEAEHAEEAAGDHRQQLLVLGADQVVVDRGRGQQADEVAGEDEQHADVEQVAVYPHALLAEHLAGTGLPGVLREVEARPAADQADQQRDIGIDPEEQKIGRHAQTPSRAARYCICGTGWATHCNGCSVDAVGRRPLLDGQPPAGSVKLTGVSSQARSMASRLSSRCSWAWSRRNAPRSGRSPPSSSNASKIAA

SEQ ID NO: 20266 - protein, 1501 aa, Pseudomonas aeruginosa
SSRCGNRCICRGSAPCRLANEFSWRLSSNVLGQRLRQGVAAESAVAGFVQPVDLAHLAHHDELVAVAADRAVVVEAPGLLGVAADHVGRFEHHAGHRVVVAATGAGGLAAGYVHDAFLGVVHHHHAVLDPLADHRAAGRRAVGVEHLDPVVIDDPGLGRVVLAEPDDRTAARQGEHQQVVAVGGVDAPFLVRGDPVQGDLRVAVGLPVQQFLGGPGVDRRPVADEAFAERLHPRVILVELLATGDGAPRDQLVDVGVAGVVADVLVLEAGPGRAGDDLARLHLDVAEADLLVFLGQRQVGVLAAGDLRQRFPGLDRDLAVGFRSQGEDHLGGVDGAVDTRPALADAALDHAMVEVADQLHFLLGVPADALAAVAQLVQQRTERGELAVDVRVVALDQVQRRQVASRHRLALALLPVMAVAAERLRQLGGGVMQQRHRDQVLLHAEVAFGDGGELLGDGLVDLPVALGFPGRIGGRRQRMDEGVHVGGVEVVLLVPGSGRQDDVRVHAGGGHAEVQGGDQVELALGTVVDPVDLGGTRTAGLAEVIVHHPVLRPEQVLEHVLVPLAGGAQQVGAPDEHVAREVLRIVRRFAGEAQAAALQFAHHIVGDRQAGGLGLGGDAQRVAVQLRRRRQPAEAFGLDVVVQGVFGEAAGVGQRRQHLVHRQLLVAPLRAVQVEEAGAVHLPRRPAPVQAEGQRRPAGLRAQLLLADIVRPAAAALADAAAHHQHVDDRAVVHVHVVPVVHRRADDHHRLAAGLVGAVGELAGDLRRARRRDAGDALLPGRGIGRVGVLVGGRHVVAAQAAVDAVVGHLQVIDGGHPQALAVRRDDLAERHPAQQYLVVGDALEVRVLLPGEVREGHLAGMFRAIEQRQLQARLVTAPAVQLGDVPLARLAPAVADGAGGRDQPAAALVVGDGLPLGVVVLAEVVRQVGGAQVAGRLERAAGVFFQQHQHRHVGVLAAVVDEVGARPVEVELLQDHVTEGHAQRGVGALLGVEPEVGELGHLGIVRGDGDGLGALVAHLGEEVRVRGPRLRHVGAPGDDVAGVVPVGRLRHVGLLAPDLRAGRRQVAVPVVEAQADPADQRQVAGAGGVADHRHGRDRREADHPVRTVGLGGVDVGRGDDLGDLVPAGTDEAAQAALALVALRLGGVLDDAGPGVHRVAVLRPRLAPELEQRLAHLRVLQAVGAVDVPGIAGPARAAARLVVGQVRTGARVVGLLGFPGDQAVLHVDLPGAGAGAVHPVGGAHDLVVLPALPVGTFPGAALVAGLAVAIGEFALLLLEELQAVEQVTHLDLLTRSVPGVTTLIRGCRGLLPTDSTGTLRTLARVPPPGGDDAAQVVGDEHVEGALGAAGHVQRGAERLRDEEPAEGADGGGEADHRGRLHARVARRAGFVGLAVAHPPGPLVAEDHRDHAEGGAVADAGEEAQQDEGAKEAEEVALAAVARQEGDHREHPADHQRVVPQGDPRAAELVRQPAAQGPAEGAHQRTEEGVLQRVDVGELGLG

SEQ ID NO: 20267 - protein, 431 aa, Pseudomonas aeruginosa
RHSSGVGGKGGRKVDVGRGGLAVDAALLLDRVVHPDHADHGQAEQQHEAGGAHADVVCGVSEHDRQAEAAEAADHPDHAADGAHVARVVVVDDPVHAGLAEALGNADDEHQEGEQPDVQADAQAEVALDAVDGHGGLRVGEEEQAHQADPEHAPVHRARAVVVAEPAAEGADQAGRQGEQHGDEGRGLQVQAVFGDVVLRQPQGQGDQPAEDEEVVQAEAPDAQLGERRQLLGQGRPLAGLGGTLEVRRIGPGEQPEQHGGDQHGHRVDLRHHAPAEGDHDHRRHQVGDRRAGVAGAEDAHRGALALLLEPGRGVGDADREGAASQADEQAEHQVVPVLAGEGQAVDRDGHQQHVDEEHDAAAEAVGDQAQRQAHQGAGEDRQGDHQAELGFAQAKLVLDADADDRKHRPHGEIHREGQGTHAEDGVLFLT

SEQ ID NO: 20268 - protein, 626 aa, Pseudomonas aeruginosa
KAFLMNKATAPDADQRDRFFGGSDRAGKPILRRSLVVRFGCYLTLLVSLALIGMFSALLFADYTHQDAAVINHAGSLRMLTYRVALEPSLEGRQALLGTLGERLDSGDIRRLLQRQDADDPIRQLHQELREGLARLDPRALPGRAVLDAYVGDIDRFVGILQAKAERRSQLLSTVQGLCLFLSLLVVFVTLYDLSYHVIGPLRELTSTARRLGRGELDARVTYSGEDELAQLGERFNQMAGELKSIYGDLEERVEDKTRALSQSHQRLELLYASARRLGENPYDSRTLQPLLNQLEKVLDAGRVTLCLNKDGVERAYSSLTTTERPADFCLQGDCGSCREQASACDQPSSLAQPLLMQPLSIAGHRFGELFIESRSGRLENWQQQLIETFCDNIARTFALSLQQEQESRLALFAERGTIARELHDSLAQSLSYLKIQVSRLGTLLKREAPAEKIEDTLDELREGLNGAYRQLRELLTTFRLSLDEPSLEAALGNAVAEFGERGEVTIELDNRLQHVPLSPNEEIHVLQIVREALSNVVRHSQAQRAWVRLSSQADGQVSIAVEDDGVGFDPQQNRSGHYGLTIMQERGQTLGSQLRFEARAPHGTRVLFSFVPTALQPSAAKEPTP

SEQ ID NO: 20269 - protein, 221 aa, Pseudomonas aeruginosa
RRAASAAANDRRGRGRRLSPACRNPHPRLSASLAHIAAPPPRKRARTACDTQQCARMSPRLRRKDISMLIGALLVLTWVILLVRYPAKALPVSLAALAGLGLVAAWVIWQDNDESRHLQRQELRLSYAPERCPVDRPLAVELKNGSDRPLLELRWRIAAYRPGDSVNLADTSFDSPRYRAPNALLGGDSWHDCLPLPPLRPGYRASTLEFRAERLDGRFGN

SEQ ID NO: 20270 - protein, 254 aa, Pseudomonas aeruginosa
PREDPMETRRLFDQGSAAYASARPRYPDALYRHLAGLCGQRRRAWDCATGTGQAALGLAQYFGEVLASDTSAQQIEHAVVHPGIRYSVQDAEATDYPDAAFDLVCVAQAWHWFDHSRFNRELLRVLRPGGVFAAWGYGWFSIDAQIDAAIDEEYLRPIGPYWAQQNRLLWNAYRDVELPLGELPAPAFVIEQQWSLARLFDYMATWSASRLCREAQGNAFVRQALQRVAALWGEPTSTRRVRMPLALRISRKDA

SEQ ID NO: 20271 - protein, 110 aa, Pseudomonas aeruginosa
ANPSPSSPAAPAASAAPSPTPSSAPATGSGPARARRTTCVPWPRPASRRCNWTSTTPPRWPVWPRNWKSKPPASTCWSTTPATAPWVRCWTAASTPCAGSSRPTCSPWSA

SEQ ID NO: 20272 - protein, 229 aa, Pseudomonas aeruginosa
RSASVSTRASETARRYRHGRPPCRTHPLLRPGRDRRGDPAQRAAARGGSLRRPAGQPADRRAGRRRPGLVVRPRAAALADLGRALAPGRPVWRSARGPLPAAGRPRLAERRSQPGGTAHRGAALPVLSGAVAGVLLRQGLWILPALTGEAASTNSSHSLQLGLTRPRLVLATHRTRPTCTVHRSPGSACSSPPCSAPSCSAARCMPPRLPPRVRQPGRKRSTRRSTSTA

SEQ ID NO: 20273 - protein, 155 aa, Pseudomonas aeruginosa
CTASTATTAPDCSPPCTASSCRAGTSRPRWRKCSTAVSATRTTCATPAPMCAAPTSTACAWRWPTANAARRASPSAMCASGWPRRSTGRKHAQGRKAWSRHASLAPLGLAAARGGPLRQPRRDSHERCPDLPALQRRHQHPPARPCATGGALRRL

SEQ ID NO: 20274 - protein, 222 aa, Pseudomonas aeruginosa
PVMDFFSVLSHLDWSQVGQLTLQHLLLVLVAVGLAILVGVPLGVLMTRFTWLAGPLQGAATVMLTIPSIALFGLLMPVYSVFGQGLGPLPAITAVFLYSLLPILRNTYLALTGVEAGIREAGKGIGMTFWQRLRMVDIPLAVPVILAGVRTAVVMNIGVMTIAAVIGAGGLGVLILTSISQSNMPMLVVGAVLVSLLAIAADLLLQWLQRILTPKGLRASAH

SEQ ID NO: 20275 - protein, 391 aa, Pseudomonas aeruginosa
QEPNMIELDKLSKTFTQKNGKEFRAVDSISLTVEKGEICVFLGPSGCGKTTTLKMINRIIPPTSGRVLIDGQDTADLDEVTLRRHIGYVIQQIGLFPNMTIEENIMVVPRLLGWDKARCKEKARELMSMVKLEPKQYLQRYPRELSGGQQQRVGVIRALAADAPLLLMDEPFGAVDPINRESIQNEFFEMQRKLGMTVIMVSHDIDEAIKLGDKVAVFKSGRLLQYDHPDTLLAHPADEFVSAFTGQDSTLKRLLLVRAEDAADSSLVTARPQTPVAEALELMDENDRRYLIVVDDQGKGLGYVRRKDLRRQEGTCAPFVTPFRVTASHDEHLRILLSRMYEFNSSWLPVLDPDQQFLGEVTQESIADYLSSGRSRGGKGLIVSPAEQVGA

SEQ ID NO: 20276 - protein, 542 aa, Pseudomonas aeruginosa
TRRSRSPRRCAPTRPARAATRRGWAGRNQRSGHSSRRHRSDRDVLRRQLPLRRRIGAGPDAAAEGGEQAGVGGQPGGLHLLLDQLLLEQPGLRVEHVEVIGEAALVGQGGDIVGLLRGSHRLRGEVLLDVHRMQADQLVGNVLQRIHQGLVVLLHRRVVAGRRLAQLRTQAAAVEDRQGHRRAGAVGVLGAAEELQHAAADGTEADRGHQVDVGVEVGARHVHALGQGGDLPAAGDHIRAATEQFGRQGAGQARLRRQVQAWPADRAALARALAGQCGEQVAGELDFFVDHLDAALGLGQRHFRLADLEMRADAAAQATLGQGEDVALLLQHGLGDVHLGVLQRELDVGADDVALQLELRLARLGGGHVGQVDGALAVAAVAPPEIELVVQADLGGVVPGSGPRQVAGAVKIVVRPAVADQRALALDLRRLDGLHQPGHGLRLAYPRMGYRQAWIAVQRLLDPGVQLRIGIHLPPLRLRPAGLAGGSLDRMVGGQGVGVERGGLGGDIACTDTTGYCGENDEKTDEGADQGQFLPESTRHVV

SEQ ID NO: 20277 - protein, 445 aa, Pseudomonas aeruginosa
PRQSAPDWASASCRCIRPSRTWARAPWCGSCRNTACNSSTSMRCTLRGSISTRRSRPGWNTSRKACPACSSATKRRWWSWAWNSEDPPEPIIARPVAGPCPPLRWRWYGRRFRSRLQSPVMKKNVFVFSRLAPEHLERLQCQFNVRVLEPKQGDIDAQYAAALPDTHGMIGVGRPLGARQLEQAMQLEVISSVSVGYDNYDLDYLNRRGIALTNTPDVLTETTADLGFALLISAARRVAELDAWVKAGNWKRTVDAPQFGTDVHGKKLGILGLGRIGAAIARRGRFGFGMQVLYHGNNRKPELEQELGARFLGFDELLGEADFVCVVVPLGAQTRQLIGARELGLMKPSAILVNVARGQVVDEAALVAALREKRILGAGLDVYEKEPLAESPLFALDNVVTLPHIGSATHETRRAMAERALQNFEAALRGERPLDLVNPQVWRRG

SEQ ID NO: 20278 - protein, 162 aa, Pseudomonas aeruginosa
LLSFVNPSAPGMSRCRAPTSPMRPRCIPSTATTTTGSRAGCGAASAARRTPPTWPRTPSSRSWFRARPRASTNRAPSSPPSPAACCATTTAARTSSAPTWKPWPACPSGKSPAKRPAPSSWRPWSSWTVCSTVCRRWPRRPSCWPNSTAWATPRSPRSWASP

SEQ ID NO: 20279 - protein, 272 aa, Pseudomonas aeruginosa
TGRALAGRAAGRRRRRTPAPGLAALAPGGPGTRAGLAPHRGGQPAPGRDRHATGPGRHQRTAFAATPARAEDPAAGPGRRRQRLGPARERQPAALERRLCHRRRRTPAPGPGRRQSPRAEQRHGGGCPLRCRRTAPAPAARGNPAQHRPGPAPAARVQRGRPAATGGHPVRRAPVRRTHPRRRPRRRGAGGEPRRPGPAAAQRPAAGLRPRATRRSAAAAGRQRRLDRRHAGGRRHAPGRIPRRSRALPPRPAGLRPAHRRPADFRQLSAGR

SEQ ID NO: 20280 - protein, 178 aa, Pseudomonas aeruginosa
PSTTTARPTCPAASAPRPTATTRTSRPVPTTSSGAAVPWPAPATNTPPTPARSSTSPASSPRPCAAATSTRAATSPCRRASTGYAAWKPVSARASSWAKVATKWASATATSTKPATSCATGPAPTAASYPAPAAATTATPAAAPKPTRSTSTIASTSAIGPSPPASATRRSIPNRRTC

SEQ ID NO: 20281 - protein, 155 aa, Pseudomonas aeruginosa
AVQIGCPPPSGTAECQGLSHRDLSMSGKPAARLGDPTACPLPGHGSNPIVGGSPDVFFDHLSAARQGDATACGATLSANVIANVLINGKPATVVGSVGTHGNLVVGGAGTVLIGNSGGGAPALALAPPKLCLQCLLLAARRNQALVPLESLGGAP

SEQ ID NO: 20282 - protein, 155 aa, Pseudomonas aeruginosa
WRRWSVGRSGSPCRAATSSMTGKRSGPPMLELDAGQLDRLQRVRDDEVIERVLLEVRREAPAWLERRGLLPAIRQLGELRATALELGIEEPGTIERFLLHGLAFPAFQDTPAFLAHMRRPLADSPEQRFQDYERIVEFRLASQKWRAYETSGRPA

SEQ ID NO: 20283 - protein, 159 aa, Pseudomonas aeruginosa
QVSAAMFQRAVVGQQVADLAGHGLDAVEGEQRLALLAEQRDTFGILLAAELAVVLGPVLRPRGEAARRVGQRQVTVGEDLGLQLLQAQLRSLVEHPAQQLAGDFHRRNPAAHAPGIQFGQGMTVVEVQRRTADKGHAALAEVIDGGHVVGLDPEFAVLA

SEQ ID NO: 20284 - protein, 203 aa, Pseudomonas aeruginosa
PGSRRPQAISAENGRKSIASPTPRVAPRSITASPSAQLAASSIAEPCCGWISTRPRSSSRARRYWRRARGCGQSKAAGSASGRGTTSNSPCWRSRNGRATSNAVTSAAAGLPGSPSQGLPATEPKANGLPGWIARRHRLTSPSSAMARLRWSSSPTETPPLVTSASHSEAARLSASRLATSSSASTSSSCTSKPRPRSKAPMQ

SEQ ID NO: 20285 - protein, 140 aa, Pseudomonas aeruginosa
ICPANSVWPGSRNSSPLLSRPMRKRRRTETVATPRLASRPSSCGRKRCPARSTGAPRRNSSPRRRTCWPALTGGNCTRSPSTTQSSCGTTQSAPVGSGAPVKIRAAWPSGRLMPRVSPAAIRAPTVRLPPLRGRSAEHKA

SEQ ID NO: 20286 - protein, 120 aa, Pseudomonas aeruginosa
PSIALLSQCGRSIGASRSSPSTRPSARSRARLSQAGGRGARASSSASASSSGRSWPPSQAQALTSGTRSRPPAPRLAGSSGAGRNCTGGCGCPVAPGESRSRRCDRRPASRAGSTPGYRC

SEQ ID NO: 20287 - protein, 530 aa, Pseudomonas aeruginosa
SSSASTWKAAPSARPPAPSAPSRPLRPERAVRLRDGREEEVAIAELRFGDEVVVRPGERFPVDGEVLDGSSHADEALITGESLPVPKAPGDKVTGGAINGEGRLLLRTTALGGETVLAKIIRLVEDAQAAKAPIQKLVDKVSQVFVPVVILIALVTLGAWLVAGVGLEQALVNAVAVLVIACPCALGLATPTAIMAGTGVAARHGILIKDAESLEVAHAVTSVAFDKTGTLTSGRPQIIHLGGDDQEQLLRLAGALQRGSEHPLAKAVLERCAERDLEVPPVNASQALSGRGIQGEVEGRRLALGNRRLLDEQELKPGALASAAADWEAEGRTLSWLLELAPEKRVLGLFAFGDSLKDGAAEAVEALRGRDIHSHLITGDNRGSAAVVAKALGIDDVHAEVLPADKAATVAELKGRGRVVAMVGDGINDAPALAAADVGIAMGGGTDVAMHAAGITLMRGDPRLVPAALDISRRTYAKIRQNLFWAFIYNVIGIPLAAFGLLNPMVAGAAMAFSSVSVVGNALLLRRWKP

SEQ ID NO: 20288 - protein, 164 aa, Pseudomonas aeruginosa
APRPHRPRARRAAPATARACAGRRDRQGSAATVRATIPAAARAIRGAAARLRRLRPPWPVAGSPAPRARGPAPGAARPVGRGPGEPAATRRSPASSGPAGPGAGRLPPGVLRGAPGRPGATPHAAAAADCIPAAWPPAHRRCRPGAVARRRPVRSGPGPARVRT

SEQ ID NO: 20289 - protein, 246 aa, Pseudomonas aeruginosa
STCALRPAAAPGCAGSRGTAGAARAPRSGVAPAGAGGVPGPGAPPPRRAPPRRAPGGRGRGRNGPVPRTAGCRSAGRTPGRRGCSCAPARSRHGSPPGCSASTGIAGGCHSAPRRGPARPRGSAPRPCRYRRGRARSPRSGPATGPAGRAARTRPAPAGNAPVGRPVLPRHPAGRPAPAPSRTAGSGAACSPGGCPAGPSSSAAGWRCSAPPAVALPTGSAPGSPPRPAGRRAAPAPPPGRAGHGG

SEQ ID NO: 20290 - protein, 188 aa, Pseudomonas aeruginosa
GGIAGNGRAPRPGPGGNRPAPVAGDAAGPGRGRVRRAGRRARSRRRTAGDAGASSAGRGPLRPGSGGTVASHRAGVRGNVRDRSRGCSVPARGSASADRGFRRTRWPGNSCRIRRARRSAAGDRPVRRAVDGKDAGAPHGPTAAGGGKSGWPSAERRMECPRRCARSQSSPGFLVYVWGVNAPETNHK

SEQ ID NO: 20291 - protein, 1138 aa, Pseudomonas aeruginosa
ERRFSAYPFLAQRRRGVVAFRCAVVEVVGLFLLVLHAKRQVAAGEQVVEGFHRVPGHLLVVVLLGMRLGHAPQGAATVVMVDLGGLPGVLVDVEVTLGVDVPLARLQGRDHMPDAVQLVAGQVLVDVAGLDDFAVLDLRIVELVAVVGNVDFLLAFQLPVVAVRRTVVHVEVVRGAQAVGGGAGTVVGHLRSPPHAALAGVVEPRQARLLDLVEGLVDQQHVTGQARGRGDPLLEVEQHVARLVRVVVLQVSTEGEGILEVDQLVGAVDLRSGLGHQAPDAAAAVAGDVVPDHLQAVLRDRERVGGIEVLQAVAAFHQLGGGGVALGRLLHRRRDGGAAVGLVYRDLVGIRVALEHGQLAGSQLVLVLVDVLRGDGEQRLLAGIGVGEEATAVDAAGVGRQAAVPGGDAAVGVAGLLRPQRSQAGAELGRFVGGYRRHHLGGQQAQGQYTGMQKNLRCFHSLVVLVKSCSPARFAPGRRTSEVHAEAERDEVAIVHGGVLAVEEVGVGEARGVGVLVLRVHPQADRLAAFLEVGAGTGRIAIDVVRPGHAGLEVHAHEHVVVVPDRTGAITPGIRGGIAIVLAVAADVVRFGGAQRADVQRLAAGQAGDGPRQRPRSEDRVTPVACLGGAFQAADVGPADLAHQGQALGAHHLVEEVRQGGLQLGDLLAPIAVQVLPGLAVQHRGVVVGAVAADAHRVEAGEEDVGGVQLHRRVGPVADFAAPRGAVGQRGGEAQAEHADIFRVLDEVAGVAGGGRRRGLGGQCRVDRGEAGGEVVDRRHGAGRGALAAEDRQAAVVVHVVGAELGVQFVGEVAQGEAVLAAVASVAVRPAADQDALVPGRRGNAQASPGEHVVEQVDGRLVVGQHRQVLVAAIGHHVRLGEEGATVVDHRLVPLDLVEAFGGQVVGEVLRQVEHVHRDQAFLDLRAGPAEGGDVDRVDGADAVLDEGALAPVHHLLAQAHAARQVADGIVVVDEGVEQFGSGGLGQGLAAAVVDVLELAVLVLQLEVVPVLAAQEHTGIAVLQFEVMDALEDLRERFPTLEVQVAVVGGLGKSLAAVVHTDQVLVRLGGRPTGPDRQRRIEGTFDFPDVEGHPKGRSRQRGSQADGQRQPGPTRERITGCHRRYSMCVFCYECVDYS

SEQ ID NO: 20292 - protein, 138 aa, Pseudomonas aeruginosa
STPCARKAASAASPRCASAAAKPPPWRSNCSDTALSHRRPAGSRCPGALFLRCPPRRCAPDAETPAPRRRSARRSPPVPGTTPAAPAVAPGRRSSGSPPRWRRTTGNSAGRRPAPATAARRSGRPSHRSPSPGRTPRT

SEQ ID NO: 20293 - protein, 282 aa, Pseudomonas aeruginosa
PGHDRLTEKRRQDSEVIETDMLIEHRPDGLLAAISLDFPDGHHLGRHFHPQAQFLYAARGLMRLATHHGAWVIPPTRAVWIPPRVEHEIFMSGEVHMRTLFIEQPETPTPLSDCCVLAVTPLLREMILRAIHLESQPRLDDFRQRLQGLILSEIANLERMPLYLPMPRDRRLQAICQALLKQPELGLTLDDWGLRVGASSRTLARLFAQELQMSFHEWRQQLRLTEALPRLLAGDSVQVVARDLGYGSTRAFSSMFRRLLGETPRDYLGRLEQLARIRGRED

SEQ ID NO: 20294 - protein, 86 aa, Pseudomonas aeruginosa
ATIRARPQNSGNGAIQSSEPPAKLRFSTGMPSMKAPSATPWKKVATSEPPMNALSQMCCLAGLALKRNSKATPRKISPTSMKINGR

SEQ ID NO: 20295 - protein, 209 aa, Pseudomonas aeruginosa
TTQGWRPISVVNQPARIAIRPDGPISRVRRRKAFELNSLSWPRQRSHRLQTPTRIISMPRPAMIRNDQNTTVEFGRSSGGKSFSAGIGSVRLCLRIRLPSTGISTLKRVSSRCMSGQPNRISGVGSPLLLSQWPSIAAIFAGWCSRVLRPWASPISACTGATISAIHMAIESILRIPGLSRPRSRIQAAEAPTKKAVARNAATDMCSRR

SEQ ID NO: 20296 - protein, 262 aa, Pseudomonas aeruginosa
YFYGIKRVATLPFKPPLACWRPSFTALNAAADIALQGSKNEKTAPADCPGLRHQRFRQRSGKAPRRRHADPPRGNPRADQADPGEGRRRPADQGVHRLRAAQRAGRREAPGRQLLPDPAVPGELQQRQGHQPGHRGRRTRRALRWLFEEIQVAGRVARRRHRRHSQRRQQQRARPAAVAEGRPAQVEGSEQRPGHAQGHRREPEEPEIQGTRIGPAAARAGPGRPGPDQHQLRAGGQAQPGQGRAGPGRPRFALCELPGGAS

SEQ ID NO: 20297 - protein, 213 aa, Pseudomonas aeruginosa
RAPGHRHQRRPGPGGARRQVPSRPAAVPARRPPEPAAIARTSGRHPAAGGILHRRLCPAPGPAGAGHRRGNPAGPRELSLARQHPRAGKRRPLRPAGQRQGRNPAAASEFWRGNARPIAGRSAAPARPSRSAVAGAGTGPAPATGHRAGRRRRGGGKAAPGTGGELKESFGERAGKARRRRLPYVRRIGSRALDRVYIERLIKLRTRRPACFD

SEQ ID NO: 20298 - protein, 635 aa, Pseudomonas aeruginosa
RTIALRHPLHPHAHPHESPGVLRCGDPDPAVRRSGHRLPPARRRMAAGRADLGLADRRLVLPAGDDAVPDLRGGHRAFRLRQDQARCRPRRAGIQLPVLGRHAVRRRHQHHPVLLLRIRTTDPLPPAAARRGRYPGSRAAGHGTAVPALGPARLGRIRPGGDGAGLLRLPPQPAAGPALGALPVDRQAHQRADRLHGGLLRHHRHGVRPRRRHGLRRAPAQLRAGLPVRHPAYPPGADGAHRVDDGRGDLGGGLRGRQGHPHPLRHQHAAGLQPVAVRAVRRSDPAPAQHPGAERRRLPRPPAGQELRPLRLRRPQRLAGLVDGVLLGLVDRLGALRRPVHRAHLARPDDPRIRLRRAVHPARLHPGVDVDLRQQRPGAGPRRRQRTRPGGHRAAVDGPLPDAPELPLEPRGDHRHGAGQLRLLRHLGGLRHRGPLHPLRPRRQRRRRRAEVAAGVLGLGHRAGHRRAAVRRQHRRAEVGGGADLPALLADPAIDDVGPAQGLLHGVAAPAGAEPLPGAADERQRQALRRLEATPVAGRALPLAGRGVPLHERRGAPGDQRGFRGVPREGPGGGRPARPGQRLAEPGDRSWRAASVPLPGADARLLHAVLRACRHGRPAPEESPLLPCRGASRRR

SEQ ID NO: 20299 - protein, 610 aa, Pseudomonas aeruginosa
PRGMTLAATSHPRAAANPSARQHSPVEQHADRDEYHQSQPLGDAREAGAGQRQRRVLAGGADHPGEQDAHQALADDQPRSQQHAASLRLFGISLFVDPGRRRTLLQGIFQQPGNQRTDHQGHADGRRQVDPQAHRQHRQAGLAGTAQEQVDEDQGDAQGDADEDHVPVQRVVENPAGDRRHQGRLRRGQGLAGVHSLARQGPGEAVGAVEQFQHRGDHQRADDAADDQRDLLAPGRGADQVAGLEVLQVVVGDRRDGQHHRGGKQRQGDRQLAVLAVQQAALDAAEAEYQQRHQDDRDDSDPRDRTARRTDQAGHVAAGGGDQEAEEEGEHHAYRHQTPELRAGHVRRGGTEEVAEDHEQRDQQYPGDQQDPLGRHVQLGAQAVRLAIAAHCPEGGPDTPHHRLEQGRQGPQRGHADGAGAEEAHLRTPQLGGQVRQALAVGRHAVDGQQRHRDAPGDHHADEDRDAGGDAHQVAGTDQRQGKTGGKAERRLPGTEPDAEAFGENLEAAAPEAEQRRHQAAAEDVVEPRRVTGGTRRAGVFLVLGAVAADPEDFRPPPPLPDTAVRSAPPSPGAAEWYRAPRECRRWSRSPRSASTGSHSSSRLSAGREG

SEQ ID NO: 20300 - protein, 96 aa, Pseudomonas aeruginosa
VKAGSEMTRDSRDQPQAAKRRWAQRSPSSKPRAMAAISRMPTTTKSVARNCAADWTMKPRPRLAAISSAATRVDQPTPRAMRRPVRTSGKALGRIT

SEQ ID NO: 20301 - protein, 319 aa, Pseudomonas aeruginosa
PSCHSRCRASKSCSGAGRNSTSTQPKRVAAHHSRARASTLAPAAQRRRSPGRRRLRGTGLATASPRVSVGMFGLRDIEEFVQQRLAQTAELGISLDRTHRFAGGVTPREVHRQALDDARRRAVHHHQVGSQEQGFVDAVGDQEEALAGLLPQVQQEHLHALAGQRVERAERLVEQQEVRLDRQRACQPEALPLAAGELSDGLLGVLLEAHQLQDLARPRGALGLAQATDAQAQGDVVEGVEPGHQGVVLEYHAALAAGPFECPAVDLHASLVRLLETGKDVQQCRLAAARRTQHHQRLALGQAQAEIAEDGAALAALFE

SEQ ID NO: 20302 - protein, 341 aa, Pseudomonas aeruginosa
FMSANAPPDALPPLLHAPVPTGPRPANGLPGPVGAGRRAARRGPPPPPRSPAATPPRFRGMSARRRGRMPPGRTPPPVRQDAARGRGDAAPLPAPPRRPAPAQPGPGRGWPGPIGSSLRAVARTGSAAGRAAPGCPRDAAAAAGNAAAARRARTAPNHRRGRRCRCLPAPFRRQRSGERGRARARLRSASDPRLPRRSNRYPVHPPGNRPASAPALRAGRAADRPPRSTASGARRWPATGGAAVQDYPAGEWKRSADDAGPGAVPARVPARPGGGRQRRCPPSPAPCRRTRAALPAPAVHCRAGLPPNRPWVAVSWGRASGAGLRSCGTSNGERGPGVGAR

SEQ ID NO: 20303 - protein, 158 aa, Pseudomonas aeruginosa
GCVGQPTPASFRTAAKTSVTALSCASCEETNKRRKGNLIRAKLFKITPVSVRGPSRSLLPRSYTTMALTKDQLIQDIAEAIDAQKTTVRSALDQLAEIVKDALENDGEITLPGIGKLKVSERPARTGRNPQTGKAIEIAAKRVAKFVPAKALTDAING

SEQ ID NO: 20304 - protein, 165 aa, Pseudomonas aeruginosa
HQGPSSSAAPRWASMASATQPSPAMSCWQERYADSARASPSCNRYSGNSGSTRCQRKSSRIGGRRRPLRSSQYNPGTRPRTRWTNSSRSTRAASPVTAKGTGERSGSSLRSQARSSPTSMPARPSMRCAIRRRCSSGRSGRPGVVVAGLARCDPPRACRQARRPT

SEQ ID NO: 20305 - protein, 218 aa, Pseudomonas aeruginosa
  UNSURE (214): Identity of amino acid at the above locations are unknown.
IEFMHTVLIVDDHPVIRLAVRVLLEKHGLQVVAETDNGVDAIQLVREHEPDVVILDIGIPKLDGLTVISRIKSLGLRSQVLVLISQSAEAFCKRCIQVGARGFVNKEEDLNNLINALNAVTAGYTFFPSLTFDTLGTPPERISESELIGLLSDREMIVLQHLAMGYSNKAIGEKLFLSNKTVSTYKTRLLQKLGLGSLVDLADFAKRHHHELGXRGNG

SEQ ID NO: 20306 - protein, 410 aa, Pseudomonas aeruginosa
GKHSSISPVFPGNPVWTVMNDLNVLVLEDEPFQRLVAVTALKKVVPGSILEAADGKEAVAILESCGHVDIAICDLQMSGMDGLAFLRHASLSGKVHSVILSSEVDPILRQATISMIECLGLNFLGDLGKPFSLERITALLTRYNARRQDLPRQIEVAELPSVADVVRGLDNGEFEAYYQPKVALDGGGLIGAEVLARWNHPHLGVLPPSHFLYVMETYNLVDKLFWQLFSQGLATRRKLAQLGQPINLAFNVHPSQLGSRALAENISALLTEFHLPPSSVMFEITETGLISAPASSLENLVRLRIMGCGLAMDDFGAGYSSLDRLCEFPFSQIKLDRTFVQKMKTQPRSCAVISSVVALAQALGISLVVEGVESDEQRVRLIELGCSIAQGYLFARPMPEQHFLDYCSGS

SEQ ID NO: 20307 - protein, 208 aa, Pseudomonas aeruginosa
SFWSALNERNQAMADLTSLSIEHLRSPRLYTHRLILRPWLVQDRARFAELNADPLVMEFFPSCLDRAQSDALLRRIDAHFAEHGFGWWALQVKGGDPFIGYVGLEVVDFDAPFVPAVAIGWRLAAEHWAEGFAHEAAEAALSYAFDTLGLDQVVAFTVPANENSLGLMERLGMHRDPTDDFEHPDLPPGHRLRHHVLYRLTREDWLRR

SEQ ID NO: 20308 - protein, 103 aa, Pseudomonas aeruginosa
STSGSVPTASCRTSRRCTSTCWPTPRISVSLPPRCSPMPFRCGRRPCRSPASTTPCGSTATCARTSGCSTPSTAPGPATHAVSCAAASSTRAASWSPRRARKA

SEQ ID NO: 20309 - protein, 137 aa, Pseudomonas aeruginosa
SASVRTGREAGRHPPLGVRHGRHPDPGRARLPGDPPSAGHPRAGRHPAAPRRPARGRGGGQARLAARTRARPGRGRAAGAGRTGTGARVAAARRAPGHPDPQRPPVGADHPRSDRPGRLLPHRAHPRARRGAAQAGP

SEQ ID NO: 20310 - protein, 334 aa, Pseudomonas aeruginosa
AGHPVPFHHRSLLTSRQRLALAPRSRCRMSEARLHSPDPRTPRPMAGWAASLRDSGLLALAVPRVFAGMERDWGDIFAGVRHLAEQELELARRLALHHLQIASIRLLGSPEQQRRLLPASVERRWLWSEAVDLRRAQPEAQEHWRGGFLVGGRGSDCFAVEDVDRLLISAWHAPSRAHLIAVAETGRAGIDISGLADGSGLFLPAGQRLHYQRLRLHPEDILVPPGLPPTPCGQLREGLTRLAQANLDLGQAARVPGDVAGQGEAPRLLALALRLVELAAESFQAAFARGGALTFRESAAASLLASEAEAVARAGLLACLRRQALEARLLGAAL

SEQ ID NO: 20311 - protein, 371 aa, Pseudomonas aeruginosa
SASHRTTGLAVATHCPSLVRSPPERGTVASEVRPMKRPNSLHRLVAALAFASLSVAAQAADITVGYQTGIDPTKVPQADGLYEKAIGEKIDWRRFNSGPEVIAALASGDLQLGNIGSSPLAAATSRKLPIVAFIVSAQINAAEALVVRNGSGIGKPEDLAGKTIATPFVSTSHYSLLGALKHWQIEPSKVKIVNLNPAEIAAAWRRGDIDGAFVWSPALGEIKKSGKVLTDAAEVGQWGAPTFEVWVARKDFAEKHPEIVARFARVSLDSFADYNAHKAEWTADSEPVKKIARLTGADPRDVPELLAGSTFPESQAQLSADLLGGGTAKAIAGTAEFLKEQKRVPAVLGDYSPYVSADFVRQAEQVQVGQR

SEQ ID NO: 20312 - protein, 259 aa, Pseudomonas aeruginosa
IPRLRSGLSERRLSYPTEGRTHEPSDGRGDQPLIRTARPAPRHPPRSQPGPGQGRVAGGAGSFGLRQVDTAEHPCRFPEAGPGTRADRRPDTRRARRRARRGIPGRRPDALAQRPRQRRPGPAHPWPGQGRAHRAGAPGPATGGPPGVRRAVRRSALRRPAATPRAGTRAGGRAGLPAARRAVRRARRADPRAHAGAPAGPVEADRQGPLPDHPQRRRSPVPGYRPGGDGRPAGAHRQAPAGGLRAALRRRRNGAFDQG

SEQ ID NO: 20313 - protein, 118 aa, Pseudomonas aeruginosa
SRVRPFAPGVAGRIPRCRGGRTCPLIPSDSPLPILSRASAVCPATVGAGPPVPACWPWPCCGGRRPVSAGSTCCSCRRPNSSSKPCNGYGRMATSMPACCNTSAPACCGCSWRSARRC

SEQ ID NO: 20314 - protein, 279 aa, Pseudomonas aeruginosa
  UNSURE (28),(52),(59),(72): Identity of amino acid at the above locations are unknown.
HDMSLTIQPISPALGAIVSGIDLGAPLXDTGQRAIEQALLEHQVLFFRDQSXEPRSQAXFAARFGDLHIHPXYPSVPEQPEVIVLDTAVTDVRDNAIWHTDVTFLETPALGAVLAAKQLPPYGGDTLWASSTAAYEALSAPLRRLLDGLTATHDIGKSFPRERFGVTEADLARLEEARLKNPPRSHPVVRTHPVTGRKGLFVSDGFTTRINELEPAESDALLKFLFAHATRPEFTVRWRWQENDVAFWDNRVTQHYAVDDYRPQRRVMHRATILGDKPF

SEQ ID NO: 20315 - protein, 178 aa, Pseudomonas aeruginosa
AWRVQLFREFSSMQERIPDELTLPELTLRGLILGALITVVFTASNVYLGLKVGLTFASSIPAAVISMAVLRYFSGANILENNMVQTQASAAGTLSSIIFILPGLLIIGYWSGFPCWQTAAICSIGGILGVLYTIPLRRVMVVQSELPYPEGVAAAGNPPGRQRRRRGRGRRPRAACRR

SEQ ID NO: 20316 - protein, 391 aa, Pseudomonas aeruginosa
PGEQLAHRAGHAGQVDPADRRDTAGLAVRGLQPLPRCRRAGHGQPAVLESGGGMRGVRLLLRLPDRRRLRLHGRPGRFVEQSDLGDRNHRGHPGVVADTRLRQHRGRPAGPPERQAGDRPGAVYHLGGAGHRGDLQRQPAGPQDRLPGRRHALAPAGRADRRLHRRRAGDPPGAGTALQRLRLHRGPAARGNGPRPGPGRAAGDPDDGDRQRDFPRRAELEHDPHRRRPGHRPDPRRPAPAPYRQGLPAGAGGGPGDLPAADHRHDPGGRCADFLAAGKCPEEACGGGRGRRRGLCRRAEATRRAAGFGADRRREPDGHPARRGDRRHRRGRAAGAGRRRLRGHRPVAGTGGIRRDLRAVLPASAGALRDSQLHGDGMLPLASFPAVRDGG

SEQ ID NO: 20317 - protein, 504 aa, Pseudomonas aeruginosa
QDQREGQGGQHHRRLQRVDAAGEQQPAGDQRGDRAPEHPQPLRPVVVGAAAVGGEGGEDHGAGVRRGDEEDEADQHRDGDHRAAPGVVLEHLVEGHRRLLDGHPAEFAGAAEGLLQGAVAEDRHPRQGEAERDEQHAEDEFADRPAARDARDEQADEGRPGDPPGPVEHRPRAQPVAGAAVGVEVEALARQVAEVVADVLHQGVEQVLGRTGEQHEQQQAASQQHVDVGEDADALVDPGDRHRDRRAHHQHDERHLHRVGMRDGVQVVQPGVELEHAEAHVGAEAEHRGDDAEAVHRVADRPVDALADQRVERRAQGQRQVVAVGEVGQRHRHQGEYAPAVQAPVQEQQFHGLPRGFLGTGLALRRLEEVGQWFGYAEEEQGDADAGGEQHAGPGQVAEFRLVVVGTELDLAVAGKRGDHHEDQVQRHRQQVVPADGLRGPGLRGQQPFAGALGEADDHCGEQQDQDRRTVEHRGIHADGRGGGGGGGGRLCVSQNRLVSSSLI

SEQ ID NO: 20318 - protein, 180 aa, Pseudomonas aeruginosa
SSVQYKHDQGPGSQSFGRMEAFGAALFPHVRRRIPSVRRQSQAPPSRLLVAACLLGGQLQEQGLYLLQRRRSGLAEQAPQTGQRWVWRCPAKIQMLRQDFFLVADQQGEVDDVFQLADVAWPGIALEDPLGFHADGRHRQVQALGIDADEVFRQRQDVSRTFAQWRQAQAAVVQVLLQAG

SEQ ID NO: 20319 - protein, 331 aa, Pseudomonas aeruginosa
LLGGTGRLQRLRRDDGRNGCGRGPLRKKKRRCKPCDTGVNKGRCNGAQRGSRDGLGSEGRDHRAGIFLLDEGFHFRAGQRGGKLLQGVAVLVVRTRHQVVHIGRIVVFQDQRVLGRVELGLQRVVGVDQVQVDLVQHARQQGRFEFLEFQVLRVLGDVLGRGQGVVRILQLEQAGLLQQQQGAPAVAAFVGNGDGGAVGQLGQRLVFPRITTEGLDVYADHGDQVGALAFVEVLQVRQGLEVVGVQALLGDLHVGLHVVGEHLDLQVDAFLRQGRLDQLEDFRVGDRRGGDEELFRCVGGNADDGGQGSQQEQFFHSSILVGRCPPLRSGR

SEQ ID NO: 20320 - protein, 68 aa, Pseudomonas aeruginosa
STAMAITEEAPHMVRTPSHPERDSAAKPPLWRRLAWLAGIWTASVLALGVAAWLMRLFMSAAGLGVPH

SEQ ID NO: 20321 - protein, 422 aa, Pseudomonas aeruginosa
PRCPVCAFRSTYHARVMTPIPHRPFRPHAMNRPRTVIRFINAAHVIDHMFMLIFPAAVLGMAGSFDLDYAGLIGLSLGGFIAFGACSLPAGWLGDTWSRRRMMLLFFFGIGAAALLTGLAGSVPMLVTGLTLIGVFAAIYHPVGTAMLVAHAENRGREIGINGMWGNLGVAFAALLTGFLTAHFGWRAAFILPGGVAILLGIGFFFCVREEPSPHLSAKAAARGEDSEGLSMRRVFGVLALVTATGGVVFNASTVTYPKLFQERLSDLLASPQTLGVVVSLAYAFGAVAQLIMGRLIDRLNLKLPFVFLTFCQVPLLLALAYGHGSAVVLFGALFMFAVFGQVTVNDAMVAHFVAPQWQARVFALRYFLSFGASAAAIPMIAYLEPRQGLLGLYLVLAGFAALTFAAALVFPRPARSAAVGT

SEQ ID NO: 20322 - protein, 154 aa, Pseudomonas aeruginosa
SRPCSRMASMVTMAKASLISNRSTSSLLQPVLANRLVIAPIGARVNSLGSWLWVAWPTIRASGFRPRRWASSAVIRTSAEAPSEIELALAAVMVPSLRNAGLRLGIFSRLAVSGCSSSFTTLSPLRLVTVTGTISAASEPSAMAAWARLSDSMA

SEQ ID NO: 20323 - protein, 157 aa, Pseudomonas aeruginosa
GALDMLSMPPATITWLVPALSRSWASITAFIPEPHSLLMVVQPVAAGRPAASAAWRAGPCFRPAGRTQPMITSCTSSAAMPARCTASRITTAPRSTAETPARLPWKPPMGVRAPATMTISDMERYLLFWIGSERFSGRILSCDREAPKGHGANHSFD

SEQ ID NO: 20324 - protein, 583 aa, Pseudomonas aeruginosa
TKPADGSRVGLILTTNPLPGVRPMLKTRLIPAAAGAYQYPLLIKSLMLSGRRYEKSHEIVYRDQVRYSYATFNERVARLANVLSEAGVKAGDTVAVMDWDSHRYLECMFAIPMIGAVLHTINIRLSPEQILYTMNHAEDRFVLVNSEFVPLYQAVAGQLATVERTILLTDGAEKSAELPGLVGEYESLLAAASPRYDFPDFDENSIATTFYTTGTTGNPKGVYFSHRQLVLHTLAMASTIGSLDSIRLLGTSDVYMPITPMFHVHAWGTPYVATMLGVKQVYPGRYDPELLVELWKREKVTFSHCVPTILQMVMNARAAQGVDFKGWKVIIGGSALNRSLYEAAKARGIQLTAAYGMSETCPLISCAYLNDELLAGSEDERTTYRIKAGVPVPLVDAAIMDEQGRFLPADGESQGELVLRSPWLTQGYFREPERGEELWRGGWMHTGDVATLDGMGFIEIRDRIKDVIKTGGEWLSSLELEDLISRHPAVREVAVVGVPDPQWGERPFALLVVREGQQLDARGLKEHLKPFVEQGNINKWAIPSQIAVVTDIPKTSVGKLDKKRIRIEIAQWQEAGSAFLSTV

SEQ ID NO: 20325 - protein, 74 aa, Pseudomonas aeruginosa
RGFPTPLKRPEAKQTLGLRVFATARSFSIRRKGASQSGCAAQITLSRDQAAGSASYSPRTHNKKHTWSSVDDNP

SEQ ID NO: 20326 - protein, 405 aa, Pseudomonas aeruginosa
PRTEVRRYRCVPARQVLVRLRAEGRAPRVQGHRRQRPQDPGQVLRSRTARRLHLPQLCHRRPAGQRAPGQAGGELGREHLHPERHQRHQPDRRHRLPPARLGDQGRPDPGEHVLPVAEPHRQPVRRRLLPDRVGPDGGRQLWHLLLPAGRGGRWLRPEPGGADQQQGVHQPAQQRARRGWPERYPVALGRGHPGPPRAGPRRSRQRPVRLRPALLRRRTEHRVRRLLHELPQPPADLQRPGRLGQHHGGDQRPRHPPRRDQPGTGRPGRGGGHRRQLQLLHRVPGRYPHVRPELLHHVAQRHRVERRSQLPAQRAGAVEHHRHPLRRPRPGEHRRQPPLRQRLGAERPGRAGPARLSAQGDHPTADHPDALLRPGDGRRAPDPGGRDRLDPRRRPGKHLQGTLRA

SEQ ID NO: 20327 - protein, 921 aa, Pseudomonas aeruginosa
SPERSRPIHKPRNRVMTDFSRTFSGTPSAVLPTANRFFRPPLPSAHVARPRLCRRLRDGLDGRLLLIAAPAGFGKSSLAIEFCESLDPRWQSLWLGLSSRESDPGRFLERLLDGLRQYHPTLGEEALGLLKMRQRHQPFAFETWLDDLLDELAPCLDPQRPLLLVLDDYHLAQGAVLDRCLQFLLNHLPEGLVLLVTSRQRPDWHLARLRLSRQLLELSEQDLRLTAEESGALMAASGLELDEDALDALLERSEGWVAGLRLWLLARGDPEEQVSPGVHGADELIRDYLLEEVIERQPPEVQAFLAQTARFERFCAELCDTVREAGDSAAILDHLQQHQVFLVPLDENGQWFRYHHLFSDLLLARPLPDFGPSAGSLHLRACGWFSRHGLLDQAVEQALRAGQPDVAASLVQNLSEEQLLAEQNIATLLRWKMDLPDSLLASTPRLILLYGWALALACQLDAAEELAGQLARFLPAPDESAQRDLLAQWQALSGVIARGRGDIDKAEAHCREALQDLAGERYGTRLQCLSTLSNLAVTRGDFWQARNYNRDALEFAQRYGNPLFEALVHYDRARVLQARGEVARAEEEVRQGLERLQHLPAQRRYAVRGRLLLYRGYLRSLALQPDEARKWIKQGIEETRSCRDVSLVIGYCVLASLEGRLGNYAAAFARLGDVERLMHAWDIPPIYYLAAITLIKCELWLAQGQTELAGVWLQRLGGTYGGQAATPPECSPLLPLHVELLQAGLERREGRPEEAARRLDRLARSTRENGALLPARLALGQLAALHLEQGREREALATLQQAMEGAVGGALLPLHELLVQQPEWLREQLQRFPACPGAQRMRALLPEPPAEPAGGAGEVLSGRELAVLELIAQGLSNQEISERLFISLHTVKSHARHINDKLGVERRTQAVARAKHMGLLR

SEQ ID NO: 20328 - protein, 465 aa, Pseudomonas aeruginosa
SRMDDHGRSRPTQPTLYVLDTNVLIHDPNALLNFQEHRVAIPMTVLEELDKLKTGKHTIAAECRQAIRLIDQVLGEATPEQVEGGVPIQRGKNGPSGSLSILMSKRAEPITWLPEHLNDNKIINQLVELKSRHSGVRVVLVTKDINMRLKARACGVDAEDYHTDQLIDDVALLSRGYHSLAGSFWDRVSKVETRQDHGRTWHRVQLTDNLPAVHINEFIVDEQGFVGWIKGIQQDELTILDLHQEPLLHQEAWGLRPRDVYQSLALYALLDPDIHLVNLSGAAGSGKTILALAAAIEQTMVSKRYRRIIATRSVQGLDEDIGFLPGTEAEKMEPWLGAITDNLEALHMDDECTHGSVDYILSKVPLQFKSLNYIRGRSFQQSLILIDECQNLTPHQMKTIITRAGSGSKVICLGNLAQIDTPYLSATSSGLTYLTERFKDFPHGVHVTLQGVPRSVLAEYAEAHM

SEQ ID NO: 20329 - protein, 253 aa, Pseudomonas aeruginosa
RPARRSGRRKTPPKARAGSKAAAATRPPRSAGRSDVYLLAPPAYLFGGIASRGPAVQAEASPVPRTPSMSHLATSTFQPLNIAILTVSDTRTLETDTSGQTLADALLAAGHRLHQRSLKTDDIYQIRAVVSAWIADPEVQVGLITGGTGFTARDNTPQAVGPLFERDVEGFGELFRQVSQREIGTSTIQSRALAGLSNGTLVCCLPGSPGACRTAWNEILLAQLDSRTRPCNFVPHLKTPPAVAPVAGCGCRS

SEQ ID NO: 20330 - protein, 223 aa, Pseudomonas aeruginosa
PATPESSGAGHGRGDRGLRPGMQGCRSAARRGRLQRLLARPAGDAAGRGGRVMLNRQRLLLGVAGRLLPLAAKVPRGLQHLVLQRVANRLFAQPLEEGAFDLLEGRWLRLEVRDLGVGWCVTRVPGGLRLVERPRASVTIRGDWRDFLLLASRHEDPDTLFFRRRLVIEGDTELGLAVKNLLDSLDPEHLPPWLWNAVERAGRAVQEERGEAPQGPVQGARGG

SEQ ID NO: 20331 - protein, 141 aa, Pseudomonas aeruginosa
AAAWRRARPSSSPTAWPTRRCWRWPASGWKAAGSMATMRCCCAGAAARSSTASARSASTPARPGAAAMCRPSTGAWCARPTSATATAIPATPSTRRRNGWATRATPSPTSASMALASPAAARRPACDRSTRCRAPAPKVRW

SEQ ID NO: 20332 - protein, 223 aa, Pseudomonas aeruginosa
RADRSDMLWPLPLLAMAISPRDGGHSTQSLSRPWLLLQSRSASRVRSRLSVPVSVLGRGCGTGIGRGTGLGSAPGAGRGSGRGAGIGKCGRGGAGSSKGSRGPMRGSGRKSAPMPLMPVSPRFRTRAISGWPGETRRSVRSPGSVVPGCPPAAGACVRETPACPGKRGRPGRAEESVRSSRALRYPVPAPSRAARRVAGWRAAGRVVRARREPPGVPPAGPAR

SEQ ID NO: 20333 - protein, 229 aa, Pseudomonas aeruginosa
VVMDACLLESVGVGAGRPGKTRDYSGKTRRVGMPVIRRSMELPVDSELVAVVPFQAASGGHRRIDCFHFTRSKEITMNGVSRLLSLALLGAALHWAPAQAEEQPRLFELLGQPGYKATWHAMFKGESDVPKWVSDASGPSSPSTSLSLEGQPYVLANSCKPHDCGNNRLLVAFRGDKSAAYGLQVSLPDEPAEVMQTPSKYATYRWYGEPSRQVRELLMKQLESDPNWK

SEQ ID NO: 20334 - protein, 1089 aa, Pseudomonas aeruginosa
ARAEVCQIVARADYFTLRNKQSHLSQLISSRQPLKIHRPPSARTLERVERRPYRSNSVLRPSRIRQRAACSQEGTDLGRLLRRFSRRFLRNIRLCQYRRYRPRGRHARRQRPGHRPCDPGCRPRGRLAAGAVVEGVCRSAAGRLDREGAGRQSRPGGSPCAGTPGEVHGRAGGVHRVAADRGQGLAGPPPLAGRLFLRPRRPGADHFLEQLHRDRPELQARSLGARPQRQRARRRPGPHGRRRGAPGAARAGGQHRPRLRPALVAVRRDGHRQGHAATAARHPRPGPASPARRHRHAFRGQPGGSAAARDRAPHRGDRRRNPAHPQPARRTGRQGPGRGPHDPPAKPEPGGAAEPAQRLAGRTARSPPGCGRPPLAGRRPGQGRGRGARRLLPQRRPDGLGRLQCRRRRHAGVLPQRQVHLQRRPGGDPADLRRRPPAFAVGRGGGRLRRGGGAIQPDPGGCAEEHFRPVDPPAFGGHPEGLRRAIGGFRAEDLRYRHPGLPARPHRLPQRAQRADPAVPAATGPGAGAGRPAGRPRQPAHRPRRRRRGRRRYAGAAEAGAGERPGQSGVFAMSGRSAGFALPSRDEWRRALAEWARSDGATWIYVFKVLCAAFLTLWLAMRLELPQPSTATITVFIVMQPQSGQVFAKSFYRILGTLVGLSVMVTLIALFAQERVLFLLSSAIWIGLCTAGAARYRDFRSYACVLAGYTATLIGIPATSHPEGAFMQAIWRVLEISLAILCSGVVSAVIMPQTTSAAMRNALYVRFGLFAAFVLDSLRGVGGRERFESSNVAFAAQAVGLETMRAASAFEDPHMRLRNGRLIRLSSEFMAMNTRFHALHQLLERLRAQGSTQVLDAFEPCLEEITGLLEEIRGRAVTDHDAERFAQRLADCRERLMARIRQARGELLAREPGEEARLDFNTAAELLYRFAEEMHDYALTHASLAAHRHEREQWKDAFTAKANAVAAAVAGMRTGLMILLFGCFWIYSTWPSGGTFALNAVAVSALASAAPNPKKVAMQMGIGTMAGGAGLGFPRAVLRSTPLSTVSRCYAWYWRRCSPSARSSPRGRSGPATVSACWCSSASVRCRRT

SEQ ID NO: 20335 - protein, 79 aa, Pseudomonas aeruginosa
PNWPAGRAAKVPSMPREIAIHGVYMPTLTLLFVIAAALTWGLDRIFASVGLYRFTWHPALFRVSLFACLYGGLSLTIYR

SEQ ID NO: 20336 - protein, 314 aa, Pseudomonas aeruginosa
GGSAPLRYREPTMTLKSVISLLATLLILLVAVFIGRTLWVNYMDTPWTRDGRVRADVINVAADVSGIVVDVPVRDNQLVKKGDLLMQIDPDHYRIAVKQAESLVASRKATLEMRQLNARRRAEMDEMVVSRESRDDAHNTAAAAMADYEQAKAQLDAARLNLERTRVVAQVDGYVTNLNVHRGDYARVGEAKMAVIDKNSYWVYGYFEETKLPYIREGDPVDMQLMSGEHLKGHVESIARGIYDRDNPESRELTADVNPTFNWVRLAQRVPVRVHIDEVPDGVLLSAGITCTVIVKPQGRDDQASAAQAPGRAG

SEQ ID NO: 20337 - protein, 308 aa, Pseudomonas aeruginosa
RSPLLATSLAGLAVVEQVVFAEEVGGDLLWRLLLDIDPRVERLHGGVVEPLDDRIEQRGELRMALHDLLTHHRGGVVEGEVLLVVLQHAQLEILQAAVGGVDEAEEHLAVLQRGVDQPGVHLADVVAGEVQAVQLAHGAEAVGAAGELRVHGEQVGAPGLGLLLFGEHPREIADALDAQVLGLFLGHGQGIGVVEAGRLQPDQALGFVELLDPAVGSRGVELLVDVVVDDQRRAGVLPDDIQLAAFLGGAGQGAAQAGGDRHVVSALLQELRGDGGEDALLGEGLAADAQGFRLRQAGGEQAGAGQAE

SEQ ID NO: 20338 - protein, 514 aa, Pseudomonas aeruginosa
PGLGKRPQPPSRLGWRRTKKFSPGKRSIMALPRRRRAMHRIGALDVQGFSAVMMRVPKFSRAFPDIRTPRFTDRPFGVGVLPSAKGVPRVMLDLVAAFIALTTLLTYVNYRFIRLPPTIGVMATALVFSLIVQGLSELGYPILEVEMQEIIRRIDFSEVLMTWFLPALLFAGALHVDLSDLRSYKWPIGLLATAGVLIATFVIGGLAYYTFPLFGWQVDFIYCLLFGALISPTDPIAVLGILKSAGAPKPLATTIVGESLFNDGTAVVVFAIILGILQLGEAPTVSATAILFVQEAIGGVVFGAVLGYGVFVMMRGIDQYQVEVMLTLALVIGGAALAARLHVSAPIAMVVAGLIIGNHGRHYAMSDETRRYVDKFWELIDEILNALLFALIGLELLLLPFSWLHVAAAFALGGAVLVSRLLTVGPAILVLRRFRGANRQVPAGTIRILVWGGLRGGVSVALALSLPLGPERDLILSLTYIVVLVSILLQGLSIGPLVRRIYAGQPLEKSEGAH

SEQ ID NO: 20339 - protein, 173 aa, Pseudomonas aeruginosa
SANGRTSARPGLRRPGRRRRRDSRWLRRPARCSGYPDGQRRVRSAARWCRWRGLRRSTAPGRARPGRYRWRSPRRAGAGRRARRDGGRAHRDNAGGRWRRQRSPGRTDGGFPSGPPSVSCRNARPGVRRGIPGCWRDSPDAAAAAAGNRASCRRRAGRSAPGSAGCRSWCRPG

SEQ ID NO: 20340 - protein, 927 aa, Pseudomonas aeruginosa
ALAERCPCREFSHGFPTSETVLRPRHEYLVLRGEFRRVDDVFDHRHPHQGRAWPERIPVRPDGRPADPHRLPGAPAAGPDHRPLRRPHRVLHPHAAGGHPDLRPGLRQPVLALPGARPVRRPGWRLLRGRHRLHLGLVREGAPGHRDGHLRRRQRRRGDHQPGGADDRGRLRLAHGAAGLLGGHAGHRRAVLAVHLDRSGAPQGCRRGQPAADPGQATGAARRAARLALRPVLLLRLRRVGRPGPVAAEVLHRRIRPGPEDRVLHHHAVHLAVRPDPRPRRLVQRPLRRALGELGRVLGLPGVPVLPLLPADHHDHPRHPGRPQPGHRPERLAVHLPGVRRRHCPGLRQGQRVPDHPRLLPEQHGHRRRHGRGDRRPRRLLLADRVRIRRRPHRRALLLLHVAVRPDRGLHGLDALRDQAATPHRRPGRLGRRRPSSHPSHPLLRNAVMGMIANTQLKAARGPLLLDWRPEDPEFWARNGKRIASRNLWISIPALLLAFAVWMIWSTVTVRLNSAGFAFSNDQLFLLAALPSISGATLRVFYSFMVPIFGGRRWTALSTASMLIPCIWLGFAVQDPNTPYWVFALIALLCGFGGGNFASSMSNISFFYPKSQQGTALGLNAGLGNLGVSVMQFAVPLAVAGGLFGAFGGEPQQLGDGGRLWLQNAGWIWVPFIAVVSVAAWFGMNDIADAKASFRDQAVIFKRKHNWLMCWLYVATFGSFIGFSAGFAMLSQDPVPRRQPAAIRLPRSAGGRPQPAPGRLAGGQVRRRADHPVELRADDRRGVRGDRLPAGRRRPGQLLRLPWRLHPAVLLRRHRQRLHLPHDPGDLPQRVGPAGARRPGRQNRRGAQREHGVGRGDRLLRRHRRLRRVLHPEGVRHLAAHDRQRRGRPLRVHRLLPELHRRHLVVVRAQGCGESLLSPSAAARGNP

SEQ ID NO: 20341 - protein, 416 aa, Pseudomonas aeruginosa
GDQDESPARPPAVLQEEAGRIRRWPRRDQQREPRLGRCLPAALAARQDRALHPRGELHRLLLLEDLREERPDHLGNPADRLPAHPSGPAQPRAARLPARGQLFLVHLQRQPPEVPEGAQAVAQALARGAGAARRPGERLGQHRRGRRQGEELQEPARPGRLRPFQLGRGHRDHRRGQRLHHQDLRSGPGDRLLADPGHVDGQLRRRRPLPVADRRGLPELLRLVLRPAAGQPADLGRADRRAGVGRLVQLQLHHRLGLQRAADADPGRALLHRGALQGHQDRLHHPGLFRGGQAHRPLAQPQAGHRRRAGHGLRSRDPEGVPPRPAERLLRRLLPPVHRHADAGVAGRTRRRRVQADPLPARRRPGGQPRPGQQPRVEDHRLRRAQRRAGLAHRRHRLPLGRVWQVEHRRAGRQER

SEQ ID NO: 20342 - protein, 264 aa, Pseudomonas aeruginosa
LEEGRVRAGAGTQPADAAPGRARLPERLPQVHLARSAAGQAGQRRQGHRLEHREGSEAGRRPQPSRGRERRQPGPAAYRQRHRRRRGGPRPGSGNQRPGRGQGLGSAVEDHRPRARPPGAAQGRREDPLPRHPGAAAQDHLQPDLVRPRGRARQLQRRLHQRPRADPVAHHHRSPAVLPGSPVDAGVRRRLRQLPAAGQHPDHRETVEQEAQRQPGDHPELDHPAPEMGHPLHLQRQPADAHPVARRSDHLAQRARRGQGRDRR

SEQ ID NO: 20343 - protein, 640 aa, Pseudomonas aeruginosa
RLGRGVQRQRRGDLPRGGQPAGQGRHGDDVPRPGTHRERTRQRDHRHPWRPPQLGDPRGAQTDPHDRRLRPAGLGLQLLRHGRLQPRRVRRGAQDEQGRLAGRTPPRRTRRRRPAATAAPGHLRRDAMKIRSQVGMVLNLDKCIGCHTCSITCKNVWTSREGMEYAWFNNVETKPGIGYPKEWENQEKWKGGWVRAADGSIRPRIGGKFRVLANIFANPDLPEIDDYYEPFDFDYQHLHTAPKAEHQPVARPRSLVSGQRMEKIEWGPNWEEILGTEFAKRRKDKNFDQVQADIYGEYENTFMMYLPRLCEHCLNPACVASCPSGAIYKREEDGIVLIDQDKCRGWRMCISGCPYKKIYFNWKSGKSEKCIFCYPRIEAGQPTVCSETCVGRIRYLGVLLYDADRIHEVASCENERELYEKQLEIFLDPFDPAVIAQARKDGVADSVIEAAQKSPVYKLAMDWKLALPLHPEYRTLPMVWYVPPLSPIQNAAAEGHIGSDGVIPDVESLRIPVQYLANLLTAGDTAPVLLALKRLLAMRAYKRAEHVEGRQDLEVLAKVGLSVEQVEEMYRYLAIANYEDRFVIPSAHREEALSDAFAERSGCGFSFGNGCSGGSNSAVNLFGGKPTNRRDVIQVVQIQE

SEQ ID NO: 20344 - protein, 169 aa, Pseudomonas aeruginosa
SAPANCRKRCATASRRCSTSSARATCWTSRRATTVSSSAAARSRCCSSSTSTARAATVARRWSTCSTAIPGPACKSTYRSCRTTCRCTSNTCRCCRSRRPAKGSPKWRTSSACWRCAWRNAAAPMRRFSRRCWNSAASARTSARCVATRPRNSATTAWRPSTGPGRKPR

SEQ ID NO: 20345 - protein, 594 aa, Pseudomonas aeruginosa
RPAGPRAAIPPGGQLRAGAGGRLPCADRPPVAPATGRRAGHRGPLRRRRDAGGSAHPPIAGGRGAGPGSRRRRLPDLVRGQSGALARPLAPAIAPCAAGLRAGRPGRPRDGAQAGRGAARRVARASRALRRPGPAFLRLSVEGGGRRPRLDRAGADRPRIREAPAAPRARAARASAGKPLWPACGGTAGARRRRAARLRRGPRTDRRAPAGAGVAASGGTVHRRAGGRRLYRGLRLRGCGWGAGAIAFGADVSLSFPKIKRSTQDMTDWIDGQGRQIDYLRLSVTDRCDFRCVYCMAEDMRFLPRQQVLTLEEIERVARLFVAGGVRKLRLTGGEPLVRPGIVGLCERLAALPGLRELCMTSNGSQLVRYARPLYDAGLSRLNISLDTLDPLRFRAITRNGELDKVLAGIDAAQAAGFRRIKLNAVVMKGRNADEVPALVDFAIARGLDISFIEEMPLGQVGRERGESFCSSDEVRALIAQRHALLDSAEQSGGPARYVRLVEHPQTRIGFISPHSHNFCATCNRLRLTVEGRLLLCLGHEHSLDLRALLRRHPLHDGPLLEAIGEALQRKPARHEFSAAGEVQVLRFMNMSGG

SEQ ID NO: 20346 - protein, 298 aa, Pseudomonas aeruginosa
RCILFGPDWTKSIKADHRLFPARAAGAPSSPLESSMIKSLNTKNLLGGLLLGVLASGSAVAADGNLRIGIEAAYPPFSFKTAEGELAGFDYDIGNALCAQMQVKCQWIEQEYDGLIPSLKVRKIDAALSSITITEERRRSVDFTHKYYFTPGRLVMKEGAQLDDSFSQLAGKRIGVQRGATADRFASAVLAKAGAEVVRYTSQDEIYLDLVAGRLDATFADSIPLQTGFLDTPRGKGYAFVGPEFKDPKYFGEGAGIAVRKGDAELVGKLNAAIDAIRADGTYKRIEGKYFKSDIYGD

SEQ ID NO: 20347 - protein, 533 aa, Pseudomonas aeruginosa
PAAAPACRRNEKGEAGWLRLFSPRLRSVLARYRLEQFGRRHLAGDLAAQQFFDRRQGEGIVLAGEADRGARGAGAAGTTDTVHVVVRVLRQGEVDHMADAVDVDAAAGHVGCHQDADLAFAEAFQGADALVLRYVAGHLGGADAVLGQAFLDAADFVLAVGEDHHPFPVVLCHQVVQQLVLVAAGHGVDMLLDGVAGDVLRLDLDDRRIDGPLLGEVHHVVGEGRREQQGLAFALVRGLPDDLPDLRDEAHVEHAVGFVEDHHLDHVQVHLAALVEVQQTAWGGYQDVAEARFQLLELLVEVHAADEGHHVQPGVLGQRRGVLGDLYHQFAGRGDDQRARLAHVALFRRRGLQQLGDDRDEERGGLAGAGLGAADGVLAAQGEAQYLRLDRGAVGEAEVMDGVHQARGEVEVVEAGLAFLRFDHEVFQLPVVHRLRLAFAARLVAARLGVPAFFAGGFGGLFAFLGLFSGARGARFAWAFLGRLFAGGGGTFRGSAGRALRDRGGTALRLGSVGLAEDFLECFEHGDLVVVKE

SEQ ID NO: 20348 - protein, 693 aa, Pseudomonas aeruginosa
TGASVKHVASGEKSMLGRRPPALAGRGLEGAARSSRGSLREDSCARPVARYKKTTVGRRRGWHLRDGAGAIRRVSAHSPTEEQENHESVPIDRRAERYRSPGTRAAGTARPAVQHLRTVATLGPAPRPAYRPELPAAWQRRRRTVADQLCRAVRPRHPDRQRLAPAGPGKPPGGVLPAAQPAADPLRDLGRRGRRDRQCDQPAAGAGAHRRADPRLQHPGAGDPGAVPRHRPVAEGRRPARTVAGAVCDRRGRSGQPVAGAAARGAQGPARAAAGGRAGLRYADRRLPGRPPGERTGDPSGRRRFLFPHRRHHRHAEAGAAQPLQRGGDGRDHGPERRLRGGRRAALRPAAVPRQRRDGYRPGALPSRRPGAPGRAPGLPQSDPDPGLLEAGGTLPGHQLQWRADHLRGVAAGPQRWPRPVQPAFRPVRRGADAGGADPPVRGAYRAQGDRGLRPHRRYLRHQLQPAWRRAPAGFDRPAPAVLPGEGRGARRRGQLPARCRAERGGQPLPEGPDGVQGLPATGPEPRYLDRRWLVQYRRPRSYRRGRLHLAHRAQQGPDHSRWPQHRPTDDRRSAAPASGRGPGGGGGQAGRQGRRAAGGVYPAQARRQRQRGRAAGARQPPRTGARGGAQGYLADREHAGHRGGQDLQAGAAPGRDPPGAGGGKPEDRRGYPRGGGRRRAPRPARPPARSRA

SEQ ID NO: 20349 - protein, 138 aa, Pseudomonas aeruginosa
RKTPGGAGRAARRLRAELPAARRLREAPGVRGACAARRRCRGFPPGTPRGPSGSRASPPPRPAPARRHGPRGQAPGRPRRPGCRAGAGPESACGARPAPGRRRSARRWIAPAPRRAAGRSGGRRYAGPPRRPARNRRG

SEQ ID NO: 20350 - protein, 439 aa, Pseudomonas aeruginosa
RLQAGGICVRNGRTIRQQALSRSQVGQIVADHAFANFPRMRFAKGSAPGTPFVARRGRAAGCLCRCRGACGYSAATGPGSDRRGAGGSPRGGEGSGEQMTIMKGTWLLLAAVCLGASATAEAGATLDAVKRKGYVQCGVSDGLPGFSYADAKGRFKGLDVDICRALAAALFGDAEKVRFTPLSATERFSALQSGTVDLLSRNTSWTSSRDTALGIHFTGVTYFDGQGFLVNRKLGVSSARELKDATVCIQSGTTNELNVADYFRAHGIRYKAVLDDSYEKSARALEAGQCDVLSSDQSQLYAQRLKLAKPEQYVVLPEVISKEPLGPAVRQGDEAWFNIVRWTLYGLLNAEELGVTSSNVERQARDSRNPDVARLLGSEGDAGKDLQLPRDWVVQMVRQVGNYGEIFARNVGDGSPLKMPRGLNAQWNLGGLHYAPPIR

SEQ ID NO: 20351 - protein, 260 aa, Pseudomonas aeruginosa
QTDAPVPVHYRATRHAEHRTREMPVNLSMTPINKAKAWGVHAVTASGVILALLALLALVDNKPQACLLWLGLALLVDGLDGTLARKYEVKEMLPHFDGSVLDLVIDYLTYVFIPAIFIYRYIPLPEHFELLAVGVILVSSLFCFCNVNMKSTDNYFVGFPAAWNVVAVYFYVLDLHPWVNLATVLVLAALTLTRMKFLHPFRVRQFMPLNIAVTFVWLISSGLLIVQQPADLPILLGLWFAASAYFVGICLWRSAREWFG

SEQ ID NO: 20352 - protein, 504 aa, Pseudomonas aeruginosa
RGRCRGGFRTYRPVSRRCAQCLPPDQSVLLRLREVRAVCRCPPGRGLRLPPSSRRHEPVARRQLGHRRDQPGPSRKHRQALGRQRFPANGPAYRADAAGESLDRSPPGGAVGHQRRPGAAGLLQFRRDLLGHRLRPAGHDFPPHRPAFPGHASQWRLPRADRRIGQEGGGPGDHEPQQQARGNAAFHPLVPVHLVRPRHPGGRQGTRGEPREPRRQAHSDSRRPCGHATGARALSAGLDGGGRRRAGCHEPGLRRTGRRGGGAAGHRSLLHRPVVPREAGDRRPGSHRCGHRPLRRSPRRRRTPVDSRQGLAEHLAGRPERYRQSLALAAGNERPDLGRLHPGDHRDPGDRSGLAAALPGLGHLSAPADQGARAGRTGAQRPVAVRRGPDRLHASAAVCARCQWTDAVLQPQLPAERRLEFRGGDEPHRARTAHGKLRDRSGVPSQLPEGHARGQDHRGGLPGGAGRSGALDRPLDPAVPRFQRDHPRCHLWLAGHHRAPPVDR

SEQ ID NO: 20353 - protein, 703 aa, Pseudomonas aeruginosa
RARTGFADESAVSEKASHEREPSPFRHFRTAWPAPAAARLARQRPRGVRRDVRRPAGNGILPQCARPRAERRLGRSRPGAFCRAWLRALGPGATGRGGVHRIHRPVRRDHGRALRPDRGDRLAPGARLLGPWTRPRSGGNRLGLRLRAAAPARGGGLHHAAQPPLLGLDGAPGHASRSGRGFRPPTPGSGSPDAPAYPLSRRRGPLGGAVNMGDGGGEVLSYHRLSMHRPERYAPGPGGLDWATQPAPFRQYRGCRQIELLHRPLEESPPYDGVFSGPAAAPSRLDRRSLSQMLYDGLALSAWKEAGGTRWALRVNPSSGNLHPTEAYLLLPGGTLEPAPLLAHYRPDKHALEVRGELPAPLVSLLDDCLPPGGCLLALTSVPWREAWKYGERAYRYCQHDLGHALACLSIAAAIQGWEMRLLRGVAESALDGLFGLDRDGFAECESVDALFWIGPALTQEPSLSPRLCEGLAALPLAGAPNRLSREYRDWPELQRIHGLCRAPRLPARPWRVAPGEPGNDNPRPAAATAAASAAYRAAHGRARRHRCRAAAGLAAQAAAGALAGAFRGHRRGRAGRSAAVRPSRPGPGAGVVLAGPQRPAAAADARGLPLAARRSGVAAVPVAGRRCTRAVGVSLLPAGHRRRRLRRARHARPSRRGARRRSLVLSAAVLGMRGGRPVALPRGGGRRAVWDGYRLLLRPPGA

SEQ ID NO: 20354 - protein, 171 aa, Pseudomonas aeruginosa
VHGQSLPFHPRPRGVGHSSLQHARVPGHAPRLARRQPEFEETPHDPDTGQPGGFAEPGTHRGEPVPGHEPGSRLPPALWRPGPGAGAVGGQPDGGGRSPRTLHARLLPASRRRQHAGGVPGGPGARRRQLQHPPGHRDPERPADLHPEQLLPVRRGRFPPPDRDARGGWPG

SEQ ID NO: 20355 - protein, 201 aa, Pseudomonas aeruginosa
GLGVRLADIRHWVFDMDGTLTRAVHDFPAIRRALDIPEQDDILLHLAALPEAEAAAKHAWLLEHERALAEAARPAPGALELVRELQRRGVRLGILTRNDHQLALITLEAIGLGGCFPTEHILGRGEARPKPDPDGLLRIARRWNVTPAELVMVGDYRFDLDCGRAAGSRTVLVNLPENPWPELADWHAADCHALLEQLQTP

SEQ ID NO: 20356 - protein, 362 aa, Pseudomonas aeruginosa
PAPIPGTSPNCWPARPSRKARRNCPPTCSAAAPPRLSPALPNSSRNRSACRPSSATTRPTSAPTSCARRSRSRSASAEFRDSAPACRSGGFLTLRRAEHMSRLTAEAISLSFEQRGQRRAILRDLSLGLAKGESLVVLGPSGCGKSTLLNILAGFQKPDQGRVQIDGRTLEGPGGERGVVFQDDALMPWLNALDNVALGLRIRGLGKAERTARARQVLQLVGLQEYAEQSVAQLSGGQRQRLGLARALAVEPDFLLLDEPFGALDALTRERMQVLLLDLWKQTGKGLFLITHSVDEALFLATDLVVMDGPPARIVKRLPVDFARRYAAGETVRSIKADPEFGRLRQALLDEFLDVAEAEHAH

SEQ ID NO: 20357 - protein, 305 aa, Pseudomonas aeruginosa
YPRTRRCQSCPAQAPSARRPSALGRRCQRAGPGPAVVGGDPFRLGRRAVPAGARTALRSPATAMAGWLPRCQPAATRRHQPAAGAPGARRGGADGDPAGRADGPQSLGRSGPRSAGGVLPADPAVGLPAVDRHLVRHRRAEQGAADLPGAVRAAADRYRRRRASRRPIAGAGGALPGGQPLAGGALRDPAECLAGGPHRPAHRPRRRLVYPGRRRADRGQPRPRLHGPVRRAIPRHRLGGGRHPADRRHRPGLRTGAALGPAALRRLGLIARVPSHFRTGLHSRGEGRSEGAQGAPATCPTSSTT

SEQ ID NO: 20358 - protein, 551 aa, Pseudomonas aeruginosa
WWCRANCRIRKGWRRPEILRVGSDGAEDEEDARAPRAAGNAPGLYDILGGGLVAALFSLWSSGFKVLAEGFSVWLSAGQAAFRLSTGFSLALVGAGYLMGITAGIAILIGVVISWGVAVPLLTVNSVPADGQSLSDLATQLWSSQVRFLGAGTIGVAALWTLATLFKPMVRGVWASLGAVRGNSQANSLRTELDMPAKWILLIAGILLVSLFVVFSHFLGAAAPDMASPQFWSLVAVCVVFAFFFGFLIAAACGYMAGLVGSSSSPISGIGIIAVILVSLLILGFGSIEGGLLDRQNGKLAIALALFTTSVVLAIAAISNDNLQDLKTGYLVGATPWRQQVALIVGCIVGALVIPPVLELLYSAYGFTGALPREGMDPGQALAAPQATLMTAIASGIFHDALNWNMILIGVALGIALILVDLLLRRTGKACLPVLAVGLGIYLPPTIGMTLVVGALISWLLENALKKRAAAAGVDEEAYAEEPKRRGVLLASGLIVGESLMGILLAGVIGATGEDAPLALAGAGFAGIAQWLGLVVFVAICVLFYRRVLAR

SEQ ID NO: 20359 - protein, 97 aa, Pseudomonas aeruginosa
KALCRPHIINSRISEKGREVSTTADFSASMLPANSSPPVTSAVTEPQNTRSHFGPSSSALPPWAERVERTTVPESAEVTKKTKLTSTVTVITARLQG

SEQ ID NO: 20360 - protein, 116 aa, Pseudomonas aeruginosa
TPMKYSASGRMSPGRSRNGGRLRRPSCRYCCRPARNLPARTAWSRSTLVAVTRRTSWGIGCCAPTRSTSRSSSVCSSLACSVSGRSAISSRYRVPPLAEPNQPARLPTGPLWAPGA

SEQ ID NO: 20361 - protein, 137 aa, Pseudomonas aeruginosa
PNSSASAWLRLRALQLTATNRPARSLWRWICRASSSLPVPVSPSISTGWPCGARRSSSSRTRCERGSKNTRALARMLSGLRSASGKVSGAGRGFSLMGNSLAARGASSACAATTAGTAAGGGRCGKRNAGASHATPA

SEQ ID NO: 20362 - protein, 393 aa, Pseudomonas aeruginosa
AGRAENLKRSCHVRIGGYRPCPHPVRVHRVLPHHLPGDHHRVGQLPGRTGRPLAENERRGLPRPLSFLVEDFRGQLRHGRGVRAGHGVPVRHQLEPFLRLRRVHHRSAADLRGAHRVLPRGRFPRGHAVRLEPRGTGPAFLRHGDGGDRHADLDVLDPRFQQLDADPAGFRDRRRPGDPGGLAGGDLQPVVPLPPAAHVGRRVPRHRLLRRRLGRLDPAARARQPGDPQDALDGHVDGADRRPGTGADRGRPWPQYPGAPAGEDRRDGRPLGQQQRRADPADPVRLAGHAARGNPLQGGDPGARQPDPQAQPDRADPGAEGLPAGRPAELHRGVLVVPDHGRPRHADDPGRRLEPVAALARPGQAVQLEGLPAPDPADGTVRPDRDPRRLVHH

SEQ ID NO: 20363 - protein, 429 aa, Pseudomonas aeruginosa
GTRDQPGRRRAEAHAGTAVVGRRRRFRRRARRPRASGRPRPGQEELRHGYRSSPHLGGHHHLRHHDVRGDGRLRPGHRHALSVLQGQRRPRCDDEHRGAGLGRQRDLAGAGRRGVVRGLPAGLRGGPVGALPAVDLHARRADLPRRRLRVPLQGQAGQAAHLGQGVHRRFAGGDLLPGRGAGRLHRRHPGGEPQLRRRFAGLDRAVPAVLRPGPDRRLHPARLHLADHEDRRPPAGAHARPGAPAGVGAAGDHRGGQPVDAAGPCRDRRTLVQPAEPVLVPAGADPGPGDLLCAAALGGQQRPREAVRAHPGVDLPRLQRPGDQPVAEHHPAGGEHLGGLGAAAEPGLHAGRRAVHHSLHPRLHRLELLRVPRQGEARRWLSLRRRRIWSVRRVIPNEIARPSHRSGDAWPGWRVSGPPACWPWASPPG

SEQ ID NO: 20364 - protein, 168 aa, Pseudomonas aeruginosa
TASSSRSTRRWRGSWPRWSGPSCSPTARRRARNCPAWSANTSRCWPRPARATTSPISTRTPSPPPSTPPAPPAIRKVCISATGNWSCTPWRWLRPSAAWTASACSVPATCTCRSPRCSMSTPGALRTWRPCSGSSRSIPGVTIRNCWSNCGSARRSPSPTACRPSCRW

SEQ ID NO: 20365 - protein, 704 aa, Pseudomonas aeruginosa
NARRPSKRLVSAFSRPPGHSPSAAKARARVVAPRKSHFRGIKRQAALAIVHALITKNTHGVASMTTRNPFSRRARLPLAVSLASSLAAPAFGVTFNIGEIEGSFDSALSVGASWSTAKPNKNLIGVNNGGKGLSQTSDDSHLNFKRGETFSKVFKGIHDLELKYGDTGVFLRGKYWYDFELKDEHREFKDIDDSGRKTLAKSSGAELLDAFIYHNYAIGDLPGSVRLGKQVVNWGESTFIQNGISAINPIDVTAFRRPGSEIKEGLIPVNMFYLSQNLTDNLSAEGFYQIEWDQTVVDNCGTFFSQPDVVADGCDQNLAVLTNNKASINLLNNVLAGAGLSVTPSPWDEGILVRRGPDRDARDSGQYGFALRYFADELNTEFGAYYMNYHSRLPIFSGQGASASTMAAINDLATRLAAINPALAAQAAAAATAGNSSYFIEYPEDIRMFGLSFSTTLPNGTAWSGEVSYRPNAPVQLNTTDILFAGLDPVSIGGNRPYDNASVLNGQAGQDLHGYRRKEITQLQTTLTHFFDQVMGAERLTLVGEIGWTHVGGLESTSKARYGRDPVFGPGPLPGTISGLASCQALNVSTLGTAEANNVSRYCENDGYTTSDAWGYRARAIWDYNDVFMGVNLKPSVAWSHDVDGYSPGPGANFEEGRKAVSLGVDAEYQNTYTASLSYTNFFDGKYTTVDDRDFVALSFGMNF

SEQ ID NO: 20366 - protein, 475 aa, Pseudomonas aeruginosa
CTPARCEPGRRAGLNEDDERMKTTKILLHTGVLALSLLATQVMAAVSADEAAKLGTSLTPLGAEKAGNADGSIPAWDGGLATNAGSVDSRGFLANPYASEQPLFTITAQNVDQYKDKLTPGQLAMFKRYPDTYKIPVYKTHRSATVPAAVQEAAKRNATTTKLVEGGNGLENFDTANPFPIPQNGLEVIWNHITRYRGGSVRRLVTQATPQVNGSYQLVYFQDAFTFRTNLKDYNPNKPSNVLFYFKQRVTAPSRLAGNVLLVHETLNQVKEPRLAWLYNAGQRRVRRAPQVSYDGPGTAADGLRTSDNFDMYNGAPDRYDWKLEGKKEIYIPYNSYKLDDPKIKYSEIVKAGHINQDLTRYELHRVWHVVATLKPGERHIYAKRDFYIDEDTWQAAEIDHYDGRGTLWRVAEAHAEQYYDKQVPWYAVETLYDLLSGRYLALGMKNEEKQAYDFNYSASESDYTPAALRQEGVR

SEQ ID NO: 20367 - protein, 152 aa, Pseudomonas aeruginosa
SSGSRPRSRRSSPRPRASSASAPSSAIPCARPATARRSSTTCSSTRSSSCRWTKTASGSATTTCSPTCCWRVPCPTSVRPPAPCTCAPAAGSAAMACSTRRWSRRCAPASRTWRRAWCRTCRKSNCWRSRTSPPCCAGRWTCRTASWRARRA

SEQ ID NO: 20368 - protein, 599 aa, Pseudomonas aeruginosa
RATPAISTTSSASSVAPRRWRGPSTWGCCARRATPCAWRAGSGLPASQEQGVADHADAGEGHRCARHHRVEQAEGRQRDADHVVDEGPEQVLADLRVGPPRDVQRRRHQARVAAHQGDAGGVHGHVGAATHGDADVGGGQRRGVVDAVADHRHHPAPAFQLGDRGGLVRRQHFRVYVVDAQGLGHHRRAAAVVAGDQVAVDIPSAQGLHRFGGAVLEAVAEGEQAEHAFLRSQFQQPGQGAALGLPVRGGTRQRAGLEFLLVEQAAVAQGQPATLDLALDAATAEGLAGVHRRNLQVALGAALEHGLGQRVLAAALQGAGEPEQLLLVVAAEVDDLRSPGGQGAGLVEGHAGDRMGDFQGLCVLDQDAVARGHAGAGHDRGRGGQAEGAGAGDHQHRHGVNQGLLQADPGDQPGAEGDQRDEDHHRDEDLADLVHQLLDRRLGGLGVFHQADDLRQHRFPAERSGAQEQAAFAVDRAAGDLVAGSLGHRQALAGDQRLVGVAAAVEHLAVHREAFAGTHHHLVAEAQLGDRHLFLATVAQAHRALRAQRPRGRGWRWRSGAWRGFPGTCRGGSGRSPRWRLRSRGAACGQAGRSARGRR

SEQ ID NO: 20369 - protein, 133 aa, Pseudomonas aeruginosa
PSSTCTRSRSCTRKPGACGHATCTSRWRCTRCSTRTSTWSTCPVPPVPARPSWRSPRPSSRPWSASATGASSPPAACRAWTRTSASCPAPRRKRWSPGSAPSPTTSKRCTWTTNAPMAASTTSSARCRCSSSR

SEQ ID NO: 20370 - protein, 218 aa, Pseudomonas aeruginosa
SHGRGRGAHAPGNPATDPGRWPSQGRRLRRGADRRHPGGQAHPRTDPAVPSAAAHQRQARTAGRGAGRRAHPRALPAGRADRRGDGGAHRRQRRGPDHLRHVQGGGPRDGHRAGPVAGEARRQERPLPQRGGRAGMIRVQYFARYREALGIDGEQLNWDAGLATLGALRQLLVERGGAWERTLGEQNLMCARNQELCGLDEPLQDGDEVAFFPTVTGG

SEQ ID NO: 20371 - protein, 372 aa, Pseudomonas aeruginosa
RPRQPWRRWPAAGAARERLRLRWRPTAPARRGAGRTAGARAAPASLREPGPGAGAGTSARRGPAGADGPAALGQQRDGRLRLVLRRPAAQRRQPDGRRADRRRRHPRHEPAAGPGGADLHRRAAADRRRLRGAAGTLRGRRRARAVAAGERRPACAPARRGVASWRAGAACRTALAPAGTRPAGESRRRHGLGASALAHRPAEQRRRIARARPDTVGRADLQRQPLLHRRLAARSGLRGARRGSARRRTGGQPRCAQPGGLRMGRAGHQRRCLGRRGRPPQARHRRAWRGQPVAPGDPAGQAVRLRLRGRQALAGAARQPCGGAGHRIAGGASVPASPAGTVRRSAAAAGAAGGLRLAATAGASPVPAGAAR

SEQ ID NO: 20372 - protein, 146 aa, Pseudomonas aeruginosa
PGAGGGVRLRQPVHHGRGPLPPVLLRHRRVAEPLRRLFAGQGGALERGTGGVDLAPQRSAHRPLRRRRGGRLPDPLQGPFPGQWPALPCAGGTDQPEHPGPGPATGGNRRGGGEDRRPPAQPGLRRAGHPGLAPGAGQLRQRAGRL

SEQ ID NO: 20373 - protein, 329 aa, Pseudomonas aeruginosa
RAAAMAARAGRTFRRAPDHPGRLSPFLAVRTAAMKLSLGPLLFYWDKRQIFDFYAEMASQPLDVIYLGETVCAKRRALSLNDWQALARELAQATRAELVLSGLALIEAASELSSLRRLCENGELRVEANDMAAVYYLSQRGVPFVGGPALNLYNGHALAELYSWGMRRWIPPVEVSGKLLRGVLDQAAQLGLEQLQTEVFAYGHLPLAYSARCFTARAENRPKDDCQFCCQQYPEGIPLLSQEGEALFTLNGIQTMSGKVSNLLADYRSLEHSGADLLRLSPRAQGMAEVIAAFDRVCKGAAPPLAVEGCNGYWHGRPGMLRAEEVGLC

SEQ ID NO: 20374 - protein, 264 aa, Pseudomonas aeruginosa
RLQRAASAGLAGHRRAPRLHRAHRPAWPAGRPVDLLPGALRGCPRRQPEQALVRPPAQCAERGAQYPFRLERRHLRARFRDQSGYRRHAYLRSHAPAPAGFLPAQRRHHLCRWADPRTHRDRERAHLAQPGDRGQEQGRRDPRRVPRQLPLQPARRQPAPLQRRGAADLAMGRPRDHQQLVLQQAARRALPGEGHRRAGGPCTPGVPRIRAAALPAPGARRADLPQGRLRPFARRVRPRHAQLPRRQQRQPAGAAQRRHRFPRP

SEQ ID NO: 20375 - protein, 650 aa, Pseudomonas aeruginosa
RRPAGRPGPAGPAGGQRRRADHLRVCRRQRQQQGAGVLQQRQPGPRPLRLPRRVLFQRRQRGGPQHRPERQPGAGQDLRPRQRRGRPGVAGAGQPAGGRQLVQWQRCGAAAPAQRRDPRQPRPGRLQPRHDLGQRRCADPRPEPGAQGRHPRRRQRSQRRLRPGGAMAGLPARHLRQPRPAWRWRARRRRGGRPATDPRGAGRRRRKSAGEPAGRHRGRGGRRLPERQRAEGLLRAAGRCHGGRRPGDLRRHLRLRRRQRQRRQARRPRPGDRPGPRVQRPHRAGRAAAGQRPGERRGVADAGRHQPAAGQRRCAGALRRHARAAPPDADRQRGLQPRPLRRGPAVLRRPPDDSDQRGGSRRTGQGHAGAQRPRPDSPRRRPQRAEPRPDPLPGTGTERLQQPARRRPYQRHRRRARLLGRQLPYPAVADADLRGSQSASGPAGGGRAPAGGQLQRAQLLQRRWQGRRFPHLARSQHGRGVPTAESEDRRGDPRLEGGHRRPDGDRERRLRRVQRHRRPGQRPQRQPTPGPALCLRQPEPGEAGQRRNCRGADLSRRQGPHLSIRGGARQFGEPGVRRHPQPSDPGPDLPGDQWRRTPDHRGEPPEVEGLGLRRRPGHRRRPGQLQPDPGARRPGPGGLAGGRSDGRQGA

SEQ ID NO: 20376 - protein, 433 aa, Pseudomonas aeruginosa
RLKALASVMRNTPGSLRKTFSSLPVPSRGFPGSRRARPFPASDSRMPSGWPVPCAGTPRRSTRRRSAAGSAIRRTPAGSVGPCRCEPRPSAAGPTSPWPAPRAWARRAAGRTGRRSWPSPPAGCSAARRSRPTRCRSRTIRGETGNWSPTAGSARTGPTCCGPCRYWRWPFRPGTAGTPRSPCRGPGSCCNRARLPGSGRGSACRSRSWAGAAEPASDAVPAWAARRGPVAAAGAAPASASAAGAARVVRRAAADPCGAAVGKARLCRSCRSPRGFVRAPFLAGQAKLDDPFVVLEALFRAVRQRPAHVCEKRRRVLESGEGQAVQKKAFDRPGLFDTQFQRRRAQLAELPDGGQQAASFEPGGSLPAYLQQDPLDDFVVADPLQAIQLAGIQFKHRRSAPFPGHRRGSRPAGAARPANAPAAPSLASIAARS

SEQ ID NO: 20377 - protein, 224 aa, Pseudomonas aeruginosa
NSWRAIRTGSDAGPEGNQARRRGGRMIAGDRPPLRHALPRSFFRNRPRPVRTGCAAGRRRGPCCCRRTSGCSSGDRTGSSPPGRARGRSVAGRSRRCRARSRPSSRRSARCCRRRFRSRCWRCRRTGWSGSCRRGCSSRRRCDSWRQGCPCASRRTALGCPCSARLRECSRRRRRSWHRRRSRRAAGRDRPGRRRSPPRCPCAGSCRGRSRCRSAGCSRTGCRS

SEQ ID NO: 20378 - protein, 777 aa, Pseudomonas aeruginosa
PRISASSRYQWASARPSLSVLLRSRRALEVRSRVRNTWKSLGWCMPAMLPAPGRCRERRRMKSARMDNGRARPRPQTDGILSLRSRHESFAVPAHRAHLGHHLDRHQAADGPGGDHPVDRLPLRPGGAGAVRRAAARPPPAKAGRTGPTPVHGSGRMPVLPEFHLLLYRQPVDSQRPGGRGVLHRHPVECAERPPVVRPAHRVERDGWWRSRPARPGAAVLAGIGGSPGHPGNLLRPRPGPARHAVLLHRQHAFQPATEGRHPPAHRQCLEHALRHPDPPGAVPVPGRAAEFRLERALRRLAAVPGDPRLGDRLHRLPDPGRAHGPGSRRLLHRAVPGGGAEHLGLRRGLPLDRTGAGRAGPGDARQRLGVPQAEGAGAGRAGALDLAEREARSAASPHLRIDQVQRPLAAQGRLEVLQRPLGHGPAGLVGGRADVRQGHHVVQGEQRRFGQRFLLVDIQAGAEDALLPQGGDQRGLIDHLAAGDVDQDRRGFHQAQFARTDQLPGLRSQRHHHADEVGLAEQFVEAEEARAEFLFQFRLAVVAVVEHLHAEAETAAPGDGRADPAEAEDAEFLAMHVGAELRGVDGALPVPGLDPGVQLGDPSRGADQQGEAEVGGGLGEDVGRVGESDAAAVQVVQVIVVVADRDAGDDFQLHRLFQLPGAERPADADHAVGIGQGGGVLGVDVALFRFEHADVELALQAFEMLGGEATEDEDVLFHDGTLQAGAKAPTIPPPSKRRAGARHWAGDYRLRRVFRVPGPAPPAPLRRAGAGRAGFP

SEQ ID NO: 20379 - protein, 548 aa, Pseudomonas aeruginosa
ASLSAAASLLKFIGPRAHERSSGLNGARTVQIPCFAPPGSDNVPRALRKELTLVGSFVGFLVVFSAISGCVSTGDIAPEAATLDANALATDHAIQAAAREAGWPQAQWWKVYADPQLDAWIEKALDGNPGLAVAHARVRQAKSMAGLVESIESPQIEGKGSLVRHRWPDDYFYGPGDLARTTSWNNSTEIGLNYKLDLWGRDRSDSERAVDLAHMAAAEARQAQLELEGNIVRAYVQLSLQYAEMDIAKAMLQQQRDILALAQRRLRGGIGTHFEVSQAEVPLPETERRIEVIDEEIQLTRNLLAALAGKGPGEGRTIRRPSLNLAAQPSLPSALPAELLGRRPDVVARRWQVAALAKGVDVARADFYPNVDLMASVGFSAVGGGMLEFFRSAKYTYSAGPAVTLPIFDGGRLRSQLGEAAAGYDAAVEQYNQTLVDALKNISDQLIRLHSVDIQKDFAAQSVASAQKTYDIATLAYQRGLTDYLNVLNAQTRLFQQQLVQEQVQAARLAAHASLLTALGGGVGAGADTPAQRKLAPENVPVRAVSSR

SEQ ID NO: 20380 - protein, 339 aa, Pseudomonas aeruginosa
SCCSAVSGSTAPGPAAAPSPSTRWRSRRWLRRRRTRRRSPCRWASAPWPAGLAWAFRGLFFVLPHYRRFPAAMPGTGAGVRPRRVHLLAAAVGRLRSRPAGVLLLRFGAGEPDRLRPGPRDQRVHRPDPLDAALGRGRRGHSAAQQRLAVEAPRARPADARGVRHQRQEQGAWLGLRKRHPRPAEPGLWRRCRAPGRAARAAALDVPGARGRPRDHRAASRAGAPAGRTLLRRGHALAPGDPRHGAGPDPAVRAPRCGEPGARPGGCRPGHPRGQAHRRTLRAALRQLAATAGAQLPALHPFFPARADLATDRTGRPDERPRYRPCLVKSPSMGSTCRP

SEQ ID NO: 20381 - protein, 750 aa, Pseudomonas aeruginosa
SSSRKGATTRPRRRRRRGGPVEWKGQGEARRMPGFFVSAGRKRAPLARNTLRLAAAGGEYPPGGLGPDLFGRRHDQALAAARAAGAEVVGDGFLGDLAEELLVGVEHRQPGAVELVHPRQQDAQVLVVAGGDPERGDERRAGALLAAQVLASHVAQALALVIHHDQVAPVVLVHQFQRLGHRGLRPGGDQAAVGGVFGAHQEQALERAVLAGEGADELVRRVRQQGVRVVVLEQPAALEHRHLVTQLDGFVDVVADHDHGHAELALHFEELVLDRLAVDRIDRAERLVHQQQRRVRRQRADYPDALLLAAGEFARVALQVLLGLQLDHAHQLAGLLLAARLVPAEQARHDHDVFLDGHVREQADLLDHVADVAAQGDLVEVRGVLAVDQHAAGGRRDDPVDHLQGGGLAAAGGAEEDADLAFLHGQADGIDGAELLAVLLGEGLAELVQFDHVRLLSVRAGAQSLGGEDALQPLQQQVGGDGQEADQYRADHQHRHVALADGSEDQHAQAAGADHRGDGHHADVHHHGGAYAGEDHRHREGNVDHPQALPEGHADALAGLADARFDAGQGEVGVAQDRQQRIEEHRGDRRQRPEALAEYRVDRHQQAEQGDRGDGQHHRGGALQRAGQPREAGHQHAQRHADEDRQAYGDQYQQQVLEGELADLGPVEMGKHAEEVHYWLPPWPAWPSSSRWCSRRKSAATFCGVCCSISTRALSACMVASSSRSMIGSNSVANSGWRCMTSLRTTGAAL

SEQ ID NO: 20382 - protein, 170 aa, Pseudomonas aeruginosa
SAQSASSCAWSSRRVLVAALKRGEVGASLMGVSSRLSKWAAACGGESQGCQTCVTGPSLSALRVFTAGRAPGPSTRAHGRRRSATGCIRRWPSPGAGRRRRRRAHRRWRRACRPRRRNRRAAFPPARPACPSPARRCGTWRRTVRCGCCRACSASVPDLRARLPATGGGR

SEQ ID NO: 20383 - protein, 665 aa, Pseudomonas aeruginosa
GRLPVRATGRRPCASSDGRPPAAGEPVRRRWLACPSWGRLLGGGGLQGGRHEAEEHSRAVGRARFEAQLAAEGLAALLHDGKPIMAATVLLRIKADAIVLDGDAHLAVGLAAQAHPGPLRLRMANHVGERLADDLQDVDFLVGAQRHVLQAVVQFDRHLAALAELGHGVPQRGFQARLVEAEAEGGEQFAQLPVGAVEAFAQFVEGVLDLLRRRLALEQGAQAADLDLQVGQRLCQRVVQFAGDGAALGEQGQAAFLFLLQGQGEGAGDVVAEGLDQLLLPVLQAAAAAFDEQFAETVAGDGQGLHQQWLGQGRGLVAGAGLLAAATAVALQAEVRRALGGGQRTVGALDPVLVQAEGHAAGVEHFLQLVQQRLQGAAVVGVLAQPAGAGVEQFEALVALREGAGLVLHALFQVAVDALQLAGHLVEALAQLRQFVLAAVGDPRVQLAAAQAAGGAGEFAQRADDVIAEVVEGDEHHQQAEEQAQALHRAEQLRAALGLGLEDADETVDVADVGVQHGASGQRARVQAREALAQLLVQLADRVVGVLALQQAADVAAVEAFAEGPEQRLAAFQAGLQGDPVGEHAQRAGVVDHRGVLVRVVGEEQGAEHPDQRQRYQQGEVAAEADYQGAAQDRLSGPVTTSKESVPLVSVRRGRLVHEKSLLKQ

SEQ ID NO: 20384 - protein, 455 aa, Pseudomonas aeruginosa
FLSNLHRNTFPRLSLNAVRAESLAMASLRQKQYSVLGMSTLSFAVNFAVWTMFSIIGIRIKDELGLSESQFGLMVALPILTGSLVRLPLGLITDRFGGRIVFFIHMLLVAIPIYGLAFASQYWHYLVLGLFVGLAGGSFAVGIAYTSAWFEKERQGTAMGIFGAGNAGAAITNLVAPMIVVAFGWRMVPQVYSVAMLVTAVLFWLFTWTDPAHLKGAAEASQRPTLAKQLAPLAELRVWRFGLYYFFVFGGLVALALWLPKYYIAEYGLDLKTASFITMLFTLPSGLIRALGGWFSDHYGARSVNWGVFWVCLVCLFFLSYPQTTMTIHGIQGDLSLGIGLNVWLFTFLVFVVGIAQGFGKASVYRIIHDYYPSNMGTVGGMVGVIGGLGGFCLPIVFGYAADHIGVRSSCFMLLFGLTVVCMVWMHYAIKQQRRIDGQAASADVDLPPTLPTHS

SEQ ID NO: 20385 - protein, 208 aa, Pseudomonas aeruginosa
CAGCTWPPSARSSASRPASRCSAKTQFPDVNPLQYAFLGPLVGALSRPLGGWLADKFGGARITLWNYALMIGGVFAVIAFLPGDGGQGNFFGFLGAFILLCFFAGIGNGSTFRMIPVIFRNEWARRVRDGQADKTGAARNASMESAAVIGFSAAIGAFGGFFIPKAFGTSLHMTGSAEGALYVFIAYYLSCIVATWWWYARKGAESPC

SEQ ID NO: 20386 - protein, 1274 aa, Pseudomonas aeruginosa
RCNARHRPGEEIKMSHLLDRLQFFKKKQGEFADGHGETSNESRAWEGAYRQRWQHDKIVRSTHGVNCTGSCSWKIYVKNGLITWETQQTDYPRTRPDLPNHEPRGCPRGASYSWYIYSANRLKYPKVRKPLLKLWREARAQHGDPVNAWASIVEDAAKAKSYKSQRGLGGFVRSSWDEVTEIIAAANVYTTKTYGPDRVIGFSPIPAMSMVSYAAGARYLSLIGGVCLSFYDWYCDLPPASPQIWGEQTDVPESADWYNSSYIIAWGSNVPQTRTPDAHFFTEVRYKGTKTVSITPDYSEVAKLTDLWLNPKQGTDAALGMAFGHVILKEFHLDRPSAYFVDYCRQYTDMPMLVLLEEHAGGAFKPTRYLRAADLADNLGQDNNPEWKTIAYDERSGGLVSPTGAIGYRWGESGKWNIAELDGRSGDQTRLQLSLLDGPEHACEVAFPYFAGQEHPHFKGVANDEVLLRRVPFREIVAADGKRLRVATVYDLQMANYSIDRGLGGDNVATSYEDADTPYTPAWQERITGVPAARATQVAREFADSADKTRGKAMVIIGAAMNHWYHMDMNYRAVINMLMMCGCIGQSGGGWAHYVGQEKLRPQTGWAPLAFGLDWSRPPRQMNGTSFFYLHSSQWRHEKLSMHEVLSPLADASRFAEHALDYNIQAERLGWLPSAPQLNRNPLRIAAEAEAAGLPVADYVVRELKSGGLRFASESPDDPQNFPRNMFIWRSNLLGSSGKGHEYMLKYLLGAKNGVMNDDLGKAGGPRPTEVDWVDDGAEGKLDLVTTLDFRMSSTCMYSDIVLPTATWYEKDDLNTSDMHPFIHPLSAATDPAWEAKSDWEIYKAIAKKFSAVAEGHLGVEQDLVTVPLLHDTPTELAQPFGGDGHDWKKGECEPVPGRNLPTLHLVERDYPNVYRKFTSLGPLLDKLGNGGKGIGWNTEKEVKLVGDLNHRVVESGVSQGRPRIDSAIDAAEVVLALAPETNGQVAVKAWEALSKITGREHAHLALPKEDEKIRFRDIQVQPRKIISSPTWSGLEDEHVSYNAGYTNVHELIPWRTITGRQQFYQDHPWMQAFGEGFVSYRPPVNTRTTEKLLNRKPNGNPEITLNWITPHQKWGIHSTYSDNLLMLTLSRGGPIIWLSEHDAAKAGIVDNDWVEVFNANGAATCRAVVSQRVKDGMVMMYHAQERIVNVPGSETTGTRGGHHNSVTRVVLKPTHMIGGYAQQAWGFNYYGTVGCNRDEFVVVRKMSKVDWLDEPRHGGLGGDALPQPLPQDI

SEQ ID NO: 20387 - protein, 164 aa, Pseudomonas aeruginosa
TSTNASVATPARSPARTSGPAAKAWSTPGSTTSRPNPGSATRRNGKTRRSGRAAGCARQTVRSARASAASSACWRTSSPTRTCPRSTTTTNRSTSTTSTCIPRPRPSTSRWRARARWSPGSAWRRSSGARTGRRSSAPSSPSGARTRTSTRSRRTSTVSTRTPS

SEQ ID NO: 20388 - protein, 485 aa, Pseudomonas aeruginosa
SRSCRSRSERHERSQPTVPPARPATRLSTRRAARGEPRPACADPHLRTAGSAARRPRGAAQRALPGRPAGRPGALRRSLRARPLGLAAALRARPRREPRPWPGDGRPARPLYRGRPANRRTGAAGLPAAVPRIPVAAAVRGGQRRARRSGAHPRPAGAAPGGTRQRLCGDFRGVAGTRRRAPGPRRVASRPGPGTARRQPGGHRPGLGGNPGELHRPRRRLPVEQRPPSNGVHRTTIAMGRPAGTADAVPRGPRRSLSMSTNLLFFGIYPYVALLICLVGSWARFDLSQYTWKAGSSQMLSKKGMRVYSNLFHVGVLFILAGHFVGLLTPASVYHHLISTENKQLLAMVSGGFFGVLCFIGLSGLILRRLTDARVRATGNASDLMILLVLYAQLILGLSTIVASTHHMDGSVMVMLADWAQAIVTLRPLAAAEAIAPVGLVYKLHVGLGLTLFVLFPFTRLVHIVSAPVWYLGRRYQIVRQKRPA

SEQ ID NO: 20389 - protein, 274 aa, Pseudomonas aeruginosa
SIMSCSHYEERVEKVELPQLKVNGVAIGEDLLARELQYHPADSYALALEAACRALIVRQLLLQRADALGIEARCEDGETPEEARIRQLLEEEVQVPEADEDACRTWYAANPGRLLGPWRLQLRHVLLACAPDDLEGRETARKQAAELLDELRGHPERFVDLARRFSACPSKEAGGDLGWIEPGQTVPEFEKRLLRRAPGLLEHPLESRYGLHVVELLAREGGEPLDFDAARAQIAAHLQVQVLQRAVGQYIGVLAGDACIEGFAFEGADGALVQ

SEQ ID NO: 20390 - protein, 159 aa, Pseudomonas aeruginosa
RKAPSSTTASASWPASASACSAALPPTASPARCWPRPVLKWCATPARTRSTWTWWPAASTPPSPTPSRCRPASSIPRAARATPSSGRSSRTRNTSARAPGSRCARGTPSWSASSTRRSTRFVPTGPTSASRASTSRATSTATDRSPAAAAVSRRLPSAP

SEQ ID NO: 20391 - protein, 155 aa, Pseudomonas aeruginosa
TCCSTVSLATFSGSISTIAGSTVHCLARFITSSVKVAENSRVWRSPLCGVCRMICRTCGMKPMSSMRSASSRTITSTMSRCTSPRWLKSSRRPGVATRMSQKRASSCLSCLSKSMPPTKVITFSPVYLVSAAASLAICTTSSRVGAMISARGSPM

SEQ ID NO: 20392 - protein, 661 aa, Pseudomonas aeruginosa
GDDGGGIFGTVPERSGECPPTHQRKNKKTMNPSPSIVGLSDIEALERVPLEQRDLPSSTYELLQRSAQRHGQRIALSCLLHGSAAEEPLRISYAELFARVTQTANALHRLGLESHQAVSFLLPNLPQTHYVIWGGEAAGIVNAINPLLEPEHIAELIRASNTRVLVTLAPFPGTDLWQKVAGLRAQLPELYAIVVVDPANLLPAPQREALKAQRGPLPEGVLDFDTLIADCPADRLESGRAIHPDDVASYFHTGGTTGTPKLAPHSHFNEVAMAEIMGLNADYGVDDVLLCGLPLFHVNGVMVTGLAPFHRGAQVLLAGPQGYRNPTLIQDFWKLVERYRVTSFSGVPTIYAALLQVPSDGRDLSSLRFALCGAAPMPVELIRQFEARTGLKVIEGYGLTEGTCGTSCNPRGGERRPGSIGLRLPYCQVKVAVLDGEGNYLRDAAPNEVGNLCLKGPTVFKGYLQQDRNRDIWIGDGWFNTGDLGRIDEDGYIWLTGRSKDLIIRGGHNIDPQMIEEALHRHPAVALAAAVGKPDAKAGELPVAYIQLKPGASASEEELLEHASRHVPERAAVPKDIWLIESMPVTAVGKTFKPALRLDAIRRVLEEESRRIAEDIRVEVVADERHGQLAHLHVPALDERRQAALEELLGGYALNYRLHAV

SEQ ID NO: 20393 - protein, 97 aa, Pseudomonas aeruginosa
SPRSRSARPCGRATKPGSTSSAGPCTACSTRRSWGSPRATSSARPGTAATRTSPACSAARATPARTCNCRATGWCRWCARSATMARSSPATSATAAR

SEQ ID NO: 20394 - protein, 232 aa, Pseudomonas aeruginosa
SSSSRPTCRSCSASGSPPRPISSVSASGAAPASGSAETTRHDGVPAWGRLASPYHRKEPRMAHPNAELIERFYQAFQRLDGEAMAACYAPQATFHDPAFGELRGREVGDMWRLLTSRARDFRLDYANVRADENEGRAQWGGPLPVHPDRAQGGESHRGPFPLRRRFDRRASRPVRPVALEPPGAWRQGPAAGLGAAGAAGDPRAGAQGPGRLPGCPSGGRLRLSVAEARIIS

SEQ ID NO: 20395 - protein, 1627 aa, Pseudomonas aeruginosa
AFSAPGSRHSPEESGARIDPRGGGRQGGGGDPGVLRTRRHRHLRPADERHGRPGVPSPRKPERQGPFGDPQQRGGSHPAPGHHFDDRVPGPQFSRRPWQAIQPGADHRPVDSLQRSSPGPAATDRSRRAALRGGRGARPRQRRVRSLLPAQGGPGWRRPDRRRGPGTLEPPASRRIAAVAFPLCDGNLQPGRQAVLATVQPGAGDAQEAGAVGAADQPGVQRPSFATGFACPGREHLGVADRVPPAAQFGDVRDHRDRVDQRSCQQPGEPRASADHGLRPGDGRFRRRLFVPRPALRVSLQPDQAGQNLRPEDEDPAQELRRHQQCRGVGAGAGNFPGGGRGGERRTTGTPDRTRLLHSPGLPVRPADAGTALSRLLLRILTPPPWPRLPLAERRASRRTRFLSIQLPALPHRPFMRSKLFLLFFCLLLSGGRLFAVEAHPSLTLFSQLRIEHEDMAIAEDDWAWLRHKGHLRLGAALDETSPFNVRIDDENYEGITADVATLVGQLLGMRIKVVSFDTHADAVAALAAGKIDLLGSHYSSAGDSSLVLSQPYARDRLAVFKRMGEKRNSPEDLAGLSVAVAREHVGELRQRFPRARFVVFGSHDEAVAAVAFGHTDLYLDDVLSAYHRINRSYYGYVRFERFADARLEGGYGFLLRRGDTNLLRVVNSAIGAINQDRLESIARRWVGSGSLPTGQRIALTPQESRWIARHPVVRLVINDDLAPLAFFNSDETFSGIASDLLDMISRRTGLHFQVTPRSGGFPEQIGVLARKEADLAIMSRSSKREEMLRFTRSFLSTSYVLVTRADDKGRAESPGSLDGKRIAIPAGHVGMQQVRERYPQASMVEVGVALDAMNLVYEGRADAAVVPLVTARYYIVRLFRERLAIADLVPIGAATAHFAVRRGDAELQSILDKALLSISPDDLSDIVNRWRSPPGMSGQTWVDYILVITEILAIAAALLLLCLGWVTYQRRQIRVRARVEQALSDQLRFVEALTDCMPPPLYVRDVNGRMLSCNRSYLQSVGLSSEEVMNRTVLELPMENFETAPEFHRSYLRAMREGRTIEAVYPVALGGRERWIDHWIQPFRDSSGTIRGVICGWLDITEHRQLIDELEEAKNLADEASRAKTTFLATMSHEIRTPMNAVIGILELALKRAETGRVDRSSIEIAYASAKSLLELIGDILDIARIESGRLSLSPKRANLRELVESVARVFEGLARQKRLSLVLEIDSSINGDVLLDAMRFKQILSNLVSNAIKFTDEGSIRIRIDGRQVEPSLLQVNLCVEDTGIGISLGDQQQLFRPFAQVNRNLQNTEGTGLGLVISRSLCEMMGGRLVMSSELGQGTRIDVELRLQVLEPIVENVRAIPLGSRQARRLQVLVVDDHAVNRQILHQQLSFLGHDVEEAENGLSALNLWHGQPFDMVITDCHMPLMSGSDLARSIRQEERENGEEPVVIIGLTADAQPEEIERCIQAGMNECLIKPIGLDVLEERLLALGFAADELPVTIDAEPVAIPTAPRLYDLDSLHALTGGEPTMLRRLLDELLTSNRKDLETLEGLVQRQETGELAELAHRIKGAARVVRGEQLVESCRRLEDACLSPNASFAWVEECAVGVKLAILALDESLVEECTD

SEQ ID NO: 20396 - protein, 314 aa, Pseudomonas aeruginosa
SFHRLRGAGGRGLRCALRTRGGHRLASRRRALGGGLRPRGGRGGAELRLRYPWPGPGGGFHRTGQRELPGADGAPGDASRSHRRLRASRPASRPPLAASCAVPVDARGLASQMSRPFPKRPPMNANLPPSAISELHGPRLLLRAWRDSDREAFAEMCADPQVMEFFPSVLDRAQSDALVDRVQAHFAERGYGPWALELPGEAAFIGFTGLFDVTMDVHFAPTVEIGWRLAPAYWGRGLAREAAETALDFAFERLRLPEVVAFTTPPNRRSWGLMERLGMRRDPAEDFDHPLLAADHPMRRHILYRVDAARWAER

SEQ ID NO: 20397 - protein, 363 aa, Pseudomonas aeruginosa
PACPGARPGNTVSEPIATASMTSATRWPASRSPRRSRAGRCACCAASPKAHWTACSALTGTASPSARASTHCSGSGRRSRRSLPFRRACAKDWRPCRWPARRTGCRGSTGTGRSCSGYMGYVGRRACRHARGGSHRASPATTTPGLPLRPLLHRRRIAQRMDGRAGIDVGLLRAWLRRLLPERSPVPFAVTGEAARVDLLLFVHRVRGLVPGLYWLDRSGLRRPPMREDFLWQRVDPELPLYLLQEGDARALSAYLSCQQDIAGDGCVALAMLAHLGAALEEGPWCYPRLYWECGEVGQLLYLEAEAAGLSGTGIGCYYDPLVHELLGLTDESMASLYHFTLGRAVWDTRLCNMPAYPAMRRD

SEQ ID NO: 20398 - protein, 300 aa, Pseudomonas aeruginosa
PVDSPNSRKHPMTQILDNLVALLSLEPIEENLFRGMSQDLGFRQLYGGQVLGQALSAASQTVEDDRHVHSMHGYFLRPGDASMPVVYQVDRVRDGGSFSTRRVTAIQKGQPIFTLSSSFQYDEEGFHHQIEMPEVVGPDNLPSELELTRQRAERIPERIRDKLLYPKPIEIRPVTQHDPYDPQPDEPVKYLWFRADGKLPDVPALHKYLLAYASDFGFLTTSMQPHAVSVWQKTMQVASLDHALWFHRDLRADEWLLYAIDSPWAGNARGFVRGSIFNQSGQLVASSSQEGLIRKREDWA

SEQ ID NO: 20399 - protein, 188 aa, Pseudomonas aeruginosa
WSATTVSTSTADAPRVVARCWSTCRKTPGRSWPTGTLPIAMRCSSNCKRRRNIRRKTSRAAAPAAPRKRKKRRRPGSCAFFLRIRAGCGGRYQPLIASVSALAGTNLATRLAAISIALPVCGLRPVRAGRSETFSLPIPGRVISPSFSRASLTISASWSSALRTVVFCASMASAMSWISWSLVSAMVV

SEQ ID NO: 20400 - protein, 200 aa, Pseudomonas aeruginosa
RLLRRGRRGSLADLSLARALPRSPDRCRRNGAGRHRHLRPRRWFGAVLARRAAAALPAAAAASRGHPGAARPAADPVRATARRLDPIGPGQPRPGPGCAGAGRRGGAGRGAASPRPRAASCRTGGGVLPGGIRPRRRADIPRKRGGVAAGERGGGGGPRRAARLPAPTGPGSPFAGRGPVGTGAWSKGGRASGGAFALIN

SEQ ID NO: 20401 - protein, 136 aa, Pseudomonas aeruginosa
NRRPLRPRQPRFLRRLQRAQGRMDRRLRTGEEDRPADRRRSQGRPRTAGRLDLPGKPGATVRRPARRRHRQGYRRHCRIPQGTEARAGRPRRLLALRQRRLRAPGGAGPGRPALNSATPLRPVGAEAFLPYGGQNT

SEQ ID NO: 20402 - protein, 325 aa, Pseudomonas aeruginosa
WTARRRASSSACRWTSRGVTPPAKRCVRSRLIPSSAVCARRCWTNSSMSRRPNMPTDTLGLAVANPVPRKRRLPGDRRRWAAGASVLALALLWWAATRFGWVDVLFLPAPEQLFEALQRLWQDGYLDASLLQHVGTSLLRVLLALGAAVLTAIPLGVLMGLNPLAGAALDPLVEFYRPIPPLAYLPLIVIWFGIGELSKVLLIYLALFAPLLIATAAGVRRVDRSRVQAVRCLGASRWQVVRYVILPSALPEVLTGLRIALGVGWSTLVAAELIAANRGLGFMVQSAAQFLATDLVVVGILLIAAIALGFELGLRWAQRRFAAWG

SEQ ID NO: 20403 - protein, 492 aa, Pseudomonas aeruginosa
RGVAMFGLEAIDLARIQFAFTVSFHIIFPAITIGLASYLAVLEGLWLKTNEEVYRDLYHFWSKIFAVNFGMGVVSGLVMAYQFGTNWSHFSDFAGSITGPLLTYEVLTAFFLEAGFLGVMLFGWNRVGPGLHFFATVMVAIGTLISTFWILASNSWMQTPQGFEIVDGRVIPVDWLAVIFNPSFPYRLLHMSVAAFLATAFFVGASAAWILLRGRDNPGIRKMLSMAMWMALIVAPVQALIGDAHGLNTLEHQPAKIAAMEGHWDNSSGEPTPLILFGWPDMQREETRFKVEIPVLGSLILKHSLTEPIPALKDFPPEDRPNSTVVFWSFRIMAGLGMLMILVGVWSLWLRWRGQDKLFNSKAFLRLTLLMGPSGLIAILAGWFTTEMGRQPWVVYGLMRTADASSAQSVTQMSLTLLTFVVVYFSLFGVGIGYMMRLVRKGPVTHEGRETNPGGAGQKRTPARPLSAAGEGFDEEHDGHAQAADRDQDKRN

SEQ ID NO: 20404 - protein, 336 aa, Pseudomonas aeruginosa
DMGIDLPLIWAVIIIFGIMMYVVMDGFDLGIGMLYPFFKDSGDRDVMMNTVAPVWDGNETWLVLGGAALFGAFPLAYAVVLSALYLPLIFMLVGLIFRGVAFEFRFKAKPAKQHIWDKAFIGGSLVATFFQGVALGAFIEGIPVENRSFAGGSLDWIAPFPLFCGLALIVAYTLLGCTWLIMKTEGRLQERMHDLARPLALVLLAIIGVVSLWTPLAHAEIAARWFSLPNLFWFLPVPILVLVTFYALLRSVANNDHVKPFVLTLVLIFLGYSGLGISLWPNIIPPAVSIWEASAPPQSQGFMLVGALFIIPFILGYTAWSYYVFRGKVKHGDGYH

SEQ ID NO: 20405 - protein, 189 aa, Pseudomonas aeruginosa
PRSRATTCTLSPASRRGRASVRRSCWRHSWKLICSSWANSRARVRELAPTRRPQSSRVSPSSGCFSNAWQIACKRRSRGIGRYSGIRSRLAISLRISPCRRWRKSSRRGWLSRWMARRIISRSSGVTASTQQSLSGVGVSGCSMNRVRMCTSPDMNISCSTRGGIHTARVGGITQAPWWVARRIRPRAA

SEQ ID NO: 20406 - protein, 677 aa, Pseudomonas aeruginosa
PRGRLRRAAYRLSHRALRLACGVHLARRGGHPARHRLFLLRARGAIAAPVGQGRGAWRGQRGPVDAPGVRRAGAGHRHRRGGVQRQHRDLPEAVPGAPERLAGVAADPRRGGQPGLCLRRGSATDHGPPDRSPEPEVAVRLPHLLPGAAAAGPGLRPRQRSGAVRRAVHVRGVRPGDGERCDGRPLRRAAVAGAGLRPALFPVVRRQRGGDPDDRLPGATAGAAGVVPGTGGLRRADLRRGAGVSASGAQRRGGHLRKRAPGQREPAGRRWLNAVSEQFERHGGGFAAADAQRGDAALAAFLAQGVDQGEDDPRAGGTDRMALGAGAAIDIDLGMIEAVFAHGEHGDHGEGFVDLEQVDVVLAPAGPGEQVGHRADRRQGELARVLALGGMADDSRQRLQATALGFLGGHQDQRGGAVGDRAGIGGGDGTVLAERRPEARDLLQVGGQRLLVVLHHALALAAGDGDRDDFRRQRAIGDGGLGALERFDGIGVHLLAGHAVLVGGLLGERTHQTAGTGVLQAVEEHVVLDLAVAHAQAAAGFLQDIGRVGHAFHATGDHHLVGASLEQVVGQHHRLHPRAAQLVDGGAAGGGGQAGRQRGLAGRALLQAGGQDATHDHFLYVLGGDAGALHRFADHDGTQVDRGNAGQAALEAAHGSTGAGDDDDIGHGTLPLVLDRV

SEQ ID NO: 20407 - protein, 580 aa, Pseudomonas aeruginosa
NRLPRPGALQLRHLQRARRAPGQRTQRGRGEGRRHGGGDGLGQPSLPGMHVRHPDDRGGAAYHQYPPLPGADPLHHEPRRGSLRAGEQRVRPALPGGGGAVGHGGADHPAHRRRGEERGTARPGRRIRVAAGRGQPALRLPRFRRELHRHHLLHHRHHRQSERCVFQPPATGPAHPGDGFDHRQPGQHPPARYQRRVHADHPDVPCPRLGHSVRGDHARGQAGLSRALRSGTAGRTVEAREGHLLPLRADHPADGDERQGCPGRGLQGLEGDHRRERAEPLALRGGQGARHPADRRLRHVGDLSADFLRLPQRRTAGRKRGRAHHLPDQGRRAGAAGGCGDHGRTGPLPPGRRRIPGRAGVALAMADPGVFPRTRARRGVVARRLDAHRRRGDPGRHGLHRDPRPHQGRDQDRRRVAVLPGAGRPDQPPSGGTRSGGGRGARSAMGRAPVRPAGGARGPATGRPWPEGAPQAFRRAGQHQQVGDPLADRGCYRYSQDQRRQAGQEAHPYRDRPVAGSRQRLPVDRLTGLSYTAETPGGQANAWSPRFRDRPVILHPPQRREPEWLRRANHTFEGSSGRQR

SEQ ID NO: 20408 - protein, 957 aa, Pseudomonas aeruginosa
LLAHLLGHSIRRSADGQPLFPPPAAVGPCGAPASLPSTARRTGRSPAADRRARRIRQEFPGHRVLRKPRSALAEPLAGTEQPRERSRTFPRTPARWLATVPPDPGRRGPRPAEDAPASPAVRLRDLARRPARRTRPLPGPAASPATGAGRLPPGPGRGARPLPAIPPQSPARGPGAAGHQPAAAGLAPGAPAPVAAIARTQRTGPAPDRRGERGADGRQRPRTRRGRAGRAARAQRRLGRRAAPLAAGARRSRGAGQPRGTRRRRTDPRLPAGGGDRAAAARGPGVPRPDRALRALLRRALRYRARGRRQRGDPRPPAAAPGLPRAAGRKRPVVPLPPPVLRPAAGASLARLRSVRRLPAPARLRLVQPPWPARPGGGAGAARRPAGRGGEPGAEPVGRATAGGAEHRHPAALEDGPAGQPPGEHAAPDPAVRLGAGAGLPAGCRGRTGRPTGAFPAGAGRVRAARPAGPVAGPERGDRARPRRYRQGRGALPRGLAGPRRGALWHPPAMPVDAEQPGGDPWRLLAGAQLQPRRPGVRPALRQPAVRGTGPLRPRPRPPGARRGGARRGGGAPGPGTPPAPAGATPLRGARAAPAVPRLPAQPGAAAGRSAQVDQAGNRGNPQLPGCQPGDRLLRPGQPGRAPGQLRGGVRPAWRRRAVDACLGYPADLLPGGDHPDQVRTLAGPGPDRTGRRLATAPGRHLRWAGGHAAGMQSAAAAACGVAPGRPGAPRRTPGGSRPAPGPAGPLDAGERRVAAGSPGPRPTGRAAPGAGPRARGAGDPATGHGGRSRRSLAAAPRIARAAAGMVARTVAALPCLSRRPAHARAVAGAARRARGRCGRGAQRARTGGAGADRSGVVQPGDQRAAVHLAAYGEEPRPPYQRQARRRASHPGGGAGQAHGVVALGAPPHVPGVLAQGFQRRRSRALPTTLTLEKAIAAPATIGLSRPKAASGMPITL

SEQ ID NO: 20409 - protein, 610 aa, Pseudomonas aeruginosa
VRREMSSAAGTRRGSPRIRVMPAACMATSVPPPMAMPTSAAASAGASLMPSPTIATTRPRPFSSATVAALSAGSTSACTSSMPRALATTAALPRLSPVIRWLWISRPRRASTASAAPSLRLSPKANRPSTRFSGASSSSQDRVRPSASQSAAALASAPGLSSCSSSRRRLPRASRRPSTSPWMPRPLRAWLAFTGGTSRSRSAQRSSTALASGCSLPRCRAPASLSSCSWSSPPRWMICGRPEVRVPVLSKATLVTAWATSRDSASLIRMPWRAATPVPAMIAVGVARPRAQGQAITSTATALTRACSRPTPATSQAPRVTSAMRITTGTKTWLTLSTSFWIGALAAWASSTRRMIFASTVSPPSAVVRRSRRPSPLIAPPVTLSPGALGTGRLSPVISASSAWLLPSSTSPSTGKRSPGRTTTSSPKRNSAIATSSSRPSRRRTARSGRNGLEGADGAGGLALGAAFQVLAEEDQGDHHGGGFEVEVRHVARRGGQPEVDAEAVAGAGAEGDQQVHVAGTGLHRAPGGDIEARADDELHRGRQEELRPRRQHPVQAGPFHQHRQHQRQRQQQRGDHPPAFAAQAALGIVLAWLPRVEQAGLVAGLFHRL

SEQ ID NO: 20410 - protein, 462 aa, Pseudomonas aeruginosa
PRTFPPHPAHPVRPRYQCPDPRSECPVELPGTPRRDPDDGARRAGQAEDRKAHHRRRVPPGHPPDRPGTRRGHARAGRGRGTDPAWQERPQRQPVDPHEQACRAHHLAAGAPQRQQDHQPVGRAEEPPQRRARGAGDQGHQHAPEGARLRGGRGGLPHRPVDRRRGPAVARLPFPRRLFLGPREQGRDPPGPRPYLASRAAHRQPAGGAHQRVHRRRTGLRRLDQGHPAGRADHPRPAPGAAPAPGSLGPAATRRVPVAGAVRAARPGHPPGQPVRCRRFRQDHPGARRGHRADHGQQALPAHHRHPQRAGPGRGHRLPARHRGGKDGALARRHHRQPRSAAHGRRMHPWQRRLHPQQGAVAVQVAELHPRAQLPAEPDPHRRMPEPHAAPDEDHHHPRRQRFEGDLPGQPGADRHALPVRHQLRPDLPHRTLQGLPPRRARDPARGAALGAGGVRRGAHVR

SEQ ID NO: 20411 - protein, 241 aa, Pseudomonas aeruginosa
PAAIAGRYPARLKKPGGIYILPGPVRGPGPHRYPIGMRRLAPACPTSLCIQSSPFRTSPRHRVMPSRAYNDWPVSSSRSTHVLTHLDSQGRANMVDVTEKAVTSREATAEAVVRMRPETLQLIQDGGHPKGDVFAVARIAGIQAAKRTHELIPLCHPLLLTSVKLELQAEAPDAVRIRARCRLAGQTGVEMEALTAASVAALTIYDMCKAVDRGMVIEQVQLLEKLGGKSGHYRKEEEGQA

SEQ ID NO: 20412 - protein, 182 aa, Pseudomonas aeruginosa
CARAIRNCAASTSRCRTATKSPSSPPSPEVEPMAIRVQQAAFDPGQELNALHAQNVGIGAVVGFVGYVRDFNDGREVGGMFLEHYPGMTEKALGKIAAEAGQRWPLLRLEILHRIGRLEPGEPIVFVGCASAHRQAAFDACNFVMDYLKTRAPFWKKEDTAEGPRWVEGRCSDQAAAQRWEE

SEQ ID NO: 20413 - protein, 538 aa, Pseudomonas aeruginosa
HLPDPRGGLGLDRRPRGTGRPDHRRHRLHRAGQHPAGGRAAVRARCRGLRRTVPPGLAARDRHFHHPVAGAGRAQQRYPGVLPARLAGRLSHRLERDSPGATGQPHPPVQFRPAPEDPASRGAGGRLRVPLVSACACDGGQLRPLDEALAELLARAPRPPACESLALERALGRVLGEDLLAPMDLPHWDNSAMDGYALCSADLPRSGGSLTVGARIAAGDTRGMSLPLGQAARIFTGAPLPTGADCVVPQELCVVDGERVQLPPVSAGQHVRRRGEELRRGAPVLRAGQRLRPQELGLLASLGVATVSVRRRLRIGLLSSGDELREPGQTLLAGQIYNANRYCIGALLRGLGFEVHDEEVLADELVASRDALSLAASEWDALVTSGGVSVGEEDHLKRAIAELGEVNLWRLAIQPGKPFAFGSVAGKPWLGLPGNPAAALVTALLVARPFLLRQQGLFDVVPRPLALPAAFDWPQPRARRQYLRARLDERGRVEIHPQQGSAMLLAASWADGLAVIERGATLGVGDAIDFLPFSALMA

SEQ ID NO: 20414 - protein, 369 aa, Pseudomonas aeruginosa
GLLDPGQAPTGSVFLECGACAPGLPTAAERVFRQRSNPMQLVCPAGSLPALKSALRQGADAIYVGFRDDTNARHFAGLNLDERQLQEGLRRVHEAGRQLYVAVNTYSSAQGWERWQRAVDQAADLGVDALIAADVAVLGYAAKRHPRLNLHLSVQGSATNAAALALYHERYGIRRAVLPRVLSLAQVRQVAAGSPVPVEVFAFGSLCIMAEGRCHLSSYVTGESPNLCGVCSPARAVRWSEEPEGLTSRLNEVLIDRYAAGEAAGYPTLCKGRFLVNGQRFHALEEPTSLNTLDLVPQLAEIGVAAVKIEGRQRSPAYVEQVTRVWRQALDSYASAPGAYSVQPQWQRALAGLSEGHQTTLGAYHRSWQ

SEQ ID NO: 20415 - protein, 540 aa, Pseudomonas aeruginosa
RPCQLAPVNRTFVKPAENSGMSGMDLKRRRVVQGLGAGLLLPALGAPAVIASPRARPKLTDGVQSGDVQGDRALVWSRTDRPARMIVEWDTRSVFSEPRRLVSPVTDERLDYTARIDLRGLPADQSIFYRVRFEDARDGSLSKPWFGHLRSAPSEARNIRFVWSGDTCGQGFGINPDIGGMRIYEAMRRRQPDFFLHSGDTIYADGPIPERIETESGRIWRNRVTEAKSKVAETLDEFRGNYRYNLLDDNLRRFNAEVPQIWQWDDHETTNNWSSSKQLDERYQVKDIDVLAARARQAFLEYAPLRFQRQGRDGRIYRKVAYGPLLDVFVLDMRSYRGGNSANLQARRSAATDFLGREQLQWLKRELRGSRAQWKVIAADMPIGLCVPDGKDAQGRDRWEAIANGNDGAALGRELEIADLLRFVQRAEVRNTVWLTADVHYCAAHQYSPERAAFKDFAPFWEFVAGPLNAGSFGPNALDGTFGPQVMFQKAPLVQNSSPFAGYQFFGEVEIDAQSRALTVTLRDLDGEPVFSQELQPDGA

SEQ ID NO: 20416 - protein, 784 aa, Pseudomonas aeruginosa
RSIPMHPLRNAALLGGLALLGLPVANAAELIISEYVEGSGNNKALEFYNSGSQVLDLSAYRVEFYFNGASAAGRSIDLSGSLAPGKTFVLANGVADPALLALASQRVEGSWFNGNDAVLLRRRSGEILDSLGQVGFNPGTTWGSGDVQTLDRSLVRKADIRDGDSDPSDAFDPAAQWLGYPRDTFANLGQHGAGEPGGGEEAGLRPIHEVQGAGAESPLVNQRVAIEGVVVGDFQNASELKGFYVQQEDATVDGDPATSEGIFVYDGGNGSDVKLGDRVRVTGQVREFNGLTELVGPLQVSVLASGVALPTPAGISLPLASADALERYEGMRVQLRQTLTVNEVYNLGRYGEVLLSSGGRQMTPTNVVAPGEQAKAMQARNDLDRILLDDGRSGQNPDPIRYPAPELSAYNSLRVGDRTSAIDGVLDYSAGSYRIQPLQTPTFEAANPRPAQPAVEGRLRVASFNVLNYFNGDGKGGGFPTSRGANTAEEFQRQKAKIVAAILASKADIVGLMEIENDGYGEFSAIADLVNGLNASLPQGQRYAFVNPNRAKLGSDEIAVGLIYRGDKVRTYRSAAVLDSSVNPEFDDTRNRPTLAQTFQEINGGERLTIAVNHLKSKGSACDGDPDTGDGQGNCNLTRARAAQALVDWLAGDPTGAKEPDRLIIGDLNSYAKEDPVNVIRSAGYTDLVARQAGAGKGYSYVFSGQSGYLDHALANASLARQVRGAVEWHINADEPRVLDYNVEFKTPRQQDSLYNAEPYRASDHDPVVIGIDLRRVAMKKHRR

SEQ ID NO: 20417 - protein, 167 aa, Pseudomonas aeruginosa
SWKRCSGLSASGRRMCARNAGVSWKAGKARPCRRKRSIVPGSSIPSSSAVARSSPSCRMAGSRPRRSSQAGASRRTSSRTRSMTSSSRTRCRRSSWPASSSSIGGPLRFPVIDEVAALQGLPDLPTLQRRHHLRPLPRGHDLFQRPAHFRAVVAQQRPAAVGHAGEE

SEQ ID NO: 20418 - protein, 631 aa, Pseudomonas aeruginosa
RDFLPGSLVTRLRKAQAYGAMGRGAWEEGRRRFAQRRVRFACAGAVRRYRAGATDSRDTVIRPAPRPPREETGRLFLAPPVRSVMLARRAEADVRPAFFHQAEVDAGRCQVGEVPAAVHGEVLEGLVLELLELLLVVALDPACRPDVDRLVGALDLVFLLQAAGDHVELQYAHRTEDDVVVALGEEHLGRTFLGQFLQALAQLLGFQRVFQAHAAEQFRGEVRDAGETEVLAFAEGVADLDGAVVVQADDVAGIGLFQLLALGGEEGQRVGDLHVLAQAHVAHLHAFLVLARADAHEGDAVAVLGIHVRLDLEHEAGELLLGRLHAAFVGGARQRLRRPVDDAVEDLVDAEVAQRGAEEHRGHLALEEGVLVEFVAGALHQLQLLDEIVVEIAEVGAGFVGVELFDDLGLDALVAVAGDVDDDPVVGQVVDALEVLVAADRPGDRRGLDLQHRLDLVEQLDGVADVAVELVDEADDGRVAQPADFHQGDGPRFDALAAVEHHQRRVHRGQGAVGVFGEVFVAGGVEQVDHVLAVGELHHRGGDGDAALLFHLHPVGRGVAVGLARLHGTGDGDRLAHQQELLGDGGLTGVGVGNDREGTALRDFGGLSGHGCVPAGIRWRGRGTARKNAGL

SEQ ID NO: 20419 - protein, 414 aa, Pseudomonas aeruginosa
LAAVGAGPVAQLVAGFVDVAVADAHFVATFAQLEALAETGFQAAYPVLARRQGEVAALVEVAAAQGLGEEAGDVELLAGVGGVFVAGAGQGTAAPELVVGTGRLVRVVAVGRGAEAAGHVGLAVVVLGHRRKRVFVAGLEAALEDQVVDPRIAVLAPIAAAGAGVEQGAAEAVGAGAADQHVVGGLQAVLAGAGAEFAVHVELGGEVLGDRPGHEVDDAADVLRPVAHRAAAADHVHRVHVADGHRRQRQLWLAVGGEGHRDTVHQHRRARRQARVEAANAEVQCQVVAAGAVVERRADPGNALQHFAGAGRALGLELLAADHVARTGMLEDVGGAGVGQPVADHGERLQVGRVFHRQRLQGIGAVAAGARLQAGAGEQGGQGFLQGVLAVQRLAAPRGGLFRAEGDQHAGLAA

SEQ ID NO: 20420 - protein, 145 aa, Pseudomonas aeruginosa
RAVPPRAAPPAGWRGSARYRPADSCRKSAGRRCAGRSPAGRGGSARLRRGIRPGACRRPPACRRSRRRCRPAAAAERRVARGRSPAAGRWAAAGPGRRGSPPAPRLRGRRRGCVRRTGARRTGCPPVAAGLPRCTRAAGAGPGRC

SEQ ID NO: 20421 - protein, 325 aa, Pseudomonas aeruginosa
KAQEWTMVAPGLARRLTASCRCGVAMNLSLYLLTVLIWGTTWIAIKLQMGPVAITLSIAYRFALAALVLFAVLLLGRRLQRLDARGQRLCMAQGVCLFCLNFICFYTASQWIPSGLVAVVFSTATLWNALNARLWFGQRIASNVMAGGGLGLLGLGLLFWPELVGHQATPETFYGLGLALLGTLCFSTGNMLSSLQQKAGIRPLTGNAWSMLYGTLILLALCLFQGVPLNFDWSARYVGSLLYLAIPGSVIGFTAYLTLVGRMGPDRAAYCTVLFPVVALNISAFAEGYRWTAPALAGLVLVMLGNVLVFRKPKAPALAGPARST

SEQ ID NO: 20422 - protein, 449 aa, Pseudomonas aeruginosa
PTETLEMTSSCIACSSCLAPSGRPTPIMPWVSGRAAAYWASMSPCFGSSTRTLNWHCRRSRCSGARRLKTKTFFFMTGLCKRERKRRPYHRHRSGGQGPATGRAIIGSGGSSEFQAQLHQRRFVALEQAGQAFLEVFHPGLDLRVEILPRRVQRIDVELLQAVLRQDPHQGALAQVLDGRIHRQDADAQSGADCLGHGVADIDLERRGADGDHFLAVGTVEQPAIQRHHRADQAQAVVAGQLRRLARRAVQAQVLRRGAKNAVGLADALGNEAGIGQLGGHHDGHVEALVEQVRHAVGHGQVEGHVAVLLAVAGDGADHVVLADAGHRMQLQLAGGSGMGVAGFGLGFLDVGEDLLAAQQVALAGLGEGDATSGTVEQAGAQVRLEVGHRPRNIGGGGVELLGRRGEASGFRHADEGSHVLQGVHRRGLLGTRRSVSDCCEGGLFHITQ

SEQ ID NO: 20423 - protein, 226 aa, Pseudomonas aeruginosa
SACIRWTSRRTSPRNRWLPRRRPTISPPWPTSAASPITSTCSTRRPGCSSSNWSRSRCRPPGWPPTPACSPPSAAASGPAPIRRRSGSWRRRTSRSERCLRDEWPLRWFRPAQPRRVAARAGRVGAQRRGDLDLRVQGALRGLPDPLAGDAPGIAAAEHGDHHRVHRHAAAERPGVRQELLPHPRHPGRPQRDGHPDRPVRPGASAVPAQLGDLDRPLHRRGRPLP

SEQ ID NO: 20424 - protein, 373 aa, Pseudomonas aeruginosa
GNARLRPDPCLAGRPPPRARAVEGRLHRQGQRGGGGSGGDAHRVDDPAVRLFLDLQHLAQRRHLRPQRGGGLGAGFGGAEPEEGRHADGHRHHGRRGWLGLSAGCSSFYPIIDGFPLLCLVLAPVFALGAFISSRPQWAGYGLGLLVFFCFGSVPANLTVYDPAHVINEYIALILSMLLSAAAAAVILPPNSAWLWKRLERDLRMRVVFAISGRSRGLGSAFESGTRDLLNQAYGVAAGRPDVQRGLLRWMFLVLEVGHAIIELRREQERLPDEPCYAEAMPWRQAIRAMGRALIRLFVRPGAENLERALAAVDQAIHAARHTDEPCAPHFDSSPLRRVRSYLHFIRSSLLAPTSPLTELAGRTSGQGTVHAS

SEQ ID NO: 20425 - protein, 232 aa, Pseudomonas aeruginosa
DGGLPRKPRRRPQHRRRGDGRLRAGQGPARRRAPEPGAHPGGGAGRRVRYQPQRAPWRLRAGRRGEDGGDRQELLLGLRLLRGNQAAVHPRRRPGGHAADERRTPQGPRGKHRPRHLRPRQPGKPRADRRRQPHFQLGAPGPARAGAGTHRRSAGRRAALGGDHLHGDRQAARARRPGLGGAGAGAGRLSGRGREKPGGCRAFSFRRGGRGRHSPGIRCGWRLPAVNIHPAA

SEQ ID NO: 20426 - protein, 148 aa, Pseudomonas aeruginosa
RRSFSSISSSASATGVCGRAVTRLLSAASSARTRSRRLSVLSWPVKALTNSSAGCASRVSGWSYWSSRPLLNTATLSPSLMASSMSWLTMITVMPSLRCISKNSFWIDSRLIGSTAPNGSSISSSGASAASARITPTRCCWPPESSRG

SEQ ID NO: 20427 - protein, 202 aa, Pseudomonas aeruginosa
PMWRRRVTSSRSAVSWPSISTRPEVGGMIRLIIFRVVVLPQPEGPRKTQISPFSTVRLMESTARNSLPFFWVKVLLSLSSSIMFGSCQCALARSPLGVRMRCSHCSSRSAAMARRLTSTAPTTSIGMLLWLMEVRISTPRPPAPITAAMVITPMFITTAVRTPARITGTARGMSTIRRRCQKVMPMPLPASRMPASTPVRAR

SEQ ID NO: 20428 - protein, 358 aa, Pseudomonas aeruginosa
QGEERRAGGAEQQLLVVVQVNAGEDQAAQAVGADQERQRRGADVQRQGHAHAADDDRHRVRQFHPQQHLVGRHADAGGGFLQRRRDIAQALVGVAHDRQQRGEEQGEDCRAVADADDRQGDGQHRQRWDGVADVEHLHQAFGLGLHAGTAEQDAGRHADQQGGRHRTEDQHQVGLQVEQQVLAVVEDGRGGDPVDQQGQYGGCGAEAEQGLATGFHHGRDSLRNERWLRCRALRRSAETGRKSKASDGHRIPDPERVDRSSFAEVQRNGHACAMTGPGQAAAAAVSPGLAANEEIFPGEAVDNGAAASAARHAPYRCAGRPGLFCGYDAGSEIFSGFSRHSHPTVHGSAFWGRCFTFC

SEQ ID NO: 20429 - protein, 478 aa, Pseudomonas aeruginosa
GSTPRHARSRRGIHCLDHLAHLRELPLHPPAADHRRDGHGAGVLADRPGAVGTGLSDPRGGDAGNHPPHRLLRSADDLVPARAAVRRRTARRPLRPAQLQVADRPAGHRRGADRHLRHRWPGLLHLPAVRLAGGFHLLPAVRRADLADRPHCRARHPQVRRRAETAGDHHRRRVAVQRRHRGGGVRHHPRHPPARRGAHGQRHGDPLRPGSHRRRGLRCGARLRRVRDDARHRPVPGGGHADPRPGHRRCRAGRAPARIGADRDGGGRADHRQPRTPLRDVGRDPALRGQVLGTDRRDPQRPAVRPDRPGAAAVAVLLAARGGGLRPRRRGAGLAPAHGGPGDPGPAPFPWRQPAGTGGHHPHPGLGWAARRRLGGAGAVPAVGAGARPDPQPDLHRGAGIDPAPGAFHRPAGASYLRRPAAGEKRGGALSAAFAKRAPAVMAGVFVGGHQALSCGASLRWVPRRFIAARQTCSRISA

SEQ ID NO: 20430 - protein, 543 aa, Pseudomonas aeruginosa
LRRSSWRCRWRLSSLSCQITQAATRPSPARAARETGRALAGYRTRRMTQVRTSSAPISIEMSFLRSRGDILAHCCVSQAVRARLRGGGAAICAREAESRGCGFRQAGDSRRPRPRRSFAAALAARRQQTLQLDEQALGVLRLAVLAVALLQAVFAEGQVQGRDYLVARQAAFHAMQRATVEGQDRSPGAGPADQQRDVAADSGDAGHLRQPGAIQAQREIVGQLRHVGAAGAGVDQGKGIVGAAFEHHDGRLVEGSRQYRRSAAVDFLTGIKPARGSHQVVLHRPHRGLDPRTHAELVQHPLDMDLHRAFGDVQLSRDHLVAVAVGDLAEDLPFALGQLVEALRAVVAPQGLGEDLGQLRAEGHLSGGGLADVLEQALRLHVLEQVAVGAGAQDVDHVALVVGHGEHHDARVDSGLAQRAQGVQAVHALHVQVQQDHVRVQLGGQAQGFLAAAGLADHAEVVFQFEQLGDALAHHRMVVHQQQANRFVGGGWHVRHGVGSLAAEGCRAVGTKLKSTRVPWGARASKRNWLPRVWPRSCMMVSP

SEQ ID NO: 20431 - protein, 370 aa, Pseudomonas aeruginosa
PWSAWSGCTTRSSSNAASTARPPRPTSTFLPPFPPTPEECRHGHDRQYPTESRTGTAAARLAPRGPRVLGAQRQAHRQPQPVDLDPRAAARLRRVDDLEHGDCAPEQRRLRLQQRPAVPARGAAVDLRRHPAGVLFVHGADLRRSSLDRPEHRLDADPVHLAGLRRAGPEHPVLGVRPDRAALRLRRRQLRLEHVQYQLLLSEEPAGHRPRPECRARQPRRLGDAVRRAAGGGRRPVRRLRRRAAAARRRRSPVAAERRLDLGAVHRRGIGRGLVRDERHRRRQGLVPRPGGDLQAQAQLADVLAVRGHLRLVHRLLGRLRDAQPRPSSPTSTRCNTPSSVRWWAPSAGPWAAGWRTSSAARGSPCGTTR

SEQ ID NO: 20432 - protein, 226 aa, Pseudomonas aeruginosa
RSSTSTGRAPTSSTTAASTPTCRCWCCWKNTPAARSSRPATCAPPTWRTTSARTTTPSGRPSPTTSAAAGWSRPPAPSATAGASLASGTSPSWTAGAVTRRACNCRCSMARNMPARWPSRTSPGRSTRTSRASPTTRYCCAGCRSARSSRRTASACGWPPSMTCRWPTTASTAAWAATTWRPPTRTPTRPIPRPGRSASPASRRRARRRSPASSPTAPTRPAARRW

SEQ ID NO: 20433 - protein, 186 aa, Pseudomonas aeruginosa
TMTSARPAVRVPPRSTGSTTVPRASSTWSPPWTSACPPPACTRTSSCRPLPGTRRTTSTPPTCTPSSIRCRRPPIRPGKPRATGRSTRPSPRSSPPSPKATSAWSRTWSRCRCCMTPPPSWRSRSAATAMTGRRASASRCRDATCRRCTWSSATTRTSTASSPRSVRCWTSWATAARASAGTPRRK

SEQ ID NO: 20434 - protein, 200 aa, Pseudomonas aeruginosa
ARSTGWTNPATADSAATPCRNRCPRTFEERRHENSFASRHGAEPRQMHRLPHLLDHLQERLDQPRRHGVRLVQQRRDQTRDRLPEGMGKPGEVEGRLGARGRRFDPPAHRRQVPRAGEHLRQPGPARDRRLLRTVRLRLPAPAYRAQGRAPAGGAPALAGLRAAHGEDRVGPELGGDPRHRVRQAAQGQELRPGPGGHLR

SEQ ID NO: 20435 - protein, 592 aa, Pseudomonas aeruginosa
VREHLHDVPAAPLRALPEPGVRGVLPERGDLQARGGRHRPDRPGQVPRLADVHLRLPVQEDLLQLEERQVREVHLLLPAHRGRPAHRLLGDLRRAHPLPRRAALRRRPYPRSGQLRERARAVREATGDLPRSVRPGGDRPGAQGWGGRQRHRGGAEVAGVQAGDGLEAGPAAAPGIPHAADGLVRAAAVADPERRRRGAHRQRRGDPGRRVAAHPRAVPGQPAHRRRHRAGAAGAQAPAGDARLQARRARRRPPGPGGAGQGRVERGAGGGDVPLPGHRQLRGSLRDPQRAPRGSAFRCLRRAFRLWLQLRQRLFRRQQLRRQPVRRQADQPPRRDPGRADPGVSAMNDHSQLFRLLALLLDYPRAELREESLGLHALIRTCELPEALRDGLAALLNELCQGDLLDVQARYDGLFERGRSVSLLLFEHVHGESRDRGQAMVDLLDRYTGAGLQIDVPELPDYLPLYLEYLSLLPFAAASEGLAEVAHILGLLALRLEERGSAYAAIFEALLELGGERPDLGALRRDQAQEQRDDSLEAIDRAWEETPVSFTDPAGGCPSSSGRRPTASTEQPLQWVAQPVPQMQYRAAREGV

SEQ ID NO: 20436 - protein, 407 aa, Pseudomonas aeruginosa
SSASCSCNGPTRWASRPAAKTARRRRKRASANCWRKRCRSRKPTKTPAGPGTRPIRGACSAPGACNCAMCCWPARRTTWKAARRRASRPRSCSTSCAGIPSASSTWPGVSPPVRRRRRAATSAGSSRGRPSPNSRSACCAARPGCSSIRWKAAMACMWWNCWRAKAASRSTSTRPAHRSPRTCRCRCCSERWDSTSACWRETPVSRASPSRVRMGRWCNSLRRRCFPLLPEDQTEYPGHDRLDRWPRPTDRLPAPVGHRPLRLPLCLLHGRGHALPAAPAGADPGGDRAGRPAVRRRRCAQAAPDRRRAAGAARHRRPVRAPGGTAGVARTVHDQQRLATGALRPAVVRRRPVASQHQPRHPRSAALPGDHPQRRAGQGAGRHRRRPGRRFPPDQAERGGDEGAQRR

SEQ ID NO: 20437 - protein, 800 aa, Pseudomonas aeruginosa
LPHLAGLLPCIFYLLLHRSRRFCKYIGSTLSIGKPFMTNNSAPPLVVTRGNDNGYEPGSMVITHVQASGLDIIQYIPGRSSYGTPPFVPPGPSPYVGPGMQEYRRLRDTLDKSHSELKKNLKNKTLKEVDELKSEAGLPVKAVSANDIRDEKSIVDALMDAKAKSLKAIEDRPANLYTASDFPQKSEAMYQNQLLASRKFYGEFLDRHMSELAKAYSADIYKAQIAILKQTSQALESKARSMEAQAQQVTQQLGADFNAITTPTATKVQQRVKAVDASLSQVSTQVSGAVASATQAVQVKTAQAQQQANSQISSSQNLISAAFRNQIALAAQASGEAQVTAFNTKVKQIVNEATAFSTARKQALAQFAANAAAEVETEVNRLTAQVKASPTKAASQAAQATLRQFTESTYAKVNTYAQQTEAELQAKAKEVSAAVAEAQRAATNDLQKTADVVPGQIIQAANTLAMPATSTPLVSVAGFGSAAVETARLAASLTNAVNRLVQIAGSGPGAYVATFAVLSLYSDQAGKDSDKVPAGVRNALALEASALGLPGTADLQSVAKAGGTVDMPVRLTSAAQESPSGKSQIAAMLTNGATVPKGVPVRAATLNAATGRYEVTVPAKSTVPNTPPLILTWTPATPPGSQNPSSTTPVVPQPVPVYEGATITPVQAEPESYPGVPLDLDDLIVIFPVGSGVKPIYIMFNHNPHDVVIDDKIREQIPIRGWTEVEIRDVIGKGATGSSSDKRRPNKTIDGLGRNDSATVYGSPPNGYIVVNDRTGEIIQIADRNDSAWAVDGRIIWRNK

SEQ ID NO: 20438 - protein, 401 aa, Pseudomonas aeruginosa
GKCAGYAVRRPPRSRRRLPLPVPRRLRLQCGDRPGKRPARGRRFTQGRRREWRTDDNNERYLAAAGRCLPRRQRHGRGRCDAGCGEAQGLRAVRRQRRPAGVLLRRRQGPFQGARRRHLPGAGRRAVRRCREGALHPAVRHRAVFGVAVRHGRPAVAQHLMDQLAGYRAGHPLHRRHLFRRPGLPGQSQARRVQRPRTEGRDGVHPVRHHQRAERGGLLPGPRHPLQGGARRQLREERPCPGGGAVRRAQLRPVAALRPAPEAGQAGAVRGAAGSDLQGAARPGRAAGRRSLVQHRPLDPVRPAQRGGAGGHLEQRRAPGQGQPQPGRRPPARQRGRRRQGLATAARLGGADGAPGRQLWRDLRPQRRRRQPAEDAARPQRAMESRRPALCAADSLTGGAG

SEQ ID NO: 20439 - protein, 106 aa, Pseudomonas aeruginosa
PAGRGTSAWTTRTSAPTRTRGVRNGVAHYLFTQTGRRVENRIEARFRFADGLIVEHRDQFDLWRWSRQALGAKGLLLGWAPPVQRAIRGQARKGLAAYQAAHPAAG

SEQ ID NO: 20440 - protein, 115 aa, Pseudomonas aeruginosa
SPKLAADNPQDAAMITLFQFPAAFNVPNASPYCLKLETWLRLAGLEYQVKVVSDPRKAPKGKLPYVRIEGEAIGDSEIVIRTLGERYGVTLDAGLDARGKGWARAITRLCDEHLY

SEQ ID NO: 20441 - protein, 593 aa, Pseudomonas aeruginosa
  UNSURE (289),(474),(511),(523),(557): Identity of amino acid at the above locations are unknown.
HPLGEDWRYPPSISTPASAAATPRRSIAPGCVRSTCSATAPAGWSPWRPPSPWSSAGCACANWISSPATGFPTGWTTSACCCSASPRPSAWIPRRSASPRRNVSAWRCRRRSRKHRSAWAPRRWRGYRAWPISSPCAAACYRRPAVAPTPSASNATPSTDCSVTRCVPARPRRRSPTSARCGCSCRTPATHWCRATPRPWRPNGGPPRSARAASTRCPAGTSTAWAKPWRNPCRNPCQRRRADERRPFRGGRRFPVRPVLCRRRRRRSALRPARHPWPGQPAFAGVGRXPRGGDLVRGRGVAGRCPPGLRRGRRRGTRRAGPGAGRGADGAWHRRADRASVAAARMAGPAAQRRAPGPALPAQHLLSAVAGGGAFHRAGPPVASPGGGIRHLDAALRGAGRFPHPGHPRRVAGGRRPLVPGIRPSNDLSAMRGLSLVLAEVPLSLHVLNELAAADDGRMTLLQRVSLTTDRGTXSLLSPHGPLLWTPAVAVPAEDDDGLFALFDEIAGEPXPSAQLWYAEPCXWAQVHQRLWPAAAAEALALLANGDEVRRRNQRSXEVAALWQRIGERLGFPEAPPASLAPASLEQVLEQAS

SEQ ID NO: 20442 - protein, 161 aa, Pseudomonas aeruginosa
SGSATSPRWSTCSCRRPGCWPGSCSARWPWMPSACRWRSARPAPSCSCCGPWPPRYRRSATAATRCWARAPPPSACSRCSTRRRWPRAARPASRSMARWRCTAWAMPMKAWRSWPISIWSWRMAAWWPWSVPRAPARAPCCTCWRATWTRSAANWRLAAWH

SEQ ID NO: 20443 - protein, 827 aa, Pseudomonas aeruginosa
ALSNRISPEAVRTMKTETKVIKGRQGIARNRHTPLCLGLLLALSPLAAAVADARKDGETELPDMVISGESTSATQPPGVTTLGKVPLKPRELPQSASVIDHERLEQQNLFSLDEAMQQATGVTVQPFQLLTTAYYVRGFKVDSFELDGVPALLGNTASSPQDMAIYERVEILRGSNGLLHGTGNPAATVNLVRKRPQREFAASTTLSAGRWDRYRAEVDVGGPLSASGNVRGRAVAAYEDRDYFYDVADQGTRLLLRGDRVRPEPRHPAHRRCAIPAHRLDHQHGRGTDGQGWVQSRAVPRHVPRCRLGPFQVGHLPRVRLPRTATGRRLERQGQRRIPGSRFAPALRRLLRRHRPADRRRWPADGRRLQVQEHPAQPRRQPQWAGATVRPDPRTARWGHLRPGRDPPGHRTLPQPAEHPGQCLPLGPARRAAPADRPVHFAGHHHHHPERPLCPGSDQARRAADPGGRRPRKLVGPGHPGHPLQARSPVHALRRADLGLRQGLVVVCQLRRGLPAAGGSPDLEQRAVEPGGRQDLRNRDQGRTGRRPPEPVAGGVPHRPGEQSAGRPGPSGAAQQSVLHQRRQGAQPGLRAGRHRLPDALLESLGRLHLHQHRVPQGQPERLGDALLHLHPEAPAAPVEQLRPALAGSALERRRRTPGAERLQRRLPRREHAPGRLRTGQHAPGLQDRRALDGGGQRQQPVRPDLLPEPVQPQLEQPLRRTAQLQRQPAGRVLMPRQSGFGWAWRVPLALAGSLAAATASGYLLTRGLPLDDPLERLYAGLFGALGVGLLLLVGGLLARGPGNFAWRLGGSLLVLGLALWLLAGRG

SEQ ID NO: 20444 - protein, 116 aa, Pseudomonas aeruginosa
ASAMPGMSPAAWRSPVSSVACRVPRTSSGTAIGWPTAPCSASAARRSAGSGCAPSSPCSRCISPSTSGSGRAGPPRCAACTWRWASAPACSAPAACTCGCNDAPRRRTPAYGSCSA

SEQ ID NO: 20445 - protein, 93 aa, Pseudomonas aeruginosa
ARVSVPAWWRRPRCSCWGCNSCPRSYSPDPGRGGCSLSCGPPLAWRRCCCRATGRWRAGCSASPGWPAWRPPSRTWRPDSCAAGCRPWAPTSP

SEQ ID NO: 20446 - protein, 444 aa, Pseudomonas aeruginosa
SSAARCSSGTPGCRRAPPRHPPTPVSPETTMLELYRHRRLVITLALLYLSQGIPIGLAMDALPTLLRQDGAPLQALAFLPLVGLPWVVKFLWAPWVDNHWSRRFGRRRNWILPMQCIVLACLLGLATFGLGVASAGWAVGLLALASLASATQDIATDGMAAEHFSGELLAKVNAVQIAGVMIGFFGGGAGSLILAGYFGQRTAFLVVACVPLASLCCVLALGRGAPHELPPAPAAKASLLRFLRRPLAPSLLALALLSAMTAVSGFGLSKLYLSDAGWALQDIGRLGMSGGLVTVFLGCGGGAWLVRRIGLWRGFALGVVLAGCSALLWYLQAGRWLALSEGLAWTCVLIGSLATGITSVAILTAAMRFAGQGGQAGTDVTAVQSTRDLGEMLASSFLVSLTAQIGYAGGFLTGSALAVLALLLALRLQAGEGRGEWKGRAEEA

SEQ ID NO: 20447 - protein, 174 aa, Pseudomonas aeruginosa
LPVIASSAALFSVFGREAAAHSSFSRSRLARMILLAVGRRASSYSRRAAATSALRASAAASSMPSRIACEAPLAPIGYIRWAASPSSVMRPRPQCGSGSRSTIGYCRINWLRVSRSRMSNQPRSQSAKNGNTSSRRPLRFQSASLSSWPTAALGTMHTQFTSDLPSAAWRAEIG

SEQ ID NO: 20448 - protein, 239 aa, Pseudomonas aeruginosa
RSSWVGMAVAASAGPRPSSARASTAAGWILMPTPRGRISLLLSSSVTLPMPAWCRARAQLRPPMPAPAMRISMGSLMGASFSRVFESMGVRLGRMTVYRHETSAQRRITPVALFALRPDYGAAGRISAVKRRRSGVVTVAGSGASSLLRRGRSAGARAAARCRCPRTPPTPGTVRTGSSPAGAAAGRRFPPGAGLRRAGRGCRRGFRSAARRSTSGGSGTGGSATGRRRARRAGVRRGR

SEQ ID NO: 20449 - protein, 145 aa, Pseudomonas aeruginosa
RCPRHRRSAPRVRTGRPATAGARWRRAARSRRSARCGWPAPPPRAGASPGAAAPGSSARRSARKPWPGFPPPRPGDRSDARWSSRRRCAGGRRPRSRRCGSGSPSPACARPGHRRRSAPPPRCSSRDPAARSGGSPGRRFPAGCR

SEQ ID NO: 20450 - protein, 375 aa, Pseudomonas aeruginosa
PARPLRRRPRRRGRNLPRSVPAPGSAAAPGPAPAAAAPAPGPSAPAAACRRRAPRSRARRSAGRESAPAGHGAAGPGRARPAAGRPGRAVRAPRRGSRRAGPGHCFPGGRARRTAPAVRAGAATAMWAGRSFQHLVGGDHHRAAAGGVFQGHAVVRLAEVGDGVGHQERLDVVGVGVDRGDQHPDVGVYAAQHQLVAAGGAHPLEQVGVEEGAVAPLGQQPVVRPRRQLLDHLAVGRTGAHARPPEVLEQAALLLGHAARLGGVGDLHALLDAPAAQPRGVGHQSGAQALGQRAQEVALHVVHQQHRAPRLQAPARQVGRQLLGGRQGIGGDFGNAAHATVSRGKVALGIASAPDQAITALSACQGFSRGSQRLV

SEQ ID NO: 20451 - protein, 165 aa, Pseudomonas aeruginosa
TGRVCSPTCSCGLERGLAYCPAMRPTRITGRRPARRRAPASSSSTAALRATFSAWWSSMSSAQSPHCTTSASPRATRARVARRARMSPARISAGLPRRYACTSRRRDGSPHSGCCSASQRRTRCNRSSMVGPPSAGDIVSIKWECLRVLFPGPECSRRAIVGRRS

SEQ ID NO: 20452 - protein, 368 aa, Pseudomonas aeruginosa
KMNNSNLAAARNLIQVVTGEWKSRCVYVATRLGLADLIESGIDSDETLAAAVGSDAERIHRLMRLLVAFEIFQGDTRDGYANTPTSHLLRDVEGSFRDMVLFYGEEFHAAWTPACEALLSGTPGFELAFGEDFYSYLKRCPDAGRRFLLAMKASNLAFHEIPRLLDFRGRSFVDVGGGSGELTKAILQAEPSARGVMLDREGSLRRGPRQPLQPVGRGARQPGGRRHAARGAVQRRYLPAVADHRRSGRSRQPAVARQLPRGDGRRRPGGGDRADHLGQRAVAEVGALGRAPVHGLRWPSPHHRGGGRPARARRLRGGADRRPADGNPHDRRCQGLNRNFQRLAPAVSPAASWPAPGARSPLPQPSAL

SEQ ID NO: 20453 - protein, 417 aa, Pseudomonas aeruginosa
PLSADPPAQRRIGGWPSARSRHRHEAQIARRPHLDALQRLAHLAALRIAGEHPQLVAVLVGHEDEAPAGREGEFARLGAFHRAPFDETQLAAGRVDGEGHQLVVVAAIEHAEEAAVGGQVQGAGADFALEAGMRQVVGLLLTQAGIAPMGEHLTWPLSSSVRFSETPVGAEYSMARAAAGRGRDECRIGRLQRTFGLFRGVSVDEYLVGAEVGGEQVLAVGRGHHRVHMTGNLARMHLAGLVRLHLHHRRQRAVRAHRQYRHRAFRLYRVVGDEQVTTVVAEAAVGRMIAEGLDLADLLQAAADRIETVGRGATDGIALAAPSVLVDHEQSALVRGEGQVRGVAGMGHAQRAFHRAVGAVEAVYLDAFAGAFGIGPHQQVVEAGGLGLGRHAGERREGQQAEGGQSSHGQLLGSLLF

SEQ ID NO: 20454 - protein, 376 aa, Pseudomonas aeruginosa
KYSFMKIYWSSVGRRGVVRPGEGIAMTDRFTRLLGIQQPIIQAPMLGVSTPALAAAVSNAGGLGSIAITGSAAEKGRALIREVRGLTDKPFNVNLFCHRPGQADPARERAWLDYLKPLFAEFGAEPPARLNNIYLSFLEDPTLLPMLLEERPAAVSFHFGAPPRDQVRALQAAGIRVLVSATTPEEAALVEAAGADAVVAQGIEAGGHRGVFEPERGDAAIGTLALVRLLAARGSLPVVAAGGIMDGRGIRAALELGASAVQMGTAFVLCPESSANAAYREALKGPRAARTALTVTMSGRSARGLPNRMFFDAAAPGVPPLPDYPFVYDATKALQTAALARGNHDFAAQWAGQGAALARELPAAELLRTLVEELRG

SEQ ID NO: 20455 - protein, 771 aa, Pseudomonas aeruginosa
YKYHISSQDHLPPMSPLPASPALNSLLRLLREGAPLVERVGALRRLLLEHPGTRQAWYLAWQPQAQTYTPVPPSPALPPGAGEPNRASDLALRERLVRDGRLALDELRRSASWLGARLRRAGVEHGMAFALDLQAGDEGLLLVASDTPQSAALDWLGLLLAPLLAAARGVTRAAPFLAADPQPALLLDGEAQAVEFNQAFLALLGERPREAWRAYLPANHGQLVRASLGQARALGEVEAECDGRILLWQFIPDSAEARVLARCRDATASLRGEREAARASRLYRLITENTTDLISRHTLDGIFLDASPASWTLLGYWPEELRGRPAQALFHPQDRGQVALRAREALEQDGYLTITYRIRHRDGRYRWFETASRAIRETYTGAVVEVVSVSRDVTRRVEAEENRRRLAEVVEANTDLVLFVEHGGRVTYLNPSARAALGIADGQEAPALERLLAGDTPARLAEEGWRQARDGGVWSREGRLQPQDGRPSLPVSLVLLAHRGRGEERYYSLVARDMTERELREAQQRRHQDELAHTARLVTLGELASGIAHEINQPLAAVMNYASASQRYLAVLGSQPEAAGRVAEGLARIGEHAGHAAEVIKRLRAFLRKGQRRLQALDLNQVAREAIGLCAWEAGHWQVAVEEAMTDNPPPLYADRVLLEQVFLNLLRNAIEANREAHPGSPSRVVIGSRVEPGGLLCLWVRDQGPGVPADQLEHIFTPFHTSKPEGLGLGLSMSRSIVEGFGGTLEAELPADGGLLMNCRLPLAAGATGG

SEQ ID NO: 20456 - protein, 142 aa, Pseudomonas aeruginosa
PRRQEGADGQGRHPGAEHPQGVAQRPGGHLRDQPAGAAGVAAGQGSGLRRRRVGTGQRFRQARRGGRRLRHPAGEPEYRGPGHRLPQGQSATQATGRLDPRRPGAQRRGGAAVPQVVRAGHQVQPQRAPLQDRFRPDPRVSA

SEQ ID NO: 20457 - protein, 472 aa, Pseudomonas aeruginosa
LLAVLPRRPVPQRAVGRAGPDPGPGLAGAAAGAATGHPARPGAGQPLALAALADHRAGLRGARGAVADGDLLGLFLPADPHRPAHRPVHHHAAGACAVRRGVPGRDRPRRHPGPRPWPVRGGAFARPGLPGEHAPGDPPAGAAQHAAVVGQPIRLDDQGDLPGLHHRPGRSQLHRLADQYPGVHPADPGLPDPRPHLFHPVLRTVAFRLLARTPPGAARQSQGGPMIRLEKVNKWYGAYHALADVDEQVGRGEVVVVCGPSGSGKSTLIRTLNRLEPIQGGRILIDGQDIHAPGLDLNRFRSHIGFVFQQFNLFPHLNVLDNCTLAPLRLRGLKPAEARRQALALLERVGLADKAAAFPARLSGGQQQRVAIARALAMEPPLMLFDEPTSALDPEMVGEVLLVMRDLARDGMTMVVVTHEMGFAHDVADRVLFMDAGRVLERASPDDFFNRPQHPRARKFLADIRTPFAQPL

SEQ ID NO: 20458 - protein, 160 aa, Pseudomonas aeruginosa
RRRSPRRSRRRRSVASAGAATRRGCRPSARAPPPWGSSPPVARGRNRSDRSRPARPASPRTGGCARPRRAPGRRCRPASATGRGGVPHRYRAAGGARRRRYRRLPPPPADAARGRRSGAPGRSRGARRAAPLRCGSRTASRRSLRRRFFPVPGGAATRRA

SEQ ID NO: 20459 - protein, 481 aa, Pseudomonas aeruginosa
LLVAAEGRRGVALAEAVDGDDPRADLPRQAQCVAQAAGVGRGGEAVDGVVGQGDGFVDVVERGDREQRAEDFLAEQPAVRRDAIDHGRLDEDASLGGAAEAHRQPLRPGLVEVRADLLEVRRADQRAEAITRIQRVAHAPLAELRADAFEQRLADFGMDDQPRGRRAVLAHVPERAVDHVLRHQVEVLDIVHHHRRVLAAALQYHPLEVGLGGVLEEQAAGRGGAGEADHRHVRVAAQRFAGLAAAAGDHVEHPGGDPRLAGQFGDAQGGQAGLGGRLDHYGAACRQRRADLPGEHQQREVPRQHQADHADRLAYHHGQRRRTDRGGAVVDLVDQFGMPAQGIDGFRQVGVLAFADRLAAVEALHHRQFQQVLFQQLGQAQQRRLALGGRARAPAAVLERPPRAGHGVPDVLRVAGGDLRQQLAGGRVGRGEGAAAAGIAEPSVDEGALGKVQRRGDGRVFLPAQQLSHGGHPRRSARPRP

SEQ ID NO: 20460 - protein, 369 aa, Pseudomonas aeruginosa
RQASRPAGREQEEQEARIDGKKAFQRRPARAEPQVHRGRGGGLGTGAGGLPAARTLFPAGLHPGAGHPGDRQPDPQRVLRGEQLQPERRAGDQRPRVADLPGPGARLGGAARTRPAGGLRRFAHAPALVRRAAGSVAGRGVARRRPGRAVERCLVPRRRRPAGWLPLLHPSRAPRRPRRDRPQQPGDQRQLYGRPRPPDRGQPHRRLQPGAGVDRPAPRARPGGGGGGYPRLRGVALPAGAPRPAREDERAAARSDQPDGGEYRGTAQPGAARPLRGALAAADRAIVPAAARNHAGALLPGVADHRVPAPAATFRPDHAGGPGRLRLRLAQPLQQVLHRLLRLPAVERSALRQRPLDEMRAFRRTRPAC

SEQ ID NO: 20461 - protein, 146 aa, Pseudomonas aeruginosa
HSPRSAPSSCWRAATRRWRRSAAPPAPCWWTTSSPITGGCWPPVRRSSSGRRARPPAPASMRCCRTARWSSSSTTGRSRARPEPQPSRRAAQSSMAAPIACSPRASSAALAPRISRASLFWLSLNLPTRRVISISMPTISRSISSM

SEQ ID NO: 20462 - protein, 599 aa, Pseudomonas aeruginosa
NADGQGSRCGCAMPGKRGRAVRLRNSRRGESRPAGVPAQVADPAGAHPPRTIGRLHGRHLWAPHRQDRGQPVDPRPGRHQPGHRRRLRLPGRHADADDHRAEADQEVQAGPLPDPRRGRHDAAADQVHPPTGLRRQHSLAGPRGVPPGRGREARRGAPGAAGGHRRRADRQPAHPAEPEPPAAGGIQGDLRRGGEAARRAQPDPGDRRRGQPQDDRQGPQATDRQDRHSLRHHPDGQGRGRRASPALPRQRRAVRRRLRASRGGGGRPDRQRRPRRDREAAVLHGSRRYRGDPRELPFRRGGPGVFPADRSGGRHRQRHLADRRGAGRYRALGLHPPAGDPRGQRGAGRRRRRRPALPALSAAPGGRRAPGVAVAGHRRPGQRHVQDLVRPQLQGAHAQHRAAGQRPRHHGRRPALGDGRAPGLPGPADRRGVRRWRLHDEQPGTGNRGAAEDEPDGDHPARQRLRDDPLEAIEHGLRRLRAGLRQPGLRALCRGLRRPRPPGRQCRGLPAVAGALPGHARGACDRLPGGLLGERPHPQRRAARTRPGGLNRRSVAPACVPARRLRTATGCSWRSGAPRPRRAPSARSRCGRWRCAGAG

SEQ ID NO: 20463 - protein, 510 aa, Pseudomonas aeruginosa
AVAGDGQQARAGRAAFDHRRRPVDAGQGGMPVVGDAHCRDVALRVLLGVAARMVDVMAERAVGDRRGAPALVEHAGRRSALEFQQQGVALRVAVQDIRPAGQHGDALVDGRGVAVALGGVVEPDGLQRRGGGLVLDAVRGRPEQLALGRVAVVQQGAGADVAAAVRRAGEDHLRHRCGGVVVGPRAALGRADRIHLAAAAGAEAVAVAGLVQGVGEIRYLGYRQAQVARLQVGRQHQFDGQGIALDDRAPVGTVDREVLAAGLEDFLAGAGEVQQHVVGQRAAAGFQANRGAQAGGPRSADREARGVAPVRSVDPFEGCQVDFRSRRFQAHAHLQRRTRFRRQRRGAGHAAGGGRGEVDAGRRDRRVGVGEAGVTGARRRGLEHGDVASHLARTGRRQGLARAGSQRQNQACIQVRSLMHESTPSVFWEGNFLNRSRGERYAGVTESFKYFLYSFLLAIKYEEAFVDSRIDSYFLHLPLMLDCSLYQLKFGLEWLCRAFGLLQRGAGCSA

SEQ ID NO: 20464 - protein, 362 aa, Pseudomonas aeruginosa
SPGRLPLLQGFPGYAAALVSERRMQRRRMPRDQFGDPLDEHPQLAADVAVRRERQVQRHRLQAPVLEQRQQLAAGEGLARHVVRQPEDAQAGQPGRQVGVAVVHRQHMTARHPQAFLAPAHGVGQGLAGARPEEADDTLVAVLQFARVARHAGALQVGRCRVDPQLQVADPPRYQRLVAQFAAADDAVDVLVDQVDEPIAHAQVDLDLRIARMELGQRRDQQQPRQRARYVDPETPAGRQGGAGEAGLGIVQFRQQTYHPLVVGGAVGGQVELARGAVEQAYPQPRFQLLDQLGDAGAAHVQRLRRLGEAAGIHHTGKGLHRIETVHRDSGSSGIVWILQTVMARVARLSTARTTLPFFHRR

SEQ ID NO: 20465 - protein, 168 aa, Pseudomonas aeruginosa
DALVNALVTFSVARHTHGLSVTSPPFMRNDTRLSRMLHVLIHMARHEGPATSEAIAQMLGTNPVVVRRTMALLKNEGYVSSEKGHRGGWRLAKPLADITLLDIHQALGASSIFAIGLSTDHPECLVEQAVNEALGEAFEAAQALLLERLGSVTLEQLASEFERRYRPC

SEQ ID NO: 20466 - protein, 296 aa, Pseudomonas aeruginosa
  UNSURE (142): Identity of amino acid at the above locations are unknown.
RRRRQRRTRHPLPTVLSLGACQPGRGAGALRRRAAAVRAGRRQPIGAALRRGPGDPMAGRRARRVRHPRGARRALRLPGRSPGAIPVETHARGGEPMSDVRSVVVAGSRFGQFYAAGVAADRRFVLRGILGQGSRRSRALAXRLGVETWCEVEALPDDVRLACVAVGGAARGEQGPALAEALMARGIDVLIEHPLLPREWQDLLRSAERLGRRCLLNTFYPQLPAVARFIELGRQLHRRAAASATWTRPCGVQVGFPTLDILAALLEGVGPWSLEFAPRTTCRRCAGCPWCWRKCR

SEQ ID NO: 20467 - protein, 425 aa, Pseudomonas aeruginosa
  UNSURE (4),(17),(50): Identity of amino acid at the above locations are unknown.
PANXCPAPSFGMPNRAXGPRCTSACGRRRRPRRWRCSPTATRCAGATSAXWRSPPCGSGSASALASPRRRRRRWRRRAWNRCWSKPRDPGAVAPAAHLSLAAGGGHGVAGPGRALLAVALDASRLARRAAGARPGAAGPAGPGAAGGAGLAGLPGAGRAPGPPGRRGPLQRPAPAPAGAPATAAAGLVRSPGPGRRGAPRGAGRAGPAPTDRARSQRSQQPVGGAARRVALAGLAAPLAAAVLPAAAGAGRRRLPAAALGALSRPGAAAQRRAGKALGGLWRIRPQPAAGPTVPRRRHTTGRRGVGGGLRRSVRRLGEAGRPPRRAGLRAVVDALAAGLGPARRAGPGCPRRAAGARPGLRLPAPVAGPGRPGTGARPRRRLAAGRARRRRAPAAGVRPGAAGRGPLDPRAGRWRGGAARPGPCL

SEQ ID NO: 20468 - protein, 534 aa, Pseudomonas aeruginosa
  UNSURE (153): Identity of amino acid at the above locations are unknown.
RLPRRAHHGPAAWLRQRAGTRPATVRRRTATTGPGPCAAIAGAPVAARRANLGAGSADRPAGPAQPARTRRWPDPGDRRPSFGRSQRCRPDPGAGPLAVWSNAASTPPCWRRTAPMRACGVNRTARRWRHDPVRTNACAARRLPCRVAPGERXGGPGGAAGRRLRRIAGAVGRGLVRRRRVALALGRRVARFEPGAGAVAVPGHASRFRRRRLAGGWTGAQPGGALAAPGAAGVAPGRAGRRPAARPGDAGDGHSGAPAGAADRRVGDAARGDPRAVPDRPVHRPRPAPCWCLPRRAVALERAAQSGGGGCPAGRRARRRTAVAGVRRTPATAARGAARKRRPPGAGRGLAQSPPQHPGSVAAQPAQRPRLHPGGAGGVRLRPARRRLGGGSAMAGRRATGGRAGAAGALHRAAGPAHPSRPGVGPAPGQALDTLLPVFALAPLRSPEPGRAAARRQPGGRGRGIASGKWPRLARGHFPEAGAGFAERPRRTLRGRQEQPAGAARAALRRRCRACPAGWRGYPPVERNDPRRQS

SEQ ID NO: 20469 - protein, 201 aa, Pseudomonas aeruginosa
PGVPGQRPVPRQRCLEPAHGASGRRSRSAALGGAGGWPAGRDRGLAAGLGQRRRSRRRAAVRRPAATPVPGSRAALDGAVAAARQAHRQPRRRQRGAGAAQPARVARPAHPDGSDPPPGAGASGRPGTAAGGGAPAPQRTSRRSARPGRLVCRFRRAGGRGKFRDGRGSIEKDRQSKKPRRRFLHNDKHYQIVYPPRLFER

SEQ ID NO: 20470 - protein, 509 aa, Pseudomonas aeruginosa
APAATCAAERWPPTRTATTFTTWPTRAPACFYGVTEFDLSPDTLLTVGAQYQHIDSITNMAGVPMAKDGSNLGLSRDTYLDVDWDRFKWDTYRAFGSLEQQLGGGWKGKVSAEYQEADSRLRYAGSFGAIDPQTGDGGQLTGAAYKFKSIQRSLDANLNGPVRLFGLTHELLGGVTYAQGETRQDTARFLNLPNTPVNVYRWDPHGVPRPQIGQYTSPGTTTTTQKGLYALGRIKLAEPLTLVVGGRESWWDQDTPATRFKPGRQFTPYGGLIWDFARDWSWYVSYAEVYQPQADRQTWNSEPLSPVEGKTYETGIKGELADGRLNLSLAAFRIDLENNPQEDPDHPGPPNNPFYISGGKVRSQGFELEGTGYLTPYWSLSAGYTYTSTEYLKDSQNDSGTRYSTFTPRHLLRLWSNYDLPWQDRRWSVGGGLQAQSDYSVDYRGVSMRQGGYALVNMRLGYKIDEHWTAAVNVNNLFDRTYYQSLSNPNWNNRYGEPRSFNVSLRGAF

SEQ ID NO: 20471 - protein, 712 aa, Pseudomonas aeruginosa
LAGCPWTTRSSVSTPGSSARSGWACCCLSAGCWRVVRATSPGAWAVACWYWAWRCGCWRGAVEVAARPLLLSLHGGAGALFGVLLFVVLFSGAWSLGHDDLREWLRAPAQAGGETLALERLLERAGEEGVDIRDATLLLPAPGHAAFSVCDARLDCRLDLDPASGRGVATDAGDGPPAEPAQEPVRRLPRAGGGQPVRRIAVAAVPGRRGAAQPPLARPAALAAGPRAAPGAVRPARPDRHLGTALAAVVRFHRRAQRAGRARDPAAGAGGLPAGTEPGVRRVDGTAAARRRGAAIGVPHRSRPPACRRCRAGARLRRPALEPQPCRGCRRQRGDRRYPAWPAEYRELRAAPLSAGRRRPARRAQLGAARVLAARLHRRAAVAFRPVPVARAGLVRRVARPAPGDGPRRLPALRQRPVPVAATTRLGAGRPRTALAAPEPGFLCRPGGGGRVAPAGAATRALGATRRTLDGAAVPCPVGRRWPGGVAAAGRLAAGARVARRPRAGLPGGRRRAPGALTHARPAAGPGPRPHPDPLRRAAHPARLDAGARRRATRPPPCHRRPPCLSCIATAAWSSPWRCSTCPRAFPSAWPWTPCPPSCARMARHCRRWPSCPWWGCPGWSSSSGRPGSTTIGRAVSAGGVTGSCRCNASSSPACSAWRRLASAWPAPVGRSACWRWLRWPARPRTSPPTAWRRSTSAASCWPRSTRYRSPG

SEQ ID NO: 20472 - protein, 361 aa, Pseudomonas aeruginosa
NAGAAVSSRLQVAVLPASFVAVVAQALVQPLGAVAPELHRLQAQFEQAVARRARQRAVGFRQAPGFGAQGVDVGEGFALPRGDRHRVGLVRAAQPLGVGALVGQAFGAAVEDDLLAALAPVQHPRGPGVLCQFAALLAIGVGGEHHPALAQLGDHHDPRRRPALPVDRGQGQCPRLAHAVAAGAFQPVAQHLHGVRRRRLELRERGFDGPGEGLGNVRVDAHHGVPPFCPFTGRPGLRRRPRRCPTLPPSRPARRRPRRGRTCATAGRSRRPGGSRSAARRESAGGAPGGSPAARRRNRWRRPRPRRRPARTCGCASAARRRRSSFTARSGKSHSARWSGCSADSAATLSRPTKTWRGPLR

SEQ ID NO: 20473 - protein, 823 aa, Pseudomonas aeruginosa
TSMGKVEPFRPRAASSSAGRLKCSQVGIGCCMLQATTLPSWRSRAKGTVPILVSRNSLSLSVSAPRAMAVPSSGWPANGSSLTGVKMRMRASPSCCGRSTKVLSDRFISRAMRCMRSPLRSSQSKNTATGLPCSGSLAKASITTYLCMGSPGSGPPLDQRVAQQVGDDARTLAGQHRFGVELHGGEARPAQGMDLAGLAVAADLDRADLGNLDAVLQGARGEGVVEADALGGAEQVDLFLHALVGLLPALQVQAQAQAQHLVAQAHGEERPALAEQRTDGQVQVADLRLADLGGVARAGAHDHQVVAVERVRLLEAAHGHRQAQRLELLGDHRGEGVLGIDDQHLASGQVGLQLLALAGAAQPEVGDRRVAAGQRRHHVRVRAQALRRLALQRGDQPGSLGPAFRRLAQGIGVTHDGRADADAQAAVALDLGGADQDRRVQRAPALAIAADQRRHPAVVAATLRLVAADHPAGAFQRAAGDGRGEQRLAQHLAHVAAGLALDEVLGVRQVRHLLEVGTEHPAAVLADPRHHLQLLVHHHVQLVGFLAVVEEFHDLGQVRPGRRVAVGAADRVHHRQAVAHADVSLGRGADQGAFAGVDDEGPVGALLAQQQLAEEAQRAGRGVAVDARLEAPLDHEVGAFAATDLVGDDPPDHFGVGLVVEVETFLAQFQRLVRQQRQGLLQRQQLLLQDLQRQQRRAVVERLEAALGDLPVGNQRQQVMARQARAGLVQRQVGQAVQFERLAADHVEQARAIAFRAVEQGERRRPFEQALQQRCGQGVHSSTSSVVTTIAQRLAAYSRAMRWCASLKSAMASATRNGWMSLE

SEQ ID NO: 20474 - protein, 235 aa, Pseudomonas aeruginosa
PCRRDRPAGSARRPARAAWNAAWRTARRCARRGSPAAGRPGAGRRPAVPARRPCAPRSRHGGRPCPRRSRRTAPPAPRRGRPAPGSRAGPGCRRRGSAPDCRAGTPARRAGATDRPIRVAAALRSAVRVAIDRPWWVPLRQEISFRSSGNAFAFYFRDRNAQGAQLLEDVHEFAVALDLAVFKFEGMQEVVFVITFGISGEKNLAVTVAFDPEMIGVVGSEYIYVVPLPIGKALQ

SEQ ID NO: 20475 - protein, 60 aa, Pseudomonas aeruginosa
FYSFGTQEKALEQAVGKFQGCFRNEIQGALIRGMSAFFLKVPNEPGCSAVFLAERARSAK

SEQ ID NO: 20476 - protein, 139 aa, Pseudomonas aeruginosa
CSTAKVPFGVARDNLSSLLAGERVSLVGGDMLQEVPSNGDIYLLSRIIGDLDEAASLRLLGNCREAMAGDGRVVVIERTISASEPSPKSVLWDVHLFMACAGRHRTTEEVVDLLGRGGFAVERIVDLPMETRMIVAARA

SEQ ID NO: 20477 - protein, 1567 aa, Pseudomonas aeruginosa
PAATGRASGRRTARGRCAGWRGPRGCRGCAPAPGRPGAPVADRRRNSTRALPAARRRTRRGARWRRVAAATADAGSRGRRCRRPGRCRPLGPAPGAKGSGRSASCLVHQQIGLGQLPAARALVDFRVVARQQGIDGGQHEQGEEGADQHPGDDHHAQAEAAGGAGAAGEEQRHQAEDHCRGGHQHRPQADLRGAQDRRAAVEALVELQFVGELDHEDAVLADQADQGDQADLRIDVHRRVAQRQRQQRAADRQRHGDQDDQRVGQALVLRGEHQVDHHQGGEEGEHQGVAFLGVLPRVGLPVVAEAGRQAARHVVEEGHRLAHGDAGRGDRLEGRGVLLVELDQLVRFDLKRHPDHRRQRHQVAVLGAHELSCQRLRSETLVAQALWDHVVGAALHAEAVDVVLAHQHRQRLADVLHADAQAVGLGAVDADLDHRVVVVEVAVDHHEQPALSGLLLDLFHGPVEHRIVLRAAQHHLHRQAAGGAGQGGQLEGEDAAALDVADLALQLGLDRRGVALALFPGRQVDPAEARRRSVGAVDDPGAHGFRDAGVDLVELAREQFDIVEVGVLRRLDRGEHRGLVLGRRQFALGHRIQQRQADAHQQCQAAGQPAVAQGELQDLPVAPRQAAEEPLGGAAHAPLVLVRLEQQRTHHRRQGQRHHPGHDHRARQGQGELAEQRAGEAAHQADGGVHGGQGDGHGDHRAGHFAGADQRRRHRRLAFLDVAVDVLHHHDGVVHHQPDGQHHRQQGQQVDAEAEGQHQRGGAEHRQGNGRHRDQHAAQRAEAEVDHQHHDQQRFHQGPHHLVDGGLDEARSLVGEVDADIRRQGLLDLRQQLADAVDDHQRVAGGRREQPQVHRRVAVHQCAGLGGRGAQFDGTDVAQAHQAVAIVADDHLAEVVDVGQVGVDPHVGQHVLPLHHPRRRLVVVAADRLGHVGGGQAAPGEAVGVEPEAHGQALAAKGLDLGHAVDGREHRLDHPRQVVGQRRDRQGLAGKADVGYRGGLAGRAFDHRVVGTLGQLVAHRVDLGHGLGHRLGRIAVEQHADGHHATPLHRGRGKVVDALHRRHRLGDRLGDEALHEIGGGAGVLGGDGDGRAFQQRVLADRQLAQGEQAEQQDQRADHQRQHRPADEQVGKGHRGVPSAAGDRHGGRGAAQGVFLDRFHGHPVAQVDLSGSHYPVALGEALEDFHATVPALADPHRDALGAERPVAVLVGDEHGVAVGGIGDRGFRHAQRRRVGFARDPDAGEHAGGEQAFGVVQQGLDLHRARLADQRVDGADARREAAPRIGVDQDLEGLAELQLGTGAFVQGEIAFQGPRIHQAGHRLGDAEVLAEVHAADAELAGEGRADRLLVDQRLGLAHRAERHVAGGDGVVQLFLRGDVALYQLARTGMEDLGIAQLRLETDQLGLFHRVVELHQQLPLLHLLARFEGDAGDPSCRFGGHLDLATGLQLADAIEDARHHPPLHRGEGDLYRRVAGETAGVFLRRAGGVDGDADNRRADERGTGDQDGFLHDRLRPSGRWRPRRRPGAAAGVARWRWPWRSGRRSPRCVRGRRTSPAWLRRRSCSRRCGR

SEQ ID NO: 20478 - protein, 135 aa, Pseudomonas aeruginosa
QRATGAGGDFQGDPRTGLVIARQQRRQAAGRGAFHAAQAQAPAGLGGMHRLTRLVGESQQLLGVGEEFAAAFGQAHALAVAQEQFDAQVLLELADPRGDVRLRSLQLLSGAGDAGLVGDRAEDFEGGKVHRSISL

SEQ ID NO: 20479 - protein, 377 aa, Pseudomonas aeruginosa
GTGRLHRQRRAGDPGVAQRRPPGAGGGYRQRPARRGGRAPPAGEQGQGGPAGLRLAGDHPQRQAEPAERRRTGWGRRVLPRPARRHRRGRHPAGAAGCRWFRLYRQRPPGQRHGDGQGRGQAPVPRRRGGDRQLADGAGLGRGGARATGLPPGGQAEQPGLHRGAVHRAFPGRIAAGHRAGRALWRRGDAGALRRRPRGHRRGARRPGAAGGRDSPRRPGGLRLRAQVPGRRGARGVSRRPAAGDRRRGPASGAEGTPGAEAERLQPHRLPPRRTGPALVPGGQYPAGHDRHQPAAAGRGGGRDRFRRTLRADLPARNRALQGRAQGAFLIPAARHRGGPRLSLRPRGSRPARGCRRGCSAPVRRVAPGPWRRTDHG

SEQ ID NO: 20480 - protein, 439 aa, Pseudomonas aeruginosa
PLRGYPPLSRAVGGQRVACCPGKNTRPTGRATEASELFRLQAVQAFAAGFDGGGEGVHAGQDAGEVEARGGQLAVVERRVDLALALRGGGHARPEVGVGGIAEQMQVFHRGCADLARVVAGAGDDALGEVVQQVQGGQQRGDELRQFGVGAGGEGSHLAAEDGEEQPAVGDHLAAHQVERLDAVGAFVDLRDAYVAHQLLLAPFADVAVAAEHLLAEHAALQAGIGEEGLGHRGQQGHQGFGLAAFFLVLGVLGQVELLPDIGGKGAAALGQRLHGEQHAAHVGVHDDRVGGLVPGHRAGRRAALQALAGVGDGALVGHLGAADALDADGQALVVHHGEHRRQALVDFADQPATGAVEVHHAGGRGLDPHLVLDGAAVHRVACAERAVVADQELRHQEQRDAARTGRRVGQLGQHQVDDVLGEVLLAAGDEDLRPADPV

SEQ ID NO: 20481 - protein, 582 aa, Pseudomonas aeruginosa
  UNSURE (388): Identity of amino acid at the above locations are unknown.
TAGGTAAGTGLPVRILPTAAVARPLHGQFGWRRSEGGGPLAQHVFLDLAGGGLRQFREHHGTRNLERGQVFATERDDLALGEPLMIALQGNERTGRFPPLFVGPRHHRRIQHRRVAVEHALQFDGGDVFAAGDDDVLEPVADLDVAVRMADRQVAGMEPAAGEGFLGGAGILQVALHHGIAAHEYLADGLAVARHRLKGLRVGHHHPFEGRVAHALARLDRGASLQRQVVPLAVPGADRDRAVDLGEAVDMGDADAHLFHRADHLGRWRGAGDHGMHRVVDGGLGRIGHVDQGVEHDGRAAQVADLVLADQGEDLLRIDPPQADVDAGQRGHRPRIAPAVAVEHRQGPEVHRVLAHGPGHLVAQRVQVGAAVMVDHALGVAGGARGVXQRDRLPLVPGPFPGELRVALGEQRLVVQFANRAAFAILGVVDVDHQRRVVEHTDGGMDHLVEFVVGDQHLGFAVLQHEGDGFGVEAYVEGVQHRADHRHAIVRLEHLGDVRQHHRHRVALADAAPGQGGGQASAALVGLRPVAADVAVDHRGVVRIDAGGALDEAQRRQGDVVDGGGRETLFEDRHEEYPVADC

SEQ ID NO: 20482 - protein, 224 aa, Pseudomonas aeruginosa
RSAGLRGRRRPGHARIDGLAAGIGRPQGTALHPGSGLPRCLRGRPPCLRPARRADARHGRAERAGRTAGARHRPAGDLRQRPCRRAHRGARLQGRCGGFHRETLQRTIAARQRAAGPRSPRPSAPAPRSRRRVARTLGQPHPARARRALAAGARPYQPRGGRATGSQREDRRPLPRAGDEAHAGPDPAGAGGHGHRRRAGGPAALARGHLSARGPWRRAGSGIV

SEQ ID NO: 20483 - protein, 313 aa, Pseudomonas aeruginosa
YLIWLYENHISPDVWLLIDCGPPGARRRTPFLREIPIMKIRLLGAAVAAVFTLIGSAAHADDLADIRKKGEIVIGTLGTDEPNSFIDPKTRQIIGYEVDLGTEIAKAIGVKPVFKQISVAARIPELQQGHVDLLAASLTHNKEREALVDFSYSIIVTGQKALVKKNAGFASLHDLDGKKVLTVKGGTQEPNIRKALPNAQVVTFETSQQALLALQQGKGQAFVDDESALVNDFGKLGAAAGGYAILPENLSTEALAIAFRKGNPQLKQLVDSTLAGLERSGVAEQLYLKWYGPGTKSNLSERHFKIDSDRIPE

SEQ ID NO: 20484 - protein, 450 aa, Pseudomonas aeruginosa
DAGRRPAAVAEAGRRHPGLRRAAGDAGGAAAPGAVPRPAMARFRLCREHPQRTAAGAHAVLVLRRAGMATRGPQGLALRRQHRGRQRYRRADPVHRRVHERGHAQRHPRGAHGATGGRPRAGLRLPGEHAPGDPPAGLADHRTAADLANPQPVEEHQHRHGDRRRRADVPGRPGGEFYLPQLRVLCLRHRGLSQRIAADHRRRRLVPAALSGSRTAMTTLELIDSYWLYFLVGQYPNGPLGGLALTLVLASLALLLALPLGILLGLARVSPWRWLRWPITALVFVVRGVPLLMVIFWAYFFLPTLTGQRTDQFTTMLLALVLFDAVYLAEIVRAGIQGLDRGQFEAARSLGLGYLASMRLVILPQALRNMLPSLVNQFVSTIKETSLGYIIGLAEVSFIASQINTQVFTLPTQVYLILGLTYFILCFGLSRFAFWLERRQAQRGNPKEAR

SEQ ID NO: 20485 - protein, 283 aa, Pseudomonas aeruginosa
TVSLARAMASSMSSKEVTESSGPKISSRNSRLCGETPSTTVGSTKMPASVAPPKRTANRSVLAWSRYARTFSKCAGLTSAPRRLHGSSGSPMRHSRSCAPMRSSSASRTSAWTISREDAEQFSPMFQNAPLTTCCATRSRSSTSFITTAGFLPPHSSTTRLRLDSAAYLRNRRPVAVEPVKLTIATSGWRPSGSPASRPPPGTTLNTPAGIPAWLASSATRRAVRLVSGAGLTTTEQPAASAGPIFQASISSGKFHGSTRPTTPIGSRTTMASAAEPTGAVLS

SEQ ID NO: 20486 - protein, 463 aa, Pseudomonas aeruginosa
ILSISSACQRRVLMVSGRSVCWHSRIGLPLSRLSITASSSRCSSSSSARRSSAALRSAGVRERQRPSSNARRALATACPTSSASQAATCASSSPVAGLVEAKVRPPQASRNPPSMKARWGRSSVAAMAAYSSRLSSSVMAATLDDPRDLALEPGDDLRQCRLAGLVQRLQRRTYAAGAQAGQFAAVLDRLDEVTAFEKVHQRHHRRHDAPALGEVVLDHAGLVQGEVFARDEVGAGADPTARAPGEELQGLVVPAAGQGDPRVAAGQAVQLRGGAGAFLDRDDVAAAGDGGEERLVHLHAHPRRIVVEHDRQAGGAIHRQHVLGDLPRGRQRVGRRADQDGVGADGAGGFGVGQRVLGADRAGSHHQRQAPGDDFAGVGGEGQAFLGGVRVVLAGGAADHDAVHLRLDEKLQDLGEGLGVDAAVGAQRGDGGGIDTFEFHGGSSCGMLGRGAPGGRCRGGWFR

SEQ ID NO: 20487 - protein, 177 aa, Pseudomonas aeruginosa
PALRPRRGPCSAASAATRGCRCVAGTARHRSPRCWPVPGARRPRRRCAGSGRRPGRRRRRRRTRGWSGWPGAVRDTSSAGTPPARRWRPGTRCPPPRRSGSAGRTAPPPSRPRTAPGKRGRTGWGRRRTACGGPGGRSASRRGNRRRRCRPAPRRRSCPARNCSVAMPRSSAASPRR

SEQ ID NO: 20488 - protein, 367 aa, Pseudomonas aeruginosa
WSARGFRRDGRRRGPLAGNKKNKRHESMERRRFSAALQGQNLRFTGAGEGGSARARVGFLLLEHFSLPAFTQALDTLVTANLIRSESFAVSNFSLSGEPVTSDLGLLICPDLALASAALQGLDLLVVCGGLRTPLRSSAALREALQDVASRGVALAGLWNGAWFLGDAGLLDGYRCCIHPEHRAALAEIARNSQVTSDSYMVDRDRLTAASPTGAFNLALEWIARRHGRDLVEAVVDILAFEESRYRRVRPALHEKMSEPLREVINLMAANIEEPLSQEQLAHYVGRSRRQIERLFQQQLGTTPVRYYLELRITECRRLLQHSDLTMLEVLVACGFVSPSHFSKCYTAFYGYPPSKEVRYGNVRSTK

SEQ ID NO: 20489 - protein, 137 aa, Pseudomonas aeruginosa
SRFRCRRSAGASRRCSRRGRRSFSRAFPGSPRGCGSGAPPVRAHSVRRRGSAPGRGRGPPGSSRSAPGGGAPACSGTTAARCRHRRRGTPPAPRRRRAARSKPGCCARHGLPGCLARPFPGSARTAGGWRPGPLRRG

SEQ ID NO: 20490 - protein, 624 aa, Pseudomonas aeruginosa
VDFYHPGSALTMKSANELLAVLMIGWSGSAALMAGATFACRRSRRQSLPPAGRGWTARREGRSVRAVRTATTRGRTQMAKAADVVVQCLENEGVQYVFGIPGEENLDLLESLRKSQIRLVLTRHEQSAGFMAATYGRLTGKTGVSLSTLGPGATNLVTAGAYAYLGGMPMLMITGQKPIKKSKQGRFQILDVVGMMQPLTKYTHQLASADNIPSRVREAFRLAEEEKPGAVHLELPEDIAAEQTDSLPIPPSLSRRPLAEYKAICAAVEKLRAARSPILVIGAGANRKMTAKVLKQLIDKTGIPFVTTQMGKGVVDERHPRFLGNAALSAGDFVHRAVEAADLIVNVGHDVIEKPPFFMVRGGTEVIHVNFRSAEVDPVYFPQIEVVGDIANAIWQIGEALDDTAHWDFTRLLAIREANEAQVAEGADDPRFPLYPQRLVADVRRALPSQGIVALDNGMYKIWFARNYKAHMPNTVLLDNALATMGAGLPSAMAAHLVYPDRPIVAVCGDGGFMMNSQELETAVRLKMNLTVIILRDNGYGMIRWKQSNMGFADFGLDYGNPDFVRYAEAYGAHGHRVDSAEGFLPLLERCLGTPGVHVIDCPVDYSENDRILNVELRERALAV

SEQ ID NO: 20491 - protein, 525 aa, Pseudomonas aeruginosa
TAGASRRRAFRRDGSEQRQVVAGDQAHLVHVARRALEVGAVGGVAQAQAEVLEAAALHHVLQLDVALPFLALVAVGQADMVAVDVAGHEAQAGHADAAQVEVVAQLPGAFLGVGEVVHLQVVGQVRIAAVEVGHRAGAVHPLPAGAERVAALGVGEQQAEGAVVDLAGAGRAGVLAVEPAQVGAQLAGAELPLAHGTEVALAIDVAQAALGVLQQQAVVDLVVESVGVEAVAGGVAGVAFVLAVQADVLGIAGVPRGVALQAGGGEPEPGDLLAGQLGAVEQGRQQASVVVFQQRHVRQHRPVPELCLREAHLAGNAGLGVLVDRATRIVAAGRQQAAVAVRGAGVELDPEHRQGIHAEAQRALGIARAQVEDEALRGFLALGGALRVGRAAVAEVAVEVDGARFQARAAVLEEGGRGRGDESAAQGEGAQAAKGAGRTGGKRGGHAVTLDSGGKKAREGVTDGRRGLCDLGLAEKARTDRRPGRPLAGRTQRAESDEESSAAPCETLPRPCQPDRHVCARISGG

SEQ ID NO: 20492 - protein, 97 aa, Pseudomonas aeruginosa
EYFPMARATARHILVSSEAKCNELKTAIEGGADFAEVAREHSSCPSGRDGGNLGSFGPGQMVREFDQVVFSAPLNVVQGPVKTQFGYHLLEVTSRQD

SEQ ID NO: 20493 - protein, 254 aa, Pseudomonas aeruginosa
AAPSAVRLSLRVVRLSRRTRSRASSCWTNWVTLVRLMCSVSAALVKLPVSTTRAKACIASKRSIGTPGRRGLFGFYKQSWPGLRVYPRRARPYRSSIDDDGAGSPRMEVSHDCTRRGFPRRPPGPLRAQPLFPGGPQRRPAVRLRPGRQPRRRLSRTRAGDPGPPRLRQSERGARRGRLRVRRCARRHRVHCRRRGQLRAHLEDRPGVLGRGAVPHADGGGGELAVWLQLRDQGGREVAGGAVRADAQCRGQLG

SEQ ID NO: 20494 - protein, 238 aa, Pseudomonas aeruginosa
RLAIPAEHLNACLGRRYAEALHRAGLREVDLLGYCSGGLVALETAKSLVQRGVRVRQLDIVSSYRIPYRVDDERLLLFSFAATLGLDTAALGFPAPERLGLAVQAALAQTPERLGAEALAGLPGLADLVALRGRVLQAASGSADAVSVERDTLYRLFCHSVRASQAAAPEPYVGALRLFVPDAGNPLVPRYAEALETQWRAAALGACGIHEVPGGHFDCLGEALAQSLSKPMPEEASR

SEQ ID NO: 20495 - protein, 658 aa, Pseudomonas aeruginosa
  UNSURE (15),(28),(61): Identity of amino acid at the above locations are unknown.
RRPVRAVRRDSRRTXAQRPALVCRTVQXGPGAPAPVAGGGGRGAGAARQRRRGAPAQPAQXGGRRPVAADRRAPWLPRGAAGVAGAGEPGTGAGASLVTPVLWRLLRTYRWRLAAAMGLQALAGLCSLLPWMLLAWLAEPLARGQAQPALLALVLLAVLAWLGCQALAAHLAHRVDADLCNDLRLRLLAHLQRLPLDWFGRQGPDGVARLVEQDVRALHQLIAHAPNDLSNLLVVPLVALLWLAWLHPWLLLFCLLPLVLAAAGFLLLRSARYRDLVLRRNAALERLSADYGEFAHNLLLARQYPGAGIQQGAEASAAAFGEAFGAWVKRVGHLAALVYVQLSTPWLLAWVLLGALALDALGVPLALGQACAFLLLLRALAAPVQALGHGGDSLLGARAAAERLQQVFDQAPLAEGRSTREPVDGAVALHGLGHAYEGVEVLADIDLELEDGSLVALVGPSGSGKSTLLHLLARYMDAQRGELEVGGLALKDMPDAVRHRHIALVGQQAAALEISLADNIALFRPDADLQEIRQAARDACLDERIMALPRGYDSVPGRDLQLSGGELQRLALARALLSPARLLLLDEPTSALDPQTARQVLRNLRERGGGRTRVIVAHRLAEVSDADLILVLVPWPSGRTRRAPRPVGGGRRLCALVA

SEQ ID NO: 20496 - protein, 444 aa, Pseudomonas aeruginosa
  UNSURE (31): Identity of amino acid at the above locations are unknown.
TERRGGGGMTLFERMRALPEDCRAALRRASXWAVLAALLDAACGVLLVPLVEAWFAEGALPWRWVAALLGLSLAQALLQYLAMRRGFAAGGSLAAGLVRSLVARLPRLAPPALRRVAPAEGLLRGPVMQAMGIPAHLLGPLIAALVTPLGVILGLFLIDPSIALGLLLAGAFLAALLRWSGRRNLAAEDARLAAERDAARQLQAFAERQPLLRAAQRESVARQGLEEALRSLHRSTLDLLRRSLPSGLGFTLAVQAAFAFALLGGAWAVDRQWLDGARLVAVLVLLVRFIEPLAQLTHLDQALARRLARRWIPCCRFSPWLRCAVPSPGERPHDASLAAEAVELRLENGRALLEDISLRLEPGSLNVLVGPSGAGKSSLLALLGRLYDVDAGRVLLGGVDIRRLSETTLAANRNLVFQDNGLFRGSVAWNLRMARADADLEALR

SEQ ID NO: 20497 - protein, 138 aa, Pseudomonas aeruginosa
AARAVGLLEEIEAWPQGWDSDVGPGGALLSGGQRQRLCLARGLLSTAPLLLLDKPTASLDAASEAQVLRNLLGLRGRRTLMVVTHRPALARQADQELLLEEGRLRLSGRHADLLVRDDWYAGFVGLAGEESSATVVDR

SEQ ID NO: 20498 - protein, 100 aa, Pseudomonas aeruginosa
APTPCSPSVRNTSTSTRSPTWPGYRWPRMGPISGCPATRTSMSTGTVSSGTPTARSAPSNSNWAAAGKARSAPNTRKPIRACVTPAPSAPSTRRPATVAS

SEQ ID NO: 20499 - protein, 140 aa, Pseudomonas aeruginosa
ACARAATHWSTCAWATRSTSTGRRRSTSTTCSTGPTTRACPTPTGTTATANRAASTSACGARSDAAPVGLRLGLAGSAGARRQPGGGDRQRLSVDSRAAPGRPARASLRRALRRARGGLVAACRRVAGAWSGQLRLAPGR

SEQ ID NO: 20500 - protein, 470 aa, Pseudomonas aeruginosa
PAGTGPGVVAAGGARLKWRRVLSCSRCTVAPARCSACCCSWCCSVAPGVLATTTCASGCGPRRRREEKPLRWSACSNGRARKASTSAMRPCCCLLPAMPPSASAMRAWTAGWTSTRPAAGVLPPTPAMDLLLNLHKSLFVGFPGRVVVSLFGVSLLLLCLAGVVLHSRRWRDLRRWRRDRGLRLALFDLHGLIGIWGLPWLLLFGFTGALSGLGALGTLLLAPVAYPQEPNRVFVELMGPPPPAAEGRPLASRIDLDRLLAGDAVRAPGFVAQRLSLSHAGDVAGSVEIAGIQRGLPSTANFERHRYRLADGALLGERSSAQRGFWLRAFIAVQPLHFAQYQWLGPGWSAALRGLHLAMGLGACLLCASGLYLWLQRRASAPDARVRLLQRLSQGFCAGLVAAAALLLLGLQLVPSELLAGPWTGRLFLVLWAAAGLAALLLPGDWPLARGLLGVPGLACLAAAVAHLAP

SEQ ID NO: 20501 - protein, 231 aa, Pseudomonas aeruginosa
LDPADAMHRPRLPARPGDVWPRRGQRRLGGRPAGAGFAGQRDPGHRHRRHGGGALQRRAAGQGQRGTDRRGDDRLLRRRRRQPDPRRVFRPAHGVPGRGLRAAGKPVLRARPGARRPPRTPPGTGRQGQPAALPASAAGAFAAGAGTAVGDDRGIRLRPVQAVPQRCRLGLAGHRPAGHERWPGHGIPRLRRRRLAGQADRPVARFRPWRGARRLFGAALVSAGRSLVGTE

SEQ ID NO: 20502 - protein, 456 aa, Pseudomonas aeruginosa
ARSARHPHGCRLSRGRERRERAGAVACPVLLAWPFHLVAVAAGDRFQRRALLGLRSRSRGPFLFFPFAVGQDDLVGGRPPRFFVFAQGCGHVGVARQRGGQLDAVEDRLRSAVGAHRIHQVGGVAEQRDASPAPVRQRIAVDHRVLQDQLVAGQQVADVEPAQVPVGEERQHVFQASVAVPVGLVVELADGGARHHAHPVHQRLAFGRVARRDRIGDQARPVLVVGDDHGLAVEEAVELGDAAPHGDPTVGQRPLVGMQVRADRRVDAVGADQHIGTERQGLAVSVAGADQYAAVALFDALHAETGAYRLLAETLAHRGEQDHLQFAAMDRVLRIGVAGFHPARLGPYRGAALVDVAQLMGGDGGGRQRRAEAQFGEGLDRCRLDIDADAKGAYLAAAFQQRDLADAGLVQGQGATEAADAGAGDEDIDGFAHGCFLFSSVRIDGGSAGTDDRLPP

SEQ ID NO: 20503 - protein, 407 aa, Pseudomonas aeruginosa
FRECRSCHGLQGEGCARDRFCAGPGHHRAECLPGVQPRIAEAGVVPADLVQAAGIGDALGDVVRGGLQVQPGGHAAGAGHRQAERRHLLGDAAHQAGLVAAGRDDGVAVHRVAQPNHRVAGRAHRFHQRRQALADLLRAHPRDQRQAPRLAARVEALAERQQLVAADLRADLAGHRVEHLGQQRHMGAVDLAGALADPRPVGRTEIDPALLVLAQHRQLVVEQQHLVAGPDRRGIRLLPGRGVPAQVAHDVARRRIALEDPLRIGPALFGMGLAAVDHVAAIDRQGLLADLLVRLGTRLGVLPGDAPDADHRPPAGQAQGAGQQFQHGGLARHVLGMVVVHVLGAVAALHHQRLAAGDPRQGRAQGQDVAGADQRRTAAQVRLHVAQARRIAPFGLLQRFAAPYALQ

SEQ ID NO: 20504 - protein, 483 aa, Pseudomonas aeruginosa
SSLPGPESELSTVGPGGFAGGQLAGARRQVAAAPAERLVERDDVDERGGLRLRQFLADLVQRALVLQHRQVAAGAGAVAFVGDLQGVRAMGRGLEQGDQPTLVFGQLVERVADVLLGQQQGALVARQRGVGLRLDGAQAGPHVAQAERRPTDAGRQFEGARGAAEVAAAQGEETDEAAQVEARIEFGGGRADVFSARCQLPLGADYVGALEDQAVDVAQRQVLRQWRGAATVEDRRAAARRLAAQHVEAVAGALQRGRQWRNRRFAAQQVGLGVLHVLRQAAAQLQAAAGQLQGVAPTAHLGARHVQPALVALDLEVGAGGVGGDAQAYQPEVGVGRFGAGQGGVGKSAEAAEQVDFPLRVEAGAVALRQAPARLAVVVQLLFDAAAVAGLAGDLRQLVEPAVVEQRAGAAQVGAGLADVVVARQRLVDQAHQLRIVEETPPGRFPPLAGELAEVLAGDAWRRRLRTLVVGADAAGGQAGADR

SEQ ID NO: 20505 - protein, 163 aa, Pseudomonas aeruginosa
RRVRPPKNHSAARPMRPSFWCAWSSSELITGDRVSATTPDTITAPARVRANSRNSAPVRPPIRPMGVYTAARVMVMAITGPATSRAPISAAATGDLPSSMWRWTFSTTTMASSTTSPMASTIASRVSRLTLKPKASISAAAPSIDRGMVATGISTLRSEPRQR

SEQ ID NO: 20506 - protein, 273 aa, Pseudomonas aeruginosa
RRREGPGADPRGARADRQAVQRQPVLPPPGAGRPGPRARLAGLPEAAVRRVRRRAAGAPEQHLPELPRRPDPAADAAGRAAGGGQLPFRRAAPRPGSRVAGGGHPRTGQCHHAGGSSPGGGRRRRCGGRPGHRGRWPSRGVRAGARRRRHRHPGAGPPAGGARFATGGGCRRDHGRTGHPRRPGAGRERRADGHRLRPLSGVLGQRRLPRGAEGAARGAHRADRDHVRAQRPRPAQPDVLRCRRAWSAALAGLSVRLRRDQSVADRRSGSRQP

SEQ ID NO: 20507 - protein, 368 aa, Pseudomonas aeruginosa
LSLFSYPCVVLFCLQHWNDRWNMGQDKLKVAVLFGGSSEERDVSIASGAQVIQALRSAGHQVLAVDTASGLLGAEEERHLLASKVKEVPPDSDSLAIIRSGKQSLLSAGELAGVDVFFLALHGGTGEDGTLQALLDAGGFAYTGSGHLASAMAMDKDVAKRLFLAAGVETASWLMAPASEEAVREQLGFPLVVKPNSQGSTVGLSIVHSQAELQPAIELAGRYGDEVMLERFVAGREVTVGVLDDQALPVGEILLGGQEVFDYEHKYQAGAVREVFPADLPPAIAAEAQRLALKVHRALKLSGYSRTDFRLDEQGRLWCLEVNTLPGMTATSLLPQAAAAAGIGFAELCERICRLGIERCKGARKARS

SEQ ID NO: 20508 - protein, 166 aa, Pseudomonas aeruginosa
FIMVNIAARPLLTSPTSQPLAPSKFITQVAEALIPILCSMEPQCTALRAPSAPSSPTRNFGTRNSEMPREPAGASGSLASTRWMMFSVRSCSPPVMKIFVPLILYEPSACGSALVRMMPRSVPACGSVRHMEPAQVPAYMFGRYLFFSSSLPCASRARQAPAERVE

SEQ ID NO: 20509 - protein, 686 aa, Pseudomonas aeruginosa
IPYKFPGSSSAHESASRFACTQQPPAPAARGRAAGRAGRCAAPLAARTSGHAPGLVPGLAAAGADLYPGAAVAGAAAGRRRAEPGQRPGVARAAGARRPAGSGRIAAFRLLARRALAACRRGAWHGLRPRPAGRRRRPAAGGQRYAAERCAGLARPAPRTVARRRPWRHPRCAVPRGRPAAGAAARRRGAGGGIQPGLPCLAWRAAARGLARLPPGQPWATGARQPGAGAGPRRGGGGVRRTHPALAVHSRQRRGPGAGALPRRHRQPARRARGGAGQPAVPADHREHHRPDFPAYPRRHFPRRLAGFLDPARLLAGGTARASGAGVVPPPGPRPGGAARARSAGAGRLPDHHLPYPPPRRPLPLVRDRQPGDPRDLHRGGGGGGQRVPRCHPAGRGGGEPPAPGRSGRGEHRPGAVRRAWRPRHLPQSFGTCRPRHRRRAGGAGAGTPAGRRHSGAAGRRGLATGARWRRLEPRGAPATAGRTSVAASLAGVAGPSRPRRGALLLAGGPRHDRTRTARGPAAPSPGRTGAHCAAGHSRRTGLGHRPRDQPAAGGGDELRQRQPALPGRPRQPARGRRAGGRGAGADRRARRPRGGGDQAPARLPAQGPAAPAGARPQPGGTRGHRPLRVGSRALASGGGRGDDRQSAAAVCRPRAARTGVPQSAAQRHRSQPRGASRLAVAGRHR

SEQ ID NO: 20510 - protein, 298 aa, Pseudomonas aeruginosa
PRRARRAALPVGSRPGTGSAGGSAGTHFHAVPHQQAGRAGPGPVDEPQHRRGLRRHPRSRAAGGWRVAHELPAAARRRRHGRVTMAMPDEALVYVVDDDQGMLESTVWLLESVGLKARPFTQGRDFLDACEGGRHACVLLDVRMPGMGGLNVQDELLARGIDLPVIFVSGHADVPIVVRAFKAGAVDFIEKPYNEQLLLDSVQQALDRHARRRRHRDLDAGLRERLDSLTPRERDVLLPLVRGHTSREVAEQLEVSVKTVDLYRARVMKRMQAQTLPELVGMAIAAGLVDPLRLREGT

SEQ ID NO: 20511 - protein, 324 aa, Pseudomonas aeruginosa
VPRPWPSPSARAIRNSSNWSTRPSPAWSAAAWRSSCTSSGTGRAPSPTSASATSRSIPTGSPSERLTSLRDGDHARRRPSPVSPRGQRAPFPMFEFDFSLLLRGQYHEMLVAGLLLSLKLAAVTLVFAVPLAMLVALLRLAPFRALQWLGFAYVESIRNVPLLAHMLFWYFAAPEWLPEDLKAWLYAGNIEAASAIVALTLYTAAFMSEDMRSGIRAVPTVQLEAARALGFGYLASMRLVILPQALRITVPPLISQTLNLWKNTSIATVIGVAELMYQAGQVESSTFRSFESFAFATAAYLSVSLLITGAAAWYQQRYPGVERR

SEQ ID NO: 20512 - protein, 166 aa, Pseudomonas aeruginosa
GGGGLRTLGLRKIHPDPYPEPPGTDPGRAHPDRWPGHPRSRPGPQSLPLAHRLRVPAVQSVPAPERAGQLHPGAAPFARPETRGGTPPGLGAAGAGRPGGQSGGVPRTAFRRPAAARGDRPRAGDGAAADAVRRTDQRPRPGDGRRGAAGDARPGPRRHDHGGGNA

SEQ ID NO: 20513 - protein, 390 aa, Pseudomonas aeruginosa
DGLRPRRRRPRAVHGRRPGAGARQPRRFLQPPAAPACAEVPRRHPHPLRPTPVRNAMSTPSLPIIDIAALAGSDPAARRSVAVRIDRACREQGFFYVVGHGVEAQLVERLERLARQFFALDETSKLRWRMELGGRAWRGYFPLGGELTSNRPDWKEGLYLGSELDAEHPEVRAGTPLHGANLFPEVPGLRETLLEYLDATTRVGHRLMEGIALGLGLEADYFAARYTGDPLILFRLFNYPSQPVPEGLDVQWGVGEHTDYGLLTLLHQDAIGGLQVRTPQGWLEAPPIPGSFVCNLGDMLERMTGGLYRSTPHRVARNTSGRDRLSFPLFFDPNFHARVQPIEGLPEVPEQDDSARRWDQANVHAFHGEYGDYLLNKVAKVFPQLRRDLL

SEQ ID NO: 20514 - protein, 453 aa, Pseudomonas aeruginosa
  UNSURE (162),(218): Identity of amino acid at the above locations are unknown.
GCLAFSTCSILPPPQVEVHAKGKEWFGWIAAGTGRAQQEVDQLVAFARQPVGQQLPGDGPAGYPQAVAAQGAINVGRQLAEVPHVVPRQRQRAAPGVVEADFREHREALAERGAMAYGEALKVLPGAASVRVEAEAVADQQAVVRGTPHRGAVRVGRDQAPXGAPAEAGLLLGIERPGQAGVGEDRQHPPLEEAEAHAERVVGEDQAVGQDAAVGMAXQGPVAIFHGGDRCVFVKADVARQAVGQALDHGRWLHQQGTGGEQGLAIESGADVSREVVRLDHLVGLAEPIEAAPVGVEHSHAARLDGRLVLAAGLHLAVDGMALHLFAEQRLAGEIELQADPGGRYVADVVVGADVVGQVDGEAGVAPGGTEADFLGLDQDDLLVGKMQRQLARGGEAGEAGADHHPTGGAPAVVGRLRPPRRAEVIPAAGTVVGRKVGYFRHRRDLTLVIGTR

SEQ ID NO: 20515 - protein, 206 aa, Pseudomonas aeruginosa
PCWRSWSPAASSRPATSASATPPSTATRRRKKCATATSARRNEGVSPDAAGMLERTFRPGLRRSCAMSQPFLWRRVNDSSGFAEPRVFIRVYLEPGSIDAAIAFYEDLQGVAHDMRFDFPEKRLTLAAVGAFLLLEGSDEALAPFRSTTGTLLVDDIEPYHRRLLAAGAQIIFGPARAPTGACFNALLPDGTVVEFVHHRPQPGEA

SEQ ID NO: 20516 - protein, 477 aa, Pseudomonas aeruginosa
TSALAPGGAIVHGRADRLFAARQQRCAGAADIAGFLVLAELELADQAGDLDFDADDQPEHLVDVVGGAVGHFPGRFLGRLVGAGQARHQSAHIAFVVADPHPAVGVDHPVVPGRHLAVVLLLARVPLRRDVGIAGAEHHQHLVAVAQLAPNRVVARDMGFQGALRALFRAQLERQVVGVQARFAVADQQAQRIVPDQRVQRLRVGLFEMRRQVHVLFSSGTRPLYAVGGFRRHAQQARVGAHAGHHQAQFVEQQAARFVQGRQRHFRQALEDEPHAPGAGIQAGAHALAPVPAAAGDAEVVAPDHLAGVGGFVDRLAVLQGVEGLAAVGDHQARRAGIGGEILAAYRNGELHADGVVQVHHRVDARQPAVAQRAFAQGFGGAGGTLRLGAEAAERLGPGCQVRLGPVRFATRQRLAGALYGAAGDFRTNDRRRLDGEAQGAETGGEGGHFGGDDGEDRGVLGHGRLQGSVTWRGRGA

SEQ ID NO: 20517 - protein, 138 aa, Pseudomonas aeruginosa
WRERRSLAGEAGARAFRRPGGAGQRDARGAVFERSEPPPPEVERRWPRQPMWLCNAWKTRACSTSSEFPARRISTCWSPCASRRSGWCSPATNNRPASWPPPMGASPARPGSACRPSARAPPTWSPPAPTPTWAACRC

SEQ ID NO: 20518 - protein, 144 aa, Pseudomonas aeruginosa
TSVPPRWTRCISRRSKWWATSPTPSGRSARRWTIPRTGTSPACWRSARPTRRRSPKAPTTRASRSIRSAWWPTCAGRCRRRASSPWTTACTRSGSPATTRRTCPTPCCWTTPSPPWAPACPRRWPRTWSTRTGRSSRCAAMAAS

SEQ ID NO: 20519 - protein, 272 aa, Pseudomonas aeruginosa
CPGRRCDSRNRGSAAREGRYRRPGPGAAGPGCRTTGAGDARSGSAPGSRCRRTSGRNSGTGRCTARWRTWAARTGGEGRGMVPQARALPAKKQAPAGGSRADFSRNAASRRRSCTSRPSMRPGHASVSPPGRACSGCRGRPIPSRRTRLRSSTRTAASRSASRSAGARRVRSGTRRAGRRRGRCAGPRRGRCHSWRMPRHGPCDTGRSGSERVRAGARTVGSAARRTGNCRGRSGSSEGVPGFAKAASQAALATLVERLLRSRAVGAGVDVC

SEQ ID NO: 20520 - protein, 138 aa, Pseudomonas aeruginosa
RGGSAGTPGTAASAPGSSPRTAAAARRGRGARAPCSAAARGCPGRPARPPGRRCRRPPPAHDGPPPAGIPRPCAWRRAGPCRCAPRGSRRYAGGCPPVRAGGSARRRAASRPVPRRPPVAGRRPAALSATGRAVRRRG

SEQ ID NO: 20521 - protein, 197 aa, Pseudomonas aeruginosa
SCRYPPHGQRPASHRNGPSGLRVVGDCLDSTNSHGQGCAFIHGAHDLTVLPSTMTGPGAPGWRYRMTVRDVVFPAGRQALYERNRYSPAVRSDGLLFVSGQVGSRDDGSPEPELETQVRRAFDNLNAVLAAAGCGFDDVLDVTVFIVDAEANFERIWKIVPEYWGEAPYPTLTAVGVNWLYGFSFEIKVVARLPEGR

SEQ ID NO: 20522 - protein, 298 aa, Pseudomonas aeruginosa
SPRATRVTCRRSTKPSAKPCRRPPDRHSRRRPVDTLKIATFNVNGIQTRLAALLAWLEREAPDIVCLQELKTPDARFPAAALEKAGYGAIWQGQSAWNGVAILARDSQPLEVRRGLPGNASDPHSRYLEAAVDGLLVASLYLPNGNPQPGPKFDYKLAWFEHLIRHAAELMESGHPVVLAGDFNVVPSDFDIYDTRSWKKDALLQPESRECFERLLRQGWVDALRQRFPDRRLYTFWDYFRQHWQRDAGLRIDHLLLSASLADHLEDAGVDRWVRGEEHASDHAPAWVSLRRPSEPRR

SEQ ID NO: 20523 - protein, 318 aa, Pseudomonas aeruginosa
NPNNPRRPGVPMDRFDAMQAFARVVDTGSFTKAAETLHMSRTSVTQLVQQLEARLRVRLLNRTTRKLNLTADGAAYYERVVRLLAELDDAETSLSSAALAPRGRLRIDVPSPLARLLLIPALPEFHARYPEIQIDLGVSDRLVDLIDENVDCVIRGGELRDQSLIARRVGDLQLGVYAAPAYLQRAGVPSHPRELEDSHQRIVGFLWARTGKALPYAMRRGEECLRVAGRHVLAVDDGNAYLAAGLAGLGILWLPHYMAREPLARGELLPLFEDWSLEPMPLYLAFPPNRHVSGKLRVFIEWVAELIARHAPPLHPPL

SEQ ID NO: 20524 - protein, 541 aa, Pseudomonas aeruginosa
RSRFMHKRTYLNACLVLALAAGASQALAAPGASEMAGDVAVLQASPASTGHARFANPNAAISAAGIHFAAPPARRVARAAPLAPKPGTPLQVGVGLKTATPEIDLTTLEWIDTPDGRHTARFPISAAGAASLRAAIRLETRSGSLPDDVLLHFAGAGKEIFEASGKDLSVNRPYWSPVIEGDTLTVELVLPANLQPGDLRLSVPQVSYFADSLYKAGYRDGFGASGSCEVDAVCATQSGTRAYDNATAAVAKMVFTSSADGGSYICTGTLLNNGNSPKRQLFWSAAHCIEDQATAATLQTIWFYNTTQCYGDASTINQSVTVLTGGANILHRDAKRDTLLLELKRTPPAGVFYQGWSATPIANGSLGHDIHHPRGDAKKYSQGNVSAVGVTYDGHTALTRVDWPSAVVEGGSSGSGLLTVAGDGSYQLRGGLYGGPSYCGAPTSQRNDYFSDFSGVYSQISRSLRALRPARLSIAHRRITAQRLFALRPDWRLEVRLLSSSGTGRADNANGVIRRLSRAAVIRPTPGLAPGSAASFIVRDR

SEQ ID NO: 20525 - protein, 81 aa, Pseudomonas aeruginosa
RQRRYPPFIPRNGYSPHARIGTWKCGFFRRPGQVGRITPTALSAVYPAQRLFAPRLDRRVEEGRYAPPYVQSWRLVTSSRW

SEQ ID NO: 20526 - protein, 175 aa, Pseudomonas aeruginosa
GETAEPNRHRRPHRQPATGGGARQAWRGLLDSPPLRIRERPPMSQTFHGSCLCGALHYRLSSPPRALSHCHCGQCRKAHGAAFASYGSVPVADLHIDRGADLLAAFRSSPAVLRRFCSRCGSPLFWSRSEGEFADWVSVALGSLNTPFPAAKQKHVQVASMACWCRIADDWPRFD

SEQ ID NO: 20527 - protein, 280 aa, Pseudomonas aeruginosa
SPPAIRRPVPVFSPARPGPGVPCRALRRRSLPPMSATALYTDLSHYYDLMCADIDYQAQSHCVRRLHQLFGNQGRRHLDLACGTGPHVRHFLDFGYRSAGLDINQPMLDLARQRCPEAHFSRQDMAGFQVDEPLDLITCFLYSIHYNAGLERLRACLASVHGALADGGVFCFNTVDKGQIDNRAFVRHSVEHRGSRFTFGSGWYYSGEGERQALRLGIEKTTDGTTQTWEDEHPMVALGFAELQHLLQTHFEVQVFEHDYERITPWAGSSGNALFVCVKR

SEQ ID NO: 20528 - protein, 223 aa, Pseudomonas aeruginosa
RSGWHGRGSVSQGAAEDSSSLSARCVRPARGLPGRRSVRAFSARPRSQRPRRPSVTPSRAFLPPLSRVTACPPRFPPVRPAPFAAWAPSPCAADSSPRPLPPSSRTAARAWKRAPSTSTATSATAARPTRRAPPSARKPRRASSSTCARAIPRARWASAWIPWRCSGSSSTPAPRTATAACCLPAATIRVARSTSTPRPALPARCASRRHSSGTGRCCRTCRC

SEQ ID NO: 20529 - protein, 506 aa, Pseudomonas aeruginosa
KSTYRFTRRAPSMSPNPEDDHARARPDPPRHRRRSGRLRPRFPRPEPHRRGGADRSSGNRRPRRRARLPGAGAWRTGLGRGAPGSLGRGVPPLRRQAAAYPLLRRSPAQTRAARRRAAEHRPGGGPVQRHQRAIRHSGRRRESRRLCRPAAPGGRRRQRDLRHPEERRGGRRIPRPRRGGLARRPRRHLPPLELAPGRAHPPGCQRPAHVVHPREPAGNAAGGPARSGRPAARRIAPDDARHARRLAPAVRGDGTHRQRIRAESPRRTEHVPAFAFRRVRPAGAARADPGLSAGPAGQPRRSGPGRQPPAVRAEPGKGRARHPGSPCRAQQPGLERAARRRRGAGGVPRRRCLHLAAVVPEQAGAPPPGADLELPGGPRPRPGADPRRRTLCARTGGAPDPHPRGDPGNALENDRRPRRLHRRDAPADRRHRNRDHPPGRQVQAQPEQGSPRYPRRQRSAAGARRTGDRRGHGRLRRPARGLRFRPRPAAAGGGRTRPPCRPAAAH

SEQ ID NO: 20530 - protein, 318 aa, Pseudomonas aeruginosa
  UNSURE (231),(288): Identity of amino acid at the above locations are unknown.
QESGPCDDESNPPSGRRPFLRLVSPQPAAAAEAGPLRQERRPLGGGRRRLHRPRRRAPAGAAFSRRGDRPGRGPGSRLRYRRAQRRLRHRPAPRHRRRRLHRRHSDRPDRPEAQSRRPVAAPRTGAAPCHRLPDEGLRQVPGGRRGARRGCARRLPARLRSARPGLRGDRGGRPPGTHRHRFLSQGPVHPRYPAGAAIGHGQGPGRQPAGQRQPLRTHTDHRRGIWRQDPXEPSPRQHPGRPPGPRQQRVRHELRLPPGADAADLHLRQPDPAARCRGAGPPRRAPLXGPDPGRPLRHHGEAYPGQPPADPQQLQLQP

SEQ ID NO: 20531 - protein, 492 aa, Pseudomonas aeruginosa
  UNSURE (313): Identity of amino acid at the above locations are unknown.
RPELESVPASRIRSARIHRQRLEPGDNNDKSYDLDRRRTPQRLPPAVDPALRRRLLRRRLRAEHHRRGDAADDRGIATEQFLAGHDRRLGAGRHLLRRFPRRLADRPPGPPQAVLRRPQPVRPRFPGAVRGRLGGGAVRPALPDRRGGGHRVPGRHRLAGGVPAEEVSRTAPGHPDHPLVRRRRLRLPGRRPDPAQRRRGRLAPGTGQHRGDRCRAVPATHRHPRVAALAAEQGPRRGRRAGHPPGLRRSLLAGEPARTGAGTERHHLAPALRRLRQAHALRHPVLDLLGDPRVRRLRLRAQGAAGAEPEGRXGFLRFGGDHPAVRHRLHHRHPPDQPHRPALHAAAQLPLVRPGAARAGRLPRRLGGDHPRPVRCLRAVHRRRPGAATGLPERTVPHRDPRLRGRRRHLVIARRRRGGHLPGAAFPGNPGYRPDHVRRRAGDPARAARDLGPGAGNPFAEPAAGGFAHLNHPPRQRPPGAPRPSIPQEEPP

SEQ ID NO: 20532 - protein, 195 aa, Pseudomonas aeruginosa
SAAPPASTTRTPPRNAWPSPPTPAKSSPGACRWWWEPARSAPRTRWPTPKPPAPSAPTPSWSARRPTRCRPRGRSPSTCWRWIAPPACRSCSTTIRRGWAWRWTRRSSPPSPAAATSSRSRKAPAPPRNCTAWPAATRGSPCPAAGTTRPWSSSPGARAVGSAPAPTSSLANTSPCTRPAWSRTTSPRAGASWRR

SEQ ID NO: 20533 - protein, 526 aa, Pseudomonas aeruginosa
RRWTRPARRHWRRSSPGSRARSRGSSRVAAMTELLSREEYAAIAATLDLPQRAFIDGGFRDACGGRTFASTNPATGELLAQVAACDAEDVGHAVASARRAFEDGRWRSRTPAERKAALLRLAELLEEHLLELAVMESLDSGKPIRECQHTDLPETINTLRWHAELIDKIYDSTAPVGSAALAMVVREPIGVVGLVLPWNFPLLMLAWKIGPALAAGCSVVVKPAPETSLTALRVAELASQAGIPAGVFNVVPGGGREAGEPLGRHPDVAMVSFTGSTATGRLFLKYAAESNLKRVVLECGGKNPAVVMNDVEDLDLVAQHVVNGAFWNMGENCSASSRLIVHAEVREALLERIGAQLREWRMGDPLDPCNRLGALVSPAHFEKVRAYLDQARTERLAVRFGGATEAGIFVEPTVVDGVSPHSRLFREEIFGPLLSVTSFDDIDEAIALANDTVYGLAASAYTGSLRHALRLSREIRAGIVTVNCFGEGDASTPFGGYKESGFGGRDKSVWAHDQYTELKTIWIDAS

SEQ ID NO: 20534 - protein, 172 aa, Pseudomonas aeruginosa
TGGRGSADRRYSARRSSRLPVPDRGRCPPSAGGRRGWLRPGTPAASRAGRAPRGTGWRHAAASRRALRDAQRPVRCPGTSLPSSPGGWRSVRRQEGNSRARRARQAPCASAACSSRRGRRTAAPGAPGARPVAPRRRARPRRRSPARGRRGRFARRPTVAPPGRCRQGRRYR

SEQ ID NO: 20535 - protein, 286 aa, Pseudomonas aeruginosa
SADSECSWRSSQGLGEGGADVGEELPRTRVLRAVEEIVGAGALQHPAGVHEQHAVGDVVGEAHLMRYHHHGHAVAGQVAHHQQHLADHLRVEGAGRFVEQHQRRLHRQRAGDRHALLLAAGKPCGERRRFVRQADPLQQRQGLAACLRGFQAAQTERRQGAVVQHVQVREQIELLEHEADVRAEAIEVQAGSVDVLAIDQDAPALDRFQAVQGTDQGGFSGARGSADHHHLTAADLFVDIRQGVVGAVPFVDLFQPDHRASLGLPRCAWRRSSQKAKRDSPKHRMK

SEQ ID NO: 20536 - protein, 775 aa, Pseudomonas aeruginosa
PSLPSRGAGGERQPAVHEQPAIRRQLGFEGAAEALDDAAAHRQAQAQPFRLAGVERRENVFQLIRRHSRSLVANPQAEQPAGLDAATDDDPRRRAGMRLAVGFDGVAQQIEEHLFEQHAVGIQRRRIVGHRLFHRHLPVPGFPRAEADGLACHLVEVERLQAPLALAQEGAQALDHLRRVAGVLADPRQPLGHPPGGLGLAAEDGQVTLAGAGVVHHRRQRLVDLVGDARGQFAESDQPRSVRQFVLVTALLGLAQFAFGHVAGHQRVIALLAAAAMGQQHQRDWQRRTSVLRLQAPLAAPNAAIARLSPTLFGQPRRSVAGQQAFQRRRLLPVGDAEGGTCRRIEVGDAAAMLDEQHQVGVRLDHFGQAPAVLLRLDPPGDIAGHADHLHHRPGVGLADRPAGGLEPAVAAVAVADTVGDGQVAVLLQRFARAQRHLAAVLGVEQRLRRTPAQFLRPVAEQGPGSRRGVEENAVEGMPGNQVGGVLGDQPVQPAGPRRLALAAQAGGGVAAARQHPGLGAVGNELPEQDASVALRLHLAEGPRLPQAGAHQLPMVGREVSAPGLARPLAKQGKEGLVEFHRLRLAVEQQRRLRVGREERRSAGDATGGGEQRCEEQAEPVQRSALRRIAGHQQQAFVAGLQVEGEGHAMLHAGTPQARAEPGGGTPQFVQSQPAVAHQPLAQRQVAGPVRLAGARRQRRRRRHRGIGLRLRLPGQVPGLARARMFEQQAAQRTDPLDQRRALAQQAQEAVECRRSGKRTHGRKMILGTYMVFIL

SEQ ID NO: 20537 - protein, 210 aa, Pseudomonas aeruginosa
RAIIRGSPRARSSRSVANTWPRSRFRVPWCSRNCRRPPPARSRNTCCASGPPPSERRQPNCPCSGRATAAVGRMRTGNPVPAAVPPAVHRRGVQCLNTTPRCATCASCSTTCSTPPPCGSACRDWPSGSTPTPPTPSSRKRPRSPAACSRRSTAVATKKARSGRTAPCAPRPASARPTRPTPRAAGSASPAIRPMAAWACRRCWQCSSRR

SEQ ID NO: 20538 - protein, 292 aa, Pseudomonas aeruginosa
PRSGYSPYDAREAGQAFLKNDATAGYSLDKEQGHIHANPHHPPRQQPETRRRRHVRQCPARALVTLDAARCGEPHRPRLPCPAGARRRAQRTGGDRHRRVLPARPAPALRRPGRAPRTARQPRRGRPGRRRHRRGAAHPPALRPRRRPARRLGRRPAGAPAVPQRAFRQRPPPLAARAPAAPARPSLVRAGTARPAAGQRTPGAARRRRALGASGRGLAFPFQRRPYPGPDAPGDRHARRPGGIQRRPDPRRTLGTPTADHGLRPLPGRPDRGKGTPAGQPHRPQRPTGLHP

SEQ ID NO: 20539 - protein, 154 aa, Pseudomonas aeruginosa
TETVIVARSERPPSAAQFLDQRAQQFGGRQLPRQRRALAGPLGGEIMVAASQSGGLQRFGRVVDERIVRQGRHSRRGGIEEHPVGQAAGAAPGHGHGQRGARRARPLQRLAVGGVGRGLRTEDEGGAHLHGARAQLQGGADAPSVHDPAGSHHR

SEQ ID NO: 20540 - protein, 274 aa, Pseudomonas aeruginosa
RAKELPMRRLPTLCLLALAPLTGVAPQAQAASLYNLLVGTYTEGSSEGIQVYRFDGADGSVKGPLRVAHTSNPSYLTFAPDQRTLFVVNENGRGGKGDTVGRATSYRFDPISGRLQQISQVQTLGDHPTYSSLSHDGRYLFVANYSVQPEGSVAVLPVRADGSLAPVVQVESHQASKVHPRQVSGHVHSVVSSPDGQYLFAPDLGADKVFVYRYAPEQAERPLQAADPAFVPTPPGSGPRHRIFSADGRFAEPDTGTERPGEVFAHGGNARLRQ

SEQ ID NO: 20541 - protein, 119 aa, Pseudomonas aeruginosa
QTHDLAHAGFQGKVGAGALHLSADGRFLGVLNRGDDNQLVTFAVDPASGQLRFVERRSVEGTEPREFAFSPGGRFVLVANQNSDQLRVFARDPQSGQVGKTLQSVEVGSPSDLRFVAVP

SEQ ID NO: 20542 - protein, 150 aa, Pseudomonas aeruginosa
LARKQLALADRPDLPGPDVRRLGTGEAVRLSGQPGGNARRRPGAGLAVQHRHRRDPAGRLRAGPAGPQAMARRRGAGGVPAADHPHRPHLLEQDRRRSQAGDVLRPRTHRGDRRPDRHGHRQRATPAAAPGRLRGRHLPEGLRRSCRNPS

SEQ ID NO: 20543 - protein, 153 aa, Pseudomonas aeruginosa
APGSSTAPTDRRRASAGSTWRPGKSASATPRRSSPSCKARSATSRAAASSPSSWPPCPAPPAACRCRWCCAARRTIRCSTGPWKRSSRRPDRAGCSWWSTATSTTTTRWSRSASTAPRPTAWASACRTSASRWRCWWARTTSTASAWRAAPTT

SEQ ID NO: 20544 - protein, 306 aa, Pseudomonas aeruginosa
TRHEALLPEPFAPGAGPSGRHRPGRLQRRPRLPASAVAAATRRQRAPRRVLRRAAGSALVEFLRRSATGAPGRPGAGAQPRHPRGPRQPAQRPRAVRRPLARPVAAGHQPGRLQPQHRTTAGLRRRAAPAPGGELPRRLRRAVGNRPVRPPRPTFRRRPGPRRSGRRRPPAGTPEHRRRHRPRLLRDPGLPAPAGRGARPGAQLARHPGADPQQPATGQRPAGGRGERPGQPAAQRSGDSATGDRAGERPLPPRRAARRGAGQRRADPRRWRRRAIGEEPAAGRRRPPDPPAPRRSQRRAATGSEH

SEQ ID NO: 20545 - protein, 182 aa, Pseudomonas aeruginosa
PMPRGKSFSGIPGEPSRRRRMNGQRHRETPLDIERLRRLNRATVERYMAMKGAERLQRHSLFVEDGCAGNWTTESGEPLVFRGHESLRRLAEWLERCFPDWEWHNVRIFETEDPNHFWVECDGRGKALVPGYPQGYCENHYIHSFELENGRIKRNREFMNPIQKLRALGIAVPQIKRDGIPT

SEQ ID NO: 20546 - protein, 631 aa, Pseudomonas aeruginosa
NAKAFPLDRNDISCRRGTHHGRSIATRTALRSAAATRMGRSVAPARRAGVPARQSGADPRRRHPGPARDPGAGRPRRGAGGAVRRLRRGHGRPPCRERGAQGRRAGTAGRRPAPGRPAAGDPRRAHRRAVRQAAFQAARAGRRADPAGLSRRHGQRPRGPCRTAPGRSAADPQGLCGGAQHHAPPGLGRRVRAGGECLAGLDQPRDAAARLRAVDAARGRAAPGLSRFDPLAVDRRAHPPGRRRPCGAAGRGAQPGGLQGRPGDRPRPVAGALRAPRPAPRAGAPDADRADGRAEGRRAPAAAGGSGARGRPPGDLAERPDARQHHRRALRQQDPPGAQHRRGGGGVPPGGVRLRRRGRRAAPGDHPGRRHRVRRRFQRPAPGQPALHQPLRSAAEPLAGTQRGDGLVRRRSDPERNLPPGDRGMSGIPEITAYPLPTAQQLPANLARWSLEPRRAVLLVHDMQRYFLRPLPESLRAGLVANAARLRRWCVEQGVQIAYTAQPGSMTEEQRGLLKDFWGPGMCASPADREVVEELAPGPDDWLLTKWRYSAFFHSDLLQRMRAAGRDQLVLCGVYAHVGVLISTVDAYSNDIQPFLVADAIADFSEAHHRMALEYAASRCAMVVTTDEVLE

SEQ ID NO: 20547 - protein, 313 aa, Pseudomonas aeruginosa
PARVRASSPTCCATRWSSGGPEPGEPMHRYVVIDAFASEPLQGNPVAVFFDCDDLSGERMQRMAREMNLSESTFVLRPQQDGDARIRIFTPVNELPFAGHPLLGTAIALGAETDKDRLFLETRMGTVPFALERQDGKVVACSMQQPIPTWEHFSRPAELLAALGLKGSTFPIEVYRNGPRHVFVGLESVAALSALHPDHRALCDFPDLAVKLLRRRRAALAQPHVLAGLRRGRGRRHRFRRRAAGDPPGAPPADSLRAADRDPPGRRDRPAVAHVRPRRGRRRAGLDGGSVGQRRGLRRRPGLPVNGQNGGTP

SEQ ID NO: 20548 - protein, 782 aa, Pseudomonas aeruginosa
AALHRPERRHGMVRAARGGSRQRLSAVLDPSRRTADDPARRGARASRPTGGTHRSRRGAHRRARRPRTDRRPRRTRQAPGARCRCAGRRRRHPLGGPRAPASRPGAAVPRWDHHVARRHRVRPLPRRQDHDRRQRRALVAPGRLSDLGAPRGRRQVAGELGVHGAERRRRPARQRGRLEPQRTPGRRVAVLRRLGPGLVRHPRPADPQPVDPAVPDGRPRSAAALGPGTHHAARRRRPPDVSDGRQRRFAGDPRRHRAGRRAGAQRRRGRSPARIRRSAAADRQQDHPGQPRTGKRGMGRGFATEDREERGAGSDHRQLPQPGGTATLATPGRPPRLPSPASPVRGRGGIRAGAGRCAPIGSASGLFRPPLPLPAPLAGLQAQGEQQGQHRQGAAGEETAGIADLRGEADQERRRQHLAEVSGALHRGDIGAGLAALAGEAHRRGEDRHRGDAGSQRADQHAGPRQSFTQCQPATGLQIPEQRRTTGEHHAKGETAPQADPPDQPGAAAAAEEYRDQATAHAQPADVLQGPAGIAEVQLGQAEAGYRGHRRQQCQRQQRRRQRPTQEAQQAGLGGRCRGEFVGGAAPQGEHAAQACQRHAGHDQERRALAEIPGEDQAAGAAAEEADHHPGDLYRVDLGQQLAAEVLRRHAVGGDVLGRAGQRSQRQQADRPTGAGHAEAKRRQAEQAGEDDALHRQDPVTPPAETARPMVVDPGRPEELDHPGQPHQGQEGQRLQWRAILAQEGGQGVHGQADGNALGQVEQRQGDDQAAVAIQLKHGGLR

SEQ ID NO: 20549 - protein, 141 aa, Pseudomonas aeruginosa
VRAPGARRRPPGRPARGRRATRAPAASRPAAATPPGQRRPTGQGTAAPSRVRRVAPRARVAAPAGATRPPPPGRHRNPGSGAARAVRGRPAPRRVVAATGTGRWRRAGRRRGPSPGAGRATRRTSPARATGTGRNATAARR

SEQ ID NO: 20550 - protein, 240 aa, Pseudomonas aeruginosa
PPPARGSRRTGSCAGSAGGPSPASVATPRPLAGSRSSRQSRRASQTLKAAWPGAGSSRVASRMSTPSSPARSSRRSSARVSPPACAGARSHSRRSSWPRLQAPLNSTTNSSTPNSAPAPPCSESRRGRAATSTAPRQQPQRQAQYQQATAQAPGEVARTTRQQPADKQQQAHPERAEEPGVETLERVVQGQPASQQIAAGGRRRQAAGERQRNPPGPAEARLARHQNAPRRLTLKLRGSP

SEQ ID NO: 20551 - protein, 254 aa, Pseudomonas aeruginosa
GAGAPPPAAVPGRPDAPAPGGGSLPSGCAGRATRAGCAAPAPRWRRRGWRWACRAAATAPSRAAREPGTGVAAGRRTAARRRDRRRCPSPAARPRSLPAGQPPAPPSAALRDRRPLAPCAGSRQRCRGTGRCPGTPGYDWRRGSFRSTGGYPRHPAGHARHRRRRAARAAPAGCSCRPRRVRRGRSANPAPASGKCPRARRGHFPDAIPRPRPPGWRRAAARPGSGLRSGARAKTGSRVSSAWPGAGPTPGRDG

SEQ ID NO: 20552 - protein, 285 aa, Pseudomonas aeruginosa
  UNSURE (219): Identity of amino acid at the above locations are unknown.
SRGRWAGCAATDPGCCGGDCARPLPAPGGRRFRAAPRAAVAGVRRTPATAVRRRARRPAGHPPPPDCAARSSATARRGRHQQGAGRGRWTGRSGTARGSPRAASPTRRSAAPAGAPECPSPASPGRAAGLRPARPGATPAAPGAASAPPGCAPVQPPASRRRRNRDAWPGTATAPAPGSNRATRRPSARATRLRRTRPRPTAPAIRRKRRPAAPPGPPXRSPGATRHGSLRAAHAFVRTGSCRHLRAVLFTPQARIGAVRRQQGGVLAAFDQTARGPAPGSGRHR

SEQ ID NO: 20553 - protein, 315 aa, Pseudomonas aeruginosa
CARRGRRHGPPGESPGDRHRGGTGQCCRPGISPAPPPAGRPARYADGARHRACPSVPGRQPPVRRAARPCSAPAGAAGCSCRSPRDRPGPPGCHPPAPDRYRPGPPRLHRHGPGRAAPPRHRPARGSSGPRPAAPGRTPAAGARRRRARPAASRRRGRAPVPGRPGPATGAGRRRPGRAPAARRGHPGPARRAGPRPAARASTTARRPARRGGRPASPRRRTLRRRPPPTPRRPVVCRRRGTVGPAAGCGRIRHSPPRAFPARRCAAAPGRDSAPSAAAGSRRRPAPAAAGRTAAARGAARPARATRRAAPPTGC

SEQ ID NO: 20554 - protein, 358 aa, Pseudomonas aeruginosa
  UNSURE (168),(202),(214),(251): Identity of amino acid at the above locations are unknown.
DRWERARSVGAGPARPAPRGAPRRPGPGDRTSPAAAVAGAPAGAGAGRCRGPRRPGGPGARPAPGSPARPAPPAAPGPAGPAAPGRAPAARRARREASRATASRARPGPATPWPPPAASDRCAAGATAPGSRGLLQHLFQARRRQRRRRRLGEAKALADPLPQGGDLXAALVAPAHLVAVGEQRQRLGRRRRPQALVHLGPXARFGIPKLGAGXRFAGYLVEQREQAVVILCRYRHRRRPQQRAMGAEQAXRAAIGGQADALQQGHAPVVGGRQFVEHVQAQRHFRQHQGQPAHRRQVVRGANSRDQGPTPSSNAARMSRVGKPTCTPQGRVQVADAAARRCNWRPSSMKRATAGNCG

SEQ ID NO: 20555 - protein, 450 aa, Pseudomonas aeruginosa
RPRAVAGLSQRRVAVRSRRRGEEGGGRFRGEGRQRRTFHRAPADPRQRGRRRAAGDPRSCRALGTARVPLPVLPRLRTGRRADWRTGGLTAGHPPRPDVARLGSDHLFPQRRLRTGCRANVQAGPARRDDRSRSRGLAGRRARRRDPGQWPHDYARGVVHPAAYAHGQPAGGVARLRVRGRPERAVHQDRRHARNQRSRRLRLRRRGAGGRQRRHRGGRRRAHRWRGASFAAVPLTPEADRPRIRPTARQIFRTPRRSSFPLSCMSRHGARHGRPSRGENHEREAARQERPGHHRQHRHRARRAARTAEDPEATGRHGHPRDHRGRRSADLGARQREGPDRQFRRQAARPARRGLRLAAGPRRHGECRHPTPGQRGPAPGQGIQRRRQDGRRHLPRPLAADRRGCRPRQDPDLLFQRAYRPDQRRRGLGRHAGESLPGERLDPDHLAQPG

SEQ ID NO: 20556 - protein, 117 aa, Pseudomonas aeruginosa
WRAAIRWCWPATSTWCPATSISTTPAPGKRTPCSSRSPASASSASCGRAGWTRYASVSPTGASIPSGTTSASTGNATPGCASTTCCSAPAWRTTWKTPGWIAGCAARSTPATTRRPG

SEQ ID NO: 20557 - protein, 86 aa, Pseudomonas aeruginosa
CAPTSTTRRRATACVACTSCSATRAGGTWTWPAVPALTCGTSSISAIAAPAWTSTSRCSTSPDSAVPKRTSAGRTWPASRWTSRWT

SEQ ID NO: 20558 - protein, 472 aa, Pseudomonas aeruginosa
HLRALFYPRCRESPHVLPVFPPFAPHPSRPGRPRPVRRIRRPGPCRLPRGRQRAPGSAHRLLQPRLPRRQLGQPAGRLQARGSRAGLHPRPALGLYRGRAGLRRGYPGDARDQARLQPRGQQQRPAAFQRPRSASLGRPVRQGRRCRQDALLADTVQVRGDAAGHAVAEIQRRTPAADPVPRRPADQRGDRRAQVLRHPPGALHRAGLQRCPGHPPALQEQTLRLRHHRQPLRRLPTRLPGQRRPAAAIRPGRPAQRLSPALPRCRGQAAARRRQAERRPALVRQRGRRRGPRRQDRQPRPQPAARLRPGRPHAQRRLAADERRQLDALPRRQQSVPGQLPAGERLRQPRGTLLATALRLRPAQRRRARPELHDPLRQRRPYPPGQRRRGQGMGARHRAEVRGAERPLQGPQPAPAQRHLPHRLRALGARRGRGAPDRQLQPVAVLSRRAGTHAGATLRRFRPPGRVRAARR

SEQ ID NO: 20559 - protein, 266 aa, Pseudomonas aeruginosa
GRSPDGRNPPTALRAAPPPCHRTLKTTMPEHAPILPVIAAEVAAFAPGFRALSLTVEAAPIVRPEIAGRAVERACQALARGEPDWAEAHLAAWAEAFRRFGAKPQRTPCSAEALRKRALRDGGLPSIDPVVDLYNAISVQFAIPVGGENLAAYAGPPRLVVADGSETFDTLKNGEAVDESPDPGEVVWRDDLGVTCRRWNWRQGVRTRLDASARRMWFILESLPEMPLAALHEAGGLLLDELRLMMPGMRADSRLLCVATEPTDSV

SEQ ID NO: 20560 - protein, 221 aa, Pseudomonas aeruginosa
GPSPRGEQNMYLPSHFEESDPQALHALIRDYPLGLLVSHGEAGLDANHLPFELSPEKGAQGTLEAHVARNNPVWSELRDGDEVLVVFRAGDAYISPQWYPSKQEHHRQVPTWNYRVVHAHGRVRIRDDERYVRGLVARLTRTHEATQETPWKMTDGPADYIDEMLRLIVGIEIEITRLVGKFKLSQNKEARDIRGASAALLARGEQAIGAAMDDCAARREG

SEQ ID NO: 20561 - protein, 558 aa, Pseudomonas aeruginosa
  UNSURE (502),(558): Identity of amino acid at the above locations are unknown.
KGLHESPTRRRLEQRRCPLRPQGGAGRCAAPADPEHGTGARRGRRRTRPVRRVRPLAPAGARTAAADRRRGLHRTGSQPCAARRGHEPRLAARLLSRRAADLHRHHATGGHPCQRSGDRDAQGDPGRFPQGHRREACGKPRHPQRRLPPGDRQDGPQRLPHAEPAPLADRPCAAGQDLLPPSDHRRHATRPGTRLRPARPDRRCHQAARSGCGGGHRPCAFRAVAPAHGRVRGTGRSGGGAGLRGLASPRATAPPEKRRRSRRGWLPGSNNKSQVPAMTKVTHLPADDRSCGWYHLSPPRRPKPAHYGRSAARWVVVGAGFTGLAAARQLALHFPDEEIVLVEAQEVGFGTAGRNAGFAIDLPHDIGADDYIGDIATARIGLKLNLAGQSLLREQVQRHAIDCQMKACGKYQAAVEARGVAVLDAYRRGFDRLGQAYEVIEADDLPGHIGTAFYRKALFTPGTLLVQPSAMVKGLADSLPGNVSLYEHTPITAVEYGDRTLXSHPHGSILADRLVLANNAFGMSFGFLQGRMLPIFTYASLTRPLDAEEQARLGGRPX

SEQ ID NO: 20562 - protein, 158 aa, Pseudomonas aeruginosa
WGLIPADPYGTTVRRTPDNRLLIRNSFSFNPDGRSAGKYLERFAVRHRASFRQRFPMLPEVGFDYTWGGSLALSRNHMGHFGELAPNVYGALCCNGLGVTRGTVTGKLLADWLAGERNELIDFLLRAPGPSGNPPEPLLSLGVNLNLRWGQYRAGRES

SEQ ID NO: 20563 - protein, 447 aa, Pseudomonas aeruginosa
  UNSURE (290): Identity of amino acid at the above locations are unknown.
NQETIMTNPTTSIEDVPLNAFHRLLTLRSGGGSFVDGYVLSIIGVAMLQMTAALQLSSFWQGMIAASALVGIFFGGFLGGWLTDRLGRRRLFFVGPSLFVLASLAQYGVDSAAALFVLRFLIGVAVGIEYPVATALLVEFLPKKYRGPRLATLTILWFAGAAFAYLVGDLILRSGGEDAWRLVLASTAAIGAVLFLLRIGTPESPRWLLSKGRDADAERVIRQVYGEAFSLENLPEQAPERNVTIWHLLYAGYGKRMLFVTLFWTCSVIPVFAVYAFAPKVLLALNLKGXWASYGSVAITLLFVIGCIIATRLINRIGRRCMLLHSFLWSGLALLGLGVFHAGSEATILGLFGAYALFIGGAQVLQLVYPNELFPTEIRAFAVGVGTSLSRVGAAVGTYLVPLSLETLGTAQTMYAAALVTLLGLLVTWALAPETRSLNLQQAASLT

SEQ ID NO: 20564 - protein, 323 aa, Pseudomonas aeruginosa
TTRRGSVRRVRRGPASHRRNPREIRRYLYPRHHPAERRRQHRHPGLHRGPGVSRRVEGARHRDRRLHRRVLRAHRRGTPGPRRPRQRSHRRAPAAGGGNRRDPHRGLAGLRRSRPRHRRRRHPGRLAALRAADLAGDRRARAGGGSRRRPADHALQLSGADGRGDGRGVLRRRRRLPQHRRDQGKLRLHRAIAPPGLPPPADRLVLRLGRPGPGVLRLGRAQLGLRRLQLHPWRTPRPVPGLRGRERLRQGPAHHGGDDAADGLSRKRSLRPVDQARLRTGRPARRRRTCAAEGAGRGRQGGTGGDRRQAQGRGRADRRGWPP

SEQ ID NO: 20565 - protein, 77 aa, Pseudomonas aeruginosa
PPCASPNWPARRGSPPGCSTWSPAAAARPANRWAATRTWRWSASPAPPRPAACSSSTPPSPTSSGWYWSAAARTRRW

SEQ ID NO: 20566 - protein, 178 aa, Pseudomonas aeruginosa
SSMPKSARRCSNASARSSASGAWATRWIRVIASARWSARRTSRRSARTSTRPGRSGWRCASAAPPRLASSSSRPWSMASRRTAGCSARKSSARCSRSPLSTTSTKPSPWPTTPSTASPPRPTPAACATHCACRGRSARGSSPSTASARATPRRPSAATRSQASAVATSRSGHTTSTQS

SEQ ID NO: 20567 - protein, 577 aa, Pseudomonas aeruginosa
RPAARLEQVAAQLREYLGHLVQQVVAVLAVESVDVGLVPATGAVILFRHLGQPFDGLHAGMEVRIEEQRERQAVSPRSVACHPVRRAAVEAAGHAFEHVSEVADERARYRRSLQPALWGAHLQAADGVLVEQREQAVVGVFADAPLHVEALRHWLARIIEQAEEDQRIAGIARGEVVGFQSQTEGDALHQPVADAGGCVQVLQQRLAQAGHLGEQVGAMQRRPGAHFGMLSVQFAAQVQAFLPVRAVGGQFAAKREIAAPGAPAKLHAPAQLARLVEGEELPRQALQALDQLRLDAVPDHVEEALLAAGAVDSHGDRPSRRRVAAGKGGDIDDRQTRSAHGVPHRGWAKGVRMSARNFRARGCCGRLKKSSGLARSSTRPASMNSTRSATSWAKPISCVTTTMVMPSRARSRITSSTSPTISGSRALVGSSNSISGGSIASARAIATRCCWPPESRAGNAAALSARPTRSSSAKAWRRASAGFRPRKRSGARVQLSSTFRCGNRLNCWNTKPMCERKRLRSRPGAWMSWPSIRMRPPWIGSRRFRVRIRVDFPEPEGPQTTTTSPRPTCSSTSARAW

SEQ ID NO: 20568 - protein, 199 aa, Pseudomonas aeruginosa
PAPGRAGCPVAAPAAAPARPGPGSGPARPTARWGTGRRGSTASSYRSVPGWSSPFDSRIALLVPGGGAGDQQRYAEIGRGGEGKGLEAAEGRTLHLAGLVHQLGDADHRGDAGVLPQVEGLRDQRRYGDPQGLREDHQAHARQVAEAQRAGGLQLHRGHRADAAAHVLAHERGGVQGQRDDSAGGLDVAGVKPGLEVLG

SEQ ID NO: 20569 - protein, 146 aa, Pseudomonas aeruginosa
ARQASRGRSPSKARKAWLNSTACASPSSSSAGCGSAARNGAARVTPRAAASNGARSRPSQSSAALCGVSLATSSRPSSPACRSRAKAMPCSTPARRKRAPSQEAERRNSSRASRPSRTSRSRNARSLARFGSPAPGGSAGDGGTGV

SEQ ID NO: 20570 - protein, 439 aa, Pseudomonas aeruginosa
  UNSURE (250): Identity of amino acid at the above locations are unknown.
LPYIFHRCYKSPQPKERFAWSLEAVHDLPSQRNQPFSTQSLRARQIVTLTQNRANNQPRGTLHVDLRTGSRARRRQPHRPDAAELHRAHRQRLSALPRGDPRQHPPRLGADLPTLPTPGLRPGRARHRPGRHGGGDAAEHPRDARGALWRADDRRGAEHPQRTPRRRSHRLHAATRRSQGADHRLRIPRGDPCRHRYARPPAAGGRRQRPRVWRRPPGWRTGLRGAARRGRPAVRLGMAPGRVAGDLAEXHLGHHRQPQGRGLPSPRRLPERAGQPDDLVHGPAPGVPLDPADVPLQRLVLSVDGDRAGRRPRLPAAGRSAKGPHPDPRAPGQPPVRRAHRAQRPDQHARFGQGRHRPPGACHGRRRRATGQGDRRGGRDGHPRHPCLRPHRGLRPGHGLRLARRVGRPAAGATRRDQVAPGRALPDPRRGDGGRPEDP

SEQ ID NO: 20571 - protein, 639 aa, Pseudomonas aeruginosa
IQRPAARHALPAQRRVRRPRPVAAPAATGRADRRRHRRRHPRGSGQGHRRPARAAQPQWRRRRRAVAGRRRAHPGRLPRGLRDLRRGRLGRPHRQSGPWRHGHAEDAGSAVRGDDVRGQRQLQPLLDPFRRCLPGPRCTRQRGAEEQVPAEHVRRHLGRLHVPDRTARRHRPGHHPHQGRAAGRRFIQDQRDEDLHHRRRAGPHREHHPPGAGQAARRAGRFARHLAVPGAEVPGRRRRRARRTQRGALRLHRAQDGDQGLGHLRDELRRRQWLAGRRSQQGPGGDVHHDELRAPVHRHPGHRLRRDVLPERRRLRPRAPAKPRADRPGGQGQGRRPDHRAPRRAPHAAHHEGADRGRPRLFHLCRAAARPGQVRRGPGRTQPGRSPGGPVDPGGQGLLHRYRPGELRARPAGVRRPRLHPRMGPGATGARRTHRADLRRHQRHPGARPDGPQGGRQRRAVPLHLQPRGASLRRRRQRRTGGVRHPAADRPGPAGQPHPGHRRPRRQRPARDRRSLGGIPASVRLYRLRLPLGAHGRRRAAPARGRPGVPRRQAGHRALLLRPHPAPRALPRRRRRSRQRKPVRPGGGTVLKLPSRGPWAACFFRDSMQRAVRRQPAITADNREAVILPTTPGKPARHS

SEQ ID NO: 20572 - protein, 295 aa, Pseudomonas aeruginosa
TRNKDISMRTLTTLLGNSQKLDGGAMFGNAPRALWSRWMQPDAENRIDLGCRALLVRDGERNVLVETGIGAFFPPALRQRYGVQEERHVLLDSLAAVGLDDADIDVVLLTHLHFDHAGGLLAAWEEGQPARLLFPNAHFVSGRRHWQRARQPHPRDRASFVPELLDLLQASGRLELLDDGERSAHLGEGWRFHFSEGHTPGQMLPEIAMPDGPVVFSGDLIPGAPWVHLPLTMGYDRFPEGLIEEKERLLDSLIARNGRLVFTHDPCVAMGRVRRDEQERYSLYDTLERVENLEA

SEQ ID NO: 20573 - protein, 441 aa, Pseudomonas aeruginosa
AKGAARPGGGPRESGTRLARALAALDSEPADPLAEFGETDPGRRRGLRQQAGGGHARQGIDLQAPEPALFVEAEVGAAVAAQLQRPVYLQRQTLGLGGDRRRQVGGKHLAHRAGLVLVLVVEDLLAAEENLAHRQRLVVEHPDGDLAAGDEALQHHLVAIAPGQLDGRLQFGLGMHDGQPHGGALAVRLDHQGEAQLLAHRLFRGRRHQPTGGLHPGGEEQALGHVLVHRHGAGQVAAAGIGETTGIQQRLQGAVLAGAAVQGEEEHVDPSQFAGAQQALLAAADDRQRVGVRRDLLDLARQQVALFLRAEQAAGGIHRQHLVAGAAQRLDHLRAAGDGDVPFLTAAAEENGDLQLVLSHVPPVVPVLEAEKHNTGVTEQRQSSSRAANGLPQPRSSSTSVRSSSAAGSSRASAAPWPAHWAAKSWLPRARAAVCNALVAS

SEQ ID NO: 20574 - protein, 144 aa, Pseudomonas aeruginosa
AALAEDSGQRTKAVPICTALAPSSRAARMPRPSMIPPAATTGSEPRAASRRTSARVPMAASPRSGSNTPRWPPASMPWATTASAPAASTRAASSGVVALTSTRMPAACNARTWSRGGAPKWKLTAAGRSSSSIGSRVGSSRKLR

SEQ ID NO: 20575 - protein, 188 aa, Pseudomonas aeruginosa
IKIGVFIFPAAVIPPRFPRTTNRPHGRFAAPDGDQHKERPMQRFIDNSLESNWLWLTARICLALMFVASGLAKLFDYQASLEEMRAAGLEPAWLFNIATAVTLLAGSALVLLDRKLWLGAGALAVFLLLTILIVHTFWSKTGVEAKLAMFFALEHIAVIGGLIATAIASAQRQRLRQDVSVAATYQKA

SEQ ID NO: 20576 - protein, 465 aa, Pseudomonas aeruginosa
GDHAETRPDRQCRAHLRGGYRHRRLRHRLGEERRRRFRRLPAGKGRPRLGGAAGGAARLRWRRRAGGRSPGPGGRRSGRTDHPHRLRIGPAGAARAVAGATQRRGGTGRADPSQGAVAQCRDPPCPCAQAGRAQRRLAGTAGQRRRRPRHGARRGAPDPGADRPEGDPRALLRPARHPPRAPRPVPRRRRAGGQPGGCADPEKQFLPGRKHQSRAEARPAPRGPGRRLSGAQLPGAHQRHRPADRQVAHGAGPGLAGQPRRPARRRHVRQHPGLAQSRRAVAERAGNRGHLYRLRRHRVRRPPGRRPAAQRQARLGADRRALGRSRGNPPGPRRGRPGSDFRTDQPERRDGRGTGQGRHPEQRRAPRAGRRPLKEPRDDLYRPVRPPAGAGAGGQHADPAARPVLPGQAADPPVPAAGKLDHHRHHRVPRRLRRSHARLRHPADRPGGVVGGGHRLPFLDLGAGA

SEQ ID NO: 20577 - protein, 1427 aa, Pseudomonas aeruginosa
RGDHPHAAQPRFDPGDDRDHGQGQLGALQAARACLRLGDRTLFRRDHRGSLRRLFQQDPADPGVDRLPVAGGRADVLFHRRRGQGPDLWRPAPGHAPLARRRPPRRARPDRLRRGRGDPPQQLPGGAGDGEGAVRAVQRAGQHRPDQRRRLPRDGHPQRWQRPGAPARRRYRRTGRRGHRDQRTDGRRPGGAPGVVPDAHRQPAGDRRRHPQAAAGDPEDPAAGCPRRPRLRDFALHPGLHRRGGADPGGSAADRGAGDLPLPRLAAQRADPGGDHSPVDARRRRADAGLRLQRQPADPAGDGAGHRAGGGRRHRGGGERPPPHRGRQVAGGGGADRRPRSGRPGDRHDHHPGRRVHPHRPDGRPHRRAVPRVRPDPGGRGDRVRGGGADPVAGDEFAAAPGAPERGAHGPRRRVVLRRPDAALRAGPGVLPGPPLADRRPGIAGVHQPAAAVFDAQARTGADRGPGRGAHRDQGAAARQPRLCRTVRAQARPGLHQHPGNREHLDHQRHRRTGGELRRDQPGGLGKARARRLGDPVRAARQGRRRRGQQHLRLPVGRPARLHRRPAGADGAAQPAGLSGALPDHGRDQAEGPTERAVRGGRQRPRLQQPGGPGPHRPRQGQQPGHPHAGHRRVAGGAGGRELRQPLRHGGPLLRRDPTEPARPAFHSASAGTTVRAHPGRQPGAAVDGGPGGASGRTEQADPVRPAERRDPPGDPRARRLHGPGGGLPRRRGARPAGRLQPRLAIRLAAIHPGRQHPGVRLPRRPGGDLPGARRAVREPGRPADHPDHRAAVDLRRAAAAGAGLRDDEHLYADRPGHPDRPDQQARHPHGRVRQRTATPRAPRPPRGDPARRADPPAAGADDHRGNGLRPGAAALRQRRRRRQPLRPGRGDRLRDAGRHPLHPVRAAHRLYPAGAQPRGSRQEPAQPATGRGRSAGEQGMKRSYPNLSRLALALAVGTGLAACSVGPDYQRPQSPPPRVASEHLGEFSGERREAPWWSFFDDPQLVRLVDQALARNHDIREARANLRSARALFDDRWLDQLPQVTSQAGYSRSIEQQLDYDGEPRRRLAESYRAGFDAQWEIDLFGRLGRLSDAALARAEAADADLRLVRLSIAADTARAYFEIQGYQRRLDVARAQVRSWRDTLELTRSSLQLGSGLPEDVENAQANLLRSEAAIPPLATALESARYRLDVLRGEAPGSGAPILDGGGAAPLAKNLPLGDVDRLILQRPDVVSAERQLAASTEDVGAATAELYPRLDLGGFIGFFALRSGDLGSASRAFELAPSVSWPAFRLGNVRARLRAVEAQSDAALARYQRSLLLAQEDVGNALNQLAEHQRRLVALFQSATHGANALEIANERYRAGAGSYLAVLENQRALYQIREELAQAETASFVNVIALYKALGWGSGDLAPGAGQLAAGETAGANR

SEQ ID NO: 20578 - protein, 452 aa, Pseudomonas aeruginosa
RRQDQAQPRIHERLPTIARLEHSGPGNKTRRHSHLIETISPAEGGPTMDDLLQRVRRCEALQQPEWGDPSRLRDVQAYLRGSPALIRAGDILALRATLARVARGEALVVQCGDCAEDMDDHHAENVARKAAVLELLAGALRLAGRRPVIRVGRIAGQYAKPRSKPHEQVGEQTLPVYRGDMVNGREAHAEQRRADPQRILKGYAAARNIMRHLGWDAASGQEANASPVWTSHEMLLLDYELSMLREDEQRRVYLGSTHWPWIGERTRQVDGAHVALLAEVLNPVACKVGPEIGRDQLLALCERLDPRREPGRLTLIARMGAQKVGERLPPLVEAVRAAGHPVIWLSDPMHGNTIVAPCGNKTRLVRSIAEEVAAFRLAVSGSGGVAAGLHLETTPDDVTECVADSSGLHQVSRHYTSLCDPRLNPWQALSAVMAWSGAEAIPSATFPLETVA

SEQ ID NO: 20579 - protein, 576 aa, Pseudomonas aeruginosa
PAGADSLPADRRARLRGARRRHAAAGAEGPGAGAAAAGAGPGAAAEPGAGTERGRFRPRRRGLRRSGRAGHRRRDRSRRRRQLRDQAALPGAHRRLRHGQRAELLPPVAAAREGRLLDLHRPHRRTHPGRRLARATHQRARRPGGDEPDQRHLPLPAGRAEPGRGHGIPRQPQGSRRAVHGGGRGAEDDGADLRGRRPGARSLPQGDGAPGAHRVLHRGPDQPRRARGAARDAVRPDRHRQPAGKRLPGDPPLRAAGSRLLQRGGGADRRRWPGRAHAGLGDPDPHRRDRGRRPPAHRRRLDHRASLRSPGRGGGKPGQGFRADRRAEEPGAAAPGLAPARGGGAGQPQRADRRLLAARRQRAPAVAGRPVRTRGADRRCRGHLHLDDRQAAQVAGPDGDRARLPGAVLVRRLRPGDHGPRPGQPHRDRPAEDRPPAPGHPFAAQRAPAVPRRVPEPPGAEPVPGPGPATPAGAQPGRAETDRPVRRRRARRLLQHLRRARPAGPHRDSRGRPDRDQPRPRDRRGPCPARAALRLHAIPPRIGADPRGSAHHRRPAAPRAGRAAALSQESPCTDMS

SEQ ID NO: 20580 - protein, 97 aa, Pseudomonas aeruginosa
TCRRAPSYSARNRTATRASASSPRSTNCRSPATRCWAPPSPWAPRPTRTGCSWRPGWAPCPSPWSARTARWWPAACSSRSPPGSTSAARPSCSPPSA

SEQ ID NO: 20581 - protein, 94 aa, Pseudomonas aeruginosa
NCFAGAGRHWRSRMFSPAYGVVEDAATGSAAGPLAIHLARHRQIPYGQQIEILQGVEIGRPSRMYARAEGAGERVSTVEVSGNGAAFAEGRAYL

SEQ ID NO: 20582 - protein, 147 aa, Pseudomonas aeruginosa
PEGPRTGTEPLGLGGAVLAREQPADHPQRPRRTPARRARRRPVAEPPVPDPPDVDRLAAERNPRRHPRPARRSPAPGGNRRPAAAPAGLLPVRTVPGVGGVLGQRHRAAARAPALRPRRRRLEAPLPATVTTPLRRRFTADMRPAAP

SEQ ID NO: 20583 - protein, 422 aa, Pseudomonas aeruginosa
TVIRPSRTPIDSNTREKEAPMSEPIDILIAGAGIGGLSCALALHQAGIGKVTLLESSSEIRPLGVGINIQPAAVEALAELGLGPALAATAIPTHELRYIDQSGATVWSEPRGVEAGNAYPQYSIHRGELQMILLAAVRERLGQQAVRTGLGVERIEERDGRVLIGARDGHGKPLALGADVLVGADGIHSAVRAHLHPDQGPLSHGGITMWRGVTEFDRFLDGKTMIVANDEHWSRLVAYPISARHAAEGKSLVNWVCMVPSAAVGQLDNEADWNRNGRLEDVLPFFADWDLGWFDIRDLLTRNQLILQYPMVDRDPLPHWGRGRITLLGDAAHLMYPMGANGASQAILDGIELAAALARNADVAAALREYEEARRPTANKIILANREREKEEWAAASRPKTEKSAALEAITGSYRNQVERPR

SEQ ID NO: 20584 - protein, 358 aa, Pseudomonas aeruginosa
PICAVRLTRNEDASISPRSRVLCTAVTSVPAWPPWPAKRIAAVRIATEVMPVASEPISTQVHANPSLSANQRPACRYQSSAEQPASTTPRAKPRHRPIRLTSQAPPPQPRNTVTRPPLMPSRPMSCKAQPASLRYSLDRPKPDTAVIADSSASASSEGASGRRRKRSRLALAAGAGGSSWGAPRPRASTQHRLASGTQATTRNAVRWPKYPARIRLPAPPPKKPIITPAICTALTLASSSPLKCSAAMPSVAMSWVALASEASASRPTAQPALATPRPNVARPSRQARTMHCIGRIQLRRRPKRRDQWLSTQGAQRNLTTQGSPTRGRKASACNGAPSWRRRVGRASMARPMGMPWDR

SEQ ID NO: 20585 - protein, 316 aa, Pseudomonas aeruginosa
LRGHELQPQQEQRGRRHQAGTETLAQALQEPYAGVRRRGASLQPQVQAAGAEQAGAEAHRQVQAAQRGGPARPEPLVLGEMQRLHGDEGAQPEPALRRAALAEQGAVGQPIAVPLEVRGTRQATLDTGDLHAAGDIPGMAEAQALGDEAGRPHGIAGKQAVEIDAGRQWPPLGGGRRRSHQLDEHPVRFLRVGHRRQQQGPERAQPAERAGETEQQQPGQSPDADQAVQVEQRQAQPAVPPPTPQVAPAAAVQHHAGQAQQQQRYAEQADHHPPGEADEQALVQVQQEVHRRRRWQHPGRWPGRGPAGSPGAHRRR

SEQ ID NO: 20586 - protein, 740 aa, Pseudomonas aeruginosa
  UNSURE (704): Identity of amino acid at the above locations are unknown.
AVVSSWNGCTVTPVACCMASSRLNRFCCSRRSWSMTLADCGSSRGLSGTLPRVVTPGGWVADVLSPLITMSGSSVSPSLRASATAAASGLSASSSPRHNGVCRLRAMPWRPLITFVSVFIVRTASGDIRFDNAYHYEEIVSGAFSIAGLSLSIHDRRGTFLARQPDETGIPVVPDEQIGVTSAEAQAPLLQQQFLVGLTRQRRAVGHYHQGAPAAQPEQVAQHLRLAGGVEAGGGLVEQQQRRRREQPASQAQALPLAAGQQRAAGTDVAVPALRPGLDLFQQANRPRRLAQRFEIGVRSRHAQVPGNAAAEQAVVLEHQVTIGGEGRFAQPADIHATQQDTPGIDVVEPPEQRQQAALAGPGGSDEDVQRTRLQPQGNVLEQGAAIFQTQFHGLGRQAGVVRPLARARDCAAEPGRKPAAGYPAPGQAPGQRLVEMGELGQRLDEAHQQHQHGHQSRAVQPLPIHRPGAAEQGEGERRLHRQGEAEAAGQAAPQQIQGAAVETAQGLFQPLAGDAFALRRAQQWLAFGERLQLPCGVALGGQPGILRRQIAPPAPAQQRGEEGTSKEQAEGDGRVDQEQPEDHPERRHQRGDQRPQQVRRNAHRLHHRAAQQAFGRRDPAQRRRRQARQARHQAAHQSSRQRAAGGETATHGQVLQQRLRQAQTEQRGDPAPGQRAFGEPGLDQRHQQYAASGVQQRRQDRPXARPAQRGTAVFGQRTHSFEQGHAATSAPFCSRHKRA

SEQ ID NO: 20587 - protein, 696 aa, Pseudomonas aeruginosa
  UNSURE (516),(549),(562),(599): Identity of amino acid at the above locations are unknown.
QRTGQGQSLQFAAGQLQVASRHAVVATRQGHDALVEAGVTGRLANLLEIGIGAEQGNVVGQGYLQRRRLLADQRDMPMAHGIGHVLQCQAANLQFAALRVHVARQQVQQGALAGARGTDQGHQAAILQLQIDIGQDLHAFIGMAQAVQRHRAIDRLAGRAALGQRRLVEHLLQALGGGARAQQRVAAVAERLYRGGQGPQQEQEGAGLAERQRHAEGIQGQRAEQDPGQQPGRRQLHVDQRGEVADPLHPGAERFAEGRRRRLGALLYAGAGVLSGQQQVVGEFAIVRREPFQRGVAPQHQVAIARRAQQQEAGGGQHQRQQAEQQQPGVQPGQPEQRDERHHQQVAEIVGSVRDQLVQGPHVLLHEARHAVRALATEPVQRQPLQVRQQAQAQVVAEVRVDPVGQVRGQRLAAQPGQHRQQHQGQQGRLRLAARQRLGEPGEKHPGQQRAEPGQGLQPHGRRQPPAIGAQQAPQHRGHEACSSTCSRLAGASDAGGASGKPRRSPIRCHRAATSXLRWLRRRTSSPLASSASASAAAAGHRRWCTWAXLHGSAYQSWALGXGSPAISSNSANRPSSSSAGTATAGVHNNGPWGLSRLXVPRSVVRLTRCNKVMRPSSAAASSLSTCRLNGTSASTRDSPRIADRSFEGRIPGTRGRRPPATRRGCPGWGNRPAPRRAASRWRMPPPGDATGGPAR

SEQ ID NO: 20588 - protein, 221 aa, Pseudomonas aeruginosa
  UNSURE (74): Identity of amino acid at the above locations are unknown.
AGSAGPGARRCAAGPAIRAAATDARSARRCHAPSAPRPAPGPARRVPRRRPRRRPGGHRPATPRPRTRSPPRGXRPTPANAGCPGQGCRAGRSADRRRRRRHRTGRTGNRRPPRNGRRSSARLLWHGFRQGLRQGFAQAVEVPAGHLVDAARAERGGPPLGLQGLGVARHQWVAGVRHEQPQRADVGLRRRGLAGTHRVTEQSVEGVAFDADGVGATAGRL

SEQ ID NO: 20589 - protein, 281 aa, Pseudomonas aeruginosa
HTTRVDLADPMKVILGGRLDWYKADADTDSYKVTRNVTRYAGVIYDLNQTYSVYASYTDIFKPQSNFDAGGGLLDPITGKNYEIGLKGEHFGGALNSQIALFQIDQENRATEDVGGPSPCPFSPTSRYCSRASGKVRSQGVDLELSGALSDDWQMMAGYTYVDAKYKHDSNKANEGKPFDAAKPRHLFKLATSYTLPGELHKWRVGGDLATQSKTEDSSTGFQQGGYTVVNAMLGYKVNERIDTRLNFNNLFDKYYYSGIDFGNLNYGEPRNLMFTVKYSL

SEQ ID NO: 20590 - protein, 314 aa, Pseudomonas aeruginosa
QAHLMKLTLFRDYPNGRYAMTFDVIIVGGSYAGISAGMQLARARRRVLVMDTGLRRNRFARASHGFLGQDGRDPAAIADDARAQLLAYPSVEWLSEAAVAAKKEADGFVVKAANGERFTARRLILASGVADELPEIPGLAERWGRHVFHCPYCHGYELDGGPIGVLAASPLAIHHALMLPDWGATTFFLNGVFEPDAEQMSRLDRRGVTIDREAVVSLGGARADVTLASGRTITLAGLFTQPRTRMASPLAALLGCEFEDGPSGPFIRTDGMRETSVPGVFACGDAALAAGNVAIAVGDGARTGGAAHHSLLFR

SEQ ID NO: 20591 - protein, 232 aa, Pseudomonas aeruginosa
RRRLTGQGSGPPPGKSFELPGAPAFHSPACHATAPATGAPAEEKTMSAKLQGKNVLVITANTGIERDELLEPLKTLKQQGATVTHATIEGGEAQTWVHDSEKDLIVNSDARLQGLRAEDYDLLLVPGGTVNADTLRQDSEARRLVREFSDAGKTVAAICHGPWLLIDAGVARGKTLTSYSSVRIDLTNAGADWVDTRVKVCPANGWTLITSRNPGDLQAFNEAIGEALQAAA

SEQ ID NO: 20592 - protein, 397 aa, Pseudomonas aeruginosa
SSFAEATGGHPEDRHLQRQRHPDPAGRAAGLAGAGSAGHRLPAGTENARRALPRRGAGEGRIRRDLAGPVGVERRRHPRPRQPAAGGTPRPAGQRQRSPQPLPRSGRRRPAGGQPVPAQWQSPAGTEVRLQAGLVRAPHPTRRRADGERPSGGAGRRLQRGAQRLRYLRHPLLEKGRPAPAGVPRVLRAPPAAGLGGRATPAFPRPAPLYLLGLLPPALATRRRAAHRPPAAQRQPGGPPGRRRGGSLGARRGARQRPRAGLGKPAASLRAPALAELAPALRIGSHRPSGNLATTLISKLKPYSQFTPTAVSVGYGASPQYSGTIFQMRSKLASASTMNTVTSSTSSNPQPAAASTAFRLSKARRTWVSSSGSGEPSSRLPTWPETNSRPSLRTAGE

SEQ ID NO: 20593 - protein, 348 aa, Pseudomonas aeruginosa
LFVESKQSPTTRSPDGPFRCDAGLCPCGGYRQLHQGGGDAAHEPHQRHPVGPATGSAAAGTPAQPHHAQAQPDRRRRRLLRAGGTSAGGTGRCRDQPLQRRPGAPRASPDRRTEPAGAAAADPGVARVPCALSGDPDRPGRERSARRPDRRERRLRHPRRRTARPVADSAAGRRPATGGLRGTGLLAARRRAEPPARTGGQPPAYRRLPLGAHRQGPALRHAQGRGMPAGGGPSCAGGGRRQRLPGGRAGRPGHPLAAALHGARAPRPRRAAAAVRGLEPGADAAVPGVPAEPPRQRQAAGVHRVGRRTDRAACAAVASAALKQGRRRILENPGVMVSGQGSIYAPRL

SEQ ID NO: 20594 - protein, 464 aa, Pseudomonas aeruginosa
LAAFANPGTPSDEPDLPRQLPVRRAALPTVLAPARTLSLPLRPVSQGPWRGIRQLWQRPRRGPAHRPRRRPARRVPLLTRRAPALLLALRLAAVLVEERRRVRRLGIGRPRQPEHALPGGETEACPGRIDGLLVQDRRRLAAFRLKSARDPPAGACFFAGKARAWGTMPRPSPPVLAAHVRHRAVHRPVPLLRPDVRRHRLPGAEPLRASPAPVVRQPGPAAPGPGLRYRPSRAALPRFRLSQRRPGHQPADARPRPTALSRSALQPAGHGRLPGGRAAGPDHLFPLFDPLQRRAGALARMPGQRAWRTGGWRRVLFQHGGQGADRQSRVRPPFRGASRQPLHLRFRLVLQRRGRAPGAAPRYRENHGRNNPDLGGRTPHGRPRLRRTAAPVADAFRGAGLRTRLRTDHALGRQLRECPVRLREALASGYPGANVTIRLARAGQRFTGGCGGFFVAFGTLRPTR

SEQ ID NO: 20595 - protein, 457 aa, Pseudomonas aeruginosa
TKVAKTPPAICDTFARFFTPAVESHRMSSPFSPRSPRTLRGLGALALCGGFVAPAPAAFLEDGSARLEARTVYFNRDFRDGSSANPQGASKREEAAQGFILDLRSGYTEGALGFGVDTLAMLGIKLDSSPADSNSGLLPSSGHDPRRSVDQYAKAGVAGKMRFSQTQFRYGAMLPDMPLLKYNDGRLLPTLFHGAQLTSEEIAGLRFSATRLERYTARDSSDAQDIRLHCKNKRYACDTTGNRFDAYRLDYQVNDGLLLQYAQGGLRNVYRQRYLGAVGKRQLGAGKLSADLRWFDSEDAGAARAGKIDNRALSLLLAYAQGGHTLSAGWQRMNGASSMPYLDGSNPYLANYLQVNDFANPEERSWQLRYDFDLRSVGVPGLSFMTRYVNGDHIRLANGDEGKEWERDIELKYVVQSGRFKDLSLRLRNATYRTDFERSARDVDEVRLIASYNLSLF

SEQ ID NO: 20596 - protein, 607 aa, Pseudomonas aeruginosa
AVAPERTPARRSGGSDRQGAFAQLDVEDAVVLRVIHRAIDHMHPGRAQAALQQRQEALGTVDPVAVGAVGLGIAHEVRVAVVQPEVGEAHVRLLPADHPVAVVAQDDHRQVHLQPHRGFQFLAVHHEAAIAAHRDDRPVRVDQVRGHRRGQAGAHGGEGVVQQHGVGHVRLVVAGEPDLVHAVVQGDDALRRQRPAHVGHQALRIEREARVVGAFGDLRLVGLADRQQAGEVPVRGIVQRLADLPDGVGDVAHHFDLREIHRVHLGGTEVHVDHLGTAANHEERRLLDHVVADVDDQVGRLHRAMHEVAGGQRGVAEEARVTLVDHALAHLGGDEGNAGLVDQLLEDLGGHLAVGPGADHQDRAARGAQLLHRGADRLVFRQRPAAQARRDGQAVGLLGGDVLRQLQVHRAGLLFLGQAERLADPRGNVVGGGQLVGVLGQRLHHADHVEDLEAALLGLLDRLLPGDHQHRHAAQVGVGAGGDQVGGARAEGRQADPGLAGEAPIGGGHEAGRLFVAGEHQPDLRLAQGLQQVEILLAGNSEDVLHALVFQALHNHIGCLGHLRSTSGGGGSDRSNTAPLASRCPAPPGRRKALAPASPASERRSRH

SEQ ID NO: 20597 - protein, 422 aa, Pseudomonas aeruginosa
TRMNTRGSAKPDESLTRRQRKGWDMAQDLRRPGRKVRSSMPAASGETPSFRRADVAVAHFFRRRVAVEGGVALAEVAGRDEAAGDQDLQHGQVGMLQQAPALGDPQLQVVAHRRGSELLLEQSLDLPPRAPHVVGELLLAERFLDIRRHQVDHFAQRLAHLLVQGGAHPPVARLLEGEDIHHRLHQVAPVAPGDPLQRQVEGAGGAGRGQAVAVDHIAVAGHLAVAGDLGEGGAVLGMDAAAVAIQQAGVAEEPGTVPQPGQGDAARRHVLQRFPQRGGRAQGRAQTAADHQQVESLQRRRGERQVRADQQPEVAGHRLAAQAEVAHREGLAADQVGGHQGVQRLGEGRQGKVFEQQEAHPRPCRAPLPGPGEPEVLPLQGGAETPSFHRFVPLVLLVPGQRAATPAVTAKTPGAPSYAQAM

SEQ ID NO: 20598 - protein, 252 aa, Pseudomonas aeruginosa
TKPMTSRKASMKAQPDVDSNSADAPFDRKAVLGDALRRRILSMELAPGAVVDELALCDEFGLSRPPVRELLRQIAAEGYIELEANRAPRVAAMSHDSLHAFFLAAPLIYIATTQLAATHASEAEIETLKAIQEDFRKAIEEKHVENRVIHNDAFHLEIGRMAHNDYLMPSLRRLLIDHARLGKIFYRHPTTDDMQRDLELACDQHDQIVDAIKRRDPDAAADIVRAHFELSRRRMAEYAAPAGVEVALVYEG

SEQ ID NO: 20599 - protein, 334 aa, Pseudomonas aeruginosa
TCSRRLRSPEPPAAAASAGCAAAQHPTGGTPVKFEGIYTPAITPLSADGSIDTQAFTEVLEFLVESKVHGIVIGGSTGEYYAHTAEERLALAAHASEVIAGRLPLVVGTGAIRTEDSLAYAEAARAIGADAILVGSPPYALPTSREIAEHVLAVDRAAGLPIMLYNYPARMGVEMDEAFFAAVAGCRNIVAIKESSGSTAQLHRLACRHPRIALSCGWDDQALEFFAWGARSWVCAGSNFIPGEHLALYQACVVENDFAKGRRIMAAMMPLMDFLESGHFVQSIKHGCELAGLRAGGVRAPLKALDEAGKAALAEIVARLKGEVARIVEGGRHD

SEQ ID NO: 20600 - protein, 336 aa, Pseudomonas aeruginosa
AAEPGGIRGHRRDAGPSPARLHRRRVPRCLRRPHLRLDQPGHRRAAGAGRRLRRGGRRARRGQRAAGVRGRPLALAHARRAQGGAAAPGRAAGRAPAGTGGDGEPRQRQADPRMPAHRPAGNHQYPALACRTDRQDLRQHRPGRFGGAGHGGTRADRRGRPGAAVELPAADARLEDRPGAGGRLLRSGQAGPRDQPDRPARRRTGQPGGDPRRGVQRGPRRRPRGRRTAGPPPGRGDGQLHRLHRDRPPVPQVRRRVQPQAGGTGVRRQEPGGGDERCRGPRPGGATRGQRRVLEHGRELLGVLAADRPCRSPRGAARTHRRAAPRVAHGRPAGSV

SEQ ID NO: 20601 - protein, 626 aa, Pseudomonas aeruginosa
SPRRAGQPGALREGPRVPRPGQDGAVGGALRRRHRGWHLRRADRGRWRLAAQPAVPRGNLRPAALGHLFRRHRRSHRPGQRHRLRPRRLGLHRQPAPRTAPVAGDPRGDRHRQLLRRGRRLDALRRLQGVRLRRSRQVGLGTRPVHRVEDHLDRRFLKLSGPQGPALPPGGETGQPGRTGDQVQTTPILHNVPSLCCCLHPSLFRQERHGDSSMTDNHIDVLINGCGIGGAMLAYLLGRQGHRVVVVEQARRERAINGADLLKPAGIRVVEAAGLLAEVTRRGGRVRHELEVYHDGELLRYFNYSSVDARGYFILMPCESLRRLVLEKIDGEATVEMLFETRIEAVQRDERHAIDQVRLNDGRVLRPRVVVGADGIASYVRRRLLDIDVERRPYPSPMLVGTFALAPCVAERNRLYVDSQGGLAYFYPIGFDRARLVVSFPREEARELMADTRGESLRRRLQRFVGDESAEAIAAVTGTSRFKGIPIGYLNLDRYWADNVAMLGDAIHNVHPITGQGMNLAIEDASALADALDLALRDACALGDALAGYQAERFPVNQAIVSYGHALATSLEDRQRFAGVFDTALQGSSRTPEAPGRRALLPAGAVAGAARLNPPARPERSVRPRA

SEQ ID NO: 20602 - protein, 246 aa, Pseudomonas aeruginosa
PFPAGSSGLLGIAALRLAAFEPEGETRQSEAQDEIGEAEDQVDLGRQGEHLGIDLRGDEADFGQADDVAQGGLLDRRDELVDQRRQHVAQRLREDHQAHARQVAQAERTRRLELATVEALDAGADDLGQVHRVEQHKRQQHGGELVGALAGEGRQEEIGPEDHHQQRHPAHHEDQRGDRPAQPAPGADPRQAEQDAQWQRQQQRQRGQDQGQGQPAQRPVGVLADEEVQPVAIDQFQGGHRRSTPG

SEQ ID NO: 20603 - protein, 146 aa, Pseudomonas aeruginosa
RHGRRRATVRGAGRASPAQRSAAYRWPPAAGLRRRPAGRGRRPCHAPRRHAASARRARRRNAAIRPEPAGRRAPAARATPGRWPGSARRRPAAAPATAAPGYRSAPAAARPGTRPGACPDVRAASGAAHRPARPAARPRAAGAGGC

SEQ ID NO: 20604 - protein, 555 aa, Pseudomonas aeruginosa
  UNSURE (202): Identity of amino acid at the above locations are unknown.
PLPRTELTISHGVLFMSIFEQGLAPAAVNHIALTPLSFIERTASVYPHYPAVIHGNIRRDWAQTYQRCRRLASALAGRGIGQGDTVAVMLPNIPEMLEAHYGVPMIGAVLNTLNVRLDAEAIAFMLQHGEAKVLITDYEFHEVIHAAIGMLDHPPLVVDVNDPEYGEGRPVGELDYEALLAEGDPQFAWEWPRDEWQAISLXYTSGTTGNPKGVVYHHRGAYLNALGNQMTWSMGQHPVYLWTLPMFHCNGWCYPWTVTALAGVHVCLRRVDPQKVLTLIREHQVSHLCGAPIVLNALINMPDSAKAAIDHPVHAMVAGAAPPAKVIGAVEEMGIRVTHVYGLTEVYGPVTVCAWHGEWDDLPLERRAAIKSRQGVRYPTLEGVMVADPKTLEPVPRDGQSIGEIFMRGNTVMKGYLKNPSATEEAFAGGWFHTGDLAVCHPDGYIEIRDRLKDIIISGGENISTIELEGVLYRHPAVLDAAVVARPDEKWGETPCAFITLKSDHQGLAESEIVAFCREHLAAFKIPRTVVFSELPKTSTGKIQKYVLREWAAAL

SEQ ID NO: 20605 - protein, 632 aa, Pseudomonas aeruginosa
APPAELPVQRPCHGGRRQDAHGQPCTCGRPAGRSPTRCAMPEYNAPLRDMRFLLNDVFDAPALWQRLPRLAERIDADTADAILEEAAKVTGGLLAPLNRSGDEEGAQWQDGAVRTPAGFREAYATYAEGGWVGLTGNPAHGGMGMPKMLAVQFEEMMYAANASFSLYSTLSAGACLALDAHGSEELKNRYLPNMYAGTWAGSMCLTEPHAGTDLGIIRTKAEPQADGSYRISGTKIFITGGEQDLTENIIHLVLAKLPDAPAGSRGISLFLVPKFLVGDDGALGARNAVHCGSIEHKMGIKASATCVMNFDGASGWLVGEVNKGLAAMFTMMNYERLSIGIQGIGCAEMSYQSAVAYARERLQSRAPTGPVARDKAADPIIVHPDVRRMLLTMKALTEGGRAFSTYVGQQLDLAKYAEDQEERSQAEALVALLTPVAKAFFTDTGLESCVLGQQVFGGHGYIREWGQEQLVRDVRIAQIYEGTNGIQALDLMGRKVVANGGLFLSIFSREVRAFAAGANAELAEFVTPLLTALDLLDNLTQGIVARAGNDPREIGAASVEYLHLFGYTAYAYLWARMAAAAQRQREVDPAFHDGKLATARFYFARILPRVHSLAAAVEAGSESLYGLEAEQF

SEQ ID NO: 20606 - protein, 251 aa, Pseudomonas aeruginosa
RRITAKRLFSLRRPGSRPGILEKRRNRRLFARQGTRTYPCEPSPPSSATARNSTAAPCSAMPRARSGHAGCSPMRRTASTSAAVPCWCATASATYWWRPASARSSRPPCASATASRKSATYCSTASPRSAWTTPTSTWCCSPTCTSTTPAACSPPGKKASRRACCSPTRISSAAAATGSARASRTRATEPRSCRNCSTCCRPADAWSCSTTASARRIWARAGVSISAKAIPRARCSRRSPCPTARWYSAAT

SEQ ID NO: 20607 - protein, 147 aa, Pseudomonas aeruginosa
LNRDSHRRAQRTASLSRAVPRPACAAVRRPAAPAPAPRPGRPTGRRNHGCREPERRSATLWSRRRRTDSPARAALQARRHRRTSGWAGRGRCARTWSRSARCAPRAAPSAPRGRRRWPRTPDRGRRRCPSARRSRPAPGRRGCPVRP

SEQ ID NO: 20608 - protein, 288 aa, Pseudomonas aeruginosa
RDRSMDLSSLEIFRAVAHEASVTRAAQQLQRAQSNVTTRIRQLEEDLGVELFLRDGKRMSLTERGSEFLAYAEQLLALADEARQSMHPAKPGGRLRLGSMESTAASRLPALLASYHKACPRVALEVSTGTSRALLDGVRARRLDCALVAAGPGWAGELDGSGLRGEPLFREELLMILPAEHPPVHDVAEVRLRTLAGFARGCTYRQLAEDSLGTPLTVQEVGSYHAILACVAAGACVGVLPRSVLQLLGTPPLRSLPLAEVDTWLVWREGYATAAFERWRGVLGQAGD

SEQ ID NO: 20609 - protein, 261 aa, Pseudomonas aeruginosa
AARGEPNGLAPVQPRAIRTIASQGVAHEKTAHPLPAGPRAAHRRGAPGPGRQPLQPAGGDLYRRLQRRHPGIPLRRRRRLGERPAARGPYQQPLVPDLRPGPTHSVRGQRERTGRQGRYRRSRHVLPFRSDQRPPATDQPGPDPRRSSDLQQPQPRRSLPVRRQLLGTAGRLGGGTAGARGRLAGAGGAGGVAPGQQGASAPGFRSCALGGVLARRPVPVRPRPRRRQGIRLPIRPGTGRTSAAGGRSGIRPDPARQRPAP

SEQ ID NO: 20610 - protein, 399 aa, Pseudomonas aeruginosa
SPRPSPARNASGCARTSPWPPPTRRPEAIMQKPVLIASAALICAAVIGIAVYATGSAKKDAGGFAGYPPVKVALASVERRVVPRVFDGVGELEAGRQVQVAAEAAGRITRIAFESGQQVQQGQLLVQLNDAVEQAELIRLKAQLRNAEILHARARKLVERNVASQEQLDNAVAARDMALGAVRQTQALIDQKAIRAPFSGQLGIRRVHLGQYLGVAEPVASLVDARTLKSNFSLDESTSPELKLGQPLEVLVDAYPGRSFPARISAIDPLIGKSRTVQVQALLDNPEGLLAAGMFASIRVSRKADAPSLSVPETAVTYTAYGDTVFVAHQDGDRPLSAKRVSVRIGERWDGRVEILQGLAEGDRVVTSGQINLSDGMAVEPVKEDTLSSAAPPVPVAGR

SEQ ID NO: 20611 - protein, 1033 aa, Pseudomonas aeruginosa
RNPAMTFTDLFVRRPVLALVVSTLILLLGLFSLGKLPIRQYPLLESSTITVTTEYPGASADLMQGFVTQPIAQAVSSVEGIDYLSSTSVQGRSVVTIRMLLNRDSTQAMTETMAKVNSVRYKLPERAYDSVIERSSGETTAVAYVGFSSKTLPIPALTDYLSRVVEPMFSSIDGVAKVQTFGGQRLAMRLWLDADRLAGRGLTASDVAEAIRRNNYQAAPGMVKGQYVLSNVRVNTDLTNVDDFREMVIRNDGNGLVRLRDVGTVELGAAATETSALMDGDPAVHLGLFPTPTGNPLVIVDGIRKLLPEIQKTLPPDVRVDLAYETSRFIQASIDEVVRTLVEALLIVVLVIYLCLGSLRSVLIPVATIPLSMLGAAALMLAFGFSVNLLTLLAMVLAIGLVVDDAIVVVENVHRHIEEGKSPVAAALIGAREVAGPVIAMTITLAAVYTPIGLMGGLTGALFREFALTLAGAVIVSGVVALTLSPVMSSLLLQAHQNEGRMGRAAEWFFGGLTRRYGQVLEFSLGHRWLTGGLALLVCISLPLLYSMPKRELAPTEDQAAVLTAIKAPQHANLDYVELFARKLDQVYTSIPETVSTWIINGTDGPAASFGGINLAAWEKRERDASAIQSELQGKVGDVEGSSIFAFQLAALPGSTGGLPVQMVLRSPQDYPVLYRTMEEIKQKARQSGLFVVVDSDLDYNNPVVQVRIDRAKANSLGIRMQDIGESLAVLVGENYVNRFGMEGRSYDVIPQSLRDQRFTPQALARQFVRTQDGNLVPLSTVVRVALQVEPNKLIQFDQQNAATLQAIPAPGVSMGQAVAFLDDVARGLPAGFSHDWQSDSRQYTQEGNTLVFAFLAALVVIYLVLAAQYESLADPLIILITVPLSICGALLPLALGYATMNIYTQIGLVTLIGLISKHGILMVEFANELQLHERLDRRAAILRAAQIRLRPVLMTTAAMVFGLVPLLFASGAGAASRFGLGVVIVSGMLVGTLFTLFVLPTVYTLLARNHAEVDKSPRSRQLAEADLLVNKA

SEQ ID NO: 20612 - protein, 156 aa, Pseudomonas aeruginosa
RSAPAWPPAASAPTTSVRSRRRHASPASTSASSPASGGKRPGGVSSTIRNWCAWSTRRWRATTTSARPAPTCAAPARCSTTAGSTSCRRSPARPATAAASNNSWTTTASRAGAWRRATAPASTRSGKSTCSAASADFPTPPWPAPKRPTPTSGWYA

SEQ ID NO: 20613 - protein, 415 aa, Pseudomonas aeruginosa
SAPSGNWQRALKTSARPPPNSIRASTWAASSVSSPCAAATSAAPRAPSNWRPASVGRRSAWATCGPACAPSRRSPTPRWRATSAPCCWPRRTSATRSTNWPNTSVGWSPCSSPRPMARTPWRSPTNATAPAPAATWRCWRTSARCTRSARNWRRRRPPRSSTSSRSTRRSAGAAATWRRAPANWPPAKPPGPTVESSDSGPGSDDHAGFHRQVDDPLHREAAAPEQVDHLLGGAVTASAGHEQVHVPEHRLRRRLAGRDGPLDHHHPAVAGHRLAAIAEQPQAGGFVQIADDPRQQVDIAVGRHLLQHVAAHQADALPCQQAGEVVAGHAEGNLRGRASRPGRWARPAGWPWSIRRNRHRRRRSYARGNPGAWGSRGRPGCSPSSPAGSAGRHPGSASGSYRSLRRTPARSLGYR

SEQ ID NO: 20614 - protein, 177 aa, Pseudomonas aeruginosa
RYSHLNDIYRQGALTMPDTTNPIGFTDANELREKNRATVEKYMNTKGQDRLRRHELFVEDGCGGLWTTDTGSPIVIRGKDKLAEHAVWSLKCFPDWEWYNINIFGTDDPNHFWVECDGHGKILFPGYPEGYYENHFLHSFELEDGKIKRNREFMNVFQQLRALSIPVPEIKREGIPT

SEQ ID NO: 20615 - protein, 164 aa, Pseudomonas aeruginosa
SASGASPGSTPSRVPSRTSRSASRPCRSIAATWSTAARPMPNSAGPIRSGSSRAMRRRATSCATWAGTPRPGRRRMPRRSGPATRCCCSTTSCRCCARTSSAGSISVRPTGRGSASAPARSTAPMWRCWPRCSTRWPARSARRSAATSCWRSASASTRAASRGA

SEQ ID NO: 20616 - protein, 853 aa, Pseudomonas aeruginosa
WPGPAQKRSRAQPSPWRPWHERHSRNHRLSLADRPAVAGQPGALEPGAAARGAAGARHAALLPAPAAREPARRTGGQRRAAAPLVRRAGRADRLHRPAGQHDRGAARPAQGLLGAGHVRQSGRPRGGRGAGAGAGRLAADQVALQRLLPLRPAPADARRRPRPVGAVRRIRPRRGADLHGRRLLQRHPAVPGGRRHRRLQRGAPPHGPGIRRQPLRDGGHHRRGAGMNALPTSLLQRLLERPAPFALLYRPESNGPGLLDVIRGEALELHGLADLPLDEPGPGLPRHDLLALIPYRQIAERGFEALDDGTPLLALKVLEQELLPLEQALALLPNQALELSEEGFDLDDEAYAEVVGRVIADEIGRGEGANFVIKRRFQARIDGYATASALSFFRQLLLREKGAYWTFIVHTGERTLVGASPERHISVRDGLAVMNPISGTYRYPPAGPNLAEVMEFLDNRKEADELYMVVDEELKMMARICEDGGRVLGPYLKEMAHLAHTEYFIEGQTSRDVREVLRETLFAPTVTGSPLESACRVIRRYEPQGRGYYSGVAALIGGDGQGGRTLDSAILIRTAEIEGDGRLRIGVGSTIVRHSDPLGEAAESRAKASGLIAALKSQAPQRLGSHPHVVAALASRNAPIADFWLRGASERQQLQADLSGREVLIVDAEDTFTSMIAKQLKSLGLTVTVRGFQEPYSFDGYDLVIMGPGPGNPTEIGQPKIGHLHLAIRSLLSERRPFLAVCLSHQVLSLCLGLDLQRRQEPNQGVQKQIDLFGAAERVGFYNTFAARALQDRIEIPEVGPIEISRDRETGEVHALRGPRFASMQFHPESVLTREGPRIIADLLRHALVERRP

SEQ ID NO: 20617 - protein, 506 aa, Pseudomonas aeruginosa
ARRAHAQICRDRRLRQRTAARQPGGGVLRLRRPQRRAHAAHGAGDEPVGEHLRTPPATGRRRAHPHLHPGQRTAVRRPPAAGHRHRPGRRDRQGQAVPGDQDGHRALRPGAPGRQGGGLQHAAADPHLGALQPPGRAARRPRPEGLDLSHRGLPQRPAPRLRRPGERRRAVRAAPRPPRAVRLPGPGGETASPAPGGTGAAACSRRPTAWSRTPPPVPPPGRWRSTWRATGRFPTGSRSRSSRASRSAGRRACTPAPRAPASGSRRWKCRATARPSPKAGPTCERAERRNAMMGVNANISESLTGTIEAPFPEFEAPPANPMEVLRNWLERARRYGVREPRALALATVDGQGRPSTRIVVIAELGERGVVFATHADSQKGRELAQNPWASGVLYWRESSQQIILNGRAERLPDERADAQWLSRPYQTHPMSIASRQSETLADIHALRAEARRLAETDGPLPRPPGYCLFELCLESVEFWGNGTERLHERLRYDRDEGGWKHRYLQP

SEQ ID NO: 20618 - protein, 220 aa, Pseudomonas aeruginosa
PGGGGDTAQAWWSPVTRGWAGGAAARACIQACRMSSAPQRIRVRSGPRAGSRPRMSQGARCATAAARQASPGTPSNPRASGQSPGSSNAARPAAAHRTRNSRPVQGPASSSEGTSCSPSRSNAAAATRPAQKPWLRRCKSRTRASGAEARRCSHRYRPLAQSRQAPRPIARCRPRNAADQPGPSHWYWAKCNGCTAMKARSQNPRCAELRSPSRAPSASR

SEQ ID NO: 20619 - protein, 830 aa, Pseudomonas aeruginosa
ATGASSRVPSAPSPLSAPVKPNNSSQGSPQMPIRPCRSNSARRSPRSRRQRRRSRQRRLCSTTPARHSSNSDTPNRLTTTRPGKPTNRLLCRFSRRSIAGVGGNTPAAGRVEVQPAVQARIADAEGGMAGSRQQQGRIADVDAFLARPFEQALQRKGFSSRLRRGPQPLAQVVVAKTPGATEQHHEQQHAEQRAGATVQREQERTRRHFNRAPPAATTPGPVPAGYRPGARRSCPDHAPATRRQAATSPPRARRRARRRDARAGRPGAARESTDSRWRSPPPGCRRAPAEPARPSRSPTGAASERAPQADVEAARFAVAVVPVGVGQALVVGPVEQVVDVDRRRPVLVDLVAQAHVDQCVAALAHAHAAVVDAVVALRLESAADAPAPILPGQVVVAPQAQQVPRGEGGVARPRVVLAVLEVLGAGVGVAGRETPVGRQVAGAFQLEALAAHLAAADVERIVGRPRMVRVFLRIVLQVDAERRQRQVQAAVGQFALDPGFVGLAFHRAQRLAVPGLAIRLRLVDLGVADIPRPVPGEVPDQPAVGRELATGLEAGGRGVLVPPAFAAADHQGQRLGELDPTQGIEAFLGGGGGARRSVLADLRARHAVRVPAVDIDRGVRQVEEACGVLAGLALGVGDPTEQFVGQAEQSHRPIEVGVEAALDALELVGGARQLATVAGLRVDGAEGAGVTQARIGFLVFGADLAFPAAAQLLFEGAERAVGVPLETVPVDIEVRVAGQPEIGPILGHRYPGHVGDRVDVLVLRTDGEQGVGAQVELGHPVKAGGCPGRPRRKSSRGPRRRPPLGRARCRWRSAGRRRRPRRGSGPSARR

SEQ ID NO: 20620 - protein, 91 aa, Pseudomonas aeruginosa
RASAGRWVTTIRVRRPRNPSRLRSTCASLAASRLAVGLSSSSNGAVESSPRARHRRCRWPPDSSAPPGPTSLSQPCGQASISSSRPTARAA

SEQ ID NO: 20621 - protein, 493 aa, Pseudomonas aeruginosa
  UNSURE (355): Identity of amino acid at the above locations are unknown.
SRPSSASRLLLPAPEGPTRTFSEPGSSLREMSSSKARPFSRRNSTASAARLASCGRSPGLGTAQRSQGENRQQGIQRLARRRANAWSRWVSWASGSMKRTSSTSTATSRAPSSHCRSTAQAPPSRAKANAACTARVKPRPLGRLRRNRSRVLRWRLRKASSSPWRATLSRCAARSSGWRSANACNCRAASRSAASRASSAARLRRPLQRNSAARKAPARSRPRAMDGSIRNSPRITPSGVTNAAISGPSRCAGMPIACITGPRSRPSAGATRRNAGGARRGKRATRLRTSPAASEPPAAKPRRMARYCNSACARLKPSNAATQRQGNAPSANQASTNGTSNTPQAASSSAARTAXALARRNAARQSSGSARIRSNRVMPPPPRRSVHATSAHRRRPPPTGRGARRVRPDGQGTSTRIRSASLTSAKRWATITRVRPPPRSRRLRRTCRAVCGSSAEVGSSSSNRRAGDSSARARASRCSSPPDSCRSRPGTLS

SEQ ID NO: 20622 - protein, 163 aa, Pseudomonas aeruginosa
RAERSSRKPAAASTSGSRQNSSSQGCSQASQSNATSGTTNRLLRSLGACAISWCRARTSCSTRRATPSGPWRPNQSSGSRCRCASRRRRRSLQRSASTRWARCAASAWQPSQASTASSTRASRAGCAWPRASGSASQARSIQGNSEQSPARACNPMAAASRQR

SEQ ID NO: 20623 - protein, 174 aa, Pseudomonas aeruginosa
GKTRKSTKKRRKTVNARKETTKTTKTKTETEIRRGQRQGARRRAKKGQTKEPKSRRPDPGGAPKERRGQERQESTQTRKEKKKNKTARRREKEKKTKGATRRDGKKRNEREQETGDTTKQREQDKRQGAKEKNKRKEAKEEERTRKTTKARGTDKREGEGIKAALLSLARFSFP

SEQ ID NO: 20624 - protein, 173 aa, Pseudomonas aeruginosa
SRRTSTTRCSTTSTRWSRRRAWPVRRWWCRKPSTRCCRSARPGASTVASGACAACRPWPTTACSRIPTAWPRRTPWMSTTVHRTTTSGRCSASARCWCLTTATRCTRRASPMATYSRAASSIPTCCATSCIASGWSRRPCARASAIPTPSAASTSTKTAGRSSPPTSTTRMAC

SEQ ID NO: 20625 - protein, 383 aa, Pseudomonas aeruginosa
MAATMRLAMPASCSRLSRSCSTARKNARIAWLMPTVVRLPLRLRRTFCRCCSMRSLRIVSRSVAPWCCSRRWLVFRLSRRRWWRPWSSLVFAVSSNSSWPLSRCLSSSSARCSSTFSRRRRSRCWLLCSRPRTWPSTEFSSSASFCATMRSQSSASSRSRRLRSSSAGSPRTLASSACFADSGSTSPRCRPSWRAVPSWIRRMAFCTKRSPERSSQSTSILFSTANRLLWPSSRSGWMYFCQISMSEAVTPASADSRNRIAWALGSIDRVSSGSLPRAFRPGVSRIRRPWRSSGWSKLTRAWRQAGTRTWSGSSAASRASGWKPSWIACSTGSALVLATWAKAWAMPSGSPVSSGMFTQWRGTRLNWATLASARRVSIGSRRM

SEQ ID NO: 20626 - protein, 270 aa, Pseudomonas aeruginosa
GGSSGVRRAARRTRRGSPWAAGGNRGAGPRRPSGRSSEEDAQLLGHAGHGRQVVDHQHVDQLQREEREDRREIQSAEVRQELAERHQQRFADLVHQLRAGVVAARGDPGKDHADDQGEEEHLQEQRGDGDDRPDQQLHDEAADAVAHQHQDQDHQHQLDQDRQHQRGQVDPTEAGDDPPQRVQQRLGGAHDELAEGVVEVRADQLQDEAQQHDQQVEAAEGLEDIDSSGVEADHRLLLIGQAVRPARRSAGWRRSGPAPPVLRSRWPGRI

SEQ ID NO: 20627 - protein, 561 aa, Pseudomonas aeruginosa
SPPRWCRWAKSPGAAVRPARPRWTAPSAPRRGRSAGSGARLSRGTGRASRRRRSWPASAGRNAAAQQAGTHRTARFGRGVNEMRKPAFGVSALLIALTLGACSMAPTYERPAAPVAHSWSGAAAQRQGAAIDTLDWKSFIVDAELRRLVDVALDNNRSLRQTLLDIEAARAQYRIQRADRVPGLNAAATGNRQRQPADLSAGNRSEVASSYQVGLALPEYELDLFGRVKSLTDAAMQQYLASEEAARAARIALVAEVSQAYLSYDGALRRLALTRQTLVSREYSFALIDQRRAAGAATALDYQEALGLVEQARAEQERNLRQKQQAFNALVLLLGSDDAAQAIPRSPGQRPKLLQDIAPGTPSELIERRPDILAAEHRLRARNADIGAARAAFFPRISLTGSFGTSSAEMSGLFDGGSRSWSFLPTLTLPIFDGGRNRANLSLAEARKDSAVAAYEGTIQTAFREVADALAASDTLRREEKALRALANSSNEALKLAKARYESGVDNHLRYLDAQRSSFLNEIAFIDGSTQRQIALVDLFRALGGGWDEGRSLVVHRGGRS

SEQ ID NO: 20628 - protein, 434 aa, Pseudomonas aeruginosa
PWIAGRFRSMTTDRFSFLRRPALSLAAGLAVVAALAWLVLAGGTAKRTEGERWVAVRAAPLVHQIGLVGRLEPGRVVTLAAPFAGNVEALLVEPGQRVAEGQELLRMDTREIAVQVREAQSALLKARRTLQDLRDWERGEDMARVRRALRSAQLAQSSTERKLRETRELFQRGIVPRNELDDLEQQASQQRMDLEAARREVESTRAKGQGENRQIAEMDLANASVKYETLQAQLDGRTVRAPFAGIVVAAPGLAGEQGSREPVQAGSKLGQGQALFGLASVERLKVSAKVSELDINQLREGQAVEISGDGFEGTTLAGVIAALGGQALPGMAQGGSPQFEVTVSVAPLDPRQLQKIRLGMSAKLTVTTYRKEQAIVVPPEAIRHEGDRLFVDFRQAPGASVMAQQVKIGRSTPEGVEVFELQPGLVRVPSSSDR

SEQ ID NO: 20629 - protein, 220 aa, Pseudomonas aeruginosa
SLSRIPVRTAKAGGVVRLAGGSDGKAQGGRGGGSATILPHDQGSATASVANSLEGYKTMKSIKSLPSFAALALCLSVSSMASAATITPVNSAFTAPGTISVSSPASLNLPVTCNITFKGKTAADGSYASIDSVTVSGSNTLCSVPQMTGLPWKLTVSSTTAGKVDGVGFKILSSTCGPSTVNGSWSNATNTLSASNQSLAGNCKINSLSVKPTPAFVVNP

SEQ ID NO: 20630 - protein, 406 aa, Pseudomonas aeruginosa
DRLPVRPVQAPVQPVHLGADRQGPELWRQPDPPGGDRLRLRLLRPGNAQGSWPRLRRPAGGDLRLGQRRPVRGAQGHGNGRQGDLAVRFRRHPVCRGGALRRAVGIPDGAEERAPRAHPRDGGAVFPAVPRRAPALGPGLRYRAALRDPERTGCRGCAAPAGQRLRLCRRRRQHALDPGSRRPVPRGRHPLRAGQGVERRRGGGERPGDVAERHAPALERGRGGYQAARHHAVDPPCLPAVRRGAGAGQLREGGEHRRLRQGRRCDAGAGRGLRSSHRGKTGLQGSPVFPCGGYSAGRGVVSVLAGSSGYSTRGCLPLRLCRKATMFSTSSGANCLPSWALPMIATASLSSQTWPLWKYGAVRATLRRGAARNTYSSLWVLVTAKRPLSPLGSTLASGFFTRPNGK

SEQ ID NO: 20631 - protein, 137 aa, Pseudomonas aeruginosa
RRPGRRRRRSRRCARSRSAAAGRCPARGPPRGTPAGVLRRSNRGAGGPSPAHARRRARESRRAAPAPGAAAPRRDAPVAAAASVPGVPAPAARHRRRVRSRGAAVPGRLPRPSAATAAASCRGESPPAAPVDCGCRR

SEQ ID NO: 20632 - protein, 630 aa, Pseudomonas aeruginosa
PLERHRRQAQACIQPTHREQRTQDVEVFLQPDAVALQVAPVVLACHRQVVMATAWYGVKGAAQPEQFLAHARLFPIHQRRAEPLQQGRVGFAHQAQRLAQFPAADVQLVAQRTFYHVARFLDALIPLGLMHIDEAYVVVAVRRSEAPGPAARLAGVEHDYVVLAFDPFQLIQYPLAHGGGERMAFFPVHFDSSPAGATGRPSSFHAHHLTQGVQHFHQLALGFHDPVDVLVGHRDLVDHVGVLAAFDVGGGARLVGDAEDLLRLGPAHGPPGAVAARAERFLVAEAADDEALRPHRAGNDAELALLRGHRAFAGDQYLLAEVALLLHVVVVAIDRLQVGFERLADHLARRLDHRVHHQRAVLPGKILGPADRFHVVVEVPAAFLEVGQVLVRQVGDVLAHVRLGQFDEQVADGVADPARTAVQHEPDAVGLVQADLDEVVAGAEGSQVLAVVGLLQPRVLVGDRLEATGERLPGLVGGLRYLVPGAAVAAAEGLAVGYRLLDGAAQAVQVVRQVGGDQRGARGDHSAADIHAHRGRDDRAEGRDHATDGRALAQVYVRHHRQVLEDEGHLRRVQQLLARFLLHRDALGPELDRLAAGHFEDIHVFHRAFLVLRAVLSTARLSFVIRPASA

SEQ ID NO: 20633 - protein, 533 aa, Pseudomonas aeruginosa
AVMKRTVAIGFIGATLDRLGKGAARWQKWRPSIGLCQQPDLLIDRLELIHGNDARDLGLAERIRADIAAVSPHTEVRLQQMELRNPWDFEEVYGALHDFVSAYPFDTEREDYLVHITTGTHVAQICWFLLTEARYLPARLVQTSPSRRKDEARHPEGSATLIDLDLSRYDRIASRFRREQEESLAFLKSGIATRNAAFNRSIEQIERVAVRSRAPMLLVGPTGAGKSFLARRIYELKRSRHQLDGRFVEVNCATLRGDGAMSALFGHVKGAFTGAQNAREGLLRAADGGMLFLDEIGELGADEQAMLLKAIEEKRFFPLGSDREVESDFQLIAGTHRDLRGRVAEGLFREDLFARINLWTFELPGLAGRREDIEPNIDFELERHAREQGRQVRFNLEAKRRYLAFAGSSEARWAGNFRELSASITRMATLADSGRIDEALVEEEILRLRQAWGLDAGREPLADLLGQRVEALDLFDRLQLQAVLEVCRGAKTLSEAGRRLFAVSRQDKRNPNDADRLRKYLARFGLDWAQIRA

SEQ ID NO: 20634 - protein, 227 aa, Pseudomonas aeruginosa
VARAHPGGAQPRRGEGPRPRSRRLRRGTLERRAGGNRDRRQPRQVRPERFAEEIPSGHRRPGAGRGQPGGRDLGHRPGRERSPGSRAGDLARPQPARLRPDGGAPEAGSVVVPAQLQLHLVDRLADMAELAFGAQAQAEVAAQLHLLDEAQAAAHFTVVEVVALGLQGQVAQRVAPQQAAVEAHRRGDGGGEVPVVLDPRGAHGVEQQVVAEHPRLCKNVGIDLAVI

SEQ ID NO: 20635 - protein, 266 aa, Pseudomonas aeruginosa
SIQISGGTSMKRFIQGEHRGQSSLLPESLDDYVADTNPVRVVDVFVDELDLGQLGFDGVVPAETGRPAYHPADLLKIYIYGYLNRIQSSRRLEREAQRNVELMWLTGRLMPDFKTIANFRKDNGKAIRGVCRQFVVLCQQLGLFSEALVGLPTGTSFQAGHNGERHFHQRSTFTGEWEEDRLPAFNRLPEPHWNTPGSSGDLPLGPGSKPKPLPRQVSRNLNTKTARSPREIKGSPPPNLREKPDFPRPNPRCSFARKNTLRPGNG

SEQ ID NO: 20636 - protein, 161 aa, Pseudomonas aeruginosa
LRRAGSAAPLRGRRQPRSAAAVLPRSLAQEAPPQAADRPAGIRRTGAAQAEGRRRAAHGHRLGALCRAYAGRHERGAGLPQPGRRRPLRAAPARASGDQVRAARGAPGTWRLGPQVRARRLIHRTSDVPLAPNRRRDSKQTGNTRRTSPSSCTFPGFGRIQ

SEQ ID NO: 20637 - protein, 486 aa, Pseudomonas aeruginosa
ERHGSAGCKGDCCVEETGHPVARGRLRLGGAGQGRRSPGRTPGPGPDPAGGGAGRQRRWQHPALDRRHHPGAGRLPARHASPRPVRRRSSAPGPRQPQHGRLPGAADAGHPGLAAGQPGIPPAGLPHPPQRIPAAAPVRRYPRQRQPRRADRRRQRRAGRCRRRALPPAAERPGSDLEPHHALPRRATAPADQPGGGAGQRQLQPAQARPLPVLRLWPRGDDPGEPRQHVVLLQVQGGRAGAPGRFGAGGAGNPRPGAVDPQGLALQPWRAARAPLADPGLRQPAAGYQRHGHGGHRGCLQRCTGPLRVGVARQARDAGALQQLRGAPEGPRLWRHTQEPLHQSRPAALRAASRLGGRGDPAQGLQPSLRQAPLLPRRRQLADPRRRHLRQGWRADPGPGGPSDQLLRCAAGLQHPGSDLRLQGRPLLRRWAGQQRADVRLRRAGRAARLHPAGAAPGGELRRTALRRSARRRVACRRRPGAPAPG

SEQ ID NO: 20638 - protein, 460 aa, Pseudomonas aeruginosa
PLTCLWSRSQARSSPSPQPRSRTRLPAGIHSWMISRSARIGSSHADAVHVTAEGLQVPGDRHEEGVVALRGVDLQVADVLFRRDQGVDDFPRAGRRETPVGGEGHQAEVRLDALQGAHQVVTMGGGGVEIVQRLGHQQVGIGVEAGGELLALVAQVALDLELDAVQVVVELLGLQYAAELGAHGVVGQVGDMADHPRQLEAALGNHALFLEVAAEELRVGKNRLPGDFVEGDVLRRQLRRAGDAQAVTDALGVADGPLQRLHAAEAAADHRGPLADAEAVCQARLAMHPVFHRDHREVRAVDLAGRRIDAGGAAGTVATAEVVEGNDEELAGVDRLARTDAAVPPARLALVDAVVAGGVVVAGEGVADQHRVALRGIQLAVGFDHQVVLGQGLAAGQLERFVEVQRLGGDQTDGVVGEDCGHRPCSRTKEGASLKSVAPSGKRAGARRGSGVRRAASRAG

SEQ ID NO: 20639 - protein, 171 aa, Pseudomonas aeruginosa
AGGGGGGRGRPWSSRSVRTAVGRCRAACRRAARAVPRPSPGAGAADAGCCAAGQGPGRARSSPAALPSARRCARRAALPADPGDCVRAAPVRRGPWPAAPASPTAAARRRAAGRAGGPCRPGSGGWRSVRSARRKGRPRARRSCSARRTGCCGRPRAVAGCTSARYPCPRR

SEQ ID NO: 20640 - protein, 165 aa, Pseudomonas aeruginosa
GRSSGSSGDPQFLRQSGRTADAHPFLPVQLAAFETHQALGHAEGLAEEGQQMGVGLALHRRCGEADLQAFAVQPGELVAARLGLQVAIEEQVLAVPAVEAQRKMLNCWGMPVMAARLLITSMSISFSARNAKIGERSSPPRFGRSLRNGISSGSQIWFTSCAPGL

SEQ ID NO: 20641 - protein, 298 aa, Pseudomonas aeruginosa
WSAQPIRALNTACPERPRHMAKPGGIEYRHWPGGPAATFARRWRLGVSLPVVAACALSPSSAVWPFGLYRRPCGGTTGRALKGCERSGANANNKQARTIDLPAGDRQGLPPGGAAAADTERRLPGHLSRRKLRDRRRVGLGQEHPAEYPRPARPPGQRCLPLRRARHLQRRRGPTGGDPQPPDRLRLPELQPVAAAERAGQRRAAPELSRDAAPRGTGAGRGDARPGRPGRARRPSSGGPFRRPAAARRHRSRAGRRAGADPRRRTNRQPRREHRERSAGAAPHPQPRAPGDPGGGHP

SEQ ID NO: 20642 - protein, 424 aa, Pseudomonas aeruginosa
SQPGRPSRAPTDSAAWRGARGPGGGLPVSASPSPRQLLHEALASLRGLGRRSLLALLGIVMGCSSVIAMLNIGSNATDEAMSIFKDMGTDTLVVQFPFAPQAPMPMPASLDTEPLLRDVAGLEHLAVLGLYSAPVTFHGRTSNASIVGASAGLAAAARLRLREGRFLSRFDDHDTYVVVGATIAEALGAPGDPLRLGEQLTVNDYLFRVIGILQPQASAALLPFAANDSLFVPAPGMPRLQPAAEVSHVVARVSPGADVYSVGAALGAALTARLPGHEAQVQVSQQVLDGLKRQTRTFTYLLAGLGIISLLGGGVGVMNVMLMSVAERRREIGVRMALGARQRDIRNLFLIEAVTLTAAGALSGAVLGVAAAYLYARFSGWTFSLAYAALPLGMGSTLLVGLFFGLYPAVSAARLQPVEALRDE

SEQ ID NO: 20643 - protein, 417 aa, Pseudomonas aeruginosa
RLPATDRAEVRPARRRRRLQPEAGGARRLSRQPRHRRPHEDQQCLAHRDPAWRIWHSLQPGLGQAVPHRRRGRALPQRWPRPDRRPAVAARCGLGRHHRAAAPGTSLRRRQSPATQGQRVADHQPGHRRLPGAAARPGAGAHRSRSPGADPGAARGQPGDDPRRANGRIRDRADRGRRRQPGAQCRGVHQPGRQRTPGPAATAGAGPVDANPRQRCAGRHADRGRPPAGDQDRPAAATGIPATPDRQSPGRPQPGAGEEPAPVGCLAGGRRQPDPRPLQRGRWRQFTQLGQLRRGTGGNSHRRPQPPAGRGARPGRRREPEDPDRGCPADPGAERHRCGARPRHALAPVPDRPARHRVVAAQAGDRTGKAARRAFEQLPGAELRDRPAQRREHPIECPDLVSQCADAARPDRRHDPG

SEQ ID NO: 20644 - protein, 147 aa, Pseudomonas aeruginosa
PWRRPSPAMSRRCWWSRDSGSRKDRSCCAWTPARSPCRCARHSRRCSRPVAPCRTCATGSVARTWRGSVVPCAARSWRRAAPSASCARPASCSSAGSSRATNSTISNNRPASSAWTWRRPGGKWSRPAPRGRARIARSPKWTWPTPA

SEQ ID NO: 20645 - protein, 453 aa, Pseudomonas aeruginosa
QSTRGETLNNKNDISCLFARKPLPLLCALIVGGLFGTSQAQAGGFMVPTTNTAGWGRAMAGGSLFPNDPSAAFNNPAAMAFIDKRIAQLTVNYADIDIKYNGDAYDYQGNPMTGGYQDGPGTPELGTNDGGQAGFGAWLPTGFLVVPINDRFAFGLSQVVPMGMRSTWDPNWKGRDFAVDTKIETIGLTGSLSFKVNDNFSLGAGVIIQRTSGFVSQNLDLYASAANSPGMGGIPFPASNSSALMRVKVDNTSPGFFAGAVWKPTDRDTLGFAYHAKIRNKLKGHYNLYDHDGGLTEGAIEGGTPGLAYPGLDLRMGASASARLDIPAYASLDWVHQFNDRLSLGASATWTEWSSFQDLTLKSHGNTIVSIPYTYRNTWTLAVGGDYKVTDQWTMRAGVAYDQTPTHNATRDPRIPDGDRYFASAGRRLSLPVDAGVVDRRGLLGGNSSRRCR

SEQ ID NO: 20646 - protein, 450 aa, Pseudomonas aeruginosa
KPVRKMTQSVDAFLERLKRRDPDQPEFHQAVEEVLRSLWPFLEANPHYLEAGIIERIVEPERAILFRVPWVDDQGRVRVNRGYRVQMSSAIGPYKGGLRFHPSVNLGVLKFLAFEQVFKNSLTTLPMGGGKGGSDFDPKGKSDAEVMRFCQSFMSELYRHVGADLDVPAGDIGVGAREIGYLFGQYKRLSNQFTSVLTGKGLSYGGSLIRPEATGFGCVYFAQEMLKDRGRGFDGQRVAISGSGNVAQYAARKVMEMGGKVISLSDSEGTLYAEAGLSDEQWEYLMELKNVRRGRIREMAEQFSLQFLEGRRPWGLACDIALPCATQNELDAEDARRLLANGCVCVAEGANMPSTLEAVDLFLEAGILYAPGKASNAGGVAVSGLEMSQNAMRLRWSEGEVDTKLHGIMQSIHHACLLYGEEQGRVNYVKGANIAGFVKVADAMLAQGVV

SEQ ID NO: 20647 - protein, 416 aa, Pseudomonas aeruginosa
SGLLQRDQSVQYLVQATEYRNPVDALGHPLQGFQFLQTQRGRVFLHDLRGIQQRAGRRGFLAAADHIGLGRLLRLHHLRQQGLHFAREDDVAYAQAAHFQAAVFQLGGQVGADRFVDRLLVLQQFVEGTGAHCRPQAELQLAVQILQRFAQPREGGEHVAVAPIGGEVQAQADLVAGEDLLAADLQRLDTGVDQFHADLPVVAPETVLSSLQQAGKGAVDLEHADLERRHLDQQHCVQARQGAVAQVRLVQLGDQRGGQSIVLGQVDALQALLGLAFPVQSAAARCEQLHQHAVLVAQAGLVVAQVHPGEVALHQLRFALPQVAGQAVFELRGVQAEAFQAQAVVRIEAAVGARFEHGEEVAFGIQQAAFVLLHDKALQHFHLFIPFILPWCRCCRPVERRGWSAEEVGLADVLSI

SEQ ID NO: 20648 - protein, 112 aa, Pseudomonas aeruginosa
STATTPATSAWPSGFAPTSPRCRRIPRSACSRWNCATPGTSRRSMAPCTISSAPTPSTPSARTTWCISPPGPMSRRSAGSSLPRRATCRPGWCRPRRRGARTRRAIPRARRR

SEQ ID NO: 20649 - protein, 575 aa, Pseudomonas aeruginosa
STSTCPATTASPRGSAANRRKAWLFSSRESPRAMPLSTAPSSRSSGSPCVRGHPCCWWGRPVPANRSSPGASMNSSAAGTSSTGVSSRSTAPPCAATARCRHCSVTSRAPSPARRMRAKACCAQPTVACCSSTRSASWAPTNRRCCSRLSKRSASSRWVRTVRWRATSSLSPGPTATCADEWPKACSARTCSPASTCGPSSCRAWLDAARTSSRTSTSNWSGTPASKGGRCVSTWRPSVATWPSPVPAKRAGPATSASCRLPSHGWRPWPTAGGSTRRWSRRRSSACARPGGSMRAGSHWPICWGSGWRPWICSTACNCRRCWRCAAGLRPFPRRDAGCSPFRARTSATPTTPTGCASTWRVSAWTGRRYAPEHHFGISLASFHGLQGRMPMSEIMDVERLRQRCAAGESFKYLYFWGHRPATDDKVGKSCFSQWYEASFKLDGVRYASAEHYMMAAKARLFDDPRLLERILAARSPGEAKALGREVAGFGEARWNAERVGIVIEGNLGKFGQNASLKKYLLGTADRVLVEASPVDAIWGIGLAASDPLAAEPATWQGLNLLGFALMEVRRRLAQ

SEQ ID NO: 20650 - protein, 417 aa, Pseudomonas aeruginosa
ENEEKHKKTKKNGERAKRNHEDHKDKDRDRDKERAKTGRKKTGKEGTDQGAKVPEAGPGRSTKGEKRPGTTGEHTNKKGEKKKQNSTETGKGEKDERGDKEGRQEAKREGAGDGRHDKATRTGQATGSKGEEQEERGEGRGEDAEDDKSKRNRQARRRGNKSRPSVSSKVFFSMSDTPQSPAQDSLAEHDEARPMRTVKSFVMRAGRMTEGQQRGLDLGWPKFGLELSDEVQDFDAIFGRQAPRTFEIGFGMGHSTLEMAAAAPDIDFIGVEVHKPGVGALLNGLLTQGLGNVRVYSCDALEVLRHCVADASLDRLLLFFPDPWHKKRHHKRRIVQPEFAELVRRKLKVGGVLHMATDWEPYAEHMLDVMSAAPGYRNQAEDGRFVPRPQERPVTKFERRGERLGHGVWDLKFERVD

SEQ ID NO: 20651 - protein, 502 aa, Pseudomonas aeruginosa
STAPATYPWRRTGAGTPSRPGTPGGPHLQAARFPASAGSNNKSGTARPAAKETAVLKKLGILLLGAGCAWAAQAKVDEVQAARLDQDLTPLGAERAGNADGSIPPWTGGITQAPAGYRPGMHHLDPFAADRPRLVLDSRNMAAYQALLTPGTQALLQANPEYHLRVFPTRRSASLPQRLYDATRANASRAELIADGNGVQGAAAGVPFPLPQSGQEAIWNHIMRYRGEQLHLQTNQAAVLANGSYNLLKLDRYLYFVYGREGMIPENLDNTLFYYKYKVVAPARLAGSALVVQETLDQVLSIRKAWRFNRGERRVRRLPTLAYDSLQPDTNGMATADTVDVYNGAPDHYEWALLGKREMLVPYNSYAVHQKGLAYGDILKSRFINPDLLRYELHRVWVVEATLRKGFSHPYAKRRFYLDEDSWQILAADIYDKDGVLTRAQEVHPINYYDVPLVSSTLEAIYDFKGGRYFVDGLDNNEPMYDFGVQVGPRDFTPQALRREGN

SEQ ID NO: 20652 - protein, 352 aa, Pseudomonas aeruginosa
WPGKCPTGGCGSSATGWRSGPARNPSRVPCNESACRSAEFTCLPARMGVHPSSRQEMLQQVVEEQLAAFAGAQALRVVGEQPGVARGGAGIGDRRQWLAGALWVERGGDAVDQAQHVHHELEWQVGRFQRALAGLEGLLRVEVVLRQAGLPGPHDASVRRAQLGVGAGADAEEVAEAPVVQVVPGVQAVAGVGGGLVLAVAVLVEQGLAGFLDVPEDVVLGQLRRLAPEHRVRLHGQLVPGEVRGGQGEGLAQVGQGVVEALPGQAVHQVEVEVVEAGLARHVGGAHCLGAVVDAPQGLQLVGLEALHADGQAIDAEAPVVGELDLFEGAGIGFQGDLDAVGEADPALDAFQ

SEQ ID NO: 20653 - protein, 98 aa, Pseudomonas aeruginosa
PAQGLGREQAGRAAAEEDRTQAPAVDMAQVLLQVGEQGVDIGLFGQLRASGVGVEVAIRALAHAPRDVHVQGQGRELERGGLGHGGAGWRRFRGAIVA

SEQ ID NO: 20654 - protein, 262 aa, Pseudomonas aeruginosa
VRPTSKAAGRNAVPTPPGGGADGCGSETQALLEQGHGAGSVAEAVLLLGRQLGAGAVAFRHPEQRVVAEAVGAAGFAEDAAFPDALAEDRQRVVGVAHQRQHADELCAALGVRDILHGLQQLGVVRRVAPAVGIARRVDARRAAEEVHRQPGVVGQRRQAGEACGVACLEDGVLDEGKTGFLRFHLAELADRAHLHAGAEHGLEFLEFAGIVAGQHQLFELDHSSGKISLLKLKVCAGSPLASTLMVKTRVSRWLIGNCARL

SEQ ID NO: 20655 - protein, 458 aa, Pseudomonas aeruginosa
LRRVEGVERVLLVVPAVDGGDHAVGHAGLVLEVVEVVLHRAEERQDRLVDADRGQAAVEVAPHLLQVLFHAFAADRLAQRRALVLQQALVGLQVEQAAVVAAVVVLGLRGQFEQQLAAVALLVVEQRALFLDLLQAQAQQMLAVVQQAKDLAEHGVLQQRFLLRDDALAEQRFQPIQATAFEQRRFAADLGQQRLLRRQRQHVAALQAELAGRAVLDQADGVLYEALAGKVVPEHVDLVQHGEQAAVAVLAQWLDVLLPDIHVRGGDTGVGGQQEQDRLGVGQHRQGQLRLAAEGIQARRVEDPQALAQQRVVEVDQGVAPGRDAHLVGLVGGFQGIRVEAELDRLFHRQRLGLGDLGEGLGHALRVAGVQRNVHPVARHALELGDAGVGQARLDRQQADVAALGARIVEQLGGAHGGAPGVGRQHALAVAGEEQAVDQLGLATRELADEGQGDVVRA

SEQ ID NO: 20656 - protein, 599 aa, Pseudomonas aeruginosa
RPGIGRRTSAGKAPRPTKTGVAGQLSLGLSYTWPSFFPFLHEVLVLAQYVYTMHRVGKIVPPKREILKDISLSFFPGAKIGVLGLNGAGKSTLLRIMAGVDTEIEGEARPMPGINVGYLPQEPKLDPQATVRDIVEEAVGQIKQAQARLDEVYAAYAEPDADFDALAAEQAKLEAILQASDGHNLERQLEVAADALRLPPWDAKVEHLSGGEKRRVALCRLLLSAPDMLLLDEPTNHLDADSVAWLEHFLHDFPGTVVAITHDRYFLDNVAGWILELDRGHGIPFEGNYSGWLESKAARLAQEAKQEASHAKAMKAELEWVRQGAKGRQAKSKARLQRFEELQSQEFQKRSETNEIYIPAGPRLGDKVIELHNVTKGYGDRVLIDNLSLSIPKGAIVGVIGGNGAGKSTLFRMLTGKEQPDSGTIEIGETVQIASVDQSRDSLEGNKTVWEQVSDGFEQIKIGNYEVPSRSYVGRFNFKGADQQKFVKDLSGGERGRLHLALTLKQGGNVLLLDEPSNDLDVETLRAMEEALLDFPGSAIVISHDRWFLDRIATHILSYEDDGKVTFFEGNYTEFEADRKKRLGDAAAQPHRVRYKKLA

SEQ ID NO: 20657 - protein, 245 aa, Pseudomonas aeruginosa
RDASGRVRMPTTNKHEPLISLRGIGKGYLLGGQPLQILKDVCLDIFPGESCAIVGASGSGKSTLLNILGLLDRPDSGAYRFAEHDIFSVDGDRLAAIRNRLIGFVFQSFNLLPRLNALDNVALPLSYRGMPRREALERAEAMLARVGLAERAGHRPADLSGGQRQRVAIARALVGEPALILADEPTGNLDASTAKEVLELLLTLNRERQVTLVVVTHDPSLAARLGRQLTVRHGEVHEDLAEACR

SEQ ID NO: 20658 - protein, 559 aa, Pseudomonas aeruginosa
PPRARSRARCSAWRLRISTPGSPAGPSPWPTRPCRWGWAVPCWWGCSSGSIRRSRRLACNRSRRCAMNRWGLGVLWLVTALPVAASVNPALSPDVPSMAREQGRSVLLSEQVIDLSLSDAVYLGLRNNRGIRSAYLQRIAQKFDLRVAADAFNPKLVVRGDYRANRATEDRTRTSNVSPTATLLGEYGTRFSLAWVKQFRTADEAGRYRSDGLDLTVVQPLLRDAGWDVTTAPLRLARLSEDANRLQLKASVSQTISQVIGAYRELLRAQEQARIAREALARTQELLEVNRAMIRAGRMAEFEIVQTEADVASQELNVEESTNQVDSARLALLQLLALDLSTQIRASDALAATPIEVDRQQAIRTALQQQPEYLQRLIGSRQADLNLVLAKNQRLWDVSLVGGASQIRDRYSEGGGDNSRSWDSYAGVQVEIPIGDLSRRQAEVRAQVDVENQKILIEDARQTLEQNVIDAVRDLGTRWRQYQIAQRATALSRRKLEIEREKLRVGRSSNFQVLSFETDLRNVENTQLNALISFLNAQTQLDLIVGMTLDSWEISLNDH

SEQ ID NO: 20659 - protein, 253 aa, Pseudomonas aeruginosa
PVFLPAPAGIVARRRPGGCRGAGLAGPRRRHRETHGRGALGRRTGGPAGASDRPGRTPGTGARGDPGGALRRQCRGAAGGAGTAGRGRTGAAAHGHPRDRRAGARGTVGVAQGPSHPAGPARLGAWRGHGAGPSCPAQRAAGAEQHRAQVARDPRAVPARDRPAQRTRRSRTTGQPAAHGPGGGPAGSGVDPRQGAGRESPDRRNGPGQRQREIRDAAGPAGWPYGARALCRYRRRGARPGWRAGQPRTGAGR

SEQ ID NO: 20660 - protein, 252 aa, Pseudomonas aeruginosa
SRLGNRERCQLTGRIQNNEIHQVPAVLCCSCSLPERFVHGQRGHHHPGQLGLHRTWHHQRELAGVAQSASDLQHHLQGQDRRRWLLCLDRQRHRQRQQHPVQRAADDRPAVEADRFQHHRRQGRWRRLQDSLLYLWPEHRQRFLEQRHQHPQRQQSVAGRQLQDQQPEREADPGLRSQPVIRAAAGALGASGFALPLPGVLRGPAGPREFPPEAAQNLVRTWKTVWGRVSARTLKQADHRAPCISSPPGVKP

SEQ ID NO: 20661 - protein, 246 aa, Pseudomonas aeruginosa
PPPSSAWSPILTGRKRSITRRLLCRWALSRGVVKLPAPARAMGSSNWSARCSSAAQPLSIQPMACVATCSATRSALTPAWPKAQKIAQMCSQSIRSSRALPGPWSSARNSSWRSSSLQPRRWRTLSSSRSPTCPGIPASSARAWRRSAAPGCSSCSGRQRAGRTRASSSPPPAGTKPWRSSSRSTSAPIRCNSGSQLSRRKSAGGASGLWVPPLILTRLSPLAASSAGSRVCSTSEQLPAEPMAKA

SEQ ID NO: 20662 - protein, 166 aa, Pseudomonas aeruginosa
GGERLPAYRRDPPRLARTSGRRPVPRGPVRPHQPVDLRAAGPGWTPRGHRAEHRLRTGAARPRARAAGAFQPGGQASLPGLRRFQRSALGRQLPRAVGFHHTDGDPGRQRADRRGAGRGGDPPPAPGLGARCGPGATGRSAGAAGGGPGSVRPPATAGGAGGVPRG

SEQ ID NO: 20663 - protein, 127 aa, Pseudomonas aeruginosa
RPPADLNRSNHSKVDANVFTQSGMFGDDLLLYAMGTARIENNRDFAAAIAPAVGFDSGLLWRNPLGNLTLEAKGDYFHNGEVRRSLGFVQQVELGRDLGLRLGAEREFSHVGKPINEVKLELRWYYY

SEQ ID NO: 20664 - protein, 590 aa, Pseudomonas aeruginosa
KDAKDIPKWCSGAYLRPVQAETRQVLAQPVGVVGVALVLARNGEQPASRLGKGLSPAAHLQHRLQLQAVEQIQGLHPLPQQIGQWLPARIEPPGLAQAEDLLLDQRLVDPPAVGQGRHPCDGSRQLAEVAGPARFAGTGEGQVATLGLQVETHLPPLLAGVPLQFEVDVRLDVLAASSQARQLEGPQVDAGEQVLAEQAFGHSSAQVAVGPGDKLEVALHLTVRTQREEALLFDSLEQHRLFVGAQLADLVEEQHATVGCAQQAFARILRAGEGALDVTEQCRHRAVAAQGGAVDLDETPVELVPAALEFIDAPGEERFAGTGRPHQQHGCPRTHGDPLDLLDGAVESGIARGDSRLEKSQAFLLFAAEPRGDAVVAGQVEVDQRRRALGMARLVLAPRRRGLHQPGRQVARLGKEEPADLRDMGPGGDMHQVVLALGVEGVGADEIVQGAIDLLEVPGVAQFHLLQADLGMRRHRGDVGANPLGQAEVAGVVAVDQFEAVDQQVRLLAQADARPPLLPARRALAETVEGGADEADGDRAFHHRLSFKIKIDMKIYRNSQASLHRIRRRSAIKNLFTFKIKQLSKKQSHR

SEQ ID NO: 20665 - protein, 418 aa, Pseudomonas aeruginosa
PRRRQDGAEHKESTMKDMNILEVAGGKPIKLWTQGVPVEEEARQQLLNTAKMPFIFKHLAVMPDVHLGKGSTIGSVIPTLGAIIPAAVGVDIGCGMIAARTSLVAADLPDNLHGLRSAIEQAVPHGKTFGRRDRGAWHEVPEAADQAWKALAGRFKAITDKHPRLEKTNNRQHLGTLGTGNHFIEVCLDEADRVWFMLHSGSRGVGNAIGNLFIELAKADMRQHIANLPDKDLAYFEEGSRHFDDYVEAVGWAQDFARQNRALMMHAVIEAARQVIRKPFEANLEAVDCHHNYVQKERHFGQEVLVTRKGAVSAQKGQLGIIPGSMGAKSFIVRGLGNQEAFCSCSHGAGRTMSRTKAKKVFSVADQARATAHVECRKDADVIDEIPMAYKDIDRVMEAQRELVEVLHTLRQVVCVKG

SEQ ID NO: 20666 - protein, 282 aa, Pseudomonas aeruginosa
RAPCGARWGRIEMNREERHPLPAAMRERVLDELERIEREHDVVVLYACESGSRAWGFASPDSDYDVRFVYVHQPEWYQRVEEPRDVIERPLSDELDISGWELRKALRLMRKSNPALLEWLGSPLVYREEPGVREELLWLGSAFHSVPGSRHHYLSMARKNYRGYLKGDSVRLKKYLYVLRPLFAVRWLDAGLGLPPVAFERLVEATLDDPSLREELDALLSLKRQRDESAYGPPRLALQRFIEAELLQAERGATQPTGARQDSRLLDRYLHDKIWQYTRETS

SEQ ID NO: 20667 - protein, 187 aa, Pseudomonas aeruginosa
GSAAAPTIHWRRRRTFSATAGCRCCSGWARKSTWNCCATASYPPAVASCWRGYARHAGGRCNWSIPARRCGARRGRCSPGFPGTSASVSWRGSASASVGATKNASWSSSRRTTGRATPCCCGSTASTSARSSAPSARPASAPNGWRNRSRRKPSAGWKAAARRTSTSPTNCCCPWPWPAPAASPRRG

SEQ ID NO: 20668 - protein, 397 aa, Pseudomonas aeruginosa
RLIRRKKDAVLATAPAWQPVAVVRHAPRPGRCPARPGQRAVQTHPRAGHRAARPAHQRATARTRQETVLRPAPVTQPCAQLQHLPQRRHRRRRQRTDVGRSRLAEGATQFADGLQRRVQCRAVLGWPCQGPGGAGQGSDPEQRRDAQYPAVGRTDPGQHPGIRGRLPQGLPQGRQAGQLRQHGAGHRGLRGDPGDSGLALRPVSQGRRQGPRRTAEERPQGIHGQWLQRLPQRHQPGRPGLLPVRPGEEARRQRAAQRRQGPLRRDQDPERRVRIPRRAPAQRRPHRAVLPQRPGLGTQGRGGDHGQRPARQAVGAGRRGEHRRLPAQPERQAAARRISAAAGQHGDHAASRGITATRKNGAPLEPRFSSMGRPQTTPCASIASATLTKPAMFAPFT

SEQ ID NO: 20669 - protein, 148 aa, Pseudomonas aeruginosa
RMPASRNRSTASRVEGMLAPSATQTQPLASRRRASSASSSFWVAQGSAISQARPQGRRPSRNCRENCSAISRMRPRRTFFSSIRYSHCSSESPASAYRVPSESDSEITLPPISMTLRAAYWATLPEPEIATRWPSKPRPRSLSISWAK

SEQ ID NO: 20670 - protein, 222 aa, Pseudomonas aeruginosa
ASWRTPSPRPFSMCERGSAPLPAETPSDLPAREGRLAAGARNRWRRGRQRQPGLRVDYEGRGRLHAQAVDLAVACQRLIAGAEGVGGVAPGTVDGARATGRGENLEADAIDLAGGGAGNGQLPRQAGHLRHAAQGVAAADGDAVDRGIGAIGGGLALEGDVAGHWQIERRRRAHADGARCGEGRVDRGDGGRAGHGRNAQAESKSSKGRQGLDGFHCFVSFQ

SEQ ID NO: 20671 - protein, 448 aa, Pseudomonas aeruginosa
RGVPTRIGSSRSDPANPKLGCQLSVGRGRHANETRLQLEHLHALRRGASDLDLLRHHAGAGSLAKVHEQPVTLVAYRLRRHDDGLFFAIGGDRQLGAHSQTNLLQLAGIKRRYRHRHLELRAASLGHAGQSLTTEGGDDARQRGALEAVATDFHRLPFAQLVDIQFGNLRRYLQPLDAGQAEQRLALPQLATGLHRFAAALLASQAGRRDDDTGKGRAHRTAIQLGLQRLVFHAGVGQVHFGDLAILALPLGAGRLHFPPGRLQVHALLAGLLFEIVEFVARDDPALEQLAGLAQLALGAALRQLRAAQGTTDPRHVLATLPVAQVLQGATGLEQRRLCLAHLHGDLAGVHAQQLLSFRDPLSRLHQQRLDIAGEGRRQGHHAPRFQASDQADLMHQRGRPYGDPALPFRAFRGAAGEDQPGQRRDNRQAGGERQCRPAQEGKPVSGH

SEQ ID NO: 20672 - protein, 119 aa, Pseudomonas aeruginosa
GFHAWAERSCRPDAWCRRTEPKRAPHEEKEKNSAKYMTDREKAGQPPRFSWGGALCRRMFAVRFQAATVTLSSVLAALTVSATLVLSKAFCLSEAATIAPCEVWVGLALLAAMVLPLKT

SEQ ID NO: 20673 - protein, 672 aa, Pseudomonas aeruginosa
REARRGEIQPATIDPNQSQKNKKNLKNDTRSQIRPATRLPAQGQSRPSANPVVSGPAPAQGPGHRDGQSSARHHGRTGGTGRSEQGNPEPSLRYPRRSQAAPGKPCQEYPRTPHPQRRPAAAGAAGSATRADPGTPRPARPAGAADVRAEPGTPGRAWGRQLAVLCRSPGRLLPARPAEACVPYRYQRGDLQRTLHRPDLRHGRCRAPRSRGQRRVVRHAGGAVPAWRVEPRTTCQPLSGRQLPPASTVSHTFTRSTPAASMYHQAPSLVPASAERAEQVDQGDLPLGAAVDEGDLVEEAAALRIEVAQVVVDATLVACLGQLQGFVAAVRQGAQGLLFATQGIAGRQGVGDLAESGLDGPLVGGHRRILARLGQAQVGTVAPAIEDRQRQRRQEAPGARAAIEQAGHFRAGGAEAAGQADAREERRARRADIRVARPQTMFGGKDVRASLDQLGRRAGSDVLQQLRPLPRTPRNRLRGIVATQQQHQRVECLLFLPQVALLLGARLLHQAKGFLVVQRGGGAGRAALVDQGEGILAADQGLTGQRQAPQGAVIAQVGLADLGDQGDPCRARCLLAGQVLLHGCVGQALDPTEEVQFVLRQGQPDLVAAGHFRAIAGGQVGRLPLAVAGGSGVQARNPVGALDSILRAGRLDIQEGLAQRAVVIQGHVHQAA

SEQ ID NO: 20674 - protein, 198 aa, Pseudomonas aeruginosa
SMIGLNTAAIYILQTLGSLYLLIVLLRFILQLVRADFYNPLSQFIVRATKPLLNPLRRIIPGFGGIDLASLVLAILIQLVLMILILMLMGYGVGGFIMQLLIWSIIAVTSLFLKVFFFALIISVILSWVAPGSYNPGAQLVNQICEPLLMPFRKLLPNLGGLDLSPIFAFLALKLIDMLVINNLAAMTGMPQQLSIFL

SEQ ID NO: 20675 - protein, 726 aa, Pseudomonas aeruginosa
STPSFPRRSRALEPLDEHGKTQPSNRRLRRLEARADAGNHPLSRLAGAQPAEQPGGRGQARTRPAPTTRGPHHPGLRRRVLAWQDRADQQPVLRRLRPAHAAVPRRAHHHVPHRAVPRSARRAQLHPPAADRDAPGRRQRRPVQARAAPLGEHSAGHRRPGGHGPGLRPGRQDQGAAGGTGDPARLPPGCPGSRRRARPGARPGLAPRPGQLRPPAAAPGPADPRHAWPECPRQRAGADPVDAAQRPGDPVPAVRRRRCHRLGHGYLAEVHPATARGRPQQPVRRAEQDRRALGRPFRRALRTERHPPDPGRHGPPARPAARRRAAAVGEAGAAGQGPRRTGAARTQSPGSAGSAALRAHRRAEGSAAGELRARPGPWPAAQQPASAAPAPGEGRGTARAARRQAARQRPTAVRTDREDQGRPRPPPPPPAQPEDQPAPAAAPGRDAARDDPQRTHGTAPAEGAAQPQRQPDHGRHQPGDPGVLPRGGARPRQPRARGRHGQPHGRRHLPPAQRGEPALRPRRAAATGPALPARTVATEEEGRPVPPAAEDRAYRATPADPALLRHPGAGGGRPAPAPARGNRALGQRRADAADAAHPGKQTVARKPHAPPQGPGPGDPAGTPAQPGLRRVRRGIAGTVARSRRHPPPVAPPLAPAAPGQGGQPARLAARLTPLPRRAPARLPLGATLFRLAPSFVREQGRCPQSSPTTPSVWSPPRRCTSTNRSS

SEQ ID NO: 20676 - protein, 162 aa, Pseudomonas aeruginosa
SATPSPATTTPPATTASTSASRAGGTAASVRASRSTPASSSSLPSTTSAVATVPAAPPASIRRPARSTARTSRWSRWKTGCIARRAWQTASASASGPRWSAAASAACRRCNGPSATPSASVTACASPARRSCRRRTSPSTKSPGRRFFPTLSSSAATSRNRA

SEQ ID NO: 20677 - protein, 214 aa, Pseudomonas aeruginosa
TASACEDPMRADLEIIQEWIPAGSRVLDLGCGDGELLAWLRDHKQVSGYGLEIDPDNIARCIENGVNVIEQDLDKGLGNFASDSFDVVVMTQALQAVHYPDKILEEMLRVGKTCIITFPNFGHWRCRWYLARNGRMPVSEFLPYTWYNTPNIHFCTFQDFERLCRQLRMRVLDRLAVDRDHRHGWASRLWPNLLGEIGIYRVTGPGVQTRNLAV

SEQ ID NO: 20678 - protein, 284 aa, Pseudomonas aeruginosa
PARSSPWSSAESARKAPSTTWRNSRSASARPWSSPSRSRPRANLRKPSVSTRKSSRTNDQARTAGAGQPQCRQTQGTPGHARRQREGALDRRVQPGGTGGNRSFLRRERHPQGTQRRTPLRPAGAGRRLRAGGGLPRRRAGHLLGALCRRPGRRGEQRQAAGGHEGCPGRRARRTVRQRAGAGAPRRRPAADPLRGHLGRPHPPRSPRRPRLRLRPAVLGAGTRLLQRRAGARGEEPPQPPSPRHGPAQAAPGSLSRNRRRRPRAASARRFVRPPWRLAELMPR

SEQ ID NO: 20679 - protein, 407 aa, Pseudomonas aeruginosa
RPETASTPPHRDPSHPVPAPAPGPVRAHPVVRAQVPVLRLQLPRRWPGAARRGLCRRPARRPGARPAPCPRPAPGFDLLRRRHAQPVLGQGPGPATGRRRAQGRLRRRHRDHPGSQSRHLRTGQVRRLPAPRHQSPVHRRAELPGRQAAGPGAHPRRRRGSARRRHGAPGRLRQLQPRPDARPARAEPRRRPGRPAPGPRPGPHAPLLVPTDHGAEHGVLEPAAGAARGRHPLGHPGSRPGPARRARLPPVRDLRLRPRRPARPAQPELLELRRLPRHRRRRPRQAERAGRTHRADLEDPPAEGLPQPAKGLPGRRAPAGSGRPAIRVHDERAAPGRRRPRRALPTAHRPATGGDRRCLRRRARRRAARRRPAAPAPQRTRPAVPQRPAATFPAVTTDARPSVPAGR

SEQ ID NO: 20680 - protein, 121 aa, Pseudomonas aeruginosa
TPPTDTPIRYKEPSMDYALDLIATLSRWSRSHLSDISLAIMATLLVLFGPAINAWVQQRIGSLNFVFRTLLFVLICAVGYGLAMVFVTPWLAKGLGYFNNYTLAPVLLLVFFVIGMIADRS

SEQ ID NO: 20681 - protein, 170 aa, Pseudomonas aeruginosa
SFRRPRSAGAAARRPLSRSSAFVPGAREKTPRISRSGVQARICAQSRPKRARYLRSRSASLGLRLSWRETANSRRPASERVLAPRHTSSTACSCRRSNRSRASTRCPSRSASGSRPASSPQAWRRRRISSSTSASSIRPLSARVAIRVMEADSSRKLPAQRASLEPAKAR

SEQ ID NO: 20682 - protein, 134 aa, Pseudomonas aeruginosa
RRLASRLKRTCRPCSRACRSSSKSMFGSMSSRRPARPGSSKVHRLMRANRSSRNRPSATRPRKSRWVPAISWKSLSTSRSEPSGKKRFSSIALSSIACSSAPSSPISSRNSMPPSAARSRPSRAFCAPVKAPLT

SEQ ID NO: 20683 - protein, 402 aa, Pseudomonas aeruginosa
RDENAEALYREEERTRPAVFRRRLPRRARTGHLPPLRSVRPPEPGKLQPEHPAVRTPPGRLPAAERTAAGGALLHPDGPGRQRGRPALRGRRAGGVARTGQPPTVLERPDRAAPGAHRPDPGLSIVRRAGRPVAPAEPARPRPGGPGRSVAGPGAGVPGRRAQGRRRPCRPAASWTIRFLALQPASQRGTGRHPYPGAGGQRPGDPHPRQGQPAPEPRRQLALQRRAHRLLAAEQTAGVSVPRAAVRPAGGSGHPYPRRTAGEQAVDRRSGQRPPGRQAGRQRPGSERPGRTRHHPPGRNEDPAGAGGGGGEGGPGQCDPPPRGNLGDPLAAEYREGHGGKPDRAASEGIGNPGAGGRAHRPDFGIRWPGPGIERTGHAEAGLITNDSRAVDKTARSTRKAR

SEQ ID NO: 20684 - protein, 166 aa, Pseudomonas aeruginosa
SPRAPRWSPPTCRTTCTACAAPSSRRYPTARPSAAATAAPGTRYRRPPTRPGRRSPVASRRSPTSTRGWRRPTTASTWEPSAPATTSSRSAWTRPTASGSCCTAVRAGSATPSATCSSNWPRRTCASTSPTCRTRTWPTSRKAAGTSTTTWKRSAGPRILPGRTAR

SEQ ID NO: 20685 - protein, 185 aa, Pseudomonas aeruginosa
RPEPVDDQRPAAAHPQHPWPAQPSGAAAAAPHRGARGGGNLRGRGRGCRARLTRAGVPARCDPRRRLRLRHRLRRQLLAGTANPAAGAARGQRRKPGEDQRRHPQSTGAAGGLSPRQLAAAVAADGRGSRPGTAAPRLRTRRRWRAAGAGTPGTLAAAATGASRRGAAAPGAGAARRDSRARRRA

SEQ ID NO: 20686 - protein, 150 aa, Pseudomonas aeruginosa
TRAGPVSGPGANLREPHPGGRGVPAMSSSRLGVLVLALILLTATLLGGCESTHQYLLAKGYPPAYADGFDDGCGSGRQAAGSISGEFRKDVPRYLREAIYASGWGDGFEQCRSMARSEERRRFEERQWDDRDDDWQRDRDRALARALRER

SEQ ID NO: 20687 - protein, 350 aa, Pseudomonas aeruginosa
GEKKMQSSQLLPLGSLLLSFATPLAQADALHDQASALFKPIPEQVTELRGQPISEQQRELGKKLFFDPRLSRSHVLSCNTCHNVGTGGADNVPTSVGHGWQKGPRNSPTVFNAVFNAAQFWDGRAKDLGEQAKGPIQNSVEMHSTPQLVEQTLGSIPEYVDAFRKAFPKAGKPVSFDNMALAIEAYEATLVTPDSPFDLYLKGDDKALDAQQKKGLKAFMDSGCSACHNGINLGGQAYFPFGLVKKPDASVLPSGDKGRFAVTKTQSDEYVFRAAPLRNVALTAPYFHSGQVWELKDAVAIMGNAQLGKQLAPDDVENIVAFLHSLSGKQPRVEYPLLPASTETTPRPAE

SEQ ID NO: 20688 - protein, 153 aa, Pseudomonas aeruginosa
CRAAWYPPRPRSNAGAWRSATSPGRSPPPRRRSTPCPARRGCRPRGTGRRLPGSRACWRLRRHRRSRWPAGAAHPRHPVRSGSRRAARYRRPGPRAGALRGTAGKTAPPSRGCARGARSSAPSGIPTARRRAPPRHTGCLRNRTARSPCRPFP

SEQ ID NO: 20689 - protein, 467 aa, Pseudomonas aeruginosa
IVATALAVAVADLAGAAHQRDIPQALVLRQHQVEVGLATADQALQVFRLLLQGGPDRLLAVDLDRRGGQRIAGADLRRQVQRQQLQQGQACAVDLVGGLLDIELLAGDVGLGLHDLEFGHSPGADHRPVDLEQLLGPRQGFASDARLLLGAQQLPVGADDLADGLRHAGLELQAIGVFGETCQAQRRGGDVPARIAQQRLDDGQVEAIAAVAPGLVGGAELLDPGQAEASAIFAKQGRGGRDIAGPRAVFGGAVGAIVAAHHQLRVEGVGGDAQVELLRDPLQVGATDSTVVAQAKIDRVAQAEVDHLLAEQHRPALLAGHARYVRTQRRVDAGRHRKSGDQPQHAQAPPIHRAAPRPVAGEPPRPPDRARRTAPPAGYCPSPAAGPRRPGRRSSRRTWRRDTQPPRRAPRPRARPRRSGSPPRSGTGCGCPAGARPAPCARRFPGGVRRHSSASRSSLRRRRRAGR

SEQ ID NO: 20690 - protein, 321 aa, Pseudomonas aeruginosa
RYPATPAASGAPAREDWRGPREAIAGATGWRSPAGLRQVLVHLAMPHCQLAPETGGQAGIMGDHHQGHLALAVEGEEQLQHFFRGARVEVAGWFVGEDQRRLADQRASDGDALPLAAGKVRRTMAGALGQADPGEHRLGPLQCLAARHPSIAQGQRDVVQRVQPRQQVEALEDEADQAVADRRQSVPVDAEDVVLGEAVGTAVRAVEQAEDIQQGALARARRADDRAAFSGKDVQADVFQYLQRLPPQEVALADPPQGDQWFVLVCCWHSHPTARIPSRPARSYRRKAGDTGRTAILLMMETAHKPPPPATIPRGASAERR

SEQ ID NO: 20691 - protein, 586 aa, Pseudomonas aeruginosa
KNRRPATPAGGFSRARLRQFLVAHAVRLGRGVAQALLAVRLELGVVAFEEGHLAIVLVGEDVGGDPVEEPAVVGDHDGGAGEVQQRLFHRTQGFHVEVVGRFVEQQHVAALLQGQGQVQTATLTAGEVLDELLLVGALEVEATDIAARRDFVVADLDLLETVGNLLPHGLVAFQAVTALVDAGDLHGLADLDGAGVRLLLAGKHAEQGRLARAVAADHTDDGALGNAQGQVVDQHAVAVALGHIVQFDDLVAQARTGRDVDLVGLAALLEFLRLQFLEALQARLGLGLAALGALAYPLQLGLHGLGVGGFLLGFLGQAGGLGFQPAGVVAFERDAMATVEFEDPAGDVVEEVAVVGDRHHGAGEVVQEMLQPGHRVGVQVVGRFVQQQHVGSRQQQAAQRYAALFAAGQVLDLGIPRRQAQGVGGDFQLAFQVVSVGCLEDRLQLGLLGGQGVEVGIRLSIGGIDLVQPRLGLLDLADGLFDDVAHGGLRVQLGLLRQVADVDPRHRPGLAFDLGVDAGHDPQQGGLARAVQAEHADLGAGEERQGDVLEDFTLGRNDLADPMHGVDVLSQNEHLMKKRKKTRPSI

SEQ ID NO: 20692 - protein, 265 aa, Pseudomonas aeruginosa
ARRRPSPRARSGWAWHCSRPWCCRSRPDAKQGVGRSSLLQLIQISLKRTKKTSKMTLAPRSAQLPDSPHRDSLDPAPTPSSQDQRLLKALATAMVNHPRATMGELAELAGVSRATLNRHCGTREGLKRRLESHARSTLERLTHSAALQRLEPREALRELIREHLAQRDLLALLMFEQNPGRQAGHGDASWQSYVEALDAFFLRGQQKRVFRIDISAATFSELFIVLIYGMVDAERRGRAASAGLSATLEELFLRGASNPAQPASP

SEQ ID NO: 20693 - protein, 678 aa, Pseudomonas aeruginosa
RSPAPPHNPRHPSPAGPAPWSPWMSMERLSHQIDAYVAWKRELMREITRYRGWLERSRLNSPAVEAKLERALRQLRADHITLAFVGEFSRGKTELINSLFFAGYGQRMLPSHAGRTTMCPTELFHDPRAERSYIRLLPIETRLADASVAQFKRVPRHWVNIPLDTGDPEGMAQAFAQVAKTKALPVEQAIQLGFHPDALEAADEPDQVRVPAWRHALVNFDHPLLRQGLRILDTPGLNALGSEPELTLSMLPNAQAILFLLSADAGVTASDMDIWQKYIQPLREDGHSSLFAVLNKIDVLWDDLSGERFVQNAIRLIQDGTARQLGLQRGDVLPLSAKQALLAKVRGEPALLERSRLDRLEALLCERIVAQKEALLENSVLGQVLGLLHNSQHLLRLRLEKVEEQRALLDDKQRDSGQLLFELTAKTKDDHGRHHRRLLNLKTNQRLLQHQGATLRETIRSERMEQHLQKVRRNLNGSLTTVGINQAILAFFRAVEHDLDNLEHEAGMANRMVAAIYRRHNEENPLYALDAPQLRVQRYQRELLQLKKKGDQFRLQLKTVLTEQRLLTRRFFATLVQEVVGLHQRLREETERWANDALMPLMQHTLENKQLLESHMLRLKGLAQETQQVRQRSQAFAGFAGELQEQLREAGDILRQLRRPSPLQRQAKVVNLPGSQRA

SEQ ID NO: 20694 - protein, 504 aa, Pseudomonas aeruginosa
PRRYRPCTIRTRSSKRCCGSARPASSLSPTSATGAAAGTWRATAGCRSPSSCRIPGTTRRTSISAPSRTSSACAASCACACSTAWPWTVTTGMAGPAGCGLIYWVRLESTGSPDPECRPATSPSRNAPGCGPGPGAPPLVLGRALPKPAKAAGSRPWTTSMPPFRRNHHAPLHRFRPRPLPEPAGPRRAGAALRRPGRPLQRVQLQLPPAQRGQRGRPGTQQGAGRDQRGADGERQAGRGRRDRLGQGPDRQGHPPGVPPSQRGRRHLQPGAIPDQPARDPGLHHQGRGQGRTCANLQFQQGNLPGRMIKLEQLVLASHNAGKLKELQAMLGASVKVRSIGEFSQVEPEETGLSFVENAILKARNAARLSGLPALADDSGLAVDFLGGAPGIYSARYADGRGDAANNAKLLEAMKDVPDAERGAQFVSVLALVRHADDPLPILCEGIWEGRILREARGAHGFGYDPLFWVPERDCSSAELAPEEKNRLSHRARAMALLKQRLGL

SEQ ID NO: 20695 - protein, 424 aa, Pseudomonas aeruginosa
AATVGAAPGRRRHGVSSGRLGGWPNSCHDSAPKPPPPRPTVTQATPFQLPPLALYVHIPWCVRKCPYCDFNSHAAGPELPEEAYVDALLADLEQDLRHVHGRRLGSIFFGGGTPSLFSAKALGRLLEGVERRVGFADGIEITLEANPGTFEQVKFADYRRLGINRLSIGVQSFQADKLQALGRIHDGAEAVRAADMARQAGFDNFNLDLMHGLPGQSLDDALADLRQALALAPTHLSWYQLTMEPNTVFWSQPPELPEDDILWDIQEAGQALLDEHGYRQYETSAYARDGLHARHNLNYWSFGDFLGIGAGAHAKLSAPDGRIVRTWKTRLPKDYLNPQKAFQAGERPLEAADLPFEFMMNVLRLVDGVPAALYPQRTGQPLAAIADACAAARDAGLLADDPQRLRPSERGQLFLNDLLQHFLP

SEQ ID NO: 20696 - protein, 111 aa, Pseudomonas aeruginosa
SPIAAEPPVSRRPAPSPRASWPPGARMKPIKHLYLHFTDGQRLSLRFPRQQDDPAEVARSIRQQLDTPYLSVEVDGDLLLIPRDSIKYLQISPAPARLDDDGTLRGAELIV

SEQ ID NO: 20697 - protein, 925 aa, Pseudomonas aeruginosa
GPSASVPLPAQRLRGEVARPDLHAEVVHRLVVVQPIDEVAAALEVVDRFQGAGDQRHIVVVDRMDLLGPGQHAILVVDVGGEDLPAVFVEVEAALGVGMAEALAQGRLDHPDAMQLVAQQVGIDEAALEYVAIGEALLVHRVAVVRHQHLALAEQRPLVVVRCTVVDIHGVRRGHAVGIRLQAVVGQGRQAAHAPLATVEAPGLADRQHLVEGFLHHQRRTGQARRRDHLVLVVEQRVVEVLRDHPLAAIDEVQVAVELEQVVAAVGQHRRLVGLQVQLLAAVAHDVVPDRFLAALRQGEGHAGGSALHAVAVGDQLGAAGVGAGSVVQALRQGCAAAGGEDPQVVFRVGLQQGLGARRQQRLVGGHVAAVEDQARTIGGERVEVMHAGPVAGRRLGDAAGPGRDAAIGVAGPLRPQRGQVLVQACGLDFVYLGLRRPGATGPEQQDAQFLQHSSLLCSRPSRAALIIGSGRSRETCSLKVRSAGCSRSAWSPGAGSAPGVRRWCGGSVDALELEVPDAMSQALPAPLELGHRTLLRARHEAAVFGLVAVARRRAHDVQHMLGIRLPVGGHVQHAADLQLAPHQFGEFRLDDPPLVVALLVPGIGEEQQQPIEAGVGHAVAQHFQRVAAIHPHVAQALGQQAVEQRADARLVHLDADEVDVRRGGGHFQGGMAHAEADLESPRRLATEDRVEVLNLIAQFQAELRPAQVEATLLAFGHAPGAHHEALHGAHRPCFVVFRQGVLGRGLRGIAHGKENLARDRRAAFIPSPSRLSVPLAFVVFRVLSSSFASFLLFFSFAPCRLSCSRCFVVSPVSCSLSFRFLPSLLVAPFVFFSFSRLRAVLFFFFSFLVCVLSCRSWPLLSFGAPPGSGLRDFGSLVCPFFARLLAPCLCPLLISVSVFVFVVFVVSFRAFTVFLRFFVLFLVF

SEQ ID NO: 20698 - protein, 564 aa, Pseudomonas aeruginosa
NQTVKQETVSSIKTWHAARYIHFDRIAHAGRRVGTPVPPVPEPTPGVGVVHAARNHDGHSRMTAMPLRGSIAQPGRATIHEMVCRGFDSRSNVALTAITQWQHPPVWPRRTAQAARKAGQRKGAEAAAGPSGPRFGHGARQAGDRGNRSYGQDVRQANLLRAPPTTLDGPATPAPRKNERNEEMKMLKRFIVKKNERGLLYSEGDFLAVLEPGTYRRFDPYDRLSLESFSLNTPQFEHRLAGYLRQSEPQLVERYFTRMDLGDNEAGLRYEDGVLVELLAPGSRRLYWKGQTEQRLERIDLTQDYRLSAALVAQLHQPNLRDRALAGLDAVLLVQVPAFQVGVLKVDGALAGLLQAGQYGFWRYNRQVSVELVDTRIQALEVSGQEILTRDKVSLRLNLAANWRYSDVLTAFSRLSKPLEYLYRELQFGLRAAVGTRTLDELLENKQSIDEAVSAHLAAKLEDSGLEVSGLGVRDIILPGEMKTLLAQVVEAEKAAQANVIRRREETSATRSLLNTAKVMEENPTALRLKELETLERVAERIDRISVFGGLDQVLNGLVTLKQA

SEQ ID NO: 20699 - protein, 375 aa, Pseudomonas aeruginosa
RDPYPRRDHPGRGGRGYRLRNDRRAHLAGRRRPAGQPARPAQRHRAGGTPRQDLRPPRPRRLARGTGGRRPGLEGARRSLQGDHRQAPEAGEDQQPPAPGNPRHRQPLHRGLPGRGRPRLVHAAQRFARGRQRHRQPVHRTGQGGHAPAHRQPAGQGPGLLRGRQPALRRLRGSGRLGPGFCPAEPRADDARGDRGGAPGDPQAVRSQPGGGRLPPQLRAEGAPLRPGGTGHPQRRGVRAEGPARHHSRLDGGEELHRPRPRQPGSVLLVQPRRRADHEPDQGEEGLQRRRPGARHRPRRMPQGRRRDRRDPDGLQGHRPGHGSPARAGGSAAHPASGGVRERMTGALWRPLGKNRNEQGRTPSAPRRHARAGTG

SEQ ID NO: 20700 - protein, 591 aa, Pseudomonas aeruginosa
AGTDRTRARRSRALRLRVGQPGLGLRFAGQRLRRTLRLCASARVVSARRGTSRRDRTSAERRAGHQRLGTAQGVAPDAQIQPGPAGVARLAAGVSGRAWRARGTALAGQRLSLRTRQSPSLPVDGTQELPGLPEGRQRPAEEIPLRPASVVRGALAGCRPGLAAGGVREASGSHAGRSVAARRTGCPAEPQASARRIGLRPSAPGAATLHRSGVAPGRTRGHPTNRRAPGQPTAGSLPPRQDMAIHKGNLMRKDLIELDGSEGGGQILRSALSLSMTSGQPLRIRNIRGRRSRPGLLRQHLTAVRAAAEICAAEVEGAELGSRELAFRPGAIRAGDYAFAIGSAGSCSLVLQTLLPALLAANGESRVRISGGTHNPLAPPADFLRDSWLPLLQRMGAEVDLELLRHGFVPAGGGELLARVRPARWRPLQLEHPGAALRRQARALLAGIPGHVGERELERVRQRLGWSDEERQLEFLAEDHGPGNALLLRIDCEHICAIFCAFGQAGVSAERVAEQVATQAIGWMESGCAADEHLADQLLLPMALAGAGSFTTPRLSAHLQSNRRVIERFLPVRIGDQALDGGGHRIVITSA

SEQ ID NO: 20701 - protein, 212 aa, Pseudomonas aeruginosa
STSSRAARRWPLLTGPVVTPDKEKKRCSPRNCSRLAACCCRSPRPSPRPMPCTTRPARCSNPSPSRSPSCAASPSASNSANSARNCSSTRACHAAMCSAATPATTSAPAAPTTYRRRSVTAGRRGHAIRRRSSTPCSMPRSSGMAVPRTWGSRPRVRSRTASRCTVPRSWSNRPWAASRNTWTPSARPSPRPASRSASTTWRWPSRPTRRPW

SEQ ID NO: 20702 - protein, 498 aa, Pseudomonas aeruginosa
AASSRASNIRCCRPARRPRRVPRNNRHKEKRGSPGAPFFLYGTTSDHALRQHRIGDLDEAGDVRPLHVVDPPLLLAVQQAGMVDRLHDAVQLGIHLALAPTQAHGVLRHLQAAHRHPAGVRRLARRVEDAGLEEQVDGFQGRGHVGAFGDTDAAVGQQAPRILGIQFVLGRAGQRDIAGQAPGPAPFEELQGKLLRHLADAPAAHVLQLHQVFPLLVGEPRLGIQGAFGIGQRDHLAAHFHDLARRVLGDVARAGDRHPLAVEAAATILEHFLGEVDAAEAGRLRADQAAAIAQALAGQHRGELVGQALVLAEQVADLTRADADVAGRHVQVGADVAVQLAHERLAETHHLGVALALRIEVGAALAAAHGQSGQGVLEDLLEGEELQHPEVDRGMEAQAALVGADGAAHLHPVATVDPYPALVVDPGYAEQDRPLGFDDAFDDAGFQVVRVGLEERPEGTQHLFHRLVEFGLIGIAPLQALEESVDGLRHFSHRFLVL

SEQ ID NO: 20703 - protein, 421 aa, Pseudomonas aeruginosa
RPLGPGGAGAQAQTVVELVYPIQRGVGGDIQARRGGSAHTQVQARIGQARGAALDGALGESTVVVVEVVVPLQLVADLRVVGEAQGVAVGRLPHRAGEEAGRGVVHLDPHQRGRVRGRERNPAHARGVGGRGIEIEVLADEAGGALDDHPGAQGEVVVDLERQGAGQADRLDLGVHREIAAFPVRVPGAAHSHRNDLAQTEGEAVVDRYDQEAGRQPRAESGLAAIVGTQLGGARPVLVAAGHGITLVVVGIAVVLDVDIGVVDRQLGDPLVDERHGRRVVERGARIVGKQRAACHRTAPARRVGGRHHEATGLRLGRAEQSADDQGAEQWQWFSGKQAGNIVFVVQGFTPGGLLMHGARWSACLSVLADTLPQTVFHVRTRFCAASGGNSLGPAGPRRTPGSGSAKPLAPRAPAAARITG

SEQ ID NO: 20704 - protein, 73 aa, Pseudomonas aeruginosa
VLSGADADGPHDEPGQTGYRKDPIGFANPPRLKMPTWPTSANAGLTGLAITTKGQWTSQRRGPEYGQRGSGKA

SEQ ID NO: 20705 - protein, 79 aa, Pseudomonas aeruginosa
MPWRADEALSRRNPDTSVNIRVGKKRTMTGRTYQNWQLAKRPSQPKVRLPTIGRTRTARERDPAATRTPPRPPAWSVRS

SEQ ID NO: 20706 - protein, 170 aa, Pseudomonas aeruginosa
YPVRKPSQIPSAARRWPGRTTPGPAPACYRPAPVRGCPARQPGRAPRRRYRQRARAPYGHPAGPAASRISRWRWPGPFRRSGDSRPAPWRGSTPLPAGPPPGPCAAGWPVVRDRRVRCAGRSRAGTARGSRATCARCCSAPAARCAGHDGPAPCPRHAPSRAGPAGCDGP

SEQ ID NO: 20707 - protein, 246 aa, Pseudomonas aeruginosa
ATPTVPRAPARRSRGCPCAAAPVLPRPAVPAPPAAPRHCRRRAPPGSPRAPVPGVRPGRSDAPAGPPVRRPSAPLPCVSRCRRRGPARPAPRQPPGRRRATMPAGAGRKTGQWSLSEISQLSRVMPTIRSSCVCALRNEIRAFNWVFSTLRRSVSKLSTWKLLERPTRSFSRSISSLRRDNAVARWAIWYWRQRVPRSRTASMTFCSRVCRASSIRIFWFSTSTWARTSACRRLRSPMGISTCTPA

SEQ ID NO: 20708 - protein, 367 aa, Pseudomonas aeruginosa
TASLRLRSITCSLSSTDLPCSRAMLGTSGLSAGLTLAATGRAVTSHSTPRPHLFIAQRLDRLQASRRDRRIEPEEQPHQQGTAHPQRQGRVGQGEGPAGEPGVEIRSRHAEHRARERARGGQGHRLDQEQVADVPLARAQRHAHADFPAAFGDTHQHHVHHSDAAAEQGDDPQSGQQVGEGPGLPLESIEHLLRDLDLRLVTGQPRRQGRAQGRADAIDVRSRRDPRHHMADLGGRLQARHARRRHEQRVVGGERQESGAGLRLENADHAKQIVVDRQLLAEAQRIAGRPQGLGDCRAHHHVGVVIVEAREETSFAQPQPGGSREPGAGADDTGVAGASVKGHRRRVQAQHRQVLQTGHVAEQRFGV

SEQ ID NO: 20709 - protein, 154 aa, Pseudomonas aeruginosa
TAHDDTQQRQQRAAPQPAKTGEGLVKQLPGRRAGAHRQASARSSCTSPCRTVSWRPRRAARLGSWVTTTRVTWRSRLRVRSSSSTSFAVLASRLPVGSSARISAGSPTSARAMATRCRWPPERSAGRWPARSARPTRASIASARSSASRRGIPR

SEQ ID NO: 20710 - protein, 86 aa, Pseudomonas aeruginosa
LPILICSKPSETCSHTVLLPSRLSRLWSTLAICTVSPISMVPESGCSLPVSMRNRVDLPAPLPPITPTMAPLGMLRDRLSISTRSP

SEQ ID NO: 20711 - protein, 171 aa, Pseudomonas aeruginosa
NSSNPACRSPRPGAGRRRRSSCGPPARRDVRRSAPWSRRRGSGRSAAPIRRMQVCASRSLPGRSGLFDGCRLAAQQHFFLLMQAMTDAGEKLGLSRETASRLTLQTALGAAQMALSSEVEPAELRRRVTSPNGTTEAAIKSFQANGFEALVEQALNAASQRSAELAEQLGQ

SEQ ID NO: 20712 - protein, 298 aa, Pseudomonas aeruginosa
GVVDDRPQHRCYLYPPDPRQPLPADRAAALHPAVGPRGLLQPPQPVHRARHQAAAEPAAADHPRLRWDRPGLAGAGDPDPTGADDPDPDADGLRRRRLHHATADLVDHRRHLAVPEGVLLRPDHQRDPFLGRPGQLQPRRATGEPDLRTAADAVPQAPAEPRRTGSLADLRVPRAEADRHAGDQQPGGHDRHAPAVEHLPLSFYRWDGEDLLLDCHLQPKASRDEFAGLHGERLKIRLTAPPVEGKANAHLLAFLGKAFGVAKSLVSLESGELNRQKRVRIRRPTRLPEELGIAARPA

SEQ ID NO: 20713 - protein, 390 aa, Pseudomonas aeruginosa
TGALLCSRAGSMPTVFPDDSVGLVSPQTLHFNEPLELTSGKSLAEYDLVIETYGELNATQSNAVLICHALSGHHHAAGYHSVDERKPGWWDSCIGPGKPIDTRKFFVVALNNLGGCNGSSGPASINPATGKVYGADFPMVTVEDWVHSQARLADRLGIRQWAAVVGGSLGGMQALQWTISYPERVRHCLCIASAPKLSAQNIAFNEVARQAILSDPEFLGGYFQEQGVIPKRGLKLARMVGHITYLSDDAMGAKFGRVLKTEKLNYDLHSVEFQVESYLRYQGEEFSTRFDANTYLLMTKALDYFDPAAAHGDDLVRTLEGVEADFCLMSFTTDWRFSPARSREIVDALIAAKKNVSYLEIDAPQGHDAFLMPIPRYLQAFSGYMNRISV

SEQ ID NO: 20714 - protein, 202 aa, Pseudomonas aeruginosa
DWNLPGHRTRSADPQPRRLGTRQAAGQGRAPLRSSSGERCRSRPRPPAADHGQRPCHLSGETTMRRFTAFVLGLCLSLPVLAEQVQRFGDLDVHYNVFNSSFLQPNVASAVGLVRSKAQGVINVVPMEKGKPVEAAVTGSAKDLTGKVIPLEFRRVSEEGAIYNLAQFPISQRETLVFTIKVEAKGEPAQTFSFNKEIFPDE

SEQ ID NO: 20715 - protein, 167 aa, Pseudomonas aeruginosa
PKPPRSSSRPWPCTCTSRGACASARIATSTPTPLARSCPKRPMSTPCSPTWSKTCAMSTAGAWVRSSSAAARPACSRPRPWAGYWKASSAGSASPTASRSPWKPIPAPSNRSSSPTTGASASIACPSACRASRPTSCRPWGASTTAPRQCAPPTWRARPASTTSTST

SEQ ID NO: 20716 - protein, 577 aa, Pseudomonas aeruginosa
LAFYPRLFPIISAWLARGEPVVDASKKVTTILNRSLKIGDMMNLSLLSRYAFFACIALFTLVSLPFLGSTEWLWPFTLLGVALSLLGLFDLIQTPHAVRRNYPILGNIRYLVEGIRPEIRQYLLEADGDALPFSRAQRSLVYSRAKNESSEKPFGTLIDVYTAGYEFISHSMRPAPLSDPCEFRVDIGGPQCSKPYSASLFNVSAMSFGALSANAIRSLNRGAHMGNFYHDTGEGSISPYHRENGGDLVWELGSGYFGCRTRDGKFDPERFAAQALDPQVKMIEIKLSQGAKPGHGGILPKHKVTPEIAATRGVPMGEDCVSPSRHSAFSTPIELMQFIAQLRELSGGKPVGFKFCLGHPWEFMGIAKAMLETGILPDFIVVDGKEGGTGAAPLEFTDHIGVPLREGLLFVHNTLVGLNLRDKIKVGASGKIVSAFDIASVLATGADWANSARGFMFAIGCIQSQSCHTNKCPTGVATQDPLRQRALVVPDKAERVRNFHRNTLKGLAEMLAAAGLEHPSQLEAKHLVRRITDTEIRLFSQLHYFLKPGELLSGKIEGEFYERMWNMARADSFDAAA

SEQ ID NO: 20717 - protein, 128 aa, Pseudomonas aeruginosa
ACSPAATTRSAWPSCSSPPARRSACCWHWSSRKSTGDAIVQAGPALLYGGLLGVGTGFTLQVVAQKHAIASHAAIILSLEAVFAAIAGALFLAETLHLRGYFGCALMLAGMLVAQLWPRKLAAEARPA

SEQ ID NO: 20718 - protein, 295 aa, Pseudomonas aeruginosa
HSATERRQGTVRRAGLVQRNVPLGAQVALAEHLQVGAERLARGLVASQLQAQRRHFGGAQVLATGRATQAIARELLGQQAEHRERLQVRTLAEHLARLGPGRVEQDEQRSLAFRQRGDLVHHPLRRHVFAGEHQVWLPLRVGQQLQQARVDLGARPAEGEGVGHGIGDQPAGVGRFQRLDVVHDQAHACARLDPRPPGAHAIARQQPTAFAARHARTARDEGFQAARQALLAQAGNGMAHRAGSRYGKDGRRNIEDSRKRAGKRPRNSIRARVAPALSDNFRGREKKFFTGASDV

SEQ ID NO: 20719 - protein, 370 aa, Pseudomonas aeruginosa
PYCLSRRMTPPLLEIRNVTRRFGDFTAVDNVSLTINTGEFFTLLGPSGCGKTTLLRMLAGFDQPDSGEIRLNGQDLAGVEPEKRPVHTVFQSYALFPHMSVAQNIAFPLKMAGVAKSEIDARVEQALKDVRLADKGGRMPTQLSGGQRQRVAIARALVNRPRLLLLDEPLSALDAKLREEMQIELINLQKDVGITFVYVTHDQGEALALSHRIAVMNQGRVEQLDAPETIYSFPRSRFVADFIGQCNLLDATVEAVDGERVRIDLRGLGEVQALKSFDAQPGEACVLTLRPEKIRLAQSVTADSDEVHFRGRVAELLYLGDVTLYIVELENGERLETLLPNATPGRAKFFEVGDAVEAAWRFDAGHLVRA

SEQ ID NO: 20720 - protein, 294 aa, Pseudomonas aeruginosa
DDEKEPRQVAAGLAAASVSAVLLPGSGADHAVRLVPLSRRLRRPGALDVQRGRADRLRPQRGELHPAHRELGVPATVRQILRLRPGHHPGLPAARLPGGDHPRPGPGEVAQPADPAGDPAVLEQPAGTRLRLDDHPLAVRCPDPRDQRRTGPVRRAADQPDVHPVRGDPVHGLRAPAVHDPAALRQPGETRPGPAGRRPGPRRRSLATLLAGDLPALAAGAALVFIPVLGMFAIPDLVGGTDGIMIGNLIKSQFLDSRDWPFGSALSIALTGCILLLVALGMGAARARKGGAHA

SEQ ID NO: 20721 - protein, 205 aa, Pseudomonas aeruginosa
TSSGQRSSCADPHRYRRKGDPRSPFCVSVPRTERGNMAPIRHRPSREWADGNNSPPPSVESAYCPRRSSMSRFMALALCFVLPTAAHAASLKDFELSKMLEKVAKESSVGTPRAINEDILDQGYTVEGNQLINHLSVRASHAERMRSNPDSVRSQLGDSVCSNTGYRQLLARGAILTYSFTEYKTNQPVATERFDAGSCRIQGKK

SEQ ID NO: 20722 - protein, 79 aa, Pseudomonas aeruginosa
ARRAVAMLDKQHLLKIARTPMPFGKYQGRMLVDLPEEYLLWFYKKGFPPGELGRLMQLTLELKIDGLDGLLKPLRPPAP

SEQ ID NO: 20723 - protein, 599 aa, Pseudomonas aeruginosa
QRQGAVVIGREEHPDHVAHLAKQGIAEGGVLVRLLVLAVLPGMRSSDQRPAQPAGRTPEFLLLAGEDQGLAHRAEHLHAERFVAGNQVESALVGQAGGHHRLLVERGDDPTAHRFQFALRLADPMLERLEHAAEAVAGQFVGIADPGAQVGVGLHQFGIEAVQRGHRRAGVVAIAQRRDDRFDGMAQGQRVVPFEGTLAALLGEQPAGQFESLRLDPEFVCMLVEQLPGLFVVMRIARQRQVVRGVVAGAIEAEALDRLGDAVGNRQRVAEDAAVLLLHAPLQALLHLPERTDEGGRVAPIEADRIEAAAAQVQLEALQPLMGAQFGALLDAPAIGDHHRQRRPAILGSPPARNPVAAALFLGGTIGEERHQGLAGQRHVRVLQFGEAEVAALGDTAGGMRIHVAAQWRRRCAVGGLGVPVEVLQQAVQPFLAVGIGALLLRVQVAGEDVQRVDGGHAMALAHQPGASLAGQDVECQIAGVGRDHVQGSAGVALGLCLEILGLQRLAVQADAPGVGHVHDDAQGAGGQPVEGAEQLVDAGQVRLQPGLDQLMSGAEHGGAGLCAMLERTMALQPRGKRRLGRRMGKQLVLTGQNLTHGG

SEQ ID NO: 20724 - protein, 368 aa, Pseudomonas aeruginosa
PPVQGGCRRSMRMPYEADDYLSRHFQTSGTDLARKVDELAALAAPGDSPNLALYREMLFTVTRMAQADRNRWDAKIMLQTLREMEHAFSVLEQFKRRRKVTVFGSARTPVEHPVYALARKLGEELARYDLMVITGAGGGIMAAAHEGAGLENSLGFNITLPFEQHANHTVDGSGNLLSFHFFFLRKLFFVKEADALVLCPGGFGTLDEALEVLTLVQTGKSPLVPIVLLDQPGGRYWEHALEFMQEQLLENHYILPADMRLMRLVHSAEDAVKEIAQFYRNFHSSRWLKGTFVIRLNHALNEAALAHLHEHFASLCLSGGFQQQAYSEQEQDEPEFRNLTRLAFVFNGRDQGRLRELLDYINLPENWD

SEQ ID NO: 20725 - protein, 200 aa, Pseudomonas aeruginosa
TVLFHRASRSPTPDGKNVPNGCPQTRLARVLAVAHAQQAGQRGRHRLPAHGVAVAVELAALTDQPLAVGPSQPDRAYRLFRRATVGPGDTAHRHRETRPAVPLGAAHHGLDHFPADRADCREQRLGHLQLEGLLAVRVGHVASLEPARTPRDAGDRLGDAATGAGFRRADLLAQVTKAFAEAGGQCGQVGLHQGHHCSPG

SEQ ID NO: 20726 - protein, 378 aa, Pseudomonas aeruginosa
KRKGTTLHHRLFHSEAAFGQAQPREGSECANMRVPSPSKERHTMNIAPLKVSLLSLALLLSPVASLPAHAACTANLALQPASSLPALGGRLVYHSYMEYGDGSSNLYLHDFKSKSTRQLNQPGWNIEDPMNAHFSPDGRYLTFMGRQNGAWHVFAWAIGGTQAPSNLTAAIGGRNEDPKFSFDGRQVVLKHEGDIRLATLVFNGDGSVGVSAWKAVTGDGWSTEESMPFLTPSGKYVVYATGAGDSLRVVRRNLENGQVSALATPAAGGRDYYPVVRDYTAYFLSRTQPAGNDQLAMVVPNSPPGTPAILPLNHCQGDNSDAAPVNEDYLIFSSTSFDPTYSLLLGDIAAARVWRLDPAQINLPDGRQKLGASYTAAR

SEQ ID NO: 20727 - protein, 313 aa, Pseudomonas aeruginosa
SKHYCHTGTIQMNRWEGLDEFVAVAETGQFTAAAERMGVSSSHISRQVARLEERLQTRLLYRSTRRVSLSEAGQTFLQHCQRLQDARDEALRAVSDLSAEPKGLLRMTCAVAYGERFIVPLVNAFMADYPQLRVDIELSNRQLDLLHEGFDLAIRLGRLSDSRLVATRLAPRVMYLCATPEYLRRHGTPQSPAELGQFNCLIGSSDLWSFLEDGRETQHRVQGNWRCNSGQAVLDAALRGFGLCQLPDYYVIEHLRSGRLVSLLEGHQPPNTAVWALYPQQRHLSPKVRQLVDYLKEGLAQSHPGLAGEKNLR

SEQ ID NO: 20728 - protein, 433 aa, Pseudomonas aeruginosa
SSKAIHRCDRLGGFPFHPLSIQGSRMSAFNAFRQRYLVRFWSPLPALVALGVASAYYFALTGTFWAVTGEFTRWGGHVLSWFGYQPQDWSYFRLIGLQGTPLDRIDGVMIIGMFLGALCCALWAGNVSLRWPTSKRRLLQGLVGGIVAGFGARLAMGCNLAAFFTGIPMFSLHAWAFMFATVGGAWIGVKISLLPFLRTPLKVGATASALPSAESLARRARLQARLGLAVLALAALFAAWRFEVSLVLGMACLFGLLFGGLIERAQICFTSAARDLWTTGRTRAAFGILLGMAAACIGTFAAIRLGVAPKIFWMGPNAIIGGILFGIGIVLAGGCETGWMYRSMEGQVHFWVVGIGNVIGGTLVAIFWDQLGTRLALPYPKLNLLESFGPGNGLLLTFAGLALCLLLVQLNASRFTRPRKPNHEPDRQTDPVA

SEQ ID NO: 20729 - protein, 448 aa, Pseudomonas aeruginosa
EEKGWLLPPLHRTRLGSAAEFRATTVRRLGAQLLFDAQQLVVLGHAVGAAQRTGLDLTGGGTHGQVGDGRVLGFAGAVRDHRGIAGGLGHLDGLQGLGERTDLVELDQDRIADALLDAFLEDLGVGHEQVVADQLDLGADLVGQAFPAGPVGLVHAVLDGDDRVALGQAGQVVGETGGVEYLAFAFQVVLAVLEELAGGAVQGQGHVVAQLVAGLLDGLGDGGQGVFVGRQVRREAAFVTDGGVQATGLQHGLEVMEDLGAHAQRLGEVLRADRLDHEFLDIDVVVRMLAAVDDVHHRHRHGVLAGSAVEVGDVRVQRYALGLCGGLGGSQGHREDRVGAQLGLVLGAVQLDHRVVEGFLVGRVLAQQQVADRAVDVGHGFQHALAQVTALVAIAQLEGLAGTGGSTGRRAGAADDAVVQDHVRFNGRVAAGVQDLTALDVDDLCHSC

SEQ ID NO: 20730 - protein, 368 aa, Pseudomonas aeruginosa
HSEVNERGGLRRLGSLDCRKALDQLVQLLELGQEGFEFVQAQRARTVALGVLGVRMGLEEQPGELLAEPGLGQVGDLGAPAAGGVRATARHLQGVGDVEEYRVLELLHDAEAEHVDHQVVVTEGGAALAEDQAVVTGFLALGQDVLHLLGREELGLLDIDHRVGPGHRHHQVGLSREEGRQLDDVADLGHRLGLERLVDIGDDRYLEGLLDLFEDLHSLFQARTTERVDRGTVGLVEAGLEHIGDTEFLGNPYVFFADLHGQVARLQHVHAAEQHERQVVADLDIADANDLLCHAQAFPEYFSAALTKPLNSGWPSRGVEVNSGWNWQATNHGCSGDSTTSTRAPSPERPEIFRPACSSCGSRLLFTS

SEQ ID NO: 20731 - protein, 194 aa, Pseudomonas aeruginosa
AAPVPRPGSPGMRDSGRRAPPARCCRQRRPAPARPAAGYPATGRPPGSAPANRPPQPASHGGHAAPTAPARLRSGPVGRADAATPWNPARRKTPRTSPPLRARAPGPVTDGIRAAPPACLRSSCDKPGECRACRSYQCAGWLTARRSSSGGRNDAPATHPFPGPGASSVASAVRHGSIRPCSPDRDGRRPAVRR

SEQ ID NO: 20732 - protein, 315 aa, Pseudomonas aeruginosa
WAVSVWRPTLRDRAPGVEPGARAIRVFPPQSAEQRRYRPSRLTIIEEDVVAPELVTQCLDQIVRRIHPPALAELQQGLGVGAGVVQGDRAGTAMAVEQLAQPAQAIALQQVGVQLHPQALRQAGTRLLQAHHALGAQAQSAGEVVLADLALDHHQRVGLQQRLGRGEGFGEQRGLDPSGAVVEGDEAHLVALLVLHHPQVDDQPGHRLGIARRLQLDDALAGEAPHLAFVLVDRMAGQVQAEGVLLALQAFLEGQLLDLAVVGVDIRLRLGEDSAEQVHVPAVVAARGLLGGLDRFLHRRQQHGAVEVDGSLVGL

SEQ ID NO: 20733 - protein, 710 aa, Pseudomonas aeruginosa
LVVVVRPQAIQRTGADQRFQGALVDAFQVDAVAEVEQGVERPAFGAAFGDRLHRPLADALDRAQAIDDPAIVVDGEAELGVVHVRRHDAQLHVPAFFDQRHHLVGVLHIRGEYRGHERRREVGLQPGGLVGDQAVGCRVRLVEAVAGEFFHQVEDVAREVGIDAVVLATLDETAALLGHFLGLLLAHRPAQHVRATEGIAGHDLGDLHHLFLVQDDAVGGLEHRLQAGVLVIGVRIGQLGATVLAVDEVVHHARLQRTRAEQRHQCDEVFQAVRLELLDQLLHAARFELEHRSGLGLLQQRIGRLVVQRDEVDVHRLQALLGLLAVDDLHRPLDDGQGPQAEEVELHQAGRLHVVLVELGHQAAAFLVAGDRREVGQLGRRDHHATGVLAGTAGDAFQLEGHLPDLGGFLVALEEVAEHFFLLVGLIQGHADFERDHLRQPVGETVGLALDPRHVAYHRLRRHGAEGDDLAHRVAPVGVGHVVDHPVAALHAEVDVEVGHGDPFRVEETFEQQVIGQRIEVGDLQHVGHQRAGARAPPGAYRYAVVLRPLDEVHHDEEVTGETHLDDDIEFEVQAIDIDLALGLVVRGVLRQQHLQALLETFEGGVPQVVVDAHAIGRGEVRQEVLAQLHLDVAALGDLDGVFQRFRQVAEQLGHFRRRLQVLLVRIGTRPPRIVEGPPLADADAGLVGLEVFLLDEAHVVGRHQRRVAA

SEQ ID NO: 20734 - protein, 704 aa, Pseudomonas aeruginosa
RQSHRRVEVLLVVDPAGTLHFDVEALGEHLHPLAQQRLGLGFLAVEQSVADLALLGRGQRDQAFRRLLDPVAFDDDLAVALAFAPTAGNQLGEVAIALRVHRQQAQATERAIFLAAGEPDVGPADRLDAGAHGGLVELHQRAHVALVGDRHRRHAQPCHCLGQGLDPDQAVDQGEFGMQTQVNEGYGHEGPGAEITQKRQGPDCTGPGGKATGSRADDAPRLRREASPAPRSGAAVVPDARLELLLDFRELAGVEGRQLAGLALGVVVLGQLDREVGQQQDGDQVGDRHQAHRHVGKVPDERQRSQRAEHHHRQHDQTEDQQARQVVVLEEYQAVLGIEVVGDDRGEGEEQDDHRQEIAAPVADLAGQGILHQHDALAFLRSGQQDDGGGSGTDQQGIDEHAGHLHVALGRRVRRIGRGRGGGVGRRAHACFVGEQAALEAVEDRRADAAGGGLVPAEGTLHHHRQDARQFAEVEQDDAHRQQQVGHRHEGYRQFGEARDGTQAAEDDQRGEDHHGDAADPGRHAEGALHGTGDGIGLHRVEDETEGDDQEDREQDAHPARAQALLHVVGRAATELALVVANLEQLGQGRLDEAGRHPHQGDRPHPEHCAGTAERDRYRHAGDVAGTDPRRQRGAERLERGDSRVVRLAAALEHAEGMTEVAELDQPQAHGEVQAATDQQPDEDLAPDKAVEQVDDLSGEFLHG

SEQ ID NO: 20735 - protein, 84 aa, Pseudomonas aeruginosa
SPICTLCAIMIWLSSFTPLPISVSDSAPRSMVVFAPISTSSPMVTPPIWAIFCQTPFSLAKPKPSPPITAPDWILTRAPMVTSW

SEQ ID NO: 20736 - protein, 509 aa, Pseudomonas aeruginosa
TYARCTPAQSMVSLLGTTYKSEGLAQGELEDLGFRVVRLLDRRRQAEAQRAQRGDPGQADAHGTGEVVGLDAVAVGGGLGRAVGIEGATHVPEQHGTQLALVLDERQREQQLGAAGDQDVTTEGFGILVRVGVATTLIRPRNDLAILVSPRGGTTRPQRAVLEAPHRVEAAGVVVLVERQALGGSVAVAIAQLGVEAHGVVVGQRGEDLAAVVDLVERQVAARQGGFQGQALRVTTGGQHALVQGRFGPADGSLEVGEVVAFLVEEVVDLVHGVAAGVDLVALHAQAIGQARGLADRVADAHAGAQAVHRVAGDVDVEFVVVGLPVEGVVAEADAVDGPVGVDEAEVVAGLVFAAGQADADLVAGTQEVVLADRAAEDQAGALGEADAGGDRAGRLLFDAVVDVDLVVGAGNRRGLDVDFLEVAEALQAGLGLVDQVGGGPAAFHLAHFAAQHFVFGLGVAAEIDAVDVGALARVDDEGHRDGLVVVMGFRHAVDVGEGVALVAQATGD

SEQ ID NO: 20737 - protein, 294 aa, Pseudomonas aeruginosa
VGGGGHHLAREHLALLYQQQALHFLFRHLQVAGQLHVADGVLLTLVDVDGDVDVLLVRGDGYLGGGDIHVDVAAVQVIGAQALEVAGELFAGVLVVVLEERQPVGGLQFEQVGQVFFGEDGVAHHVDVGNRGDRAFVDVDLQRDAVARLRDHFRVDLGRVAALGHVLALQLVAHAFEGGALEDLALGQAGLFQALEQVFLGNRLVALDLDAGDRRALDYSDYQHVAITAELDVLEEAGLEQGAGGLDQGLVVDGLADVQRQGGEHATGGHALQAIDPDIGNSEGLGVNLGDHQR

SEQ ID NO: 20738 - protein, 110 aa, Pseudomonas aeruginosa
LRGSDWKIALCSLSIGRSTAPLRLTACMNSAPDITSASLLASSTRLPASTAARVDGSPAAPTMAAITMSTSGALATSHNACSPNSTRVRTPAAASKPCKAIAAACSGTTA

SEQ ID NO: 20739 - protein, 495 aa, Pseudomonas aeruginosa
RTGLGLDLLAGLAEAALALGEIRQGSPHRRVLEVGPEQVGEIQLGVGQLPEKEIADAMLAAGADAQVGQRLVAGHQAALEQLGGDIVRRQVPALDLARQALCGLDDVPLAAVVGGDLEEETGIAGSGGFRFAHGRLQLRMETRAIADDAQADAVLVELAHLAAQGHEKQLHQRADFVRRTLPVLAGEREQGEDLDPCLGADLDHRPDGIDTGLVAGDAGQKTLLRPAIVTVHDNGHVAWHAHILPGLFHDVSPASDSHEVRFFGFQCLLDLTDELVGQLLHVVAGAALFVLADFLFLLQVLQLGQRIATDVAHGNPRLLGLGTRLLGVALAGLLGQGRHRYADGGAGGGRVEPQVGGHDGLLDRLDHALVEHGQGQGTGVFHGDVGDLAQRRIGPVIGNHHAIQDARMRATGTNLREGMAQRFQGLAHALLRFLLDLVDHSQPSSIRVPSAPPTTIFSNAPGLFMLNTRSGMFWSRHRQMAVRSITPSLRSSTSS

SEQ ID NO: 20740 - protein, 151 aa, Pseudomonas aeruginosa
APTTSPSTRVRRRMLTFSPVLATRARRASSRASTSGAASVSFSLKAFSRLSATKPLKSSWRARKSVWELTSMITAALLSAAILTAIEPSAAMLPAFLAALIAPAARMSSMAFSMSPPAAVSAFLHSIMPKPVRSRSSLTMAAVISAISKSS

SEQ ID NO: 20741 - protein, 332 aa, Pseudomonas aeruginosa
VVALKKPLCPACRAETQRWQKGGLAPFLRTVGRLNVPESAFGGFGRRFLDELVGAGGSALLAADYRFAHRVQVELHGADGIIVTGNYIVDAFRAAVGIDNADDRDAQLVGFGDGDALVVDVDHEQSVRQAAHVLDAAQAALELLEVTAAHQGFFLGQLVEGAVLGLGFQVAQALDRLTDGLVVGEHAAQPAMVDVRHAATSGFLANDLAGGTLGADEQDLVLASGQALNEGQGLVEHRQGLFEVDDMDLVARAENELAHFRVPVTGLVAEVHTGLQHIAHVDLGHDSSSISRVRPPRIPMTNPCGHPGHRVDACVGLCSGKGRSLGAGRFIP

SEQ ID NO: 20742 - protein, 285 aa, Pseudomonas aeruginosa
IGRSGLLESRIPYSCVLARPKRIRMTVTIKTPDDIEKMRIAGRLAAEVLEMIGEHIKPGVTTEELDRICHDYIVNEQKAIPAPLNYKGFPKSICTSINHVVCHGIPNEKPLKEGDILNVDITVIKDGYHGDTSKMFLVGKTPEWADRLCQITQECMYKGISVVRPGAHLGDIGEIIQKHAEKNGFSVVREYCGHGIGKVFHEEPQVLHYGRAGTGIELKEGMIFTIEPMINQGRPETRLLGDGWTAITKDRKLSAQWEHTVLVTADGYEILTLRNDETFPRTSAA

SEQ ID NO: 20743 - protein, 801 aa, Pseudomonas aeruginosa
HRQGPWRRPLGTRRGGRRGLLPEPPVAALGHPTGVLAGAEPPGDVDHRATQGPLRPAGDLRFRPTGRRPDPPRLPVRAHRGRHQRHQPDALELLARQPAPAALHRDQARPAPRPGEPGGPRGADPPDADRGPRPTGTQRHRPGRCRAVMEPARRRLLPAPHRRRRGLAHRGDPPAPGRRHAAGADQGNHPARVRERFADLHLRRRPARFLRGHRGRHGPAQPEHPGRADHHLHQPVHPRYLYRARRRRRLHRQQPGAHRRDPRGAYRRIEEPRRLPDHHPAPGAAPAQALRLRPAGDHLHRRAAPGLGARSHRPRPPRPAGADRRHLPGFRPVGAERQDRHPRRARGGRLLHHRCAQPAARRPRPVQTPAGRPGRAAVTRQRTGHPAYPDKLLRSLANAMNTALDNLQPYPFEKLRALLGGARPPATLKPIALSIGEPKHRSPSFVAETLAENLDQLAVYPTTLGLPALREAIARWCERRFSVPAGWLDAARHVLPVNGTREALFAFTQTVVRRSEPGEAPGLVVSPNPFYQIYEGAALLAGAVPHYLPCREENGFNPDFDAVDEATWQRCQILFLCSPGNPTGALVPLETLKKLIALADRYDFVIAADECYSELYFDENAPPPGLLNACAELGRTDFSRCVVFHSLSKRSNLPGLRSGFVAGDAEILKKFLLYRTYHGCAMPVQTQLASIAAWSDEVHVRANRSLYREKFDAVLAILDGVLDVQRPDGSFYLWARTPVDDTVFTRELFEQQHVTVVPGSYLSREVDGENPGANRVRMALVAPLAECVEAAERIRDYLRAR

SEQ ID NO: 20744 - protein, 239 aa, Pseudomonas aeruginosa
SLRGETKRDRRGDPFFVHTQRAKRLVSQLSCWSSSRRMSPRVSSSISLLRRCRYSSRRCARNAFRRKALSAISRAWAWSRASSVVGAVSSDWRYSAMICARASATREVFAASLPSTCGNSSLSRARIAASAVLRQASRRSRSWAPLLLAGSPRSSSGRPMVAPIREIRITLVAMKMIRSRCGKALPSIRLIGTDSTAARVTAPRTPLNALRAERRRREMPLSPGGLLPRQRSMRSDSFQ

SEQ ID NO: 20745 - protein, 206 aa, Pseudomonas aeruginosa
PAPTTVKNTRPNAIIRIGQRIRQTSRLGIRQPSTNSSGGMNRKRNSSGSRAMCSPRDGKASRAPAAIWISGSGKGSNWAARRVAPTTSSRVRTVYTVCMRAGISGFVPGRCDCVDCTIAIGRQLSDIRTIRTVFPSPAALPRASAPSAATTGAPGQGSRTSTSELFHSGARRSYTPLQSRPAVASARTTPRRSTGCSAHSDKGMPP

SEQ ID NO: 20746 - protein, 149 aa, Pseudomonas aeruginosa
PRDRTGAERRGIIRRSPFGDLSAGPGKTRASGEAMTYVLYGIKACDTMKKARTWLDEHKVAYDFHDYKAVGIDREHLRRWCAEHGWQTVLNRAGTTFRKLDEAQKADLDEAKAIELMLAQPSMIKRPVLELGGRTLVGFKPDAYAAALA

SEQ ID NO: 20747 - protein, 211 aa, Pseudomonas aeruginosa
AGGRMSVAWALFVPACFALNLAPGPNNLLSLNNAARHGFATASLAGGGRLLAFAGMLALAASGLALVLHTSAWLFLAIKVLGAAYLLWLAVQLWRTDAQPLVNEASPARPSLWRLGRQEFLVAAGNPKAILIFTAFLPQFVDPGQPLGAQFAQLGAAFLLLEWLAIALYSYAGLHLGRLLAGQRARRLFNRGCAALLGSAGLGLLLSRRPA

SEQ ID NO: 20748 - protein, 398 aa, Pseudomonas aeruginosa
TKRCTRTTEPSSPPRSPDGARQRRRVRYPFPCNRPRTVSAMSLPSPWRADFPAFSAFAAEGLTYLDSAATAQKPQAVLDALNGYYLGGAANVHRAQHVPGERATRAFEAARSRVAHWLHAGNPAEVLFTRGTTEAINLVAYGLERHFRPGDELLVSALEHHANLLPWQQLALRRGLVLRVLPLDERGVIDLEQARHIIGERTRLLAISQLSNVLGTWQPVVELIQLARERGAWTLVDGAQGSVHGRHDLPGLGCDFYAFSGHKLYGPDGIGVLWGRPQALEQLAHWQFGGEMVRHTGFHEASFHAAPLGFEAGTPAVSAAIGLGATIDWLATLDEAEVAAHEGALHARLLAGLLARDGVSLLGEPQAALASFCVDGVHVADLAHLLGEQGIAVRAGHH

SEQ ID NO: 20749 - protein, 274 aa, Pseudomonas aeruginosa
IPPAPAALHRRNAGRRTAPPRRWPLPHRPACALWAIAGPAGSAARRRRDRDPGVRPSDSAVAVRAPGRRAAWRSAGRATPARCSATAGACRSARPAGRPVVVRSYRHAAHPCPPAAPEARRTANAGSGVAPAPRHAPPGQAARGSSGWRSSPRACAPLPTPRAAPTSVAGRPDSRPWPAGPTRPHAARPGYPANRRQTACAGHSASRCPVPAASALPPARQVPRLRARAAARRRFRPAPPPAPAGRSAYCAACVNALPGPCAGAARASRAARRP

SEQ ID NO: 20750 - protein, 182 aa, Pseudomonas aeruginosa
GLLPRAYRPAALGAPEREPGRRVPGRRPLGAVGQPDPRDHQPGAAGVPPGVRPEAGQAGPQLCGERAHRAERPVAVHQHHPPLGETRRQRPAALSRAGRIGALKHTAACRRCEPAVPSSTLHLLFATGCRSTSRRAAGYPVRSTSRTLSCSDSLPSAPACYSRPTPSPCPSPTCRRTTPPAA

SEQ ID NO: 20751 - protein, 492 aa, Pseudomonas aeruginosa
SPGRRRASARTRRLPPPAWPRRSSARPGEPTDGARSPRPLLPSGPRLVLLHAEPGGIERRQEQQGEHGGDDQPAHDRHRHRPEEHAARQRDHRQHRRQRGQHDGPETPHGSLDDGVPAIQSMADVLFDLVHQDHRVAHDHAGQGDGPEHRHEAERLAEQQQEQGHADQAQRCGEEYHRHPREAAQLHHQQAQHHHDEQRHAGVHRTLALRRVLHRAAHLQQVAVRQLGADRFQGRGDLRDQGRRQRIVVDIGAHGDRRQAVAVPDDALFEAVFERSDLRQRHAPAILGRHRQARQQRQVTTLLLGAAQEDLDQLVVFAEEAHVRAGQRALQELRQAGGAHPQGTGALLVDAQVHHLARLFPIQVHIHHVRVLAHLVGDLARQFANLRDVLAGNPELHRIAHRRPVLQATDAAAQVREVLVHPLDQPLAQRLAALQVLGQHHHLGEAGRRQLLVQRQVEAGRASADVGHVVVDAVMALQHFFQALDFLAGRAQ

SEQ ID NO: 20752 - protein, 749 aa, Pseudomonas aeruginosa
GALRQLDVQQQLQTRRGREELLRHQAEQQQRADEGGEGQDDHRLAVAHAPLHQTPEALVEGRSIGIVAIGAAAVLLRVQPGQVRQQLGPQVGNEDHRGEPGDHQGDGHHLEQRAGVFAGAGLRGGDRQEAGGGDQGAGEHREGGTGPGEGGRLETVVALLHLHRHHLHRDDRVVHQQSQRQHQGAEGDLVQADAEVMHGGEGHRQHQRDRQRHHQAGAQAEGEEAHQQDDHQRLGQHPDELADPGTYRRRLVGHLAQFQSGRQRLLQAGELGFQGLAQHQDVAARLHRYRQADGVLAHEAHARRRRIVEAAANLGHVADAEGAVADADGEVADLLHRIETPGNAQLHAVAGGLEEPGGGHRVLFLQRLLYRRQGQAEGGQLGVGQVDPDLLVLQADQLDLADVPDPLQLQLQAVGIVLHHRVVEALAGERIDVAVGGAELVVEERALDALRQGGANVADLLADLVPEFGDLAGMDVLAGHEGHLRDAGAGEGHDAIVVAGFHQLLLDTLGDLPGHLFGAGARPVGLHHHGLEGERRVFALPQLAVGQRADRAKQDHQVQDDLAILQRPGGKVEGHATTPWPPVSPCGWPGRSDAPAALREAPGPRWPPPSRQPSGLRAPAPGPRHRDRCAPPAGAGSSCPARPPRRTPGRPLRSAPTREPITAPPRRRRRRPARSGPVRPESRGRRRPPGRRRYAIADRPRARARGYARRSVCRVATRVRPTPAGRCGNVRSCVPAGRSAPRVRRRRPG

SEQ ID NO: 20753 - protein, 312 aa, Pseudomonas aeruginosa
PCRRCGRPAPARGGRGSRRERPGSPPPPAGAGRRSPDAPRLAAACRCRRRRGTGRKTGTGRRAGYGGTCDTFRKLRSSSYTGRYSKNTEPISPVFQLYKRMSEPTSSVGPGRPKDPAKREAILEAAKRLFLCNGYDGSSMEAIASEAGVSKLTVYSHFTDKETLFSEAVKAKCAEQLPALYFQVAEGAPLEKVLLNIARGFHRLINSHEAIALTRLMAAQAGQNPKLSELFFEAGPKQVIDEMERLLEQARRSGKLAFPDARHAAEHFFMLVKGCANYRLLIGCAEPLDEAEGERHVEEVVALFLRAFAAGG

SEQ ID NO: 20754 - protein, 152 aa, Pseudomonas aeruginosa
PRSPGWRGRTHPGPGRPWRPGPAGGCLAGRRPPWRSSVRCRRRTCAGGRWRPRRNRPAPDRGSPPPVARPASPARRPARRTPPRRPPPAAGRAAPPSAAQPRRNRRTGLGHAGEERRNRSWSGNRRGKRGFCQSWPARAHRQTFHRPMSRWK

SEQ ID NO: 20755 - protein, 453 aa, Pseudomonas aeruginosa
RRQAWQALAQQRMETLGLLGRQVIVGGMQEYVWSQAGLDPVGHLVDPGQKEHLVGRQVGTADETHLWRIAEGRRTDRQARLLRLGVEHRRIVRTATEQRPRIQADALHATLAQVAVEQALVLAFVEERRVAYFHGNPSRTQLIEEIQQFAQALRGERRRQLQPQRADPFAKRRQQFEEVAGGLEPFAQVAFVTDIAGKLGTEAEPRRHRLGPAPHGFRRRPGIEGGIALDRVEDAAVVSEVVGGTQFARIEAAAPGRLVPGWTTEEIRKGNHGSAGNRSGVEVEAEDILGAGVDVEAGGGVVAGQGHRRMAAYRALERQQVAGADRQAVAARRTGLDLARLRRLLEALAAGNRRRLLAPRLDLALHVAIRRDRGARSGAALQRQRRGRKTVDTHDQNPGKSPHSSQPRKAWQLPLRGIFRALFSASPRCRAGTPAAPVPPPRLRRAPRRSRPG

SEQ ID NO: 20756 - protein, 263 aa, Pseudomonas aeruginosa
RTVSSLSSSRWISSSPVTSSLPATFGGLCSVWYTRPEAGCTRRPAIRDTISSSSTAISTTWSMVTPASFSASACGMVRGKPSNRKPLAQSASVMRSLIRAMMMSSDTRPPLSITPFTCWPSGLPALTAARSMSPVEICGMPNFSVMNRAWVPLPAPGAPSRITRIDMLLRIGKRKSGSASWGQSRICRKRHCMAPKRLSKIHSAPPPHKTPKVAPRLPSSGVAQSGGDPRDRHQQRLLQAAAGVALAAPRTGQKLSLEQVQRV

SEQ ID NO: 20757 - protein, 817 aa, Pseudomonas aeruginosa
TASARGAKSCAPRSWPGSWIALLQLVEAVGHRIALIDAARACRARAMALDDRHRRVVRQLAPQFKFGLEVADLPVERVALVVHGLDRQLVGCHVGLFLAGEQRALEQQRLLQHRRQRHLGREAPRQQVLVGLIAQRLDHAARDRQRRAASLAQVLKGGIARAGNQLLKDLQLRLVLFLDQRRQPDAGHRLGLGAGVARALHLLSEDPRGPFGRLLRRRPGLAGQARATGGRDGGGVRHAATVDQVVARAGDVADHPDGGLARTTGIAAAHPGNAVVAAARLGLLDSRHGIVAANRVTQGHAFGHLAPAKLATRRLGHLLRHGAARQLGAVEVQPRLQHAVGQQVVQARIGALNDQRRQRCNRAGRALDHVAHDLLKAVRDAVELIAQRGLDAHIAADQVAVPPHADPDGAHAGRAAHGHRTATADRVHDVIAEDGAAVLVSDLRPRQAADQSERAGQRRRAQQAARLGGKVDRFRTLHRGTSEEIDAAQEHLPAAFAARIGTPQRPGVVALLGLGQRAAVREHHAGVGQARRQLLPLARRGITLHQRAGRPVAVAGVGKQRLVHVDLPAARDDIARALGHHCPGFVVVGLVQEAAARIDVSPEIHRGARTDLAHARNQRLRVGHFRHVVAPGQRVQGAEQIRHEGRARALAEIARRRRELVEHLPARMADDIAVLEFGEVVFVVFVSGPIAAGLCGGIGRAHRLHLDPGVLAGVAVAGDDRIGHVVPDLDRRAHRAAAIGAVQPVADAHHPVLQAVRRHDGRDDRGGVQGVAACGGGQQQRGHGHAQAAQQIEWARHGCALRCCSMRAMARATSGSP

SEQ ID NO: 20758 - protein, 178 aa, Pseudomonas aeruginosa
SGSSHAPAGGPEARARDQHMATDPACHQRMARGDAPLQLPIQPGVGTPTLEAAQDAAADEDAERHAQDDERRRQRDRAEHPGQRRADQQAGGAGQAAANPEFVSGEAAHHNGMAVEPVRKEGDRSVRTDVLLLGHTGLAYRMPVASVSSQMPITSSTAPMATVRPNWPHVLRPVWISA

SEQ ID NO: 20759 - protein, 159 aa, Pseudomonas aeruginosa
ELPMTTATAQSKMTLPAAGEVKAAVQGQRALAAYLATQFETQHIQIFDDHKQAHQVELPTSALRLLVDILAELADGNAVKVVPVHAELTTQEAADLLNVSRPHFVKLLEDGVLAFHRTGKHRRVRFADLMQYKEARERASEQAMAELAQQSQELGMGYE

SEQ ID NO: 20760 - protein, 320 aa, Pseudomonas aeruginosa
RVAGSRRTWPGNQQRYGCRAQAARAAAAVPGEPGRKHRHRPRASWSQYRSASRLARTVWPQVPTVLIPSASIHVPSRYSMSQWSLSQLLSSLHEDIQQRLSVVRKTFGHPGAKGDASENVWIDMLDTYLPKRYQAAKAHVVDSLGNFSQQIDVVVFDRQYSPFIFTYENETIIPAESVYAVFEAKQTADAGLVAYAQEKVASVRRLHRTSLPIPHAGGTYPAKPLIPILGGLLTFESEWSPALGPSMDKALNANLTEGRLDIGCVAAHGHFFYDQASGAYSYTNENKPATAFLFKLIAQLQFSGTVPMIDVEAYGQWLTK

SEQ ID NO: 20761 - protein, 659 aa, Pseudomonas aeruginosa
GVAVASIRSEYHRFLAHLTQRHVHDDVRRLAHLVLDHLQPLAEVGAARRGRSTRLAPLAIAHLAQMPVAYDGDARGPENGPALGRLHQLEVGPFRGFMRQETFDLSHDITLVYGANGTGKSSFCEALEVAMLGSISEAQAKRVDQRTYCNNARLRRHIAPVLSSTAAGEAQAVQPDEAEYRFCFIEKNRLDDFARIAARTPSDQRQLIATLFGVDQFSEFVRGFNPSLDQDLMLAGVQAAQLAQRRLQLANSEQTIAAYPQKIAAVEGLEQALAQRMSPGATYQTCVDWLLGTPQQQGRLPYVQAQLDANPPAIHEVTQARLQALLAEAYRVQGLWQASSAQLAARAGEVSYAKLYEAVQALADGATACPACGTELAAVAQDPFARARMGLEQLAQLAVLQQQEAGHRTQLSEAVRALCDEMRRVVAAAGVACPAESQAAGLPLLPPTSAGNWLGGGVNGDQRAWQALLRIAQIIEGFDARARDVNAQRGAMAQERDRLQQHQLEIERLRTMRTTADQELAAARQTVAQFDDANRGLIQAATDEMPVVVHHQRVKAAYDGFLPEIQAYLTALPGVLLQGLGDQARHLYNAFNRADARRSAARAVVARGRERQDRGGVRRRAGRALRRVDRLQRRAHQMPGPGDSACQEPRAGLPRGHIR

SEQ ID NO: 20762 - protein, 124 aa, Pseudomonas aeruginosa
CRRPRRSARSSPATGASGTPGTRARSRARLCAVSTLTTRPTAPRSRKAAARRCNQTREASSSPMTANGRRPGASITRRATVPGVSLLLRTGSIAASSAGVAGTRGVGMGGRAGALARGWRFRAS

SEQ ID NO: 20763 - protein, 415 aa, Pseudomonas aeruginosa
PGCRGRLLGTTKQGVLRYRHDAAPTHRVVPVAADQESRCHVVAARTARHRPPVRPEPMSATDTAGPAPANSAMSGFERYLTLWVAVCIIAGIALGQFAPAAFQAIGRMEIAQVNLPVGLLIWVMIIPMLLKVDFAALGQVRQHWRGMGITLFINWAVKPFSMALLAWIFIRHAFADWLPADQLDSYIAGLILLAAAPCTAMVFVWSRLTGGDPAFTLSQVALNDTIMVLAFAPIVGLLLGLSSITVPWDTLLVSVGLYIVIPVILAQLWRRALLRKGQAAFDRALERIGPLSIAALLLTLVLLFAFQGEAIIRQPLVIAMLAVPILIQVFFNSGLAYWLNRQAGEKHCVAGPSALIGASNFFELAVAAAISLFGFHSGAALATVVGVLIEVPVMLLVVRVVNRSRGWYERRATTS

SEQ ID NO: 20764 - protein, 323 aa, Pseudomonas aeruginosa
CAQGQRKAPQRVRGGHDGAVRLDQRGLSPRTCCFQMANASSAGSSARMTMGWSCRLRSFAKYAARSAMALSLMPLRNSSRPSLMNSTLLPMSRLNAVRSLRSACMASANWSTRKSSVMSMRSGSSSSRSTSSDAGGRLLANSSAWASSAAWPCNARTNVEPPCPSLRASAMGLPSNMTVAVKHSVSSLAKSATLRFLSVMRSCRVMVSMESPDIDRVDDTPLTGRGIHPVGWRKVASMPGGQRSPVRCRGELAGGVGGTHGSLDTLAAGCCRCVGNAGGRIARPAGRVVHQSVALDPVLCRHCTSRWPSHATHGTAMELPIAL

SEQ ID NO: 20765 - protein, 87 aa, Pseudomonas aeruginosa
SLAGGQGAASIRMRRKAVSQQTEMSRPPVLCALAAQRATVPWGPLRRWAFTLALRASVVDGLRAAPHVALSFDAILRSTAVPRGPFR

SEQ ID NO: 20766 - protein, 86 aa, Pseudomonas aeruginosa
TGLLHAFVEAGCHYTGAALRSGEVSRSDVKMSTCGVPMPAVVSYSRPGARQSTRHHPALPAERAQVMIVASWSSIANPLSSWTHQA

SEQ ID NO: 20767 - protein, 490 aa, Pseudomonas aeruginosa
PRLALADGVAIALPGIGGERCVEIVQRVGVAQEVTGQRPVVVGHPGPLSTMDVQDHLAGFRLAVQVAAKHRGLSEEEVEELSVQAGSGLHAEQVDADQPGLRWLPLLYFEMTEDPVQLGIEGGFAGIAMRGVGEQAVGGLLGGVELFEQGIEDGHLVFPRRRLGMADSFVEEEPQRQAGEFARMAIADGAAGPVGVVERRVLVAAPDLAVEVADELVRLAVANRARTEQFQGAEVDRRLVDGRWRRGPAKTLCQDEAGEIDVLRRAFAAQVALTVGRGERIAPDHPLQSQFEQLIVRGLASLLQRLAVDVRGDAAGTHQQPDQGKLLAFLQAHLPLADAEDPAVARPAAVAFHRQDAGEVTMEVEGIAMEPDRFFQLEIGHDGSPVPGPGAAGPVGGGYDWVSLPPRLARVSLYLAMLWSILSMAKLADSASIAPAAAATAAAAPISRSVARAPSASSAAWASLFSAMFWVICRSRIAWLARAILLTPSK

SEQ ID NO: 20768 - protein, 183 aa, Pseudomonas aeruginosa
GTGRPCRATGAPTHGSPRAAADRAARAAAGTVAAGCSGVNSGLPLTRSSACLRLRQIDRQLRRGTTCSLQSNQWGRVRRRGVKLRLPGRTARYGLGALRQSGGRSVFYSERVARFGLAGGGPERTDGGRGGTAGGRGGLSAAGCPRAARATAFRGSSRTFRRALRLRSGARRGAGTGRSLRPA

SEQ ID NO: 20769 - protein, 537 aa, Pseudomonas aeruginosa
FLRLARPQRRGQVHHHRDSLDPGEQDQRFGLGVRPRPRQGPGRPQALPWRGAAGVQLQPVREGLRHRRDPGRLLRHPGEDRQGARRALPDPTGPVGQAQRSLADALRRHEAAPDDRPRTGPPAAPADPRRAHRRGRHRAASFDVELPHRTQPGRHQHHPHHPLPGRGGAALPQHCHHRPRRDRAEHQHARPADDPAFGNLPARPEERPGPAADPRRLSDAAGRRPHSRSAGGEEPGHQRPVRPTGCTRHRGTEPAQQDQSPGGAVRVAGGEEPDEDRPMSSELSANLVALNTIVYREVRRFTRIWPQTLLPPAITMVLYFVIFGNLIGRQIGDMGGFTYMEYIVPGLIMMSVITNAYGNVVSSFFGSKFQRSVEELLVSPVSPHTILLGYTIGGVLRGLAVGVIVTLLSLFFTKLQVHHLGITVLVVVLTATIFSLGGFINAVFARNFDDISIIPTFVLTPLTYLGGVFYSINLLPPFWQTVSLANPILHMVNAFRYGILGVSDIRIGVAIGFMLLATAVLYLGCVRLLVSGRGMRQ

SEQ ID NO: 20770 - protein, 273 aa, Pseudomonas aeruginosa
RSIRRSARPPPCRRRTAGSGGRRGTSASRTRRSFVALFENVAHAAHGMDQALRVVVVDLGAQAADGHLDDVGIAVEVHVPDLRGDQRLGQHLAAAPQQQFEQGELLGGEVDPLALALHPAAQQIEFEVGQLQGGLLQLLAAPAQQGAHPGEQFDEGERLHQVIVGALFEAAHAVLYGIAGGQEQHRYGHPGVAHAAQDLPAVTAGQHDVEDQQVVVAAQGQLLALVAIVAQVDGEACLGEPLAQVLADARFVFDDQQFHVHPSLHLPAMPTCF

SEQ ID NO: 20771 - protein, 536 aa, Pseudomonas aeruginosa
PRPASRWWRSASSRSRRTRRTSSSRSRSSFTSIPSTSPPSIVARRFARYCRKTSRPLPGRPWACACAASTRLPRRASGVCRGAASTSWTSPSTATSSRARNCCAATPGGSSRSSSTATCSSPTARSPASPTGAPWWSTTGARRWTRPACWPTWFPSASTRTSTNSASNASSSTCSACCSRRRSASTRATYAVAAWISIPTAAWRRSHRTTDAWCASNASQHADTKKPRPCRGFSFRQVVQIPMLARLCTMERSVPARVGWLTSKRSTARLTPSTRLPSLRASSLASFSSMSLIRSSSSARCSSFSGGCCSSCSRRADSSRSRLSFGMVFPSTYKSSVDLRRAPKGPSMPNRLTCRAQMCAIRINPQQAFQQREEVRQFWGAHGRVLGQVVEAAQGQAVLGIGRLDVGRGGTLVERPALQHQAVPGGRRQAGVVARVHRAEEALGRYVQAHRLPDRLWEQLAQQACAEFLVAQVLLVDLRRVFVEVADIVQQGGDYKAVRATGALGQGRTLQRVLGLADCLAIGLGAMAGEAFGQFV

SEQ ID NO: 20772 - protein, 244 aa, Pseudomonas aeruginosa
ISEAVMPVDQSRQYLRIRDQLAADIAQGVLQVKLPSERELAERFLCTRITLREALQQLETEGLVYRENRRGWFVAPPRIRYNPTRTTGFMEYVSAQGRQPRTETLHAERRAAGAWLAKRMGLEDSAPVYFLQRRRWVDERPVLIELIALDAGWCPGLLDHDLDTSLMSLLRERFGLQPTRCQLAMHPTALNAAQAEPLQLAPGSPALYLERLSYAEGQRVVEFDQEFWRPDALEIVLDAAYPGA

SEQ ID NO: 20773 - protein, 171 aa, Pseudomonas aeruginosa
YRLAGVEQEPCMSTGKIQFAEQNGSFVLKFVGEVRLTLCSALDSTIEKIFAALNFSAIIIDLTETQSIDSTTLGLLAKLSILSRQKIGLLPTLVTTNPDITRLLQSMGFDQVFNIVDRPIPCPECLSDLPPQDQSEDVVRDKVLEAHRILMGLNESNREAFHDLVSALERH

SEQ ID NO: 20774 - protein, 425 aa, Pseudomonas aeruginosa
ILRCAGTGRPACASRRQRRSVAGRQLVFELFLVACEQADAFGQLFGGHGVLVHLPTESALVEHLARLAFAWQQQARQLALGVSQLLQQVGTDGQAVAAGQLLDLAEIAEAGAHHHRLVAVGLVVAIDARDRLHAGILGAGVVAVLALLVPVVDAPDERRDEEHPGVGAGHRLGEGEQQGQVGLDALAFQNLGGADSFPGGGDLDQNPLAVDALFVVQLDQAVGAGEGGLAVERQARVDFGGNTSGNDSEDVLADCHGEAVASQSGVAAATRGSLSKVLGVARQGGGLEQQRRVGGGVHRLQAGNGIEVAGVGDHRGVLLELFQLRSHGEVLSGGFLGRRIPRPYPSRRRGSMGAIAPPEVPAPGRKPAADRRPCARPPRAVGGIAGSRGSPGPGRGYGGSRDASRRLRPGVARCTDADGARPRCD

SEQ ID NO: 20775 - protein, 444 aa, Pseudomonas aeruginosa
CLHLVHLDTLRRDWRGLNARGITTLPDVHVSRAWPARQRRSQRLEVCVGVEPTRAGGPWQLLALPVCPCRPSPFEILRSWHGPVRWAVRRPAPASIKDRCMRLPRPRFALSAALLLCLSGCVSELDSGAYGSMDDPRNAQMLDLVDQALKGNMAVVLVADVMPHKSLSDALTMTQWTPTAIWEYEKDPKVTFGRKFQTNALQRKPDETYLFKAFEVHILPPGKYLLTGGDDYQIHGLLDQVGARSGPPGSGHGANGTAYLSPELYREYYREEVWKDATYGSEIKTEKVCTAVHVASGACVSWGEQQYTQTTQGSQAGYYQQTDSRDVPSIKVQARLPVDKALASFTVQGGQLLLAPRMHLKTPGYKYQQSKCRAIDPKKIECPLENLTVYTWPAPMDFSQSLIAQRALSDKHRQLLSRLQPLQITPLRKQGMEDPVWGVPLSLK

SEQ ID NO: 20776 - protein, 205 aa, Pseudomonas aeruginosa
TMPSLANNRAPAGKSMSSARLPIARLQPSKAAGRPSRSLAKAISWLASQRQPSISATPSPRRRSEVGWTPVVFHGSCGLSCSLCSQRCRWRVATPRIVTGVGNSASRKLSGWCLSSSFSRVPAGISMPPRRVGRSSTALCAASSRARSRSYCQRPISSQARSPNGISISRPRLGQRRRKRWRARGLKARSDSQISSQMPATNDDR

SEQ ID NO: 20777 - protein, 616 aa, Pseudomonas aeruginosa
FQDRCIRPGALRKIPPVPAGGTEGSVLLLHQLDVVDEHRLLLVTAEDHQFSTLDRPLRQLHLAAQDGPAAILDHLVAQGQVFAGPTLAFQVEVGIGHGLRAATVADPYVRAERVGPACFQVAQQAGARAGAGVAPLVGFQGQPPGAGDARGAGAGMHAAPAADAALEVVGDAFRRRRYARRRGLGFLQVHLVDQQAGAAVAPDRHVEVALVGGGTVVEGLLQATELVAADRQFDALRRVVGQGAIGAFAEQRHAHGFTGIGGLEHDLAAQPVAAAGAQGGNGADQQIEATHVDQQGIVAAALGDVHQAQLGVAGPCAPAFHAGELAIAEQAAELGFRAPWQVRRGLRVSAGARVDRAGYLGRAKVGDLRGHAVQRAYGVRVFFPAAGLVGASGVDHARVGEKRCLLVGAEGMRVGHHGGEAPLHAVASDPFVGAAVGVARIVVAGLQVLLVGVAQAHVVAGFMGEGVEPAVDPGEVVGNVLGVAVEAPAVLIARAHVADAAGDVAVAAVLRAVDQADQVGAVLLAQALHLRVAHEAIEVGAGHRRVVGPVQALLVHQTQAQVDAALLVGGVGELDVAGDPRIDVAAICGLGRRGGVDDHDVDGLRRGLGGTGYRQG

SEQ ID NO: 20778 - protein, 202 aa, Pseudomonas aeruginosa
SSSSPTCFAPRISSASSNASIGEAAGRGTAGLRNARRLRAAAETAAGKRGAARTGGAARSAVLPPGSLPVRSRRAGHDAWPARPGVDAGAIEGRGVHSRSRGQPAIGDGRRGAPPRHAGLSAARRTGERARGCRGGQPGAGVTEPGFLLVAALALRGGGRFRSGAPRTGAALGHHPALGYRLHQLRVDLEAFGALGGADPAG

SEQ ID NO: 20779 - protein, 122 aa, Pseudomonas aeruginosa
QRGNRPPQGCPARLRRTVRRWPEDAFAWFALGNSRYAAGDSAAAEQAMLTSVERRVDFAAGWFNLSQLLAERGCAAPARQAQACARALQPGEARFAAALPQAVAPAARCAELPACPVGAPPR

SEQ ID NO: 20780 - protein, 345 aa, Pseudomonas aeruginosa
GGGAEGCRNPVPARRLYTWEDPTQVQNMANDKRTSPPTPRQPAKGGAAGKRQGHAAEGTRKPRARGEERKEKPADGRSATALTANERREIDDKQPPRAAVLHEVIRVQGEHELQRTLAALWWSAVAAGLTIGLSLMGMGLFRAALPEQEWAIIVSSFGYPMGFLAVILARQQLFTENTLTAVLPVMTEPTLEKAWQLLRLWSVVLFGNIVGTLLFAWAVLHLPIFNEAADAAFLEIGREVMHNDLAQMFAKGIVSGWMIATMVWLIPAAEGAKIWIIAMVTYLMALGSFTHIVVGSAEVGYLAFAGEIGWTEFLLKFALPTLGGNIVGGSLIFALISHAQIRSEG

SEQ ID NO: 20781 - protein, 165 aa, Pseudomonas aeruginosa
QRGRSFPTLAPSRMIQATRLMTTSSGSRIGGLLHASLFSLLGLGLLLAGGFKTVERYHFLRTAQEAQGTVSALNAGGSHPQIDFTSVSGERISYPQGGFIFGYQVGEPVRVLYEAGRPAASAIVDDAGALWGTSAFLCGFGALFGIVGFRGLLGLRSSQPTSKGH

SEQ ID NO: 20782 - protein, 99 aa, Pseudomonas aeruginosa
DLRVLFNLGECVQEIYSEEQMRKALGLAETRPKKVRTEASQPVRYTIVELSVRKGGAGLPLRFEHRSRSISKVTAQLEAEKEAKRQGYQVWALLDIRQI

SEQ ID NO: 20783 - protein, 280 aa, Pseudomonas aeruginosa
IERLIRRTACGERRDRRCASASAASSSSSAGASPLTRPSARAWRGSSSCPSRHSSRALATPRLRASIWVPPPPGIRPMSTSGWPRKRSTWSSSAIRRRSQASASSQPPPRARPLIAAMNTLSMRRMCAVTSWNRFMSATPASRVRRSSFLAPGKWRRRLSLSSSRRVSQAGMEKVMGATARSISSTSKWVRKTPSAAPERMTAPMSWRCSRSSSRSASSCITAVVRKFAGGLSSRTCRTRPRCSMRRCRGARVIAASSLDNERYIKIIIQCDDIVSPTNG

SEQ ID NO: 20784 - protein, 109 aa, Pseudomonas aeruginosa
SVGRVRVFSGHPNLKKSCFSPYRGSGAGRFSSESFTFYPVMEKALKLASCLYGLLILLSLAMVAFLSQFPFLLSSGAENLSMSILPLLIPLMVGLVVCEAVRAVVPKKR

SEQ ID NO: 20785 - protein, 109 aa, Pseudomonas aeruginosa
QSGMKFCGRRNNSVRIVILASPPGQSGFGRLRGSRRRRFVVDDTLRFASRLCKFIVAASFLLVAVASLCLWWTGQAYEYAALAFFPFAVPMLLLIMVCDLLAALNGRRR

SEQ ID NO: 20786 - protein, 141 aa, Pseudomonas aeruginosa
ADVEPRQPAPRAWPYGEAFIHCLPGATMSDFITVLRDTCPVPVLDATKWKRIDGDPHTVNLNAYASADGSKLMGTWICTPGKWEVNYERWEFCHFLDGYCIITPEGEQPVHLRAGDVFVIEPGLRGTWEVVETVRKYFVFA

SEQ ID NO: 20787 - protein, 484 aa, Pseudomonas aeruginosa
AMASESECYHWLSEAVRLYPIRLNWRTKRKKENPGTGPGFSSRSQVRSEHAERVLDEGTDFVAVVVVRAGVVGDTQERAAQTQGEVLGRTALHHVLDLVEDLALLAVAGLGGLDVVAAHVGYAVGQAGHAVLGEVQGVADLPGTLVLGVEVRPVGVGQPDGGAAVADAAGILVPAVVVAGVAGVALVGDHEGVGVDGVGRRQAPDLVVAVTVEVLVGEVAVQLGAIAVEVEVQRLVGLQRDGVVQVDVLLLQYVLDVGSVQRGVEVIGEGVLAAEHVDALQAAAVAPFGALAGFRGEATGVQLQALDLLGGDQGAAVAFREQARVVVAEHRQAGHLVAVLEHGVGDAELHRRAALGQIVRRGAAVALLEEVDTGGAATTLAAVQAYRVQTERVDTDAHRPLGEAGGEGGSGGLAPFGLVLPAMFVVTADIAIAEEQIEVAVLDKPLCCFLVIGHRLACSRDAQCQQANPFLQHLIVPGCWLDVR

SEQ ID NO: 20788 - protein, 105 aa, Pseudomonas aeruginosa
SPGVPAFPLPAAARPGTTGNCPSRSPPRPFPAPCPGCRCASRRRQSADGCRPTVGRNWRPGSAARSPALPGTAPAPASAGRDGAARWSRPAIPRRHTGSAPAGSR

SEQ ID NO: 20789 - protein, 74 aa, Pseudomonas aeruginosa
QANDNRSQPMSRIEVAVLVGTSVPESLRSKGLLACWILMVDGAMWAGPFTSRDEAEALKGTWELSWPLEAAISA

SEQ ID NO: 20790 - protein, 369 aa, Pseudomonas aeruginosa
CSSSPSCANCPAASRSASSSAWAIHGSSWASPRPCWRPASSPTSSSSTARKAAPARRRWSSPTISACRCAKACCSSTTPWSASTCATRSRSAPAARSSAPSISPASWPPARIGPTRRAASCSPSAASSRRAAIPTSARPASPPRTRCASARWWCRTRPSGCATSIATPSRAWPRCSPRRAWNIPRSSKPSTWCDASPTPRSACSRSCTTSSSRANCFPARSRASSTSACGTWRGPTASTRRPEPPPSHARKSRRHRCLRLFHVRVDQPSRMVAQVTVITVRATNCAALPMSLAFFDRGWRSSETRSTVASIAELSSSTISASRHTAIISARSPRLTSRRKATGISTTLSSTSWRKAASPRKAARKPARE

SEQ ID NO: 20791 - protein, 293 aa, Pseudomonas aeruginosa
PCTSSSWRTASAWKPCCPTPRPAGPSSSRWATRWKPPGASMPATWSGPETMRKNLGKWLLVWPPQAYLLFFFLVPALIMLFASFRFPGDYGGLAPWMYSEDGQTVYDLSVENYTRLTESWVYLQLFVKSFGYALVTTLACLLLAYPVATTLARAPAKWRNLLILLVILPFWSNLLVRVYAWMIILSPSGALTRGINAALDLFGAQPISLMFTPFAVILCMVYVHLPFMILPLYANLEKHDPALLDAAQDLGAGRWQRFWRVTFPLSPPARHWYSSRCWECSPSPTWSAVPTAS

SEQ ID NO: 20792 - protein, 278 aa, Pseudomonas aeruginosa
PAASCCWSPSAWAPRAPAREAPMRRPYLLWSATALVYLFLYVPLVIVVLYSFNDSRLNAEWVGFTLDWYRKLFGNRDMLQAAANSLVIALVSASVATLLGTLAGVALHRFKLRVLPLLVLTPIAIPELLMGVSLVIFFIGLNMSLGMLSVTLAHITFSVGFVALVVQARMSGMDESLTEAARDLGATPWQSFRLVTLPLIMPGIVAGALMAFTLSIDDFVITFFTAGGGFATLPTQIYTMIKIAVTPEVNAVSTLLMLLTLVLIVIASKLSPSAIKGH

SEQ ID NO: 20793 - protein, 548 aa, Pseudomonas aeruginosa
RRRLDGITDVSRRRPGGHWLLLSAGNPRWREGPARMRHAPGAPRSRQRQPRALPLRSREHRRGGHLPRPPGPQRPAAAPGGRGLQGPDLRHRGHLRTAGTHAAGLRAHPGKGRRLGEPLAQPDRQAEHQAAVYPGRHRTRAQAAPADQPRQHRGGRSWRAGDLSQRRAHPRLVDRRSAIPRPGATAPPGVFRRPRQHLLAVDARALAAEPGRRGDARIHLWRSRSPRQQRHPGGTGGDSRPGAPRRRQRADPVVRRRPHPGPALLPRPLLPGGPPAATGGIPRQPDGRPCQWHLPAPQQRVRRPRPRVHSRHRHHPPGGMAAGAARNPQRRRVDGDQPDQERRGHHRRQRHVHRRPYRPSLQAQPLAPGMPCGIPRLPGARHPGPQHRRRRQRGSRVPPAHRGQGADPYPRRLLRPRRAIAAARLGRSLRPPSSAIPDTWRAGKDGSAAGRDPRASRLGCRDTGARRTHRDLSRRPQLSRSPWQYADDRLSRVVVEGVCECPTKPMTIFPGTSRPAAPTWRGRSTNWRPLRLPATAPISRSTARCSSP

SEQ ID NO: 20794 - protein, 162 aa, Pseudomonas aeruginosa
PLGSGGLDVDLVDRDAEVLGDQPAHGLDVWRHLRRLGDDGGVDVADLPALLGDDGDHVSQQRATVGALEPRVGVREVLADVAQRRRAEQRIGQGVQQHVAVGVGDQPMFVGNAHAAEGDEVALAEAMHVVAMANSHEKTPWLESGRDSTPDRDRLQVSRINR

SEQ ID NO: 20795 - protein, 464 aa, Pseudomonas aeruginosa
SSRRYRSVRTASTGPAAPPPARPGAAGRWRRPSRSSGSGKNDGNAGASRRRSSGCRSVRGNPSRDLRETVVASRRARRDGLSVMNDGADALAFVHQLEGLVDVLQPHGVGDEGIQRDLALLRLLDIARQLAAPAHPAERRTAPDAAGDQLERPGADFLAGTGDTDDHRLAPALVAAFQRGAHQLHVADALEGVVDAAIGQFDDDVLDRLVVVLRIDEVGGAQFPGDIELARVDVDRDDARGLGHLRPDDRCQADAAQAEDGNGSALFHLGGVQHGTDPGGDAAAKQADLLQRGILGNLRQGDFRQHGVFGEGRAAHVVEDRLALVGETAGAVGHQALALGGAHGLAEVGLAGQAEFALAALGGVERDDMVAHLQGGHALAHRFDDAATFVAQDAREHPLGILAGQGVRVGMADAGGDDAHQYLALLRRRHIHLDDFQRLVGGEGDGGTGLDHLGTPERWKPAGR

SEQ ID NO: 20796 - protein, 134 aa, Pseudomonas aeruginosa
SSARRSASPVPHGTSGPPAGPAPPSASCSAWRPPASVPSPRSAWASRRRSSGWARMRSSAAFSSASASSSPAVARPAGCTARWRARCTSGWSASATSSAEPWWRSFGTSWAPASPCPIPSSTCWKASGPATACY

SEQ ID NO: 20797 - protein, 94 aa, Pseudomonas aeruginosa
TPPDSPDRGNRTMSQTDKPTLSLDLRGEHCPYNAIATLETLATMQPGERLEVVTDCSQSVHGIPEDTQRQGYKCLAVEQHGALFRFLIEVPLES

SEQ ID NO: 20798 - protein, 273 aa, Pseudomonas aeruginosa
TSEPATTRKPTLGAAFLCQGSVRKTALQAQQVFRGGDLQVVGAPFHQLRRIAGPLHRRSLVGDRHAGHQRIGQRPVQGAEAEHLRRIGQPDHRAVDGFADPAVAVGALESVPRRHRQQPADRIFGEFFEQAVEVAAGQVRPRGVMHQHPVVGLCPQLQQAQQAVQHRAGALGAPGGALHMPAGGAVQPGPVGIVLGQADHQAPEHRVFEETIEGTLDHGATGKIEILLRAVGAHARTHAGGGDHRPEGGKVGSRHREKGRQLTWRAGRGFRRP

SEQ ID NO: 20799 - protein, 438 aa, Pseudomonas aeruginosa
STGNGLLAQTRVVRRRAPGQSPAPLAGTVQARNVGHREQFVGSEEQRQTTAQEARYARFVEQSLEVAATAPGQGQHLPTPPVVDAQRPRRNLAEQRQPTIAGKKQWMSGTLPDERSRRRPPVRRQPPDPPRAATQLAALQAPDRVGIVAGIAQRLPAGPVVTVRQPRQLPQPGPQQVALARSAEAAQRLQGDPGQIQPVRPIQFRGLAAGPEVDGGQFSQQVFGLAQMRRAARHAGDGLRPVGGETRHDLPAQVVAREARILVGRILHPVQPVRLRIGFQFGAGNPEQGSAQAAAAQRPARRHRRQAAQARSTQQAEQQGLGLVVEVLRGEQHLSLAQVRLECAIAGVARRLLDAAANGDLHPLDPQRDTQRPADHLAVRRPTVRRSLQAMVDMQRRQRRQGFAPGQLGEQMQQHRGIQPAGKRHAPAPRFAPGRQGL

SEQ ID NO: 20800 - protein, 400 aa, Pseudomonas aeruginosa
QTGFERHRRHACAPHATSPANAGLVDRTSAPDGLRRAVAHQAVVTTLQQLTHFQALEHLQLRQQFATDRFGHARRIAMGAAQRFVDDLVDDAQAFQALGGDAHGLGGFRRLLGGLPEDGGAAFRRDHRIGGVLQHVQLVADTDGQRAAGTALADHGGDDRRLQSRHHPQVPGDRLALAAFLGIDARVGAGRVDEGEDRHLEAFGHFHQAAGLAIAFRTRHAEVAPDLLTDFAAFLVADDHHRGTVEAGNATDDRRVVGEMPVAVQFLEIAEQVADVVEGIGTLGMARELGDLPTGQIAEDVFGERLALVLQTRDFVADVQRIVVAHQAQLFDLGLQVGDRLFEIKKVRVHRLPSCADSSGPFPFGALPYGIGRQGSSREQGRSAFSRRRARNNGVIAHRD

SEQ ID NO: 20801 - protein, 121 aa, Pseudomonas aeruginosa
VGLSSSGMKSMFTGSRPFLACSRLMISIAHLMMVRVRRPRKSNFTRPAASTSSLSNWVTRPPPSSSQAIGEKSVSLVGAITTPPACLPVPRVMPSSLRAISQISAASSSLLRKSRSISSCS

SEQ ID NO: 20802 - protein, 233 aa, Pseudomonas aeruginosa
TRSSSTISRSRLTLARIDAAAIAGTWLSPLTTGAQGTASFGQRLPSIRASRGVTLRPSTARCMASMVACRMFSRSISSTSARAMHQARAFSRISSNSASRRASLSFFESFRPRIGRLGSRITAAVTTGPHNGPRPTSSTPATRSSTRLKSRPSCISGAPPVAGRLPPPVPRHPGARPDGWHRRIPPAVSRRPAAARGLRPALAESRRPGSAPAPTGVRPTGSAGRCTGFSPSA

SEQ ID NO: 20803 - protein, 154 aa, Pseudomonas aeruginosa
FAFRTDDFSRAYRLVVDGSVAVEFPDAALHADELGVQLQLVARQDRLAEAQLVRTDEVVKGAVGGLHVEHLETEDTGRLGHRLDDQHARHDRVLGEMSVEERLIDTDILVGANALALDVQLYHPIHQQERIAMRQVFANLVDVHHVRGSLFRKG

SEQ ID NO: 20804 - protein, 402 aa, Pseudomonas aeruginosa
DGYRQPPSVCDRTGATGWHRPGRGWPPPARYRRTRRRRQPSAGRRRHGFRAGTCDTAGWPGSSAEPVRPPARSPGPGSAGPRRHGLPRRHARPAGPGCRTRYSSSTQLVHPLDHLAGDVVLRLDVDHGATFDDHVVTTFLDGLLDGLVQLRLEFLQHVAVGGGLRLVQFLGLELEVTGLLLEVQLGLLAVALGHLAAVGNQLVLQSLGVALEVLQLVQLGAELLLGIHGVLLGGIGLEQRHLVVEHRDLHFSERRRSRHDGCGDQDELGELTHDALLHKAWFRYSVLRTNQKVWPRENWKTWVSALSGFLIGVARLKLSGPSAVIQVRPTPTELARLSVLMPSQLVVVLVGQSVSKVLPTSQNSTVRNWRWSLTNGSGNSSSAPPVIRMLPPKASGSWSGSV

SEQ ID NO: 20805 - protein, 156 aa, Pseudomonas aeruginosa
EIGDGTSRDDGDPLTDRLAIEGLFEQMGRYFRLALVEHLDVAAQRNGRHHELGAVPVVPAHQRRAEADGEAQDLHPAASRDPEVAEFVERHQHTQGYQGADDHVKRTHLLPPGRPKTSRRAGSTIARRPNARGDRQPGPDRAIRLRSPPRGSARPR

SEQ ID NO: 20806 - protein, 208 aa, Pseudomonas aeruginosa
SGCAAREMRPRPPRSRHSAWPGRCRRFPRPGSPGAGRGSAARRGAGNPGDRRRTYPAAKRRNRFAPARPWHRKSACACPDCRAGRSPNRRRSPPSSGSRSAGGSPPRPGSAGRRTASTPRSVRAPCSSCWRNRRKSSAPSTSSGAHKPAPASPKQAAPAASHGTGRRRRSRGSGARRPAPGHRHNCAAATGRSRCARCRSAGAPRRCA

SEQ ID NO: 20807 - protein, 215 aa, Pseudomonas aeruginosa
LAATWRRKRVLPAVAASASRMAACNSGWKRVRSPMMRRRMPFSSSLRTSRRRATRNSSISALTSSAGRCQFSLENANRVRTSTPASAQTSITALTASTPALWPATPGRRRFFAQRLLPSMIMATWRGTHTSFRVFSMTSARPQTAMRSASLASSAFSISPMNLSVSFCTSSPARRSSSSLISFSFCRSFNWASASRRMLRTETRACSASARACLV

SEQ ID NO: 20808 - protein, 906 aa, Pseudomonas aeruginosa
QIKEGRMPQVDPELFDRGQFQAELALKSSPIAAFKKAIRQFREVLDNRFNSGRDIRRLIEDRAWCVDQILQQAWQRFDWGDDADIALVAVGGYGRGELHPYSDVDLLILLDSEDQESFREPIEGFLTLLWDIGLEVGQSVRSVQQCAEEARADLTVITTLMECRTICGPDSLRQRMLRVTGSAHMWPSKEFFLAKRHEQQRRHAKYNDTEYNLEPNVKGSPGGLRDIQTILWMARRQFGSLNLHALVREGFLVESECSMLASSQEFLWRVRYALHMLAGRAEDRLLFDHQRSIARLFGYEDNDVKLAVERFMQKYYRVVMAISELNDLIIQHFEEVILPCEQPVQIQPLNSRFQLRDGYIEVTHPNVFKRTPFALLEIFVLMAQHPEIKGVRADTIRLLRDSRHLIDDEFRHDIRNTSLFIELFKSSQGIHRNLRRMNRYGILGRYLPEFGHIIGQMQHDLFHIYTVDAHTLNLIKHLRKLNRPEMAEKYPLASKIIDRLPKPELIYIAGLYHDIAKGRGGDHSELGAVDAEAFCQSHQLPLWDTQLVSWLVQNHLVMSTTAQRKDLSDPQVIFDFAQLVGDQTHLDYLYVLTVADINATNPTLWNSWRASLLRQLYTETKRALRRGLENPVDREEQIRQTQTAALDQLVRNGIDQDDAEQLWSQLGDDYFLRHTAGDVAWHTEAILQHPDDGTPLVLIKETTQREFESGSQIFIYAADQHDFFAVTVAAMDQLNLSIQDARIITSTSQFTLDTYIVLDADGDSIGNNPERIAEIREGLIDALKNPDDYPTIIQRRVPRQLKHFAFAPQVTISTDALRQVSVLEVIAPDRPGLLARIGGIFLDFDLSVQNAKIATLGERVEDVFYITDARNQPLADPDLCKRLQAALVEQLSQDNGRDTLPTRINF

SEQ ID NO: 20809 - protein, 200 aa, Pseudomonas aeruginosa
RHHGDARRFRQLQRRHRRPGHDRRPRIRRRVRRQGVGPGRRLLDHGHPFRWRQHRHQRRRRLPDRRQRRHRHPAGRSQHRRGRPVHHRRHQGRPARRAERPGESGQGPRPGRSARPAVPPQLAERCGGVQDQQDRHRAERSAARAQLSPARLPARPTVLASAAGCATLSPVTVLAQCPPCPCRLPGAPTFRPFPPSPRKA

SEQ ID NO: 20810 - protein, 258 aa, Pseudomonas aeruginosa
ARPSTGWPPWTKPKSPPTKAPSTPACSPACWRATASACSANHRRRWPASASTACTSPISPTCSANRASRCAPATIERCRCCNASKVPGAPACLAGLVQRCRRPGALLPGPRPLTGVAAMNPVLPEQAQEALDAFGHTASWEQRARLLLQWGERLAPLAEHERQEEHRVHGCESLVWLLGEQRDGHWRFRADSDARLIRGLLAVLLARVDGIETRELARLDLNDWFTCLGLSRQLSPSRSNGLNAVLQRMRELAGQTAG

SEQ ID NO: 20811 - protein, 458 aa, Pseudomonas aeruginosa
PVGRIVGLGRQDPRARTPLDPDIRRTVGKLHVQATQRRAVQFRQPALCRRQGRYLGCALALQPGEGSGQRRHQRQQDDQRIAPHASMPSPGHAPAPPEPAEQHADREQRGNQGDIDQLQGAAQCVDIGVQLVLHLAQLLADAQLLLHVLAHRGLLFGRQFDGLLRGGALLEGGELLLGIGEALLELVLLLPEARLGLALQALDHHERPAEPAAGAHADQRVGARQVVQRVDHQRAVVGPGLRHALAEEVLHLDPHAIAEQVGIGHDDDIDVARLLQAFAMPLDALREGTLRRPLDTGGESMPPAARAQLAHQIAGVAQQAEARGIERHRLGRALQQRREAGARSGEPFEDAGRRQGQAFQAGSGDVVLVQRLARQAEPGRMPGRTLVPAKTDGHRIGAVAEHLARQQAQPPGLEQRREVGRLVAIQRSGEIAAAVGLAEGVDERQQLAPAQDELVDGV

SEQ ID NO: 20812 - protein, 392 aa, Pseudomonas aeruginosa
RSPAVASCLRPPGQVAEYLVEPAALHVQFADPPAALGDQPADLGEDHRARLRQDGQAAFGGVLLDARHARQHRQRHGIQGLVAVERHRLVVARAAGQLQRRAVRQQPPAADHQGAAAQRRDFLEDMGGDDHDALLREAADQFADLVLLVRIEPVGGLVEHQRPRFVEDRLGQADTPAEALGEGFDGLPAHLVQFQQPQCPGDPLALAGTTVATDLGDEIEEALHGHFRVAGRTFREVADQPLRLQRAVADVEAEDARGAGAGRQEAGEHLHGGGLAGAVRTEEAQYLPRRHLEGQVVHRHPRAEAFAEVSCFDHGPLPVPAAAALSGQGREKRAGTIAEAPRRLAIRGIGRTLAKRDRTRTPAEGSTFATCSPPFAVGRVAFFCGPPGIAAN

SEQ ID NO: 20813 - protein, 159 aa, Pseudomonas aeruginosa
ARRLADPGAHARRGRPERSRRRADHSGQRVLGTIAGQRIEPLEAAVRRQLGGHRAPAQAGAHPDPRTQDPRAVLRADPPARAGGTGQGPRAHAAHGQPYPPGALPQPEDRGDRSRPVAPPQPGQGPAARAAGTPGDQRGMRERTDIPGEGRRHRAALRQ

SEQ ID NO: 20814 - protein, 462 aa, Pseudomonas aeruginosa
LAPADRLRAGLHRLRARAGRPHLPRRTARRDQEEGVDLRPVQGGRRPEAAFWPGLGELRRADPSRPVPRPPPARLAGPGPRPGIPPRLAAADHQPAGQGRRPPPQRRGGDQPGQPGRPGAALHQPTGPRRKRPGANPRPLPGAAAQGALLAQRDPAGRRRPGPDRIREEHEPAGRAEGRAGPHPLSRRTERGAGDLLPQQRPPRLRPAGADRQLLPEQLADQPRTVAALRPRALSLPAGGTVHPLEPGRTRRGDRPVAGGPGGTGPAAPGERHLHPPGAKLAAIRAADPPRSFGNPDPAALLHGHRPAAQRGAERPDRRGTGEPLHRDGPAPVDPAWPERPGVLRQEPVPPLHPDPSRPARAAQGRGRQAELPRTARRTGRRRRQARAAGGDPSVDPPGGAGAPRRGSRRRKQRRGRQLKPGARPARDGRRSAEISCDLSLFRPGNLCWFPGSEARSFFCSV

SEQ ID NO: 20815 - protein, 136 aa, Pseudomonas aeruginosa
KEAPMKKLPLLLAASILAGCGTQQSTSNASFDGEVFYRERIALPPSARLSVSLEDVSLADAPSVQLASQTREITSQVPLAFHLEYDPKQVKPGHSYAVSARIELNGQLLFINTTRHSVKLDGSDPQPYRVQVESAR

SEQ ID NO: 20816 - protein, 164 aa, Pseudomonas aeruginosa
SAGRNSRVSTVATISPPMIATAIGPKNTLRDSGIIASTAASAVSTMGRKRRTVASMMACQRSSPWLMSCSIWSTRITELRMIMPARAMVPSIATKPNGWRNSSRNRVTPIRPSGAVRNTIAIREKLRNCTISRLNTTTMNSGTPAFTELWPFAASSTVPPTSSR

SEQ ID NO: 20817 - protein, 219 aa, Pseudomonas aeruginosa
CMAAKVIASTSGIDSATTRPVRRPREKKLTSRTITSASASTRMNSPTPVRTAAGWSDTLRSSSPAGSDCCRRANSVSRALPSTRMSPPGFIATARPMASSPMKRMRGAGGSLKPRRTSATSPMRKVRSPTRMGKSRISFTESKRPETRNCTRSLAVSKNPEEATAFCSSSAFCTAARGRPRVASLVLDRSIQIFSSCRPISSTLPTFLIRCNCSCRRSA

SEQ ID NO: 20818 - protein, 474 aa, Pseudomonas aeruginosa
PLRVTLNAAISRSRSYSRPSSTRSPHSAARRRTSLAGGGARCGRTSLRRAWAGAPSRIMKLRPFHCFSMHSAGCQRCRSSRRSTINSCTACGWNRHQRRCGPMRATARSGCATCIFCNQASGSRCISSQWRTPARPSLAQGRCARRRRIGQSMVCCMLAASLRCRHSALAQGLLRIDVVAAGLAFQAIAGLGPFDDRRLARALHHHPVAGQGQGRLQQRRGVEIVAHQRPEQTHFLLHQCALVAMGKHRVEVDHLRRLAIPGAHQVRRVAAEQTHPRGDRRHVGIAPGALQAILEQGGDQRLALDQGNLAAQAGEDEPIPAQAGRGVQDPRADAWLDADRLGDHLSAAAAELAPVGAGALDEIDPHRTGGVRPQLQDLQALLADLHGELRLVVRRQRQAEPLRPAPRSLGAIGGQGLDMQARSGGIGHGRAIVGESADFARVGPRALTGRPSIGPCRGGSDPGGRRCSRAPAPH

SEQ ID NO: 20819 - protein, 168 aa, Pseudomonas aeruginosa
LSGVCRNTYGVRPASIQSATLSTQGKRNTSLAGRSGPPMKRTCGVSLKAAGRIGRRGFFDWAWSTAGSSERQLNSARESRQMRSTPRSRRWRLSRRSSSPLSKNAGWRTSTAIRRGLSSSRKYSSSPRRCGVNAADSCSHSGLTLSPSGASSSRKSPAASSRSRRSPS

SEQ ID NO: 20820 - protein, 387 aa, Pseudomonas aeruginosa
LARAIAAWLLTGRWNASRSRALTGRLSPPAELAWTLRACGACSKPWLPETGAGCSRRASTSRCTSRYGVTAEPGRALRSSGNEEEERPSIRMIKTRGSLHTLASPERLGNYRCAAFSGRFFRRRHVVAQVHRQRLFRLHAFAARPGEAGQAEQVLGMRQQARVQRGRALRHALDVAPAGAGAEPVRGSGVPRYGDPLGRQYRFAAGQAHLALLQLVATPVDLVHPRVDGRGDPLRTLLAVGPLGQDRQVGDRQYRALQGEGQALDHADGDAHAGEGARTAPEGDGVHRGQGDAGLVEQVADHRQQALGVQARDHLVVTERPPLVEQGDGAGFGGGIQGQQSGHRRFRVVKKTPIVPAFAAPETPTARKRAVGATALRISSGPKALSR

SEQ ID NO: 20821 - protein, 863 aa, Pseudomonas aeruginosa
SLRRGLPGPTGHEPDQQQCNQRCGHCPRPAGPPVPTAERLHLHRNGRTFLFHGVLRCTADSGQVQGRRLDATCPVDLLSHLEGGIQLADAVLLHELVAFCLLLGLGLREREVETWRHGAEQHFHALGEDDALGELARFLACGEHQRLLRRREFAEARDLLHLVRRHRQAHPPLDHVEHRLRCTWQVVDVLRRQPEPGAQLAPHFCNFHDIGREQRVLGDDVTFVGHVDDRPSQVLVALGDVVHRADQADVGDGELRVVALAGIGRQIDQRDVGLGPRRAVAVEHLAVRALAEHVHRVRHLQQPRTAHLGQRRVLATDAQCIAHIAREHGALLRHAMFGGVEDALADQRAVGPRHPRFFLVFAARDHQPCRDLQFAEHVALLIRLHGRGIRWLVFVQGIGIERLHVAGRFDQPACVGERRQADARSGGQLDPVHGQAQAPREVAEQAEAVAGFHDEKPRPVDGRHLVQQVVERGGLARARRAKQKQMGIHLPIQPVQGVERNRAASAIEHRDAGVPRALGAAPHRRQVRRVLGEHQLRVPAAPILAGVVAARQPAQVAVERRHLVVLAHRLQAGVEHDVRQVQAAPIQFRLVAPAQVERQRAPVELVRAADQGAGLVHVLEGLLRRQRLAHGFLRQVVQIRFQDILRRGDHRETHQGVLGHLVEQRVDRVPLAGLAGQVPRAGRHAQPVGDQHAVRHAVEVPGPLRHVRARLPEEQPLAEIPPARQLDLAGLGLVRVARQRVEALPVLRPRTEQRGARVEPSQQPVVNVRCNHAPGLDAGIRQPAAQAIANDAQHLLGCLAAAVCLSLTARAAVHHHAHAPRLAAPAQPRDHRVLEQAAGLGHSAQVVAEEAQVELGERRTART

SEQ ID NO: 20822 - protein, 158 aa, Pseudomonas aeruginosa
LHVIAQGLHVLVEARFVLGIELEHPRVLVQFIETVLKRVFQGVAGMREPARLPALGAQRHQLEEGGHGLTVLQQHRLRLGQELHPGQQFHEGRGDVVQRLLLGHGRRPAALHRGAGFGDADLLQGINVALPAVRLLIASRAADAGARQLRPGKFPPHQ

SEQ ID NO: 20823 - protein, 157 aa, Pseudomonas aeruginosa
GLRAEVLLGVAAPLAADARNAVGIADPAQAVALLVVLLVALAVFGDRANRAVVEDERDAAHLTAHARERPVARGGAAENGAGHVGNVDAIGGQVVRPDQNFERIGIVDRAVDRHAADQGRHRHRSHQRRVGRHGIDRLGTLDPGGAGARVGHGFSGG

SEQ ID NO: 20824 - protein, 418 aa, Pseudomonas aeruginosa
IRCVPDRPSAALPVACVPNAGSPPPGQRVPRPRPVAPAARVQDASWGVSSLRRLRRQATRRRARRLRCTDALGRAVVAVQRQAERVAGGIDVHPRDLDRIAHQGALDLLGAVVLVRRDVQRHHPVAIGHGAHARRGVVAIAAAGNLVDAAHALTQLARGAAVVIVRPQEGLAGRGEVRRERVEVARVVFFAIGWPAVEGLEHVERERIDRFGRHFPPLAGTAGAQVGRDVDGQVARRAPPAAAHDQGDDDQRARAQAQGLDVRLQMGNLVFEAAHRMLLRVDQKPEREISTWPPTQPAISGWRVAMRHCSCRYSQVSGRPRLRRRRMPPPMKTPSATPRTTNVGASAIVRNTQDSGAPTSRPAAPDRPQQIQSSSAVRPRTTTGWRLSRCGRKVTVPSARTCCCSDIPASLTGCRWLR

SEQ ID NO: 20825 - protein, 368 aa, Pseudomonas aeruginosa
VCGQPTGSGRGRRGVGCAAPACPTQASADRGGPLSRNPAAPRPCANDQGAGDLSHHSLTRREPRMTKNPSSDATLPKGIHRSWKLPDTSLGALWDSIVMDEALKKQLLSQAIVNFTVRPKVERTVLPLHGVILLVGPPGTGKTSLARGLAHRVAESFSSAKFRLLEVEPHTLTSSAMGKTQRAVADLFSQSIAESAAAGPTIVLLDEVETLAADRAKLSLEANPVDVHRATDAVLVQLDMLAERNPHLLFVATSNFPQAVDSAFLSRCDMVMEVPLPGKDACKQILVDCLNGLAKTFPGIGKLSSAHQFDACAGECVGLDGRAIRKVVANALAADPQVAIDPNKLSVEHLRSAIRQAKQMRLQGGKQK

SEQ ID NO: 20826 - protein, 340 aa, Pseudomonas aeruginosa
CGGVEQRKLSLDGWNGQAEPRLDCRTQRPGGSGRILEATLMLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYGNEWKGLVRMVKYWNNNPKHGDQKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 20827 - protein, 213 aa, Pseudomonas aeruginosa
RSGTCTTTCAGWRTWCSITCSHWPRSVLHAGGAPRAWRRWPSRIWRRCLSPTTGTRAAPKTGRRSGDCTSSKSGRFEDSCGRRRSTSAMTSPWSTVPTAPARAASAKPWKWRCSVRSAKRRPSGSTSGRTATTLACAATSRQSCRLRRRARRRPSSPTKLSIASASSRRTASTISPESPRGPRAISASSSPPCSAWTSSASSCAASTPRSIRT

SEQ ID NO: 20828 - protein, 307 aa, Pseudomonas aeruginosa
PLCRGFCYRGWETKPAISTTHSTGPMPGDLLHALWLPVAENGKIEVEFAGEPGARYDALIVFSEGHIKCLGLAILLAKNLAQGCPVVIFDDVVNAIDDDHRDGIWRTFFEDGLLHGKQVILTSHAEEFLHRIQQELGVRRAAAIKRYKFLPHQGEHELRVDSDPPAKNYVLLAQQALAADEKREALRQARPALESLTDRLWTWLGRRADGRIDIKLSGPRAPWELNNKCTKLRSAVERIAAQHAGAPDAVGALVRLLNVSGTSIEWGYLNSGVHDAQRDHEFDRATVRTVVEAVTALDAALDTLQNR

SEQ ID NO: 20829 - protein, 474 aa, Pseudomonas aeruginosa
IVEIPDHLAGLRAISDAGLDVRERLRVRRDLQAGTAALVDERDEFIAHQFIEFVGMNVDRHASASHCAGQAIVDSVLVDVSGHRNQVREHRIADRCGDLGVRQRIQTHIDDGPLSDDLHPVEDRARVGQVGVVRRQEMGDLAARELFQQRQQRCNDLVEVGLVVAHRRAQAIEHRVVVARLGEVLLQRHHTLLAPDHVPWDVLLVELGLDLDDHLPGLGLRLGKVVLGVLNEQRVDVDDVALDQHVVRALPQFHQGAGDDVHEAPCELAERRAVAFAGELPRDACRHFRDPTEAAHGVVAGADFRPAQVEDVELAFAASALGFDVHPFQEIGIPLGVDDDDDLMLAGSIPAADVLRDEQFGQARLAHPRGAQHQRVPDALAQRQADVHFVGLDAVQPWQAADRRQRAHGVERHVPAGELRQARERQWRELQPFLQAPGQPVGRRRLDVAAELGPVRLHQPMRVLLLPEKAAPHE

SEQ ID NO: 20830 - protein, 328 aa, Pseudomonas aeruginosa
ARVGPDGVSSWGGLLARGEDRGGWARALHAGKVAGHAAPIADGGLAASGAVVAADRQQPVLAGGVLLLQDLGGNGEVAVRVQQIARAGEAVLVVAKVDLAQARVDARVRRGAHRLLQASAGVGARGEAARLAGDVEGPRPWDDAPVAPDAALLQGHGVEHRRRDARALGGKLVGRWRDLLGMGGAGIHACREHQCAQELRYGGSYGWRCHWPFTSRTAAGKSPGRPSDSQRPPSWLSVMLPARTRAGSICARLAQSRMRASSWRLPTMYRSKSAPEDCRRCTSCPQAAQPSLTNTAVRPLPRTGPAPGLSSGRFTRCMPGFRRCQASS

SEQ ID NO: 20831 - protein, 425 aa, Pseudomonas aeruginosa
AHAASRRRPWRGHPRAWTRRWSATAGRAALPWVPTRPACSGRSARPGCTRAPRVRARPRLPRWHRVRAAPWWSRSHWPGLRPGGRRRPSAGIHGLRAWHRLFCCDADTLAARGGAVSQECELGATRFCSPTHSATRKPNCGLHIDSIIVVLSNHARRSSHFRLKRPGSHPAPARVPRLGRCWPGRTDAKHASRPARRGPQHLVLPLEGAGPCRPRHHRAAGSQPDLSGRVRPHERPHRLPDRALLPRWRMRGFSIQDLLLTMTDTTYNALFICTGNSARSILAEGILNDMGQGRFHAWSAGSHPKGEVHPLALATLERLHLPTTGYRSKSWDEFVKPDAPVFDFIFTVCDNAAGEACPLWPGKPVSAHWGVPDPAAVEGSLERQSKAFFDTAMTLRRRIELFLSLPIKSLDAMSLQRELRDIGRQ

SEQ ID NO: 20832 - protein, 206 aa, Pseudomonas aeruginosa
LVPATSSSWPWPPPSAYSASIPVRHSQQWSACSSRCRSCCWWCGWSTAHAAGTNAARPLRNLQEASMSTITIYHNPACGTSRNVLGLIRNSGEEPTIIEYLKTPPGRDTLQALIAAMGVPVRDILREKGTPYAELDLGNPKWSDDDLIGFMLQHPILINRPIVVTPLGVRLCRPSEAVLDLLPQPQRGAFNKEDGEPLVDEKGRRV

SEQ ID NO: 20833 - protein, 620 aa, Pseudomonas aeruginosa
ADAMWTCDLPRSRPGRRGAGFQVQQTPGQAEQPKELDQRRVAQAPCAAAMALALAVQQGRQVGGELRAVQARFGDGLTRQGSEERQHRAAERRRGLAAGAARKPDAIGAILDVLVQACLPGDLARELRDVDAQPIGRVQARVDVPDIGDRIESAGLHRDGLQHARREVGRQRIAQLVGDHALDRLQPFGRRCRRDDVLTKQIARCSRRASRGRFASRLVVVAQGGLGRRRAGGWRTVRRCRRGDGRCCARRSRRAGGGRRQRRLRRRWRRVTDQRPVAAFRFGQIQRQHVVADAQQLGHLADQLVLHALRRELVALRVELRQHLLKKAVEVQRQRAVLGVVLPGAFAGRAHDRQPLDLVAPKAAIKHGGNGGQQVAHRVGHAGDVRPLDGEAIGRQAAGQFRLAQGGAALLLVELPCFLDAERALDEREATAQFVLGKMSGQRDDFTALRPWSEQTRYAEEAFFLGLRPEFAQDRQPRVAAVADDVVVPAGPARDSRRRVQAALADGRLDFLVSRVALHARVMVVGPQLVKRHDHGRVRDRVAQGRSRWAAALEAGREQLACHVLRGHVSHGRTPRSPHDRRPAPCGPLARRGGSAHGRSIRPGGHSLSNSCRSPRSRPW

SEQ ID NO: 20834 - protein, 307 aa, Pseudomonas aeruginosa
RGLGWREAAPSARMAVGAGRPVAVAGSVPRAVLGQREQLLFAVPVERFAALFGFVAALVEALEQVDLFVRHEVQAIAAEEPQQVARYQVGDLRIAVEDLGNQVLAEVLGAFRVARQFVHQLVETLEEQPVVFFRHLLGLAQGAEDVAQVLEQGEVVLEVGVGHDGSSGKKLGSIKGFAAPASFSGSPGTGSGAGGFPVAGVRCRGAAGPAPGASAAGPVAAGGSGCPASVAAAVAAAGSAAGVAVDPAAIAGVVRRSAGAVPGAGVGAVRQRAAPPAGAAARHRAQAVRPAPGAGGETRLPGRWQVA

SEQ ID NO: 20835 - protein, 302 aa, Pseudomonas aeruginosa
CRARERVGYADGRGKRHRVPVRLTRATTCGILHEDARRRLELSPFAAVWRQGRSAWPVCHVIGENFPFRLGQIARREPAMQSYLQSGRFVDSDHPVVVEFAEKSRGNSAKPRDQAVALYYAVRDGVRYNPYVFSRDPQTLKASHALQQGESYCVPKAILLAACARHCRIPARIGLADVRNHLATPRLLEALRSEVFAMHGYTELYLEGRWVKATPAFNRALCRAFDVAPLEFDGVADSVFHPFNRQGERYMEYLADHGQFADLPEELFFSHLQQHYPHLFSGRPLALGGDFQAEAGQDEGRR

SEQ ID NO: 20836 - protein, 244 aa, Pseudomonas aeruginosa
SPSAGASSFFGPSSVGCGMSSGRSGDPSAASTEEGTQSMLTIWGRKNSSNVRKALWCAEEAGLEYRTVDAGGAFGLVDEPAFRAMNPNGRVPVIEDDGFVLWESNAIVRYLAARYAPGDLYPQDPVRRADADKWMDWTTSTLAGPFRDLFWGTLRTPPEQRDEALIAKALQTCGELLRVPDQTLAGQPWLSGERFGMGDIPLGCFIYAWFEMPIERPPLPHLEAWYLRLRERPAFRTAVMTELT

SEQ ID NO: 20837 - protein, 335 aa, Pseudomonas aeruginosa
AGYCCILLPVALSSSSSSPSDTGSLMSSALSIRQLTKTYGNGFQALKGIDLDVAEGDFFALLGPNGAGKSTTIGILSTLVNKTSGSVSVFGHDLDKDPAGLKRCLGVVPQEFNFNQFEKVFDIVVTQAGYYGIPAKIAKERAERYLTQLGLWDKRNEASRMLSGGMKRRLMIARALVHQPRLLILDEPTAGVDIELRRSMWSFLTELNQEGISIILTTHYLEEAEQLCRNIAIIDHGEIVQNTSMRDLLMTLHSETFLLDLKNVQALPPTLDGYPTRLVDDHTLEVQVEKSQGINDLFAQLGAQGIEVLSLRNKTNRLEELFVSLVEKNLTRIAR

SEQ ID NO: 20838 - protein, 475 aa, Pseudomonas aeruginosa
AGAACANETLEGMKQKPPSWGLRVSSARASEIDDETGPAVGRLAADLAAVGLDDGAADRQAEPGVFTLAFAARRIGTIEPVEQARQALRRNRRTLVLHAQAPVAETDADLAAIGGEAQGIVQQVGQHPPQHAAVARQAQAALAQQADIVVFRQRLVELQQRVDFRAQVQGLAAGRQQAVVGLGQQQHVVDHRGEPFQLLEVAVQGLAIVLQRARAGQYHLGLGQQAGERGAQLVGDVGGERREALEGFFQARQHGVQLAGQSAQLLWHPAGVEAGGEGVGGNPRGDFAHPSQRRQAGAGGPGAEQRRGQRRQAHGQPDQLAHALQEVLVMTDVEDHGESRRSVVAGLQRGAEFAVGGQAGMRRLRQALEPGVAIRAVQAQAEVGMACQFAQQFRFAAAHLLFRAEAAQLIAKHRELGGHRHMVELDEMLVDGPAEDQSGDQRDRRRAGGEQQAQADAEGHPRAEPGAHSSRSSRT

SEQ ID NO: 20839 - protein, 219 aa, Pseudomonas aeruginosa
SRGASRGIAERPLGRCRGARGRAPAQPRRGCRGGHRASAGALHRRAGHRRRRLRAAAPGTAALRRRADRRGAALQPPAQVQLPGHRPARLGHPGGRLPGPGAGPGQPAGLPGFLPPAPGLPRTVRRTHLPRPAAPVAAAGAQRLRALRTPWRPGYQSLPQPGGGRTGQPTPGAPVTPRNTRIRKSPGHAGAFHFGKSFRYPCWPGSARWSGACRRGSGG

SEQ ID NO: 20840 - protein, 241 aa, Pseudomonas aeruginosa
SCKGDTAMRARGVNWIERSARILACASLALAPTLSLAASEEDPWESINRPIFTFNDTLDTYALKPLAQGYQKVTPNFVQDGVHNFFNNLGDVKNLANNLLQAKFHNAGVDTSRLLFNSTFGLAGLIDVATPMGLQRNDEDFGQTLGYWGVGSGPYVMLPFLGPSTLRDAPAKIPDIYVSPYHYMDDVRARNVMFGINTVDTRANLLKSEKLISGDKYIFIRNAYLQNREFKVKDGEVEDDF

SEQ ID NO: 20841 - protein, 395 aa, Pseudomonas aeruginosa
PMHKVSATLLIIDDDEVVRESLAAYLEDSNFKVLQALNGLQGLQIFESEQPDLVICDLRMPQIDGLELIRRIRQTASETPIIVLSGAGVMSDAVEALRLGAADYLIKPLEDLAVLEHSVRRALDRAYLRVENQRYRDKLEAANRELQASLNLLQEDQNAGRQVQMNMLPVTPWSIEGLEFSHRIIPSLYLSGDFVDYFRVDERRVAFYLADVSGHGASSAFVTVLLKFMTTRLLYESRRNGTLPEFKPSEVLAHINRGLINTKLGKHVTMLGGVIDLEKNSLTYSIGGHLPLPVLFVEGQASYLEGRGLPVGLFDDATYDDRVMELPPSFSLSLFSDGILDVLPGATLKEKEASLPEQVAAAGGTLDGLRQVFGLANLAEMPDDIALLVLSRNLA

SEQ ID NO: 20842 - protein, 149 aa, Pseudomonas aeruginosa
WASTNPTAKPSTTWSAPWSAINRSIPSRIPAESSAAPERDALHARPAGSGDQWRVANWYSSFSWSRANRRMPSASFSVAMASSFICQRKALSSSTWRGSPSPGSSRRGSSPWASASCCSRSGLMVRRSQPASCSIWPRLRKLAPITTVL

SEQ ID NO: 20843 - protein, 393 aa, Pseudomonas aeruginosa
RGRAAALSSSDGLVVASTGFRRAMASKSPVSATTVVYCLSCSSFEVMARSCQVGSWEEEFPDLTRAAGAAQWELSPRQKFQRLVENPQRIGGLVHVHREQLAESPGAGEALGQAEDMAGHVMHRAAFGLVSLDVRTQTEQGLAATERRRFAAEQLAVHRGQQVGVVVGLATEHHAVEGLQVLAAGLEGLDAAVEDDLQVREVLLQLRRDLVAQRRYLAVLLGREPFEDGDPRMHGEAPAAGLAYLADEIAEFGVAVAPVDTDAVLHRHRYLHRIQHRLHAVSHQRRMPHQAGADHVVLDPVAGAADVEVDLVVAGLFRQPRAGRQFRRHTAAQLQRQWVLAFVVAEEALAIAVQQRAGGDHLGVEQGVTGQLAQEEAAVAIGPVHHWRNGEAA

SEQ ID NO: 20844 - protein, 80 aa, Pseudomonas aeruginosa
EGGGGVGRFWAHRDFGRESGAGRGILSGMEVEEGRDERASVNACKSRGWWDAEMIISLPSVRHLYSFMSFSSEIFFNIYF

SEQ ID NO: 20845 - protein, 179 aa, Pseudomonas aeruginosa
PRCLPGSARRPVARPRRGPYRRGRTGGGRGRRPGRRRSARCRAPTPVARFPALPASARRRGSRRCRPCHRWRTIAHRRGSRCRRRGCRSPGYSLRRRRDARRARWRRRFPGWRRNASLRSRRLPRHAGAAKWDGRRWFSMGPAGCPARSAASVAGGGWRRRGSSPGWGIRLLGSFPAGA

SEQ ID NO: 20846 - protein, 530 aa, Pseudomonas aeruginosa
AGRSGEEGRRGSRGRPCGLGSMTSPARRAGYLPEFTGRVPMPQRQTVFRPCPPGATPWRGRRSGMESAKCRFKPRRDGPMGWLSVSVVQWGKTNERKRRQGVRSDSTGARVEDPERPVPAVLCTDVRPGRLRLGGVVPEHVDLAGNHQRGRRAAHAQPEDGPRGAAIATRRRRPKGPGRDHRPVRTLGRRPGYGQCRAQREPDGRAGDRRPAAEGGADLGPLPGHARPGGTACQPGRSARLLAVFHRAVGRAEQPGLADERARRQCPAHPDVDRLRLPVGDPGAGGARPAVRPGAADAAVAWVGSGADRGRRGELHPCPGGGPCGQRDRPHRRWLRADAPGRQRFAGERQAQRGRDRQGRGRGPGAGARRRRPGGAPAPGPGPGGHRDERDERHRGRGRPPRQPCGALHARRRGPGPRGTASGGARQQPDRCVGGGTGTDRPGAEHPAPACRQCRPGAYGDQQHRRADQPAGAQCRHRGGAGRGGRARLRRGGGRSAFAGQPYPAVDPGDPGVDRAVAGRRQRCGRRHAR

SEQ ID NO: 20847 - protein, 157 aa, Pseudomonas aeruginosa
CGFPGCRAPRSGFPPRRRPPGRRARPAGRRCYGCWRGVPARPARDPAGSFPAPGRAPACRAGRVRPAPGIREYPGAPSRLRSSPCQSVTRSRGAGVVTGVGASMRVASAAGAASAAVGAAAAWAAGDWRACGDASGGAGSSSQPPISAPPMAAAEAA

SEQ ID NO: 20848 - protein, 248 aa, Pseudomonas aeruginosa
VNVARSLGRSLSQRGGNRSHLRQAARRRDETANQAGALRAPGHVRSVRCGKAGVRPPCCSRRKASAHLAVLALEELDEVARLVEADAIVYGSPTYMGGPAWQFKKFADATSKPWFVQLASLTPGAGYGVSTSRPTVACSLISRQPGTASSRAGASASRQLQETGALLHQRPATADAFDDAVEAFDLLLAEAVVLGPAEQLQPGPAGDGLALRLGLPAVVPVALSDQGLHQPRGAQRQQLPVLLRVRVA

SEQ ID NO: 20849 - protein, 594 aa, Pseudomonas aeruginosa
RRTPFRRLGAAGRRLARGAGIGAEAAENGDRDDTQERWALRNQASPSRTNSRVSRRGHSHENNNKHPPCRCRPGSAAPAHLRRGSARPGSDDRYCGSHAATTAQPRSPATAEDARRPGRPEEAGGHGRAPRPGGESHQQPDQRRAGAVQPAAGPGAGGRHHRHHRVVPSDLHHHRHALRHGYLQLHQMHQSVRRLAGALLVSAMLGGCAQPPRLPPESAALPARVELREVPFFPQEAYQCGPAALATMLGQRGLALTPGQLKDEVFIPGREGSLQLEMVAAARRHGMLVYPLQGGLESVLEDVAAGNPVLVLQNQAFSWWPRWHFAVVVGFDRERRELVLRSGITRRWVTDFTSFESTWKRSGRWAVLTLPGDRLPATAAAVPWLKAASDSEETGHPKVARRAYEEPCDAGLRTPSPGLPWATVATPQAIPPLPNRPCSPASSVAWISPRVGSTCPSCWRNAVARRRRARRRPARGHCSLGKPASLRPCRRPSHPRLGAPSCRPVPLAHRPAEAAEPKVVGTPFQRDGSIPGRTPLRCRTWPTTSGLRPPPPGNRPRAVRRASARGMRRRARASRVRAARSGKRNRPTDVRPRR

SEQ ID NO: 20850 - protein, 239 aa, Pseudomonas aeruginosa
STMPARSGEPALSSAASAHSSVLSGSGDCWACVLPNRPQKDIEVMSQLPIPLPLNESRWRYVTASGGGMTVAFLAGSGGSITLLSPEGENVSFRYGGVGGGIGLGMRLPRFGKVNLNVKGKSVGGAGALEALPSTGTVLVADGLVGRDLSRGDFTGPCMYVELGAGVIAGGSGTAILFGLDPKLLAAVALASASPLTAALGASMSRQLLQSSRGALLMAGVNVGAQFGGGAAAYLGALF

SEQ ID NO: 20851 - protein, 239 aa, Pseudomonas aeruginosa
CRRAIREDRPFYLAQACGGQGSVEFHGQRGGGGNRYRRGERSSEIPNRHGSVLSKQAHPLVRGVVLVSRLIMPGGPLSQESDVRIFCSAKERLDFYRREIHYETGQLSSRTNAYLTAQSFLVIAYASSMANLNPAWGELFTLVVPALLALLGIVNSLHAWPGIQASSEIICHWQFKQSCLLHSDPEIGLAYDDSPLFSEREVNRGSFEKTLLFSRRVPFLFAGFWCALGVFSLWLQLAG

SEQ ID NO: 20852 - protein, 176 aa, Pseudomonas aeruginosa
LRPAEGLAVPRGGGDRAQPALRFRLALVRAQRRRQRRPGDRFRAYLPGAVLGAAPGQDPAERRAGRGAQGAPGMRRARRAGGHLRQGGVVHERYAPSLIPKQEYDDAGTAGRRGRPDLAGRQGVAGAPQGQSWRWLLVGARRPSRVRRGGGGLRPARSPGRDRPGAERTAPRPVQQ

SEQ ID NO: 20853 - protein, 231 aa, Pseudomonas aeruginosa
RSLSNVTTSSPQPTDSRHALQTGTETGHPRPAVEQGRSAGEAPGLRQHRPGHLDEGGWSYHRGVLLAILQQGGVARSDPAARAERPARCLSAGQPGATGRRHPSLPQSRSCAACRHGLPDSGAGRRGGPGRARGAGNLRTRPGTAATAAGRTDGRREPGLGAHLLVGRRGASRACPGERGGARQGPGCGAGACAGPAFGERSGFAASGPGLIAQLQCSASSVRLSLRQVSP

SEQ ID NO: 20854 - protein, 339 aa, Pseudomonas aeruginosa
DARVFRSRFAWRRPPLRSETEHCSNQNEIEGASPRAAHGLMIDGGNMSAAQPGILTPIPVVGRYLFFSISQPEQVAATLASLAAATDGYQLVVGIGHSLMLSLGKTVEGMKDYPVLAAPGIDLPSTPSALWCWLRGEDRGEVTLRSHALERSLAPAFQRTGAVDAFLYGEDRDLSGYKDGTENPKGDAALEAALVSGRGAGLDGGSFVAVQQWLHDFDRMQAIPGEEMDNIIGRRKSDDEELEDAPAYAHVKRTEQESFEPAAFLLRRGAPWSDEHRAGLLFAAFGRSFEAFEVQWLRMIGVEDGVLDGLFRFTRPISGSYFWCPPMADGRLDLSALGL

SEQ ID NO: 20855 - protein, 151 aa, Pseudomonas aeruginosa
IGRCRIASSCACNINLIDKYHAAKSLQFSLWAVIPSNRERIDKEGRDMKILIAVFAALALSACASPPASNAPALAASTSKAPYDYAMCVLPKWQRQAPGVALVEEGRGYRLADAGQWLEVQPARGGSLVRIHDQQPWVTRGAFIDAARTCS

SEQ ID NO: 20856 - protein, 169 aa, Pseudomonas aeruginosa
LFLSRKLIQPCPPFRYHAREVHVQGIKRKLVYVTAYELIGMSISTLGLALLAGSTPTTTGPLAVVITTVAVTWNFIYNCLFEFWERRQAVRGRSIARRVAHAIGFQLTLVVYLIPLIAWWMGISLLEAFWLDLALIVLIPCYTFLFNWAFDRLFGLPTSALPAGEAASV

SEQ ID NO: 20857 - protein, 190 aa, Pseudomonas aeruginosa
GFFFFSAIRARLGRGKSPTLDGRALWCRFREEVRPQAMKVCPGEDGVRHFDERIGVTMRILGMLLGAVLLAGCSTSTPSLDETDQVPKERLYNYQFRDDGDAFLVVSRDREFLGSVCNTRLIIDSRLAAEIQAGESARFRLPAGLRVVSVQGDGICRGEAPKQVVHVQNGQTTHYRITVDSGLNIGLVPG

SEQ ID NO: 20858 - protein, 349 aa, Pseudomonas aeruginosa
RGWLPRYGVARFAESCTAWPESGASVACGRAVSGCPGLAAQVAVEVDRFAALEFQASAQVVEHSVVLAALAHDRSLPQAQAVAPGQATGTAGEMHGGVARQFEAFAERLAVDPALHVEVYGHRAGLGLQDPVAQVDIECLAVDFAGRGEMQMAGNEHGLPPFRITGEMPLPARVCFAGLGTAVPGQFFPDWSGDANGAGSVRVLTDWAAYAGLFLSAFGSATLLPLQSETVLAALLLRGGQSVAWLLALAIVGNVLGSWVNWWLGRYLEHFRGRRWFPVGEVQLLRAQRHYRRYGRWTLLLSWVPVIGDPLTLVAGIMREPCWSFLLIVGLAKTLRYLVLAALVLGWAG

SEQ ID NO: 20859 - protein, 282 aa, Pseudomonas aeruginosa
GLRFAVAPQRLLHADRADAVHRPAARTVRRQAGRLQVLPGPSMGVHGHRQGHAGDRHPPRLHRRRRQGRRHRRGAAGVHRPYRRAAARRPAVRPQHPGRPQPARQDQGRRQRQDRQRLRYRQRPGHRRGLGQLGARLHVRHRLHPVAELPYQQVPDRRRHPGPAAPARAGGAGQGRAGAQLPSQHPQGPGRDARRGGPGTSLAARSQAPGATHHRHRDPPVLAAALLPQAGRTAFRQDRGRVLRAHVEHGAGRQLRRGGLSRRPRTLEKAGGIAASGFFMSA

SEQ ID NO: 20860 - protein, 357 aa, Pseudomonas aeruginosa
GIPRTPRSSFQTPRLAGRVADPPRPVERAMRSQALRADVLMLITAMIWGVSFVAQRLGMDAIGPFLYTGLRFVLGALVLVPLLMLRSRRDGAQPFNRGQLLAGVILGVALTTGINLQQVGLLFTSVTNSGFITGLYVIVVPLLGLLFGQRTGAGTWLGASLAVLGMALLSIGPGFQVASGDWLQLAGAVVWGAHVLLVGLFASRYDPIRLAFLQFATCAAVSLLLALVFEEIHWGRHRPGRSRPAIRRPARRRHRLHPAGGGAEARHRFPCGDHPVPGSGVRRHRRRPVPRRDPAPARLFRLRADAGGHAGGAVVAAQARRRSAPGLTLSHGTAPGHGAPGWPRPAECAAWRPGSAR

SEQ ID NO: 20861 - protein, 437 aa, Pseudomonas aeruginosa
PGTCLRAPRPAAARRTCNSSAAADSLRSAACANRARRRVSGCAPGAPGASGKRHGSSGRLPIRKGRAKEHRRLEETGWKATAKFYQSPRGSCFVGQLPRPRKKILHRGLRRLVRAGCDPYNPPPFSTPGSRLRPLTLLPLQTNDAPLARDPQRDPPLRRLHRRRQCQPDDQHRRILHPPRPFRVRQDHPPAHARRLRPAGQRRDPPQRPGPRRRRAGEAPGAYGVPELRAVPAHERGAEHRLPAEDGRSGEERDRRPRRTGPEGRAPGGQGRAHADTAFRRPAPARGDRPRAGQPAAPAAARRTAVGAGRQAARRNADRTDQPAEGRRHHLRLCHPRSGRSPGAVAPHRGDEPGPGGAAGRPGNHLQLPAQSFRRRLHRPVQPARRHGRGGRRRTRAHRSPGPGRGPGAEILRRPARRGLRADPAAGEDPPGAERHR

SEQ ID NO: 20862 - protein, 84 aa, Pseudomonas aeruginosa
SCCSPRSAFPATTAAWRPGCTARTGRPSTTSAWRTTPGSPRAGCTCNCSSNPSATPWSPPWPACCSPTRWRPPSPGPRRSGATC

SEQ ID NO: 20863 - protein, 357 aa, Pseudomonas aeruginosa
QGTMMKKLLLVATLMAGAAQATAAEKLYLFNWNDYIAEDTLKRFEQQCGCELVQEFYSGTEEMMAKLAAGASGYDVIIPTQNAIEALIRKGDLLELDKSRLANLSNEAAGYLDKDFDKGNRYSLPYAFTTTLVGYNKTELDKLGIDPADWSVIFDPAVLEKIKGRVTVMDDPQELFGAALKYLGHSANDTDPQHWKEAQALILAAKPYWAAFNSSSYIKELTLGNIWVAHGYSSDMYQARADAEAAGRAFKVDFALPRQGAVLAIDNMVIHKGSKNPDLAYRFIDFMLDGRNASELTNQIGTGTPNAAALPFIKPEIKTLAALFPDATTQARLEPLKDLNSRQRRALNKLWTEIKLR

SEQ ID NO: 20864 - protein, 164 aa, Pseudomonas aeruginosa
VARGAHGYPGTVVPPAPRRPPPRPPSDRAARGSVPAPAGRPAGRPARPRPGAARRGASVRAGSCRWRSAAADRSRSAPRPGSRRRGPGARPGRRRTPSAGRAWGSPGRPVGPGCGRSSVAAPGRCCDRPGRAPGPCRSSRQAGHRRRWCPGATAGSCRSPRYAK

SEQ ID NO: 20865 - protein, 625 aa, Pseudomonas aeruginosa
NPRPATAGRPGGCAGRRSCARRCAGRWRSAGRGRGTVGRRWPGPVAARLGPIDERCGTRRRGSLRYAGADHGLAATRQTPARPPHGQATRPDWAESDSWWVASLVVPCSLGSTRQRALTCIKLPAPDSFTLALYEGSMAFHDPRKVSGCRQSSDGGGSMASLTFLGAAQEVTGSCYLLETLDGVKVLLECGMRQGRREADNGNRAPFPFDPASIDAVVISHAHLDHSGLLPRLAAEGFKGPIFATEATCELLELMLLDSAHIQEKDADWENRWRNRIGKPSIKPLYTQADTERALKLRRPISLGSTVAVARGVRVTFHNAGHILGSSIVEVQFHDQVQPRRLVFSGDLGNTCSPLMRAPSPLSRADVVMLESTYGDRDHRDSNDTLEELAAILDQAHRDGGNVLIPSFAVGRTQDLLYYLGRFYQEGRLPQQAVFLDSPMAARANGIYLRHSNEFDDRDREYIRGTGTTRLEEWLPVLRVTRSADESMAINRIKSGAVIIAGSGMCTGGRIVHHFKHNLWRPECHVVFPGFQARGTLGRNIVDGASAVRVFHQRIAVKAQIHTLGGFSAHAGQSQLLDWVGHFAHRPALYLIHGEREKMEALQGAIRERLDWDAEIPEPGERIEI

SEQ ID NO: 20866 - protein, 413 aa, Pseudomonas aeruginosa
SFRDSGIRRADLPRPGGRGQDRSTRQTRHAGATCGKARRARAHGAPADPWPPAARRRAYRARSPLASIGFGVSHFFGVGLHRAALGQQLVANGLLQYRTDFRIVFQVLGGVRLALADLAALVAVPGAGLLDQAQLHAQVDDLAGTVDALAVEDLELGLAERRGNLVLHHLDAGFATHHLVAFLHRAGTTDVQADRGVELQCVTAGGGFRVAEHDADLHADLVDEDDQAVGVLDIAGDLAQRLGHQACLQADVGVAHLAFDLGLGYQRGHGVDDDHVDRVGAHQHVGDFQGLLAGVRLGDQQVVNVDAQLAGIVGIERVLGVDEGTGGALFLGLGDHREGQGGLARGFRTVDLDDPALGQAADAEGDVQTQGAGGDGRDRLALMVAHAHDRAFAELAFDLSQGRGQGALLVLVH

SEQ ID NO: 20867 - protein, 1307 aa, Pseudomonas aeruginosa
PARPGNEGFRRGGRPVRSGRTPSGSSLFSRVETERDYPTPSAFPFRSSFRTSATARRQRMREHACSITVQGKAHHEHRATQGLSALPRPAPLPRCQPPRPCGLHRQPGPATRQQPARARRAPGLPQLYGVRGRLLEPLPARFQEQEHPPAQPARLEHRGPDECAFLPGRPLPDLHGPPEWRLARVRLGHRRYPGAEQPDRGHRRSQRGSEVLLRRPPGRAQARGRHPPRHPGLQWRWQRRRERLESRDRRRLEHRGVDAVPHTLRQVRGLRDRSRRQPAGGAQEPGERPGQRPRHPGRGGPRLLPGGTRLHRLLPLAYPAGRQRPVGHGRTQQPARHPGDPAAQPLPGRQFRRRAGERGLPDLLQHFVRPDLQPAPRRHRRGAGLASRPGADQPARRSAEARRQLYRGTLKAARTGADLRVRAGSERTRHRPANRVNITLFCTVQSPLPKARMTDLSQHTPMMQQYFKLKHQHPDQLMFYRMGDFYELFYEDAKKAAKLLDITLTARGQSGGKAIPMAGIPFHSAEGYLAKLVKLGESVAICEQIGDPATSKGPVERQVVRIITPGTVSDEALLDERRDNLLAAILGDERLFGLAVLDITSGRFSVQEIKGWETLLAELERLNPAELLIPDDWPQGLPAEKRRGVRRRAPWDFDRDSAHKSLCQQFGTQDLKGFGCQNLTLAIGAAGCLLAYAKETQRTALPHLRSLRHDRLDDTVILDGASRRNLELDINLSGGRENTLQSVVDRCQTAMASRLMSRWLNRPLRDRAVLEARQESIACLLERYRFENLQPQLKEIGDLERILARIGLRNARPRDLARLRDALAALPDLQNAMTELEAPHLQALATTIGTYPELAELLAKAIIDNPPAVIRDGGVIKTGYDAELDELQALSENAGQFLMDLEAREKARTGLPNLKVGYNRIHGYFIELPRVQAEQAPADYIRRQTLKGAERFITPELKAFEDKALSAQSRALAREKALYEELLERLIGHLAPLQDSASALAELDVLANLAERALNLDLNRPRFVEHTCLHIEQGRHPVVEQVLETPFVANDLALDADTRMLVITGPNMGGKSTYMRQTALIVLLAHIGSFVPAARCELSLVDRIFTRIGSSDDLAGGRSTFMVEMSETANILHNATDKSLVLMDEVGRGTSTFDGLSLAWAAAEDLARTRAFTLFATHYFELTVLPESQPAVANVHLNATEHNERIVFLHHVLPGPASQSYGLAVAQLAGVPAPVIQRAREHLKRLETTSLPHEMPSQQSGKPASPMQSDLFASLPHPVIDELSRINPDDISPRQALDLLYAWKMRV

SEQ ID NO: 20868 - protein, 108 aa, Pseudomonas aeruginosa
KMTFVVTDNCIKCKYTDCVEVCPVDCFYEGPNFLVIHPDECIDCALCEPECPAQAIFSEDEVPENMQEFIELNSELAEIWPNITEKKDALPDAEEWDGVAGKLQHLER

SEQ ID NO: 20869 - protein, 139 aa, Pseudomonas aeruginosa
GFPSLEQRVTRQAILLQDLPQALQRLDLDLTNPLAGQADFLADLFQRAAFVPAQAEAANHHLTLLVGEFRQPLVDAFAEIVILQQLARVGGAIVGERIQQGLVRVRTKRDVYRSHPFVQAEHALDLGDRLLQQVGDFFG

SEQ ID NO: 20870 - protein, 561 aa, Pseudomonas aeruginosa
IRCPGAAGAAGGPASGNCWRRSCPGRGRSLRNRHDPPARRKARRYRVRSPRRRWQSVCAWVFRLPCRYQVEDFTHHYGGETTGRQDEFQLQNIRFRIMPRQPLDGEPQDAPFVRHARLRQPAAERRLAPGQGQLAFEDAGAARRIALAPERSGGVQVEGGQTGIAAFFLASEEKAAAVGKGQQVTDRCPVPATLRDPLGEQAIEQVAAPGGKEARTQVAVRRQQVLFRATARVDQVAAAVAEALQAEIIGHAVRGDTFQARVEKGTLRPQPGQTQGEAVGGMRASLQLARMTGAAKNPQVRALGCTQVGIGLARQVQAEPLPGQGLAVLQPGVADVLLLHAGGAAEATGRLLGVQSALFHPQPEVLAFTAEGNVQHLVDLEVLGHGLEHRLAAGCPMGARPEQVEFAENAHRAISKATACTAMPSSRPVKPSRSVVVALTLTWSTATPRSSAINPRMVSMCGAIFGAWATMVASTLPTFQPFSATMATTCRSSARLSAPLNRGSVSGKCLPMSPSAAAPSSASDKACSSTSPSEWATSPCLWGMRTPPRVMKSPSPKRCTS

SEQ ID NO: 20871 - protein, 332 aa, Pseudomonas aeruginosa
PWPIRMKKRPGWNQGVILPRIGTGFRYRGSTVENPGMMAQVILDETGDEVVAVVVAWLQTQLQRVAGLVRRIAYRFRLELDGEEVVALALVDQDRQAFGRTLEQRTGIPLAPGRRVLAQVAGERLLAPGTIARMADRREGRQRQVAPRVAQRANQRAMPTHRVPADAAPPGHREMRLDQRRQLVYHVVVHAVVRGPGLLRGVQVEACAQAEVPGAVGIAGDTAAARAGIRRHQYQSQFSGDPLGAGLLHEVLVGTGQSGQPVQGRQRRLRLGLGRQVDGEDHLAVQGPGKMTVTLVPAAEGLLAADQFEGILHVTSVKRSWRAAGPAATACQ

SEQ ID NO: 20872 - protein, 66 aa, Pseudomonas aeruginosa
LGSSLRPRTPPNAEPRQTRPVTSWNGRVLISWPAPATPMITDSPQPLWQHSSAARINCTLPTHSKE

SEQ ID NO: 20873 - protein, 105 aa, Pseudomonas aeruginosa
SFGLMKSVAPSSLAISNLPGLMSTAMMRAALAIFAPMIAARPMPPRPKMATVAPSSTLAVFSTAPIPVVTPQPSRQTFSSGASLGIFAREISGSTVYSEKVEQPM

SEQ ID NO: 20874 - protein, 436 aa, Pseudomonas aeruginosa
SGMTWSPTCREVTPSPTASTMPPPSWPRMHGNTPSESWPDRVYASVWQTPVATMRTSTSPFCGGATSTSTISNGLLGAKATAARDLIIWELLNDGSRRAAKRPTETESVENRVSRNNQAIIKTLLPYRDNPDESLGRTRRIRRCRRNRAVHRGSRTHGRFLVAHQPPGRPPGGAPADPPALPQHPASIAERSRTDLPATLPAPAGRPRRSPARGQRPLRGAQGPAAHDLRGSLRRTFHRAAGECLHGRLSATAGRHRAVQPPVGPAPRGLRPGHPPRPPERFAIGRHTVGTTRHVPLRHPGIPAPPRHSAVAGGTRPVQLPDRQQRPVELPRGRPGNPAPGPGQLALQQRPGGARRRPARLRPVPAARLLCDRASAQRPPGLPAGRPPAAEYSGMGAVPAAAAPVAESQATGGLSQGRPGAIPSGTRRGEKPALKQ

SEQ ID NO: 20875 - protein, 413 aa, Pseudomonas aeruginosa
TWRFPVPPAIDSRKSHVCLQCVSPTLPGEVLVAAAGAGRPRRRLRLLLRAHRHLLGGDRRIHPLGRPRAVLVRLPATGLELLQADRPSRHAAGPDRRSDDHRHVPRRPVLRPLGRQRQPALADQQTSPAAGSGRRYRRRLRRAPGDGLQPGGVLHRYPDVFPARLGLHVRHRRRRLDRREDQPAAVPAHTAESRRHGQRPAQRRKPGPTRTPAGPPGPGGAGARRAVRRLALRGIAGAGHGLPVRPAVRRPDRARADLLHQCRTGPLDHRPDPRRLRHPARHGGRLHRYLRRDPPGRRAEDLLDGPECDHRRHSLRHRHRPRRRLRDRLDVPLDGGPGALLGGRHRQRHRRNPGGDLLGPVGHPPRPALSQAQPAGKLRARQRPAIDLRRPGPVPAAGATERLPIHPTAETEP

SEQ ID NO: 20876 - protein, 573 aa, Pseudomonas aeruginosa
PVRILRRPAWPGRATPARSCRRTARTAGRCRSGYRRRERSSVPCSGLPGIFQRGVDETAEQRVAITRCGGELRVELAGDEPRMLRGLDHFHQGAVAGAAGNLQAGLFQLRQQVVVHFVAMAMALDDHVLGIAIVHQGAGLQLALLGAQAHGAAQVGSFGADLGGAGRVLPFGDQADHRVAAGLVELGGVGVAPAEHVAGVFDDRDLHAQADAQVGNLVLAGVLHGADLAFHAAQAEAARDQDGVDAFQQAGALLLDVFGVDVAQVDLGAALDAGVGHRLDQRLVRVQQFHVLADHGDGDFTLGVELGIDHPVPFGQVGLPALQAEALDDDVVQALGMQHRRDAVDGVDVFQGDHRVLLDVGEERDLAPRGDVDRVVGTADQHVRLQADGAQLLDRVLGRLGLGLAGGGYVRDQGQVHQHRALGADLDAQLADRLEERLRLDVADGATDLHQGDVGIAGALDDAPLDLVGDVRDHLHGGAQVVAAAFLAQHVHVDAACGEVVVLGHGGTNEALVMAQVQVGLGAVLGHEDLTVLERAHGARVHVDVRVQLEHRDLQATRFQDRSQRSRSDAFPQ

SEQ ID NO: 20877 - protein, 146 aa, Pseudomonas aeruginosa
AGRSQTNGPAAARQSAGNHQIRPAPRRSSPLSRRQIGSASSPASRNDSQPAQWSLSGNRVSCPSQARSRLRWRAALRRRRGSRAIRGRSSQSGQSSSEGWRQARRSMAASSASRSSASRRCAAQRAMPATACGQWEARRGMISRRR

SEQ ID NO: 20878 - protein, 340 aa, Pseudomonas aeruginosa
AVVQQRQEGCGQRLRSRGVLDQLRHQQASGQQVRQGDVRAFHQALENPIRQPGDPISHHHRPLVEQRLESRGAGGDQHRIAGGKRFMGRTVEQRQRQRLAALEHLLDLFAPCSAGAGQHETQARPFDEQALGGVEEQGAELADLAAATARHQRQHLSVRRQSEPRAGRSAIRLQGNGVGQGVADETHGHPMLFVETCFEGEQCQHQVAGFANLQHPLLPPGPHRRADVMHGAQASLAQLVFDAEGEVGSVDADHHIRPGLDERADQALAPSQQLRQPAQYFDQAHYRQALHGKIAGQPFGLHARPTDADELDIRVPRPQRLHQSGPEDVAGGLAGDQGYA

SEQ ID NO: 20879 - protein, 322 aa, Pseudomonas aeruginosa
SVSHGSAGDAAGCALDGITEHRDLGELGSAFGQLGQGFLDGMSLAIDHLVGTPQGMDGLAAEAAPTHAFEVHAAGFGRVAEDRHVGRDVLADGAAHAGKAVRADPAVLVHQGVAGQDRPVVHVDMPGQRRVVHQDAMVADHAVMADVRIGHDQVVVANGGFRAILDGSAMDGHAFADHVVVTDHQARRLALVFQVGSILADAGKLVDAVVLADLRGALEHHVRTDHRPFTDLHFRPDDGPRAHLDVSRQPGARIDDGARIDQTHSLRSAQMISAEHTGLSSTVAWQSNFQMLRFTLMNLACSCSWSPGRTGWRKRSLSEPTK

SEQ ID NO: 20880 - protein, 375 aa, Pseudomonas aeruginosa
GHGSQAFFQLLKSTRHVVQLTNARGAFFPFGRRLHGGTGGIRSRLGDRAGHHGHAGHENVVADLDMADQANAAGEHAMPADLGAAGNADASGHGGMIADLHVVRDHDLVVQLHTVADQRIGQCSTVDGGVRADLDVVTDGHPADLGDLLPDALLVGETETFAADHRARLDTHPRADGDVVVERDPRRQPAAFADHATGSDHAVRADADASADAGATLDHRIGADAGARIDLGVRRDDGGRMDTGSRLRFAIEQVRQAGIGQVGVGHHQRGTGEPVGVGSRQQDGAGTAFGQVLAILRVGQEAQLSRSGLLQGRQALDRQVRVATDFRADMRGQLAQGVGQGTHHQRSWFIRSITWRVMSYCGLTSTTAPRSMTMS

SEQ ID NO: 20881 - protein, 205 aa, Pseudomonas aeruginosa
PLRALPSPRTASSRATSSTSPSRSTLSWTRCPGRARTLSTTCCQSSTAMPSMLCKRSPSFSPAACAGPLGSSSASTGGKAGRQGRMPSEAMGSGLSSPFSQPSRRTWWVESTFEPFSCTRTSSVPLSPRRRTSCRLTPFQPVTGSPSTASSSCPASRPAWAARLSGATEPMTGRTCWLPSRATTQKNRIASRKLAMGPAATMAIR

SEQ ID NO: 20882 - protein, 486 aa, Pseudomonas aeruginosa
SALISYLQAVRRLAGVPGQPLPGDRTRAAIGSQDLIERFDCGHRLAVQHVLDDNRDVAEADVPLEKCGHGHLVRGIQHGRGAAAGFRGLARQAQAGEALLVGALEIQATDGEHIQRRNAGIDSLRPGHGIGNRRAHVRIAELGDHRTVDVVHHRVDHALRVDHHLDLARLGVEQPARLDQFEPLVHHAGGIDGNLPPHRPVRVRTSLLRRHRSKLLQRRLTERAAGGGQEDPAHADPLQAIGIIARQRLEDRVVLAVDRQEHRAAALDRLHEQRAGHHQRLLVGQQYALAGLDGRQGRRQPGGADDGRHYHVHFGRAGHFAQRLLAEQHPGADTRRGEQALQGNRRGLLRHHRIDGAVPEAQRLKFGQAAEASQGEGFVTIGMTLDDVQGAQANRAGRAEHADPLRSTHGAPQPAAQSRAANTGMAAVRLSMRSSTPPWPGSRLLLSLIPDWRLNMLSVRSPTIETNTTSAAPSRARSSAPRDQPR

SEQ ID NO: 20883 - protein, 231 aa, Pseudomonas aeruginosa
SFSTLLDQGAFGTTNNNIQQCARLVHVEHPQRHVLVTAQADGGQVHHAELAVEHFIIGQALELLGIRVLERVGSVHAIDLGSLKDHVGVDLDGAQASRRVGGEERVAGTGGEDHHLATAEVAHGLAAVVVVGHTDHGDRRHHQRGDVRALQRIAHRQAVHHGGQHPHVVAGHPVHAGRGQGRAAEQVAAADDQADLHADPDQLADFQRHAVQHLGIDAELLRAHQGFAAQL

SEQ ID NO: 20884 - protein, 452 aa, Pseudomonas aeruginosa
RPGRRGRRRLCACVACEPAERAGNAEAAPNASPFDEEAARISGQPLPGRQSKPSLLLLGGGYLSGNFGSEVHFGLLDAFAHFVTNEGNDFGAGLLGQVADLHFRVLHERLLDQARFGEELADAALDHVLDDVLRLAGDLVGVQRQEDFLLFRDRFFGNFRSAQELRVAGGDMHGDVLGQFRVAAFQVDHDTDAVAVQVGADHVALDAGQAADVDVLAGLGDQGQTSFLTCFDQRSGVGQLLVEGLFQALGDEALEVVLEGQEVGLGVDFDDHGGLVVGSDLDGDRAFGGNVAGLLGSLDRTGSAHVVDGLLDVAASGGQRLLALHHAQAGTLAQFFNHGCSNFCHFEILLSGSSQKTFVPGLPGRNSKVAKRGPSPLPAHRRTSERPGISLRRIRPALPRRTRRRWWQRPACRGLPLRPSSSGRVARRGWHHRYRELHSRRLPGCCWYRQRR

SEQ ID NO: 20885 - protein, 391 aa, Pseudomonas aeruginosa
ASTHPNDQPLRAPRPSCRCMCGFVLRKRPQPRSGALYTITVDAVKPAADGRAGVDRSVRSARIAYSLFMRACTPEENSHDRHHQDARRYREDAHRRPPGRRSAGNDRRTHQARRDHRGAGSHLPRLYRQRAEGDSRPPELQGLSQVDLHLDQPCGLPWHPQREAAEGRRHPQRRHHRHQGRLPRRHQQDVPGRQDPGMGRPPLPDHPGMHVQGHFRGASGRAPGRYRRNHPEARGKERLLGGPRILRPWHRQGVPRGAAGPPLRSCGYRHRAEGRHDLHHRADDQPGPPGDPPARRRLDRDHQGPQAVRAMGAHRAGHRRWLRDPHPAQRRNLPAHLGSLIRPGFCCQPCASTPRPIPAGPTPRFGAARAPIQRKNAPRRGARVSNPTASR

SEQ ID NO: 20886 - protein, 162 aa, Pseudomonas aeruginosa
SPPSWNAAPSAALTACASACCGLPAARTCGRARSSSWPNATNSSAATPSTTTPSTTSSPTSRAPPAACATSRPSSGWPAASSAASTCTPWCAKASWWKASAACWLPARSSSGGSAMPCTCSPGAPRIACCSITSAASPVCSATKTTTSSWRSNASCRSTTGW

SEQ ID NO: 20887 - protein, 93 aa, Pseudomonas aeruginosa
PSPPTRCARSRCSKSSPPTAPACWRGSAASSWISTCRCRTPRSPPSASAWRTSSTSPMRATSRSPTPTCANACRPPWSSSCHKTTDGTPCLPG

SEQ ID NO: 20888 - protein, 954 aa, Pseudomonas aeruginosa
TSEKPCQRHEYRTRQPATLPLREAPRPARRRPAARDAEADRTVHRRAQAPLAELRRRNPGGEPGPARGLPDHPRPAGPARSHRALVRAALLGAGRLAGCGAPRTAGERYPRGAVRLHPDRGPPQRARRGARPGGQPEPVLPDLRRRGAARRSRAALPALPRGKRLQPRLRCGRRGDLAALPDSLPLLARQPHRGPGTAGDPEEADRPGRPLRLRDRRRRVLQRTLLRRKRPAARPAQRLRRAGPHGLQPLRGVPQPVQALQPARPALGLRRRRRGDPEEIPPLPHLPRLRHAGADPVGEHRRLERRGPCARQPQPLPREIRRRAGDPRRRARRTAPGRQFLPVGTYPGGRHRIHPRTVRAAARDGGAGFLPVARGGRREPRRQPRAHGPGGTTGRVRRSRRAHPRLPAGALKPARRNEKGSPRRSLFRSHPAGEAIGQPAFLLVQLAQDVAQGLVVDLVVAPLPVQFQALRAQRLQAQGLVGDLQGLGLVAGLIGGRCGIQRLAVFGHDLRTRLGDPRSIRRIVAFHLRQFLALQGPDRRLRGLAPGLAPLALVGAIVARRQPAQQQRQADGRADQGNQDHAGGDEDDQVALREGATIHQAHRYRQHRRQGHRTTHAAQCTEGGETAQGDAAQPGRALAAPAVDAQRQLPVAIDPAVADQHQHGGDRRHVGQQQRGTPEQVAVVVGHRLHDVRQLQAEQQEHHAVEGELQHRPDAAVEQARGSLPRQQVDPALHHAGRYRRENPGDAQVFRHHVGGERQQQHQYHVGRRVVPATGDHPGADAAQRPAEEHPDGQAADRDQEEVEAGVHQREHAGHRRGDGELECHQARGIVHQRLALQQVHQAIGQPPLGDRRDRQGVRGRQHGGEGEGSRQGNFRDQQVDEIAGTDHGEEHQAERHHQDRPAHPPDFPLGNTPAVDEQQRRNEQEEEQLRVEGNVQSEGRQGQQGPGGDLDQW

SEQ ID NO: 20889 - protein, 157 aa, Pseudomonas aeruginosa
RCETLLHSPSVQARRSVGQDDAPKEYGVQRPLRQRNAAMTSKGLTSALLLASMFAATSGCLQQNALTQGYRTTQPGQPGQAQVASANTPCTPSATNDLIATGRSLLDITTNLIKTRNQMSDGGSIMRDVDDVQKVGKGHAVLDSVESMTGGPQQPCG

SEQ ID NO: 20890 - protein, 130 aa, Pseudomonas aeruginosa
WQCRITPLDVVVSGRSRDGTSFFPYRGIAEQRPMRRAEMLLLKSLAETLMADRDNRHDDLQATMRLAHLSSPEMILYMVNRVLELEESIERIAAVLQKLSADEPMPLEETPPEPAFEPALQSRATETAET

SEQ ID NO: 20891 - protein, 850 aa, Pseudomonas aeruginosa
ASQPFGPRWTQFHSARAASCSASLFSGRRAISSDEAVTGPQQSWQPGLQAKPGICRRNWSIWRPMQLMGNLLGGGRIVQRGPEHSESTGKDALQRAESTCSTCALSVPGQGNSPAPCPPARPRLSAVTPLPSAVAPRPHRGGTTWHNPAITFRRPIGRAREDPGLGRSNDLRSLRHQSLRHHEEGSDLARRAQGRLRLPRLQGRRHRPRTPAALVRGARLANRPQPRRHHLPQARRSAEGRSRRSQGDRADAGPAVDDQAPGAGAGRQDAGRLQARRLRRRPGLSGRPHECRLGPVRTRLLRPQPGAGAEQPAVAEQRRPARFRHRLAGRRRAPAGIRRHARPGRLRAGAGAAHLGLAVPGDQGARRCLPVVACGAIVADRCAATGERSQPGASQPLAPGAPGVPGGGGQPEGDPDFHRLPAAVRRSRPTAGRPVRPARSGIPAARMAGHRSLFLCRAPPRPAARRPAGPASVQPRLRRAARQRGTGPAAQPPSGLTVPLRFEETHMSQSLFSLAFGVGTQNRQEAWLEVFYALPLLKPSSEIVAAVAPILGYAAGNQALTFTSQQAYQLADALKGIDAAQSALLSRLAESQKPLVATLLAEDAAPSSTPEAYLKLHLLSHRLVKPHAVNLSGIFPLLPNVAWTNIGAVDLAELAELQLEARLKGKLLEVFSVDKFPKMTDYVVPAGVRIADTARVRLGAYIGEGTTVMHEGFVNFNAGTEGPGMIEGRVSAGVFVGKGSDLGGGCSTMGTLSGGGNIVISVGEGCLIGANAGIGIPLGDRNIVEAGLYITAGTKVALLDEQNALVKVVKARDLAGQPDLLFRRNSQNGAVECKTNKTAIELNEALHAHN

SEQ ID NO: 20892 - protein, 409 aa, Pseudomonas aeruginosa
PSSHSVRHVPAVSLARRLSGLFRLRRGRPDLPRQRRHRPEATGRTRRPERLLPRRRRQRPPRPTCPRRACHPGLRGRAQPRRPLAARRQPGRGTVHPRHHRGDQPGGLWPGAAFPAWRRTAGQCPGTPCQPASLAAVGPAPRPGPARVAAGRARGDRPGAGPPYHRRAYPPAGDQPVVQRSRHLATGGGVDPAGPRARCLDPGRRRPGQRPRTPRPAGPGLRLLRILRPQALRPRRHRRALGSPTGPGATGALAVRRRDGTPHRLPRSQLPCRSARLRGGHPGGFRGDRPRRDHRLAGHPGRSRSRRPRRRPPRPPARRPAGARRRQPARRTTGGAGQLLRRRRARRRSRPPARRTGHRGARRPPLSDAAAATPPRYPAPLRVSLGLYNDADDLERFFLALDRSLELLR

SEQ ID NO: 20893 - protein, 365 aa, Pseudomonas aeruginosa
SFCSVRSSRAPLNSRPETMLKARNASAISNSPAPEDNTRFIDSPSFGFLQVDRHRRGGQPGDDQADEIQQVAQVDDALADGIEAGQQAQRGHRIEQPLRRPLAERIEHQRKAAEHEQEAGGHGEDESDHLVLRQGRHARTDGQVAAGQQPTAQIAGENRTVVRLAQVVHREHHGEGQQQRDSGERPGGQELAGHGFEAGQRQGHQQLDRAGLALLRPQAHGQRGNQEQVEPGMEGEEGGQVGLVAFVEVAQVEGEHARQDQEDNDEHIGQRRGEITRQLALEDHRQLLHASVPRVRLRNTSSSRPRSTSSSRIRQPRSATSPLTWGKITAPGCARTVRLPSAGFSSMPATPGSTASATASRGSSL

SEQ ID NO: 20894 - protein, 865 aa, Pseudomonas aeruginosa
DALRSFAALRGLRQTSRARHAGSRSTASRHRMPRYPFRRFGFGALRRLLYLWVRSETINQSAFTLKIDRSKPVLYVLQQPSVSDLAVVDTECRKAGLPRPVMPVAVGDAIEPAAFFYLTPEPDWLGRQDKRGASPTLVRMLAAVGQNGLDDAQIIPVSVFWGQSPDSESSPWKLLFADNWAVTGRLRKLARILILGRKTRVQFSAPIHLRELVEQGKGHERTLRMVNRILRVHFRNLKTAVIGPDLSHRRNLVKGLLRAPLVRQAISEECESERISQEKAEGIALRYANEIASDFSYPVIRFLEVILSWFWNKLYEGVKVNHIERVQDVAQGNEIVYVPCHRSHIDYLLLSYLLFRNGLTPPHIAAGINLNMPVIGSILRRGGAFFMRRSFKGNQLYTAVFNEYLHTLFSRGFSTEYFVEGGRSRTGRMLHPRTGMLAITLRSFLRDSRRPIVFVPVYIGYERVLEGRTYLGELRGATKKKESIFDLFKVVGALKQRFGQVWVNFGEPIHLDQFLDRHQPDWQDQDLGPEYRPDWLPQTTNLLAKDVARHLNDAAAINPVNLVALALLSTSRQALDESALARILDLYLALLRKVPYSPSATLPDGDGQALIEYVKSMNLLAEQKDALGRILYLDEQNAVLATYYRNNVLHVFALPALIASFFQSNSRISREQLLRFARALYPYLQAELFIRWSLDELDAVIDQWLAALVEQDLLRQENDTFIRPAPSSRQYVLLILLARSVTQTLQRFYMAIALLLNAGQNALTAEELENLCTVMAQRLSILHGLNAPEFFDKSLFRHFIQTLLDLRVLRKDEAGKLSYHELLGELAEGAAKRVLPAEIRLSIRQVALERPAEEAAAESNDAAAN

SEQ ID NO: 20895 - protein, 290 aa, Pseudomonas aeruginosa
NSTAATRSPIACRSNRRAEAHRGMPPVRTGGSLQYTPPPIRYRLPIHLTTSGRIPRTFHIKDAVMFRLTALCAGLLLSANALALSLADLSQNDASSGLKDALTQGAQIAVRQLGQPGGFNNNPDVRIELPGKLGKAAKLMKQFGMGAQVDQLEASMNRAAEAAVPQAQGLLVEAVKKMTVADAKGILKGGDDAATEYLDKSSREQLRAKFLPIVKQATDEVGLVKQYNAFASQAATLGVVDAKSANVEGYVTEQALDGLFEMIARQEKSIRQNPAAAATGLAKKVFGAAR

SEQ ID NO: 20896 - protein, 108 aa, Pseudomonas aeruginosa
TRALWPSSAGVARSSKATRAAKVRDCGSAAGESSRICPAKRLSRCDQSSTDTGWPMRKRSKLCSGRPISTSRSPSAARLKTVCPAATTWPTSTRRLAITPSWGERSTA

SEQ ID NO: 20897 - protein, 200 aa, Pseudomonas aeruginosa
ITCGASPSQARIRSAELPPSRRIRAAIGATSGSRRARSRPSSSRAAISGWRSTRVTSQPRLARTNPSRPRPAVASRTRGRMPGWTPTALAIICPLPPPNLRRWALAPSTKSTRTGPGESAPSCKTCKPCSPTCTANSASSSAASGRPSRSAQRRAASAQSADRAWTCRRGAAESVMVGQSSGKARILPELARARSPADLP

SEQ ID NO: 20898 - protein, 174 aa, Pseudomonas aeruginosa
AHVEVEVIPVGGVVVGPQHRIETGAGAVPHAGQEAPVGALAGPVRGQADPPPVGQAEAADVQGIGRGMLAAPTVLAVVDVAAGEAADMLDPRQRLAIDVQGCRLQHVPLEQRIAHRQRATGEKAAAQLQRRPTHAQAVAQRAGSRWRVVGYPLVAQLRGGQGGVAEAPVVGQPP

SEQ ID NO: 20899 - protein, 248 aa, Pseudomonas aeruginosa
KRRRLYQPSPPRKRRRPASGPSVLQRCGSAQGRKHFRGDLLDRADAGDAVVFRGAFGGRQLLVEVDQRLGLRMIDRQAVTHGLFLVVLALDQLFAGNVVLAGDLRRVVLGVVHAAGGRMHATTGDTRHDLLVVDGDLDHVVDGHTGVLQRFGLRDGPREAVEQEALGAIGLGDAFLDQGDDDVVGYQAAAVHHAFHLLAERAAGLDCGAQHVAGGDLRNAELLGDEPCLGAFAGTGCPEQNHTHRYAP

SEQ ID NO: 20900 - protein, 261 aa, Pseudomonas aeruginosa
PELTRAERRAVVRQQSLHGDAQAGVIGHGIAQEQDRLRRLLIGMHGGERQPCVIIDGHEQRLPACTIDRVATVACDAVAGPHDAPELLGVDVQQVPGRLVLVAHNGFDGLQVAQPGHARSRQNAADRGLRDAHTACDASLQHSTFAQLDDEQSLARIDGPGRSQRPGRGIGQGGLATGQVTTEPLPGRWRSDAVRGCGSHGIQAFQRHLLDHLESAGKGKSGMLMGVHPVGRPEWIGCLATSSLSNPIRMNTGYNLLELHN

SEQ ID NO: 20901 - protein, 162 aa, Pseudomonas aeruginosa
AVVLDGVEVHVDERDAREHHHHDGDEDPVLDAGGAQHAFIALVGAFCTGLQPLLHDDRHERQREDAAGHQHGPDAVVDDPGHQRQVVLQVVGREQRHGAISPQPACISRLASSATMATTPAISVRTRRRRAWASSSRTSSRRRIQIHPYTVAPYRHSRHTKK

SEQ ID NO: 20902 - protein, 196 aa, Pseudomonas aeruginosa
VARSTSVMSASGHGVPSRSNISPSVPWQNMSIASAISSSRARRISGNVGSWPRMRSALRTSRVSTVRFSATQCSAASRMHWRISERSARVIRASSLSSPPVIISRAVISSSPSTSRCSSASMAEASGGWSSSRASASSVCTSLGVSISRRASANGARLMPDPGASLTRFTVRPRRRAKSLNRPKLLPASTMKSRGR

SEQ ID NO: 20903 - protein, 155 aa, Pseudomonas aeruginosa
TGLALLTPAARAPALATVSVVVKSVLWAGPKIVGKLMPPLAPRPPLRPSGGFASSGSTHRTPPSMRASSPPCSPRPTGRSAWPPPRPPMLSRRRCRSASSHSVWLARAGPPGSWSRRRLDRSDSSAELMRWSMEFSRWRSRWFSSRCDLLSESAV

SEQ ID NO: 20904 - protein, 365 aa, Pseudomonas aeruginosa
  UNSURE (206): Identity of amino acid at the above locations are unknown.
SSVRNCFTWATSVATVSRGVSPSMPSAFISSGVSWAPLSAAGGAVPPPPENSRIPANSTRMATGIISHLSRPLLRMAGLLGVLVAVRLRQMHGRVEAVNRRQQRLREAAAARDQVQDGRVLGRAARAQRLVLEGGGEEIALQHARVERDPVGAGVGEAHGSHPLVFQAPRREHGRAHRQRWHQCVQVEVAGQVDPHDARKRLDGAXRCVKVLRGEARQHDRDRSFAPRGPRTCLALGACRGLRTVGLLAIASRCAVTLDDAHRLQLGFPVLGRFGYDVQQDQRARVGVLQLQPRGLDRLAGTQVHRAARTLHAQALAHACGHAHAHVPVDEYDAFLTDLQRHCQWHAFPTQDLHRLGNGCRGHGQ

SEQ ID NO: 20905 - protein, 209 aa, Pseudomonas aeruginosa
AGDGRTRSAVARVGNGIRMRHSPFTAVYDACVLYPAPLRDFLMWLGLSGRFRARWSQAIHEEWKRNLLINRPDLTRVQVDRTSDLMDRAIPDGLVEGYEALVAGLTLPDPDDRHVLAAAIRCGASVIVTFNERDFPNDLLAPYGIESQHPDEFVDNLLDLDAAAVVSAAQRQRAQLKHPPIEVDRYLEILLRQGLVQTTKVLATYRTIL

SEQ ID NO: 20906 - protein, 237 aa, Pseudomonas aeruginosa
CQRRSLGVRAVEGRLGSLAAVSEGAARLGANRAQKAQFSHHCTGLEPRNCHAGAGRCWTSAVARPRRFPQVMSTVATYSYTHSVTYVTDNILKSLKDIILLSGLDPEHFADRWESNTRAIKTWLGTGDLRKVILEIYNPATDKLVTRWDIDIVYGWSDGDGSFWTDTEQLKYAIKKAGLLPSQAKYKLMLDTKPGRPDVEGWSKGSYRSTDGMVKQSLGSTVEHSGLAGQAGYWRQR

SEQ ID NO: 20907 - protein, 208 aa, Pseudomonas aeruginosa
RNAPRGGGGWGRLSCRIAGRGPATAASHVGGQLARRRGEWGPARLASPLTDRTDHRRLRRAGARRECPARRDGPGAGPPATASAGDRTAADHAHDCGSGAGGRPPNRGPIRRREPRPNPGGHGRNAGGGAPSAGQGRLRRLPARDSGIPNRSAGGSATGAGRPSPPSLQRIQPGRCPAICCTRCGCPWPRTARSRWSSPASRARATTR

SEQ ID NO: 20908 - protein, 136 aa, Pseudomonas aeruginosa
SSSAKGTSNAWAWRFCLPRTSRRAAPWSYSMTSSTRSTTTIAMASGVPSSRTVCSTASRLSSPRTQRSSCTASSRSWACAAPRPLSATSFSRIRESTNCGSTATRQRRTMFFWPSRRWRLTRNARHCVRPGRRWRV

SEQ ID NO: 20909 - protein, 223 aa, Pseudomonas aeruginosa
VLLEAACGQADCHPQQRRAGQQDDQRMHRYGQSEIGDPRQHGQRHQAGLRAVVDEAGFAARAEPAHIPSHQAVNQADECRREDQRQREHQDQQAHQEGERREGRSDQVAFGPDIDLADVVAEVAALPVAGRADALGGLAHALQQPRAHEHPLVPGIHQLVRRAPGLLYHHAAREVVGQVPEFVPQHLLGVAPALVLPEQVHAGALHHDRKQQRANEHPEQPER

SEQ ID NO: 20910 - protein, 218 aa, Pseudomonas aeruginosa
APNAKALPMPMAGLSASDHGATRHRNAAPAHAATVYSSTAGRSRTSTGCLPDMASLLDAGGRDQRRVVPQAQAIGQVVAGHGRERYARHQSAQPCQALRGLDVDHQADRAAFTQSGGAALQPDPGSLVVADDRERPQAGRFDHAPRDGTGRELAAAHRQHRGFVRWRGGNPGRRDGGAGRRVGARLEVQGFVVRQCRRAATVLDHDQRLASTRGQRQA

SEQ ID NO: 20911 - protein, 112 aa, Pseudomonas aeruginosa
LLYYRTMQEDQAISALNALAHTQRLRVFRALVVAGPGGLTPSTLADQLDVARNTLSFHLKELAHAGLVTIEQQGRNLIYRAEYGHMNGLIGYLTEHCCQGGVCEVSPSKTCC

SEQ ID NO: 20912 - protein, 297 aa, Pseudomonas aeruginosa
SVSCSSIPFSSTGRSWSRRWVCACAGHRKPCSTFCRNRSAARSTRKTASRWLMRKAVVSEARLDLPNIDAALFQQPDAEHLFAPARTTHAPRFLLLYGSLRERSFSRLAAEEAARILRALGGETRLFNPSGLPLVDDAPADHPKVKELHELVQWAEGMVWSSPERHGAMTGLMKTQIDWIPLSVGAVRPTQGKTLAVMQVSGGSQSFNAVNQMRVLGRWMRMLTIPNQSSVAKAYQEFDEVGRMKPSAYYDRIVDVMEELMKFTLLTRDAVPYLVDRYSERKEGAESLSKRVRQGAI

SEQ ID NO: 20913 - protein, 418 aa, Pseudomonas aeruginosa
SSGGDQLPGQCDLDGITVLVQDIEPGFGHVARGGLRDHDLLGHQLQAGHLRGTGVAEVDHTHGLLLPDAPGAACRLLERVHVVARLHEHDRRELQQVQPRLDQLGVGDEHVDATVQLLGDPVFAAAGIHARAQHRHLEAFLLQQHLQARRGVARAGIDRVGQDLAALRLLLFADVDQLTLLGADLELVELSRDKRQGVARARMHHGLRPEAAIRPGQQHVEDHTQQGRIASRQSLFQLGGQPTRQIAVGRGLRRVHRDFTELLVIRRQDVAADVLELEEDREWQDAAQDALGAEARGLDRAHRYLGALGRLVRRAGALGVDVLQHPVIAHERHRSRGHAAARGRAVAVFDHPPRKGSEQQVKKIITVAAHQRASQQQGLASLRRQHAHGLALGTAPVLVLMRFISDEQVERTLRQVVG

SEQ ID NO: 20914 - protein, 402 aa, Pseudomonas aeruginosa
QQFTFVGHTTQPSAVPALMLADNALPHGVGAARRPSYIVPAASHKTVISPACAGRLLMTEHQVPRRDCPRWNNYSDDFTSHPLDELRGLITALAKAELHVGHRTFHARGLTVGKHQLAVAIHEVDELVDVVAQHRGQEAVTELLHQLLRSDFPDGRDALQGFEDGRGLVAAGQAARADQRPQGRSAMAALPAVLLGFERDRVDRLAVEVGDDRAAVRAGRHVAVAGAPLGEDGLPVETHPHPDAPQDEELLARGLHAQLLTQLEELDERIRPIEHPYLGAGHRLLDLPPPLVNQVRWRQDQSAAVAFGVEHGGRGDANGRLTTAHLAIDDRGAFATVDQQLGGGVDDFGLGREQLAFEAGDDELPVRLRLAGIDRRVGAVEGVEQFVAELADEILKAQGQRG

SEQ ID NO: 20915 - protein, 137 aa, Pseudomonas aeruginosa
PSSPRRAICARKARRSMVESSFTDSPSGHSRPKSAGSPSWVLPGAAASAGGGASTPKGVVSTIGSADACTGAGLAGLDALVGLAGVAAGCAPCSSSSGSTSWVAKLRASSRLSLSMPLSVMPSRLARISNRMPPPTG

SEQ ID NO: 20916 - protein, 654 aa, Pseudomonas aeruginosa
HPGCWLLPMRRQCRRKDRATCRPRRTSIRSARSRLVQALHQPLAQPRDARHGHGVADRLVARRVGGGLTAVRDQRVVVGHALQPLALHRHQPTYPPLRPVARAGVVPVVAEMCLEVRCQHMGLVGTAAAGAQRGRDAIAQFSGQAFGATAQRHADHHRPALAWLGATRGERPGKLAVAGFQPQLAARVLRERDCRHDAGIRVAEAMPAGTQRRRMVRRRIRPAALCGEGNDRHALAGAVLAAALAAVGGAERVADAARDGLRHEGLDLEVVLRAGRRGQAGRDVDGSCGVAPAESERHRGLAVGLLQSWISRVPACCRSARSSSAGSVLPRREARRRIPAQAWALKKYLGGIDATSTTCHKKHATAPLGDAEILSIEQAPGDAAPGSRHTTCVRPFLPWRFERTAFAGQCAQEVSEGVAAVAEDAGDVFPDERCRRAAVLAAGLVDGICKLHIGKGQGAARVSQATAGAGHAERLARRAADQEVWRGHGAGADLAGDRGHVAQVGHAGVTVGEHGARERLDLGEPRGFEAERLPSEAHGLDAAADAAVEQRRVARRCAKFRVHVGLLFVWRRAIALAGALKGRRKAPKAPGAFGSGGKKNHPWADWQARSSLEPSAHPAITPGPCRGWGRHRLAHIRAQREPVFAPAGTGTEYR

SEQ ID NO: 20917 - protein, 830 aa, Pseudomonas aeruginosa
PRRVSGWLAQASHRGTLRSVRKRCGRGERAGCGSRRSYLQVPRPGAAERDAHTDKKALRAGRPAGHAEHGPRRRWRARLTGNGGRSGAFAAALAWARGTTLGRAGFDRQRAFAVGIATARPERPALAGALARGRATLRTSRSLRNLDGQRGAAVLRDQLRNPGGLLADEHIQGELSALDHVQRLFPDGGGAGVGNRRGHGVDQRERCIRCADGATLLHDIAAGDQPADDVGPRRLGADARRVLELLLQARVGHETRNALHRLDQFALGIGLRRHRLEGLDVGPGDLACHPVTQRRQHLAARGTIAVLVRLRFGRHQAPSLGDDLLARGHQLLLAAGEIGHGAVELVVREELGQVMCPDQPVHRPFLLAHGGEIRGFERRDDAVVRRHLAVVPGARTHGAVELLRDRAQRGIGLEQAVEDRRHLGEHAFGQVAGIRARVRRGLMRLVQGLSDLQRLLHVQPKLLGAHLLQGAQVEQQRRAFAHALGLDRHHLGTARGADLLRGLLCDGLLQAAAGVVGAGIGCHPLRGERLTACGQGHVDGPVGHGLEGRDLSVAVYHEFERRGLYTPDRQHAVVAGLPPEHGEQPAEVHAHKPVGARARQRRVIHRQRLGRGPQLGERGADGRIVERRQPQACYGAAVSAQVDDLAGDQFTLAVGIGGNDEMGRLRQKRFDDLELRGGLRFDLDPPLLRDDGQLLQRPALERRVIDLGCCRFDEMADAPGDRDAGAVEAAFTALRGAENPADVFALGGLLAQKQPHVRPSASRCSWSCWDRGCRAPVGAAANKLHAAATAFTRWDGCGGDGVRPAMCESGAAMFGSAWKPVDAGGAIPWG

SEQ ID NO: 20918 - protein, 436 aa, Pseudomonas aeruginosa
RALCSGLAQQVAQALDVLPGHLGRHDVARRLGWWRSRRRWCWRCWAGLLGPRIELAAHGALDDAEQISGGVADAMLAAPCGPFVQHGLPQGSVHLLQRHPGSGLLFRLQFREALGPLQVAQRTRLRGSTYFINTTTTYCTVLLRIPKSAVWRGFRPCFGFRRGAFAIPKKARGPFFGIVDRILLWITFGGGDALVGQALGEHLQPRRQGASGQHRVVRDLLEGVESHHLNGLGRMPQRLADQGQVVGVELHGLERCQGFVMQDVEVSEDAAGLGVAPSSHEAQPARQAQQRQRPRDGLVGGLSRAGHGRQPGAQLLIGRERRDAVVVEHQPEHLPGVALQRCQAAVEEQPPRHALVPIATEQEGVAGRGRRGHCHGRWRAGMWLGREVLQRSVEQVGECDGALTRGSWGGVVHGHGLAQSLIDPVPDRGPDHRERQ

SEQ ID NO: 20919 - protein, 139 aa, Pseudomonas aeruginosa
SPPACTGMDCNTLAEKSGGSASPNWSATMRWIDCSRSVVGAGETMCSRSRSLGAAAGLPVAASLAALSSWRKVGSDAGGLAGGGPSAAAGVAMDDAAPGGVGVPAVGEGNAGCAAGGVGSLTSARWRLSDSVRSSASTS

SEQ ID NO: 20920 - protein, 63 aa, Pseudomonas aeruginosa
RVVLLLQFSHLTSGLFKRGLKGQPLHEDRLSCFHGDERMRHAFATAEQKSWPVLGIVGAHPAF

SEQ ID NO: 20921 - protein, 169 aa, Pseudomonas aeruginosa
ETEMAEHSHEHQHHTSGQMGKHGRPYAKFWVNMVLGLVVMYFVMFSMIDGARDFRNNLNMLYMAVTMWAPMGIFMLATMPGMFPNRRLNLVLYGLFAVLTLGSFAATRAQTGIGDRQFIASMVPHHSGAILMCREAQLSDPELVNLCQAISDGQRAEIEQMNRIAARLR

SEQ ID NO: 20922 - protein, 856 aa, Pseudomonas aeruginosa
LEHDGLPYVRDVPVDSSQSPGFGWVKTTKAPEGAFVGCDRRFAAECQRILPSASCSSSLAKSSTSITLRRAASAWCRACACSALSTPAAAPASIGFCPACGWTLPSLIALCRVFSSAALSRTASKAWARAPTGSCGSFGRNAPAMIALQRRVVVRTVDDFRDLGVQFVARPFVPAAELQYQDLQRAAEESAGEVVQQVLQRRLGLAEVFLHGPAQQRMQVVRVAQVVVALERRRAQVEIAEDIAETRGEAFLALQFAAQQHHAEVGEQGEGRRQAVQRAEVGTADAVAGRVAEVAAAETEEEAAGGVADGEADVLHQQRVELAGGLVLVLALGQFHFLEYVRMATDRALAEDHQVAREDVRAFHRDEDRRALPGTTQVVVRAHDDALAAMDVHGMGDALAAALGEVVLEDRRKHRGLLAEVHRVGGEDSRAVHQPGVAADAGKRLLDAFEGGDRHVELLADLSVATADVAAGLAGAGAHRRQRDGASDRQAVHQHHPAFADHFLPADDVLQRHEHVLAGVRTVHEGGAQRHVAAADLDPGGVGGDQRQGDAQVLLVAQQMVRVVALEGQAEEGGHRAEGDVALFPGQAQAEHLATFPFALADDADVGHAAGIGARVGAGEGEAGDVVALGQARQVALALLVGAVVEQQLGRAEGVRHHHRRGQVAATGGELHHYLRVGEGGEALAAVLLGNDQAEEAVLLDEGPGFFRQVHALADVPVADHGAEFFGRAVDEGLLFFGELRLGVVEQFLPVRAAAEQFAIPPHGARLDGLALGVGHRRQDFLEPGEQRTAEHAPAQVGQGEGKRHRQPEQPEDQQQPAGRVAEHAHQDQVGGADAERGSGWGTPMGEVSDTEYQYD

SEQ ID NO: 20923 - protein, 86 aa, Pseudomonas aeruginosa
SVGNGGDSGPRADYRGTHSRRLPMRTFTASTLAFLLVLAPTVPAMADSGGDIVFERMQAQAAKARAAHQEKLAKQAEATKKDKENC

SEQ ID NO: 20924 - protein, 262 aa, Pseudomonas aeruginosa
SPVLPPPAPHGMTEGSDPVFTRHRFPGFRSAGFLCPSVALGDLSLRGPQRRQADKDVMLPTASRQAQRHRIGDINPMEIPRMFPRRLLPASLIVLGVLFGASAQASPAHGQAFGKPAQAAQASRSIEVVLGDMYFKPRAIEVKAGETVRFVLKNEGKLLHEFNLGDAAMHAEHQKEMLEMQQSGMLTPTGMASMDHSQMGHGMAGMDHGRMMKHDDPNSVLVEPGKSAELTWTFAKATRLEFACNIPGHYQAGMVGQLTVQP

SEQ ID NO: 20925 - protein, 308 aa, Pseudomonas aeruginosa
RCRPIRIHLPPPASAARRAGKGPARFIQQVSLMQHPAEHSPLGKTSEYVSSYTPSLLFPISRTAKWAELGLSAETLPYRGVDIWNCYELSWLTPAGKPVVAIGEFSIPADSPNIIESKSFKLYLNSLNQSAFDSREALRAVLQKDLSAAAGAPVGVRLRSLDEVAEEGIGRLPGRCIDELDIAVDGYEQPRPELLRCDAGRIVEEQLYSHLLKSNCPVTGQPDWGTLVVDYRGPALDPASLLAYLVSFRQHQDFHEQCVERIFLDLQRLLQPQALSVYARYVRRGGLDINPYRSLAEVAPDNRRLVRQ

SEQ ID NO: 20926 - protein, 439 aa, Pseudomonas aeruginosa
RMNTYFDIPHRLVGKALYESYYDHFGQMDILSDGSLYLIYRRATEHVGGSDGRVVFSKLEGGIWSAPTIVAQAGGQDFRDVAGGTMPSGRIVAASTVYETGEVKVYVSDDSGVTWVHKFTLARGGADYNFAHGKSFQVGARYVIPLYAATGVNYELKWLESSDGGETWGEGSTIYSGNTPYNETSYLPVGDGVILAVARVGSGAGGALRQFISLDDGGTWTDQGNVTAQNGDSTDILVAPSLSYIYSEGGTPHVVLLYTNRTTHFCYYRTILLAKAVAGSSGWTERVPVYSAPAASGYTSQVVLGGRRILGNLFRETSSTTSGAYQFEVYLGGVPDFESDWFSVSSNSLYTLSHGLQRSPRRVVVEFARSSSPSTWNIVMPSYFNDGGHKGSGAQVEVGSLNIRLGTGAAVWGTGYFGGIDNSATTRFATGYYRVRAWI

SEQ ID NO: 20927 - protein, 595 aa, Pseudomonas aeruginosa
NIAILAWASKMGRSTTRTSLYQGSMHETAPPAFCPFRRLAALPFRLRVGTRFGRLWQHGRSAQRADAGPGGPGAEGEHGRGTGGRRDAAQVPERCPDHDPVDANGDLGVREGPEGDLRPQVPDQRAAAEARRDLSVQGLRGAYPAARQVPADRRRRLPDPWLARPGRRPQRSARFGPWRQRHRVPVPRAVSRVLPGRSLERCHLWQRDQDREGLHRRACGLGRLRELGRAAIHADDPGLPGRLLPADRLPRRALDQGPGAPAGRQGAGQLHRAGRAIAAGPAHAPEDPRLQVPAVEVPGDRSEEDRMPIGKPDRLHLAGADGLQPVPDRPAGPERQAPATAVQTPAPADHAAAQAGHGRPGLGRAAVIEIAGVRSGGRRVPPLSTIGREAFPHKEGDMNVYRKVSRSAATWLCAALLAASGHAWAEDWWVVHKGDDPAELDVFLADADSLAPVPGIENAWQVQIAMLFDSFHLLSAHQYRCDTREVKVVNAKTFSNNGQPTNLQFTFAKGWTPLPNESHEAVLQFICAPQERERNGMRSTGRGVPLQAVITAVGMVEMERAQANLAEARRKLEEAKSDRVMGELDRLLGNEPRKP

SEQ ID NO: 20928 - protein, 119 aa, Pseudomonas aeruginosa
GEADRAVFRSDRRRSGRRVGRVSMKWYSRISLGLSLAVASAFLVAYWRSLVSHSYPNMNAPGLIAYLLVFPACALLLHSPALAFVLQQRKLGSARERALQWTINLALWMAPLCFIFASL

SEQ ID NO: 20929 - protein, 537 aa, Pseudomonas aeruginosa
SSGEKPMNESVARVFDRILRGLGLKTLNAQFLLSYALMFGLAACASVALYLSMSISPETINVAGAQRMLSQKMAREALQLRLGAGDPKALAATIAQYERSAADLDTGNAERNVSRMGAPEIAAQRQKVAQIWGRYRAMLDQVAQPASQVDLRGFSQYSTELLGELNNLVSLMSARADSVQHTQMWIAFGCLLAILVLVVLGRQFGLAPLMRQLRGLEVALTEVGAANFTHALAAGHADNEIGRIVAGYERMRQDVSGLLANVKRSAAETDKDVAEALEQALGAGDQVARQHQDLDQVATAMNEMSATVAEVARHANHAAHSTRDAAALAHEGRRLVEHASSQTGALAEELEQTALALNTLHQHAGSVGQVLTVISSIAEQTNLLALNAAIEAARAGEAGRGFAVVADEVRSLANRTQQSTQEIQGLIEQLQDGANDAVAAMRGSASHAQSNLVEADSAAQALGRIVATVEELDGLNQQIATAAEEQSQVAQDIDRNITNVSGLSEQAHEGTAAVLSANQRVKEHMAGLRVVLGRFRT

SEQ ID NO: 20930 - protein, 414 aa, Pseudomonas aeruginosa
FEVFRLAVQAGADHAEGFQHRRFVAAGHVGVAGVRAEAHGDRLDALADSTVERLRGFRQALRGGVLHQRRTTLVETQTDFGIGDQAFAGQLPGVGQYPLALGRVRVAHVGFRRSLGGNDVALLAAPGEGPVQRGAFRRIAEVLETQQLVRQFENGVAALLGCRAGMGRATLHLEQQAVDAIGGYRHCVPVRRLVGEDVVLLPGQLGDQLLRAGGAGLFVGIEQHGDPSVVPEALLPEQRQGMQHHRHAALGVGHAGSVGALRVLAERTLRRAAGGEHGVVVDHQQEALAAGAIEGGHQVVAGRGRRRCAADLRAERLQAFGEQRGQLAEAFGLAGTAVHRDQLPERVEVGRAFGFGLAQQLGGWRVGSEGGGRKQEGEGERQEAGQAAGVHGRSSSGGRRRRGCAPRYPIDLRS

SEQ ID NO: 20931 - protein, 278 aa, Pseudomonas aeruginosa
FLRLLAGYLASIQLPSRWPARSRLGKSGQDGSSGILSFRRAGGSVVRGGARFRRRVRGCGGDMRRCRRDRACSGFLAASRSICELHKGGRRFVAWGRRVVVSPEGRASAPRRRKTAIGTILRKGGRCGTKPRLPGLIAGFHAEVIPMRTTTSIRRVAAVLAALHLLTFAEVPLAQAAMIGTAEVMQQQQHNLDRQQLLKMLDDQGVQKKLEAMGVPRDQVASRINSLTNAELAQFNQQLDQAPAGGIIGIIVLFLVIFIITDMLCATDIFSFIKCINR

SEQ ID NO: 20932 - protein, 482 aa, Pseudomonas aeruginosa
RRLRSGWKKRHPGVPFCRRGLDPELVAQAVVPGADGGERYAEQLAAGEGVVRQAGESVEALGLAAQGFGQDLAGDVGVGHAVAAATLGIVDVVADAADLGQAREGQQEVAGPGEVDLHVLQLREGLEHLRPDDRLDVRRITSAIDHAATIDQALVAGEAIVVEQVIAVFHAVVLRQQAVGQFLVQRLGGDHLGAAGHRLGRQFRDQAVEVGVTGDHDELRLHLALRGMHHRAGAALDAGRRALLVNSAAERLHRRRFAEGEVQRMDVAAAHVKHATYIVVGRHHLADALGVHDLQLVVAVAFPQLFLRAQVIHLLLGEGGEHPAVLQVALDTVAGHALADDAPAFEGHLAEQLRFALADGALDHVDVAAVAVDDLAAVAPGSAEADLGGFQYGDLETILQQEQGGGEAGIAGTDHADVGFDLALEFRAGRRGIGRRGVIGGGVGGVRHLAPLFFIFYGCPDATRVEIGRLASVQNFQRTPRK

SEQ ID NO: 20933 - protein, 163 aa, Pseudomonas aeruginosa
PWSDADHPVASGTLGVVQRGIRPGECPFRFFAAAGQGTAGTDGHRHGRAGTVDRGRFHQFADAIGDHGQFRGLADPDHRHELLAAETRQEIFRPQRRAQSRSRLAEDAVAGPVPQGVVDTFEMVDIAVDDADALVAGPRQLQFMLVQRVEAGPVPQLGEGVEQ

SEQ ID NO: 20934 - protein, 270 aa, Pseudomonas aeruginosa
GAQPIDTGVRNMELTIFQVDAFADSPFQGNPAAVCPLDAWLDDERLQAIAEENNLSETAFVVGRDGDYRLRWFTPQVEVDLCGHATLATAWVLIHKLDDASPVLRFATRSGELSVRREGDSLAMDFPAKRPEPCATPDGLLEALGIAEAEVLKTDDYLVVVDDEKTIAALAPDFARLKGLPCRGVAVTARSQRFDFVSRWFGPNVGVNEDPVTGSAHTSLAPYWAQRLGKTRLSAEQGGARKGRLECDVRGERVVISGKAALYMSGTLHL

SEQ ID NO: 20935 - protein, 143 aa, Pseudomonas aeruginosa
SRSRSTTMPAPQVGVGVLILRDGKVLLGRRKGSHGAGCWSAPGGHLEFGEAVEDCALREALEETGLALSELRHGPFSNDVFEGRHYLTAFILAGCAEDAEARLMEPDKCDGWAWFDWADLPEPLFAPLASLRRRGYSPFDPKR

SEQ ID NO: 20936 - protein, 178 aa, Pseudomonas aeruginosa
TAGGGRAGWRRARGMRPRPGRSSRSSAHSAVRRLAGRPSEPGGAAGARRRSRAATGRAAGAAWPGPGRRTAGSRRPSGECSGSAKAWRKPGKGRQSCRSPVGHVDGVAFGQVVKIRTAERALFPGDGAHPFDVFAHGAAGIALGGGGEEAGLFAGHALRPVAGSRLVDRTLDQAHRLR

SEQ ID NO: 20937 - protein, 204 aa, Pseudomonas aeruginosa
RHRLPNQRIVGMRYKPEQKQATRALLLSKAAPLVKRQGFASTGLDTLMKAAGLTTGAFYSQFSSKAELLEAILQRELSAQHDAFPLDSLEQLAGATRLYLSRGHAQHADMGCPIPALAAEVGRAGPEVRETFERALEQRQRRLAELMGDENRAWVLTCLSVGAVLLARAQASEVARDKVLDAALEHALGLLSASGAVSPQADRD

SEQ ID NO: 20938 - protein, 156 aa, Pseudomonas aeruginosa
RCARTRWNGRWRRPSSGPARWMRSSTARTATCPATRTAPRTPRAMRRSRPRWSPGAVRAWMAAVSLLSSSGCMTSTGCRRSPARRWTTSSAAASPTTKNWKTRRPTPTSSAPSRKASSPPRSSCGAARPGPTSTARGCCSPPSAARSRPSRSNGYG

SEQ ID NO: 20939 - protein, 178 aa, Pseudomonas aeruginosa
TSAWCRAEAGATKKAARGRLFHARRLFADRFLDLFGRRPDPIADLHVLRRIDHDRQLAVVAQQEAFADHRDEALLLLLAGAGHHRAHRPADLVQAVVGVAPAFQGVFFQLAAQALLVAVGLEGLAGDDLDLECVFRVLFRQVDDLAGEAGICLRVGNLFIQFGGHGGAGKSGNAGGDQ

SEQ ID NO: 20940 - protein, 118 aa, Pseudomonas aeruginosa
TGLATDPLKKTQTDALTALSCGTCYELAGNFKSPASIATISPKHFSPAERREIVAASGEPQVPDAPLKTIALPPQMVFFLPAIRPCPDRLAQDMEHSVTSPTELFTRASVSYPARVTT

SEQ ID NO: 20941 - protein, 449 aa, Pseudomonas aeruginosa
LPCTSNLALPSISAHIKPTTRNNKMLKKRICLLALGIATASQAMANDQEAAKGFVEDSHLDLFFRNGYISRDYKHGRQDKAEWGQAATATFTSGFTQGTVGVGVDAFGLYAVRLDGGKGRSGAAGIDFFKQGDSGSAADDLSKGGAAVKFRISNTVLKYGDQMPSLPVLSYDNSRLLPESYSGTLITSKEIEGLELNAGRFTAESRKSAEGRDSGGLKSINVFGGKYAFTDHFNASLYASDVEDVLKKQYINLNYTIPLQADQSLNFDFNGYRTKLDSDFADQNFNGNRDNKIWSLAASYTIDAHTFMIAHQRNTGDTGYNYGWYQNAGGIGDGGTTIWLANSYWSDFNAEDERSWQVSYALDFAKYGVPGLTYRVAYVRGDNIKTAETSNGKEREIFNQVQYVVQSGPAKDLTLRLRSSFLRVSNDARSYNDDGNEIRAFVEYPFSVF

SEQ ID NO: 20942 - protein, 175 aa, Pseudomonas aeruginosa
SNLRARREPRASPGVFFFAFRAPVQPYRVEPYSFGKPVIAFALACHCLSISTMPFRKHLLLPLLGLALLLGGCGPSVSYSYIPPTSDAGLHCVSQCNAEKRQCKTLTKLQQRQDEALYQAQSTAYNYCMQNSDKKKRKSCPYPQRNFDFGDDCQDEYRSCYQSCGGTIRRIVHQD

SEQ ID NO: 20943 - protein, 277 aa, Pseudomonas aeruginosa
HVAYRNKELFFSTNVLDSRYRPPIATSYARRAMPHASNPHPQGSNTMSNLPAIILVHGFWGGAAHWSKVILELKRLGHDNLHAVELPLTSLADDAERTRKMIAQQQGPVLLVGHSYGGAVITEAGNQPNVVGLVYIAAFAPDSGESPGGITQEHLPLAAANLAPDSDGYLWVKADRFHESFCQDLAADEGLVMSITQKAPLASTFGDAIGSPAWKSKPSWYQISSADRMIAPENQERMAARIAPRKIVTLDASHASLASRAKEVAALIDEAAVATAH

SEQ ID NO: 20944 - protein, 184 aa, Pseudomonas aeruginosa
GHRAHAPHGQGVHRRDQRPGPGWRLRAGAGLRPAPDGRGRPSGTLPRPAGSTHRPDTGRRRHPDAGAQPGRSQGPGAVPGRATAGAAPGPCAGPGQRAGASGGATGSRRRAGATPVPALTASGAPDQAFDLPGGFPRLDGGHGQRKGRLPLRRLPGQYPPRHARIHRTGAHHHPGRAPFPPCGF

SEQ ID NO: 20945 - protein, 176 aa, Pseudomonas aeruginosa
RPDRRQRHRHGLQVICMTASPSPVSATPWLTLSIRLMAGGFLLFFGLALATLLLRLDQSLLDSDAGRLLLRLVRWGDQQGGGQHYELMISTIYLVWGAFLWRAASQPFRHRLFIDFTVAANAAHFGLMFLQGLLMPGEHIHLAGDVLLGWASLLPLMLFWIPQRKRAAPSLAVERK

SEQ ID NO: 20946 - protein, 99 aa, Pseudomonas aeruginosa
RRRWARTSARRNRSAGCARSPPPRGTASPSAGRSQAPGRRSSFRRRPPRGNRRSSALPPRQYPAPPAVRPVSRKAPDAWPGSPSPASRPRAARSAHRYG

SEQ ID NO: 20947 - protein, 295 aa, Pseudomonas aeruginosa
NPQILLVRDPTCQDSRRSGSHIDAKIAPTRSGSFIETAADISCGRCTSLDPFPACSTRPGFFLPSSPLRRLRTPGWPSACPAAIPKVSTVIRIQYARLPPPSRRSPAPAGPGRHGAGRHPRRTLPGRPGGTGAGNLRGEDRADQSDRPRPPMVQGPYRPGCRTDAARPVLLRPRHPGQRTADGDGRLQGSAFSRQSAGHRAALHPLLRRRAPARQQWPGHRHTLPDRPEPAASGSPGRTPAQSTVDPGRRISPATQPHRAHPLPAPGDRPGAAQVTARPPHPIVEPGRLPRAAPA

SEQ ID NO: 20948 - protein, 73 aa, Pseudomonas aeruginosa
NRPAQRLRPQASFVENTMSKLQHIGLFLFVLLSAGLALGYRVDCPDGSHVETYMLRGMGARILGNDLCEQAAP

SEQ ID NO: 20949 - protein, 138 aa, Pseudomonas aeruginosa
AAAPPPNCAPTLTPAINRAPRDDCSNCRDMLAPSAAVNGEALASATAASSLGSRPKRIAVPEPPAMTPAPSSTYMQGPVKSPRDRSRPTRPSATKTVPVLGNASSAPAPPTLLPLTLRLTLPKRGRRMPSPIPPPTPP

SEQ ID NO: 20950 - protein, 181 aa, Pseudomonas aeruginosa
KTEVQDAAHPLPLLLLRRVGQSRAAPPGTPGRGRNRRLRDRCRLYRPLHRPVPVGEWFQGHRTGNRQGRLRRFRAQRRPDRQQLQPRHRRDRAHRRQARSAVARRDGLRRRAHHPRARGPLRYPMRPEGRRGVRRLHREADGSPARAETVVGTLRPQPVGDHGRQAHPRGGGDRQLYRWHA

SEQ ID NO: 20951 - protein, 591 aa, Pseudomonas aeruginosa
SGGHRGDHPAEDAQDLPATEGREDRLRLDRQLPADPLAPAPGRPHRRQHLLFPGLQRPRRDLHPRRRQGPGRSPARPGRALRRFRRPAALPLPRRQAVPRTVHRHRRLVLQPARQARGLVRVDRTAPRGAVFSIRSSTFATDLRMTDQGEDQATADDVAAQGRQGELQQELGPADFPGERQVAYLRRAHHDVGEAAQRHQVGDHRDDPDLRALRRRDQPDHGGDHPAGNDALGEHLRQVVVHHLAADLKERRVGRFIEYRQMQHRPGEQQRTDDIAEQHHAPETQQLPGLFQGRLGHHRQHGGQGVFGEQLLAGEDHCQEAHGIAEAADDDRPLLLGQGSAEQAHAHQREADGQPRGHRRPPECRQRALQLVFALDANHLVQDSGARWLLVVDLPPLVGGQRRGRTSVGRFLFPLLAARTRLARALRRMPLALARRTALGRLPGGGGRSPLVVGHVLHLSGVLPGIEPSRWNGVPTTFGSAASAGRCANGTGRQLGAPSRGCDGLRQGRSEAGFPRLQCPRAGLRLARRRRATAFRQQLGQVEPTRGEIHATLDAGEHGLFGSGGIACGVATVAQGKPGEGVLRPASHGSS

SEQ ID NO: 20952 - protein, 139 aa, Pseudomonas aeruginosa
GFLSFHLVQICPTLSERANGTGVVWMLGTRLKAARIRAGYSQKQLGMLVGMDEFSASARMNQYERERHSPNMRTSEQLAMVLQVPMAYLYCPEDELAELILKVSSLTPEFKKELTRFIEQLLAAQGSTSRQPVRTRSEL

SEQ ID NO: 20953 - protein, 170 aa, Pseudomonas aeruginosa
FAVSSRRRAAWRKCERLPPRWERLLPRLRATFTQRRNNVAKTWIYAASAAAIGGALIGGWLLDPAPPEASPQARQSPAAQAAAAPTAALAAPAADATRMLAPTPVTTPAPRERVTLWQGELRSREGAPGYSRIPGAGRTRPARHAGARPGAGNEPAGSRAGLAGTPRQHP

SEQ ID NO: 20954 - protein, 649 aa, Pseudomonas aeruginosa
RPARRSCRRAARRAATDAAARPGLSPPSQHVSPAVPSGRHGFLLSEHRQPMKKSLLCSTLALAVACAAQAAPKTVDIMVVYTTAATQTANGRDIDARIASYIEFANTAYEKSGVNLRLRLVHKQRLDWADYPTVTGANLDRFMRDPQVQRLREQYGADLVSLVNRSQNSGNGYITCGIGYMGSGDKNSGRFHSNAKDIAYNLTGVNCGLNTFAHEAGHNMGLRHSYEQDLESSYYDPRYAHSGTYEWIRGYGVQGRFATVMAYPHAFGTNKQAPFFANPRMVNAGCANQPCGREEHADPVRALNSMATQIADFCPTKVPGTINPGSGGDTQTPPDLPWCTKAKLGGLLGDGEFASMEGWRAWSGNAQLSLVNVAKGCRDNALLVDVRGFDLLVRPIAPLRAGSGYRLSGKVMFKAANTRETVRMALLSERADGALAYNPAQSVELSVSGNEFSRLEKTFDYRPAADQRNLYVAVWSDSGASLLVDEMNLQEAQAAPPSVPPAPKRIAYDFESGIGGWSGVHASARATRVASAGRLALEAYQRRYAGTGASTSLLGNLEAGRTYAFSADVRVGDGRGSQAMTYAYLYLESQGRPGEYLPLGYKVVENGRWAILRGQVQLPKGPIKRAELMILSGNQQESMFIDNVQLVQK

SEQ ID NO: 20955 - protein, 457 aa, Pseudomonas aeruginosa
GQSDTAAHNRAASARQTRTFRARPPPAPPLAARPRLPAFARRLRCRHASRRAAAPGRSRTPGLPRHAPATGRGGQRYRPGRRPRPVVRAARRTPAGARRASPQRTGDALGRRQPGGHPRWHRQQALPADDPLRHRVRRRQRGEASVPRGRGARLRTRRGRRQGRRGDGAACPGAAQAARLQGLRTDHRAVQSRRRDRLRRLEATDRRAGPAAGLRLLLRAAGPGRSDGSHQWHRRPAARGEGSLVPCRLGTRARPQRHSRTVAPVAASQGPRRSGERHHAELDPRQGRREAQHHSRRGFGGSRHALLGPGRERAGTGRRPEADRRTPGRRYRSQSASRQGSSASGEEPRLAAPGGNRADALRSSRQAHRADRHALRHGRRLRLRARQRQTGGAGNPRRGRRRPAQRGGIPRTIQHRPPPVPDGGADPRAVRRLAPTPAASLRYGSDRAPRASQPCAP

SEQ ID NO: 20956 - protein, 158 aa, Pseudomonas aeruginosa
SSPRRPRSAPLPTHATAASAAPGRTAGRAPPAPGSPTGNRRRSTSGCAGHCRRARSSARPGCSARPTARWNTARSRADRPGWQAVPPGRAWPGSGPRSAPPSAAGRRSPARPSGSRCARHCPYPGRRPSVRTGRWSRPGPLGRRRRVAIAAPRGPSSG

SEQ ID NO: 20957 - protein, 178 aa, Pseudomonas aeruginosa
NRSAPSDIARARSCGSPMGRSSSPRVGWAGPLPAHFPPGKERNSFPRFPQRSWMKKSPLLILSVLLAACGPDKLISDLPSPNGQYHVEVRKCPEKGSITWGEEIQVSLLETGKSEKCHAVVRSLAQFDLRASADQLQLEWLSDTELRAWHPSFEPGNQPNGSRLKHDAPVKMVFAPKR

SEQ ID NO: 20958 - protein, 439 aa, Pseudomonas aeruginosa
QRHAPDRVFHALLAQRRDLQGLESGQQLPVLVAQGPLGDQGLAEVHRRRPGVDGQVFQWAFDLLRIDRPALRLLVLVAGGLQVHARGQQQLPALHGEAGQRLVDRQARLDLDRGHVAGVGLLVIAGLGALGRLRVLLLAPAHAGARGHMHGGADLLGLDLAAIGGIFPDFFPVVLAIQLGGQVRGAVGAMARTGRTAAGADLVEQAMDLVVVAAGQQVLAGRQDMHLEGLEQIGLVGLPLQRVGLELAAEGHLRVLLVLPDRRWRPLGHGQGIAQGLVRHHVGHQYHGHVPLQRLVHQVQHLRVARIVHAAIGARIEFRHATGKAKQQGGGKGKTRAGQSHASILDRGWCGSSNGPSYWPMPGSQYFKWTRSAGAHRQGQELPRPAGPRWFYAYADLQALGSALSGRPGSGNVHIRKSGNPARIEATPVSSESIQMYQV

SEQ ID NO: 20959 - protein, 88 aa, Pseudomonas aeruginosa
KQHAHHYHLHALLPAYILGTNFHLTIYPFGQNDHNMIHTEPFPLADAEYQNKYSSFTPSVKLGQHTRPTQQLYPTNLDYPANYKILQK

SEQ ID NO: 20960 - protein, 90 aa, Pseudomonas aeruginosa
WTGPIATAASSCASCPVTPCSTPRWSPPARCCTAIASASSATTNASTHWRCNWAAVCRRNWRPARGWRKRPATTRSTSTSAAPATGSSTT

SEQ ID NO: 20961 - protein, 311 aa, Pseudomonas aeruginosa
QDLAMTSKLEQLKQYTTVVADTGDFDAIARLKPVDATTNPSLLLKAAALPRYAEHLRQATAGSGGDAGLACDRFAVAVGKDILGVIPGRISTEVDARLSFDSEATLARAHRLIELYDEQGIDRERVLIKIASTWEGIRAAEILEREGIQTNLTLLFSFAQAVACADAGVFLISPFVGRIYDWYKKSENRDYAGAEDPGVQSVSRIYRYYKANGYKTVVMGASFRNLGQIEQLAGCDRLTISPDLLQQLADAQGELPRLLLPGEGEPRQVLDESAFRWQMNEDAMATEKLAEGIRLFARDQEKLEYQLATRH

SEQ ID NO: 20962 - protein, 400 aa, Pseudomonas aeruginosa
PCRTPPRRQSAALRRGTKLPVAAQAEQERAPAPGAGPRRSRRGTGRSHRRCRGPAGEPGRTTDSLRLAGRATGIGLPAPCRAARPSGRPDPPRRRAPLAGPRWLLAGPRPAGHRAPRRLRAGQRPTASTPGRTQCRAMDHRPGRQRAVVRPLASRLGRSRTYRARPLARRRHPGTVPPGRAFRDRSPGRAATLPARPRRPPPERRKTMSRARHRFLDELAERFASHGAEPYGEAVSQAEHALQCATLAERAGCSDSLVVAALLHDIGHLYEDPAQIDEEDLRHEEFGARLLRELFPESVWQPVRLHVSAKRFLCAVDPSYHASLSPASRHSLVLQGGPFDERAAAAYIKAPYAQDGLTLRRLDDLAKDPAMRTPELTHFFPLLERLLRIDPDRAHLRPTG

SEQ ID NO: 20963 - protein, 230 aa, Pseudomonas aeruginosa
RGMNMKLLIVEDEPRIGQYLRQGLAEAGFAVDLSDDGNEGEQLALGGDYDLLILDVMLPGRDGWQILRSVRDAGMTVPVLFLTARDAVEDRVRGLEQGADDYLVKPFAFVELLARVRTLLRRGSQQLQETTLQLADLELDLLRRRVQRQGKRIDLTAKEFALLELLLRRSGEVLPKSLIASQVWDMNFDSDTNVIEVAIRRLRAKVDDDYPQRLIHTVRGMGYVLEERDE

SEQ ID NO: 20964 - protein, 412 aa, Pseudomonas aeruginosa
AWRTRVRRFLLSACRACSTGSIVPIRRAAKARVNTPGSAWRSAAPSSRPTAARSAASLPTAGPVSSSISLARADETRSPHDGGFCFMPSSVSLAHAAPAHQQPYAAEIEHRGGQQHEADGHADANVGDAEDAVAEGVDHVQDRVGQRHCLPERRQQVDRVEHPAQVGQRRQHEGRDDRDVVEVAREHRVDETAQGENGRGKHHHQYRDAQVVHLQLGKEQRQQGHDHPHRQAAQHAADGVAEEDGVRRHRRHQQFLHRALELAAEEARHHVAVGVGDHRHHDQAGHDVFHVGEAAHVADLPADQIAEDHEVQDHGDRRRQQGLRPDPGEAAHLAVDDGVQGDQVGAQFAAHRAILVRFFSTSDTNSSSRRLVLLRRLSTSMPCAPSWANRSLMPWLFSTCTSRVWSSTSRVG

SEQ ID NO: 20965 - protein, 90 aa, Pseudomonas aeruginosa
PAWVTTMSKTFSNWLKLNSCGTTPRQRLRPAGSLSRSWPNTETEPLVLFTRVERIPMVVDLPAPLGPSKAKKSPSATSRSMPLRAWKPLP

SEQ ID NO: 20966 - protein, 581 aa, Pseudomonas aeruginosa
RRPGLDGDGAELPRPGRAAAPLRHRRAAPALPAEPGQGRRHPLLRPHRPLRGLRCRRHDRRRHRLQGRMGRSRGARPAPDLGKALHHPRPGGHPPRPGLQVPRPGPSVGRRGGPGHHPGADPHRHPRGRDRPPPRAAGRRLHERSELRQGRVRAAGVHHRRAGNDRQRLDDADELPVGRTLHLAAGGGHQRRQGQQLRQRSLRSGPRAVQRADRRLRRHPGGACPHRRQRLADGQRANPHRQRGGPRREALGAFGDPQVPPHRARPRVHRPCHGHPWRQGHHHGPEQLPGSFLAGRADLHHGGRREHPLAQPDDLRPGRDPLPSVRTQGNGTGPARGQGPGRPRVRRAAGEAHRLRRRQRRQQLPPQSQLRPPRQRARRPHQPSLLPRAEPPGGVLRPARRLQHDAAGRRTEAQGTPLRASRRCPQLSLPGLGGAQALPRPGQPGLPASAAALGHGGKPRQARGGAGGPAEQLPQPILRLRAEGPGTAVRPPAQRAGRRTGRRDRGNHRPSGRRPGVAGRSSPARSCRRTRRTRSVPSPTPSTRYAKAPRWRKPCTRRSRKAGSSRKRGRTRSMPAPPPAC

SEQ ID NO: 20967 - protein, 195 aa, Pseudomonas aeruginosa
RTGGHHAQATCHRPGSLVSPPAPGAGRTACALWRAAAPAGGAARWRTAPTPAPGTAPALRRTTPAIAAGSTATPAAEPAAATAAATDAGQPDPPAATGPAALAPGAGPAAPRQRTPATGKPPAPEPVPGDPLKLAGAAKPFILPSFFPEDPSWPTPTSSTTSPCSSTCATSSAPWARPSRCRKKTTGCSSSVSTS

SEQ ID NO: 20968 - protein, 266 aa, Pseudomonas aeruginosa
STTSVAYDARPNCRPRPCHPGNSLAHRPPHRLLADTSNQGGSGYGSSESARRQRNRFRSPVRGKLACRAGWPAQTRATPCARQQPSGRRMAVEHRGQGDAVPAPVTGAGTRPPGLPVPGPGTRLPGQRAPPDPRGPPHRPRHRPARWPVGALRRRRLAAGTPGAAGTSRPGGQGPGLAVAPTAAALRAALHRRTALCRHRQPTRHRPAAGAQARAVAALAAERRLFRRRRFTRQTQPRSFLTSESRPVRPAPLPDEHLPIQGESHG

SEQ ID NO: 20969 - protein, 1034 aa, Pseudomonas aeruginosa
PHGCECPDHRCRHPDQRQGGRRSPGPGHRRALPDRQPFRRPVPAERSLQPAGPEPDLHRGGFQGGVDDHGDRRQERYLTRPLIPGVPRHVRLRQEIRARARAIRRQRASRRPWRGRPADASQRRQGVRQRRREAAVAPFAAGRHERAPAQADRGAATGHQRPEQSSRAGGADEQQRNRRLCAVADRHRAEHDDQPGLRAGGAIRRQLLRRSQQDRPGQPGDPAPADDPEHRRKQAGPGCRGRARRPCHRPADGRCRRGSRGGRGDRGGIGQLRHRQDRPEHCQVQRDPRQSRRQGHPIVATTDGAGGARPWHRRAVMAYFKLEEPVRFHRYPFDFHSHFAGILPVESNSRWTRDRRVFRVGERQVSLEKGQELSLIGLLMSARGVAPDVDGKALEEARQAAHYELFELALQRMVRRNPFAATDRQGYLRGECAAENIYLACLILAQRFGRTSPPAAIDQPAIYLGTLELLGASAVRDSETDQFVRYFNRKIWSGNKYTPFDDAYWARGAIRDRHPGEFACLTLGFLLHEGISHTQTATGEDEVAVLDSLFEQFNASEKTAYRLLAHTAHGYASEAAFDAELHRILRHFEIQQGQPPQARLVGIDLLGMETATGLYRQFFDFLLGQAAVFRRYLDGKPETRKVVLHIHCGEGTGVSDDNRSLSGYFLRNANALDDFYAALSAYAWKCYGNTIRQGKARLRERENLQDRDKAPSALAGLFDELFFGNSLTSSGLRLRRFDITSGTTQALVAYYARTNVVNLCQALASRDADGNSYYRRLLESDLFSLRIGHAYYYRNYLASKFPELCFDTNLGSNFITGASGLFDSLQEYRLNRGLRHLDGYVGTDQLKELSLAIAYQGEQRLDPQQMQYVHALAESQSGFDELGEHLPGTPGWAKPALEQFFVSQCALYRSEEDRYFPVRSLPAPLRPGPQLALLSAGRRRPGCRALQRTGRSDPHGAPAQLCRRGPPRPGTGRFAGECPTPAGATGQRLLGGNHRRRRPGRRAPSGPRAAALRRVRRPRLGRAHLHPQQLRSDR

SEQ ID NO: 20970 - protein, 291 aa, Pseudomonas aeruginosa
NCSDEHPPQEKRHEGRTRNPRHPGQGTPHRMPARLAPGPVPGRQRGRPGQPWTVGGAVEHRLQHPAGRCRRLPRRYRRQRAGPLGGRHAAVLKPRHDTPRTARLSQRSPRMSISEELGRNLVQLAQRWLKRPLTSEEHEQLRQFQLGLGNDASSDPAVHARQQAEQVIENGRQRSEGSIRQILQNVQQASTQALRAQDSGEQAILEAVNAAGSLAELRPSHLQSGQASANQLVMSQIADRLANLVKSEVRLCFEQNFGSLKQQLENAIAIFNQSNHNTSAPPPDKPDPPAA

SEQ ID NO: 20971 - protein, 156 aa, Pseudomonas aeruginosa
DRTDKRPASRGACIFAARQAWRRRIHNSLAGAFIKTARHEPCRSLTGSHIMSFPTAVNDQITDAVTQSNVKVVGEAPAMALGTIYQTMAHSTGILFENAVSAQQQQNALALAASNMGVMQIYSLDTAADAGATEKVGQLGVADNLTSLLTVLKSFT

SEQ ID NO: 20972 - protein, 198 aa, Pseudomonas aeruginosa
TRCCCMRRMAACGCGICCQHLLPSYDLVLIDTQGARSVLLEMAVLASDLALSPVTPEILAARELRRGTMQLLEDIAPYRHLGIEPPPLHLLINRVHPVSANARLIQQALRDLFQDSAGIRVLATDVPAIEAYPRAATRGLPVHRVEHRQPPGRVAPAALDTMRALASELFPQWQDRLAQVSGRPQRPLDPGRPHGERT

SEQ ID NO: 20973 - protein, 269 aa, Pseudomonas aeruginosa
PSQRPTAPLQGHGLRRGRAGCAQAPRAHQRAGQRQRLVVLGHGQPRSAAAPAQPGTGRGEGNRHGRSHAAAGGQHGDGQPLLWPDPSGSRPAAGDPRPAQAQGAPPRPGRDPGHRTVAAMESRDQQQERRSGGRDLDSRCGHGPGRGHVTAALGGLGRDQELGRSGIGLGHGRGRHRPTSPASRPHRTRRPVRRCAEGPHAQATSQRASAHGSAHACRVRRRLPVQWQSARERAAAAVPRPPPDTAGAQRLAGVPADAQRRRRHGVLDL

SEQ ID NO: 20974 - protein, 163 aa, Pseudomonas aeruginosa
RGLGGLGQPVLRHARRVDRLGAATSAATGQWASLPPAARGTGPADHWLGNDVPALAQARPLGHGRGPVAGADGEHQHAGQPAGRPARDRAAAHHAEHADQPVAHPGQAGTGLRQQGRRGGRRLPAPAHVLSRRNARSVIAPGIPARARRRPGAGISTTKEIAT

SEQ ID NO: 20975 - protein, 207 aa, Pseudomonas aeruginosa
TDRPRDHRPVRIPRPHSTPVAVGAQRCVHPHRARQAAALGRDAADVLLGAGALARRLACGHEPQPAVHRARAAGRLRRRAVGRACTDPDAQTRGRPRPRDRGLRVRALLGHRRVPVRRRSDVHRAVGGTRCQHRRRRPLPAAARRTASRAADPRRGQCPGGVGRDRARARRPAAAVRPGHPAGGVLQAAWAGRAGDAGDRSGPVRDA

SEQ ID NO: 20976 - protein, 190 aa, Pseudomonas aeruginosa
RSIRTSAPRVSTPGSRPQAWNRRWSTSVSSRSTAPRSIRRARRNPRRRRPKTHPRPKPTTPSTRPPSPPSASPRRKSKSRSRHWLLRSDTAWPLTGPCRFSSRIRRVPMTRACAFHPPSSAWSHRRAVVAFLKGDQPCLWHPVLLRNPRSCAPIVHSRTTAFVPSFRRSSPTLRMGVGPIDMPTYRPRPC

SEQ ID NO: 20977 - protein, 185 aa, Pseudomonas aeruginosa
NWIRPSTAALCVHRSPAWASWATRWTSRRRSGAARPNCNLRDRRRRMRSVLHPPAGVPSPCGGGPGHLLEVFIMSTIACDIPRSALDEPAWRALCETAAAQATKGCGLSHDYYVERFSSAIDAQLGRLPEEQRAQALKIAQEWDYATPAERQETQDWNAEHGYCSHGIEFGCCPAGCDRDDDDWD

SEQ ID NO: 20978 - protein, 72 aa, Pseudomonas aeruginosa
SSLKHLSNDEVSSDEEMLGYFIDNGLTEEQARQALTYRDQYLNNIYLDGFTPITAVDEALHFNPHTRQFEPD

SEQ ID NO: 20979 - protein, 107 aa, Pseudomonas aeruginosa
TIKEEPMASHRIETYCHRLTFPIGALIFSRGINRLFNAGRLDPIPYFRRHTRGDWGDVNVCQWHANGVALQSGASLESHYVIHPGLAIRIITDAGRSVTAIVLPSED

SEQ ID NO: 20980 - protein, 605 aa, Pseudomonas aeruginosa
AARQHHPTRKRADFHLVFLYERVCLTFFKRELQMTTQEIACAGAPSHESVNWHSIDWARCHREVRRLQARIVKATREGKHGKVKALQWILTHSFSGKALAVRRVTENQGKKTPGVDGITWSTPEAKSQAMLSIKRRGYRPQPLKRVYIPKTNGKMRPLGIPTMKDRAMQALYLLALEPVAETTADGRSFGFRPERSTADAIEQCFTTLSKKVAPQWILEGDIKGCFDNISHDWLMGHVPTDREILRKWLKAGYMEDRQLFPTEAGTPQGGIISPTLANLVLDGLEAKLDAAFGRKRYANGVQTRLMVNYVRYADDFIVTGRSKELLEQEVMPIIKDFMQERGLTLSPEKTKITHIDDGFDFLGQNVRKYNGKLLIKPSKANVATFLEKVRSAVKGNKALDQPRLIRMLNPMIRGWANYHQHVVSKATFARVDHEIWRVLWQWAVRRHPQKSSVWIKQRYFHSVGTRNWVFAAATGERFPDGNPILTSLRKATDTPIRRHRPIKLEANPFDPMWETYFEERMSLKMQNSLRGRKKLINLWLDQDRRCPICGELITQESGWHVHHIIRRVDGGKDGSTNLVMVHPNCHNQIHVNGLKVVKPARESGL

SEQ ID NO: 20981 - protein, 256 aa, Pseudomonas aeruginosa
PRTANLLRSARRPCSRRVPIRATRHRDGADVPAGACGFGRPAMNASHPAQRSTAAVVIQSLFWLWLIGLSVIVALGYLAMRDQTDQDRLDSRLQRLEAQATGLAETIEAIQQRPAVATAADLKDTRQVLEARAAQVEKSLSGYAAADDLQALRAEIEQIKTRQTAARAAAPAQPRASRPAAASKAEPPPLPFRVVGAELRAGQRSVSVAPSTGDFMPAQLQVLLPGDAVGPWRLQAIEGNTAVFQAGNQTRRVAIP

SEQ ID NO: 20982 - protein, 245 aa, Pseudomonas aeruginosa
PEHPMKPSILLSALVLASVQWPIWAQQPATAPARNAQSQERPLAARVLDDRAASEWGLQPQEWTRYRELMDGPLGIYSPNLDPLSALGIEARTDEERRRYAELQVQVEARRVEKLLAYQRAYDEAWQRLNPGMQRVNLPDDKPGAGPVRGRGRTAVFVKDGCAACGQLVQRLQSSGADFDLYMVGSRQDDARIRDWAKRAQIDPARVRAGSITLNHDGGRWLSLGLPGDLPAAVREVNGQWQRQP

SEQ ID NO: 20983 - protein, 135 aa, Pseudomonas aeruginosa
LPPYRSSCAHWCSLQACMPAPPMPRRSRHRPTSLPPSARASLRRCSTPWPCRRAASGATGASSHGRGPSTSPANRAASPRAPTPALACSRRCAPRRTRASTRAWARSTLATTSTASPARAICWTRTATSPLPPRS

SEQ ID NO: 20984 - protein, 129 aa, Pseudomonas aeruginosa
CRRTGPSSAATSSRRRPTGWPGAWRNGWSSRHCRSLACRSSPAGTCLSTPCARCRLSAACQGCTASSPTKWTSACRWASASGTRWCWAPRGWARRAWPNCSSRRTSAAGMLPASMRSSSSSTPRGMPIS

SEQ ID NO: 20985 - protein, 599 aa, Pseudomonas aeruginosa
HALRQSLFQALDRCDLLRVGGDGLFGVRQLQATLRQLRRLHAGKHQVLIERGVEAAHELAELVHAEQGGDELALIARGPRGDSGEIVEAVLLDEAEAILSFVGLDGLRLARRRRRQDWRDVAAQASVVAVRPLVDPLGLRFADRTEHRHFQGFAEAALAGAVGTVDQGDVMAEVERLLPHESSKRPDFELVQSPERRPVFGAARVPVVGDRHLRQMRDGQRRQARGAPPACSTDLGQWLQVIEHQVRQPAHVVVHVPLRQVRQEPVVLRTYACHSDPSLGQPLTVSLHIDHGDRSTELKLRDQLEKKRGRRLVFVGVAVRAAGLVIEKVPVGGNASDVQTPLGEVCVQRLVHGWAQCRTPFALEGEQATQNRNQRLRWVGPASVRDRQARAVQPAHTGDLLLGIGHKPRVSRLLGLEHGVHAFGWNDRLVLVGEDKRRILPIKHHHIDLLAEVPQAVHHMRLRRLVPFGQIGIQHVDPDVLARIPLRTRVTEGLAYYGQALLDVFMQGRQELGKRPLGHAVPRWDVYGSRWNQDSGNLGPNSARQARSASILRPRRAWSMAMLASWLAWNSSCCARCLRAASISLLIAGPSPAGSGHSS

SEQ ID NO: 20986 - protein, 60 aa, Pseudomonas aeruginosa
SRGRQFHLMSLFVVIKDLDVLRLELGCEVSRQGTLTLDGCLHLSRGGKGHLGLGSGGGHG

SEQ ID NO: 20987 - protein, 260 aa, Pseudomonas aeruginosa
  UNSURE (78): Identity of amino acid at the above locations are unknown.
KARPCTTATSLPVLPSAPPWPWAPPRCPRCRSRKVCRNWRTPTRGTGHRHHGDHPQLRVRHHHARGPAGGGVDVHRRXVPRLRHLRGDPHRPQDVGPVRPHGRHRRRAARDRHLAAHRSHRHPVSEAGMSEQQHVRADGTVTFLPHRLNRHPVVVRGLTADELWICCGLSGAAGLLVGAPLSWVFRTIALAPTFVVLGVALGVFIGGGILRRLKRGRPDTWLYRQLQWRIATRHPLMAGWVGGHVLISRSGFWSTRRSMR

SEQ ID NO: 20988 - protein, 248 aa, Pseudomonas aeruginosa
SPRPVPVWPRSSRVTAAACPMSARTAPSAPWASPAKKRSARFSRAVSGTCRPGSTSSTAKPSPPSMSNPAPRLPSTSKSRSPSTSIPKAARSITAQEKAMPLNLTNLARGLALALAVAVLAGCATSKEKLLTHGDRTMMDIWQQEAGDGGGAAGRNAGRQLLDARQSLRRPLTDADMQAAPAEQMRYTRTARNEVHRQFQRLPNPDLVMYVYPHLAGTDPVPVPGYTTVFPLYQRIQYAMPGERVEDY

SEQ ID NO: 20989 - protein, 191 aa, Pseudomonas aeruginosa
WMHLVRSPGGLALPGRAPSDLTVWRFAMSFVVNDSCLESLSAIAAQHEDWIIQQAIVLLERRIFKAGPCLSRPAAVRDYLRLKLVAEPNEIFAAVFLDSMHQVLAYEPLFRGTINSTSVYPRVVVQRVLELNAAAVVFAHQHPSGITEPSSADRMLTQQLQAALALIDVRVLDHIIIGQGAPFSFAESGLL

SEQ ID NO: 20990 - protein, 386 aa, Pseudomonas aeruginosa
AGSSHRPARPEPGRRRPSAPHRDGLPRRDRRMEFGCHDHPGRGGGPALCGLWRAGRRPRHRAHRAAPEGAAMTRPFDLLRRLRVPVASLLLATATGSYALNTATIVSSVMSPDCLEYRVVGICYWLYCTYGGCSVRTSVKVRHYVPDAVVSSYSNTGENPWVEVQAMSTPNPSAQAGGDGTTNEDHENNLAKFKNSDVIGHPGGEVFNQFASSSGYFCQGAGTAFMPYLLSTLDTLAWRYNVPEMAYPEALIPGMREVGARTTMNLWGNVYPRGGFLHQTDDHKSGAVVAQRAGDVVTRRGQIHVYQPLLANARDGYWPAGALMEGDASTGKWQELTPRLSNTCVVFPHSGTLTQAQQGDYAWALWRPYACCERRGQVFLGSVDFL

SEQ ID NO: 20991 - protein, 467 aa, Pseudomonas aeruginosa
GATMKRPEPINLSAKACRLLRPTALAGTLALVCGLAWAQVGYQNSGPVLGDDVMYSIGGGSAVSMGRAAGMRSIGVGVGWNSNLICGDMSIQTTLRNQLNGITNGFQQIMSNVIQSATSAVASLPALIIQRADPGLYNLLTNGVLQARLDFDRSKLTCRAMAEKMAETAGGQLGWSQMAEGMALRDAVGSNDAVSAVEQAETRRGNDGVPWVGGSNAGGAGQSAIRVVGDVTRAGYNLVNGRGVTDTSSIASTSCASLSCQTWTSPQQATEWATRVLGEQVQRTCDSCTKTETVPGVGLTPLIQEEYEAKLEVLQELVSGTRNTTFENLREAGSTSLPITRGVIEALRDEPDQDLLARRLASEVALSSVLEKALLLQRTLLTGKKEPNVAANELAVEAVNHESDTLDREIRNLKTELELRRELANNSPMAIIQRHGTRAAGSRGIYEGDPVPDRLDQLQKGNPGARP

SEQ ID NO: 20992 - protein, 169 aa, Pseudomonas aeruginosa
ACPTYLCPPTRDGQADDAGRLGCRASRSRARRHCANGQEVARSLPGRWPSRLGRCLFQAAAIAQGHRCGQGFAHRRAAQTSNAAGSHRTQCGRLGVHGQPRSGASGHVQVERPGARRSRCALRARGARGPAAHRHQEARAHRAAQPPRHRQPSRLGRWCRLGDAVRGHR

SEQ ID NO: 20993 - protein, 101 aa, Pseudomonas aeruginosa
PLDASHLVPLDLRPLGRRLRDLLSQAVRVVLGLTGQSLLLAHASETRESISVRNSYLDPLHLLQAELLARSRRCQGDACGGLEQALLVTVAGVAAGLRNTG

SEQ ID NO: 20994 - protein, 333 aa, Pseudomonas aeruginosa
GKAGGNFRCLVRWGGAVYLGQPFRRHTVPFPANTRLAPRGGSRLSLTNSKEHIDACDSARGTRCRQRHPGTVHHREVRHSADLHRRHAARRSQGRQPARPAGERRDGQRRPGIRRHHHRPDQGTHHRGRLRQGLPVRRLPADHPAGRSAEGRRCDHRPRGRDRRRRRGDRVAYRRSSRASGLRPRVPHRAQPAEGRRQGRRYRRRADPARGRQGRDRASPPVGLSFADQAAGRLLPEAVGRRRHPEIPQHRRRRLGRADHRESAFGPELIRSAVAPTARLRAVGVSGAAKAGTIGVFFTTRNRRCPLCWPWIPPPKPAPSPCSTRGGRSVTTR

SEQ ID NO: 20995 - protein, 202 aa, Pseudomonas aeruginosa
SRACTPSACCRWSATCSTRPASPCPRWTPSPSGAVRAPSPACASPSAWSRAWPSPCSARYWRSPTWRSWPSGPTASRVRSGSPRPSTRGWTRSTGVATSCNRARCAWPAAKRYCRPSGSPYRGTPLPRTGSAPAPAGATSSACRSARPRWTRACCRMPRTCSAWPASPGRAAKAWRRNRRCRCTCATTWRRRKKRPENAAQR

SEQ ID NO: 20996 - protein, 133 aa, Pseudomonas aeruginosa
LPSLSGLARVWRLPRVLIMRIDGLSSSSLPLERSARPGSAVTPYRDVQREVEARREQPAPVSGSQGFEQAPQARKVQASSAGGDSLPVSARDLLAFQRPVSSHAAMALASYNSTASLNIDAGAEDVLGLDLYA

SEQ ID NO: 20997 - protein, 294 aa, Pseudomonas aeruginosa
AVPCAPVVSLPYFLGCPSWNEAAWRGSFYPRELRSADYLGHYGGIFNAVEGNTTFYARPSAETVRRWAETMPAGFRFCAKFPRDISHEGDLRERLEAAGDFLELLAPLGERVSPLWLQLSAAFTPQRLGELLYFLDELSPRRIAVEVRHPAFFDKGEDERLLNRHLRERGVERICLDSRALFSCRSDDPAVLHAQSKKPRLPIRPAAFSDTPQVRFIGGPDLPANEVFLLPWVDKVADWIEAGLTPYVFLHTPDNHLAAQQAQRFHALLGQRLPGLPALPEPIPAPEVEQLGLL

SEQ ID NO: 20998 - protein, 298 aa, Pseudomonas aeruginosa
ARRSTLHRPAPRLGSPFPATEPAAMTSQRQRAERFRDLHQGPGMLVLPNPWDAGSAKMLASLGFDALATTSAGLAFSLGRRDAEGAVSRTEALENARAIVAATDLPVAADLENGYGDAPQDCATTIRLAAEAGLVGGSIEDASGRAGQPIYEFSAALERVAAAVEAARALPFPFTLCARAENFLHGREDLDDTLRRLRAYADAGADVLYAPGLNRREQIVAVLEAVAPKPVNVLVGSPRLELSLDELEALGVKRVSLGSNLARVAFGAFHQAAQALARRDLEATRAAMPFDRINDLFR

SEQ ID NO: 20999 - protein, 471 aa, Pseudomonas aeruginosa
SARARRRSSKGPSPAIAWKASPAATTSIRRRPWARAECRHRREAASMQQTIDCPIRRRLAHLPWANDGRAGVRHWLEMQRDPLAWLQKMHVAQPDLAVARMGPQRLWCLFHPQAVQELMVDRRDDLQRWQPALCMLKQWNGRSFMMREGAPAQARRKEVRPHLAPPPASEVRRLAAEWGERVEEGREYDLDLEMAAFSVTLSGHALFDVDLQPSAYRIAKAVRLLSRVALLEMSTGLPLGHWFPSKLCPRKRWALGQLREAVGEVAERSPRPLADLRDELCTLLMASHQSTGVTLTWSLLLLAQRPELLARLRAELARVNWTAIRSVADLRDCALLRAVLQECLRLYPPAYGLAPRQVTADIEVFGQRLKRGDVTMVSSWITQRDPRWFEAPLEFRPERFLEPARWPRGAYFPFGLGDRACPGTAMAMIDLAAALAYWVEHWDIMHDGDLAPRGWFSLRPQRARVRFRRRA

SEQ ID NO: 21000 - protein, 1033 aa, Pseudomonas aeruginosa
NWRPRSSRMSFNLSAWALQNRQIVLYLMILLGAVGALSYSKLGQSEDPPFTFKAMVVQTNWPGASAEEVARQVTERIEKKLMETGDYDRIVSFSRPGVSQVTFMAREDIHSSEIPELWYQIRKKISDIRATLPQSIQGPFFNDEFGTTYGNIYALTGKGFDYAVMKDYADRLQLQLQRIRNVGKVELIGLQDEKIWIDLSNTKLATLGLPLAAVQKALEEQNAVASSGFFETASDRVQLRVSGRFDSVKEIRDFPIRVGDRTFRIGDVAEVRRGFNDPPAPRMRFMGEDAIGLAVAMKPGGDILVLGKALETEFARLQQSLPAGLELRKVSDQPAAVRTGVGEFIRVLAEALVIVLLVSFFSLGLRTGLVVALSIPLVLAMTFAAMHYFGIGLHKISLGALVLALGLLVDDAIIAVEMMAVKMEQGYDRLKAAAFAWTSTAFPMLTGTLITAAGFLPIATAQSGTGEYTRSLFQVVTIALVVSWFAAVVFVPYLGAKLLPDLARLHAQKHGGSADGYDPYATAFYQRFRRLVEWCVRYRKTVIVLTLAAFVGALLLFRLVPQQFFPPSARLELLLDIKLAEGASLRSTGEEVQRLEKMLQGHDGIDNYVAYVGTGSPRFYLPLDQQLPAASFAQVVVLAKDLESREALRKWLIERMNEDFPHLRSRISRLENGPPVGYPVQFRVSGEDIPQVRELARKVADKMRENPHVVNVHLDWEEPSKVVYLSIDQERARALGVSTASLSQFLQSALTGSHVSFFREDNELIEILLRGTEQERRDLSLLPSLAVPTENGRSVALSQIATLEYGFEEGIIWHRNRLPTVTVRADIYDDSLPATLVAQIAPTLEPIRAELPDGYLLEVGGTVEDAAKGQSSVNAGVPLFIVVVLSLLMVQLRSFSRMAMVFLTAPLGLIGVTLFLLLFRQPFGFVAMLGTIALAGMIMRNSVILVDQIEQDISHGLDRWHAIIEATVRRFRPIVLTALAAVLAMIPLSRSVFFGPMAVAIMGGLIVATVLTLLFLPALYAAWFRVKKDEARA

SEQ ID NO: 21001 - protein, 164 aa, Pseudomonas aeruginosa
CRRCRSMAASTWPAGSRPRRGWSWRKSASNSTCAASRAMPRKSRRRSRCCCWCIPSSYPSRRYTPSTSSSCAGASCWRSSTPSARPTAAAISPLRWMATSRPTSRRCSRPGGCACCRARCSATAPMRCPSVLAGTSVRPGIRPGSACRARRWTRTTSPLPAWKA

SEQ ID NO: 21002 - protein, 355 aa, Pseudomonas aeruginosa
ADRRGNRRGARLEAERSGMEAGFVEAGVAYHLAAELPVRQLLQGLWATPEHADAVGAVELVAGECVEVAAQARQVVASVDAALGAVDQGPGTALAGQLDQLHHRLPGAENVGQLADRQQAGTLADDMAGLLQVDHPALVQRQHAQDQAAAQGQLLPGKQVGMVFQGTDQQFVARPEMPLQAIGHQVDRLCGAAGEQYLGRVAGVQPVGDAAARGLEGPGGTLAGDMLGAVDVGGAAEVVAVQGVEYGLWLLGGGGAVEVGQAFRGEGGKGRKVGAPGRRQGHGGHCARTVTGERVAHPAALASTVGRAGRRAGLSCARAALRSARWRSCWSCTPPHRSASCGGTAGRADRPGRGP

SEQ ID NO: 21003 - protein, 356 aa, Pseudomonas aeruginosa
TGIATCGFPRNGVERSGRTAAEQQAQSRAAEQRGATAVEQTPGPLAGEQPAEVEPGIGIKSDGQPFEQQECRSELGELGAQRLAGIDELRQEGGENQDRLRVARRHQELLAPQAPEAGTRRAGFVHQWLRIGPPQLHRKPQQVGSAEHLDRQEQPGRGVQHQRQPGGGQGEHAGECQQAPAAGQRGGGETVPGGVVQRQQVVRPRRQVEGEAGGYEQGPGDTHAASRSGQGGGVGVGLEADQRPAAQLQHRALDHRRLGQHQLDRLGFVEIGLLRFVELAEGGAGAVEDGLPAVLRAPAPQVFAVDADGLVVVEVVGDLVLVEPGPSLLHGVAGFDAVENVGHCFSRGPGLPGPCR

SEQ ID NO: 21004 - protein, 410 aa, Pseudomonas aeruginosa
LPTDRDGAIDAVASSRDEAGDPRPHANRVHRSDPAAGRRRHPPGCPVAALAATTDPDRRRGPAGLAVPRTAHCPRPGAVPLPVHSAAAVRRRLAYSQAGSLADALADPDDGVRPGVLHRGRCRLFHPPADPGNSPGGFLRPRRRAVAHGRPGGLGDHPRAAAQSPDAPAGGRGADERCLWPGGIQVRHRRGDDRRVLAGGRQPQLPPGRGRRPGHRGVPQLVAGPHPRLDDLPWLGRPGDPRGTDAVAAVRLLHGGGTPGRLRDSLGGSGRHDAELGRPAAAADFHAPAQPQRLVDAGVRLQRRGVPAARPAVAGHHEVGGQPPRRPALAFLAAAGLRGGDHRRADADPLRLGLWLLEAVAAHRPLARQEPARAERHLPAPSLRPQCIERRAWCGDPGGGAVGTDEPDGW

SEQ ID NO: 21005 - protein, 532 aa, Pseudomonas aeruginosa
GPRPGPSPGDRRQGLAPEGVARAAPGTVPAAAQQRDRRRDPGRHPARAGPAGKLADQSLRPLGVNEKGIAAAIPFRFSAQASARPQVVADALGGFDALGQWCHQGHAHAVGAGVLAVHLARQVGTRHHRHVLLLEQFAGEYGVVHRGTCPQVETAVRALYVEHAVEDRQHGVEFLAVEAAVGAHMDLVAPGGDARQLGLHRHGAAVVGAVEEEFLQDLRVAGDEARAQAGQVGALGQAVEHHAAAEVRAAQLGASVEQAGRRGVFVEVKFAVALVGGDHEVVAVGQGDQLLQGLQRYQGPGGVAWRAEEENLAALPGRLVDRIEVGVEAVFLAAGQVMRHGSGEQRRAFVDLVERVRADHQAGRLAGLAAADHGLGEGEQRLAGTVHRQYVARRIQPAGRHREAPLAPARDGFAQGRQAEGGRVDRELVQVLRQGFGDEARRAVLGLADGQCDRLQRRGRPGAAEQGAELLEGVGLQVVECGIHGVGKASQKFIRVGRVSRPLSCDSCSTRAACRRLHRSGSASGWLRASVM

SEQ ID NO: 21006 - protein, 320 aa, Pseudomonas aeruginosa
RLGSIRERPVLVRFCAVLVRALRRIGASAPPEWGGASRRTAGSKSRAGSGCRGAREGFVVAQGEDLVAIGGDQHGVLPLRGQLAVLGDRGPAVAEQAGLRAALVDHRLDGEDHAFLQLDAGTRTTVVEDLRLLVEHLADAMAAVFADHREAVLFRVLLDDFADIAQVRARTHHGNALVHAFLGDLAEAVGPFRGLADQEHLAGVAVVAVLDDGDVDVEDVAFLQRLLVGDAMADHMVDRGADRLGKALVVQGGGNRLLLVDDIVVADAIQLLGGHAGLDVFADHFQHFGGQAAGDAHLLDIVGRLDGDGHANSLRACKHA

SEQ ID NO: 21007 - protein, 312 aa, Pseudomonas aeruginosa
PTDLLPPGHPRRVSLRPRLWYKAPRSEAAAFSGAQTHTCIDTMAWVPARVGHWDAWRPNPTYRGTIMSQVNMRDMLKAGVHFGHQTRYWNPKMGKFIFGARNKIHIINLEKTLPMFNEALTFVERLAAGKNKILFVGTKRSAGKIVREEAARCGMPYVDHRWLGGMLTNYKTIRQSIKRLRDLETQSQDGTFDKLTKKEALMRSRDLEKLERSLGGIKDMGGLPDALFVIDVDHERIAITEANKLGIPVIGVVDTNSSPEGVDYVIPGNDDAIRAVQLYLNSMGEAVIRGKQGAATSADEFVEEAPAESAEG

SEQ ID NO: 21008 - protein, 186 aa, Pseudomonas aeruginosa
GSSSGPGRQDRRERQHPPPDPRRGRRGRRLPARPPHRCRGQPERRQPGTGQGHRHACRRQQPAVPERFGSFRRSDREREGNLPGAERRQDRRQAGEHRREHGQGPHQQVPRRSEPGRAAFREEPGSEGRRPGQAGRRRNRFLRSLRSGRRHREGRSGLRCRSCRSSSRHQAVTKTVSTVAPEEAAR

SEQ ID NO: 21009 - protein, 152 aa, Pseudomonas aeruginosa
THSSKVERRSPDGLGGVRHRSQGAGPHGAGNRPVGRDRRAGRPGHRRRQPVPRRGPVRGRHGPGDRRPHGDAGHRDERPGDARCAGALEHPRAGDVGDLHGRCDRPLRPPQGHAPPRRWRGGDLLRRYRQPVLHHRLGGLPARHRDRRRRGP

SEQ ID NO: 21010 - protein, 219 aa, Pseudomonas aeruginosa
PEHAAAGVQHEQAGRIAEYCCWWCRRHPDRGGLRMINEIKKEAQERMGKTLEALGHAFAKIRTGRAHPSILDSVMVSYYGADTPLRQVANVTVEDSRTLALAVFDKSMIQAVEKAIMTSDLGLNPATAGTTIRVPMPALTEETRKGYTKQARAEAEQARVSVRNIRRDALAQLKDLQKEKEISEDEERRAGDDVQKLTDKFIGEIEKALEAKEADLMAV

SEQ ID NO: 21011 - protein, 256 aa, Pseudomonas aeruginosa
GRADVMEKTRKDVCVPRHVAIIMDGNNRWAKKRLLPGVAGHKAGVDAVRAVIEVCAEAGVEVLTLFAFSSENWQRPADEVSALMELFLVALRREVRKLDENGIRLRIIGDRTRFHPELQAAMREAEAATAGNTRFLLQVAANYGGQWDIVQAAQRLAREVQGGHLAADDISAELLQGCLVTGDQPLPDLCIRTGGEHRISNFLLWQLAYAELYFSDLFWPDFKHAAMRAALADFSKRQRRFGKTSEQVEAEARPSC

SEQ ID NO: 21012 - protein, 143 aa, Pseudomonas aeruginosa
GAVPQAPPRLCGGAGAGRGDCLAGLARRGGCPHPGAVRRAGVVRSGQRARSGHGNGGHRRRRRAAVDPGGRRGRQARTAGQQGGAGDVRRAVHAGGQAQRRGAPADRQRAQRDLPVAAAQLCRWPGAGRRAPDPLDRLRRPVP

SEQ ID NO: 21013 - protein, 821 aa, Pseudomonas aeruginosa
VVCSHVEFESAALCGRFSICQLEKKDSMKRFLLPALLSALMIAEVHAESFTVSDIRVNGLQRVSAGSVFAALPLNVGETIDDQALVQATRSLFKTGFFQDIQLGRDGNVLVVTVVERPSISSIEIEGNKAISKEDLLKGLKQSGLAEGEIFQRATLEGVRNELQRQYVAQGRYSAEINAEVIPQPRNRVALKININEGTVAAISHINVVGNTVFSEEDLTDLFELKTTNWLSFFKNDDKYAREKLSGDLERLRSYYLDRGYINMDIASTQVSITPDKKHVYITVNINEGEKYTIRDVKLTGDLKVPEEEVKRLLLVQKGQVFSRKVMTTTSDLITRRLGNEGYTFANVNGVPEAHDDDKTVSVTFVVDPGKRAYVNRINFRGNTKTEDEVLRREMRQMEGGWASTYLIDQSKARLERLGYFKEVNVETPAVPGTDDQVDVNYSVEEQPSGSITASVGFAQSAGLILGGSISQNNFLGTGNKVSIGLTRSEYQTRYNFGFVDPYWTVDGVSLGYNAFYRKTDYDELDVDVASYSVNSLGAGMSIGYPISETSRLTYGLSVQRDQIDTGRYTVDEIYDFLDKEGDNFTNFKASIGWSESTLNKGVLATRGHSQSLTLETTLPGSDLSFYKIDYRGQVFAPLTDNYTMRFHTELGYGDGYGSTERLPFYENYYAGGFNSVRGFKDSTLGPRSTPSRAYKDGKIIPGPDERGRYTDPDQDPEAFGGNILITGGAELLFPLPFVKDQRQLRTVLFWDVGSTFDTDCPTKTTTNCDGIKTDNLASSVGVGLTWITALGPLSFSLATPIKKPDNAETQVFQFSLGQTF

SEQ ID NO: 21014 - protein, 320 aa, Pseudomonas aeruginosa
SACRLRCGADRLRHRDSRGAALQAADGGGLSGRRVDVSDSQALGEKPVHLPAEPVGRTPVGAGADPGRRDSASAGRNPLAAAGRRLTAGGILRCHPSGLAPGCLGTGGGSRPATGGAPLMQLGLDFNLVEDLVAGVDEVGRGPLCGPVVTAAVILDPSRPILGLNDSKKLSEARREALFEEIREKALAWCIARAEVEEIDRLNILHATMLAMQRAVEGLSVTPRLALIDGNRCPKLAVPCAPVVKGDSQVPAIAAASILAKVSRDREMVELDRVYPGYGMAGHKGYPTAVHLEALSRLGPTPIHRRSFAPVRELLDVSVQ

SEQ ID NO: 21015 - protein, 483 aa, Pseudomonas aeruginosa
QQSATSGTGELSMQEFATQVVDLLNGLIWGKILIWLLVGCGLYFTVRLGLIQFRHFGHTFSVLKGSRQSDDSGISSFQALCTSLAARVGTGNVAGVAVAITLGGPGAVFWMWAIALVGMATGFVEATLAQLFKIRDDKGQFRGGPAYYMEKGLGARWMGILFSIFLIIAFGFVFNSVQANTITGAMQGAFGVPTWISGIAVVILTALIIFGGLRSIARFSELAVPFMAVAYLLLAVGIILFNLSELPGVLAMVVKSAFGWHEAAAGGIGAAILNGFKRGLFSNEAGMGSAPNAAASATPYPPHPASQGYVQMAGVFIDTLLICTASAAIILLAGPQEGEGIMLVQNALTSQVGDWGRYFLAVIILFFAFTSIVANYFYAENCLVFLEHNHLAGLLIFRLIVLAMVMFGALASLPFVWNLADVSMGLMAITNLIAILLLSNLAIKLAKDYNAQRKAGKLPTFDASQFPEVQQKLEPGIWDDRRA

SEQ ID NO: 21016 - protein, 1198 aa, Pseudomonas aeruginosa
TCSFATGPGTIRALSFLRYFCSGAFMTVSFVHLRLHTEFSLVDGLVRVKPLAKAVAGLGMPAVAVTDQSNMCSLVKFYKTAMGAGIKPICGADIWLASREEDGPLSRLSLLAMNAKGYRNLTELISRGWSEGQRNGEIIIERDWVKEAAEGLIALSAAKEGEIGHALLDGEEAKAEALLREWMEVFPERFYVEVQRTSRVNDEEHLHAAVALASRCNAPLVATNDVRFIKQEDFEAHETRVCIGEGRTLDDPRRPRTYSDQQYLKSPAEMAELFSDLPEALENTVEIAKRCNIEVQLGKYFLPDFPTPNGMGIDDYLRHASFEGLEERLEVLLPKDTPDYEAKRQVYVDRLNFELDIIIQMGFPGYFLIVMDFIKWAKNNGVPVGPGRGSGAGSLVAYVLKITDLDPLAYDLLFERFLNPERISMPDFDVDFCMEGRDRVIDYVADAYGRNAVSQIITFGTMAAKAVVRDVARVQGKSYGLADRLSKMIPFEVGMTLDKAYEQEEMLRDFLKSDEEAAEIWEMALKLEGITRGTGKHAGGVVIAPTKLTDFSPIACDEEGGGLVTQFDKDDVEAAGLVKFDFLGLRTLTIIKWAMEIINREQAKKGLEPVNIDFIPLDDKPTYSLLQKAETTAVFQLESRGMKELIKKLKPDCLEDLIALVALFRPGPLQSGMVDDFINRKHGRAELSYPHPDYQYAGLEPVLKPTYGIILYQEQVMQIAQVMAGYTLGGADMLRRAMGKKKPEEMAKQRGGFIEGCKNNGIDADLAGNIFDLVEKFAGYGFNKSHSAAYGLVSYQTAWLKTHFPAPFMAAVLTADMQNTDKVVTLIEECRHMKLRIVAPDVNNSEFRFTVDDDGRIVYGLGAIKGVGEGPVEAITECRAEGGPFNTLFDFCDRVDLKRINKRTLEALIRAGALDRLGPHYHDELKAYQATVDLNRAVLLAAMEEAIQAAEQTARSHDSGHMDLFGGVFAEPEADVYANHRKVKELTLKERLKGEKDTLGLYLTGHPIDEYEGEVRRFARQRIVELKPARDTQTVAGLIVNLRVMKNKKGDKMGFVTLDDRSGRIEASLFSEAFAAAQSLLQTDALVVVEGEVSQDDFSGGLRLRAKRVMSLEEARTGLAESLRMKLHADLLKGDRLRWLGELFNRHRGSCPITLDYTSADAKALLQFGESWRVDPADDLIQALRDQFGRDNVFLNYR

SEQ ID NO: 21017 - protein, 285 aa, Pseudomonas aeruginosa
GAQACRRCRSNPVCYRPWRPGAKRGAGAWRFPAGWIPRCCCICSPNWPGAKPCRRCRRCMSTMACRLRRTVGRRTARWSAGRWVSRCGSSGCRSPLAAASSRRRATPAIAHSRRTWARDRCCSPRSTSTTRPRPCCSACCVERACAAWRRCRRAGRWAAAACADPCSGFPAPNWKPMRRRTGWTGWRILPTRIRASRATTCAGRSCRVSPPTGRRPSPAWRAARRICARPKTCWLNWPPSTSGPAANPRNWIGRTGWICPGSPWSLCAASALRASATCCGPGWGS

SEQ ID NO: 21018 - protein, 234 aa, Pseudomonas aeruginosa
SHHRHGRQVHGTAGRVQVADRGDDPRRHPEPHQGQPALHRLRRHRAAGHQPAGRRRRHPGPGRLRPARRGRQDQHRAVRPREQDSLPGHLPGHAGRGHRIRPQRARLERRQLHRVRQVQRPPGGRPDHRMAGRDRRHRDPHRSFRPGRHHAPGRPGVPAADRHPGARLLCQGRDRRAPSPSLRSEQQPAAATGTGRPEDFRPLRRRRPGGSGRVPGASVVRRLPVPPGVHLHTA

SEQ ID NO: 21019 - protein, 302 aa, Pseudomonas aeruginosa
WPPAVQRFRQRRAEIFREGLSMAQKIVRVGDIQIGNDLPFVLFGGMNVLESRDLAMQVCEEYVRVTEKLGIPYVFKASFDKANRSSIHSFRGPGLEEGMKIFEEIKKTFKVPVITDVHEPFQAQPVAEVCDIIQLPAFLSRQTDLVVAMARTNAVINIKKAQFLAPQEMKHILTKCEEAGNDRLILCERGSSFGYNNLVVDMLGFGIMKQFEYPVFFDVTHALQMPGGRADSAGGRRAQVTDLAKAGLSQKLAGLFLEAHPDPEHAKCDGPCALRLNKLEAFLSQLKQLDELIKSFPAIETA

SEQ ID NO: 21020 - protein, 444 aa, Pseudomonas aeruginosa
SPQTAPFIHFGVLTRMAKIVDIKGREVLDSRGNPTVEADVILDNGIVGSACAPSGASTGSREALELRDGDKSRYLGKGVLKAVANINGPIRDLLLGKDAADQKALDHAMIELDGTENKAKLGANAILAVSLAAAKAAAQAKGVPLYAHIADLNGTPGQYSMPVPMMNIINGGEHADNNVDIQEFMVQPVGAKNFAEALRMGAEIFHHLKAVLKARGLNTAVGDEGGFAPNLSSNEDALAAIAEAVEKAGYKLGDDVTLALDCASSEFFKDGKYDLEGEGKVFDAAGFADYLAGLTQRYPIISIEDGMDESDWAGWKGLTDKIGAKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAPYRGRAEFRG

SEQ ID NO: 21021 - protein, 375 aa, Pseudomonas aeruginosa
QAVAGPEAFQQVELGIGQGEAGAQLVPKDRHQGSADDVADADHPEVHLALHRAVHPAGLATAGEDDADAEENAADDRIRAHPEDLRRDAQADRGEGTDAGGRHAEQDAEGGAGPAGGPEVPCGTGEADLRALDQAAEQQAEQAGHAQHQRYLEAPGGEQRGERQHRQAQAGLQACASGQAFGAGQGAGRGADFQRCAQERQQADLHADPGAADGGEHEGPGVQGKHRDTGEERRQVAAHRQARAEAGDDTADQTLQQATFAGRPAQADVAGPEGAAQGAEEHADDHHSVDPVQRRALKADQPEVAPVLWLVAEPGQHVAAPAGEFAGHRPEGAGEREVVGGGDAEGDQRRQRRPEPHQVALAKRIEGRHATSLNR

SEQ ID NO: 21022 - protein, 331 aa, Pseudomonas aeruginosa
RVERETAKSIAAVNRLTASAQVFLPGESRMGLRQAFLEIVHQLPDFRRQVPLLRVQRPYRCIRRLVAFQQGDQAAAAQMLDHIVVGQLAQAEAAQGGVEHRLAAVAAPVALDPVLGFPAVLEEAPQVAAADQAVELAEFRRRLRSAVAAQVFRGGAEVHDAWCQPCGDQSRIAQAAEADGQVEALVEQVQLAVGQLDVDPQLRIVGHEGIHQRHDETFAVGYRAGHAQQALGLRGEVADRAQGFVAGVLQALAMLQEGLSGFAQRYSPGAAVEQAGLQALLQAGDLAADVRRGNAHAFGCRGELPGFGDSDEFVESFPAIHLDCPCMAIMF

SEQ ID NO: 21023 - protein, 262 aa, Pseudomonas aeruginosa
NPRPGTDRADGKPMRILIANDDGVTAPGIAALYDALADHADCVVIAPDQDKSGASSSLTLDRPLHPQRLDNGFISLNGTPTDCVHLGLNGLLEELPDMVVSGINLGANLGDDVLYSGTVAAAIEGRFLKGPAFAFSLVSRLTDNLPTAMHFARLLVSAHERLAVPPRTVLNVNIPNLPLDRVRGIQLTRLGHRARAAAPVKVVNPRGKEGYWIAAAGDAEDGGPGTDFHAVMQGYVSITPLQLDRTFHEAFGGLDEWLGGLT

SEQ ID NO: 21024 - protein, 180 aa, Pseudomonas aeruginosa
GSPFPFLPWRTVMTLMESDLTALAARLGESLRYLGEQVSTAESCTGGGIAEAITRIPGSSGWFEAGYVTYSNRQKTLQLEVPESLFPAVGAVSREVVEAMVRGAQRHSGARFAVAVSGVAGPDGGSPEKPVGTVWLAWADGERLVSERCQFNGDRDAVRRQTVATALTGLLRMSNGENPG

SEQ ID NO: 21025 - protein, 102 aa, Pseudomonas aeruginosa
RNPRQGGEEQGFPAVPPGRVPDPLRQGHLPYRRDHRPGRAIGPGREVRRLVQLPGQQDRPGQGERRQVPGRQSGNRFGTGEDHSRPVAGQERPGEGRRRRSG

SEQ ID NO: 21026 - protein, 160 aa, Pseudomonas aeruginosa
RRSRLRPMATVLDTPVAVRRAAMDLLARREHGRAELSRKLRQRGASAELIDPALDRLAEEGLLDESRYLESFIASRARSGHGPLRIREELAQRGLPRADIERALGACEVDWSAQLREVWRRKFARLPQDAREKAQQGRFLAYRGYSMESISRLLNGRSDD

SEQ ID NO: 21027 - protein, 823 aa, Pseudomonas aeruginosa
CRSAPFAVCCLDCKAPLGRLPTMSQILPSQDELLAHAAAEPAFAAWLQGHGPLQHSAETRAAVFRTAHQLVQAGLQPDLASVYQLFRALDRLTASALRIVVHMTYARRIRLDGQPLQAEDFKTQPEGHTGGALNMVPAYAGYLALNVLTGKTRAWLMGQGHCVAAIDALNVLTGNLHPEQERAYADGEEGLNRLLQDFYGYAQAPNGAPAAPLGSHVNPHTAGGIAEGGYLGFAELQYAHMPLPGETLVAFLSDGAAEEQRGSDWIPRWWRAEDCGAALPVMIANGRRIEQRTELGTHEGLEGFKLHLRRCGFDPISFDGRDPAAFVCTLWEMEQRLERRVQEKNSGILRYPLPIPYGIAETVKGFGFYGAGNNAAHNLPLPGNPHNDEQARQLFNQHANELWVEPEALELARRLFAEQRGERPLERDNPLALRHPIEPIIPPLRYRDDACSPMAALDRFYTELVEANPDLRARVGNPDELASNRLGGVLKALKHRVSEPESELESVSGRVITALNEEAVVSACLANQGGLNLVASYEAFCVKMLGAVRQTLIFARQQKEFRRPAGWLGWPLVATSHTWENGKNQQSHQDTTFCDALLGEMSDMVRVLFPADHNSALALLPTIYRSRGQLACLVIPKRDRPMVFDAVQAERLARDGAILVEERCGSDPLLLIANGSYQLEQMRRAAQRLAEAGQAYRLVYLQEPGRFRAPRDRWEVEAVADEALVERLFPDSHERRVLLTHMRAEVARGHLWPILPDARRTSVLGYRNRGGTLDEAGMQFANRACWGNVLAACARLMEVPRTALLTPEEAAAVAGKGDPALLR

SEQ ID NO: 21028 - protein, 196 aa, Pseudomonas aeruginosa
ICVGRVAKPPPAVKKVITKSSMDRVKAISAPATMPGMISGRVTRRKLCQGVAPRSRAASVRLSSMPDMRACTTRATKPTEKVMCARVTESMPRLMFRPMKKITSETPIRSSGMAIGVSTSRGSTRSLKRCRATPARVPSRVATLAETSAMTSELAAAWSMSRLPNSLRYQSRVKPTHSAFSRESLKEYSTTITSGT

SEQ ID NO: 21029 - protein, 433 aa, Pseudomonas aeruginosa
SPGKRNEANSMISAGTRKKNSRYACGGQTSSHLPRFFLIVSGPDQVAGIEAPGGFHRVAHLEELGPAGRGVGQQGFQALAVLQLDDVQGHVAQVEQFGDAAAEVHLVAVSGDALRQADLLRPQGQHAGLAGLGVEGFQRLDLAQAPEIDAHAFAVDRLDRGVEQVALADEVGDETTAREAVDGFRGVQLLHPALVHHRDAVRQRQGFALIVGDIDEGDADVLLQVDQFDLHFFAQLGVQRRQRFVEQQQARPVDQRAGDRHALALAAGKLCRHAPALVRQAHVLQGLFDAGVDLALRHSGHLQREGDVLRHAHVREQRVALEHRMHRALLRLDAGEVLAVEADLAAVRLVEAGEHAQEGGLAAPGRAEEGEEFAGVDRQADIVDGGEVAEAAGHVADLEQGGRHSSGEAVRSAGGAGCPVSKKGADYRDRIPL

SEQ ID NO: 21030 - protein, 290 aa, Pseudomonas aeruginosa
GPCEEFFFAASEVVRQSRSHAGSDRISRSLSSPFPRVFDVPSPVLSVSGACPMSHAVSRLRQERLARSLKPFVARGSRMPRCEGCRLLPSYCMCAWRPRVEARAGMCLVMHDIEALKPTNTGWLIADTVADTFAFGWSRTEVDPRLLELLADPQWQPYLVFPGEYVAAERVVNEVAPLAEGKRPLFILLDATWTEARKMFRKSPYLEPFPVLSLLPEQLSRYRLRRSTRGEHLCTAEVAALCLELAGDEAAGEALGAYLEVFSERYLGAKRHIPLDEASPAHRALAPFRG

SEQ ID NO: 21031 - protein, 126 aa, Pseudomonas aeruginosa
EPDVSPSPFKGQTGLKRILNATGYSLAGFLAAFRGEAAFRQLVLLNVVLIPVAFLLDVSRGERALMIAVCLLALIVELLNSAIEATVDRVSLERHPLSKNAKDMGSAAQFVALTVITVTWATILLG

SEQ ID NO: 21032 - protein, 550 aa, Pseudomonas aeruginosa
KSRRQRCLRLFLACEGGGSGRRVEAVGPRHVPHALVELALDLAGKQFARLEEVVQLREQADLGVGDASHQVLGFELRGMFQARRGEHLGQALEGVAMEVAHPLGLVRHHQRALAQRVLGGDAGRALVGMAALRLDAADGEHEAARRVGPIRAGGQDAGDIEGADDLAAGADLDLVAQVEADQGVVDEQQAFAQRHADMVGELQRRRAGAAFLAVDDDEVGEDAGLQHGLGDAHELPWMAQAELEADRLAAGQFAQLGDELHQLDRRGEGAVARRRNAILTHRHATGGGDLGGDLVLGQDTAVSRLGALAELDLDHLHLRVEGLGGEALRVELAIAGAAPEVAAAQFPDQVAAVLAVIGTDAALAGVVVEVAHMRATVQRANGVGAEGAETHRRDVEQRSGVRLAALWPADVDAELAGIAERRRTHRVADEFVAGGVHVDQGAEGLLRAFVLRPRVDQRALGAGEGQGVAVGFQQVLADLRADAFHQIADVAQDRIVAAHRVGRLDQVEQAEQAQGHAQEGERPEPFGAAEERQADQGEQGDTGEKRIATE

SEQ ID NO: 21033 - protein, 254 aa, Pseudomonas aeruginosa
PRNPAHCRRWPAPAATRPTGRRAAARRPARFPTATAAGSPNRTPRGTARRTRPSQSTPERSQRHSHPHSNPEKTDLGQPSRGRRSIPWQARAFPRLSEKEAGHVHSRPSASRLGQRSRPPGIRYPPALPGPGGRGPPGGRTLRHGGPDRRPAFQRKLRTAARRRRAFRQPCQSPGPAPRPALAAGTDRAPAPRVRRYVRRPAPTPETQERRSDRPRPLPARRGRGILKRLSRMLRKPPTQAMPCNFQRSGRLHT

SEQ ID NO: 21034 - protein, 118 aa, Pseudomonas aeruginosa
VTILVKETDMTLKTRSARAKQAIQDQAMAELQDLIAEVDQLMSGTGSLAGKEGANLREQINSVLHRGRDAIERTRRGVVQRSQAAAEATEEYVEDHPWQTIAVSAGAGFLLGLLMGRR

SEQ ID NO: 21035 - protein, 116 aa, Pseudomonas aeruginosa
SAPRTTVFFICDKITHPRLPRQPCRPAGYSGKTASPGGTVMDTSPHTFSNLFRQLGLPAGRDDIVAFLARHHLEEGTALPDAPFWNPAQASFLREALAEDSDWAEQVDELALQLTR

SEQ ID NO: 21036 - protein, 213 aa, Pseudomonas aeruginosa
RPSPSPRRWSFFCPRFGRAPTGWPRTWNIPLRPPLNFSPVPRCLTLLALPRKENLKDMKALLIAAGVAALSSTAMAAKLDEKVPYPKADAGFTRQVIHLPKQDAEDAFKVEIIAGKTLEADCNQQRLGGELEEHTLEGWGYSYYRLDKVSGPMSTMMACPGQKKEQRFIPVVGEGFLLRYNSKLPIVVYAPKDVEVRYRIWSASEKVEKAVSE

SEQ ID NO: 21037 - protein, 327 aa, Pseudomonas aeruginosa
ENCYELFQRYHRAVPRRPRPRLLFRRRPCLGSSAFGGEHGHRQPGGGAGFRPFRANPPRSPSYGAGQGPGTASADDRRAARPVAGACAGTLPGIGKPPVARRGCGHRQRAAVRRPPHPFRALPAARCRGAQRGAGRCPRPAPWRPHQPVLRIRRHQREPAGALPVCRRGIAGRDHLAAPSRPAEAGAGAVPGRAGERAADPGRQLRPTVGRHPSADCRRLLAHRQPGHGAGNGRGGDRLGQFPVVPGRAAAGNGKAGTPGLQEYQERAETACPRYLAEKPAIAQGRPGTGWHAGHPSRLKRYAMHFTEKTRPVTRIAAHAGSPASST

SEQ ID NO: 21038 - protein, 140 aa, Pseudomonas aeruginosa
ASAMPRSASARPSPSCSSARTRRSTRRRARPTTTACRTATRRSASPAPTRSATSISATTARTSTAVATSPAAAPSAASSTRTEARRPAGIPDVRQYRQAKTKYLRTVSTTSQVPRRPGSMTNTSPALRCTGCSPSGVMMQ

SEQ ID NO: 21039 - protein, 75 aa, Pseudomonas aeruginosa
WPFFPSAVVHGDRMPRIALVLGVLLVSACAQPVTPDSIVEESFSRSASERQLEELNRQGLPYEQYRLRRQRILGR

SEQ ID NO: 21040 - protein, 331 aa, Pseudomonas aeruginosa
RSLSNEEAAMTLAPRHLRIEQRGRVLQVLLDNPPANFLTTAVMQELADLLEDLEQRQDIGAVILSGAADGVFLTHFDVDEIERAVAPITFSMPAWLTRLLLESESLLRHLPGARKLLRRTLLAGVADMNLFHEVTAHMRRMDKVFIAAINGLALGGGCELALACDLRLMAEDDQVERFLGQPEVLIGLIPGGGGTQMLARSLGVARALELCLEGQLLEPRQALALGLVNGLAPAEELLEAADALAQRLSRRSPQAVRLIKRSIYQAASRDWTEGMASEKAGFLSAASQGNTRRAMREYIERVRTITREERPFRRADFDDLTEGNAIDMAYR

SEQ ID NO: 21041 - protein, 475 aa, Pseudomonas aeruginosa
QFEQAPLDAVADWPMLTVCANPKGISRPAPPRSGFFFACRSALRVEGRIAPPAQARQGREQRFRQIGPIEPGPAVALVRLHEARLGILRATGQDERGEVVAPLEDVIAERAVAQFAQRQAGLFQGFAQGAVLHRLAELEMAAGRRPAASAMTALAAPQQHLAVPQDQDAHAYLRCRHRRTPASGSEMERTAHVQRRLAGDDHPLAAHVAFQAPLARPALLGAQPGLAQALRPVRRQGGMRGTGHRVFVDADVGPEPARDEIEALAARGHRHPAARQALQPGEVRRQGGDRLFVVDHHEVIVGLQHFRLGNTQRLQQSVRCRARLRTLGREVHRQRVALAPHAQLTATGSETQYRGSVVELVDQYPGRRQGRMTAQVHLDLRREPAQSIVAVAADDKGGFRKIVLFRDGLQALVVQPGIEGADRRRIALEGTVGECVYLEDRQFHVPDSCIDGLRTLAAGPRPGQCRAPRRRLAQI

SEQ ID NO: 21042 - protein, 345 aa, Pseudomonas aeruginosa
SGSSMLACPLPPDEALRQQALDDMALVDTPAEHYLDALVELARETFGVKTVLISLIDHDRQWFKARIGLDAEQTPRDLSFCGHAILASEPLMVTDASRDPRFHDNPLVTGPPFIRFYAGEPLHASNGQAIGTLCLIDPSPRLLDLREGRQLNRLSILAEGYLQLRSLTEHTRFLRQEIDREQRKSLLDPLTQLWNRAGFHALHQHELELARASDQRIGIIYSDIDHFKRINDTLGHRAGDSVLREAASRLRAALRPEDLLARFGGEEFVAMVRVRETTELTMIANRIRELMEATPIDCAGTSVPVTISAGCTLAGSGEEPERALARADAALYDAKRAGRNRVVSV

SEQ ID NO: 21043 - protein, 448 aa, Pseudomonas aeruginosa
PADFDSGSIRASVKNKKQRCKMPHTPYPSSYYAASANPAPPRPELQGEVETDVCVIGAGYTGLSTALFLLENGFKVTVLETAKVGFGASGRNGGQIVNSYSRDIDVIERTVGKREAQLLGEMAFEGGRIIRERVARYGIQCDLKDGGVFAAFTEKQMDHLRAQKQLWERYGHNQLEIMDAKRIREVVATDNYIGGMLDMSGGHIHPLNLALGEAAAVESLGGRIYEQSPATRIERGASPVVHTPQGKVKAKFIVVAGNAYLNGLVPELAAKSMPCGTQVITTEPLNEELAHSLLPQDYCVEDCNYLLDYYRLSGDKRLIYGGGVIYGARDPADIEAIIRPKMLKTFPQLKDVKIDFAWTGNFLLTLSRLPQVGRIGDNIYYSQGCSGHGVTYTHVAGKVLAEALRGQAERFDAFAGLPHYPFPGGKLFRVPFTAIGAWYYSLRDKLGV

SEQ ID NO: 21044 - protein, 143 aa, Pseudomonas aeruginosa
RSGKANCAAAKAPQGIPEYLAQVEPALLDTLALGQVLEMSLPGRERALQARLASTHNSAGLPVWRGGLVDGDEAESLTVVRGSLETHINVATLDGSYSIIVDNRSGKTRVIDENDIAARSDPHGDHVDAPLAELPPMPPPAQG

SEQ ID NO: 21045 - protein, 92 aa, Pseudomonas aeruginosa
TCRKPRPRRRAYRRRRNASPTTSRAASAAGAACMPAPAPRASPAPGGWPWKPTSGATPAPARAPACWATWKQAGPTRSARTYGSATVAARRP

SEQ ID NO: 21046 - protein, 282 aa, Pseudomonas aeruginosa
TMITSVSLVSEGPAHLPRSTPDDKRPPGRLQPPDGYPDPAVDRRHAAAQRRVLDLPRPCQRARPRFRSHRHRCRRRPRRCGAGHAALAGPRRHPPVEPAAAGPGQWTAGAAKAVPALRARRVFLRRRRGAARQGRPVPGLLGAGELPAGTAADSLGHLPPTPGATHRQSQLRFGGTGQPVRRRLGDGDRAHPAQGRPARRGKPPVRLRSAMPIEIRLDVMLALRKARSKDLAQAIGITEQNLSLLKQGKVKGIRLATLEAICAYLACQPGDLLEYLPGPTEE

SEQ ID NO: 21047 - protein, 193 aa, Pseudomonas aeruginosa
QPGAYALERGGAHQRVFRPSPLSPLQSRFIHQTWARPGMAKSSERFESLRRDIDALARRLDVPSVLIMRSLPRHMRVEASAGRLEDTYPIGAEGRKSVHEDGAKPLYCERVVDRDAPLHVRDSRQETEWAGNEDEVEFGLSNYLGYPVHAPDGTPYGTVCVLDSRPRDYSAEERALLEELRRKVEALLAETVS

SEQ ID NO: 21048 - protein, 434 aa, Pseudomonas aeruginosa
PKVNRIPRRTTAPPPPARRGPSVHARRLPRLLPLALAFLLSPAAFAADTPAAELLRQAEAERPAYLDTLRQLVAVDSGTGQAEGLGQLSALLAERLQALGAQVRSAPATPSAGDNLVATLDGTGSKRFLLMIHYDTVFAAGSAAKRPFREDAERAYGPGVADAKGGVAMVLHALALLRQQGFRDYGRITVLFNPDEETGSAGSKQLIAELARQQDYVFSYEPPDRDAVTVATNGIDGLLLEVKGRSSHAGSAPEQGRNAILELSHQLLRLKDLGDPAKGTTLNWTLARGGEKRNIIPAEASAEADMRYSDPAESERVLADARKLTGERLVADTEVSLRLDKGRPPLVKNPASQRLAETAQTLYGRVGKRIEPIAMRFGTDAGYAYVPGSDKPAVLETLGVVGAGLHSEAEYLELSSIAPRLYLTVALIRELSAD

SEQ ID NO: 21049 - protein, 526 aa, Pseudomonas aeruginosa
RRRPQPASGTEATEHHAQASHVLLDPLVGRKHCGGPFVGLLGESGDVGDVAVDVLGHLALFLSGGRDLLVEAVQFFHRGDDAPQRLGRAVGLDEVALGMAGATAHGGDRIVGAVLQLLDQPLDLLGRLLGTVGQRTHFVRHHGEAAPGLPGPRRLDGGIERQQVGLLGDAADHRKHLADTAGMLVQGVQRQGGLFQFLRQRTGLAAGVLHQTPSLVGQGRGVARGVRRMVGVAGDLGHGGAHLVHRGGHLVQVLVLARHLVAGAERLLQGLGHVLVGLCRAALDVRQQTADVLAHPLVASDDAADLVVRMARRQGMGEVRRADLGQRHFQPTQLPHQRRQAELPAEHHQHQDRQQATEGDPHLGVLDTVGARAHQRDQVVQLAQQLGGILREAAQIDLAGRLCHLVEHGPVAAPDLRHLLPLGGDLRRAHPAHVALGIARIQVGGRAFVLGDGRGQGLWVAGAESQLQRLAGHLLAEHALRAGHVDGFRRDRHAQVQRHRGAGGQAEHQCIGQQELGVQGLQPEPP

SEQ ID NO: 21050 - protein, 378 aa, Pseudomonas aeruginosa
TLAGTRHAAPETSWNPTRKDARVIPVAPLPLIVPLIYLSSFVAGIWLLIWLSLLAFSPRARQRLRRRWPSRGLLMLIPLGLRAWLEIGLWQYERERAREEAAHSAVLERPTRLGGIEMPAGTRLKLELKHQPESFREAEFPTPVTIRGVATRHLQRWLQSEQDNPQDPWKTTGVHPTSLRLRGEGVAEIEGWRCDASQEIAFASERDGRPAAFEGCSLAIGNRADDIDFPAGARLFASDGMVYTDGYRDAERWRVMPETGQRVSVRGIALSGGALAFDRDRRLYGLGGTVLAEALQLGAWHYPAGTEVSLSPRAAWRAQHPHAWLFSPTREAASHASGERLEHGVSLLQTLDGQELERLDNRAAGVIDFIELEIGDER

SEQ ID NO: 21051 - protein, 72 aa, Pseudomonas aeruginosa
IIRYIDLHLSCFINRRGRDDPSARHRPTSYISKILSSRLGNYGRRTPNTTLQFTENNTPITTTYMLCCPPIY

SEQ ID NO: 21052 - protein, 217 aa, Pseudomonas aeruginosa
LREGDAGCGGDSGDGEAPHRYQRARQLRRTLRFRRPGTRGRLPELHRACADRHPRRALAQGEPRGTAAALRGRGAIEEGLPGPGDRPQRRHQDPRGLPRAPADLRRRDARSQGLPQPLPAGRGGQPVVRQRSAAAQSQRGLAPSASVHRATPGRRRRDASRDPPYPRPGPGLPRLPAIPPTALGGRAQGRRSAAGFRPGAGTSGGAIAPIEPRLRLG

SEQ ID NO: 21053 - protein, 258 aa, Pseudomonas aeruginosa
AGLDHLPDAFRMPSSDQLPRFTALLFGLSGGLVDFGARTLSLALLRSHPHSPAEHLRDASLLPFAEAQSFLLQRKPNKNERQRLEQALDEAAEEQAEAIAGAVALLESLDEQRIPYAWQDELPESVCQRLAAPLGRADALIPLAGARPWPAPDGCWQALARLGIERLDGCVLVSAQPRQLQAGLNAGLWTIGLAASGPSCGLSPADWDALGHTERDRLRADATLELYRLGVHSVIDHLGELQPCLHDLAVRRLKGEKP

SEQ ID NO: 21054 - protein, 136 aa, Pseudomonas aeruginosa
RTSSRCWNACCGLIRIAHICARQVNLFGMDGPFGARRRSTEDLYVEGNTMPKESLLRELSALREQLEQQPPLNEEQRAELELLIRDIELKLANEDALNEGSLVDGVNLAVERFEVSHPTLAGTLRSIVQSLANMGI

SEQ ID NO: 21055 - protein, 270 aa, Pseudomonas aeruginosa
TTCRNEKPRHGRGFFVSACCEALLAHQASVVRCDLRQAAVGIDIQAATAYVARVDAERLRLQQALQVEEDAFDALFVEVLVLAEGNQVGQQAGRVQRRAPVVDHQGAPVGLAGDRAVGLEQVAVELLLDDPPGVAAQQFRARLLVAVDGDVQLVDAAPRQTPDALLGNLVEAAQAHAHGRPGSGREVFLQYRAKRLATIEGGLVEGIEVKLERLRLDDVRRVRRDRELADRHHRLAGRGQPGQLVAVPDIHAAIRQGLGAQAKLGPFRRA

SEQ ID NO: 21056 - protein, 320 aa, Pseudomonas aeruginosa
AARPRLGTTDAPPRSGTAARTGTPSRPRPAPERPGWQPLVRAPAAACASRPARQPRTRRPAGARQRRFAATHRDPRHQSSPALPATHAPVDLADHEPVGAGHGAARRLGHRRQPGAAATDARSRRAGFRQLPHHPPRRQPDARGAARTGRRAERHAGAPGRSLPAPLGVLRRHRPRVAHPAHQPADPDPGGTVPPALAGGLSRGPARQPRGAGTAHRDGQRHAVAGQGRPRPAGAQPPGPGPGRGSRLAAGVLPAAGGRPRYPPAAPRQPEPAGRPRHAAAGAGQPAGQCPALHRRWRRDPHPSRRPAPERGEPGSGDSS

SEQ ID NO: 21057 - protein, 264 aa, Pseudomonas aeruginosa
NSPGECHPCRSVRRTARVGRPGSGPAPAATRRRSAAPLRSGPRRVAPAAYAAFPRTGRGTARRESRWSSPSTCRRRRGAPGPADRGRPAHSGRPGSGRWRWTPRGRSRRPRSPAPDRSGSSRGTPAHPPGRTPRRHPPSGTPGQPPRRTTAPCAHCSSSSGPRWSTYSAFPLRLMRRMGRRSARTTCRTLPRMDRRRKTRRLMVTIDALHLVRPQPGNRRPGPAGGRRTGADSAAAGERRTVPPAGRRTGRDRPGIPCSARPGG

SEQ ID NO: 21058 - protein, 998 aa, Pseudomonas aeruginosa
ARDAAWRLHGGFRMLLLWLVVLVLGVAYLAHRRTPPAPALGISAAYLILMGVFSHAPGWLLLVFWLLWLAVALPLALPDLRRRVLSGPLFAWFQKVLPPMSDTEREAIEAGTVWWDGELFSGRPDWQKLLDYPKAQLTEEEQAFVDGPTEELCAMVSDWDIGQRMDLPEEAWAFIKQHGFFGLIIPKEYGGKGFSAFAHSQVVMKLATRSGDLASTVMVPNSLGPAELLLHYGTDEQRQRYLPSLAKGDDIPCFALTGPYAGSDAGGMTDVGIVCKGEWEGREVLGLRLTWEKRYITLGPVATLLGLAFKCHDPDHLLGDEEDLGITLALIPTDTPGVEIGRRHVPLGAAFMNGPNSGKDVFVPLEYIIGGQEMIGKGWMMLMNCLSVGRSISLPAVGTSAGKASSYVSGRYAQVREQFNVPIAAFEGIQEALARIGGNAWLMDSARILTANAVDLGEKPSVLSAILKYHLTERGRECIAHAMDIHGGKGIIMGPNNYLGRSWQGAPIFITVEGANILSRNLMIFGQGAIRCHPYVLKEMELAQREDKDQAAREFDALLVKHIGFAVGNAASSFLLSLSCGHLGNAPGDRISRPYFRALNRLAASFALLADFSMMLLGGELKRKERLSARLGDVLSYLYLGSAALKRYHDLGNPDYLHPLLRWAMEENLGKPEAALEDLLNNFPSRFFGCALKVLVLQFGRRHKGPGDELDAEIAEIIDRPDDDPALQGDHRRRVPAEGPAGPGRCPRPRLRRGTRKRRAGENPAQGDQGRQGPAASGAEPDRCRRRRRRAERRAGAGPAPGRSGTAQGDRRRRLRQGGTATGRRQDPLTLRGKATVATDKGAFRRLCRLHPPKPGRLARIDGHIPDVREAIMLKLLATGLAASFLLLPPAQAAPPAPYGVQPHQQAVQRAGEQRQRQLQEQRQRFDEQRLQLQQDQLQRQQQNLQRQRQQRQMQDNLIRQQQLDQQRWRLEQDQRRLDSERRQLENRRRQSQSPAIR

SEQ ID NO: 21059 - protein, 187 aa, Pseudomonas aeruginosa
NWPAPRNPLYCPAFFQRTRHGQLLPRAPPRPAPAPAQHPRRPGRGRAGAGRKPRVVPRAFRRADGRTAARPGRRPIPRPGPDFPGLPPLSADRPPGTSRPAVVLRRRLPALHAGRRDRPVPAPRRAPLRSRRARRNVRLEPRKAVARAARGQPAALSPPRPPAVPPRPPSVRSGPPPASPNLATLSE

SEQ ID NO: 21060 - protein, 378 aa, Pseudomonas aeruginosa
HPSWRSDRGNRADPAEPPRDLRLRLRRGVGADPPPTSLRPVDRRHGIPQPRAGPPLFAPARSLRFRREGLPASPGVAPGAPSPGQPGERTARGSLRDTTDQPEHPSSDAQRQPPEAQRATANMETRRADQLPQRPDPDQRPRSPTTQGRTAGRAPVTQVTASPTARLTDCSPTRATREVAVMDRPNQPGGNETGSDRLFEESWRAAQAGLRKRAQRLARGNSHRAEEWLSSTAVKAMLFLRQSPERVRDPQGFLFLVLEHVYLDSARHQIREDRLIDRGIDLHDGQLERFAAVGSPLERLEQLERLDQVDKALASLSRQQQQLFELRFIEELPYADIASQLGIAPPLVRKRVQLLRSRLSADFFAGDVSQDRRSRVHS

SEQ ID NO: 21061 - protein, 103 aa, Pseudomonas aeruginosa
QASRGPCDRPPCPTSTCPFKESPMADPTAVNAQITDAVTQTNVKVVAEAPAQAIAALYQIASHSAGLSLQNAVYSQQALNQISTAVVSKAVSMIMAIEDKKGI

SEQ ID NO: 21062 - protein, 216 aa, Pseudomonas aeruginosa
SQECPDMFGFGKKSAPAPAPSGDSEQAAAPGEAGRQTPASGGRASANGDVKLPSRPSPLAGMSERLLKQTEAPPPDTSALNSQVVQAVQMSNSETAGYAPSQIAIAPNMMISQASGLVAQSAASYFDGVSKIALASQAILLRQMTQNIAENKLAQAAEDALGALATDLLMGAAAAVAAAAGAIEAESASFAIDKIDQSIAKYSETLASRGGKDTQS

SEQ ID NO: 21063 - protein, 127 aa, Pseudomonas aeruginosa
VSARSTAPRRIATFQFEAYRRLFAQVLNWRSYLLGADGQGVEHSNVQDEAIRMALLLNYAAADRHGRVPVASLENAQRLLVQLGSAYWEETIGAVDLAGAPHRDRELQRFEGFAAPASVVRISTRSS

SEQ ID NO: 21064 - protein, 155 aa, Pseudomonas aeruginosa
GATDERLRTLHQTPRARRRGPPGAAFAGRQRGDTGPTAPQQAGERKAPAGNIGQRCGQALGRAETARMSTHPRRSVMKEELETLVTQVKALLTECLQGWLQALSQGDSVDDPASLGQLAVQLSTAYSTLQAAAAAYPGDTGGSAQAPSADGTQQY

SEQ ID NO: 21065 - protein, 321 aa, Pseudomonas aeruginosa
APISSLRPHRSMGRQLIDSCISSKTRPPAADANGLLRLRLGHRLKRPSQAITTQQPLGKKGAGDVAHPKGDEDMHKDISTSKVFYRPIEAAIRWAGLLRYLPMILATIASPRVLPRSLNCPRWNECRLHSERIYDGILNGELPYGKNGITLNDPKLLNSLDLTVRHVDLKRWMRTHYPEHRPGFLFSRGERMAHPFITMETGQAILVERLALQAALEQARREMRELQEQHDTLLKQSSVLLASKQCEISERAETTYLNIIGGMLTLMLSQSPSGVPYSSFKTQEALVSALVAHYGGTMGITERTLNGKFANAKRYVRSASA

SEQ ID NO: 21066 - protein, 153 aa, Pseudomonas aeruginosa
KRIHAPQRAACQCIGSSTASRPAESPLPRSTRCARSPASCSRNGRTDWLKYPAARSDLLILGGPMANAHELARGHKRLRALIEFAVGEGWHVKRTPGGHLKFTKAGCAAIYTSWTASDHRAELNARAQIRRAEREARMAPAGGRGDCEGCGHG

SEQ ID NO: 21067 - protein, 377 aa, Pseudomonas aeruginosa
AHRLAGTDDRTAAVDPAHGRRPVGRCAAARLLGERVAVHPGASRRTLSDLRCLVHRRGPGHARSAAHPHRAVRARDRRGGRPGRVHRGSRRWHRVCVPRPRPSPVAARPRGADAPHFPDGSARRRSGPGRRAARHRPADPVARPEPRPWQRRKALERHGVGQALSAAPLGPASAGPGSRHHGARDVSEGGRMSTSHPLNQAVIAQALYDLRNGQLRRCKAMGFGEAELDALKHPALISVLANASVSWCSVTVNREVLQRLLNQAQDVEKEIATVDRMLRLGASTEMVSRFYGLTHQEVALRREILGLPKRKGRHPVLDETQDTELWRQWKAVTSSRNVDLEDETSILDAAMDLAEGMSLPLSVVWAAIRNWVDQGLG

SEQ ID NO: 21068 - protein, 411 aa, Pseudomonas aeruginosa
AMAVDDTAPRAPRQGPIALADLFDAALKDLTPKPHPSAPAPMAVPTPAASGDAFLFSGNRHESVPRRLFLDRRLTPLERNAWQVFRLMLNDDGVTAFSTYEQLRPWLASMPCAGQASHETVARALTLLRLTRWLSLVRRRRDPKTGRILGNLYVLHDEPLTPFEAMQLDADYLALVSQSLGHSAKAVQVVGLNTLQEIADDPMLSGRTLPSRLQVLAERLADQGITATESYPQEDAIHDSEEGPASLLRNGERPSSESEAGPKPAPDGALRNPKQDRTVRSSSINEVRTTAQARALGDLQWPKRFAELKAEQQAGARMALQQVDAALGQAVLDEWAARCGKHGIRNPAGYLFGIIQRAMRGEFNAWAKQTGPAPPTPSAARAPPSEPPRNVVPPEVARQHIERLRDLLRKT

SEQ ID NO: 21069 - protein, 195 aa, Pseudomonas aeruginosa
CGRCCRPIRKRSHCRRGRIRMSDLNQPTRYFRGLQQGAFMRLEHAASLKGLLKPFKGKGDLEAWASQCFAMRDELIGLAQRQVLQQASGHPFHLLPVELAQQTTGSGTTFLRWRRHDRSAMGVALWQELMASTSTPVNLLADLHAIELQRITLNMQISLLHTLGRQAQDCASKAAEAEDAYLRRLTSFPAAMRDR

SEQ ID NO: 21070 - protein, 678 aa, Pseudomonas aeruginosa
TTGSGWTDMRLFLCEKPSQGKDIGRILGATQRGEGCLNGSGVTVTWCIGHLVEAAAPEVYDAALKRWSLEQLPIIPQQWRVEVKPQTATQFKVVKTLLAKATHLVIATDADREGELIAREIIDLCGYRGPIARLWLSALNDASIRTALAKLRPSAETLPMYYSALARSRADWLVGMNLSRLFTVLGRQAGYDGVLSVGRVQTPTLKLVVDRDREIAAFESVPYWAIDVSLSAGGQTFTAQWVAPDASTDDAGRCLQQPVAQQAAQQIRAAGSAQVVSVETERVREGPPLLFDLGTLQEVCSKQLGLDVQETLEIAQALYETHKATTYPRSDSGYLPESMFAEVPTVLDSLLKTDPSLRPITEQLDRSVRSRAWNDGKVTAHHGIIPTLEPANLSAMSEKERAVYRLIRAHYLAQFLPHHEFDRTVADLSCGQQKLVATGKQVVAKGWRLVPAEPQADEDGDGAARSQVLPALRDGMACQIAGADIKALKTMPPKPYTQGELIKAMKGVARFVTDPRLKQKLKDTTGIGTEATRANIISGLIARGYIVKKGRSIRASDAAFTLIDAVPAAIADPGTTAVWEQALDMIEGGQLTLDVFIGKQAAWISQLIAQHSSTSLSIKVPQGPACPQCGAPTRQRTGKSGPFWSCSRYPDCKGTLPVETGTSKRGASRPRKSGRKGS

SEQ ID NO: 21071 - protein, 584 aa, Pseudomonas aeruginosa
RRPGLPISPRVVLLSSRAEGPWGLRRLSPAFQRPGQGDGPAPYEQETDMHPKLCAPPRNTPLLYGSVCSGIEAVSLAWQPLGLEAAWFAEIEPFPSAVLAHRYPRVPNLGDMTTIARQVRAGTVPAPDLLVGGTPCQSFSVAGARRGLADPRGALTLAYVELANAIDQTRRQDRRPPATLVWENVPGVLSDRSNAFGHFLGALAGESRALEPPGQKWAHAGCVSGPRRRIAWRLLDAQYFGVAQRRRRVFLVASGGGGVDPAEVLFERPGLRGDSSPGFAPWQDAAGAAGSGAAAAGWYSGYPGLKQPYGKATVTFGFGGGNTAGPIDVAACLTAAPGPKNDFEVETFVAQSVAGSISHTLSTANGGKGCSEDGTGKGVPIIAFTAQGCGADATTNHAPTLRAGGHRLSHANAGVVPAIAFAQNSRGELRLESGHGQLAGTLSTGGAKPGQGRPMVIGVALRGRTEGLAAELGDGVSTALRTSSGGADKPHVLAPDFEAHFRYDWNDPGPGDWSQWRVRRLMPVECERLQGMPDDYTLVPYRGKPAADAPRYKAIGNSMAVPCVAWLGQRLVQCLHKTGSSATD

SEQ ID NO: 21072 - protein, 266 aa, Pseudomonas aeruginosa
CTTRPAGRAILPPALPTHRQQPAARVSRLPWVPPTPPASSPRHLTGERCPPGIDATFLQPTGCMPRPVRGVSSTRSISGLSMDTITRQDRITLKNLKVADFASEETLCFTATVMFDGRPMAEARNDGHGGSTFVRALQGQAALLAQAEEFAKSLPPASLDVEREDDEPLLIDMTLDFLVDQLADAMHAERKLRTAFNRDIGNKVLFIKDGRLLFLKGIKLKAIADRAAYFAKLRSRQDQPIVILAELPADEAFAIWKQHVLGDKPR

SEQ ID NO: 21073 - protein, 135 aa, Pseudomonas aeruginosa
FVSTCQQPGFQAAAGFSPRNPPVRIASIARTRVPKTLMLFFNRVRELPSREGQGPAFPRSPSMSQQASFGRFGQLALTYCGKFLPLEVLHSAAGHYIGTRDTEGPVSRESREYFRSHAAAQRALERGGWSQLAIP

SEQ ID NO: 21074 - protein, 137 aa, Pseudomonas aeruginosa
SKWRNHVMNQLLPQEVVDQIVREERHFSAAPQAFFEAWKRGVEIAGPQWFGDGTREGLNQAKSKWDLRPDMLRLNDALGVLSSGERMFLSAMVSFYNAREGGAMLKRCHFNGLSDFDGLDLPRRQVIADLLLNYSGW

SEQ ID NO: 21075 - protein, 406 aa, Pseudomonas aeruginosa
RLRHGRLRRWQYQRRCMETCLLPASARALLRLRSLTQPAPSEGLFLARGAGKRARLGALSCGPVAHSGRHPCFHVRRRCRHMPRQSRPSRLQARETVLVDSSYGPTASIHATHKGPLPCGRGIPCFSSRSFPMDRSLIKSMMPSLVAGHVPRNVRSFKYRVFDDQPLSSTLGFAIDPQPFDGKVVAATDDAIVVKLKPSEFAVLDPSLVTTVPAEGAKVHVQPYARRRFDGLRADTPEVITEKTSDGTPYTITRHILGSAPAKLPIPTPQCMELGQLIEQLEEMPAPDRFRRITHMLVDAGARDFTWVDPTPSKIIETPPAISFTVSTAKFEGRVTILYDRGGDTYVVELHRQNGESVELVDRHDEVYFDMLGEVLERLIDDGRWRQIDVSILDAKAARKRQAVPA

SEQ ID NO: 21076 - protein, 158 aa, Pseudomonas aeruginosa
RPSADPRHPPRRSSHSCRVPYRPFIPSGGGPFSFFTQEISSMSLRFKGADLRPVLTEAIANQCRIVLVKDQGVYFLAERGERRPDGRQQLLAYAVGCNPDTDPFDDWWHLAGRELGGDDFAEYFDPKDGLFTRLLHSADDLVLSATATHLSLAVVPPA

SEQ ID NO: 21077 - protein, 217 aa, Pseudomonas aeruginosa
SGNGRAAIAAPAPGAFFCSHHGHRRACAFVSSRQGTPRGPQRRHATGDDRMNTSSTSPRLHLLPVSLRTANVFVLAHHHRPVQAAKFALAVTLVDSDLIRGVAIVGRPVARHLDDGWTLEVTRLCTDGTPNACSKLYGAAWQAAKSLGYIRLITYTLPDEGGASLRAAGWRLIGARGGGAWSRPSRPLADTPEHLRRPKCLWQAPGGADKGKHPDAD

SEQ ID NO: 21078 - protein, 245 aa, Pseudomonas aeruginosa
GRSGGLCKLRARTQVRRSSQVHACHGEPTAGTPAMGRPQERPVGRLQPRPGEPRQRRPERTQGQRPQSAHPSGARHRPEPAPEPGVVAAGRRHAPAQGVMPRGPRPPRARPFLSSTGCRRRPVIHHQENHHGNPIGFREIGCAHRRPRPAHAAYHPRQERPVHGWPPRHAPRYVRGQRPGAGAVPRMQVRRGIHNQVHLPEVLSGRRRHAVRDPCQPRRHDAQRHRQTQPRRSPQLRHPGRRSAR

SEQ ID NO: 21079 - protein, 166 aa, Pseudomonas aeruginosa
VFLRCTCGIPSPTGGSSPRGGLQLNFSRRPLMGWYFSPQSRSELITELIAPQQTERVSAKVIAHALRGNVLWSVVELTAKVEGVHRDLAPGQSLRYIRCDLLERSGNQWGYKPLEESMHPYYYSCPLSYLDLAPEQSADWRAGVRAYHARRRTPTAVTAPAAALLA

SEQ ID NO: 21080 - protein, 278 aa, Pseudomonas aeruginosa
PTATSTSTTSTWTASRRSPRWTRRFTSIRTPDSSSRTERFSSTPWGSTCPSGRCCSRSSEDTTMPANTSSTLYRIDECPDVMADACVGDDQGNLIFLSIWARDTAVQQFLARLTLGRDEQGLDQFHVITDQGGSVPVFIGNVDRLEKRITRAYRRTLFGSLSNVWLFDRRCVKPDKANASALALLPRDSAHRLDRLWMLVRDTCPLPLLDHWRETVLELLQSREMLARLPSALGPLEGHRLAIDVPALSLALGSLIRSDALTAYPYPAKIWTPEAVAA

SEQ ID NO: 21081 - protein, 176 aa, Pseudomonas aeruginosa
HPQGQDAPAGIHRTRRRLHRRDTHPHRQVRACHPRVGHDAWLPDTGRGVDHSLIHRTRCRPAVPTRRRNTMIPNPFKRPAPHKQPLFTPSTLKLSEKVHWLARRGLIDPLAYVQRHVRGDWGEIDEATRQANDVAIQQDNLMISQFRITPDLALIVKTSEDHQTTVVQLPEERDLI

SEQ ID NO: 21082 - protein, 423 aa, Pseudomonas aeruginosa
STRDSPFASSPMRGAASLPSCCRPKTEHGSPAGHSGQHLQPPSAARRFPSHHGACHCPAGGGACPIFHWSITMSFDLETTAADAAPVQGELLDAESSPLTLSLQDFVGEFGDELLDALNSANPPVYTGQPQAHRQLIVASLKRKLFPAQAEVVHAAAELLIDRGERAAIVNGEMGCGKTTVGIAAAAVLNAEGYRRTLVLSPPHLVYKWRREIQETVAGAKVWVLNGPDTLVKLLKLREQLGVQPTGQEFFVLGRVRMRMGFHWKPVFTQRRTRHGDVAACPDCGTVITDLDGEPVNPVALEAEEYRRKCSHCAAPLWTLIRPRSLSGSDQSSAVLKALKRIPTIGEVTAQKLMQKFGDGFLASMLGDNIHEFINLMDGNGELVFSDRQATRMERAMANMEFGFGEGGYQPSEFIKRVRREVV

SEQ ID NO: 21083 - protein, 76 aa, Pseudomonas aeruginosa
SCRDNVAGPSGRANAVRQGVICEHQCGYGARLGGMTNESELLLNTVMNDKPKMLTGLNQKVCGRLPFIRFGGTRTS

SEQ ID NO: 21084 - protein, 450 aa, Pseudomonas aeruginosa
SRLAKAGFERLEPYEGKLSRTVLRGGWASNGLSLPDYLPQGTFDLLIADEAHEYKNGGSAQGQAMGVLAAKARKTLLLTGTLMGGYGDDLFHLLFRALPGRMIEDGYRPTTSGSMTSAAMAFMRDHGVLKDIYSESTGTAHKTAKGTKVSVRTVKAPGFGPKGVLRCILPFTIFLKLKDIGGNVLPPYDEEFREVAMDTAQAAAYRDLAGRLTAELKQALARRDTTLLGVVLNVLLAWPDCCFRSETVVHPRTRNTLAFVPAQFNEFEISPKERELIDICKEEKAQGRKVLAYTVYTGTRDTTSRLKVLLEQEGFKVAVLRASVDASRREDWIAEQLDRGIDVLITNPELVKTGLDLLEFPTIVFMQSGYNVYSLQQAARRSWRIGQKQPVRVIYLGYAGSSQMTCLELMAKKIMVSQSTSGDVPESGLDVLNQDGDSVEVALARQLVAA

SEQ ID NO: 21085 - protein, 210 aa, Pseudomonas aeruginosa
PRRRARPRYRHRNRRADAMPAIHVSRHLVGAGLLAAALASGCATTTAPLAPDAIEEVSAAPEPEAPEYIPVVRYGRYTLVELAPTAAQRDLLLQTIDVSMPEDARATVGDGMRHVLKRSGYGLCETAHAVIELYALPLPAAHLHLGPMTLRHALLTLAGPSWELHADDRARQICFDRPGDRAVAESPSGPLATETVQTFPLAPAVSGGQP

SEQ ID NO: 21086 - protein, 384 aa, Pseudomonas aeruginosa
TANGSASRSCPRIAVLARTGALCRRVCQHPPCPGGPATGLPACRPARGHPFDGALRRGLAGERHPAQRAHRPMAVVPQRRRPIAPLRHARRRLRWPAAGDARHAAHAHRRGPGPDQPWLPQAPLHRRVRSAGPVPQPRRCRRDPEGAARPRRGLAAGDRPLPPPRWRRARRPLSAQRVPPPCPRAGHAPNRRGLRRAPGDLPMTKPHPVQLALTGLLMLLSGLPLASRAGEPLIVVEDRGGTSALPYYEALNLQPRANAPARPPIPTPRVPATPADEAAMLPVRSSKLTPGTVARRVIEAPGLRPFAVIGDDEASRVWLQRRAAALRERGAVGLVVNVETAQSLARLRALVPGVPLAPVAGDDLADRLGLRHYPALITATGIEQ

SEQ ID NO: 21087 - protein, 140 aa, Pseudomonas aeruginosa
IHPAHQQGRRCRPASHGVHADALGHRGPHRKSREGRPSDREFQQFIHVARARDGHRGTADEAVAEGRGLYNHHRLGRDGQLRHPRRDGFHVEHPGPHQHGQRADDRAVTRRRPAQGPVLRAAAGRPALEGAYAAAGAGPG

SEQ ID NO: 21088 - protein, 316 aa, Pseudomonas aeruginosa
SDAGGPAATGRVHAPELQRGHAVVGVHQLVGLAGCGLARRPAGRCRCGRARRGGHRRRRWRGQRGRAMKDAASTAQREQNHRQGLIVGTITLPFRLLGVLIGSLLFSIVVECAGMHLFWKDQGWRHSQQMLRYELGHLSNHFTRSVVVQEPGRTAHELVDTGYEWVFVRSGLLERMSQTAERVRAPSHGQSRNFRYYISQVYVWAESYLIAAAFTTLTFLVRLLVLVLTLPLILTAAFVGLIDGLVRRDVRRFGAGRESGFIYHRAKASLMPLAVLPWVTYLALPISVHPLVILLPSAALLGMAVSLTAGSFKKYL

SEQ ID NO: 21089 - protein, 124 aa, Pseudomonas aeruginosa
PGARARRHPVPPDAITRSAARPLRTGRRLPHRAGRFAIAEDDCGGRAMNGAQVSAFQANSGIAPSAMATVLVGVVLAVLLVWGVWAIRTAYVGWSESRLNQRQFLGVCIRFVAMYLVLSFFLLS

SEQ ID NO: 21090 - protein, 125 aa, Pseudomonas aeruginosa
  UNSURE (79): Identity of amino acid at the above locations are unknown.
PERPDHAQPQPHFPFCPARRRGHGRRRAARAVVRARSAAIGEPQRAAPATGIMETIRNYGYDIIMLVALLVVASMFIGXWYHAYGTYAEIHTGRKTWGQFGLTVAIGAVLLVIGIWLLTEATGIL

SEQ ID NO: 21091 - protein, 420 aa, Pseudomonas aeruginosa
  UNSURE (288): Identity of amino acid at the above locations are unknown.
LPPLHGRAASARARHLRDSRPRLWRRPHGARAHRVRSRLGGDAGHHGGRVLRRRAGQARPGALSDQGHAGGRRSRPQPVRPGAGLLRRRAPAHQCTGADAPGAEWPVSASASRRKHPMKHPVLALLGLLAVAAAPVAQAVEILRWERMPLAVPLKVGQERIVFIDRNVRVGVPAGVGERLRVQSASGAVYLRASEPIEPTRLQLQDADTGALILLDIVAEPPKDGEAELEPVRIVEGDSAPGRYGEQPDSAEAPARAQGQAGARTARRETPVPVVLTRFAAQNFYAPXRTVEPLPGVMRVNLPRDLDLDTLMPTLPVRAAVLASWRLEDQWVTAVRLTNTGADWVALDPRVLQGDFLTATFQHEALGPRGTPEDTTVLYLVTRGRGLAQSLLPAIHRFDPAVHLPQPDGDENAKEARHAQ

SEQ ID NO: 21092 - protein, 513 aa, Pseudomonas aeruginosa
TGREPVGAPALCPGRTELRPVHADLARLRAVTCARFGVHRVLPALLRPPPARCGQARRPVRGHGGHAAALARPDAARAHGGVPPRERSGTGKPPRPDTRADAGHRLRSPVRRAGECRHPGPAHGCSGRSRLAAAMVQPAPHAARSWGGGPGALLLAGALPGRDRGRRDRVGERAGFQPAVVLRAAALGRGARGLVLRRHAAPRADHRPAAHAARHGAPDRRDPQGGRDQHAVRPDARGHLDVSHDGRHAAGCPGIGSEPPGEESRGRDAGVGADPQGRARGPLPDRQRAQALPGHAGVLPARARRGGTGSARPGPGERHAQRRLATGARGRRGGAAQQLPALAAVLLQPRQGSAPLVHAADVRPARGEPVAGVGPRPGHGAPRHHDVQSRRRPDYVRPLEQVGSADECPSVSVWPYGLGQVRHAQQPAEPGDGHLPAAAFHRGSRQQLRPVQRLRAAPGPDREPGQAGPRIGHQPGAVRRRTPADRNAQRRADARCRCPGRRPATGCLGHGGG

SEQ ID NO: 21093 - protein, 302 aa, Pseudomonas aeruginosa
AARRARRTGDHGTADDHGRRRQGRSADDAGRPLADPPVHPRRRRTLRGGEAHRAHARCAQCTAHPWPGPDVARDAPCAAAGDGGRDGHVLPRHGRRDVRPRRHAVARGRHHAGRSGDLCPRGLQRAALHRLHQPDQHGEQHRRARPVPGTADRQRDRRRSHHHQEPAARALCRENYKNVAQVGRLVLAGDAEHRRPATCSGADAQHDRVVGVPVDAAGRGGEDRALPRTLAGAEGADALRTQGSGQVHRGRHPLQEHGSAVPRRAAKSLPRARANRARGEGRTLPTHAAARRQRAGCRLQGG

SEQ ID NO: 21094 - protein, 155 aa, Pseudomonas aeruginosa
STSGAHDMPAAFIRFAPSWRTLGLAVALPVSLAVFSPATFAADVVVVTDSRHPVKTMGGERLIELDETPRMEAELSANLPADPERAAAIVRQGLNQGGADLQRRIAMAYQGVTDAWSLGVTTIPAVVVDQRYVVYGEPDVARAIARIEQHRRAQP

SEQ ID NO: 21095 - protein, 545 aa, Pseudomonas aeruginosa
GRRPGAAPPGAHRDRGRRRHRGAGSQPADAGGLRGDGAMTLFTTDYLEYYLTLVSWIVNNGIWAVLVSSGVFALPFVAIIVQEWLKARAEGADEGNKGVLSAARIENRVFVAIVVVMFAGIPFIDVDLNTIQYDSSRSAQCQVSVPQPSNTGWSQSFSTINNQSAKVPVWWAFMHTLSRAVTGASVAAIPCGTDLRQMRMEIDATRIDDPVLAQEVADFSRDCYGAARAKLFMQRPQLDEQQMHDVTWIGSRFFTDTNGYYDTYRSSTPREDWPYDSTRDAGLAQVASGGGYPTCRQWWSDGSNGLRARLLGQVDPSLLNRLAGWAGFLSRAEVDDSVIRTIASPRQQKLNQGSVYTDYGGQIDKTLPNIVTRATGDVGMAVGAIAAFPAMDVARQALPMVLALLKMALVICIPLVLVVGTYDLKTVVTVSVVQFALFFTDFWFQLARWIDSTILDALYGWGFGWNRPHTNFDPLVGLNNAFGDMLLMFVTGTMFIVLPTFWIMALAWAGVRAGNVLQGLAGATGDAKAAGGRGGSIAINAVSKK

SEQ ID NO: 21096 - protein, 332 aa, Pseudomonas aeruginosa
ETGSRQTPNPLRTPNRMNTHKHARLTFARRLEMVKQMTLEGLDAVRAAAAHGVTAPTARKWLGRYLAGGQAALADASSRPLRSPRAIDAGKALLIVELRKRRMLQARIARSVGVSESTVSRVLARAGMSRLSDLEPVEAVVRYEHEAPGDLLHIDTKKLGRIVRPSHRVTGNRRDSVDGAGWETLFVAIDDHARLAFTAMHPDEKTAQAVLFLRNAVAYYARLGITVQRLLTDNGAAFRSREFRSTCVELGIKHNFTRPYRPQTNGKAERFIQSALREWAYGWTYQNSAHRTDALASWQHHYNWHRPHSGIGGIAPMSRLNSSRNNLLTLHI

SEQ ID NO: 21097 - protein, 282 aa, Pseudomonas aeruginosa
RSRGSPPDCATPDEGRRGATFGVLCGGGALCILDSLFGAIQCRFLQIRDWPHEADPDFRLPILRSISMRVILLGAPGAGKGTQARFITEKFGIPQISTGDMLRAAVKAGSPLGQQVKGVMDSGGLVSDDIIIALIKERITEADCAKGFLFDGFPRTIPQAEALKDAGVTIDHVVEIAVDDEEIVSRIAGRRVHPASGRVYHTEHNPPKVAGKDDVTGEELIQREDDKEETVRHRLSVYHSQTKPLVDFYQKLSAAEGTPKYHSIAGVGSVEQITAKVLSALS

SEQ ID NO: 21098 - protein, 279 aa, Pseudomonas aeruginosa
HRRPACGPSAFPGRRRLVQSASFSPRGTVDVHSVGPGYLHRSLLRRPAPRGAGAQSLRGDPAPARPAPAADGPRPARRGRRRPVRGGRHRLRARSGRLHRRAHRHRRGPGPGLRPAAPGTGGLRPGDPGPAGLPRAGCGAGRRGHRRADGRGLLGLLPVATGRDAPGRQRSGTAARAGRRTVGRRCRGLVRRRHRLGLRRAHAAAPGRAGREPAAACRGLAQPGRLRLGARRRRGGGTGAAGVPARQRGDAEKSALKMPRSGNCQAFRGWLECGDFPGF

SEQ ID NO: 21099 - protein, 171 aa, Pseudomonas aeruginosa
AAMRRWPWPATTPPPASTSTPAPRMSSASTSTPERFPALPWFPFLISSVVHPGTRRPGAAASIRANCVPPTTSDTTAASSTRSRAIPPSMPGLRRKPCGAGPRRCRRGSASVPSFPAISVTKATCANGSRPPATSSNCWRRLAKGSARCGCNCRRRSPRSAWANCCISSMS

SEQ ID NO: 21100 - protein, 276 aa, Pseudomonas aeruginosa
AWARILPGSPSALSIRRRRRWRGATWKRPVRRCLSTVSTTCSAEPVRRLAWLLPLLLLAGAIGALRYQWLDLPARWNPWLPLDVREPPNLLTRYKLWRLADDRSLCDAALATSQLRYQRVADDPPSATCPLSNSLRVRGAALELSSSFLASCPLAVSYALFERHVLQPAALDIYGQPLARVEHVGSFACRNVYNREDGRRSQHASANALDISGFRLADGRRIRLATDWAGESADGRFLPRVRDGACASFNAVLGPDYNAAHRDHFHLDMGLWKVCR

SEQ ID NO: 21101 - protein, 259 aa, Pseudomonas aeruginosa
ARAGQLWQNPRFPRRLPDHDRFRRSSPACPSPVRRLRRGCAALGGAARPAAGGGRRGGVRRAGRRAGLAGLATGGGLPRSGAGRFRRGRQRPPAQVRRRQRTDDRQGGRRPARHPPAGPGRHGRPGPGWVRPRQPGLRGYPGRAPAADRRPARGWPGARPARSRRGADRRADASARRQLGGPDARLGWRGAAGDLPRPDVSPSRQERIGEEGNASVPAAGGRRSRRPGAVAGGPGPGQPPGGGEAPAQGADHRRAQARL

SEQ ID NO: 21102 - protein, 398 aa, Pseudomonas aeruginosa
ELERSLRKVSHVPPYPARRPVPVFLPVPRRLRQRHAAASRGASGDRRPAPAGGGGEPGLSRRDPRPPRAGAGLPHRRQGHPPAGGSRRAGEEGPAPGRTRSPGRAPATGGGAGPGQCRRGQLADRARRVPALPHLARPQPGQPFPVREHPEQLPRRRGAAEADPRRIQRRRQPGRLRRAALAPGWRDRQPARRGGPGGGGRTDGLQPGRRRRTRGADRPAGTQLRTFPHRPAGVGRTLVATRQTLRRAYPRALARGRSAIAYLRRPGGLRRPRDSGRTGPERAGLRRRRRGGAVIGSLVGADRRGRPGVRLGGRAGQLDPAPAGGAHRSLCRGPGAGARRPEGWRLGGGHRGPGASRRAAGASDRPGQPHGETGGQGVVACPSTFPPGRCRIARSSCT

SEQ ID NO: 21103 - protein, 106 aa, Pseudomonas aeruginosa
PSPPSSARCCCSAWCRSSSSRPRRVWSCCWTSSWRRAPHCALPARKSSAWKKCCRAMTASTTTWPTSALARPASTCRWTSNCRRPASPRWWCWPRTWRAARRCASG

SEQ ID NO: 21104 - protein, 957 aa, Pseudomonas aeruginosa
SRGSGWPTAPRGRRPGTRLPGSRSGAPRAAGRYARGRRPHHRSWRSKSIAGYRSRRECWRRAAMAVFSWEPPFRRNKKTSGPLTRETSIGCRAGTGKGRRIFQRSDARPSRGGRRVSVGGRVVAFGGGFLGGALQRHLADRQTDLRRQHALGGAFGQFAEQFVVAQLAGLVLAQHAQVEKGLDEVAEQALVEELRGVQAMQDRQALGHHGAEVLQFLGGQGVLPRVEQQGDGHVEALQGLGYRTSEEDQQHVLPRAWRRADEGVVLLAQQVLFHQGRQPLVDHRVEFVQAPADEQFRLQVGIERAGEAQQLFAADPRVALEEAGDQRRQGEDVEDVVAVVGRQHRVLFVEIEDAAQRVLLLGQQVHALHVFDQGLAVAVRQGRAGRVGHLAQQRQVEVEDSRQGAFVEGLSAGGEQRQGDQVDRVDRRRVVEVAGDVLGQQVGGLRQPVGAVFRAEVLVLPVGLVAVEELVEMDRLAEVHPDLAKTLLQGADHLEQVEDRLLLLGRAAQFAEVGAAFQHALVADVDRHEDDRPARVTEEAAQGDGEHAGAWVEHAPGARTAALDEVLGGEAAGEQGVQVLVEHRGVELVALEAAAHEEGPAAAQDRADHRHVQVDPGGDVRRGQAVAEQQVGEQQVVDVAAVAGHVDDLVALGHVLHPLDVVDLDTFVQLVPEPAEDDFEEADHRIGEVRGDFIGVAQRDAFGLLLGYPFALAFLADRLAYQRRAQQALDQVAAVRQVGTDHRGLQVAEVHPEDTVDHAQRALVALALFHQLAQVDRRGELHAGLASEDQDARQLAQAPGDRPVVGEQQLPGARFAVRRLSPEHADRNDLRVVETVLADRGEHAHQGRRGAALILAAEPVGFGRQVEERRRLDGVAYRYRHHRTRQPGLAAFGIHYREIADRRLLQHVEHRLAAVDLQGEGRLVDGFRAYPEVQQAAQGAKTKAAERVAGHTVSTGS

SEQ ID NO: 21105 - protein, 572 aa, Pseudomonas aeruginosa
SLRVFRGPGRTRRRPPEQVGDHDRNKKPRQTLRLAGGGGRPVLPGGDGGGTGLPRSERRRQVHHHEDAHRLPGAQRRHREHLRLRHPQPHAAGAAADRLPPGRFALLRGNDRAGLPRFHRRDPWLPWCRQARAGRPGTGAAGTGRGAPADHRNPLQGLPPACRPGPGDPPRTAGAGARRAHRRARSEPEAPGPRTDPRPRAGAHRDHLHPYPRGSLGAVQPRPGDRRRAAAGGQHAAGAGQPLALPPGGDALQRRAPGCRGAGGAAGRGGHRGEPRRRQPDRPGAAGRGDLPPGQRAGRRARLADPRTGRGARPARRGIPQPDPGDGGMKQLPVIFKRELASYFATPLAYVFIIIFLVLAGVFTFYLGNFYERNQADLASFFAFHPWLYLFLVPALAMRLWAEERKSGSIELLMTLPLTRFEAVAGKFLAAWAFAGIALLLTFPMVLTVNYLGEPDNGAILAGYLGSWLLAGGYLAIGSCMSALAKNQVIAFILAVAACFLFMLSGFPLVLDAFSQWAPQWLLDAVASLSLLTRFDAVSKGVIDLRDLLYFVSLIVAWLAATAVAVDLKKAE

SEQ ID NO: 21106 - protein, 697 aa, Pseudomonas aeruginosa
RCPGTGAAAQLRQARRGTAARLRARGERQDSPAGDRSRAVLRERGQGHRVRPARNSPAAGRRQPVLRPGRQQRPGRSPGHTLLPARSGGVPRIRHQPPGADPGTAAAAGGRPDVVAAAQWRLRHGQPAADLAVDGHGGNPPAIRPAQPQERCHGNPAGGLGAAAGASQAVTRADAIRHRPVRPARGQAAGVRRPLQRGRQRQRFRRYAGWRQVVRPRAAVRGLGAAPAAGQGARRRRLCDVHQSWPGPASGPASGLAQLAARGAGPGRHRHCRPGKPDPGDARHPRKAPRSEHQLHAFAAKLGPGDAVRCLALRPAARPRRSDARAAPERPAAYSRRPYPGAGEECLRGGHRGASRRPEGGAQHQCHRRGRYRPAQRSHVGPGAGLLRPARAAALGRQRRAGGQRAGQPVGHRRADQRALPRPVQPAVRGGRAPAARGRDELPAKGGPAQAAPRRYRAATRRPPAGRRPGEGRRTDARTAGHGAPVHAGEAAHPQGAARGAVPVERRYRRTGPHPEAGQYRPGSLVAHGRRAARLALAAPAHGPGRALTHAAQYADRPAGAGGGAGRNLRLAAARARNRGTCLAGGRALAAGTGQRDAEWPAHAVCRRFAGYPGRAACGRVGPAGQGRLSGRPATLVGAARGVGRGAQARGEERQPEEPRAAWPGGAWRGAGATPEPALAVRRASGAAGGQGCAAWR

SEQ ID NO: 21107 - protein, 171 aa, Pseudomonas aeruginosa
AVEGQEEALQVVGIVVQAQRDTQGRRVPWRRCSSGIAQWWPARTAMPCSPSRWARSATCTPSTQKLASAACGSPSRLTPSRASRPASRRAWRAPSWAATSASSRVASQSMVAPRPIAAETAGVPASKPSGAAWKLASWKPVWRTISPPNCQCASCSRACGRPQSTPMPSGP

SEQ ID NO: 21108 - protein, 414 aa, Pseudomonas aeruginosa
RTRRRWRAPSGERGGELGSVVRVQRFVQLDGGLVGLALHRTVLRVAAEQQVGLTGQVAGLDHFHQGVLLVEQGDLGAGGDVQAGLDDVAIAQRDADAGVGADQAAFADADDDVAATGKGAHGRAAAAQVRPLADEHAGGYAAFDHARAFGAGVEVDETFVHHRGAFTDVGAQAHAGGVGDAYAGRDHVVGHLRELVDGEDFQQLALQSRFQLQFGQFGQVHRADVGPGHVRQEREDAAQVHSVRLDQAVGEQVQLEVGLRGGGRRGVFRQQGGDQRLLAFRQAREQGRLSGVDTLQGVGQLVGLLRSEGQRLVAGCVAKDRCDGGDDFARRLEQRQRVEHFQPGFLAVLGADAEGQAEQGLRHVGFLETEWNGQAGRRLSSRPSPALPSSAAQPRLNRRRARWPASSRPRWSPA

SEQ ID NO: 21109 - protein, 153 aa, Pseudomonas aeruginosa
IVVVRLAAGLLRTAGHALDAVQYGMALADLLHVVDVAHDAAAVAHLVAGLDQVGGDVQQAATGSDQVIGGAGGARGVGGGDLGLAGLPGLGGAVALGQCVLLEAAGGGGEHRGEQQCGSKSLACHGGIPLSEWALHPVLLRGVVLADATAGLD

SEQ ID NO: 21110 - protein, 620 aa, Pseudomonas aeruginosa
NSSDVLVREPWPGAPVVAAEGADARGRAAGLGKTVRIVRMSDSCLPIAMVQSTQSHRPGTKPEIPALMQTVYTVLTLLLVVGATRLAAQLLPLPLPLIQIAAGALLALPSLGLHIALDPELFLFLFIPPLLFVDGWRIPKREVWRMRWPILMMAFGLVFFTVVGAGYFIHLLIPEIPLAASFALAAVLSPTDALAVSAITQGRLPNRLMHLLEGEALMNDASGLVAFKFAIAAAMTGVFSLVDASLNFLLVAVGGLAIGVFLSWSLGRIRAWMISRGWDDPATHVVLMLLLPFASYMVAEHLGVSGILSAVAAGMMQSWVDLLPRQTSTRLLNRSVWSMLEFAFNGVVFLLLGLQLPDIMKSVANHHGDLLWRSSLLLAYVAAITAVLMLIRYGWVYGYWKLSLRIDRWRGKSPPGLSGISLRRLSALSALSGVRGAVTLAAVLSVPMSLMDGSAFPQRDLIIFIATSVILISLIGATIGLPLLLRGLPASNNGAHERERREAWRKTAEAAIRALESEELPQVEGNDAANTSRVAEARAQIMAEYRQSLDTAPTTDEARDQAQALEIADKALRLKALRAQRLELYRQRRNNEIDDETLGDILRELDQQESWLTNRFARWV

SEQ ID NO: 21111 - protein, 310 aa, Pseudomonas aeruginosa
VSARQAGHKGFLRATTQEDFEMAEITAAMVKELRERTGLGMMECKKALTAAGGDIEKAIDDMRAAGAIKAAKKAGNIAAEGSIAVKIAADNKAAVIIEVNSQTDFLALQDDFKGFVAESLEKAFNEKLTDAAPLVEAREEARLALVAKTGENVNIRRLTRVEGDVVGAYLHGHRIGVVVNLKGGNPELAKDIAMHVAASNPQFLSASEVSEEAIAKEKEIFLALNADKIAGKPENIVENMVKGRISKFLAEASLVEQPFVKNPEVKVGDLAKQAGAEIVSFVRYEVGEGIEKAEVDFAAEVAAQVAATKQ

SEQ ID NO: 21112 - protein, 311 aa, Pseudomonas aeruginosa
QRRFRLSPRKRLPADACGLFVKWGSVRGSFRVAGPLGGLARNAGAKSSPPTTARPSRIFIAAGEKVMAQQLSARQPRYKRILLKLSGEALMGSEEFGIDPKVLDRMALEIGQLVGIGVQVGLVIGGGNLFRGAALSAAGMDRVTGDHMGMLATVMNGLAMRDALERSNIPALVMSAISMVGVTDHYDRRKAMRHLGGGEVVIFSAGTGNPFFTTDSAACLRAIEIDADVVLKATKVDGVYTADPFKDPNAEKFERLTYDEVLDRKLGVMDLTAICLCRDQNMPLRVFNMNKPGALLNIVVGGAEGTLIEEG

SEQ ID NO: 21113 - protein, 617 aa, Pseudomonas aeruginosa
TTVRPRCLRGDGRRADGRSLPSAAACRSRAAAGAGLVDAGHRAGAHLPGKRRLLGRPLAPPGHGPADPVAGLAGAGPAQAVAAGQWPDHRRDGAGLGRGYRRLLLRQGLRQAQAGAAGQPRQELGRRLRRPGGQPGDHPGGRPLPRLVPRRAAPGPARRGAGGVRLDRRRPYRKHVQAPIRNQGQQQPAARPRWRAGSHRQPDGSHPGVRGPALGRWLGCAMSRPQRISVLGATGSIGLSTLDVVQRHPDRYEAFALTGFSRLAELEALCLRHRPVYAVVPEQAAAIALQGLLAAAGVRTRVLFGEQALCEVASAPEVDMVMAAIVGAAGLPSTLAAVEAGKRVLLANKEALVMSGALFMQAVKRSGAVLLPIDSEHNAIFQSLPRNYADGLERVGVRRILLTASGGPFRETPLEQLASVTPEQACAHPNWSMGRKISVDSASMMNKGLELIEACWLFDAQPSQVEVVIHPQSVIHSMVDYVDGSVIAQLGNPDMRTPISYAMAWPERIDSGVSPLDMFAVGRLDFQRPDEQRFPCLRLASQAAETGGSAPAMLNAANEVAVAAFLERHIRFSDIAVIIEDVLNREAVTAVESLDQVLAADRRARSVAGQWLTRHAG

SEQ ID NO: 21114 - protein, 242 aa, Pseudomonas aeruginosa
PAGTPGHRFRGAGEPGRPGRPGGRAGAAGGGWRARHRLERGQPAAGSPSRRERYAGSAGAGKRLECRFHPPGASGWLAEGRGQSRSHRLAGHPALAAGLAAGAGRTRPQGAGAGRRAEARRPLAEHRWHRRRRLAAGGGQRPCPSRAARPAQGAARRRSAGCCPGTGGARRGQGPERLHGGGGRRYRMAGGNAPRSELRTAGGGGSGAFPNLDHEPANARLHKENVARRALGKKLERADNHC

SEQ ID NO: 21115 - protein, 424 aa, Pseudomonas aeruginosa
LPVPVQGIERVEGRRRPRHAEETQAEAGPGRRGDHQERWLRHGHRTWRRGRRQAAIRHHPPGDRADEPAALMMSTLSYTLGQLAAHVGAEVRGDADLPIQGLATLQEAGPAQLSFLANPQYRKYLPESRAGAVLLTAADADGFAGTALVVANPYLAYASLSHLFDRKPKAAAGIHPTAIVAADAEVDPSASVGAYAVIESGARIGAGVSIGAHCVIGARSVIGEGGWLAPRVTLYHDVTIGARVSIQSGAVIGGEGFGFANEKGVWQKIAQIGGVTIGDDVEIGANTTIDRGALSDTLIGNGVKLDNQIMIAHNVQIGDHTAMAACVGISGSAKIGRHCMLAGGVGLVGHIEICDNVFVTGMTMVTRSITEPGSYSSGTAMQPAAEWKKSAARIRQLDDMARRLQQLEKRLAAVTSSGDASSDA

SEQ ID NO: 21116 - protein, 266 aa, Pseudomonas aeruginosa
NHLCGTQTMSLIDPRAIIDPSARLAADVQVGPWSIVGAEVEIGEGTVIGPHVVLKGPTKIGKHNRIYQFSSVGEDTPDLKYKGEPTRLVIGDHNVIREGVTIHRGTVQDRAETTIGDHNLIMAYAHIGHDSVIGNHCILVNNTALAGHVHVDDWAILSGYTLVHQYCRIGAHSFSGMGSAIGKDVPAYVTVFGNPAEARSMNFEGMRRRGFSSEAIHALRRAYKVVYRQGHTVEEALAELAESAAQFPEVAVFRDSIQSATRGITR

SEQ ID NO: 21117 - protein, 379 aa, Pseudomonas aeruginosa
AMADGLRVALVAGEASGDILGAGLMQALRARHPDIEFIGVGGPRMEAEGLSSYFPMERLSVMGLVEVLGRLPELLRRRKRLIRTLIEARPDVMIGIDAPDFTLGVEHKLRQAGLRTVHYVSPSVWAWRQKRVLKIREACDLMLALFPFEARFYEEHGVPVRFVGHPLANTIPLQADRAAARARLGLPADGQVLALMPGSRGGEVGKLGALFLDTAQRLLVERPGLRFVLPCASAARREQIEQMLQGREPLPLTLLDGASHEALAACDAVLIASGTATLEALLYKRPMVVAYRVAGLTYRILKRLVKSPYISLPNLLAGRLLVPELIQDAATPQALAATLLPLLDDGSQQVEFFDAIHRALRQDASAQAAEAVLQLVERR

SEQ ID NO: 21118 - protein, 270 aa, Pseudomonas aeruginosa
VAGASLRPPDELRRAVSHPAHWYDRQARHSPGLSHEERKHAGGAARIPSVTGPGALARSGGLVRGVFRRAGFHGVAASARPTGPERSLAGAVGAACPPWLAGCGGRLAGALPGGLPVAGYPAAGRAGAGRRWRQHRAGGARRPLSRIPGEPGRGTGAAHRAAPRRPGRDPAVPPVAWSGPARPGGDAGEPAAGRRPPVPTLARGFPRRTGSLCAGAPAGLGGGSFQPGSALLAQLPAPGDHAASRLPLAAGRRRHGALRGASARGRRPAG

SEQ ID NO: 21119 - protein, 159 aa, Pseudomonas aeruginosa
PLGRLGVVARCRRRCRPDLAPGERRAASRRGADLVVAGGLAGGGGTVRLGASRSSIASSRQWSAGVARRGSGGAVARRLPAGWGGAGPGRARSPRPQAIAQRSGRTELPARSFAAALPSRRTARGGQHSWPGQSPRGGLATVLEPADERPGFELVSRFQ

SEQ ID NO: 21120 - protein, 547 aa, Pseudomonas aeruginosa
LLGFFMTRYIFVTGGVVSSLGKGIASASLAAILEARGLKITMLKLDPYINVDPGTMSPFQHGEVFVTQDGAETDLDLGHYERFVRTTMTQNNNFTTGRVYMDVLRKERRGDYLGATVQVIPHITDEIKRRIIKGAGDADVALVEIGGTVGDIESQPFLEAIRQLRVEIGAKRAMLMHLTLVPYIATAGETKTKPTQHSVKELRSIGLQPDVLVCRSDHPIDVSSRRKIALFTNVEEHAVIALEDVDTIYRIPSVLHAQGLDDIVVERFGLECGQADLSEWDRVVDAKLNPEREVTIAMVGKYMELLDAYKSLIEAMTHAGIQSRTKVNLRYIDSEDIEQQGTSLLEGVDAILVPGGFGLRGVEGKISTVQYARENKIPYLGICLGMQVAVIEYARNVLGWSDANSTEFDKSSGHPVVGLITEWQDATGATEIRTEASDLGGTMRLGAQECQLQTGTLVHDCYAKDVIVERHRHRYEVNNNLLPQLEQAGLKISGRSGDGALVEVVESPEHPWFVACQFHPEFTSTPRDGHPLFSGFVNAALKYSGKA

SEQ ID NO: 21121 - protein, 109 aa, Pseudomonas aeruginosa
RGGKSHPFSSQGVRGLRLRSPYWLFVVLILALAGLQYRLWVGDGSLAQVRDLQKQIADQHGENERLLERNRILEAEVAELKKGTETVEERARHELGMVKDGETLYQLAK

SEQ ID NO: 21122 - protein, 280 aa, Pseudomonas aeruginosa
GRARRVPNWSQKIATRVPPMTLPMPTTQKCTWPSIERYIQPVSQPPARTMPMPKRMPPMIAFGPIQKIFGATPRRIAAKVPMQAAAMPSRMPKAARVRPVVQRSRAALVKQICARSIRPPNSRPNRQAMPSTSDTSKRQAANSAASASTARPRRACRRARRARLSALGRALAVAPTFSGVRRNGSRLIFTPIQAPPTVANMKAQACRENIGIPVKNAARLQPIARRAPKPATIPPTRPCSRRRLLVGQRRLTLPAQRAQHRAPRNMPMIITPSIRSSGVP

SEQ ID NO: 21123 - protein, 697 aa, Pseudomonas aeruginosa
NAVFYTFRFSGSLSGPPASIVQEFPDDQVPCRRRLRPQQAVGNRRGGCGAAAEGRGTGAHRRHRRLPYRRVHPVRPGFRGGVPVHPGPRRWRHRRSGGRGRDLPAGGRPCHPALHRRVRQVQILPVRQDQPLPGRARHPGQGPDARRHQPFLLQGRAGLPLHGLLDLLRIHRAAGNLPGEDSQGCPAGEGLPAWLRRHHRDRCRAEHRQGGRGRYRCHLRPGRHRPGSDHRGEDGQGRAHHRGRHQPGQVRYRQGTGRHRLHQSEGLRQADPGRHRRTDRWRRRLLLRVRRQRAVDARRAGMLPQGLGRVGDHRCRRCRPGNQHPAVPTGHRPRLARFGVRRGARAQRAAELCREGAEGRDPAGYLHHPHHGAGGHQRGLRADARRQEHPHRHSLLTSRRGGPCGSPRPFHGGHVKDSLELIGSQKTFGGWHQRYRHFSRTLNCEMVFAIYLPPQAEPEAALPALYWLSGLTCTDENFMQKAGAQRVAAELGLVLVAPDTSPRGSGVPGDPDGAWDFGLGAGFYLNATQEPWAAHYRMHDYVVHELPALIEAHFPVSRRRGISGHSMGGHGALVCALRNPGRYLSLSAFAPICHPSDCPWGQKAFSRYLGEDPAAWREWDACALLEGASERLPILVDQGERDDFLAVQLKPEAIRNAADKAGHPLELRLQPGYDHSYYFIASFIEDHLRHHAGVLNG

SEQ ID NO: 21124 - protein, 523 aa, Pseudomonas aeruginosa
NHALIPTRAFFHANWPWLRRASLRRGRLHHPRRRAHSPQTWAGRPLRRRRAAARLVRCAARRGGAGRHRQALPGHRPAVQGRRQSRAAATRGRHRRREGLEGRQRRRHHRRPGAEDGATHRDHARVDRRGPRRRGRPGQRQGHHYRAARFHRTRRGHCCTCGRFADGPMSVLGELDLLGPRAHGAACGEAVLKAVAEDFQVDEVLDIPLSGEGEHLWLWVEKRGLNTEEAARRLGRAAGVQQKNVSYAGLKDRQALTRQWFSLHLPGKADPDLGAAEGADLRILRCTRHSRKLQRGAHAANGFTLRLTGLRAERALLDARLERIAADGVPNYFGLQRFGHGGGNLVDARSCAEQDLLPANRNLRSRFLSAGRSYLFNRLLAERVAEGSWNRAAVGDLLAFTDSRSFFLAGEEECRDARLAALDLHPTGPLWGEGDPPSGAGVLERELALAGREPALCRWLAKAGMAHERRILRLPIQGLAWHYPEPDVLQLEFVLPAGCFATVVVREILDLVPTGQTENPCAY

SEQ ID NO: 21125 - protein, 359 aa, Pseudomonas aeruginosa
VSGSGRVQRERNRPGLSRTHARDNDMALKKEGPEFDHDDEVLLLEPGIMLDESSADEQPSPRATPKATTSFSSKQHKHIDYTRALDATQLYLNEIGFSPLLTPEEEVHFARLAQKGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTHKLDHEPSPEEIANLLEKPVAEVKRMLGLNERVTSVDVSLGPDSDKTLLDTLTDDRPTDPCELLQDDDLSESIDQWLTELTDKQREVVIRRFGLRGHESSTLEEVGQEIGLTRERVRQIQVEALKRLREILEKNGLSSDALFQ

SEQ ID NO: 21126 - protein, 894 aa, Pseudomonas aeruginosa
QIESLPRADIVGIDPRQFIDHRVRQAGEQVALHRRGGLAALLARHLVRQAGGFQALEVFAGALDYRGRHAGQLGHREAVALARRSRQYMVQEHDAFIVLGRVQVHVGYRGLAFRQYGQFEIVGGEQGEGASPGQVLGRCPGQRQAVEGAGAAADLIHQHQALVGGVVQDVGGFAHLHHEGRAAAGKVVGRADAGEDAVHQGQLAACSRNEAADVRKQHDQRGLPHVGGFTAHVRTGDHQHPGVGIQRQVVGHERCLQHLLDHRMAALLDVQAGVFDEPRAIQVEVQRAFGEIRQHVQFRQRRGAVLERSEVADQAFQQLFVERLLAGQGAALGRQRLVLEGLQFRRDEALGAFQGLPADVVGRRLFGLHPWQLDEVAMDAVVADLQVGQAGAGLLARFQVHQELPGVFAQRLQLVQLGVIAGLDHATVADHRWRVVDDRLGQQFGEFGIGADGGGQRLQVRRFQFGHGVLQVRQRRQRVAQARQVARAGVAQADAGEDAFEVADFLELRLQVLEAVAFQQAGDGLLAGFQYRAVTQRTVQPAAHQAAGHGGLAAVDHRLQGVLAATAEVDIQLQVAAAGTVEDHRVIEAVVAQAAQVRQGGTLGFLGVGEQAAGGADGQGQVLAAEAFQVLGAELLAEALVRRVAIEVPWRAATYAAALLRRQALWPVVGNQQLGRVEALQFGQQGFPAFYLLDAEAAAGDVQHGEAEQALVAEDRRQQVVAAFVEQRFVAHRTGSDDPHHLALHRPLAGGRIADLLADRHRLAELDQLGQVALRGMEGNACHRDRLAAGLAACGQGDVEQFGGLLRVLVEQLVEVAHAIEHQLVGVLMLQFEVLLHHRRVLGEVGHTGLRKRALDGAKEGNVNPIRRPVSGPFGTGADPQVRACAGCFQRAAV

SEQ ID NO: 21127 - protein, 398 aa, Pseudomonas aeruginosa
ATARTRASRVCGQPFGTFFPSGVGERLALWNNTVYLYSCSWPSGRPDFARTSMDENKKRALAAALGQIERQFGKGAVMRMGDHERQAIPAISTGSLGLDIALGIGGLPKGRIVEIYGPESSGKTTLTLSVIAEAQKQGATCAFVDAEHALDPDYAGKLGVNVDDLLVSQPDTGEQALEITDMLVRSNAVDVIIVDSVAALVPKAEIEGEMGDAHVGLQARLMSQALRKITGNIKNANCLVIFINQIRMKIGVMFGNPETTTGGNALKFYASVRLDIRRTGAVKEGDEVVGSETRVKVVKNKVSPPFRQAEFQILYGKGIYRTGEIIDLGVQLGLVEKSGAWYSYQGSKIGQGKANAAKYLEDNPEIGSVLEKTIRDQLLAKSGPVKADAEEVADAEAD

SEQ ID NO: 21128 - protein, 423 aa, Pseudomonas aeruginosa
RWTVGEVTDPVEQLRLPGVGGEAAEGMDLRLDRDALVEHANRAGAVDDVAAQGAARLEAGEYHMAFRAPEVVLEVMDDTAAGAHAAAGDDDRAALDPVDRHRLVGAAGYAQHRQPFLQAGGAGAANVLAVAVVELVAVAQVDAIGTGGHRAVEEYRLLRQAALLVEAAEVVEQVLGAADGERRDQHVAAVAVRLVENRRQFLQGVVAVAVIAIAIGGFEHHHVGPAQRRGRAHQRRAGVAEVAGKHQAARLHLVVELHFDDRRAEDVPGVVKGHPHATSDRHGAAEADRPAQLERAFGVGLGIQRLDARLADPVAPAVLPVGVLFLDVRGVQQHEFQQFAGGLGGEDRALEALGRQARQQAAVVQVGVGDDHRVDARGIEGEGRAVAVVGFAAPLAHAAFEQDLHAIEGFQQITGASDLLGGA

SEQ ID NO: 21129 - protein, 224 aa, Pseudomonas aeruginosa
SPMAGASSSAPNWAPMRGWRASSCTCAAAASIRSASMGATRPPSSVRSGRWSSAWSGACRRRTAASSATRCRFPTASPRRSRASASMAPATTPRTTCRCRAIRITTNRPGNCSTSMQTNSGSSLRLSNWPAGCSPSSAASVPSNGTTRWPCAIPSNRSSRRCAIATTPARRWPRWTASIPNWWRPTPTCAPGSAIPTNWPATASAACSRRSSIGSASRRANWNR

SEQ ID NO: 21130 - protein, 143 aa, Pseudomonas aeruginosa
RSTAPRSPAVRRGTGTPARWRSRAGRAYAWAPPLRARAAPMPRATSSRMQPVRAIDSALPNGQSRESRNWLLIRLPIMMPSVPPTRSGMANIPSTGMNTSAAPAARAGRSPARSVANDRRRGPGRRPAGPGRVSPGWRRAAGS

SEQ ID NO: 21131 - protein, 90 aa, Pseudomonas aeruginosa
LWNTVCTGRFSGSTPARSWPLRRISPLSGWSKPASMRRRVVLPHPEGPRRVKNSPVLIVRLTLSTAVKSPKRRVTLRISSKGGVIRLERQ

SEQ ID NO: 21132 - protein, 541 aa, Pseudomonas aeruginosa
PRRCRVSARNRAPAMAANTASRDRMIAAWEAMACFCATTCRVKPVPTPSRPPYSRAGPAWTMASPVDFLEDQCQQQADRRAGGELQEGQADRVVAAGEQAYQQDVRAPDHRAGQLQPVAGGDLEARADAQQGHAEHRQRRPQPGARAGALAEQQAEQRHDDHVEPGDEAGVGHAGEQQADLLQVDPGGQGDAEDHTGEQLSAIEGLRAVASRAQHQQWHQHQGTEDEAQAGIEERPDGVHPQALGDERHPPDHGGDQHQDIGTQGLASHGSLDGAGRVRHSASKPGCLKRRTRCTRYPSFGLTGPPSVGILSAASAGPNKLGHVMASYEILIADDHPLFRSALHQALTLGLGPDVRLVEAASIAELEARLNEKADWDLVLLDLNMPGAYGFSGLVLLRGQYPQVPVVMISAQEEAAVVQRSREFGASGFIPKSSPLETLQQAVRAVLDGDTWWPPQDAAAEALSEEAKAASAGLASLTPQQFRVLTMVCEGLLNKQIAYDLNVSEATVKAHVTAIFRKLNVRTRTQAALLLQQMETVPASH

SEQ ID NO: 21133 - protein, 287 aa, Pseudomonas aeruginosa
CSCENRRISVSVMRRTRCLASSCEGCSRPAAASISARPLRVLRWKLRTRSALSGTTSARWRSGSWVATPVGHLLVWQLCDWMQPMANMKPRAELAQSAPVARTLAISKALTILPLAPTLILSRRLRPTRVLWTNSRPSRSGTPIWSVNSSGAAPVPPSLPSTTMKSGRMPVSSMALAMPMNSHGWPRQNLKPTGLPPDSSRSWAMNCISSIGVEKALWRDGETQSSPIGTPRVAAISGVTLCLGRIPPCPGLAPWLSLISIIFTCGSRAWAAKRSGSNLPSRVRHPK

SEQ ID NO: 21134 - protein, 323 aa, Pseudomonas aeruginosa
RSPTKRSAGPAQHQRSQDEVAERLGQADDQQETPAGLTHDAGHQRQRIADDRHPTEQQGPAAVAAIVSLRPEQLHLAHGKPAATAEMLEVATQPPVDPGTQHIADDGQRQQPRDRLAAAQQQGGQHGFRLQRQQGRRTERREEQPGVRGPVSQHPNAPSAIRIPTPIRKKLTWDSRPEAGEAYPGRQGHFPGYPKRRQAMFIPGHLHLASASEVDRQAFDIHLRYRVLEAEARPVAVHFDMEGRIDGQPFSESFELPRDAAVHFASRASRLARRHGLRLRQGPIVRQRREYDAMFDDLRRRLKLKSGEAIDLDRYLRGEAGAS

SEQ ID NO: 21135 - protein, 310 aa, Pseudomonas aeruginosa
QKKSAAFRSADRRIAMNFSSDTIELFLAVLDRGSFSGAARALGRVPSAVSMGIANLEAELGFALFERTHREARPTALARALAPQARMIAEQLAQLQVHALELSQGLESRLSLGVVADIDSGRLFGALRTLSERYPLLDVEVLSAAQDDALALLHGGRISLCFGFAGISVNPQERFQYVGAESLVATISPRHPALQKPGQALYLEELVNVRQILVASCDLPLADTRPLIAGACWRTDSLGTALEMVEAGIGWGNFPLSRVAPLLATGRLVRLDFRNTKNELKLPVHAIWLKNQPLRKAAQELVGMLATRPD

SEQ ID NO: 21136 - protein, 146 aa, Pseudomonas aeruginosa
DRPPGRRRQGQTPAGPWRVRDDGRSWAYLSEGKPDARRRTLQLCNQSRSACGETAPLAESRPSACSSAASRTLSRATSLAWARARSTAPTDKQVSTQARFSSPISSASRRCRCSRARSKVSRTSGPARPTSAASAGIGQPMSACCA

SEQ ID NO: 21137 - protein, 147 aa, Pseudomonas aeruginosa
LPLRRPSNTLPSRKIRTPTPTCGAGIVVLLLRDQRWSVPLMYNAALPEMTTRSPRTSHSRRPLRAPPCSALSRVLPRRCAQYGAREVCAEPVTGSSLTPTLGPNQRETKSKRWLRAVTATPRHGKPFSRAKSGARAAIVFSSSTTTR

SEQ ID NO: 21138 - protein, 144 aa, Pseudomonas aeruginosa
STRARGFWISGKDASSIDCRSWPKDISSYAASPSTPASCARRSTGSSASHCSTPSPNCGTGPASTRCTSMNWSWRGPATSASASSTAISTISNVSTTPWGTGPATASSARRLRDCARRCGRKISWRVSAARSSWRWSGSARPRN

SEQ ID NO: 21139 - protein, 85 aa, Pseudomonas aeruginosa
PTPTSPARSWPKPCAARPSASTLSPACRTTPSPAASCSAYRSPPSAPGTTACATSSGSSPRRQNGTPGCRFFHPLLNLRYGSAHD

SEQ ID NO: 21140 - protein, 241 aa, Pseudomonas aeruginosa
NPAISPGRRGLVPQRPPFLSIVPIAVFRRLGADARPSGETTTRRPQATKRRPPLCNSHILRLAARKPEHARSRRHRRISPPQPRTRRRNRAPPRTTEPPARRKLRIPELPSCPDLPNLERAGQRDGSCMDARYPAKSRKNQSGILAETVGHAGGNGRVFRQRTDEPIRTRTALPQHADFRTAGHGPPGPHGLPLLPRGRAGRAHPQGVQPDTRVQERADAFHRTVARGPGINQPPACTHKE

SEQ ID NO: 21141 - protein, 114 aa, Pseudomonas aeruginosa
TVNKSLDSDSITTAIMALRRLRDTHPEQYRELLPLCASGLVETLVGQSDGDDRRKAETQSETIARWTWLQLLGWAQNNSLSQQQIESLYSIVEGIRSCRPLMQERARLLQLARG

SEQ ID NO: 21142 - protein, 91 aa, Pseudomonas aeruginosa
GGIGELLELPGRSAHIGGAAVDDGIGFDEPSNFVQFFKREDGQVRRSLPPRTAWRPNASLAAAHRAHVTWRPQRSGLIRSFVTPARGLAQM

SEQ ID NO: 21143 - protein, 194 aa, Pseudomonas aeruginosa
STRTTSPRVATRTAIMSTRRSPSCHRCRRPPRAEPTFPACFPSGALGAPWLPIVRTQATHEEIPAMLHPSPGGSLCRPGRAEDRRHHGRLHHRGDPDRKWPRHRCADRQLHRVRQHRLREERRQPAPASGAQAAPGLGRLPDGDRRQPRSLHARPAGAAPARAVRRRPGQPGQPLAEQRQRLHHLRHRLHGLGR

SEQ ID NO: 21144 - protein, 206 aa, Pseudomonas aeruginosa
NRAHGAAQRTRRWRPGLQPGAERRTVGQRQRVQSPGEDLRLPSRRRPAQPLRGGLERQRRQPAGRRDEPAGSPGRAAERTAGAETHRLRLRERHRRLERRACQRPRHARRQRRAAGPGSLPAALRRHRREHQPAGQPGSRPDLRVQRGRTGRRRSRLAGHDLCLPLPGKPGSARRIPAPGLQGGREWPLGHPARPGAIAEGADQAC

SEQ ID NO: 21145 - protein, 204 aa, Pseudomonas aeruginosa
SLRFPSFPRGLPTFPGVPPMTSDRLAGYSRLMATLTLLLIAGMLLLNAACWIFPDLASEHGLGFALTATGVAGDLGVVARDMPLWQALGGILLSSLPLLVLASGLQALRRLFQHYGRGEYFCEDAAALLGKVGLCLACWVLANFLLEPLLTVWVTFLQPQGQRIVSLSFGSAELVSLFAAASVMVIARIQRKAALLAEENRQFV

SEQ ID NO: 21146 - protein, 183 aa, Pseudomonas aeruginosa
ATTLAIRFMRPTAPRTAPSAYSTADRATIRPRNEPCWKNCGARSRRCWRKPSHDLRSIGYRGAQPRRLRPPDEDLPCTPAACPASCRSPSPSCFRPPPSLPTRQPPSCCARPKPNARPTSTRSGNWSRWTAVPARPKASASCPRCSPNACRRSARKSAAHRRRPRPATTWWPPSMAPAASASC

SEQ ID NO: 21147 - protein, 305 aa, Pseudomonas aeruginosa
SASCPPTSADARSQPQVRKRPSTTRKPAMCSLTLWLAESTAAVPSWACSESPETLVMLRSMSWATWLCSSAAVAICWLRPSSSSTVATMRPSAWAALSASTRLLWAWLALPRMAATASLAPSCNCSINPWISWVDCWVRLASERTSSATTAKPRPASPARAASMAALSASRLVCSAMLLITVSTWPTLPACWCRVFSARAVCSSSSANAPVWLLACSTRRRPSWARAAASRVECAAWLAWRATSATVALISFIAVATWSRSWCWRATWSPAPSACSRASATSLSVSAALRLTFASKPLTSWRIRS

SEQ ID NO: 21148 - protein, 110 aa, Pseudomonas aeruginosa
RSAASPPATCNAGCRASRTTRRTHGKPPASIPLRCACVARESPRSKAGVATPARKSPSPASATGVPPPSKAVAWRSATAPTTSTSPPVRDCSPAMAWSTPTATATPSAGG

SEQ ID NO: 21149 - protein, 75 aa, Pseudomonas aeruginosa
PYQCDFLLWWSPKPRGPLIPPGLSPRLLPLPSLIQQPIAVQRGNPMKLSIVALGLLSMAGVLICTYLILKSLSAI

SEQ ID NO: 21150 - protein, 345 aa, Pseudomonas aeruginosa
NPSPCSALPAEVPMRPEPTNAPAALSRRFSVAPMMDWTDRHCRFFLRQLSRHTLLYTEMVTTGALLHGDRQRFLRYDECEHPLALQLGGSVPAELAACARLAEEAGYDEVNLNVGCPSDRVQHNMIGACLMGHPALVADCVKAMLDAVEIAVTVKHRIGINGRDSYAELCDFVGQVREAGCRSFTVHARIAILEGLSPKENREVPPLRYEVAAQLKKDFPDLEIVLNGGIKTLEACREHLQTFDGVMLGRKAYHNPYLLAAVDSQLFGSEAPPLSRSEALLRLRPYIERHQAEGGAMHHVTRHILGLAQGFPGSRRFRQLLSVDVHKAADPLRVFDQALELLAGR

SEQ ID NO: 21151 - protein, 186 aa, Pseudomonas aeruginosa
RRRRRTGLRPLRRGSRQGHPRSHSRTYFHRSRRAPVVRQRGHPRPRPPPDRAVRRTGHRPRAGSDQDRLHLGRNPRRRDSGTRGHPDQPDPAVLLRPGGGLRRRRGVPHLAVRRAHLRLVQEEREPRLRRRRGSRRAVGLAHLSLLQGQRLQDGGDGRQLPQSRPDRATGRLRPPDHQSRPAATTG

SEQ ID NO: 21152 - protein, 370 aa, Pseudomonas aeruginosa
RSLFLLQRSSWQHIEDAIGKQRQAEGRRQLHDPVVIGRIVEQAHRQATALQVARLPFDEQHRKRQVAADAVGQAVLLQVDDPAEHGHVLAQLGVDQAAVDVRQHLGRLELRERAVAPRLIEQARGHELQQHRDEGRGSAMAGNVGQVERHASLVDPEVVDEVAGEIQRRNDPVGKLQPLDAPRRHRKHVHLHLAAGVLVFLKQVQAGLQFAVGGFQLVAVALVLDPQVGAIQGPAHRMLEHREVFQGLDQVVGGAQAQGFHRIAHHAGSGKYDDRRFRSGLADAADQFEAVDLRHAQIANDQVRLFAFEDLQALQTVEGLQHLEVAVFQVGGEAFAHHLVVIDDQQRGTDFMHGSSRQTAPETVGPRRLL

SEQ ID NO: 21153 - protein, 138 aa, Pseudomonas aeruginosa
PLPENPPLSVRSRPHGINFDDNRQDCQSPSHRPDHEDQPMQPIEHNYSEKRDFIRMKLDTPVTIRCEGRESVALCRDLSASGLLLEAQSELAPGDHLRVSIPSTHETLTGLELEARVVRCERLGPGRHSLGLSIVAIH

SEQ ID NO: 21154 - protein, 138 aa, Pseudomonas aeruginosa
KSYEMADRQLLHTAHIPVRWGDMDSYGHVNNTLYFQYLEEARVAWFETLGIDLEGAAEGPVVLQSLHTYLKPVVHPATVVVELYAGKLGTSSLVLEHRLRTLEDPQGTYGEGHCKLVWVRHAENRSTPVPDSIRAAIA

SEQ ID NO: 21155 - protein, 152 aa, Pseudomonas aeruginosa
LRRPDRPRRARSPGRPGARTPGRTRPPSAPPRNSVAPGTAPVNPAPVAAARPGPRSARSGASPVGSASAAGRNARAAGSSAKYRGRGPAGLGTTRHPGRSVRSAPDARPPSGAVAGNTPARCPPAPSAWPARRRLHAARRAASRYAAGVPGR

SEQ ID NO: 21156 - protein, 136 aa, Pseudomonas aeruginosa
TICQTPFACPAPTNSRASPPCSSDSPAAWWISAPGPCPWRCCAAIRIALPNTSATPVCCPSPRHKASCCSASRTRTSASAWSRPSTKPPRNRPKPSPVPWPCWRAWTNNGFPTPGRTSYRNRSASALPRRSAERTP

SEQ ID NO: 21157 - protein, 186 aa, Pseudomonas aeruginosa
KEKNHEPRPSPLSRRTGRTLRQPWRRALWRGSQPGRARAAVCDPGRARRLLGQPCSRRPAARYRPPLRRPGADRRGGPAPRGIRRTPAARAVPRVGLAAGAPARIGQALPLRGGPELPRQPVAGLPAQPGAARRAVRRACRRGLHQGALCPGRPDPAPPRRPGQGPGHAHPRTDALLPAAGTPAAD

SEQ ID NO: 21158 - protein, 611 aa, Pseudomonas aeruginosa
RLADPAQRARRRDDRTGAVPDRPRCRRGPRARPRTRRRRLPGEAVRLRRTARPGAHPAAPGQPAVAGDHPATGRPRTRFAAPPGATPGQADRPHRQGVRPARTAAAAQRRGAAQVADRLAGLGHELRQRYQRHRGGHPPPARQGRRRLPAAPDPYRARHGLRSRRARRMSAGFGSRMSLGVRLSLLFAACTAAVSLIAGLIFSRAIDEHFVELDHMAMSAKLAVFRDELRGLGSEQQMRRREAELLRELARHPDLGLRLNGPDGNPWFERLPQPAHPGLPANRELGAPLEPGNDASPRLTVILDISHHQHFLQRMRQLIWLTMSLSALATALLGAWATGASLAPLRRMREVAARVSANSLTTRLDASRMPEELRGLAGELNAMLARLEEAFQRLSAFSADIAHELRTPLTSLLTQTQVVLSRPRSLEDYREALHGNLEELERLTAMVNDMLLLAKADHGLLAPSRQALDLGAEVDSLLEFYQPLAEDHDIRLLRQGSLSLPGDRGMLRRVLANLLDNALRFTADGGEIRIRLGDRRLSVENQGPAIPPERLPRLFDRFYRADPARREGQGEHAGLGLAICRSIVQAHGGEIRCESADGWTRFVIDFARPRR

SEQ ID NO: 21159 - protein, 332 aa, Pseudomonas aeruginosa
SGAPRGRRWCSGRPGWRSVRCSSGDPRQVLLHQRHEQLLQAIGLVAQAQYLDALCTQLGEQVVDALALLHLHFESVVVDQPRRIAVEGRRQGLDVLQVEQEGFRMQGHQQVAHAGVLHDLAVVDDGNVAAELLRLFQVVGGEDDADAFLVEFCEEAPHRTTQLDVDPGGGLVEDQQARLVDQCAGDHQAPLHAAGEHPRGFVALVPQAQLGQVALGALLGDLRRDAVVAGLGHDDVEDLLELVEVELLRHHAKATLEAGRVLVEVVAEHRDRTAGLVHQGRENPDGGGLARAVGAEQGEEITFGDVQVDALEGLETVAVGFRQLTDGQGGTH

SEQ ID NO: 21160 - protein, 221 aa, Pseudomonas aeruginosa
QNATVAGSGQFGHYRGAERRALAQAQVPGLEVGQRRALDGHLEPGVDETAQGNVTHAEAFAGQPGLAGQGLVRHPQQLAAGLQRLCDQGLVALLRRRTQRSPEQVAERPGESRGGPVHPLVGVGAAHRVLRIEVARRIAGGQVADDGVGLPEDEAVVLDHRHPTVRVHRAERRLIHQAERPAGIHRPVLQASLLGAPQRLAHIARVLPAPDGQHTLRSLFG

SEQ ID NO: 21161 - protein, 133 aa, Pseudomonas aeruginosa
WACSATRPAGCCWSSGCSGWRWRFPSPCPTCAGACSAVRCSPGSRKSCRRCPTPSARPSRRAPCGGMANCSAAARTGRNCSTTPRRNSPKKSRPSSTARPKNSAPWSATGTSASAWTCRKKPGPSSSSTASSA

SEQ ID NO: 21162 - protein, 136 aa, Pseudomonas aeruginosa
RSWYCSSAAGTKGRATNWTPRSRKSSTVRTTTRRCRAIIAGAFLPKDPQDPVGALAHAFDAVRESAALEKTLHKAIKEGRVQPQAGQNPIDAGAAAGVLSAEQAQALHQAEAARRKVIDVDDFAKEELQLADGRIR

SEQ ID NO: 21163 - protein, 196 aa, Pseudomonas aeruginosa
SASSNWTSSAGAWSRTSGASTANAGNWKTAGARASPRRSAETGRRRETLYTAQLFSRGPVMANSYLEHHLALLQHLRNILGALGEAEQVPEENHGLFLERFDELMDELPRDPEGAQYLGQDLISQVFHRYPQIAHLVPRDLLWFFGGDCLHFMPDEEIDLFQRLDERRYEAEERGETFDWNREKQLLALPEDSPRH

SEQ ID NO: 21164 - protein, 281 aa, Pseudomonas aeruginosa
QFCRVAGASHPFAAHVPTDCSAASMSYLAGAADQSGEGAGMHSNESTEDRCSRHYTLLQRCPLLHGLPDLLRHVATHASERRLRDKDVLFLKHDPEDFIGLVLGGHLYTVLYGPDGRELIVNDIRPGEVIGETALIQPNRRETSAYASGAASVLILHRRHFAPLIADTEFLNRALALLCSRLREASGFVERVCLHRLESRLARHLLASLASEQPEGACATLPTNQSILAAMLNASRPKLNAQLQIWKREGLISCHNDRILINDLGRLRRKAELPAAPLSPR

SEQ ID NO: 21165 - protein, 179 aa, Pseudomonas aeruginosa
RLWIVRISQAATKPVPIACSRKAGVPRRLACANARNALRAATAIGPKNGCRAPRSRRCCSCASHRSGYATPRASCSWSWNTSTWTARATRSARTASSTAASTCTMASWSASPPSARRWNAWSSWNVSTRWTRPWPRCRANSSSSSSCASSKNCPMPTSPANSASPRRWCASACSCCARG

SEQ ID NO: 21166 - protein, 146 aa, Pseudomonas aeruginosa
APPTAPCRPLPPPTPAIPAAARRPPRRTARSSTEASPRHPAHRASIAEESAHVDLGRIGKESGPAGATLAETPPHQRRTRAVETVPARPRQRRQQRSGRARATAGRTGDRERPAAFRRLHPPDPAERPAGLDPGPPRPGQRRAGDS

SEQ ID NO: 21167 - protein, 111 aa, Pseudomonas aeruginosa
FRRITMSFPTAVNNQITDAVTQSNVKVIGEAPAMALGSIFQTMAHSTGILFENSVAAQQQQNALALAASNMGVMQIYSLDTSAAGGATEKIGQLGVADNLTSLLTVLKALP

SEQ ID NO: 21168 - protein, 86 aa, Pseudomonas aeruginosa
IEVTPTNATERSGVTAMSQTPVLPPNERRILRLDEVEAKSGFKRAHIYNLMKKRQFPQALRLGVRAVGWDSIEIDQWIAERLNHRT

SEQ ID NO: 21169 - protein, 295 aa, Pseudomonas aeruginosa
PALPRTSHSQPESAMQVVSIISTKGGVGKTTTAANLGGLAADAGLRVLLLDLDVQPTLSSYYELTQRAPGGIYELLAFNERDLGQLVSRTIIAGLDLVLSNDHRGELNTLLLHAPDGRLRLRHLLPALAPLLRPGADRHPGRAFRAAGDGGARLRSRAVARHAGDPRGTRAAARHHAVARRHCAVPAPGYRTAAAALAHQPRPPGVRQRTADPAGPARPVPGQRRHPRARHRRAGHRSVSTRRNARPASASGRAPPAARQSRPCRARHDARARQRVVPAMAGPTGSSIRPPAATS

SEQ ID NO: 21170 - protein, 587 aa, Pseudomonas aeruginosa
TPVRRSAAPSERPAWRRPAVVGTARGAAMADMTSQDMAGKLLAAGFERSGPAATALSDPIADTPMVVTLDQLRPYDHDPRMKRNPAYEEIKASIRERGLDAAPAITRRPGGDHYIIRNGGNTRLAILRELWSETKEERFFRISCLFRPWPERGEIVALTGHLAENELRGGLTFIERALGVEKAREFYEQESGAALSQSELARRLAADGFPVQRSHITRMADAVRYLLPAIPTVLYGGLGRHQVERLSVMRTACKRTWEHYAKDRSLPLDFDSFFQEVLAQFDTQGDEFAPQRVQDELIGQMSELLGIGYDVLALDLTESESRHRALVSDPTPPAAQPALPSPTAGTPTPPGAASSIATPAAADGPPPASPPASEPTLRHDDKAASEAATGSPAAAPSDLLREHIVSPAPTTERLQSIQRMVADQLGDALPPDFSASVLQSIPVQAGGLYPISDVWYIDAGLDTPDRLRIHIAQFAREIAGEAGLDEYIEDRADGIGFACRARGQAPSPLGRAVLTLLTSLTGQPVAEAGLDGAQLATDLPTLLHGQSQGHGSGARRLSDTALVKLFRLLRLARRLLDLEAGTTAPGT

SEQ ID NO: 21171 - protein, 283 aa, Pseudomonas aeruginosa
LPSAACGCWRLPVHQRAITMATSNEPLQLNLGSLRSAMSLTLHTHHASRIWHGRAAAEGRPGIVGLNGYIAVMNKMKRGSEQDDPYSDWWMLRIEDKLDQTKTTLQTLREQVDQALAGVPAALTLGENLNVQPVKLPLFVNAQLGFAAVYLLADYDDIARKLILAHHTALIDRSTLERWLNEGAHALRSLFSLAQQYRYSGCTRDDFAAKNAAARAALEKFGELPQDVLEGTRRSKFAPPIVRRGLQQRGESPAAAATSVDGDAAAAADPSENAATAGEDESA

SEQ ID NO: 21172 - protein, 217 aa, Pseudomonas aeruginosa
TCRSACCTPWAGRHRIAPARPPRRKTPTCAGSRPFPPQCAIGDCAGHPSTRPAPTRCGYFNHQGDCNMSTHFSGEGNIGSPPEYREFPNGNDEPRRLLRLNVYFDNPVPTKGGDYEDRGGFWAPVEIWHRDAAHWKDLYQKGMRVLVVGRMEREPWTDNEDQPRETWQINARSVGILPFRIESVVLSPKSQETAQDAQPKPQAAQEPAAPKEPKRRK

SEQ ID NO: 21173 - protein, 199 aa, Pseudomonas aeruginosa
SGGGRPQYVAAPHVIASYPQGIAPPASTGFHALPNIAAPDSHIAGRTPSPPQPSHLVKAVAAACSLFAAAPTGARHPRSQQLHEQREADGRTCGCFCARSPPRAKTSAGFSAPRSAVKAASTAPASRSPGASAISSKRQHPRSMTRRSSAGRWSSCPSSLSSGGSRSNRRPPRNSRSSKRFWRRRPISSLPPMPTARVN

SEQ ID NO: 21174 - protein, 168 aa, Pseudomonas aeruginosa
TATERSRPSSPCPTGPSTCPCPQAVRRSPRSGWHPMPAPTTPAAACSSPSHSKPRSRSAPRAVPRWCRSRPSACAKARRCCSTWAPCRRCAPSSLGWTCRRRWRSLRPCTRRIRPRRTRARIPATCPKACSPRCLRSSTACSRPIPRCARSRSSSTAPCVRAPGTTAR

SEQ ID NO: 21175 - protein, 179 aa, Pseudomonas aeruginosa
RSTSSWTSWPMPCTQSASCAPRSTATSATRCCSSRTAGCCSSRASSSRPLPTARHISQSCAADRTSPSSSWPSCQRTRHSPSGSSMSWATSPADPASPHRHGRPALVAGLFFVPAHINRGWTRCRFPTDVARHPHEAARMFADSSAHASSQGFRLPRGSLRATHQSASHPLRGRAFPRR

SEQ ID NO: 21176 - protein, 317 aa, Pseudomonas aeruginosa
TTAVGEPVPGTSSSLRSRDPMRDMRLVRGHVPRVFSPPSAIRHQAVPLRMPPTGVNSRWRGLSPSLFCWRNPMSQNPNPFLRGYWNLKIVRTLSISHEDGSPHVWRNIHPSQQHLCDAALVSSPCIVTSDFAVVRTGTEPVGAALIAECDAAEGVSGEGVVGAVVYAIHGDDFDGRPVHIGDTYSAEAAREVVQRLSFETGYYSRCWEISSAHISHETGQYLANLADLATPEAFLFVAFRVPYSPAIGVKLISTPWTDQHLQDVEEISAEQLRQEHCSKGMPDDLAQILALAGQADVRILILDADAPVLPGLPLAGE

SEQ ID NO: 21177 - protein, 124 aa, Pseudomonas aeruginosa
LPHTSPAFLFITACRPVSHQGAGPAHFHRSDPMFPDLITPASDFEHQLGACVNAMSQDDAIGQILVFERMRGALHMRHIASADLMNTDIDDYDMVVFDGGNTSGDAWKHVFFPRQREHYFVYEA

SEQ ID NO: 21178 - protein, 154 aa, Pseudomonas aeruginosa
PKPSPISAASSWSRTRACTSSPSVGSVARMDASNCSPTPSAATRTPTRSMTGGTSPAASWAATILRSISTRRTACSRASCTRRTISCCPPPPRTCPWPWCLPPEAATAAQPSQPPHRGRSFVRTTAIAAHARSSPAAKARPAGHSAGMPPETTA

SEQ ID NO: 21179 - protein, 372 aa, Pseudomonas aeruginosa
RCQRHARQPSVFEVAVQFPLRDRASSHRIHPRAATSLWWRMLSPYQPTAGLRTFPACVGRCVSASSQWRFTMNTTSNEKSYFDLHASGIGYVQRVREVPVRGGRRAQPFLACTIAALVGPARDPSYRYFDVKVSGAEAKKLVQRYIGVDDPKQRPLVRFRLGDLWGDAYIRDKGEQKGHAAASLKARLLKAELIDRAELASIEQHELITRGIGYLNRVKDVTPKAGDSFLSCTVAALAGPVDEPEYRYFDTIVATPEAEHLVRRCVQAIEGDRKVLIASRLNDMKIDPYIRTKGEHAGEPAASLESTLVHIGLIKIDGTQVYPTSQAQPEAPPAEDASASEADDAIDTATEPAEREPEAQVEEQEPALAASF

SEQ ID NO: 21180 - protein, 323 aa, Pseudomonas aeruginosa
YGMAPHGALSLLFPHPPRPHDARLRISSPEFRVVSPPRGCRISQRRSAMSLASRFAPQSPILRSDRPLSDDRIRAVVPSIFADAPHGSRSDRYAYIPTSTVLTKLRQEGFEPFMVCQTRVRNEDRREYTKHLIRLRHASQINGDEANEIILLNSHDGTSSYQMLAGMFRFVCHNGLVCGDTTADIRVPHKGDVASQVIEGAYGVLEGFERVQNARDAMRTINLDEGEAEVFANSALALKYDDPAKSTPVTESQLLAPRRWDDRKNDLWAVFNRVQENLVKGGLNGRKANGRNQRTRPVQGIDQNLRLNRALWLLAEGMRQLKA

SEQ ID NO: 21181 - protein, 260 aa, Pseudomonas aeruginosa
CHADLAHLGRGHSSHPPGAVGGPSFIIRRTIMATPSASEKSVAPIVVPGQLTLRTIRGKNGPFTVGRLATHLGTFEVKDPELEQYPECKYDGEFIIRYIFPKSYPVGGGMRFEIRASLDGMTLNGIDKLSRDEARSFATQDVDPLDEEQGAQPAATPAKPTKASRPAKPAPVQASADPMVDTTPFGVDAPPPAEAAAPGSTQDGDPALFGLLWPLGESVKLDSTIDRRALRAQIARLGELGYALDFKTQEWSRQAELQPA

SEQ ID NO: 21182 - protein, 414 aa, Pseudomonas aeruginosa
SAVTRSPPIPIRPRFGRRKRWRLDPPSEARLGVLPSFIPANQETSMALMFPRLARNFAKNGYYPTDEPTLERALNALMPSDGPMCILDPCAGEGVAIAEASHALGREQAKAFAVEFDAERARHARGLVDHCLHADLMDTMISKQSFGLLWLNPPYGDLSKDVNGNIGYQGQGRARLEKLFYQRSLSLLQYSGVLVFIVPGYVLDAELVGWLTRHYTDLRIYRAVETQFKQVVIFGRRVRQRELAPDGVKAVRNLLLQVGLGEVEAEELPSEWPFLPYIVPASPAEPEHFFRVTMEPEQFADEVGRLQGLWPSLDTHLGTAQQSLRPPARALSHWHLALALAAGAISGVVRSQTGRVLVVKGDTHKDKTLQREFTEREDGSIAETRILTDKFVPVIRAWDMTPGSPTRGEVLTIR

SEQ ID NO: 21183 - protein, 159 aa, Pseudomonas aeruginosa
STVANAPRSSMARWAVVRRPLASPRPPCSTPKATAALWSCRHRTWFTSGGGRSRRRWPAPRYGCSMGRIRSSSSSSCVSSWACSPRARSSSSWGASGCGWVSTGSPSSPSGAPATATWRPARTAARSSPTSTASRSTRSRSKPRSTAGSAAIALRPCGR

SEQ ID NO: 21184 - protein, 197 aa, Pseudomonas aeruginosa
SSRKRGAWVVRAGANRCSASGCWNSAASMFGRSRRASDTTAFLINQRLAVFLVERAALRLRQKVEHGFRWPAQAHTQRRDHDRPVDENGMLEHETDQVVVAPLRVAQVEFGIGRTFLAQYVPHRHAHRRDQRLERVAAGRRLQVLDDGRFLAAVADQAQHVARCAAGWVVVDRDGAHGCLLEITKWSRGVRTSRVSG

SEQ ID NO: 21185 - protein, 159 aa, Pseudomonas aeruginosa
INVQTTVGFAGCAMCWTAKAGSSQFAFLTDRAAARGQGIGIATEEPMPCPQSMYPGTWSAPASWPQPWPVAARPPRRRSHPMPSRKSRPRPNPRRPSTSRSCATAATRWSSWHPRQRSATCCCRPSTCPCPRMPAPRSATGCGMCSSAAATAFARPRMP

SEQ ID NO: 21186 - protein, 211 aa, Pseudomonas aeruginosa
FARSRARGERPMAAPAVAAPVSQFLRALVLSAGVYASTPHAQEVPPPAYQLAAQRAGIPSTVLYAVALQESGIRRNGRIVPWPWSLNVAGQSRRFATRADACAGLQQAMRATPHTRIDAGLGQINLGYHKHRFTGACDLLDPYRNLAVAAEILKEQHAPGEDWLLAIGRYHRPAGGEPAVRYRRSVSRHLARVQGTRPTAAVFAARQETSP

SEQ ID NO: 21187 - protein, 740 aa, Pseudomonas aeruginosa
SRPPASSNEAMSGKQPVEVLLRPAVELYTVAACAGAAFLCLVAPWSLALSPAMGIGSALAFGAYGAIRYRDARIILRYRRNIRRLPRYVMTSKDVPVSQQRLFVGRGFLWEQKHTHRLMQTYRPEFRRYVEPTPAYRLARRLEERLEFAPLPLSRLPKLTGWDVPFNPVRPLPPVGGLPRLHGIEPDEVDVSLPLGERVGHSLVLGTTRVGKTRLAELFVTQDIRRRNAAGEHEVVIVIDPKGDADLLKRMYVEAQRAGREGEFYIFHLGWPEISARYNAVGRFGRISEVATRIAGQLSGEGNSAAFREFAWRFVNIIARALVELGQRPDYMLIQRHVINIDALFIEYAQHYFAKTEPKAWEVIVQIEAKLNEKNIPRNMIGREKRVVALEQYLSQARNYDPVLDGLRSAVRYDKTYFDKIVASLLPLLEKLTSGKIAHLLAPNYSDLADPRPIFDWMQVIRKRAIVYVGLDALSDAEVAAAVGNSMFSDLVSVAGHIYKHGIDDGLPGAVAGARVPINVHADEFNELMGDEFIPLINKGGGAGLQVTAYTQTLSDIEARIGNRAKAGQVIGNFNNLFMLRVRETATAELLTRQLPKVEVYTTTIVSGATDSSDIRGATDFTSNTQDRISMASVPMIEPSHVVGLPKGQCFALLQGGQLWKVRMPLPAPDPDEVMPADLQQLAGYMRQSYSEATQWWEFTSSSALQDAALPDDLLDDAAAAEPGAVATGADDGAGNEAVP

SEQ ID NO: 21188 - protein, 249 aa, Pseudomonas aeruginosa
SVRSVRGLARRAGPHSPRRRANCPPTWEAAVAGPRPAIRQDKRPQPPPPRGAFRHTALGPPRSTASDARPPAAAGRPVARAAPGPFAPWRTGPAPRRPVRFHMPDTRSPRPPTLARPRRASRTTPRRRGPRVARKTLATVPGRGRPLPATLAGGPGSPREWQAGWRPAEPGHTVAVLAAAAYPAASPRRFDRSRQVTCAAPKLVPGPRPLRSSAGRRRWSVRSSPTAGDAAPAAPPARRQASGPDRARG

SEQ ID NO: 21189 - protein, 133 aa, Pseudomonas aeruginosa
SHRNGAMVASIWLRAAHRGVPTFFVTALVLGQSPMALAESPAQRQELVAALRQLDALERTVADSAAHAPIQPGERYHFDYPRLLADLARVRAGIQFHLTPSRAQPRDPSELAGDYRTERAASPSPKTTAEGEQ

SEQ ID NO: 21190 - protein, 118 aa, Pseudomonas aeruginosa
  UNSURE (86): Identity of amino acid at the above locations are unknown.
VSSFCPDLKGPTMHNRNLTSRFAQRAAVAMGAAALPALSFAQGLPQLENPNARHRPPASWRPSATTGTTSSCSWPCWWWRRCSSAXGTTPTAPTRRSTPAARRGASSASRSPSAPCCS

SEQ ID NO: 21191 - protein, 329 aa, Pseudomonas aeruginosa
RTLDLLRPVRRRRPAGRRAAVLGVPHDRAGADVRRPGRGARRLHRRRHPAPPQAWASRHLAVSATAMAHRHAPSADGRLGRWPCADLALGLLVHPQEHAMSRFKNEITHLQAHIKTLRLGAGALVVVALVMGGGWWSAPRDLTIHVPPDLRSGSTRKWWEVPPESVYAFTFYVFQTLNRWPTNGEEDYSRNLHTLSPYLTPSCQAFLRADYDYRRSTGELRQRVRGIYEIPGRGYGDDPTARVRTVSDRDWVVTLDITADEYYGAEQVKRALVRYPIKVTRVDVDPARNPFGLALDCYDGAPQRISAPEPTRPAPSGLSPQAPQGGNTP

SEQ ID NO: 21192 - protein, 558 aa, Pseudomonas aeruginosa
LPCASPTPAPTGSRSTRACCKAISSPPPSSTRRWARAARPRTRPSCTWSRAAAASRSRCCRRFTASTLPCICRSRTATRTPRRPAMRSNGLLKWLMIPVAILVLFAGIRLFSGGGGTAPPAADNGAQLTPEEMKALGIEGDTPRDTVATLVAQVKQLRTELQTALSDNKSQREENQRLRQRENSIDQRINSALESERSNLRRDQEPGGPARASQTEWLLADLQRRLDSIGGRGGGHADLPVGLGLQGGDEARMEGGVRWVEPDDAKPPEGRNGGRGASGGMSFPTIFGPAQSTLLTTTETVANAGARAAGVKSAKPVYTVPTNSTLMGSVAMTALIGRVPIDGTVNDPYPFKVLVGPDNLTANGIDIPDVAGAVFSGTASGDWTLSCVRGQVRSITFVFNDGTIRTIPEDREGNQQNNQQRDGLGWISDPHGIPCVSGERRSNAQQYLGSQALITAAGAGVASLIESDSGRMSYVGSDGSIGTVGITGQEAVGQILAGGVRDMSAWVNKLYGQAFAAVYVQPGAKVAVHLEKPLAIDFDPEGRKVDHRAGESHALELD

SEQ ID NO: 21193 - protein, 1074 aa, Pseudomonas aeruginosa
PHDDGHLAAGGRRRRWRSRTECRSPTARCAPEPASAADRRRHAGRACRADALYAHRPQRGSSPVPAPAQSRSRDVRVPAPGRHRSRAGAGLHDRLPAVPAHSVRDAGRARGGLLMRWKLPWSKLTGASISGPAGDEQPDGWQRHVDALQQVGIPEPGAPVQGRRPATVAEEQALYDVAPSFVELLPWVEFLPESKAMLLEDGQSVAAFFELVPLGTEGREPGWLAHARDALENALQDSFDELDENPWVLQLYAQDEPSFDQYMQTLRDYVQSRARGSAFTEFYLRFFGHHLRAVAKPGGLFEDTVVTRLRWRGQTRRVRMVVYRRASGQGQANRRGQTPEQMLGIVCDRLCGGLANAGIQARRMVAADVHDWLLRWFNPRPTLLGPGAEDRERFYSLARYPDETEAGEIELASGRDFSQRLFFGQPRSDVAQGAWYFDGMPHRVLITDRLRMPPGTGHLTGETRKGDAINTLFDQMPEDTLMCLTMVATPQDVLESDLNHLAKKAVGETLASEQTLKDVHEARSLIGSAHKLYRGTLAFYLRGRDEAELDRRGLDLANVMLNAGLQPVREDDEVAPLNSYLRWLPCCYNPGKDRRRWYTQLMFAQHAANLSPVWGRAQGTGHPGITMFNRGGGPITFDPLNRLDRQMNAHLFLFGPTGSGKSATLNNLLNQVTAIYRPRLFIVEAGNSFGLFSDFARRLGLTVNRVKLAPGSGISLAPFADARRLIETPSDVQTLDADALDEDQPPDASAMEADEQRDVLGELEITARLMITGGEDKEEARMTRADRSLIRQCILDAAEHCVAEKRTVLTRDVRNALRIRGQDPTLPEMRRARLLEMADAMDMFCQGTDGEMFDRDGTPWPEADITLVDLATYAREGYNAQLSIAYISLISTVNNIAERDQYLGRPIVNVTDEGHIITKNPLLAPYVVKITKMWRKLGAWFWLATQNIDDLPRAAEPMLNMIEWWVCLSMPPDEVEKIARFRELSPAQKALMLSARKEAGKFTEGVILSKSMEVLFRAVPPSLYLALAQTEPEEKAERYQLMQQHGVSELDAAFKVAEKIDRARGIESPTLDLP

SEQ ID NO: 21194 - protein, 263 aa, Pseudomonas aeruginosa
ICRTPENAMEQKRPSIPMQVQAFRRRHWRPSWPWTVAAALVALLLIWLVSRWPGQSTPQTSAPVSETQVAGPPWQMGNPEGRFTLTLYADLECPFCRSYFPVLKRWVAGNADVALQWHHLPLAAHEPAASAEARLAECAGQASGHAAFWQAVEWVYAHTRSDGQGLPEDLRYPDLTPPIEQCIASERPDAAIRAQTAEATSSGVTATPSLRLHDRETGKAILLQGPIEGDALLSAMDMLAAGDPAATPTTSEMPADVVGDMPR

SEQ ID NO: 21195 - protein, 138 aa, Pseudomonas aeruginosa
GRSGARPPRPVAEGQSRSQAMSAARMTWRPLRWLFSRRAAKALLWTVLIVADAVAANIAGIYLVGSVAGWERWLAAAGYFFVWRLCLYGATVYGWIWMRRRLLVREDDAQARRRLVRTEIAGVVAIVALEASLLMQAG

SEQ ID NO: 21196 - protein, 262 aa, Pseudomonas aeruginosa
ADPQRCSTDGPLAGRRRFRGGEGWYNRRLFHHAEPSMSTLLALDTSTEACSVALLHEGRALSHYEVIPRLHAQRLLPMVRDLLDEAGVALSAVDAIAFGRGPGAFTGVRIAIGVVQGLAFALQRPVLAVSDLAILAQRAYREQGAERVAAAIDARMDEVYWGCYQLQQGEMRLAGSEAVLPPERVAVPWDAAAADWFGAGTGWGYVERMPQRPAALDASLLPHAEDLLSLAGFAWARGEGVEAEQALPVYLRDNVATPKKAP

SEQ ID NO: 21197 - protein, 261 aa, Pseudomonas aeruginosa
SVETSPGFDHAYRRSFFLFVAAGAQRPTGLRGHAVSRRAARGRGAARAAGAGFRQPGLRAGAAGAQGPGQFGGRRQPAGQRPRPAGVPAPGKQPCGDGPGQLQLHRQPQHRRRRRGCPRPRPLRLSGSLRSRGFPSLFPRLSILERGGLARQLLSARIAFRRLPRTLRRHLQRGRGQYHLLCPAFGGNRAALGRDDAGGVPLLCQVSPRYQSRRRPARTARGRRRLPRTAGAAWRKGQPAVAATVGGVHPAAPGRTAVFPR

SEQ ID NO: 21198 - protein, 169 aa, Pseudomonas aeruginosa
AESATDCRGSTPPGVLRQRRGRAPAQPPPARAWRGAHLPGFAGAVQLPFGRSGGAPRPVEEAAPADPSGGLQRYATGAFHRRSRPAGQRGVPFALGRQGGRLDRGRPDSIRIPAYPRQSPGGPAGPAFPCAAGPAPARLAGATRADPGPGSGATGPALSAALDAPPACA

SEQ ID NO: 21199 - protein, 194 aa, Pseudomonas aeruginosa
VLRRAGAGRCRGRGGPCVAISVHPLRPRGELPAWSRGSRRHPAASARLRRCRRRCALRARFEPPRTDRRGARSGGAEAGQRAGRFAAPGAVAGRAGSPRRQAREPGLESCPGRLRRFPSGGAGAGAARPGSDPCGDAFRPYQRPVPLNPCAAWPGCCHYCCWRGPSAPCATSGSICRRAGIPGCRWTCANRRTC

SEQ ID NO: 21200 - protein, 400 aa, Pseudomonas aeruginosa
AMRCSSGTCCNRQPWTSMASRWRGSSMSAASPAATSTTARTVGAASMPRPMPWTSAASAWPTGGGSAWPRTGPARAPTGASCPACGTAPAPVSMRCWGPTTTPPTGITSTSTWAYGRSAGERARANSGKIRAFPDDCPTMTDSAAPRLHVQALSADCAEAARRWAERLGLPLAADDEAEFAVQVGEQGLQVLQLGADSPGPVRVDFVEGASAHRRKFGGGSGQMIAKAVGVQPGIRPRVLDATAGLGRDGFVLASLGCEVTLVERQPLIAALLEDGLERARRDPDVAPIAARMRLLGGNSADLMRAWDGEAPQVIYLDPMFPHRDKSALVKKEMRLFRPLVGDDLDAPALLQAALALASHRVVVKRPRKAPIIEGPKPGYSLEGKSSRYDIYPKKALGKG

SEQ ID NO: 21201 - protein, 153 aa, Pseudomonas aeruginosa
PATLAAGAVHAETVERAQLHDARGRPRPGPAQRSTAAPGAAAGQRGSPPGRGVGRAGGGGARIRPRPGNGCVQRHPQRSRAVRRRPATVGLSDRQGGAPAVAGGIAGNEHRPAAGPLVSEQTVSAQALGAGPVARGGGRGGGALAAAAGGPAR

SEQ ID NO: 21202 - protein, 389 aa, Pseudomonas aeruginosa
WVLYFYYTAQYKNSNAVCGRCHMYRHIPLVALSLFSSLFLAACGNGTPPPAAARPAIVVQPQPAGEVSQAFPGEIRARHEPELAFRIGGKVIRRLVEVGERVKKDQPLAELDPQDVRLQLEAARAQVSAAEANLQTVRAEYRRYRTLLDRNLVSHSQFENIQNSYRAGEARLKQIRAEFNVADNQAGYAVLRSPQDGVIASRRVEVGQVVAAGQTVFSLAADGEREVLIGLPEHSFERFRIGQPVSVELWSQRDRRFAGHIRELSPAADPQSRTFAARVAFDDRATPAELGQSARVYVAAAEAVPLSVPLSALTAEAGQAFVWVVEPGSSTLRRQAVRTGPYAEDRVPVLEGLKAGDWVVATGVQVLREGQQVRPIDRANRTVKLAAKE

SEQ ID NO: 21203 - protein, 595 aa, Pseudomonas aeruginosa
SHVLQPFRLGVAESPDRPVPDDPAWRGRRAVLQQAGAERRPAVHLQGHGGADQLAGRQRRRGGPAGHRAYREEADGNRRLRSHRVLLPPRRLAGDLHGPRGHPFQRDPRTLVPDPQEDQRHSRHLAAKHPGPVLQRRVRHHLRQHLCAHRQGLRLRGDEGLCRPPATAIAADQERRQGRADRPAGREDLDRPVQHQAGHPRPAPGGGTEGAGGTERGGLLRVLRDRQRPRAVARFRAFRFGEGDPRLPHPRRRPHLPHRRRGRGSPRLQRSAGAAHALHGRGRHRPGGSDEAGRRHPGAGQGPGNRVRPPAAVAAGRTGTAQGVRPAGGGTYRGRRVHPGAGRGAGDRPAGELLLPRPAHRPGGGAVDPAGAGDDLRRHALLRHRPAQDLPRRPGAGAGIAGGRRDHRGGDDGGEDGAGLRPSQGGRLRLDQYRLPDAHRHPDHRRRLPADRHRAVRHRRIHPLAVPGGDHRPGGLLVRRGGLRSLPGGQAAAGPGQVARAEARRQRRWLRSLCYGLLPALPASGGVVRALPQDGDRPDPRRLRRRAAAVPPGAAAVLPALGASGAAAGHQAGGGRLTALYRRGSPAPGKNAAGP

SEQ ID NO: 21204 - protein, 309 aa, Pseudomonas aeruginosa
GTMIETRNLGKRFGSRVAVDDLSFQVATGEVLGFLGPNGAGKSTTMKMLTGFLAPSAGTASIFGFDIRNRTLQAQRLIGYLPEGSPCYAEMTVQGFLDFIAEIRGYRGAGKRERVARALGLLELDEVRRQTIETLSKGFRRRVGLAQAILHEPRALVLDEPTDGLDPNQKHQVRELIRGLAQERIVIISTHILEEVSALCSRALVIGGGRLLADSTPLELASRSRYHQAVTLYSDEPLDAVALAVLPGVAGIEENPAEGSLTVLAQPGAVIFPQVSGLVAERGWRIRELDVERGRLDEVFRNLTRGTEA

SEQ ID NO: 21205 - protein, 623 aa, Pseudomonas aeruginosa
RKPNEGESMKRVLSSGAGLLLIALAFLAFNMVSGLLFSGARLDLTEQKLYTISPGTKRILAGLDEPINLYFFYSDSGARELVPLRNYARRVEELLRAYEREANGRIRLQVIDPEPFSENEDKATEFGLQGIPLQQGGDNLYFGLAGSNALDGVQVIPFFPLDQEEFLEYDISRLVQTLAQPQRPVVGLMSSLPLNGGFDMASRQPTSPWMVMEEIRQQFDLRSLKSDATEIPPEVSVLLLVHPKQLPEQTLYAIDQFVLRGGKLLAFVDPFSEADSGSDFAATLDGDKSSDLAPLFEAWGLRLLPGKVLGDGAYAMSISLGRDQRPARHPAWLSLPREALDQDDIATAGLESLTLATPGILERLPGASTSFTPLLQSSAQAMPFDASRFGLLRDPGDLMRELRPSGRRHTLAARIQGPAKSAFAEGIEGHREGLKEARNINVIVVADTDLLSDRMWVQVQDFFGQRVPQPWADNGALVVNALDNLSGTDALISVRSRGRFSRPFVVVERLQREAETSFRQKEDQLKQRLADTEQQLAALQQGAAPEKAVELTPEQQATVRQYMQEKLRIRKELREVQYQLNADIDALGRTLKLVNIALVPSLLTVGVLLGWLWRRRRMARGGH

SEQ ID NO: 21206 - protein, 327 aa, Pseudomonas aeruginosa
RMRRNTLIVLLALVAALAGTFAWLQRERATEVPALPAAERWLPELDSATLSGLHMQFADGSPDIRVERRAGAWVLPAKADYPADRLRLSALLEALAEARKLEAKSANPKNHALLGLAERGEGQALRLSLHWQSGEPLVLLVGKDAQHGGSFVRRLGDPQAWLIDKRLPLPNNELEWLDRRIATLPFARVRELQLRYPKGERLDLYRDDAGQPNLQVRQLPTGRKLAYEAAANGAAALFADLRFADVAPLAQVGFRQAPLLLAFSLRTFSGARLDGEIRRQGEQYWLLPKSVEGFAEGEVAAHPDWAYRIEEDRYRALARHLPELLAR

SEQ ID NO: 21207 - protein, 151 aa, Pseudomonas aeruginosa
RRRAPAGRRAGGRGGRLRGRRLRLRPGWPASRWSRLGRSPRKPPGCPPRSRAERHGSWLRGSRCGVPSRRRTASAPVAPGPVGDPRARRCRRGRRACGRRMRRSRSPGPAGRGVRGRCPGRRRPGSRHRARGPAGSTPPPVARCRERWTTG

SEQ ID NO: 21208 - protein, 153 aa, Pseudomonas aeruginosa
TVPRPGCRRAASGRRGCARPRRPGWHARRGHVGRGGRWRRRRGSSRSGRRVRPVASGRWRRCRGRSGLPRRRRKRPESRRARETAGTWRTLCEDGYRGKGSAPGGAGEHRRASGEASWAQLCACSASFSSMAVLLVLHSTAPFCELRRNSRSG

SEQ ID NO: 21209 - protein, 115 aa, Pseudomonas aeruginosa
PARSRALTTFTRAFCSSSRATLVPAVMYRPASTMLRSPSGMPMPALAPIRQPSPTLMTMLPPPERVPMVEQPPPRSDPLPTNTPADTRPSIMPGPSVPALKLTKPSCITVVPSPM

SEQ ID NO: 21210 - protein, 225 aa, Pseudomonas aeruginosa
CRRERRSLLLPRPGSSRALPIGRRKVIAGLCHVVPPLCGLGATALGSGVTADSRGRAGGQGAGLFPWPGTERAQVEQVDSARWRASLPVLSECSGPRCTILPPPRRFPMSCIGRQIDQLRLQIPGFACKPGCHDCCGPVTASSEEMARLPLKSEAEHDAALAEWNCVHLGPNGCEAYEERPLICRLFGTTPNLPCPEGRGPEVPVAEQVERQVHALIASTRQVLV

SEQ ID NO: 21211 - protein, 229 aa, Pseudomonas aeruginosa
QLLDQGGLQAFAQVGVGERLVARIGDVEDVLHALAEGGDLGVLHRQVEIQEDAADPRQQAGAVGGDDFEHRDLAQRVGGDGHLRGEGEVLELARHPALDDGRVVVGVLQCVDKPLADLGDALRVVADGVAVGVEHDIGIEGELAGGGDDPRVLDAQVELVHGGHGDREEIVLVGGVDEDLRTALELALGGFLDQHQRRAVVRVLEDRLGVPGHVAGGVAQEVVVAELAP

SEQ ID NO: 21212 - protein, 725 aa, Pseudomonas aeruginosa
LLGIVLVDAVAYQLVEGRGLRLADLLLAVHRVLQAAAQGALGLGVELPEQAGAPGVPERRVGGVDVGHGEHVQVVEVGLVADQLGEIEDHLRVGEVLALRGGRHHQVVLHQPGHQLGVPERQLVALAEGLGVHRAEFRVVAATALGDVMVETGDVDQFRLGQTIDDLARQRIFLGHLRPIQLAQVLDQVEGVGVHRIDMEQVVLHLPDDMAELRQVAAEDAVAVHPPQVAVDTLAALEQLDEQAGVADVVAELVVDQVSAVAQQANGVGAHALDFRVLGHQHEDFQEGERGALEDVRVRHLDVAVAQLEATVQRLDLHRLLAGQDDFLEVLDDQVVQLGDRHHHPVVLLHEAFDRQLDVVVFVAEQTGDAALVIEQQAILGAPGEHVQGIADPPEELLAGSQHAALAFHQEAFAHQGVQVEAAELAAGHPEDGLDVAQAAGGALDVGLEVVLGVVVLGVAALLFVAFGQEELLARPHVRAAGNPQHALAQAVRAADGAAFHEGGDHRQVGACFLRALLHRAHALADFQADVPEQGEEAFDRLAEALLVLAVEEDQQVDVGVGVEFAAAVAAHGDQGDVGVVSPVEALPGLLQDLVDAPGAIFDQAADVAAAVEAVVEHFAELPDGLLEGGDRAGLQGQFRLELPAIEQFGIHLRHAAFLYLLAVGFDTRAPRLGAFLRCIGARAAPNRGVGPAGMGRGVEAHGWQQKPGRIRLPRCAGRFRRCAG

SEQ ID NO: 21213 - protein, 64 aa, Pseudomonas aeruginosa
PDLSRNYHVPSQHARYAEGRCALRPPDPLLEPENGQVHFRRAQQDPYHQPRKDPADVQRGPDLR

SEQ ID NO: 21214 - protein, 500 aa, Pseudomonas aeruginosa
QSLGEEASSARRRRPQGRCRCRQGGDRGLRRGRGRGPHPVRVLQRELAASGGRSQRADGAVSRGPAPRGAQARRERHPPAHHRRSHAFPSGVAGGHARSGSRHCRQYPFPPPGRRQLRRPVGHRPGRTAPGARGPGRAPGGGRYLRRAAPGLPGDRRPAAARPVHPHRRRASHQQFPSLAAGLRRAVFLRPVLARLQARGDAGCPGGFLQAPAPLRQDQRASRGRGPSVMLKQRIITALVLLPIALGGFFLLEGAFFALFIGAVVSLGAWEWARLAGYEQQFGRVAYAATVAVLMVALYHLPQLAGAVLLLALVWWTLATVLVLTYPESVGYWGGRWRRLGMGLLILLPAWQGLVLLKQWPLANGLIIAVMVLVWGADIGAYFSGKAFGKRKLAPRVSPGKSWEGVYGGLAASLAITLAVGLYRGWSLGALLLALLGAALVVFVSIVGDLTESMFKRQSGIKDSSNLLPGHGGVLDRIDSLTAAIPVFAALLWAAGWGAP

SEQ ID NO: 21215 - protein, 451 aa, Pseudomonas aeruginosa
EMSALYMIVGTLVALGVLVTFHEFGHFWVARRCGVKVLRFSVGFGTPLVRWHDRHGTEFVVAAIPLGGYVKMLDEREAEVPAHLLEQSFNRKTVRQRIAIVAAGPIANFLLAILFFWVVALLGSQQVRPVIGSVAPESLAAQAGLEAGQELLAVDGEPVTGWNGVNLQLVRRLGESGTLEVRVQEKGSNVDSTHQVRLDGWLKGEDNPDPIASLGIRPWRPALPPVLAELDPKGPAQAAGLKLGDRLQSIDGIAVDDWQQVVDSVRARPGQRVQLKVLRDGEVLDVALELAVRGEGKARSGYMGAGVAGTEWPVEMLREVSYGPLEAVGQALSRTWTMSLLTLDSIKKMLLGELSVKNLSGPITIAKVAGASAQSGVGDFLNFLAYLSISLGVLNLLPIPVLDGGHLLFYLVEWVRGRPLSERVQAWGMQIGISLVVGVMLLALVNDLSRL

SEQ ID NO: 21216 - protein, 332 aa, Pseudomonas aeruginosa
RRQDRLGDLRRRPGQARLRQPHQFPRQHQDRRRSAAPRNAPDGRRLGLHLPDRPVQGPPGAPRLLQGSQRRDPGGSRHRRPGRRQLQRRRATVRLDHRQRRLRPERRPDPRRLDQPEQLPGYRQQGQHRPDPQRIPDPLQLRLRRPLLDRRRRQPRLQRLLPEDRLRRTRRRRRQLLGEQPGRRHEHRLPDQRDLAPDLWPERAARPDRHRPLHRGRDLRLPRQGRRQLHQLQGFHRLVRIDPEQGRAGHPWSLAEPDPGNHPAGQRPVVLQDRLPRPGLRPADRQLHHALPHRAGLWRRLRIHRAPAVLRELLRRRLQLGAGLQGQHAGAS

SEQ ID NO: 21217 - protein, 181 aa, Pseudomonas aeruginosa
YRVTKPCFVQECIVRKFTQFVLITAAIMAAPSAFAEMKIAVLNYQMALLESDAAKQYAVDAEKKFGPQLNKLKNLERDAKALQDKLVSNGSKMSQGDREKAELDFKQKARDFQFQSKELNESKAAADRDMLKKLKPKLDQAVEETIKKGGYDMVIERGAVVDVKPQYDITRQVIERMNQLR

SEQ ID NO: 21218 - protein, 160 aa, Pseudomonas aeruginosa
RFFASPFSEQAPPNMMDINEIREYLPHRYPFLLVDRVVELDIEGKRIRAYKNVSINEPFFNGHFPEHPIMPGVLIIEAMAQAAGILGFKMLDVKPADGTLYYFVGSDKLRFRQPVLPGDQLQLHAKFISVKRSIWKFDCHATVDDKPVCSAEIICAERKL

SEQ ID NO: 21219 - protein, 556 aa, Pseudomonas aeruginosa
PYLSPGDKRRATSIAESPAPSCQVPFTAKFPSARTSFRVCPKHAAFYPGGRLTTIRHKRNRGVIHARIRHSGRRPAQRPYLGQDPHLAAGRLRPVLHRAPGADPVPPLRSYLQRAQGQPPVGRLGNLLVPGALHLSGGAGRYRQRRRRGGSDHARRSRRSVLDVGDRPGGDGDRLRRGDPGPVVQDSRRQGPVPWRPGLLHGEGPGRALDGHPVLDLPDHRLRFRLQLGAGQYHHRCHAGRLRRADLDQRHRRGDPHRVDHLRRPAFHRALLRTGGTLHGGGLPAAGGGHHPVQPQRTAGRPGDGGEECLRLARGRRRRHRRGDPQRLQARPVLQRSRHGLGAQRRRLGHALSAAPGVPGLRADGRRVHRYPADLYRFRRHHPAGRTAGRRGHHAGAECPDQPGRRLGPLFPGGDHPVLRLHLDRRQLLLCRELPGIPRAQPPGGPVDLPSDRAGDGDVRRAGFAAVRLEPCRRVDGPDGDHQPDRHPAAVQPRDQAGQGLQRPAQGRQAADLRRQPVPGSPAEARAGHLGRPPRLSAGRARLLGAAEAHRPLLNL

SEQ ID NO: 21220 - protein, 407 aa, Pseudomonas aeruginosa
LCHRARYNPGLVVFALFLLRGLHDRILRSPASAYRILPGRRPGPGQAPGQGSGRAGHAGGGGHRPEQHVLAGEVLQDRHGRRHQADLRGRHLARQPRGRWPAQSPEPAGDEREGLSQPHRADFPRLERRPAQRRDHHRTRLGQGGGGRPDRAVRGQGGRDRPRSARRRGSQGRGAVARVDGGVPRALLRRSATYQPGQRRGAPPRGGGFGVTLQRAAGGDQRRALHQAGRLRGPRDPRLHRRGADPRRSAAAAYLFGPAIPEVAGGNGRAVQRPAGSVGKHRRDRQALQHRGAAGQVLPAGLPHAQWHGHRRLPAARLLRRSRGAPGGAVAEGHPGLRGQAPGLCRSPELRTRYHHPDGFPRLLPHRDGLHQVGEEQRRTGRPRAGLGRRLAGGLRAEDHRPRSAGL

SEQ ID NO: 21221 - protein, 686 aa, Pseudomonas aeruginosa
GLRAGRNAPRLPQERRGSRRDLGDGPQAGRHHPRYRQARRWRGDRADQADRLLADRLRRGRRRPGDPVRQGRRGGGRPGEVRLPRPADPDHHQVGDGDHQPRAGQEGPGAGEHRLHPAGRQADLFAAAEGRDHCGVPARIARHEGADQEAQAGLPGRPHRTGGAVPPGSSAVGHGGRLHQPQARSRRAVLSAPRLPVRRPGAGAQAHLRHHPVPGTGDADRPGHGRLYPRWRGHAAPGDGQEEARGNGQAARRFHRGLQEQRHRCRPRGQHLRPGGKIRRLRLQQVALGSLRPGLLPDRLAEDPLPGAVHGRGTHRGYAEHRQGGDADRRMPAHEAAHRGAGREQLRVPLHRRRRWPDRLWPGRDQGRRRGAGGGDHRMPRRRRAVQHPVRLLRPRRPETHQQAHPGSADPRRCAGSPGAALPRRAKGLPGYRRPQPRRAAGGDGGSDPGRRADRAQPRQRAHGPVRRSLRRAGGGCLRQPPQGQGADPQGTPEGREGHPRPVPDRPSDRRVRRRGAALRPPAHRRAEAGARYPDGGRADRQPAGDEEQEGRQDGLRHPRRPLRTDRGLAVLRSLRRGPVAAADRRAGGGRGRGQPGRLLRRTAPARQARDEPGGGAYRPGGEPADEAARRPVEGRSPALAGRAVQPPSRFLPDHPGLHQRRRQGPAAVRRELAGGSGGRSDPGIA

SEQ ID NO: 21222 - protein, 332 aa, Pseudomonas aeruginosa
GAKRKRPTRICARRKPMNPNFLDFEQPIADLQAKIEELRLVGNDNALNISDEISRLQDKSKALTENIFGNLSSWQIAQLARHPKRPYTLDYIGYLFSDFEELHGDRHFADDPAIVGGVARLDGSPVMVIGHQKGREVREKVRRNFGMPRPEGYRKACRLMEMAERFKMPILTFIDTPGAYPGIDAEERGQSEAIAWNLRVMARLKTPIIATVIGEGGSGGALAIGVCDQLNMLQYSTYSVISPEGCASILWKTAEKAPEAAEAMGITAERLKGLGIVDKVIDEPLGGAHRDPASMAESIRGELLTQLKMLQGLEMGELLERRYDRLMSYGAP

SEQ ID NO: 21223 - protein, 465 aa, Pseudomonas aeruginosa
AIRRTGTIDKPGIRRACRMRSASMPAVPLESRLLQALAPWREAGGWCVAFSGGLDSTVLLHLLAQLARSEALPALSALHVHHGLQAAADGWPAHCQVVCRSLGIPLRVERVQVAVGGSIEQAARDARYRAFQANLGEGQVLLTAQHLDDQAETLLFRLLRGAGLRGLAAMPASRPLGGGRLCRPLLGVSRAELEAYAQAHRLDWVEDPSNQDPRFSRNYLRREIMPRLASHWPQAVAGMARCAAHLREAEDLLAELAAIDLRACRQPSELDWPDWLDLPRIALEPLRRLSAARQRNLLRAWLGQLTRLPDSDHWAGWESLRDAGDDADPIWRLESGELRRGAGRIWWLPADWRAAAGPFVWERPAHPLLLPGNGRLALLGEVPAGPLRVDYRRGGEVLALAGRGRRDLKRLLNEAGVPSFLRGRLPLLFRADELLAVANIPGLDSPREGGWRLSWSPPTNDPGLS

SEQ ID NO: 21224 - protein, 166 aa, Pseudomonas aeruginosa
NIPGRPEHGTEDRSRRRYPDRQRPAVRAVRRHERAGVARPGHAGLRRIRTGYRETRYPLCVQGQLRQGQPFLDPLVPWSGPGRGNEDLRRDQEDLQGTGHHRCPRAVPGPAGGRGLRHHPAAGLPLATDRPGGGDGQDQRGDQYQEGPVPRAPGDEAHPDQVRGSR

SEQ ID NO: 21225 - protein, 185 aa, Pseudomonas aeruginosa
SGRDPGQRHRRQRLRAFRCFHRFPRGPRAARWRQEPLPGQGRAESRGQHQRPDPRPAAGQGRGRPESPRPRDDRAGRHREQGQAGRQRDPRGVPGCRQGRRTGQGRTAVRAHRRPQRHSRPVLHAGADDEHHQRRRACGQQRRYPGIHGPAGRREELRRGAAHGRRDLPSPQGRAEGPWPEHRRR

SEQ ID NO: 21226 - protein, 270 aa, Pseudomonas aeruginosa
RKAPRPSRSVRGTSSAWSRTAKPSTSSPSELTTLLPMTTSDLPAFWTVIPAAGVGSRMRADRPKQYLDLAGRTVIERTLDCFLEHPMLRGLVVCLAEDDPYWPGLDCAASRHVQRAAGGAERAGSVLNGLLRLLELGAQADDWVLVHDAARPNLTRGDLDRLLEELAEDPVGGLLAVPARDTLKRSDRDGRVSETIDRSVVWLAYTPQMFRLGALHRALADALVAGVAITDEASAMEWAGYAPKLVEGRADNLKITTPEDLLRLQRSFPH

SEQ ID NO: 21227 - protein, 399 aa, Pseudomonas aeruginosa
LFLETRFSTLSVSVGRLAARRLPSFRSSQMIKSRAAVAFAPNKPLEIVEVDVAPPQKGEVLVRIVATGVCHTDAYTLSGQDSEGVFPCILGHEGGGIVEAVGEGVTSLQVGDHVIPLYTAECGKCKFCLSGKTNLCQAVRATQGKGLMPDGTSRFSYKGEPVFHYMGCSTFSEYTVLPEISLAKIPKDAPLEKVCLLGCGVTTGIGAVLNTAKVEEGATVAIFGLGGIGLAAIIGAKMAKAARIIAVDINPGKFDIARELGATDFINPKDYDKPIQDVIVELTDGGVDYSFECVGNVQLMRAALECCHKGWGESVIIGVAGAGQEISTRPFQLVTGRVWRGSAFGGVRGRSELPSYVEKAQKGEIPLDTFITHTMGLEDINEAFELMHEGKSIRTVIHY

SEQ ID NO: 21228 - protein, 164 aa, Pseudomonas aeruginosa
FQPGRFFMRIGHGYDVHRFGEGDFITLGGVRIPHKHGLVAHSDGDVLLHALSDALLGAAALGDIGKHFPDTDPRFKGADSRALLRHVVAIVAEKGWKVGNVDATIVAQAPKMAPHIETMRGLIAEDLGVAVDQVNVKATTTERLGFTGREEGIAVHAVALLMAR

SEQ ID NO: 21229 - protein, 195 aa, Pseudomonas aeruginosa
PGCGRSVPFSTRAWNVSPRTACPIISACNASATAAATWSTRAVARNRTCCRRTATCVRASFPPGAATCSIACSPSGSRRVAGTGQRSVTCWPLPTAAAFSSLARKNAAMPVWPPSTCTPPDRSGARAIRRAAPASSNASWPWPGASRRSAAGWRRRAWRTNGASCGSPSRGWRGIIRNLMFCNWNSSCRPVVSPP

SEQ ID NO: 21230 - protein, 373 aa, Pseudomonas aeruginosa
RPLFRYRGGGHRRALPEGAGLRLLAGLAVDGQPAHRHALRPPAGLRPRAPGRAAAYRAQRQYPEPAAGSRTWYPTDPPRAPCPCRRTGEGGQSARQGRLLDRRGRRCRGRRAGDGFPRGHARLRVDHPVAAGPHLPRSLRRPRRVAGRTDVMSEDLHRRGIGMTSQRTRERLIQRLYEEGLSNAHVLEVIRRTPRHLFVDEALSHRAYEDTALPIGHNQTISQPFMVARMTELLLAAGPLDKVMEIGTGSGYQTAVLAQLVERVFSVERIQALQDKAKERLAELNLRNVVFRWGDGWEGWSALAPYNGIIVTAAATEVPQSLLDQLAPGGRLVIPVGGGEVQQLMLIVRTEDGFSRQVLDSVRFVPLLNGPIA

SEQ ID NO: 21231 - protein, 302 aa, Pseudomonas aeruginosa
TKAKKMDKGEGLRLAATLRQWTRLYGGCHLLLGAVVCSLLAACSSSPPGGVKVVDRNGSAPAAARRTPVTSGQYIVRRGDTLYSIAFRFGWDWKALAARNGIAPPYTIQVGQAIQFGGRASAQPSVAKNTPVVAAPVATKPTPVPPAVSTSVPVKPAPAPASTTTPPSSGATPVVTGPAVGGWAWPASGTLIGRFASNGSLNKGIDIAGQLGQPVLAASGGTVVYAGSGLRGYGKLVIIKHNETYVSAYGHNRRLLVREGQQVKVGQSIAEMGSTGTDRVKLHFEIRRQGKPVDPLQYLPRR

SEQ ID NO: 21232 - protein, 163 aa, Pseudomonas aeruginosa
ASRQPAAPMARVRFWQPKPFRSWVPNCWQRLLCAESRSKSHGARRRTPRRFSAGRPCGQSSGISSSAGLRRSSSASRVSQPFISWTLKRPLVMSSTARPNRRSSPRIAASRLSRRSSSSASSLTVPGVMIRTTWRSTGPLLVAGSPICSQIATDSPSLTSLAR

SEQ ID NO: 21233 - protein, 144 aa, Pseudomonas aeruginosa
SLSVSTLENSDDPDGVRPDRTGRPPRRKPSLPGRAGQHGGILHRWRHRRGDHPHPGEFGLVRGWLRDLLEPPEDPPAGGARVAVPGSRRGQPGSGRGHGARRPAAQRGAFRGGGERCRRARRWLAGKAGRHGLAGLGRRRAAGQ

SEQ ID NO: 21234 - protein, 324 aa, Pseudomonas aeruginosa
GSRIGPPAVRRAARRASPRTGQPAGPAPSHRTDHPAAALSRRRLLADGRAGPLLYRTGGGQPRPARPGRQSRRIGQQPPRRRAQGAQASGQRAGERTGIGERSGHHRAQRGGGGVRLPGQPGRTQPGCQLRSVLREDARRGAPDPDLRPPAEGIPASGRLAGLAAGRYFAYLGERQEPAVAPGHHLLRCPAWRDERHGPGALPGRSQQRPGAATDDLPQPGPTGLPGDPQARPADGVRRRPGRAPGPRRRDPGRGALRLRSAAADRQRQLPARTDAPRRAAPGRGRAGLPAGLPAGAGTLPRAARSLGGRGGGRRGAGGTTVPG

SEQ ID NO: 21235 - protein, 359 aa, Pseudomonas aeruginosa
SFQLNRYSFSAAVAWAAPAMRVATSNSFFIMVPCYGVAGLRKPEQGKAAGLSGRPAGFGGSMALDGAGGEFRGDHDQHQGEQHQQGGDGVHFGRHGDLDHGVDLRRQGGEAAAGGEEGDHEVVDGQGEGHQRAGDDARHDQRQGHQAEALPGRGTEVAGRLGEAFVHARHARLHHQGDEADREGDVREGHREHAQAHVQADEEDHQRDPHQEFRNGDRGQHQQGQHAQLEAMQGDPGEGAEQGRHAGRNQRDDQRVGGGLEHVAVAEQLAVPVQGEAHPLGVQPRVVEGVQHHDHQRYVEEQVHQRGGAPEQVGPTHGRLPCGRARRPCRGRPAAGCSRSGRSTARCRTASRGSRGTGS

SEQ ID NO: 21236 - protein, 227 aa, Pseudomonas aeruginosa
IPVPRRRREREGHPPEALPTTGAEVLGGVQQGRVVFLQVGVERQDHERQVHVDHAQDHRERGEHQADRLRAEQVQCGVDPAGQGTGRREDDHPGVDAYQQVAPKRQDHQQDQQVAPLRRGPGEGGRHRVGEQQAGQGGDQGVAEGFDEQLQVHPALGEPGVVLHAEVVDGLPVLAVHPGRQAAVVAGKAERGEQHDQRRNQEEEQQIRLRRPDQQPLAEVLSHRLRP

SEQ ID NO: 21237 - protein, 321 aa, Pseudomonas aeruginosa
NFAVAFQPVSSSLRCSFARPFRIGSLPDEPCRFPLAPGAPGAQPETLRRARFAHAALRRLSAAAELLHVRLAAAGRGARRHVPGHARHRGAETDQHRLADRRYRGRHLRLRLVAHRGRPALAGVAGRPAVAAIPGVPRRIRGGGAGGERGRPAGGRQATAVHPARRDLDRGAQDVPQESLPGAVPGAQPAARAALALSPASLDPWRAPVHRRSGGAVPGAGWRRGRGRGARRLPGGVQRALPGRQAAHSAGRGQPGAPCPGAVPWLSVRPGALRRRACAATTAPPACPPASARNRNSRAGAGSRRGTGRRRWRRTPLPGTG

SEQ ID NO: 21238 - protein, 69 aa, Pseudomonas aeruginosa
  UNSURE (8): Identity of amino acid at the above locations are unknown.
NRFRRRAXGDPTWRGHRQIPTGQQIEIFQGVEIGRPSRMYARAEGAGERVLTVEVSGNGAPFAEGRAYL

SEQ ID NO: 21239 - protein, 220 aa, Pseudomonas aeruginosa
AQPGRKLAARAELPCITGGCRHRAGADRADAFHRQQALDAGIATYVSLNLSLQSSDARLQRLQFIFQFTQQLAHRGRQGRRFGSRDRFEQGHRRRSPTSRRDQPELAQQATHLIAQRRAGPHQTTAHPMHRLHGLLLCALHRDIAHARTTGGFADRLGVVCIVLVPLDVWFDELRCDHAYRVAQLPQLARPVIAHCRRPPSPTKPRRAVWRKKSRTWCPP

SEQ ID NO: 21240 - protein, 241 aa, Pseudomonas aeruginosa
  UNSURE (60),(69),(156): Identity of amino acid at the above locations are unknown.
RWKCRATARLSPKAGPTCERAERRNAMMGVNANISESLTGTIEAPFPELEAPPANPMEVXRNWLERARXYGVREPRALALATVDGQGRPSTRIVVIAELGERGVVFATHADSQKGRELAQNPWASGVLYWRESSQQIILNGRAERLPDERADAQWXSRPYQTHPMSIASRQSETLADIHALRAEARRLAETDGPLPRPPGYCLFELCLESVEFWGNGTERLHERLRYDRDEGGWKHRYLQP

SEQ ID NO: 21241 - protein, 330 aa, Pseudomonas aeruginosa
FPGGKGVESFTRNGVCGRPNSRGAPGAGFLSPNCPPWLGGRRRPAAVRNNWARELRELGHTIRMIAPQFVKPNVKGDKHDAHDAEAICEAASRPSMRYVPVKSAEQQAVQSVHRVRSRLVRARTALCNEVRGLLGEFGLIATRRGRAATMALLETVTATEPAPLPAPMGELLRELKDELQTLEARIARLERQIQAHVRGDARIQRLLAVEGIGPISASAVAASAGDARQFRTGRQFAAWLGLVPRQHSTGGQQRLGNISKRGDTYLRTLVIHGGPCSRGVVAPTRPMPASRWLQGLLQRRPANVVAVAMANKNARILWALLSRETCYRPG

SEQ ID NO: 21242 - protein, 107 aa, Pseudomonas aeruginosa
RQRVLETGQAIRLMSEDMDNTSALVGGLAEKAQDISKVLDVIRGIAEQTNLLALNAAIEAARAGEQGRGFAVVADEVRALAHRTQESTREIEQMIANIQQKKTSRDT

SEQ ID NO: 21243 - protein, 65 aa, Pseudomonas aeruginosa
PSTPLPPTVLDLILALSTETLVKRSTAVKAWPLLWAWLPVLIASSNECGDKKGVSSGQAQKLHSA

SEQ ID NO: 21244 - protein, 256 aa, Pseudomonas aeruginosa
MDFSINPPQRIVFVGLGTIAQSFLPLLSKVHDLSTLEIYAIDPKTPPLIEYFANSFGLKFINSAIDQINYRDILVPILGEGTVLINLSTDVSSLALIELCRSAGALYLYTCIEPWKGGYDDPTIPLHKRTNYHLREQMLSLKKRLGSGVTALVAHGANPGLVSHFVKRALLDLAEEILGDCKKPSNKEQWAILSQRLGVKVIHVAEYDSPISHKSTEKGEFVNTWSVPGFLNESPQTAELGWGNHQRIPPPDASMH

SEQ ID NO: 21245 - protein, 192 aa, Pseudomonas aeruginosa
FSLAHHALCSFWACPLETPFLSPHSLELAIKTGSQAQRRGQALTAVERLTSVSVDKARIRSNTVGGSGVDGHVSLDVFFCWMLAIICSISRVDSWVRWARARTSSATTAKPRPCSPARAASMAALSARRLVCSAIPRITSRTLEMSWAFSARPPTSAEVLSISSLIRRIAWPVSSTRWRQLSAAFTMGYGRA

SEQ ID NO: 21246 - protein, 954 aa, Pseudomonas aeruginosa
AAEAYPRLVGESLAGGGEEVAGNVGEQVVHLRPSLHQRRQPGDHRAAGGGGAGAKLQQAPAPLRLALDDGGDGLGHGLVQRLGMQALAVHGLGDARRALREHQRRRADPPGQLLAEGLRAVTQVGDQLGRPERRRRAAGERRPGVLRTLRGTLGAAQPALALGAQVAALLQLAQPVAQQALARLGDTQALAQGGEVQRRRTGEQTAAGQPGGQRGEAGTVECGHRRGDALLAAPVAAQGLGRPLAHRVERRTRILASLRRRMQGDEAGQAALVGLAEHHGGRQIDLRMSAQRGVQLGQFDAVAANLHLVVLAAEELDAAVGQIAAEVAGAIQATAIGVTDEAFGGALRIAGVAERQAHPADMDLAAHARRAAPPAGIQDFHALPAQGTAIRDAGQLGVLRADRLLDRPDRRLGGAAQAEQRAVRPAPPPSGRQADRNPVTGPEHAARSRQVTLRLALQVIDEHLALGRHRVPQGDGVAFQQFRPVRWIAAARRVREDHLGPRRGGAEEVVDREVEAQLGEAEDAVVGVDAVALVDVEQRVAHRRMAEHHALWRAGGAGGVDHVGEVVRRHLRRGRWRPGAVGGQPVDGHAGAADVRDIAFQADQRDHFGAGEDRLAPQRRLADVHRHIGGAGLEDADHRDQLRGAFRQHHRDPPATARAVRFQDAAQGGGVLGDLAVAVAAGGIVDRRGVGGQQGTLGETGGDAPGTTGQRLRRRLDGFRGIAVGPGARALRQAPEQPDEVVEHGFRLALGEQPEAYVPADLQAAELVGDLAVQPDLRGLADHVAWRARRLAIAEQALHAADATGEHHRHQVGAATAPARQFAQQVDAAEGRVVEVVEHLLADASGTLDETVAVAAVHCQQAERGEVTEHLRQLRMQRRPVEYRQVETERRCLAPATDGLGEGRQGHAGSAQAVFAGARAERLPGGLVEARVEVPEARGPGVRLHPQRQVGTPR

SEQ ID NO: 21247 - protein, 137 aa, Pseudomonas aeruginosa
RHSPSARVMLSARRRRSTLPLPFNGRLGRHHRRSGRIAWGRRCSRPAWSAAASSPSPGASASTRASRSLRHRQRGASPAAARSANRLGNSARRSGRSSSKAAPSSASGDSHSRSTSNRRPCGRSSAAASARPSRLAS

SEQ ID NO: 21248 - protein, 148 aa, Pseudomonas aeruginosa
RPRCSACSRPSSSACTTIRSGKRVAAASMRTRLRSKRVSSSPGRNSEAMPWSSQSPARVSSTATRRRSPAAGVGSASSRRARGLAAVRQARGHRLRRQPGIEEQRGRRLFAGEQAAQSVAHRGQPRGLPAEPAQRLVERRQRAGGGVR

SEQ ID NO: 21249 - protein, 613 aa, Pseudomonas aeruginosa
FHGAFGPWRQARYQHRAEARHATAEHRRAGAIHASLGAQRGLHLAQLDALAAHFHLLVDPTEEFQGTVAPVATAIAGAIPAALGIVDEAPGAEFGIVAIAAGQAGAADPQLADHQVRHVAPVGVDHPVGLSRQWPAVGNRTPVRRHRIDALQVRPDARFGSATQHMQAAAFGTTWAQAAGQVQGHPVAGQQHRPQTAIVGLARRQAEGHLQQGRRRVPQAHRMPLDSLRPGSGIARLFLGRQDQAGTGAEAAEQVEDRQIEVQRGDRQQAIRCVHPQQVEQRVDGIDRRRVADLDALGHPGGARGVDHIGTRLRRQRHGGGQRRAAQQALDIQARRQGLRIVLLGDRQAYPGGLFDQAPPCGRLVDVQRHVAGACGEHAEYRRDLLRSARQADLDRVARAHPGFAQAAGDAQRTLGQFAAGDTLVAIEQRVGIRRLGGAKEEVAMQGARRGACRLAVEQGPARLLRPGQRQIGGLLPGAVAETLEQPHVGFEHGFRQAFGEQADDAVPGQQDTVAHPVELVVEPDLRGLREHVVEIAESVAEGRRDEALLAQVAGEHHRRRAWLAPAGAPRGAPPGRGMRRGRWLRGGCAGSSSPPRRRTPRPASGTPAATGW

SEQ ID NO: 21250 - protein, 239 aa, Pseudomonas aeruginosa
GEIPRFRSSAPGPARRRSRTRWTRSRHAARQDAPGAGSRRRKAGMPGAGCAAGGCFPARRPTAGPARPASAAGVPASSRGPAPRPRRVAPHGAPGSRRNAAPAAPPGAPAPGRQRPVRPAAGAGFRHRRQAGRDSARGDPRRPACAPARAGTPGRAPPPGIHGRASRAAPASRARPRPPARCASPAGRSRTAAASEGSAGDRRGSAPATSGGVDARTPPPRPGAAGRHPARGIPGRHGS

SEQ ID NO: 21251 - protein, 134 aa, Pseudomonas aeruginosa
RCPAPRRRHVPASRPAARKTARTADRDPAPSAARPLPGRTAGPRRPAGRARPPGRGAAPTGRSPASSHARAGVPAGTSGGSSRGRSPAGRRRPPGRARRQAVHRAGRRAARSASRAGRYGNRGADPWGLPRASI

SEQ ID NO: 21252 - protein, 65 aa, Pseudomonas aeruginosa
GRLPVPGNDYQMRPYLTCLGGLAGNALDSRTVSLDAASSRSGDTPPVAGSGVVAETQRISLGEMP

SEQ ID NO: 21253 - protein, 583 aa, Pseudomonas aeruginosa
KSPAIERRGLARSLPPANDNKSHFPAMAIDRIHGDRMTSSPVTPSAVDDAPDWPAAFVRRYLDAGHWQDQNFAEALAASAARHPRRIALCDDDQRLSYADLLQRCRRLAAGLRQAGLAHGDTVVLHLPNGIAFVETCFALFQLGVRPVLALPAHRQHEISGFCRFAEAKAYIGAERIDGFDPRPMARELLASGACRMALIHGEAEAPLQALAPLYQADALEDCAARAEDIACFQLSGGTTGTPKLIPRRHREYLYNVRASAEVCGFDEHTVYLTGLPMAHNFTLCCPGVIGTLLAGGRVVVSQRADPEHCFALIARERVTHTALVPPLAMLWLDAQESRRADLSSLRLLQVGGSRLGSSAAQRVEPVLGCQLQQVLGMAEGLICYTRLDDPPERVLHTQGRPLSPDDEVRVVDAEGREVGPGEVGELTVRGPYTIRGYYRLPEHNAKAFSADGFYRTGDRVSRDKDGYLVVEGRDKDQINRGGEKIAAEEVENLLIAHPQVHDATVVAMPDSLLGERTCAFVIPRQPAPSALKLKQYLHACGLAAFKVPDRIELVPAFPQTGIGKISKKDLRERLRRELEARA

SEQ ID NO: 21254 - protein, 213 aa, Pseudomonas aeruginosa
RRCRACAWPASPMQAAAPASSVAGANACRQTSTCLPCSTRVARTASTRRRPPAWRTSPTAPPSPCAISPTRPWRCSATVSARRWPTKPPCAWKAPARRCATCSSPPIRHRTGNAAARCTAATRRRCWRTSAARVAPASYSRTPTCARCSCRSCAPTTRRSRPTDGRSPSPWPAPSTSSSASTTRKSAPPRRRPGATPAGLPPGCGTFLAATST

SEQ ID NO: 21255 - protein, 596 aa, Pseudomonas aeruginosa
SSTCCAASHIPTPFPERLHDENSRRLHRPGGHPRGHRPDRPGYRPGPRPPHGLRQGGVALQGQRGGDSGTRAGRRDAPRARPLGRGKRTRRALRRGTVRADHPLVHRRADQVLAPDTGCRMSRLAPLSQCLHALRGTFERAIGQAQALDRPVLVAASFEIDPLDPLQVFGAWDDRQTPCLYWEQPELAFFAWGCALELQGHGEQRFARIEENWQLLCADAVVEGPLAPRLCGGFRFDPRGPREEHWQAFADASLMLAGITVLREGERYRVLCQHLAKPGEDALALAAYHCSALLRLRQPARRRPSGPTAGAQGDASAQERRQWEAKVSDAVSSVRQGRFGKVVLARTQARPLGDIEPWQVIEHLRLQHADAQLFACRRGNACFLGASPERLVRIRAGEALTHALAGTIARGGDAQEDARLGQALLDSAKDRHEHQLVVEAIRTALEPFSEVLEIPDAPGLKRLARVQHLNTPIRARLADAGGILRLLQALHPTPAVGGYPRSAALDYIRQHEGMDRGWYAAPLGWLDGEGNGDFLVALRSALLTPGRGYLFAGCGLVGDSEPAHEYRETCLKLSAMREALSAIGGLDEVPLQRGVA

SEQ ID NO: 21256 - protein, 443 aa, Pseudomonas aeruginosa
GSASARRGLGQALEGGAIHLLGIHFDIGGGLLGHHHGVCHTGQRPESLDQHRVLQRGGRERQANAGHIRRFAHGNSNRQPEGSEHRASDEHHAQPAVLEHPAAEDAAQRRAEELAGGIHPHRRALAAGRRDLADQRRQRGFEQVEGSEEHHRADHQHGQAVTEDQEEQFAGQQGRHRAGQHALHATLLLGVDDERHHAEETDQQRGQVDPPVLLLGQAPLVHQCQRQGDEAGHEDGVEDQDAGVQAQQVAVLQGRQQGLARHAGFAVLGHVVRLRDEEQDQQQADQRHPGGEPEQPMQAEQMGQHRAEHHGHGEGDADAHADHRHRLGPVLLAGEVGEQRHHRRRDRPGALQDAAGDHPPDGVGIGREGRAGGEDQQPDDDHRAPADAVGNGPEGNLQDRLGQAIGADGQADQRRGRAGQVLAVGGQHRQDHEHAEHAEGEYQ

SEQ ID NO: 21257 - protein, 1019 aa, Pseudomonas aeruginosa
VVHNTLMEETAAGQGLMPLPMAPPPAPGRPGQCPRRKNAAHSTSPPPRGTGAPLCRALAASRIISGFRPPCEAAVDKILIRGARTHNLKNVDLTLPRDKLIVITGLSGSGKSSLAFDTLYAEGQRRYVESLSAYARQFLSMMEKPDVDTIEGLSPAISIEQKSTSHNPRSTVGTITEIYDYLRLLYARVGTPRCPDHDIPLEAQTVSQMVDQVLALPEGSKLMLLAPVIRERKGEHLAVFDEMRAHGFVRARVDGKLYELDEVPKLDKQKKHSIDVVVDRFKVRADLQQRLAESFETALSLADGIALVAPMDEDEDVEEIIFSARFACPVCGHSISELEPKLFSFNNPAGACPTCDGLGVKQFFDARRVVNGELTLAEGAIRGWDRRNVYYFQMLGSLAQHYGFSLEEPFDELGAEHQKVVLYGSGRENVDFRYLNDRGDIVKRSHPFEGILPNLERRYRETESATVREELAKFLSTQPCPDCHGTRLRREARHVWVGDRTLPAITAMPVGEACEYAAGLSLTGRRGEIAAKILKEIRDRLQFLVNVGLDYLTLDRSADTLSGGEAQRIRLASQIGAGLVGVMYILDEPSIGLHQRDNERLLGTLTHLRNLGNTVIVVEHDEDAIRLADYVVDIGPGAGVHGGQVVAEGTPDQVMNHPDSLTGKYLSGRKKIAVPAKRTPRDKKKLLKLKGARGNNLQNVNLEIPVGLFTCITGVSGSGKSTLINNTLFPITATALNGATTLEVAPYDSFDGLQHLDKVVDIDQSPIGRTPRSNPATYTGLFTPIRELFSGVPEARSRGYGPGRFSFNVKGGRCEACQGDGVIKVEMHFLPDIYVPCDVCKGKRYNRETLEIRYKGKSIHEVLEMTIEEAREFFDAVPALARKLQTLMDVGLSYIKLGQSATTLSGGEAQRVKLSRELSKRDTGKTLYILDEPTTGLHFADIQQLLDVLHRLRDHGNTVVVIEHNLDVIKTADWLVDLGPEGGSKGGQIIANGTPEQVAEMPQSHTGHFLKPLLERDRA

SEQ ID NO: 21258 - protein, 467 aa, Pseudomonas aeruginosa
KSPLPRKGAGGLIRPSVQLQAEGVGDAFAVGRVDLEEQADLATLDLFRYIADVFGDVGEQPLLLLVGEQMEQRGGLAVVVVVHPVVPVVRRALQAQRRLGEVRLLLPLVEAVRLVGDALMGVVAVHPHAAVAVVDLVRATRGVHRDLVVVDAQAIAMGVAVGEQTALEHLVRRETDTGHHVGRRESGLLDLGEVVVRVTVQLEEAHFDQRVVAVGPDLGQVERVVAIGGRFLLGHDLHVHLPAREVAFLDALVQVALRTLAVLGDHFGSLGVGQVLDALLGLEVELDPEALVVRIDETEGMAAETMDVPIALRQAAVAEVDGQLMQRLGEVREKVPLEGRIAQVGARVTLYHVVEIGEFERVTQVEHRGVVADQVPVALLGVETHGEAADIALGIRRAALTGDGGEAQEHIGLLADLGEDLRPGVGGDVMGDGEGAVGRGAFRMHAALGDHFAIEVGELLEEPHVLQ

SEQ ID NO: 21259 - protein, 356 aa, Pseudomonas aeruginosa
LRRSGSGLVVFLKTCRRPVIEAHTEGQTTGSQNVLDFGQGLLAQVRRFQQLHFGALDQVTDVVDVFRLQAVGRTYGQFQVIDRAQEDRIDLVFLLFNDGFAVALEVHERCQLLLQDGSGATDSLFGIQGAVGFQVQDQFVQVGALLDTGVFHHVGDTTDRAERCVELQTADAAAFVFIALTCVGRLVATATSYLQLHVQRAVVCQVGDNVVTVDDLNIVIQLNIGSSHNTRALLSQGQRHFITTVQLDGQTFQVQQDLDYIFLHTFDRRVLVEYAVDLGLDHCAARHGGQQDATQRVAQGVTKTTLERLERDLGAGLTDHLHIDVAGGQELIYRTLHGCTYFLALTWSRARQSGFR

SEQ ID NO: 21260 - protein, 115 aa, Pseudomonas aeruginosa
NPCDGKLPGSNRGTDAPARRRCDVLSAFHAAADRSRTDGHDAGHAGQERFQPCTSSRGRGRRSSGTGRCLHGETVCTWDQCNEPFLTVSYYTRRFFGGRQPLCGIGVTSVMLAIL

SEQ ID NO: 21261 - protein, 337 aa, Pseudomonas aeruginosa
QLPWLENLLDALATLGRYCFRSLHVLQALEGGVNHVHRIGGAIALGQDVLHTSHFQNGTHGAAGDDAGTFRSRLHVHLGGAMGGLGRILQGGAVQIDLDHVAASGFHCFLDGGRHFTRLATTETNATLAITHHGQCGESEDTATFYGFGDAVNLNQLLDVAFVALLLVVCHNLELQSAFTSGISQRFHTAVVLEARTIERHLGDAGRFGALGDQLTNFLGCIDVAGGTFAQVFVQGRGAGQDLAAVGRNDLGVNVLGRAVHAEAYGFQLAHLQACLASATQTGFFLDAHLLCPTSSWLLYDGRLRRRNARPCLCKAPADGSREFRQQPDRPAACRYP

SEQ ID NO: 21262 - protein, 197 aa, Pseudomonas aeruginosa
TGFWVDLKTRIFLPSSTLKPTRSALLVSVLKMATLETCRGASFSTIPPCWPSIGLGLVWRLIRFTPPTTRRSSARTFSTLPRLPLSLPAMTITSSSRRIFCMTATPYSTSGASETIFMNFSVRSSRVTGPKIRVPIGSCLLFSRTAALPSKRMMEPSVRRTPCLVRTTTAVMTWPFFTLPRGIASLTVTLMMSPMPA

SEQ ID NO: 21263 - protein, 145 aa, Pseudomonas aeruginosa
SLTCLLIEHSFNASDVALNLREQVRLPQLASCFLHAQIELVAQQAEQLLVQLLNGFFTKFIRFHHITVRLTKEVARGSFAAARAKASRASSSETPSISYRTLPGWIWATQYSTPPLPLPIRTSRGFLVTGLSGNTRIQILPPRFT

SEQ ID NO: 21264 - protein, 90 aa, Pseudomonas aeruginosa
RPAEVRPSPPPCGWSTGFIATPRTVGRTPRQRVAPALPSERRLCSEFETSPRVARHSARTLRISPERRRRVTYAPSRATSWAEAPAERAI

SEQ ID NO: 21265 - protein, 226 aa, Pseudomonas aeruginosa
IRVPGSSQQLLELLHGGHGDQHLVVGDQADGVGTLDITYIDVRQVARSEVQVLVDTIGHDQHVFQTQGVQLGNQALGFRCIDSEVGNDDQTVQTNELGKDGAQCCAVHLLVQLLFVATRFSGESGAAPTPDGATDGASTSTTGALLTPRLLATTRDFGASLLRLAALTAASHVGHDCLVHQGLVEFATKGTLGDFDSLSAVHIQLHLSFPLNREPWLPDARSHHRR

SEQ ID NO: 21266 - protein, 98 aa, Pseudomonas aeruginosa
KEAQLYGCPHRVSIFNQRTKKGAPEGPFSDGRISDYSMILATTPAPTVRPPSRIAKRRPSSMAIGAIRVTTILMLSPGITISTPSGSSQLPVTSVVRK

SEQ ID NO: 21267 - protein, 115 aa, Pseudomonas aeruginosa
PDSSSVLTRNDGSSWASLPRAIPIFSWSALVFGSTATEITGSGKSMRSRMIGFSIEHRVSPVVTSFMPIRAAMSPARTSLISSRWLACICTIRPTRSFLPFTEFRTESPELRTPE

SEQ ID NO: 21268 - protein, 1413 aa, Pseudomonas aeruginosa
CLVTARVQRFGQCGFRLAGTHTLRLAEVALTLALAVVSQTGTGRDQATHDHVLFQTTQEVALAGDRRLGEDAGGLLERRRGNERLGRQGSLGDTQQNALVLGRELVLGTELFVLFQHLGEFHLVAFDEAGVAGLADFDLAQHLTQDGLDVLVVDLHALQTVDVLDLVDDVLRQRAHAQQAQDVVRVARTVGDDFAAVHLFAFEHVQVTPLRNQLLVRIAAIVRRDDQAALALGLFAEGDGAADFRQDRRLFRTTSLEQVGNARQTTGDVTGLRGFLRDTRDNVTDAHLGAVGQVDQGVGRQEVLRRYVGTRQQQVLARGIDQLHGRTDVLAGSRTVLRIHHFDVGQAGQFVGLTLDGDALFHAHEGHGTVHLGDDRVGVRVPLGDDSARVDLVTFLDRDHRAVRQLVALALATEVVGNRQFAGTGNRDQRAVGTNHMLQVVQADGAAVLHLDVVGRGGPAGRTADVEGTHGQLGARLTDGLGSDDTDRLADVDAMATGQVAAVAHGADAMTGFAGDRGTHHHFVDAHHFEEVDPLLVDQGAGRHDDLVAARLEHVARDHTAEHALAERFYHVAAFDVRRHQQAVLGTAIDLGHYQILGHVDQTTGQVTGVRGLQRGIRQTLTSTVGGDEVLEYVQAFPEVRGDRGLDDRAVRLGHQAAHTCQLTDLGRGAPRTRVSHHVHGVEGLLVDFLALAIDDLLFREVGHHRLGHFVVGLRPQVDHLVVLLALGYQAGGVLALDLLHFVGGGVDDPRLLVRDDEVVDADGHAGNGRVGETGVHQLVGEDDGVLQTHHAIAVVDQLGDRLLLHRLVDHVERQAGRNDLEQQRAADGGVDDTGIGGQLAVFTLDLFVDAHFHASVQGRLAAAVGAVDFLQVGEGHALALRVDRFTGHVVQTHYHVLRRNDDRLAVGGRQDVVGGHHQRARFQLGLEGQRNVDGHLVTVEVGVVRGADQRVQLDRLAFDEDRLERLDAQTVQGRRTVQENRMLADDFGENVPDLGQLALDHFLGGLDGGGHTTTFQLAEDERLEQLQGHLLRQTALVQAQGRAHGDHGTTGVVHALAEQVLTEATLLALDHVGQRLQRTLVRAGDGATATAVVEQGVDGFLQHALFVAHDDVRSGQVEQALQTVVTVDHPTIQVVQVGSREATAIQRNQRTQVRRQHRQDGQDHPLRLVAGALEGFHQLQALGQLLDLGFRVGLRNLFAQAADLVLQIDGVEQFVNGFGAHASIEIVTELFEGLEVLLVVQQLALFQGGHARIDHHVALEIEHALDIAQGHVQQQADTGRQRLQEPDVGNRRSQLDVAHALAAHLGQGDFHAALLADHTAVLEALVLAAQALVVLHRAEDLGAEQAVALRLEGTVVDGFRLFNFAERPGTNHLGRSQANTDGIELFDLTLVFQQIKQVFQGLSSSRTRCDRP

SEQ ID NO: 21269 - protein, 147 aa, Pseudomonas aeruginosa
RSGCRRKVVAYLSSTLAPASSRAFLAASASSFEAPSFTTPGAPSTTALASFRPRPVSSRTTLITFTFLSPASARTMVNSVCSSAAAAAGPAAATVAAAAVTPNFSSIALISSTTCMTDISDTALMMSSLVRAMTLIPVLGDGLRPSY

SEQ ID NO: 21270 - protein, 299 aa, Pseudomonas aeruginosa
GMRFQLDLFDLTELQLHRGRAAKDEHGHLDPALLVVNFFDDTIEVGERTIDDTNGLARLEQGLRLGLVAAIGHATQDCISLTIGDRSRLVGSPADEAHDTRGILHQVPGTFVHFHLNQHIAREEFALALALLAVPHLHHFFGGNQNLAELFFHASKLDTLDQRAHDMLLVARVCMHNVPTLSHGAPLTYNHGNQPTQQGIEPPQQQRHYQHYRDHDQRGLSCFLTTRPYDLANLDARFLSKTKEGLPLGRLQSQESSDHRQNENTENAIQDWLSRKVLIAHNGNHNQNGNQEPFQEIKT

SEQ ID NO: 21271 - protein, 120 aa, Pseudomonas aeruginosa
RPPSSLDSTYTSHSNLVCGLMVPGLARTWPRSTSSRLVPRSRIPTFSPARPSSSSLRNISTPVQVVLVVALMPTISTSSWTLMMPRSTRPVTTVPRPEIENTSSIGIRNGWSMARTGSGM

SEQ ID NO: 21272 - protein, 197 aa, Pseudomonas aeruginosa
RGARGASPSPSRRCTLPMPLVNTTGIRSAPRPRRRASSRSRSTPLKVGWSRSSNICSPMRRARSTKLSPWRLSTASRLSAVKSPSTCASCGCSGGRLSTVRLRQNAGAWLQRPMVSAKAAKATPAALRPCSPARAPSACQAASSRRAWKCRKRVDRVSGCTRSGRSGRPGSASRRASHQSRSRCQAGDWRRRCSTPT

SEQ ID NO: 21273 - protein, 168 aa, Pseudomonas aeruginosa
EPLPSTRPALAHGLPAAPPPRARDDTRRVRGSCSRPGGDDRPCHCRSTAGLAGTTGVRAASPGAGVAPGRPGARRRRARVPAPAPRPGRAVRCATGNAAPVPQRRDRPTGSATPPGAAAGRRARPHRAAPVATRIAGPPATGGPAGAAAPPPAPGLRGWPRRRAARRS

SEQ ID NO: 21274 - protein, 233 aa, Pseudomonas aeruginosa
GRGCVRRGSVPAPGATARPCPGRARARRGYPAPPPAGVRRQPASAALRAGAPGASRPSGRRAATACGASQGSRSSAAGACSPASRPRRALPIAVSPAACQPSRRNASSSDGSALAAESASQSSQRRRKPSSSSSGASSSAPRISRVSTASASARPAKGCAAGSSMEPSARGARRGTSTAPRLATPPPSTAAQALSTPAWAHSAASTSPNSMRWPRTFTCWSTRPRNSRVPSPQ

SEQ ID NO: 21275 - protein, 518 aa, Pseudomonas aeruginosa
SWWSSQTCGVCESMSWRSPKASRKAAGTKPSSPRLLANTTGAERGWPLPARLAEHLQGGECGVVDGSVEVALEALHRLGEGHPGLHPALQQQQGGEVGDHLADTRVVGMPIEQRHVEEKFRAFAPARQDQREGAAEHAGQGHAMLRGKTLQAPALAGGKLECQAPGARLADAFRRAGQRQGRRVRQARQAFQPVVAGPRRGLGALRRTVRQVVGEMQRRRLRQALRRQVGNAQFGQQQAQAFDIGGKQVETQPEAILAARHAHQPEQEHLAALHRQAFMGAPVAQRLPVALGLVHLQGAPVLQVEAGQRRRRKDLLATVEEARPQHRVALTHALRRRGQALRVDIPRAEFQEGMAADVAQHLAGATSQPVGLLHGRQLERLIAILRRRQRDRCRGGQPVRAGQQVEPGPQAGALRQLGEVQRRATRAQAFLQVHQADRVEAAAQQVVVVRQGAHVGKRFTEQVGELLGQPVAQGGTGIGGQIHGGSLGQASEVGCQFLATIIKCDLISLAWEAWPAML

SEQ ID NO: 21276 - protein, 319 aa, Pseudomonas aeruginosa
LERTPAARHRPACPAVPGSRGPLQRGAGHPLGGPRRRRRPRPARFRRRAPGAVRPQSRRGAGLRNRPAPGKRRRAAAPPVRLRPSGTAPATRRRVAPRRRGGAAGGRPPPGWRQRATRGRRPARAVPADPARRLPGDRDLPTGAAHRPGLRPRRPPRRARRGSQRRRGAGLERRQPDSRQAAALSWRPLLPERGARRGDRAPAAPPRTSRRPFPRGCMMKTPEDCTGLADIREAIDRIDLDIVQALGRRMDYVKAASRFKASEAAIPAPERVAAMLPERARWAEENGLDAPFVEGLFAQIIHWYIAEQIKYWRQTRGAA

SEQ ID NO: 21277 - protein, 177 aa, Pseudomonas aeruginosa
AAWTKCPCSAASPENEDPLRPEGGRGSSKVCPWRGRAAPQGRRLERNVVVEAVVFLGRLRRRLLLRGRTRLLLRGLLRALHGLARGALRIVAGRAAAEQLHVAVDVDHDLGGVAILTVLALPLAGAQAAFDVHLGTLAQVLAGDLRQAGRITPRGAIRYAPVAGRSACPSSSRWWRG

SEQ ID NO: 21278 - protein, 196 aa, Pseudomonas aeruginosa
THQCCSLGRPPSCTSASGKATKLAMRMAWRIRMPASRRSRSPCFRVGSRAWRATLDSRCWVMWSGCGTKNRISSRPTSAIPAVNQNSPCRPNRWVSTGPSTMATAKETPMLMPIIAIALVRCCSRVRSESSAITAAEIAPAPCRTRPAITPQMESALAARAAPAAKISSPTTITGRRPMRSEMVPKGICRIAWVRP

SEQ ID NO: 21279 - protein, 147 aa, Pseudomonas aeruginosa
PWPRARSAAGTGATSITSRCSVRWPSITASAWKNPSTNSAPSTRRWCSTAPAGKTSTSAISTTAATSSSVRIPSKASCRTWSGATARPSRPRSARSWPSSSAPSPARIATVPACAARRGMCGSATGRCRRSPRCRSAKPASMPPDSA

SEQ ID NO: 21280 - protein, 474 aa, Pseudomonas aeruginosa
RGSALQITRTMPSRRMILQLRHSFLTDARTFITNSSNLTGLSAQHAAAVALQVGFLHQGFILVRNEVRLHLGHKVHDNHDHDQQRGPAKIERHVRRNHQELGQQADSRHVQSTEHGQTGQHAIDVASGLFARTDARNKCTGLLEVLRHVLRVEHQRCIEEAEENDPCSEQQDVQRLPRSDRLRDVLQPTQAFRLTEPGAQGRREQQDTAGENRGNHTRHVHLQRQMAGLRCKHLAALLALGVMHRDATLATLDEHHERDDRHGQQADADQGEDVDVTLTGRLERLTDGARQACNDTSEDQHRDAVADTALGDLLAQPHHEHGTSHEGGDSHEVEAEVVGEGYALAAQANGHADGLDQCQDYSTVAGVLADLATPRLTLFLQLLQLRADSGHELHDDRCRDVRHDPQCKDTHALQRAAGKHVEEAKNGPLVLPEQCRQAIGVDARNWDVRADPIDDDRQEQETQTCPELGQTAVA

SEQ ID NO: 21281 - protein, 215 aa, Pseudomonas aeruginosa
RRESTLLSHLVLEFTASCFDSRTRTLGGGDTFQGDRTTNFAGQHDFDALYVLVDQVGILQGLQADDVAFDLGQLGGAYFSTIHGLQGNEAELRQATVQRLLTTLEARSDLATGAGGQTFVTTATGLAQTATDATARTVLFATGTRRGTQIVQLHGLTLHTQQVVGLVDHAAVLRSVLNFDGMIDATQAETLDASLVIGQTAVQALDQSDFDSCHG

SEQ ID NO: 21282 - protein, 221 aa, Pseudomonas aeruginosa
MCWEERYTQRRTVSSSRIFRRALRARRRRVSFLTLICYALLLLGFFTTDDFVGVTHALAFVRLRRTEVANFGSNLTDQLLVDTLDQDIGLAGGFSDDAGRQFVINRMGEAEGQGQHLALGLRFVTNADQLELALEALADADYHVVHQSTGGTSHGASLLVAVTRSKTQLTAVLDHFDRRMDLELQSTFGALDGQLLTSQFDFNAGRQLDGVLSNARHADSP

SEQ ID NO: 21283 - protein, 73 aa, Pseudomonas aeruginosa
TPGETNPGSGEPGILEITPKRIKPHEGLDSMSRSTVPTGDTVRCDYQLAFTRPGTSPRMAASRSLLRLRPNLR

SEQ ID NO: 21284 - protein, 213 aa, Pseudomonas aeruginosa
RFSSRFFMLSLAMFLLQSVTEREFESTQQGATFVIRTSGGGQGDVQATQRIDLVVIDFREDDLLFHAHAVVAATIEGLGIQAAEVTHARQGDGQQTIQELVHPVATQGDLDADRPAFTDLEACDGLTSVSHDRLLTSDLFQIGYGVLDDLLVTDRLAKTHVQGDFGNARNFHHVRQLKLFFQLGRDFLPINFFQSCHGDLPSSLKPEPVSGST

SEQ ID NO: 21285 - protein, 212 aa, Pseudomonas aeruginosa
PYYHDEPDHGCGRSFVCGTSYAWVAAFAYSLPSSFFTRSGCYRLQLFLAATDDLALEDPNLDTDHTVSGVRFVGGIVDIGAQGVQGHTTFAIPFGTGDFSPTQTTADLNLDALGTNAHGVLYGALHGATEHYATLQLLGYALRNQHGIEFRLADFLDVDVHGHTHLLGQVLAQFLNIFTFLADHDAGTSGVDGDACGLSRTMNIDTAYGRAF

SEQ ID NO: 21286 - protein, 255 aa, Pseudomonas aeruginosa
APFTFNCISASPLTASLGCRTHDHITAGSAGNGTLDQQQIAFSIDAHDLQGLNGYPLRTQMTGHFLALEHSTRSLALADGTRDAVGNGVTVGVILTTEVPALDGAREALTLGLAGNVYHLACLEQIDSDLVTSGILLFAQTEFPHAATGGDIRLGKVTSLRFGNARSTTLAGGDLHCTVAIGFFSLELGDAIRLDLDDRNRNRDTFLGENAGHAAFTTDNTNCHVVNLLSVRGFHPLWPPISERYTTNAEGISRG

SEQ ID NO: 21287 - protein, 184 aa, Pseudomonas aeruginosa
PLHTLHVQAHAARGASDGTYSSVQISSGQVSLLGLGDLFQLGTGNGADFLGVRTSGAAGDASCFFQQDGSRGALGFEGEATVAVNGDDHRSRQARLLALGLGVERLAEFHDVHAVLTQGRADRRRRVGLTGLYLQLDISLDFLSHLLLQIRVQAPEGSPVAFAFIPVTTKPRSLGLRGEGCVFS

SEQ ID NO: 21288 - protein, 103 aa, Pseudomonas aeruginosa
QPEHQRFVHSGPLVLGAAPLKSQTSTADRDRTVSRRSKPSSRTTLNGEQPYPWDRLQPQDVMSRHRGAKHRRRYELLGGISLLSPEYLLSVERWPFHTEPPDH

SEQ ID NO: 21289 - protein, 156 aa, Pseudomonas aeruginosa
SARPVARRGIARCHAGRRPARPARAPPARSRRTPSRRPPDSARDARRSPASPRPRRAGSRPPPAGATSGAAGAGAPRRYPGAGTGWRSPAASHWRTDRCRPARRPARRGRHGRVRPPPRRCPPRCPSRGARPGPPAGAPRRAPYADPRQPPPAHAG

SEQ ID NO: 21290 - protein, 200 aa, Pseudomonas aeruginosa
NPPSSAVRRHPGRYSARGAGPATGRAPRRRGRGVRGPAPGAPGKRPRRAPRRHARSAAARAPRAARAARRCPRSPRAASGGARPWRSRPPPGAPDRCRPASRTRRTAGRRYRRSRRPPGGPARRRPAPGSMGSAGGPGRVRRASQGRLPGVPAGPRARPAGARRGRRRGRPGGRDSAGGPPRSRVRCAGCGRFPAVRRGS

SEQ ID NO: 21291 - protein, 167 aa, Pseudomonas aeruginosa
QAVVQRLHHDPFRQAGGGGVDEDAAAFEEGQFQPRAQQRGHALVEPEPGAGIQHRHPQAFAGSRRRQRFEQARQGPRGRPAGARPPPAAPARDRGAARPAPVRRRAGRAERCPSRSAPRPASRAGATPRRATAARWRRSPLASPASAGANRRLAPAAPPAARRGFPG

SEQ ID NO: 21292 - protein, 254 aa, Pseudomonas aeruginosa
AGPGAPAAPRATADRRAAPRRCRRDAGAAPRRLRTWFPAGLRGTGRRRCPRPAGYRRPPGRAGGRARPAGSARACRGDRRKRRGRPPGRSPPRPGCWRTPPAPSVAGPCRRASRSTSRAGNAAWSMAPWRLRWKLFTASAKDTPACIRHSSSNRVVKSAITSPIRGSSACRSNNGTLRRNSALSLQRARTSAKAQPNTLDKVTPCCAARRSRRRLSPAESWNARRRVRGWRMLSGAQANGRAGASGKRGRRSSQ

SEQ ID NO: 21293 - protein, 136 aa, Pseudomonas aeruginosa
ISFPSNGNRPHPRRSHDFLARHPIGRRRRPRLARRLRPPLSRRRPLAGPELRRSPGRQRRAPSAADRALRRRPAAQLCRPAPALPPPGSRTAPGRPRTWRHGSAAPAQRHRLRRDLLRPVPARRTPGARPPRPSPA

SEQ ID NO: 21294 - protein, 517 aa, Pseudomonas aeruginosa
TGHPHRPGTAAGDALAGCPGKPPRRSIQPASAPGRRLQARQQCRATRRTGARLPVATGAGNGRGADLLHPPGRSARTRAAYPGPAAVAGRRSAGGRRRGPRGRPRRGRRTDRARSLHHPRLLPPARTQRQGLQRGRLLPHRRPGQPRQGRLPGGGGPRQGPDQPRRREDRRGRGGEPADSPSAGARRHRRGDARQPARRAHLRLRHPAPAGALGAEAEAIPARLRAGRVQGAGPHRAGPGLPPDRHRQDQQEGPARAPAPRAGGPRMSAAWVRPFRLTPMPRLRLACFPHAGGSASFFRSWSERLPPDIDLLALQYPGREDRFNEAPATRLEDLADGAALALRDFADAPLALFGHSLGAALAYETALRLESAGAPLRHLFVSAHPAPHRQRGGALHRGDEAALLEDVRRQGGASELLEDADLRALFLPILRADYQAIETYRRAQPIALACALDVLLGEHDEEVSAAEAQAWSDASRTPARLRHFPGGHFYLSEGRDAVIEHLLRRLAHPDALSREVA

SEQ ID NO: 21295 - protein, 550 aa, Pseudomonas aeruginosa
KLPKTAPAWRTSARPSTGSTWISSRPSAAAWTTSRRRRASRPARRRFRHPSGSPRCSPSAPAGPRKTDSTRPSSRDCSRRSSTGTSPSRSSTGARHGVPHEPAGAPEPVPARLARHLRARHRPGAGARSSGLGGGVVRDRPIGPAAGIRCLGRPANALPVLGTARAGVLRLGLRPGAARPRRTALRPDRGKLAIALRRRRGRGPAGAAPVRRIPLRSARPARGTLASLRRCQPDARRHHRAARGRTLPGTLPTPGQARRRCPGPGRLPLLGATAPEAAGQTPALGADRWRAGRRFGAGAQAMGSQGERRGKQCPPGTLRQGRAGPHPGPASRRHRAVAGHRTPASATCRRPAVRLSPRQRLLPRRLPGTPGPHSRRRGTHPCPGRDHRPRRRCPGRCAARTGPAGQRQGQARTPVGGGGDPYGPGTLQRGAGNPRCARPETTGASPAPEHADPRPPRRRRRHPAAAAGAASDPRGGRLPTQRGAGLHPPARRDGPWLVRRAAGLARRRRQRRFPGGAALGPAHAGPGLPVRRLRSGRRFGTGPRVSRNLP

SEQ ID NO: 21296 - protein, 190 aa, Pseudomonas aeruginosa
DPDSWGAYPQPEERRPHTATRQTDRDHRSFRFRQVFPGFRHALCGRPAALRGIPLGLRPAVPVDDGEAGRGHHRRAVAGDFHRTEVHFPQPTLHRGYDHRDLRLPAPALCPRRYPALPGPRHPAGGADRQPDGRPGPGPAGRQQADAAGAGDPRAQGRAPGGVRRDARAWLRPRPGRRQALRTRRSAETG

SEQ ID NO: 21297 - protein, 479 aa, Pseudomonas aeruginosa
AEEAQHRCGGGPLQGSRGPPATPGRVVRDRPVPGRRYRPGSTDGRGRGCRGDHLLGALRLPGLRPLYQRAGTQAVLLQQPGRRLSDLRRPRREAILRRAPGGQRRVDPGRGRDPRLGPAQRLLLPDARFAGPALRLQPGRTLRRTRRRAPEGGALRLRPGKRRLPLSQRPRRHRQAFASLRRHPAEPGAALPRDRVGHGPRGAGQVPQHPALPGLPRYPPAPRGAACVGRRPDAAGDHRDAGRRSLRVCRRTQPDRPPWRDRGEDPQGNPRPPAIPGQRRPRLPDPRPQRRHPVRRRSPAHPPGQPDRRRPGGSDVHPRRTLDRPAPTRQRAPARHPHPPAQPRQHGDRGRARRGRDPTRRLRRRHRSGRRRARRPGSGGRYARPGDEPPRLADRQVPFRAQENRGSGQAHPARQEEAAEAERRPRQQPAERQPGNPGRPVHLHHRGLGLRQVDADQQHPVPDHRHRAERRDYPGSGAV

SEQ ID NO: 21298 - protein, 277 aa, Pseudomonas aeruginosa
LVRRPAAPGQGGRHRPEPDRSYPALQPGDLYRPVHADPRTVLRRAGGPLARLRSRPLLVQRQGRPLRGLPGRRRDQGGDALPAGHLRSLRCLQGQALQPRDPGDPLQGQEHPRGAGDDHRGSPRVLRRSPRPGAQAADADGRRPVLHQAGPERDHPLGRRGATGQAVPRAVQARYRQDPVHPRRTDHRPAFRRHPATARRAPPPARPRQHRGGDRAQPGRDQDRRLAGRPRPRGRLQGWPDHRQRYAGAGGRDAPVAHRPLPQAVAGTRSRLIAGRS

SEQ ID NO: 21299 - protein, 139 aa, Pseudomonas aeruginosa
RAISHCLLLHATLFRRTAAVMRDRGYVGDAGDLVAASIQSANGGLAARARALDVDVQVLQTVFQGSLAGTLGRYLGSERGALTRAAETGTTGGRPGQCVALTVGDGHDGVVERRVDVGDPIDHCLFDFLTGTSSRFCHD

SEQ ID NO: 21300 - protein, 253 aa, Pseudomonas aeruginosa
ISFNRAMVIYLAASSLNRFLGRLEDTNFLTVFYLEANAVSLAGFSIEDGDVGDVQRRLLLDDTALLAEHRIGLGVALDQVHPADDQTVVSENLQHLATLALVLAGNDDYFVVTTNLLHDGYSLQHFGGERDDLHELLGTEFTSHWPKDTGADRLLLVVQQDGGVAVEADDGTVGTTHAVLGANDHGSHDLALLHFAARNRFLDGDLDDVADAGVTAVGTAEHLDAHHTTRAAVVSDIEHGLSLNHIISPTPSP

SEQ ID NO: 21301 - protein, 203 aa, Pseudomonas aeruginosa
TGRAAGRAVARSAAQRIFHEVHSLSSHHRPLNKGGGEGQLCSSQGESLTRQLFGNTLDLVQDLARLDLGYPVLDPTLTFTHTNFEGLLGDRLVREYADPDLAATLHVTGQRTTRGLDLTSSKAATASGLQCVLTEADLTTTMSQTTVVAGHLFAELRTLGLQHLRTPYLAAFLRGAGATGFSSSWRPPMTSPLKIQTLTPITP

SEQ ID NO: 21302 - protein, 89 aa, Pseudomonas aeruginosa
ILMPLAPMRMAFCTARFMARRNITRRSSCWATLCATSMASSSGLRISSMLMCTGTPICLVRSWRSFSTSSPFLPITMPGRAVWMVMRAV

SEQ ID NO: 21303 - protein, 408 aa, Pseudomonas aeruginosa
RSINGPFFSERGTVVSLYLLAAADDHVIGTLVRASLLTLGLKTPRRYRMTTSRGTAFTTTMRVVDRVHRHAANGRANTTPARSTGFTQRTQAVLGVRDFAQGRTALSQDFTHFTGAQTQGYVRTFTRDQLGGSASGASDLSAFTRLQLDTMNSATHRDVAQRHAVACLDRRTDTGDQLVTCSNALGGDDVATLAVCILQQSDVCSAVRIVFDALNDGRDAILVATEVDQTVVLLVTTTDMTGGDTTVVVTAARLGFLFQQRCVGSAFVQLLIHHLDDKATTSGSRFALNDCHDAPLYSALVAKSRSWPGWRAMYAFFQSLRLPRPRAVRLVLPLTFRVVTRCTFTLNRLSTAFLISSLVASVATLKTNWLLPSARPVAFSEMCGPSSTLNTRSWFIPAAPRTSSRRTR

SEQ ID NO: 21304 - protein, 409 aa, Pseudomonas aeruginosa
WQDQRLLDDLGNHAGANGTAAFADREAQAIFHGDRSDQGDNHLDVVARHYHLYAFRQFAVTGHVGGTEVELRTVALEERGVTTTFFLGQHVHFALELGVRLDGARLGQYLATLYVFTLGATQQDTNVLTSTTFVEQLAEHFNAGAGGLGGRLDADDFHFFLDLDDAALYTTGYHGTAAGDREHVFDRHQERLVDGTNRLRNVGVQGLYQLLHGAYADAVVILAFQRHQRGTDDDRSVVAREVVGVQQIANFHLDQFQQLGVVDHVGLVQEHDDVGNAYLAGQQDVLAGLRHGAVGSRANQDRAVHLGSTGDHVLHVVGVTGAVNVGVVTNSGIVFNVRGVDGDTAGLFFRRVVDLIESTSGTTPGIGADLGQCSGQSGLAMVNVTDGADVDVRFVTFEFFLSHDSKPLT

SEQ ID NO: 21305 - protein, 558 aa, Pseudomonas aeruginosa
RAESTLFFNQRFDDVRRSFGVFGEFHGVARATLGHGTHVGRITEHLTQRNLGTNNLTGNRVLHPLNQTTTTVQVAHHVTHVVLRSHYLYLHDRLEHLAAALLGQLLGRHGSSDLERHLVGVDVMVGTIENGSLQADERIAGNDAVLHLLFDTLLDRRDVFLRNHTAHDFVLEHQAFGDIALLVHVRGRETDPAMTELTATTGLANELAFDLHVVLGDGLTVGNLRLADVGLDAELALHAVDDDVQVQLAHAGDDGLTGLFVGLDTERRVFLGQLAEGDTHLLLVSLGLRLYSDRDYRLGEVHALEDDRLLDRAQGVTGGDVLHADQGSDVACAHFLDLFTLVGVHLHHPTDALFLAFHRVQDGVAGTQDAGVNAGEGQGTDERVGSDLERQGRERFVVVGMTLVFDGLVVRADALDRRDLGRSREVVDDGIENQRNALVLERGTADGRNDLAGQGAQTQAFLDLGFGELALFEVLVHQLFVGFGRSLDHAGTPLFGQVLELRRNFFLAVGHALVVIVPVDGLHLDQVDLTDEVLFSADGELDRNRGMTQALLDLLDDA

SEQ ID NO: 21306 - protein, 318 aa, Pseudomonas aeruginosa
EVRALAVHLVDVDDARYAVLVGLTPYGFRLRLYAGGATEHHDSAVQYTQGTLHLDGEVYVAGSVDDVYAIVVVLTARTLPEGGNGSGGNGDTALLLLHHPVGGRSAVMHFAQLVVDAGIEQNPLRGGGLARVNVGTDTDITVAVDGCSTGHNKVLGGWAARLEPVVREGLVGLCHTVHVFTLLDCCALAFSGIQQLASQAQSHGLLATLAGEVHQPTHGQGITTGRTDFDRNLVSRTTYAAGLHFDQRSDGIESFFEGFQGIGLAAFLHLVQRTVNDTLGNGFLAAFHHVVHELGQDLASVFRISQHFTLGRYTTSWH

SEQ ID NO: 21307 - protein, 148 aa, Pseudomonas aeruginosa
PGTITVKLRPTLLLSTQINIKTLLLRTLGAVLRTTLLTVFDTRGVQRTAHGVVTHTRKVLYTTATDQHYAVLLQVVTFTTDVRGNLETVGQTYTAYLTQCRVRLFRRGGVYAGAYATTLRAVLQRRHVALVDHALARLTHQLVDSCHL

SEQ ID NO: 21308 - protein, 1357 aa, Pseudomonas aeruginosa
RHVLFGFQFDVDAERTDLFDQNVEGLGHAGLHAVIAVHDVLVHLGPAVHVVRLDRQHFLQGVRRAIGFQRPHLHLTEALTTELCLTTQRLLGNQAVRAGGTGVHLVVHQVVQLEHVHVADGGRTLELVAGTAVEQTHLAAFRQVGQLQHGLDLAFLGAIEHRGRHRYATAQVLGQREDLVVAQLVEVFLATADLVVDLVQELTQFGDLALLFEHAVDLLAQPLGREAQVGFEDLTDVHTRRYAQRVEDDVDRGAVGIVRHVFHRHDHRDHTLVTVTAGHLVARLDATLDRQVDLDDLQHARSQVVALLQLTLLVLELVVQELATIADVGLGLLQLFVQGVVGHAQLEPLAALETVEVVVGDLRALLQRRATFSLGTDQGGTQTLKGRAFDDAELFVQVLADLVELHLLDGQRAGIALDAVAGEDLNVDDGTLGAGRHTQGGVLHVGRLLTEDRAQQLLFRSQLGLAFRSDLADQDVAGLHFGADVDDTGFVQLVQRGLAHVRDVRGDFLWAELGVTSDAGQFLDVDRGETIFLDHALGQADGVFEVEAVPGHERYAHVLAQGQFAHVGGRTVGQDVAARDHVTLAHQRTLVDAGVLVGTGVLGQVVDVDTRFAGLDFVIRHANHDTAGIDRVDHTATASHDADAGVARHVALHAGTHQRLVGTQGRHGLTLHVRAHECAVGVIVLEERNQRGSDGNDLLRRHVHQGHVFRRLHGEFVQVTHGHQLVHQLTLLVEGRRSLGDDVVGFFDRRQEHDLVGYQAVLDHAVRALEEAVLVGAGVGRQGVDQTDVRTFRGFDRAHAAVVGRVYVTNLEARTLTGQTARAERGDAALVGDLGKRVVLVHELRQLARTEELLDRGSHRLGVDQVLRHQAFAFGHGQAFLDRALDTHQAHAELVLGHFADATDATVAQVVDVIDDALAVTDVDEGLEHIDDVFLAQDARTFDLGTTDTAVELHPAHGRQVVTLGAEEQVAEQGLGSFLGRRLARTHHPVDLDQGFQLVAGVVDLQGVGDERTAVDVVGVQGLDAHDLGLGHLGQEVEGQLGVALGDDLAGSRMHDRLGDGTADQVVERHFQLAHASLFQLVDVAGSDTTPLLHDHLAAAILDVDARDFTAQALRDQFQVQGLALDVEDVGRVEGVEDLFGAIAERAQQYRGRQLAATVDTDEHAVLRIELEVQPGTAVRNDPRGVQQLAGAVGLATVVVEEHARGTVQLGDDDTFGTVDDEGTVLGHQGDFPHVDFLFLDVLDRLVRRLAVEDDQANFHAQRYGEGHAAQHALLDIECRLTQTVADVFQGSIAGIADNRENGLEGRVQTDIAELLLGCASLQEFAIGIQLDGQQIRHIHDVRQLAKVLADTFFLSV

SEQ ID NO: 21309 - protein, 145 aa, Pseudomonas aeruginosa
TQGRRLLELDFGACFFQGFLGGFGFFFRSAFLHHARSAVYDGLGFFQTQTGQFANDLDHVHFLVASFGQDDGELGLLFGSGSSRASSGNGSGSSGNAELLFHRLDQFDHLHDGHFGYGVDDVFVGQSHDSNSCIGGRPAAIVLNK

SEQ ID NO: 21310 - protein, 348 aa, Pseudomonas aeruginosa
ACGLRLAPPTVLDSPRQAGTPIPVQRAEPAARFHLGFQGSQVDLQARTHGGAQGHALDVHAFRRGRLQALQVSQQRFNVLLQLGRLEIDLTDGAVDDAVLVGTETYLTSLGILHGGSDVRSHGADFRVRHQTTRAEDLAQLADDTHGIRGSDDDVVVQVAAFHFGSQFVHAHLVGAGSQSGFGSRTLGEDGNADALAGAVRQDGGATNDLVGFTRIDAEVHGNVHGLLELDGGQLGQQLGGLFEAVLLAGNYFLGNRLLALGQLSHYTPSTFRPMLRAEPAMVRTAASRSAAVRSACLVLAISSSWARVTVPTFWEFGRAEPLVMPAAFFSRTAAGVLLVSKVKLRSL

SEQ ID NO: 21311 - protein, 451 aa, Pseudomonas aeruginosa
ATGLKQNQADHYAGLRGEDQPILFDDLGNHASTNGTAAFADREAQAIFHGDRSDQGDNHLDVVARHYHLYAFRQLAVTGHVSGTEVELRTVALEERGVTTTFFLGQHVHFALELGVRLDGARLGQNLATLYVFTLGATQQDTNVLTSTTFVEQLAEHFNAGAGGLGGRLDADDFHFFLDLDDAALYTTGYHGTAAGDREHVFDRHQERLVDGTNRLRNVGVQGLYQLLHGAYADAIVILAFQRHQRGTDDDRSVVAREVVGIQQIANFHLDQFQQLGVVDHVGLVQEHDDVGNAHLAGQQDVLAGLRHGAVGSRANQDRAVHLSSTGDHVLHIVGVTGAVNVGVVTNSGIVFNVRGVDRDTAGLFFRRVVDLIESTSGTTPGVGADLGQCSGQSGLAMVNVTDGADVDVRLVPFKFFFSHGDHPLQGIERITLPLEQGQIFSYLPLDKWSS

SEQ ID NO: 21312 - protein, 174 aa, Pseudomonas aeruginosa
DGPAHFQPNPARKTSPKKCHWPALPRQSGSCRYCAPEAPSTDEAQPPARLAEEDRPSNRRSSPHGPRPPPRYLGPAGAAATFGHPPPHRLRQDRDRPTRMRSTLRQPEAHSAPAPAIPSAPWKQGCSRPTAECSSAHPYRVPAVRFPWPVAGIAAGARRSTRRSGPGETGRTSA

SEQ ID NO: 21313 - protein, 171 aa, Pseudomonas aeruginosa
ILSLNRASQCQPYENQVRHDPGASQFVANQFGIPTRQEYFTIRTEQLARHGVLLTNEPPEHEQTTPLNRLGRGLPWLETGKRPPGLCIVVADTSGMGAQLASHQGHARAYVAPQMHSIRRDQVRGDRGPQINDQAGLLSQVMSRDEGQPAVEPQALVVEIAVAHSRQLLAG

SEQ ID NO: 21314 - protein, 238 aa, Pseudomonas aeruginosa
VRGSMRWFFLFLLALNVLYYVWHQQQSPLRAKEIAPLELYKDGQKNILLLAESNLASRARSGSQVPAPSVPPAAEESIASESACLYLGGGGEEADARRLQQRLLGLDIEAEVEARGEMSVDYWVYLPPLASREAALRQLKELQARNIDSYLIGEGVLANGISLGMFSARDSAESAQARLKTAGYEAELKELPRGQRDFWVRVAPGSRRLVDEQLLQELARDFKGLQHQIMSCKGVASP

SEQ ID NO: 21315 - protein, 123 aa, Pseudomonas aeruginosa
QMNAKAEAKESRFDLLKWLLVAVLVVVAVVGNQYFSAQPILYRVLGILVLAVIAAFLALQTAKGQAFFSLAKEARVEIRKVVWPSRQETTQTTLIVVAVVLVMALLLWGLDSLLGWLVSMIVG

SEQ ID NO: 21316 - protein, 180 aa, Pseudomonas aeruginosa
GCAVAKRWYVVHAYSGYEKHVMRSLIERVKLAGMEEEFGEILVPTEEVVEMRNGQKRKSERKFFPGYVLVQMEMNEGTWHLVKDTPRVMGFIGGTADKPAPITDREADAILRRVADSGDKPKPKTLFEPGETVRVIDGPFADFNGVVEEVNYEKSRIQVAVLIFGRSTPVELEFSQVEKV

SEQ ID NO: 21317 - protein, 204 aa, Pseudomonas aeruginosa
SHGSDQRRHHQRRIRNVRHASGRTDQGDGREVRRYRCCRYRCRCWPGCCRCRRADRVHHRPGRSWRQESERDQGRSRTDRSGSERSQGRRRRRSGRGEGRRFERRSRSRQESPGRSRRQSRAQVSDDLASTARASSERLMAGGFCHRPFSVLGGLPPGAFHPRRESAPSGQCRPRGLQHFRLLPSETPNKQVTKLGNADGLLIH

SEQ ID NO: 21318 - protein, 96 aa, Pseudomonas aeruginosa
HRPPGQPSRPLRRRNGREPVPRGPGACRARGQGTPVHGRKRRPDAAGPDQRQAGGCRDQGVLRFEPAVAVHGPEQPAFRDHPQAPRLRARPGRSDP

SEQ ID NO: 21319 - protein, 1403 aa, Pseudomonas aeruginosa
GGKALKDLLNLLKNQGQIEEFDAIRIGLASPEMIRSWSFGEVKKPETINYRTFKPERDGLFCAKIFGPVKDYECLCGKYKRLKHRGVICEKCGVEVALAKVRRERMGHIELASPVAHIWFLKSLPSRIGLLLDMTLRDIERVLYFESYVVIDPGMTTLEKGQLLNDEQYFEALEEFGDDFDARMGAEAVHELLNAIDLEHEIGRLREEIPQTNSETKIKKLSKRLKLMEAFQGSGNKPEWMVLTVLPVLPPDLRPLVPLDGGRFATSDLNDLYRRVINRNNRLKRLLDLAAPDIIVRNEKRMLQEAVDALLDNGRRGRAITGSNKRPLKSLADMIKGKQGRFRQNLLGKRVDYSGRSVITVGPTLRLHQCGLPKKMALELFKPFIFGKLEGRGMATTIKAAKKMVERELPEVWDVLAEVIREHPVLLNRAPTLHRLGIQAFEPVLIEGKAIQLHPLVCAAYNADFDGDQMAVHVPLTLEAQLEARALMMSTNNILSPANGEPIIVPSQDVVMGLYYMTREAINAKGEGMAFADLQEVDRAYRSGQASLHARVKVRINEKIKGEDGQLTANTRIVDTTVGRALLFQVVPAGLPFDVVNQSMKKKAISKLINHCYRVVGLKDTVIFADQLMYTGFAYSTISGVSIGVNDFVIPDEKARIINAATDEVKEIESQYASGLVTQGEKYNKVIDLWSKANDEVSKAMMANLSKEKVVDREGKEVDQESFNSMYMMADSGARGSAAQIRQLAGMRGLMAKPDGSIIETPITANFREGLNVLQYFISTHGARKGLADTALKTANSGYLTRRLVDVAQDLVVTEIDCGTEHGLLMSPHIEGGDVVEPLGERVLGRVIARDVFKPGSDEVIVPAGTLIDEKWVDFLEVMSVDEVVVRSPITCETRHGICAMCYGRDLARGHRVNIGEAVGVIAAQSIGEPGTQLTMRTFHIGGAASRTSAADNVQVKNGGTIRLHNLKHVVRADGALVAVSRSGELAVADDFGRERERYKLPYGAVISVKEGDKVDPGAIVAKWDPHTHPIVTEVDGTVAFVGMEEGITVKRQTDELTGLTNIEVMDPKDRPAAGKDIRPAVKLIDAAGKDLLLPGTDVPAQYFLPANALVNLTDGAKVSIGDVVARIPQETSKTRDITGGLPRVADLFEARRPKEPSILAEISGTISFGKETKGKRRLVITPNDGSDPYEELIPKWRHLNVFEGEQVNRGEVISDGPSNPHDILRLLGVSSLAKYIVNEIQDVYRLQGVKINDKHIETILRQMLRKVEVSESGDSSFIKGDQVELTQVLEENEQLGTEDKFPAKYERVLLGITKASLSTESFISAASFQETTRVLTEAAVTGKRDFLRGLKENVVVGRLIPAGTGLAYHSERKRQRDLGKPQRVSASEAEAALTEALNSSGN

SEQ ID NO: 21320 - protein, 215 aa, Pseudomonas aeruginosa
SCVRQPRLAVKGEAEMQLNVNGAQAIEVSERTFGGEFNETLVHQAVVAYMAGGRQGSKAQKTRSEVSGGGKKPWRQKGTGRARAGTIRSPIWRGGGTTFAAKPRSHEQKLNKKMYRAALRSILAELVRLDRLVVVADFAVDAPKTKGLVAKLDTLGLKDVLIVTDGVDENLYLAARNLAHVDVRDVQGSDPVSLIAYDKVLVTVSAVKKFEELLG

SEQ ID NO: 21321 - protein, 68 aa, Pseudomonas aeruginosa
ADGDVMKANELREKSVEQLNEQLLGLLRDQFNLRMQKATGQLGQSHLLSQVKRDIARVKTVLNQQAGK

SEQ ID NO: 21322 - protein, 129 aa, Pseudomonas aeruginosa
PPPLVRMTKVAPCCVLSNSRSVTDWSRNMAKESMKNRELKRQLTVAKYAKKRAELKAIIANPNSSAEERWNAQVALQKQPRDASASRLRNRCRLTGRPHGFYRKFGLSRNKLREAAMRGDVPGLVKASW

SEQ ID NO: 21323 - protein, 193 aa, Pseudomonas aeruginosa
SQRTVSPVGTVDRDIESSPSWGLIRFGVISRIPGSPEPGFVSPGVYGRIEVEGLFFCIRSVKPMSMQDPLADMLTRIRNAQMAEKTVVSMPSSKLKAAVAKVLKDEGYIADFQISSEVKPQLSIELKYFEGKPVIEEVKRISRPGLRQYKSVEQLPKVRGGLGVSIVSTNKGVMTDRAARAAGVGGEVLCTVF

SEQ ID NO: 21324 - protein, 117 aa, Pseudomonas aeruginosa
QMSVKKETRLRRARKARLKMRELETVRLCVYRSSQHIYAQVIAADGGKVLASASTLDKDLREGATGNIDAAKKVGQLVAERAKAAGVTQVAFDRSGFKYHGRVKALADAAREGGLEF

SEQ ID NO: 21325 - protein, 167 aa, Pseudomonas aeruginosa
VMANNEQKRDEGYIEKLVQVNRVAKTVKGGRIFAFTALTVVGDGKGRVGFGRGKAREVPAAIQKAMEAARRNMIQVDLNGTTLQYPTKSAHGASKVYMQPASEGTGIIAGGAMRAVLEVAGVQNVLAKCYGSTNPVNVVYATFKGLKNMQAPEAVAAKRGKSVEEIL

SEQ ID NO: 21326 - protein, 338 aa, Pseudomonas aeruginosa
KIGASMQSSVNEFLTPRHIDVQVVSQTRAKITLEPLERGFGHTLGNALRRILLSSMPGCAVVEAEIDGVLHEYSAIEGVQEDVIEILLNLKGLAIKLHGRDEVTLTLAKKGSGVVTAADIQLDHDVEIINGDHVIANLADNGALNMKLKVARGRGYEPADARQSDEDESRSIGRLQLDASFSPVRRVSYVVENARVEQRTNLDKLVLDLETNGTLDPEEAIRRAATILQQQLAAFVDLKGDSEPVVEEQEDEIDPILLRPVDDLELTVRSANCLKAENIYYIGDLIQRTEVELLKTPNLGKKSLTEIKDVLASRGLSLGMRLDNWPPASLKKDDKATA

SEQ ID NO: 21327 - protein, 482 aa, Pseudomonas aeruginosa
MEEKTRLTTAAGAPVVDNQNVQTAGPRGPMLLQDVWFLEKLAHFDREVIPERRMHAKGSAAYGTFTVTHDITPYTRAKIFSQVGKKTDMFLRFSTVAGERGAADAERDIRGFSMRFYTEQGNWDLVGNNTPVFYLRDPLKFPDLNHVVKRDPRTNLRNATFKWDFFSHLPESLHQLTIDFSDRGLPKSYRHIHGFGSHTFSFINANNERFWVKFHFKTQQGIENLTNAEAAEVIAQDRESSQRDLYESIEKGDFPRWKMYVQIMPEKEAATYRYNPFDLTKVWPHGDYPLIEVGFFELNRNPDNYFAEVEQAAFTPANVVPGIGFSPDKMLQGRLFSYGDAHRYRLGVNHHQIPVNAARCPHQVYHRDGGMRVDGNNAHQRVTYEPNSFNQWQEQPDFSEPPLSLEGAADHWNHRVDDDYYSQPAALFHLFTDEQKQRLFANIAEDIRDVPEQIQRRQIGLFLKVDPAYGKGVADALGLKLD

SEQ ID NO: 21328 - protein, 1151 aa, Pseudomonas aeruginosa
IPSFLQGEPPDARPSGSHRLPQHAADRRAGRARPVLHPLAHVRGLGLQQALRAPQPRDGGGDPARRRPAAPYPPARRYAAHASRRYPPGHHGAGDARGRPQARAPCPRRAGQGHRPLRAAQGLRQPRHPQGPVGRHRGRPRLLVGATAWPDREDGPGELPAIADLTLPRGYEKAPAPHGRRGFFMSARQSGAIAFQQRLEEVAGVRLGHLGHLLRRTVGDDLATLGAALGAEVDQPVGGLDHVQVVLDHHHGVAVVAQAVEHVEQLLDVGEMQAGGRFVEDVQGLAGIALGQLAGQLDPLRLAAREGGRALAQLDVGQADVHQRLQLARQGGDCVEELAGFLDGHLQHLVDALALVADLQGLAVVALALADIAGNVDVRQEVHLHLDHAVALAGLATAALDVEREAAGTVAARAGLRHAGEQFADRREQAGIGRRVGARGTTDRALVDVDHLVQVLQAVERVIRRHFQGSRAVQRGGGDREQGVVDQRRLAGARDPGDAGEQADRDFQVDVLQVVAAGAFQLQQLLLVARGALGRNRDFLAPGKVLAGQRVGVVHHLVGRTFRHYLAAVHAGARTDVDDVVGESDRVLVVLDHDHRVAEVAQVGEGAEQALVVALVQADRGFVEDVHHSHQAGADLAGQADALGFAAGQGVGAAVEGQVVEADVDQELQAVADFLEDLRRDLATAAGQAESGGILAGFADRHRGDRRQRPVADPHMPRLAAQAGTVAIRAGLGAEELGQLLADRGRLGLAVAPLQVRQDAFEGMRTLDDVAAVVEIAEVDVFPAGAVEHHLLVLGAEFVEGFFQAEAVMLGQRTEHLEVIDVAPVPAADRALGQGQLAVDHPARVEELLHAEAVAGRTGAGRVVEGEQLGFQLADRVAADRAGEARREDDLLDILVLVHRCYQGDTVGQGQGGLERLGQALLEVRANLEAVHHHIDAVLLLLIQFRHFVEFVELAVDPGADEAMRAHLVEHRQVLALALADHRRQQHQLAAFRQGQDLVDHLADGLRLQRDVVVRAARGTDAGIKQAQVVVDLGDRTHGGAWVVGSGLLFDGNRRRQPFDGVHVRLLHHRQELPGVGREGFHVAPLAFRIERVESQGRLAGTGKTGDHDQFVAWQCEVDVLQVVGTRPTNQDLIHSGLAWRAKTADYTAGR

SEQ ID NO: 21329 - protein, 516 aa, Pseudomonas aeruginosa
RAAKWRACAARGRTGRMRGIFPARALPRPPRSGRRRHRQGHEALPCSGFFHEGVMHDSHTERMSGTETRAAVGLSLVFAFRMLGMFMVLPVLATYGQDLAGATPALIGLAIGAYGLTQAILQIPFGTISDRIGRRPVIVVGLLIFAAGAALAANADSIWGVIAGRVLQGAGAISAAVMALLSDLTREQHRTKAMAMIGMSIGVSFAVAMVLGPVLTHLFGLHGLFWFTAGMALVGLLLILFFVPQPDHMTQHRESSVARQALLPTLKHGDLLRLDAGILILHAILMASFVALPLALVHEGGLPKEQHWWVYLTALLVGFFGMVPFIIYAEKKRRMKRVLTGAVATLLACELFFLVFGHSLAMLVVGTVVFFTAFNLLEASLPSLVSKVSPAGGKGTAMGVYSTSQFLGAALGGILGGWMFQHGGLSMVFIGCAVLAALWLAIAVTMREPPYVTSIRLPLAPAALQDAVLVQRFRALPGVADAVVVAEEAAAYVKVDTQQVDRTALERLAQAAPGGC

SEQ ID NO: 21330 - protein, 196 aa, Pseudomonas aeruginosa
PGNPVHAQRQCGDQHHPRHQRELEGQADRPATGAYRMAPRGVIRPAWRRSPASTCARVPRCTSKAACAPASGRARTVRIATPPRSWSTSTATCSCSAAALPATIRSAPRASPCSARSRPRSSSRVRPRSSNRRRNRPRNTTASTTTFRSKRRPCGAARPRHGQTFEDPLPPSGRRGSSFSGDAALQGHFVQAAYGG

SEQ ID NO: 21331 - protein, 286 aa, Pseudomonas aeruginosa
SFPHGTELKAGFAILVGRFRIAYQTAAGEQVAPARREQGRAQRHQEIAVAFAVEPAQRRGVPATVHPFVLADVVQRRAAWVAAHRGGRMQRLQQPQDAACVGEAGADRRVQVLDSRQSFQAGRIGDFQHLAEGFQGRTDRLHHQLVFVPVLGAVQQGLSEPRIFLGIAAAGDGPGQGMGECLAGANADQAFRGGAEEAGVAAATGEQLGVGMLQTQVFDDLPRLDVAERPGLGAGQHDLAEASLADTAYRVAHLGFPLPALLRRSVALRASGRPRGPASGRLPQAQ

SEQ ID NO: 21332 - protein, 139 aa, Pseudomonas aeruginosa
LPRRARRGGRRGRRPGRWAAPVGRSRSPGSRRAGSAGTARAGRRPRVARWRHPGGGRPPAAPPRRRGATRRRVAGAVPDGRRRTGGAAARRRFPGAGRFRRPAPRRDCGRTAPGARRRNRAGRGRRRRRGPPSGWPAPR

SEQ ID NO: 21333 - protein, 296 aa, Pseudomonas aeruginosa
SGPRDPGTAGQAGRCLAAGVRSSYGRSWRCRLHGGSRPGAGAASASGGTAGPRRRSCAGLQLAAQALAQVLLADLADAGLGEGRDQLDAVRHLERGQPAGVQVLLQLQRRGRRLARDDEGAGALAEQAVGHRHDGGVVHLRMGYQQVLHLFRGDLLAAAVDLVLVAALHHQVAVLVAADPVAGAVEAVRAEGLGVVFGQAVVAADGVGTAHGQFADLAGADLAALGVDHPHFVVRRQRPALGMQHAFGRIVQAGVADQPLGHSQHLLQLAAEHRFDALRGTAAEPGAADLEQTQAG

SEQ ID NO: 21334 - protein, 697 aa, Pseudomonas aeruginosa
IGAAAFLGIQPEHRQRRYQGGVGDPFTGDQGEAMLGIGALADHHAAAGQQRADHSGAAESEVVRHRQAGEVHRVLVEAADLGAGADVVEILAMTPGNQLRRAGGAAGQLEAGDILGAGGAVFQRVGLVQRCQRLQRRLGLAVDQRHPAGAAGEQLTGHRPWVEAVDPFGADVGLGLGEAAETADLMLAMGGEGEHRAYAELEQGEAGLDEGDAVGQVQHYRVAMCEAGLAQSGCQAAAALEQVGIAEPLVVVAERDPPRMARGAGGQGFGEVLVLPVAGVEIAADEGGGPVGGVVDGRWGDGRGSHAISVDAVDCHCWEMRFIIIGGRQGPRKPAPFDCGAFSFAAGAECRALCPSPLKSPPAPTYPGRRRRVGSARATGKPDDHHHHCSATGRCRRAGTGQPARRRAHRSEHEAGDRNLLFGQRGLVRGTAGARPAPDPRAERPVALPDSRPARAPHRGAEPVHHRQRWRLHLGADLRHRQAVALHYRPARRRSPGQPPRLAARATDTPPRRRSADHELPGAAGDAGVGLADRHLPDARSDPRSLPRRQGPGVGRAQRTVPFRRGAPRRGAAHHLLGGRAHPRRPRPAGRRLAGAAVAGHAGQPRGHEPAQADRRLSQGVRRQRIRLPAGIPPARGAPDALRRRGERLHGGLPGGLQPGAFLHRFPQALRHLPQRDPLSLRDDPRPGHGRGVAAAG

SEQ ID NO: 21335 - protein, 947 aa, Pseudomonas aeruginosa
RASSATSTEPSTTPHSPPWRCSARRAGRGQPRSAPVVFASNLGEEGFVPAAFRDAFGDLHDMLSQTPQVWLDHQLYRVGDGILLAWDSVVGLFPEGLPETMFEAYVGLLQRLCDSAWEQPADLPLPWAQQARRALLNGQPACATARTLHRDFFLRAAEAPDADALLYRDQRVTRGELAERALRIAGGLREAGVRPGDAVEVSLPRGPQQVAAVFGVLAAGACYVPLDIDQPPARRRLIEEAAGVCLAITEEDDPQALPPRLDVQRLLRGPALAAPVPLAPQASAYVIYTSGSTGVPKGVEVSHAAAINTIDALLDLLRVNASDRLLAVSALDFDLSVFDLFGGLGAGASLVLPAQEQARDAAAWAEAIQRHAVSLWNSAPALLEMALSLPASQADYRSLRAVLLSGDWVALDLPGRLRPRCAEGCRLHVLGGATEAGIWSNLQSVDTVPPHWRSIPYGRPLPGQAYRVVDTHGRDVPDLVVGELWIGGASLARGYRNDPELSARRFVHDAQGRWYRTGDRGRYWGDGTLEFLGRVDQQVKVRGQRIELGEVEAALCAQAGVDSACAAVLGGGVASLGAVLVPRLAPRAEGSMELPAAQPFAGLAEAEAVLTREILGALLEAPLELDDGLRRRWLDWLADSAASALPSLDEALRRLGWQAAGLTAMGNALRGLLAGEQAPAALLLDPWLAPQAVAARLPDGREAPGAPARSAADAGCRRTPAGGGAGYPRRALARPGHGLAVAPGAGTDPLRTQPRPHRRRRHPLAGTDRGAGAGRRPATCRAPRSLRPGDQLRRAARLRGQPRRPGAGGGAAAPAGPPVAGGPAMRVATGAARCGLARRPAAAPGGVAEPVGRSRRCGTGAALPVAQRTARPGRGAGAGTRARRRRAPGRPGATPAPGDAARTPVVPAKPAVERQWQGRSSPPGREHDPRTRRVSSRALGGGAAGSP

SEQ ID NO: 21336 - protein, 1520 aa, Pseudomonas aeruginosa
AFRRTPGHGRLLSPADPGRSCPPLAGADRRNRGNPTGRGRAMSLGELLETCRSRRIELWSEAGRLRYRAPQGALDAGLAERLRAEREALLEHLEGGPGWRAEPDLAHQRFPLTPVQAAYVLGRQAAFDYGGNACQLYAEYDWPVDTDPARLEAAWNAMVERHPMLRAVIEDNAWQRVLPEVPWQRLTVHACAGLDEAAFQAHLERVRERLDHACAALDQWPVLRPELSIGRDACVLHCSVDFTLVDYASLQLLLGEWRRRYLDPQWTAEPLEATFRDYVGVEQRRRQSPAWQRDRDWWLARLDALPGRPDLPLRVQPDTRSTRFRHFHARLDEAAWQALGARAGEHGLSAAGVALAAFAETIGRWSQAPAFCLNLTVLNRPPLHPQLAQVLGDFTALSLLAVDSRHGDSFVERARRIGEQMFDDLDHPTFSGVDLLRELARRRGRGADLMPVVFTSGIGSVQRLLGDGEAPRAPRYMISQTPQVWLDCQVTDQFGGLEIGWDVRLGLFPEGQAEAMFDDFVGLLRRLAQSPRAWTDGDATEPVEAPPQALPGSARSIAAGFAERALLTPDATAIHDAAGSYSYRQVAQHATALRRVLEAHGAGRGRRVAVMLPKSAAQLVAVIGILQAGAAYVPVDIRQPPLRRQAILASAEVVALVCLESDVPDVGCACVAIDRLAADSAWPPPPAAEVAADDLAYVIYTSGSTGTPKGVMLSHAAVSNTLLDINQRYGVDANDRVLGLAELSFDLSVYDFFGATAAGAQVVLPDPARGSDPSHWAELLERHAITLWNSVPAQGQMLIDYLESEPQRHLPGPRCVLWSGDWIPVSLPTRWWRRWPDSALFSLGGATEAAIWSIEQPIRPQHTELASIPYGRALRGQSVEVLDARGRRCPPGVRGEIHIGGVGLALGYAGDPQRTAERFVRHPDGRRLYRTGDLGRYLADGSIEFLGREDDQVKIRGHRIELAELDAALCAHPQVNLAATVVLGETHERSLASFVTLHAPAEAGEDPRTALDAVRQRAAQALRRDWGSEEGIAAAVAALDRACLASLAAWLAGSGLFASATPLDFATLCQRLGIAEARQRLLRHWLRQLEEGGYLRAEGEGWLGCAERPAQSPEDAWTAFAGCAPAALWPAELVAYLRDSAQSLGEQLAGRISPAALMFPQGSARIAEAMYSQGLHAQALHEAMAEAIAAIVERQPQRRWRLLELGAGTAAASRTVIARLAPLVQRGAEVDYLFTDVSSYFLAAARERFADQPWVRFGRLDMNGDILDQGVAPHSVDIMISSGALNNALDTPALLAGLRELLSADAWLVIQELTREHNEISVSQSLMMENPRDFRDERRQLFVHTGQWLEWLAAQGGDLACGVVPPGSALDLLGYDVLLARCKTDRARLEPAELLAFVEARVPRYMLPAQLRVLERLPVTGNGKIDRKALTGFARQPQADLRHGVAQAPADELENALLALWREVLDNPLLGVEQDFFGAGGDSLLIAQLIARLRERLESARRHPFDRLIRWAISHQTQRP

SEQ ID NO: 21337 - protein, 253 aa, Pseudomonas aeruginosa
FEVASMILELDCGNSLIKWRVIEGASRSVAGGLAESDDALVEQLTSQQALPVRACRLVSVRSEQETSQLVARLEQLFPVSALVASSGKQLAGVRNGYLDYQRLGLDRWLALVAAHHLAKKACLVIDLGTAVTSDLVAADGVHLGGYICPGMTLMRSQLRTHTRRIRYDDAEARRALASLQPGQATAEAVERGCLLMLRGFVREQYAMACELLGPDCEIFLTGGDAELVRDELAGARIMPDLVFVGLALACPIE

SEQ ID NO: 21338 - protein, 409 aa, Pseudomonas aeruginosa
RDPLNSLKGMVSMAKEKFERNKPHVNVGTIGHVDHGKTTLTAALTKVCSDTWGGSARAFDQIDNAPEEKARGITINTSHVEYDSAVRHYAHVDCPGHADYVKNMITGAAQMDGAILVCSAADGPMPQTREHILLSRQVGVPYIVVFLNKADMVDDAELLELVEMEVRDLLNTYDFPGDDTPIIIGSALMALEGKDDNGIGVSAVQKLVETLDSYIPEPVRAIDQPFLMPIEDVFSISGRGTVVTGRVERGIIKVQEEVEIVGIKATTKTTCTGVEMFRKLLDEGRAGENVGILLRGTKREDVERGQVLAKPGTIKPHTKFECEVYVLSKEEGGRHTPFFKGYRPQFYFRTTDVTGNCELPEGVEMVMPGDNIKMVVTLIAPIAMEDGLRFAIREGGRTVGAGVVAKIIE

SEQ ID NO: 21339 - protein, 254 aa, Pseudomonas aeruginosa
SGRCCTYHRWLRAQHGPERGGCVMAKLTKRQKAIAEKVVAGKQYSFEEAAKLLAELSTIKFKESVDVAVNLGVDPRKSDQVVRGATVLPNGTGKSVRVAVFTQGPAAEAALAAGADKVGMDELAAEMKGGDLNYDVVIASPDAMRVVGQLGQILGPRGLMPNPKVGTVTPDVATAVKNAKAGQVRFRTDKNGIIHSSVGKVDFEPAKLQQNVEALLADLKRLKPSSSKGVYVKRVTLSTTMGPGLQIDLASLEA

SEQ ID NO: 21340 - protein, 201 aa, Pseudomonas aeruginosa
TTSLRRWCSRFGYRIRHQNDVRPRLDETVTSRSKPVAIKLEDKKAIVAEVNEAAKAALSAVVADARGVTVGAMTGLRKEAREAGVYVKVVRNTLLKRAVEGTQFDVLNDVFKGPTLIAFSNEHPGAAARIFREFAKGQDKFEIKAAAFEGQFLAANQIDVLASLPTYDEAVSQLMSVIQGATSKLARTLAAIRDQKEAAAA

SEQ ID NO: 21341 - protein, 136 aa, Pseudomonas aeruginosa
YDGRRPSPNTGIRVMALTNEDIINAVSEMSVMQVVELIKAMEEKFGVTAAAATVAAAGPAAAAAEEQTEFTIVLAEAGDKKVNVIKVVRELTGLGLKEAKAVVDGAPGVVKEGASKEEAEAAKKALEEAGAKVELK

SEQ ID NO: 21342 - protein, 1363 aa, Pseudomonas aeruginosa
PSWGTLMAYSYTEKKRIRKDFSKLPDVMDVPYLLAIQLDSYREFLQAGATKEQFRDIGLHAAFKSVFPIISYSGNAALEYVGYRLGEPAFDVKECVLRGVTFAVPLRVKVRLIIFDRESSNKAIKDIKEQEVYMGEIPLMTENGTFIINGTERVIVSQLHRSPGVFFDHDRGKTHSSGKLLYSARIIPYRGSWLDFEFDPKDCVFVRIDRRRKLPASVLLRALGYSTEEILNAFYATNVFHIKGETLNLELVPQRLRGEVASIDIKDGSGKVIVEQGRRITARHINQLEKAGVSQLEVPFDYLIGRTIAKAIVHPATGEIIAECNTELTLDLLAKVAKAQVVRIETLYTNDIDCGPFISDTLKIDNTSNQLEALVEIYRMMRPGEPPTKEAAETLFGNLFFSAERYDLSAVGRMKFNRRIGRTEIEGPGVLSKEDIIDVLKTLVDIRNGKGIVDDIDHLGNRRVRCVGEMAENQFRVGLVRVERAVKERLSMAESEGLMPQDLINAKPVAAAIKEFFGSSQLSQFMDQNNPLSEITHKRRVSALGPGGLTRERAGFEVRDVHPTHYGRVCPIETPEGPNIGLINSLATYARTNKYGFLESPYRVVKDSLVTDEIVFLSAIEEADHVIAQASATLNEKGQLVDELVAVRHLNEFTVKAPEDVTLMDVSPKQVVSVAASLIPFLEHDDANRALMGSNMQRQAVPTLRADKPLVGTGMERNVARDSGVCVVARRGGVIDSVDASRVVVRVADDEVETGEAGVDIYNLTKYTRSNQNTCINQRPLVSKGDVVARGDILADGPSTDMGELALGQNMRVAFMPWNGFNFEDSICLSERVVQEDRFTTIHIQELTCVARDTKLGPEEITADIPNVGEAALNKLDEAGIVYVGAEVQAGDILVGKVTPKGETQLTPEEKLLRAIFGEKASDVKDTSLRVPTGTKGTVIDVQVFTRDGVERDSRALSIEKMQLDQIRKDLNEEFRIVEGATFERLRAALVGAKAEGGPALKKGTEITDDYLDGLERGQWFKLRMADDALNEQLEKAQAYISDRRQLLDDKFEDKKRKLQQGDDLAPGVLKIVKVYLAIKRRIQPGDKMAGRHGNKGVVSVIMPVEDMPHDANGTPVDIVLNPLGVPSRMNVGQILETHLGLAAKGLGEKINRMLEEQRKVAELRKFLHEIYNEIGGREENLDELGDNEILALAKNLRGGVPMATPVFDGAKEREIKAMLKLADLPESGQMRLFDGRTGNQFERPTTVGYMYMLKLNHLVDDKMHARSTGSYSLVTQQPLGGKAQFGGQRFGEMEVWALEAYGAAYTLQEMLTVKSDDVNGRTKMYKNIVDGDHRMEAGMPESFNVLIKEIRSLGIDIELETE

SEQ ID NO: 21343 - protein, 123 aa, Pseudomonas aeruginosa
MATINQLVRKPRKRMVDKSDVPALQNCPQRRGVCTRVYTTTPKKPNSALRKVCRVRLTNGFEVSSYIGGEGHNLQEHSVVLIRGGRVKDLPGVRYHTVRGSLDTSGVKDRKQGRSKYGAKRPK

SEQ ID NO: 21344 - protein, 163 aa, Pseudomonas aeruginosa
RPFEGLSMPRRRVAAKREVLADPKYGSQILAKFMNHVMESGKKAVAERIVYGALDKVKERGKADPLETFEKALDAIAPLVEVKSRRVGGATYQVPVEVRPSRRNALAMRWLVDFARKRGEKSMALRLAGELLDAAEGKGAAVKKREDVHRMAEANKAFSHYRF

SEQ ID NO: 21345 - protein, 716 aa, Pseudomonas aeruginosa
SRCPTPEDLIVARTTPINRYRNIGICAHVDAGKTTTTERVLFYTGVNHKLGEVHDGAATTDWMVQEQERGITITSAAVTTFWKGSRGQYDNYRVNVIDTPGHVDFTIEVERSLRVLDGAVVVFCGTSGVEPQSETVWRQANKYGVPRIVYVNKMDRQGANFLRVVEQIKKRLGHTPVPVQLAIGAEENFVGQVDLIKMKAIYWNDDDKGMTYREEEIPAELKDLAEEWRSSMVEAAAEANEELMNKYLEEGELSEAEIKEGLRLRTLACEIVPAVCGSSFKNKGVPLVLDAVIDYLPAPTEIPAIKGVSPDDETVEDERHADDNEPFSSLAFKIATDPFVGTLTFARVYSGVLSSGDSVLNSVKGKKERVGRMVQMHANQREEIKEVRAGDIAALIGMKDVTTGDTLCSIEKPIILERMDFPEPVISVAVEPKTKADQEKMGIALGKLAQEDPSFRVKTDEESGQTIISGMGELHLDIIVDRMKREFGVEANIGKPQVAYRETITKDNVEIEGKFVRQSGGRGQFGHCWIRFSAADVDEKGNITEGLVFENEVVGGVVPKEYIPAIQKGIEEQMKNGVVAGYPLIGLKATVFDGSYHDVDSNEMAFKIAASMATKQLAQKGGGKVLEPIMKVEVVTPEDYMGDVMGDLNRRRGLIQGMEDTVSGKVIRAEVPLGEMFGYATDVRSMSQGRASYSMEFSKYAEAPSNIVEALVKKQG

SEQ ID NO: 21346 - protein, 407 aa, Pseudomonas aeruginosa
FSPLSKRFTVVAKEKFERNKPHVNVGTIGHVDHGKTTLTAALTKVCSDTWGGSARAFDQIDNAPEEKARGITINTSHVEYDSAVRHYAHVDCPGHADYVKNMITGAAQMDGAILVCSAADGPMPQTREHILLSRQVGVPYIVVFLNKADMVDDAELLELVEMEVRDLLNTYDFPGDDTPIIIGSALMALEGKDDNGIGVSAVQKLVETLDSYIPEPVRAIDQPFLMPIEDVFSISGRGTVVTGRVERGIIKVQEEVEIVGIKATTKTTCTGVEMFRKLLDEGRAGENVGILLRGTKREDVERGQVLAKPGTIKPHTKFECEVYVLSKEEGGRHTPFFKGYRPQFYFRTTDVTGNCELPEGVEMVMPGDNIKMVVTLIAPIAMEDGLRFAIREGGRTVGAGVVAKIIE

SEQ ID NO: 21347 - protein, 105 aa, Pseudomonas aeruginosa
GQMQNQQIRIRLKAFDHRLIDQSTQEIVETAKRTGAQVRGPIPLPTRKERFTVLISPHVNKDARDQYEIRTHKRVLDIVQPTDKTVDALMKLDLAAGVEVQISLG

SEQ ID NO: 21348 - protein, 278 aa, Pseudomonas aeruginosa
VKGCIMAIVKCKPTSAGRRFVVKVVNQELHKGAPYAPLLEKKSKSGGRNNNGRITTRHIGGGHKQHYRLVDFRRNKDGIPAIVERVEYDPNRTAHIALLKYADGERRYIIAPKGVAAGDQLISGIGAPIKAGNSMPLRNIPVGSTVHGIELKPGKGAQIARSAGASAQLVAREGAYVTLRLRSGEMRKVLAECRATLGEVSNSEHSLRSLGKAGATRWRGVRPTVRGVAMNPVDHPHGGGEGRTSAGRHPVSPWGLQTKGKKTRSNKRTDNMIVRRRK

SEQ ID NO: 21349 - protein, 142 aa, Pseudomonas aeruginosa
VRSTQMLQPKRTKFRKQMTGHNRGLAHRGSKVSFGEYALKATSRGRLTARQIESARRALTRHVKRGGKIWIRVFPDKPVTKKPLEVRMGKGKGGVEYWVAQIQPGKVLYEIEGVSEELAREAFALAAAKLPLATSFVKRTVM

SEQ ID NO: 21350 - protein, 136 aa, Pseudomonas aeruginosa
TRGGSLRTRGRRNYMIQTQSMLDVADNSGARRVMCIKVLGGSHRRYAGIGDIIKVTVKEAIPRGKVKKGQVMTAVVVRTKHGVRRTDGSIIRFDGNAAVLLNNKQEPIGTRIFGPVTRELRTEKFMKIVSLAPEVL

SEQ ID NO: 21351 - protein, 108 aa, Pseudomonas aeruginosa
GVAVMQKIRRDDEVIVIAGKDKGKRGKVLKVLADDRLVVGGVNLIKRHTKPNPMLGQQGGIVEKEAPLHVSNVAIFNTETSKADRVGFKVEDGKKIRVFKSTQKPVQA

SEQ ID NO: 21352 - protein, 118 aa, Pseudomonas aeruginosa
MARIAGVNIPDNKHTVISLTYIYGVGRTTAQSICAATGVNPAAKIKDLSDEQIDQLRNEVAKITTEGDLRREINMNIKRLMDLGCYRGLRHRRGLPVRGQRTKTNARTRKGPRKPIRK

SEQ ID NO: 21353 - protein, 135 aa, Pseudomonas aeruginosa
SRRNLVMAKPAARPRKKVKKTVVDGIAHIHASFNNTIVTITDRQGNALSWATSGGSGFRGSRKSTPFAAQVAAERAGQAALEYGLKNLDVNVKGPGPGRESAVRALNACGYKIASITDVTPIPHNGCRPPKKRRV

SEQ ID NO: 21354 - protein, 130 aa, Pseudomonas aeruginosa
TMRHRKSGRHLSRTSAHRKAMFQNMAVSLFEHELIKTTLPKAKELRRVAEPLITLAKEDSVANRRLAFDRTRSKAAVGKLFNDLGKRYANRPGGYLRILKCGFRAGDNAPMAYVELVDRPVGGEVVEAAE

SEQ ID NO: 21355 - protein, 201 aa, Pseudomonas aeruginosa
SWTDGLMRPPAPFLGRGLFYLHWLDPDQAEPGAYAARFLVFSRESPPMQGHPEVIDYLNTLLTGELAARDQYFIHSRMYEDWGFSKLYERLNHEMEEETQHADALLRRILLLEGTPRMRPDDIHPGTTVPEMLEADLKLERHVRAALAKGIALCEQHKDFVSRDILKAQLADTEEDHAYWLEQQLGLIARMGLENYLQSQI

SEQ ID NO: 21356 - protein, 147 aa, Pseudomonas aeruginosa
VAGLERGVRPIGLWSMSTTLSRCCRPSNESYGATSRVVAPFSAVAVIGNRVLLISVDLPEPETPVMQVNRPTGISRLTFCRLLPRAPFSFSSFFLSRGVRLAGTAIFLRPERYLPVSESGWFITWSGVPSATTWPPCTPAPGPMSTT

SEQ ID NO: 21357 - protein, 131 aa, Pseudomonas aeruginosa
TLRRSQPRIAPSARVNSPLTTRRASKNCFTPRPSQVGQAPAGLLKENSLGSSSLIEWPQTGQAKRAEKMISSTSSSSSIGATRAIPSARDRAVSNDSARRCWRSARTLKRSTTTSMLCFFCLSSFGTSSSS

SEQ ID NO: 21358 - protein, 247 aa, Pseudomonas aeruginosa
ENVMARGVNKVILVGNVGGDPETRYMPNGNVVTNITLATSESWKDKQTGQQQERTVWHRVVLFGPPGGDRRRVLAQGFPGVRRRQPAHPQVAGPGRSGSLHHRDRGRHQRQHAVARRPPFRRRFAARPARAHAAPAAGPAAAVASGPAAATGAATGPGIRQLRRRHSVLSDALAARPVRATGRPSKTPCRPRAAGGLRFQATPRCKGTSSRPPMADRASRMALSLRQVSRYSWAGSESPTRPQPANR

SEQ ID NO: 21359 - protein, 264 aa, Pseudomonas aeruginosa
LAGATLAADVLQQRRLVAAVQRAAALPVRCRMGGDEQVAQRRAGAFQAQGGFVGQRRAETVAEQRQGRVGEIAQGEGGAVGEVLQAGGRRLVEAVLATRVLQGKQVDVWRQAFAPATEEAGAAACMGEAGQAQARHRRQAERPDPGGAHARASSSRRRRSRRSFLLILPMPVWGKAGTSSMRSGTLNAASPQACRYCFSFSAEGAGWRGMTKAQVRSPSRLSGIATTVASCTCGWAISRFSTSSAAIFSPPRLIWSLSRPSTTR

SEQ ID NO: 21360 - protein, 320 aa, Pseudomonas aeruginosa
KVPLPPRIQEGVAASAAPGLQENLMTITIIAPPQADAAAPAPGNRPGVAHIDPNMKLVTGTFCSASEDWFEEPLERGLRLILVQSGQLRCRIPGQPEHLIEGPSLCTIANDGDFTSAQIYGTDKPLRYTIVQLGVEALDSRLGWLPEQLIRRPGGDPRIMSCPAPRAMQALASQIATCQMLGPTRDLYLGGKALELAALSAQFLSGEGRPVEEPRITCSEVERIHAARDLLVGALQEPPSLDTLASRVGMNPRKLTAGFRKVFGASVFGYLQEYRLREAHRMLCDEEANVSTVAYRVGYSPAHFSIAFRKRYGISPSEIR

SEQ ID NO: 21361 - protein, 439 aa, Pseudomonas aeruginosa
MPGGGARPGVPARAGAHAGRRGSPLAESRPACRRCRKPAPAAGRTGRCLPGAGAPGGAAGAAFRRLPGAPCGATRRGRGAGPRLLAGTPAALAGRAGPAVGLRAGKHPPAAHPAPGIPAFRRREPAPGASCRAAWRDLVQRVRLRLRAGPGALERKRGISPQRAVVRSACRRPAYRRGDRRLHHPVAAGVPDAGRGVLRRGGEELPAQPPRSHRPRRIPRPGGAPRGAPAGASHARRRWCSPATWARRASSRRPSATLSAISTTCSRRPRRSGSTTSSTGWATVSCWPGTASSACSPKACRKPCSKPTWGCSSVSATAPGSSPPICRCPGRSRRAGPCSTASRHAPRRAPCIATSSFAPPRRRMPTRCSIATNVSPAANWPSVRCASPAACAKPGCALATRSRSACRADRSRSRRYSACSPQAPATCRWTSTSRPHGGA

SEQ ID NO: 21362 - protein, 368 aa, Pseudomonas aeruginosa
PRWATLCAACSPANRRRPRCSSIPGWRRRRWPRACRTAARPLARLLEALPTPAAGERLRVAVLDTRAGLWLDQGMASLLRPGLELTLFERSRVLIDAAATRLPERIVVQALDDGLLHAEHLGRYDRVISFAALHAYEASREGLALAAALLRPQGRLLLVDLLCESPLALLGAALLDDRPLRLAELPSLLADLAAAGLAPRCLWRSERLALVEALAPGLGLDAAALQAGLEQRLPQAMRPERLWCLPSLPLNGNGKVDRRRLAESMTRALGECRHEPSAEEPLEAHEQALAECWEAVLKRPVRRREASFFSLGGDSLLATRLLAGIRERFGVRLGMADFYRQPTLAGLARHLQAQTVEIEETQLEEGVL

SEQ ID NO: 21363 - protein, 209 aa, Pseudomonas aeruginosa
ASTSRSTTSSAPPRRGPRWSSRTRRAAAIHRTGRNCWNATPSPCGTRCRPKARCSSITWRASRNVTCRDRAACSGPVTGFRSACRPDGGGAGRTARCSAWAAPPRRRSGRSSSRSARSTPSWPASLMAVPCAGRAWKSWMPAGGAARRACAARSISAGWAWRSATPAIRSAPPNASSVTPMAVACIAPATSAAIWPTAASSSSAARTTR

SEQ ID NO: 21364 - protein, 203 aa, Pseudomonas aeruginosa
RFAATASNWPSWTPRCALIRRSIWRPPWCSARPTSAAWPASSPCMRRRRLARIRVRRSTRCASGRPRPCAATGAARRASPRRWPHSTVPASPRWPPGWPAAVCSPVRRRWTSPPCASAWVSPRRASACCATGCASWRRAATCAPRARAGWAAPSVPRRVRRTPGRRSPAARRRRSGRPSWSPTCVTARNPSASNWPGGSARRR

SEQ ID NO: 21365 - protein, 316 aa, Pseudomonas aeruginosa
CGASMQTLLKLLQDGRFHSGEELGAVLGISRSAVWKRLQHLEAEHGLQFHKVRGRGYRLASPLSLLDPRKIDSLWPVEIMPTVDSTNSEAMRRLAAGASTPFVIVAEQQTAGRGRRGRAWVSPYGENLYYSLAITVRGSARELEGLSLVVGLAVLRALESLGVRDAGLKWPNDLLQGGKKIAGILLELSGDPADLCHVVIGIGINVNMKTATDIGQPWTSLREALGELVDRSRLLSALNRQLADYLDRHSREGFAASREEWESCNLWQGAQVILSTALSSIEGRVLGVDSRGALRLEVDGVEQGFSGGELSLRLRQ

SEQ ID NO: 21366 - protein, 144 aa, Pseudomonas aeruginosa
QMAKKIQAYIKLQVKAGQANPSPPVGPALGQHGVNIMEFCKAFNAKTQGQEPGLPTPVIITVYSDRSFTFETKSTPAAVLLKKAAGITSGSARPNSQKVGTVTRAQLEEIAKTKQADLTAADLDAAVRTIAGSARSMGLNVEGV

SEQ ID NO: 21367 - protein, 143 aa, Pseudomonas aeruginosa
GSGGYRAEDRELRLPDPSSGRRGPGSGSDRDRLRYRARPADVAAHRRRRRGRTARRARARPCDRARRVQAGQRRGHRAGRHPDRREVGRLPRSDERRRSGGAFPDHLRNPSWHLRHVLRPRPGPWPSRQHRRGGRCHRCPVHR

SEQ ID NO: 21368 - protein, 265 aa, Pseudomonas aeruginosa
HHRWSAARCRPVRGSSSERAFDPGGNQRHHLLRQRDQGQAPPGHHAERWQRSVRGADSEVASPERVRRRTGEPRRSHLRRSEQPARHPAPAGRELAGEVHRQRDPGRLPSAGREDQRQAHRDHPASDAAQGRSQRVRRLQLHQRRPGGTHPGAGRERTARYRGQVPGQVRARSAGYHQGFPVDRVVHFRGVVPGDHPRPHRGGGHRQARLPAWSERERGRGSPDPGRYRSGLPQRAQASARPRQAAACECQRGGSRTDRSAELER

SEQ ID NO: 21369 - protein, 170 aa, Pseudomonas aeruginosa
VVRLTRFRSKSVRPVVMPWPCVGWWTSPASVARSPWLCAWLASCWMPLKARAQQSRSVKTCTVWQRPTRPSRTTGSNRAAQPPRTLLWPVLHPSTATVISVSVPTLTRARPPPRSGFCSIPASTTSWAKCMTALRPPTGWCRSRSAVSPLPPLPLPPSGRVRAVSTTTIA

SEQ ID NO: 21370 - protein, 223 aa, Pseudomonas aeruginosa
RVKAPYTQEVYNMTIGVVGRKCGMTRIFTEEGVSIPVTVIEVEPNRVTQFKTEETDGYRAVQVTAGERRASRVTKAQAGHFAKANVAAGRGVWEFRLGEEQYAAGDQITVDLFQAGQMVDVTGESKGKGFAGTIKRWNFRGQDNTHGNSVSHRVPGSIGQCQTPGRVFKGKKMSGHLGAERVTVQSLEIVRVDAERNLLLVKGAVPGATGGDVIVRPAAKARG

SEQ ID NO: 21371 - protein, 129 aa, Pseudomonas aeruginosa
CPRFRPRQPDRLRQGAGHRVRREEVRGAAGMNQERVFKVLLGPHISEKATGLADGKSQFVFKVATDATKLEIKKAVESLFSVKVQRVTTLNVKGKTKRTARGLGKRNDWKKAYIALQPGQDLDFATSAE

SEQ ID NO: 21372 - protein, 95 aa, Pseudomonas aeruginosa
RDTTVPRSLKKGPFIDLHLLKKVEVAVEKNDRKPIKTWSRRSMILPHMVGLTIAVHNGRQHVPVLVNEDMVGHKLGEFAATRTYRGHAADKKAKR

SEQ ID NO: 21373 - protein, 114 aa, Pseudomonas aeruginosa
GVRKMEVAAKLSGARISAQKARLVADQIRGKKVGEALNLLAFSSKKAAEIMKKVLESAVANAEHNEGADVDDLKVSTVFVNEGRSLKRIMPRAKGRADRIVKRSCHITVKVADK

SEQ ID NO: 21374 - protein, 232 aa, Pseudomonas aeruginosa
RSRQMGQKVHPNGIRLGIVKEHTSVWYADRKNYADYLFADLKVREYLQDKLKSASVSRIDIHRPAQTARITIHTARPGIVIGKKGEDVEKLRQDLTKQMGVPVHINIEEIRKPELDAMLVAQSVAQQLERRVMFRRAMKRAVQNAMRIGAKGIKIQVSGRLGGAEIARTEWYREGRVPLHTLRADIDYATYEAHTTYGVIGVKVWIFKGEVIGGRQEELKPVAPAPRKKAAR

SEQ ID NO: 21375 - protein, 90 aa, Pseudomonas aeruginosa
VIMAEAQKTVRTLTGRVVSDKMDKTVTVLIERRVKHPIYGKYVKRSTKLHAHDESNQCRIGDLVTIRETRPLAKTKAWTLVDIVERAVEV

SEQ ID NO: 21376 - protein, 181 aa, Pseudomonas aeruginosa
ITMARLKEIYRKEIAPKLKEELQLANVMEVPRVTKITLNMGLGEAVGDKKIIENAVADLEKITGQKPVVTYARKSIAGFKIREGWPIGVKVTLRSDRMYEFLDRLLSISLPRVRDFRGLNAKSFDGRGNYSMGVKEQIIFPEIDYDKIDALRGLDITLTTTARTDDEGRALLRAFKFPFRN

SEQ ID NO: 21377 - protein, 222 aa, Pseudomonas aeruginosa
ATAESSWRPRCVDRLHQQRCDDRSCCPCCWCWRRSALHCVLRGISMSRVAKNPVKLPAGVEIKLAGQQLSIKGAKGALELKVHPSVEVIQDSGELRFAARNGDQQTRAMAGTTRALVNNMVVGVSQGFERKLQLVGVGYKAQAKGQVLSLSLGFSHPVDYELPAGIVAETPSQTDILIKGIDKQLVGQVAAEIRDFRPPEPYKGKGVRYADEVVRRKEAKKK

SEQ ID NO: 21378 - protein, 170 aa, Pseudomonas aeruginosa
SAGRHPESNGSRSPQHDPSRSERHHPAVSDQVRPWRLQGVHAAGFGRYRHHRRRRHACRSGSGWCAERPGQVLWLHQSGERGLRHLQGPEEHAGSGSSSGQAWQERRGDSLTMATVKVTLVKSLNGRLANHKACVKGLGLRRINHTVEVQDTPENRGMINKAYYLLRVEG

SEQ ID NO: 21379 - protein, 145 aa, Pseudomonas aeruginosa
SMQLNDLRSAPGARREKHRPGRGIGSGLGKTGGRGHKGLTSRSGGKVAPGFEGGQQPLHRRLPKFGFVSLKAMDRAEVRTSELAKVEGDVVSLQTLKDANLINQHVQRVKVMLSGEVGRAVTLKGIAATKGARAAIEAAGGKFED

SEQ ID NO: 21380 - protein, 442 aa, Pseudomonas aeruginosa
MAKQGALSALSNGGLSELWARLRFLFLAIIVYRIGAHIPVPGINPDRLAALFRQNEGTILSLFNMFSGGALERMSIFALGIMPYISASIIMQLMTAISPQLEQLKKEGESGRRKISQYTRYGTVVLALVQAIGMSVGLGSQGVAFSNDFGFYFVAVTTFVAGAMFMMWLGEQITERGVGNGISMLIFAGIVAGLPRAIGQSFESARQGDINIFALIGVGLLAVAIIAFVVFIERGQRRIAVHYAKRQQGRKVFAAQTSHLPLKVNMAGVIPAIFASSILLFPASLGSWFGQSEGLGWLQDVAQAIAPGQPLNILLFTAGIVFFCFFYTALMFNPKDVAENLKKSGAFIPGIRPGEQSARYIDGVLTRLTMFGALYMTAVCLLPQFLVVAAHVPFYLGGTSLLIVVVVVMDFMAQVQSHLVSHQYESLMKKANLKGYGSGMLR

SEQ ID NO: 21381 - protein, 207 aa, Pseudomonas aeruginosa
EMARYIGPKCKLSRREGTDLFLKSGARALDSKCKAENVPGQHGQRRGRLSDYGLQLREKQKVRRIYGVLERQFRGYYQEASRRKGSTGENLLQLLECRLDNVVYRMGFGSTRSESRQLVSHKAITVNGQTVNIPSYQVKAGDVVAVREKSKNQLRIAQALELCGQRGRVEWVEVDLDKKAGTFKSAPARSDLSADINENLIVELYSK

SEQ ID NO: 21382 - protein, 71 aa, Pseudomonas aeruginosa
SYPRWSVGCGKWTSVRWKSPATALRWCPRPASPSSTGTAGRRPRGIPRSAAGLPHRACRKPGKTCRNRKDR

SEQ ID NO: 21383 - protein, 490 aa, Pseudomonas aeruginosa
ADERYRNASGRRAVTGIRLPHARHVHGPAGAGHLRPGPGRRDPGADRPGHRRLWPDPGDPADSLRDHFRPHRPAPGDRRRAADLRRRRGPRGQCRLHLGGDRRPRPAGRRGDLGGGDGAALRPHPRAAPDQGDGDDRHEHRRLLRRGHGARPGADPSVRPAWAVLVHRRDGAGRPAADPVLRPAAGPHDPAPRIQRGAPGPAADPEARRPAAPGRRHPDPPRHPHGQLRRLAAGTGARGGPAQGAALVGLPDRAAGRFLRHGAVHHLRREEASHEARADRRGGDPAGLRTVLPGLRSQPGHAGGRHGGVLHCLQPARSLAAVAGQQGLAGRRQGHGDGGVFHQPVPRRGAGRHPRRLDVPARRAEHGVHRMRGARCPLAGDCCYHARTALCDQHSPAARARRAAGRGAGPAIQGVARCGRRRGGGRGGRRLCQSGYPTSGSHRPRAPGPGRAGRMLNLRRTSWPVGLTKSFWLVTSVVTRKPGTCPTAMW

SEQ ID NO: 21384 - protein, 136 aa, Pseudomonas aeruginosa
PTSPSPPARAGRTSRPASNRSVPYGTAWCYSARLAEIAGEYLRKGSQVYVEGSLRTRKWQGQDGQDRYTTEIVVDINGNMQLLGGRPSGDDSQRAPREPMQRPQQAPQQQSRPAPQQQPAPQPAQEYDSFDDDIPF

SEQ ID NO: 21385 - protein, 267 aa, Pseudomonas aeruginosa
CRRASGWHRRRLASVPRAGRADRSGIRRTGAAPAGPRPRRRRRAIASFPRSGRSAVRRGLAAPGRSPRRRTPARAVPSTGRAFAGRPRHRIPAAGPMGRSRTTPPPRPDDRAPAPGRWRARRCRARRAGTGSGAPAGSCGTPCLAPVLDLLGDVPVDDLREQSLDEGRVESVFLGPAGALGEHRGDPLGCRNRRLAGLEARRRLDVVHAAAEGLDDIQVDPVDGLADVRQAGAVFGSFHHATSRERASGCARRRSRCSITASRPSLR

SEQ ID NO: 21386 - protein, 973 aa, Pseudomonas aeruginosa
GAPMDLPPDSRTALRDWLTEQLADLLGEPLADVRALADDDDLLGCGLDSIRLMYLQERLRARGSTLDFAQLAQRPCLGAWLDLLACADRLSAPATVALPTAQDRDQPFELSSVQQAYWLGRGAGEVLGNVSCHAFLEFRARDVDPQRLAAAAECVRQRHPMLRARFLDGRQQILPTPPLSCFDLQDWRTLQVDEAERDWQALRDWRAHECLAVERGQVFLLGLVRMPGGEDRLWLSLDLLAADVESLRLLLAELGVAYLAPERLAEPPALHFADYLAHRAAQRAEAAARARDYWLERLPRLPDAPALPLACAPESIRQPRTRRLAFQLSAGESRRLERLAAQHGVTLSSVFGCAFALVLARWSESAEFLLNVPLFDRHADDPRIGEVIADFTTLLLLECRMQAGVSFAEAVKSFQRNLHGAIDHAAFPALEVLREARRQGPATLGAGGVRQQPGRGGLRPGGLPRRFRRSPRHALADPAGLARPPALPGGRRYPAGLGQRRRPVPRRPAGNHVRSLRGAAPASLRQRLGAARRSAVALGAAGAPGPAQRPAGMRHGAHPASRLLPSRRRGAGCRRAALSRPTCHPRRTGRACAAHRRRPARSRGAPWRRGRGQPAARTAAGRGGIRRARRRRLLRAAGHRPAARTAAPDRRGRRGMPGDHRGGRSAGLAAAPGCPAPAARPGAGRPRAAGAAGECLCDLHLGLHRGAQGRRGQPRGGDQYHRRAARPAAGERIGSLAGGLRAGLRSVGLRPVRRPRRRCQPGPAGPGTGARCRCLGGGYPAACGEPVELGAGLAGDGPQPAGEPGRLSQSAGGAAVRRLGGPGPARPPAPTLCRRLPPACAGWRYRSGHLVEPAERRYGAAALAFDSLRPAIAGTGLPGGRHPRARRAGPGGRRAVDRRRQPGPRLSQRSRTQRPALRPRCPGPLVSHRRSRSLLGRRYPGIPRSGRPAGESARPAHRVGRGGGRAVRPGWRG

SEQ ID NO: 21387 - protein, 184 aa, Pseudomonas aeruginosa
RLRGGARRWRGEPRRGAGTAPGATGRRLHGTTGRTALRRPGRGRGGTHPGNPRRAAGGAAGARRRFAPALAGLASGLRRQRAAVARRGVAPARLAGRGADRDGQRSARPARRRTGAGRAAPRSLAGAAGGGRAPAGRPRGPWRACSKRCRRRLPANACGWRCWIPAPGSGSTRAWPRCCARGWN

SEQ ID NO: 21388 - protein, 260 aa, Pseudomonas aeruginosa
RLPAVRRVRLAGRHRSGAPGGGLERHGRAPPDAARGDRGQRLAARAARGALAAADRACLRGARRGRFPGAPGAGPRTPRPRLRGARPVAGPAPRAEYRPGCLRTALLGGFHPGRLRQPAIAAWRMAPPLSRSAMDGGTAGGDLPRLCRRRAAPTPVASLAARPRLVAGASRRATGASRPAAAGAAGHPVHALPALPRAPRRGRLAGARRARRRTRPERCRRGLGGLRRDHRSLEPGTGVLSQPDGTQPAAAASAAGAGAR

SEQ ID NO: 21389 - protein, 159 aa, Pseudomonas aeruginosa
LHRAQPAGSGQPPRRQFRRACPTHRRADVRRPRPPDLQRRRPAARTGAPARSRRRPDAGGVHQWHRQRAAPARRWRGAARATLHDQPDPAGLAGLPGHRPVRRPGDRLGRTPRVVPRGPGGSHVRRLRRAAPAPGAEPARLDRRRCHGTRRGAAAGVAR

SEQ ID NO: 21390 - protein, 267 aa, Pseudomonas aeruginosa
CPEHRRRFRRACPADPRRHGDPRCRRQLQLPPGRPARHRPAPRPGSARRGPWPAGRGDAAEKRRAIGRGDRHPPGRRRLCAGGHPPASAAAPGDPRQRRSGRAGLPGKRCPGRRLRLRGHRPAGRRQRLAATARGGGGGGRPRLRDLHLRLHRHAKGRDAQPCGGEQHAARHQPALRRRRQRPRPRPRRAELRPLGLRLLRRHRGGGPGGPPGPGARQRSIALGGTAGTPRHHPVELGAGPRPDAHRLPGERAATSPAGTALRALVR

SEQ ID NO: 21391 - protein, 317 aa, Pseudomonas aeruginosa
LDSGQPADPMVAALAGQRAVQPGRRHRGGDLVDRAADPPAAHRAGQHPLWPCPARAERGSPGCPRAALPAGRARRDPYRRGGPGARLRRRSAAHRRTLRPSPRWPSPVSHRRPRPLSGRRQHRVPRPRGRPGEDSRPPHRTGRAGRRAVRSSAGQSGGHRGARRDPRAQPGQLRHPACAGGGWRGSAYGARRGAPAGGPGLAPRLGQRGGHRRGGGRTRPCLPRLAGRLAGRQRSVRQCDAAGLRHPVPAPGYRRGAPAPAAPLVAPAGGGRLPARRGRGLAGLRRASRAESGGRLDGVRRLRAGGALAGRAGRLPA

SEQ ID NO: 21392 - protein, 206 aa, Pseudomonas aeruginosa
MASSLAGSIAARCTYLSTDFLDKNRRPLRYTRRPIFPCTYTQETMERFFENAMYASRWLLAPIYMGLSLALLALTIKFFQEIFHVIPNIFAMAEADLILVLLSLIDMALVGGLLVMVMISGYENFVSQLDIDEGKEKLSWLGKMDSGSLKNKVAASIVAISSIHLLRIFMDAKNVPDNKLMWYVIIHMTFVLSAFAMGYLDKQTRH

SEQ ID NO: 21393 - protein, 238 aa, Pseudomonas aeruginosa
GGLAFGEVVADVLAEGRGVAAVVEQVVHQLEGDSQVVAEAAQCLGLFLAGLAQRGGAVGRGLEKHRGLAADHFHVGLFGSAGVAYLGQLQHFALGDHPGGLGYDAHDRHGTQLDHHFEGAGIKEVAYQHARRVAPQGIGGGAAAAQAGGVDHVVVQQSGGVQEFDGGGQQAEVVALVAQGLAGEQDQQRAQALAAGGDDVVADLFHQGNAGGELATDDPVDGGEIFRHHAVEGLGLHQ

SEQ ID NO: 21394 - protein, 110 aa, Pseudomonas aeruginosa
AGLTEIHMYAVIVTGGKQHKVTEGEFLKVEKLDVATGEAIDFDRVLLVANGEDVKIGLPVVEGAKVTAEVVSHGRHDKVRIIKFRRRKHHMKRQGHRQWFTEIKITGIQA

SEQ ID NO: 21395 - protein, 60 aa, Pseudomonas aeruginosa
RCWPTSACWDCRMPARALSSAQCPRPSRRWPTIRSPPWCRTSAWSASVATRASWSPTFPA

SEQ ID NO: 21396 - protein, 542 aa, Pseudomonas aeruginosa
RVEAWASKVEGMRDKVTGARRWVVKIGSALLTADGRGLDRNAMAVWVEQMVALHCAGIELVLVSSGAVAAGMSRLGWVSRPSAMHELQAAASVGQMGLVQAWESSFALHGLQTAQVLLTHDDLSDRKRYLNARSTLRTLVELGVVPVINENDTVVTDEIRFGDNDTLAALVANLVEADLLVILTDRDGMFDADPRNNPDAQLIYEARADDPQLDAVAGGSAGALGRGGMQTKLRAARLAARSGGHTVIVGGRIERVLDRLRAGERLGTLLTPDRSRKAARKQWLAGHLQMRGTLVLDDGAVKAVSQDHKSLLPVGVKAVQGSFRRGEMVVCVDQGGRESGARPGQLQCAGGAEDPRSADGCHRGLARLRGWAGAGASRQSGSGLRRGRMRKLAGLLGGLLLLPALAGAEEIGEVSTVFKWVGPNDKIVVEAFDDPKVQGVTCYLSRAKTGGVKGGLGLAEDRAEASIACRQVGPIQFSGELKDGEEVFKQRTSLVFKSMQVVRFFDRKRNALVYLVYSDRVIEGSPQNAVTAIPLMPWPTAR

SEQ ID NO: 21397 - protein, 240 aa, Pseudomonas aeruginosa
VLAPARLGPAPVLPAGAALFPGPGDPRRTSDRLAVPVRQVHHGGRGDDPARAGGLLRRPARHHPGQGSCAGLLCPAEHPYASEDRALHPGFHPADEPGLHRPASACRPGPVHRPGRLPECRPALLATAQAASVPAATGLGEVPGQAGGRGAGDVGGAAGHDALAAGLGAGRHAGAIPAPRPAGGCRSPGLFRYARAAGFPPARLFPPGGAVKRVRAGGGIMPFCLLSGARYAYNRPLSEQ

SEQ ID NO: 21398 - protein, 947 aa, Pseudomonas aeruginosa
TGPEMTDYKATLNLPETAFPMKAGLPQREPETLKFWNDIGLYQKLRAIGGDRPKFVLHDGPPYANGSIHIGHAVNKILKDIIVRSKTLAGYDAPYVPGWDCHGLPIEHKVETTHGKNLPADKTRELCREYAAEQIEGQKADFIRLGVLGEWDNPYKTMNFANEANEIRALAEMVKQDFVFKGLKPVNWCFDCGSALAEAEVEYADKKSPTIDVGFPVADADKLAAAFGLAALDKPAQIVIWTTTPWTIPANQALNVHPEIDYALVDAGDRYLVLAEALVESCLARYQREGKVVATAKGEALELINFRHPFYERLSPVYLADYVALDAGTGIVHSSPAYGEDDFYTCKRYGMSNDDILSPVQSNGVYVDSLPFFGGQFIWKANPNVVAKLEEVGSLLAHETINHSYMHCWRHKTPLIYRATAQWFVGMDKQPRQGASLRERALEAITQTEFVPGWGQARLHGMIAGRPDWCISRQRNWGVPIPFFLHKASGELHPRTVELMEEVAQRVEKEGIEAWFKLDAAELLGEDAAQYEKINDTLDVWFDSGTTHWHVLRGSHRIGHASGPVADLYLEGSDQHRGWFHSSLLTGCAIDNHAPYRQLLTHGFTVDESGRKMSKSLGNTVVPQTVIDTLGADILRLWVASTDYSGEIAVSQQILQRSADAYRRIRNTTRFLLSNLNGFDPATDLLPPQEMLALDRWAVDRALLLQREIEEAYREYRFWNVYSKVHNFCVQELGGFYLDIIKDRQYTTGANSVARRSCQTALFHIAEALVRWIAPILAFTAEEVWKFLPGERAESVMLATWYDGLSELPADVTLNRQYWEQVMAVKAAVNKELENQRAAKAVGGNLQAEVTLYTEDALQAQLAKLGNELRFVLITSTATLAPLSAAPADAVDSEVAGLKLKVVKSTHAKCGRCWHHREDVGQHAAHPDLCGRCIENIEGSGEVRHYA

SEQ ID NO: 21399 - protein, 368 aa, Pseudomonas aeruginosa
PSTSIIRWPARPWPSKSRSSTSSRPEPSVAAPFPSGEGGSKVHSSNHRVAHETAMQIKLANPRGFCAGVDRAIEIVNRALDVFGPPIYVRHEVVHNKFVVDNLRQRGAIFVEELDQVPDNVIVIFSAHGVSQAVRKEAEGRGLKVFDATCPLVTKVHMEVVRYSRDGHECVLIGHEGHPEVEGTMGQYDASNGGAIYLVEDEADVAALEVRKPEALHYVTQTTLSMDDTSKVIDALRAKFPQIQGPRKNDICYATQNRQDAVKELADQCDMVLVVGSPNSSNSNRLRELAERMGTPAYLIDGAEDMQRGWFDGVRRIGITAGASAPEVLVRGVIAQLREWGASEEQELEGREENITFSMPKELRVKAL

SEQ ID NO: 21400 - protein, 337 aa, Pseudomonas aeruginosa
PQRVADSKSRAEHRLLLMSDMIQRAAEVPFELGGQRLDQIAAQLFPEHSRSRLAGWIKDGRLTVDGAVLRPRDIVHSGAQLVLEAEQEAQGEWLAQDIELEIVYEDEHILVIDKPAGLVVHPAAGHQDGTLLNALLYHVPDIANVPRAGIVHRLDKDTTGLMVVAKTLEAHTKLVAQLQARSVSRIYEAIVIGVITSGGTIDAPIGRHGVQRQKMAVVDAGKVAVSHYRVLERFRAHTHTRVKLETGRTHQIRVHMSHIGYPLVGDPVYGGRFRIPPVASQTLVQTLREFPRQALHARFLELDHPATGVRMKWESPLPEDFLWLLSLLRQDREAFVG

SEQ ID NO: 21401 - protein, 262 aa, Pseudomonas aeruginosa
PPGPAEGRPVHLQRAGIAGRDGREHQARQAAARPGRVAQGAGECRGQPAWRRSGERPERRGVAPGAGQVHRRHDQARRGRQARSGDRSRRRNPPDHPGPAAADQEQPGADRRTRRRQDRHRRGPGPAHHQRRSAGRPQGQAPAGPGHGGADRRCQVPRRVRGTPEGSPQRTGQAGRPGHPVHRRTAHHGRCRQGGRCHGRRQHAQAGSGARRAALRRCYYPRRVSPVHREGCRAGAPLPEGAGGRTERGRHDRHPPWSQGTL

SEQ ID NO: 21402 - protein, 298 aa, Pseudomonas aeruginosa
SAPRGEHHRRRDHRRGQAVAPLHHRSATAGQGHRPDRRGRQPHPHGDRLQARGTGSSRPSPDPAEDRARGAEEGRRRSHQEAPGQAGGGYRQARARIRRPRGYLEVREGRGAGLGADPAEDRAGQAGDGGGAAQGRPREHGAHPVPDHPGPGTQPADGRPARQDREPVAAQQGDRRGNRRSGFQVDRYPGVEDARGRAREAAAHGAGAASASDRPGRGGSRRVQRRAPFARRPRRSEPAERLVPLPRPDRGGQDRVVQGAGRVPLRYRGGAGADRYVRVHGETLGGPPDRRASGLRRL

SEQ ID NO: 21403 - protein, 151 aa, Pseudomonas aeruginosa
YRADAGSGRPSHRRGLPAGRCRESGRRCRDRGGWRKPGGFRCLRNLERFAMNMQDLAGRVQAGHIDALHLVSLEGGIYVLEAQMGDRAYPVEDDLGQPVSLRSVEHARQVLRGLDRVPVELVCADVDDEMCGLLAESGSFIGGLPLSIRQG

SEQ ID NO: 21404 - protein, 218 aa, Pseudomonas aeruginosa
AGRPFSTPQRSSAMSELNLTTDEARVSYGIGRQLGDQLRENPVPGMTLDAVLAGLSDAFAGIDSRVSGEALSASFQVIRERMQAEAQAKAEAAAGEGRAYLAENAKREGVTVLPSGLQFEVLSTGEGAKPSREDTVRTHYHGTLIDGTVFDSSYQRGQPAEFPVGGVIAGWVEALQLMNAGSKWRLHVPSELAYGGQAVGSIPPHSVLVFDVELLEIL

SEQ ID NO: 21405 - protein, 385 aa, Pseudomonas aeruginosa
RARVGRSDRGVAGQRREHARDAAAVLAVAVGAELRVAEAAPRAVQVDRCCQRAFAVGHGQVVLAGRQGLQVAGDGQQIVVAEVLGAVVDDIGHAAGHRGEAVLPGLQQLHGVLHRPQVAQAQGLPLFDGFAGEVELPGTTGFAHGFFLEGDAARSMAGAAVAESLYQVGAAVDRRVRVAGGGERRVVEERPVPQRQAPALVERPAHRARRIRLGDGLHAVHQVGVQRTHVFFADLGVGRVGHRRIEIHSLGGHPLAHGAVELFEAVAADAGLPVGSDVGRVDGTHWRLQLQAAGHRRALRAGMAGDAVAELGHVAAFFDERSVRGRFAGMEQGNDGAQRAEQAEARERSRHFLILRRRPGAVPSATVHSFFRYAAVDRTTVTPLL

SEQ ID NO: 21406 - protein, 79 aa, Pseudomonas aeruginosa
ARITRACCRLGSRRSRAASVAARWWSVWTRAGAKVARGLVNYSALEAQKILGQPTDAIEALLGYVDGPELVHRDNLVLV

SEQ ID NO: 21407 - protein, 533 aa, Pseudomonas aeruginosa
TGPAGRGLGQDQFRHAGSPTSMNLLKSLAAVSSITMLSRVLGFVRDTILARIFGAGLATDAFFVAFKLPNLLRRIFAEGAFSQAFVPILAEYKNQQGEEATRTFIAYVSGLLTLVLALVTALGILAAPWVIWVTAPGFADTPEKFALTTDLLRVTFPYILLISLSSLAGAILNTWNRFSVPAFVPTLLNVAMIGFALFLTPYFDPPVMVLGWAVLAGGLLQLLYQLPHLRKIGMLVLPRLNLRDSGVWRVMKLMLPAILGVSVSQISLIINTIFASFLAAGSVSWMYYADRLMELPSGVLGVALGTILLPMLAKTYSNKDRHEYSRLLDWGLRLCFLLVLPCSLALAILAEPLTVSLFQYGKFTTVDAAMTQRALVAYSVGLLGIILVKVLAPGFYAQQNIRTPVKIALFTLVSTQLMNLAFIGPLQHAGLALSIGLAACLNAGLLYWQLRKQRLYLPQPGWAKFLVKLVVAVLAMSAVLLATMHWLPAWEQGAMLERFLRLGLLVVAGLLAYFGMLALLGFRLRDFSRRAVL

SEQ ID NO: 21408 - protein, 344 aa, Pseudomonas aeruginosa
SASGLAAGSCRFACCPAPGTRIIDHFLSNKRAMQLLRGLHNLQPLAGGCVATIGNFDGVHLGHQAILARLRERSLELGVPSCVVIFEPQPREFFSPDSAPVRLTRLREKLELLRGQGVDVVLCLAFNRRLRELSAAEFVRQVLVDGLAVRHLEVGDDFRFGCDRSGDFAFLVNASREQGFTVEAATTVELDGVRVSSTRVRQALAEGDLHLAERLLGRPFSLSGRVLHGQKLGRQLGSPTANIQLKRRKAPLNGVYLVSTLVDGQRCQGVANIGTRPSVNGDGRPHLEVHLLDFAGDLYGRHLQVTFHQKLRDEQRFASLEALKAAILADIAAARAYWLGQPLD

SEQ ID NO: 21409 - protein, 214 aa, Pseudomonas aeruginosa
KWSSRPTPSAVVAGTIARTSVSTLRILTCAVAASRTSKAAARFATMPDVDRFGRLPWLWITVLVFVLDQVSKAFFQAELSMYQQIVVIPDLFSWTLAYNTGAAFSFLADSSGWQRWLFALIAIVVSAILVVWLKRLKKGETWLAIALALVLGGALGNLYDRMVLGHVVDFILVHWQNRWYFPAFNLADSAITVGAVMLALDMFRSKKSGEAAHG

SEQ ID NO: 21410 - protein, 146 aa, Pseudomonas aeruginosa
AAGDRRLQSSAGRQDPGLRSRDHRRPAGLNRRSLRPSQAGRAVARFIRPITASPTRPPCKSNSPIPAASAPAWIAPSRSSTVPSMSSARRSTCVTRWCTTSSSWTTCASAAPSSSRNSIRCRTTSSSSSAPTAFPRRSARKPRGAA

SEQ ID NO: 21411 - protein, 613 aa, Pseudomonas aeruginosa
AVGYAGPAGDFQFAGDGPGLQVDDQQRGLVVQAGITVSGDHGPLAVVQPGDRGFGEAVAKVGLLVHADFPEQLDVGGIGHVEGEQALAAGAQAADQHGMPGATEEGVGDHRRAVDVELVGAALVAAGGQLVELLEDRAWDEGEGLVTVGIETVQHAVVGADVYPRGTGFLCFCERGVVAAGLDRLGQVGQVLGLADRRRRGVDDIAEDRVAGAEVVAVLLAAIAAQEGHAVLALGVGDIVAVRIAVQLPLLVGAEAAPGELLEARGTGSGHHDLAASSTVGHRVEDALRAPQLGLHGGLVLGGQAVAGQVASPVLVAGEAGLVGEAGQLVASVVFLQGRADGGAGCRQVLARNSVEDVLEGRDQLVRRVGAEELAPGVHCGVPQVIDVVAMVIRSVRPAEAPGGDFVIAAGVGGTLPLRAGEAGGQAQAQGIGHHVLPGRRIVARIPVLRRGIGLVRVGNVRLDIVVDIRPGIGGPVMEGLVGQGIGRSIPVRRLAAVALAIGEATTRAVGIAYAGRVVVPKTIGHQNVIAATAAVFRRGLGTRSIGIGAVDAGLLEKLPCSSHGLTQRSTTSDRQVLQPVEEVHPMLPGEVSQVVVVTVTGATADQARGTVQ

SEQ ID NO: 21412 - protein, 247 aa, Pseudomonas aeruginosa
ADGGARLVARRRSSARRGDLAWRDPWRQGAAGGGRLERRVVEAAWPGTARGTGERADDPLQVRGGFPAAHGAGQGALRDSAARRPHPDRQHLGTFGLRQDADRRGAGKPQGVCGRTVAGTGGHAAGGPLGRVAPGLSRRHPLYRSGAWLRRALAEYRALPQRAGPGTGVVPSAGGSHERAGTDHRPGPLRPGWSPLRSENQKACLRTGLFTFSRCPAFSGGSASSGTSGPGAGPRRCGSSGSPRAPA

SEQ ID NO: 21413 - protein, 859 aa, Pseudomonas aeruginosa
KEGRPMRIDRLTSKLQLALSDAQSLAVGHDHPAIEPVHLLSALLEQQGGSIKPLLMQVGFDIAALRSGLNKELDALPKIQSPTGDVNLSQDLARLLNQADRLAQQKGDQFISSELVLLAAMDENTRLGKLLLGQGVSRKALENAVANLRGGEAVNDPNVEESRQALDKYTVDMTKRAEEGKLDPVIGRDDEIRRTIQVLQRRTKNNPVLIGEPGVGKTAIVEGLAQRIINGEVPDGLKDKRLLALDMGALIAGAKFRGEFEERLKAVLNELGKQEGRVILFIDELHTMVGAGKAEGAMDAGNMLKPALARGELHCVGATTLDEYRQYIEKDAALERRFQKVLVDEPSEEDTIAILRGLKERYEVHHGVSITDGAIIAAAKLSHRYITDRQLPDKAIDLIDEAASRIRMEIDSKPEELDRLDRRLIQLKIEREALKKEDDEATRKRLAKLEEDIVKLEREYADLEDIWKSEKAEVQGSAQIQQKIEQAKQEMEAARRKGDLESMARIQYQTIPDLERSLQMVDQHGKTENQLLRNKVTDEEIAEVVSKWTGIPVSKMLEGEREKLLRMEQELHRRVIGQDEAVVAVSNAVRRSRAGLADPNRPSGSFLFLGPTGVGKTELCKALAEFLFDTEEALVRIDMSEFMEKHSVARLIGAPPGYVGFEEGGYLTEAIRRKPYSVVLLDEVEKAHPDVFNILLQVLEDGRLTDSHGRTVDFRNTVVVMTSNLGSAQIQELAGDREAQRAAVMDAVNAHFRPEFINRIDEVVVFEPLAREQIAGIAEIQLGRLRKRLAERELSLELSQEALDKLIAVGFDPVYGARPLKRAIQRWIENPLAQLILAGKFAPGASISAKVEGDEIVFA

SEQ ID NO: 21414 - protein, 77 aa, Pseudomonas aeruginosa
CGSGRNPYRGEGLPACSGEALRKDRDMRKVTPGRSSVTFPEPAGGAFASVRAIRLPGSGARMTRPGVIAKAQRRARA

SEQ ID NO: 21415 - protein, 86 aa, Pseudomonas aeruginosa
LMAHKKAGGSTRNGRDSESKRLGVKLFGGQAVKAGNILVRQRGTKFHAGYGVGLGKDHTLFAKVDGVVKFETKGAFGRKYVSIVAA

SEQ ID NO: 21416 - protein, 415 aa, Pseudomonas aeruginosa
PALVVGGVSMKFVDEVSIHVKAGDGGNGLMSFRREKFIEKGGPNGGDGGDGGSIYLEADVNLNTLVDYRYTRRFDAQRGENGGSKDCTGAKGDDLILPVPVGTTVIDANTQEIIGDLTEPGQRLMVAQGGWHGLGNTRFKSSTNRAPRQTTPGKPGEARDLKLELKVLADVGLLGLPNAGKSTFIRAVSAAKPKVADYPFTTLVPNLGVVSVGRYKSFVVADIPGLIEGAAEGAGLGIRFLKHLARTRILLHLVDMAPLDESDPADAAEVIVRELGRFSPALTERERWLVLNKMDQILDPAEREARKQAVIERLGWEGPVYVISALERDGTEALSQDIMRYLDERTLRLEEDPQYAEELAELDRRIEDEARARLQALDDARALRRSGLKNAGAVDDDDFDDEEDDGDGPEIFYVP

SEQ ID NO: 21417 - protein, 277 aa, Pseudomonas aeruginosa
SQSQGGAQAMAGRPLADARHPGAGRWGGEGGEPGSQEPVAGWGQGGPGQLPSRRDGGLCGPGRARKWRAAWSTTVRWRRRRSSVSRRMPSRPCSATWMGRSWCIATIWFWSEERANAQARGVAGWSAAVAGACRGGGDRRGFHGVQVGRAERQDCRRGFRRSQGAGRDLLSVARQDRWGQGRPGAGGGSRRGVDRLSPGGADPVQWRTQGWRRGVQAAHFAGVQKHAGGALLRSQAQCLGLSGLQRPGDRGQSAERGDGDSPHALADRSLRRASRGQ

SEQ ID NO: 21418 - protein, 653 aa, Pseudomonas aeruginosa
DDRLQSDAKPSGNRLPNESRPAPARAGNPEVLERHRSVPEAAGHWRRPSEVRPARWPSVRQRQHSHRSRGQQDSQGHHCPLQDPGGLRRALCAGLGLPRPAHRAQGRDHPRQESSGGQDPRTVPRIRGRADRRAEGRLHPPGRARRVGQPLQDHEFRQRGERNPRPRGNGQAGLRVQGPEAGQLVLRLWFGAGRGRGRVRRQEVADHRRWLPGGGCRQAGRGLRPGGPGQAGADRHLDHHALDHPGQPGAERASGDRLRAGRCRRSLPGAGRGPGRVLPGALPARGQGGRHRQGRGAGADQLPPSVLRAPVAGVPGRLRGPRCRHRYRPLVAGLRRRRLLYLQALRDEQRRHPQPGAEQRRLRRLVAVLRRPVHLEGQPQRGGQAGRGRQPAGPRNHQSQLHALLAAQDAADLSRHRAVVRRHGQAAQAGCFPARASAGSHHPDRIRPGLGPGASARNDRRASRLVHLAPAQLGRTDPVLPAQGQWRTASTHRGADGRGRAASREGRHRSLVQARRRRAARRGRRAVRENQRHPGRLVRLRHHPLARAAWFPPDRPCQRPGRRSLPGRFRPAPRLVPLLAADRLRDRQPCAVPPVADPRFHRRRVRPQDVQVAGQHRGAADRHRYPGRRHPAPVGGFDRLLGRDRGIPADSPA

SEQ ID NO: 21419 - protein, 269 aa, Pseudomonas aeruginosa
RRCLPADPQYHALPAVQPERFRSGHGSAAAPGNAGPGSLGGRSRPALAARDRRGVPRVPLLERLFQGAQLLRTGAGRVLSGHHQGPPVHHRRQQRRPALLPDRTVPHRRGPRALDRPDPGVHRRGSLEVPARRARRVGNARHLVRRPQRTAGRRDAESPVLGTGHGGEGRGQQGAGEPARGQGRGRQPAGRGHPVYGRRAAGPIGQAGQRATLRPDHLDRDPGAAVGGSGRRGGQRSRRPQAESGQVDPRQVRSLLAPSRGRRSARCAS

SEQ ID NO: 21420 - protein, 222 aa, Pseudomonas aeruginosa
RKARPGWPSPWRWCSAAPWATFTTAWSLATWWTSSWCTGRTAGTSRRSTWPIAPSPSAPSCWRSTCSDRRNPEKPPMAESTRIGQESRVTLHFALKLEDGNVVDSTFDKQPASFKVGDGNLLPGFEQALFGLKAGDKRTLSILPEQGFGQPNPQNVQIMPRDQFQDMELAEGLLVIFNDAAKTELPGVVKAFDEQQVTVDFNHPLAGKTLAFEVEIIDVQPA

SEQ ID NO: 21421 - protein, 135 aa, Pseudomonas aeruginosa
QGSFVQSPRRPRDRHANQTRQSPRLLRRRGSRHRDRQPCPRCLRPADLRASRGGAQQVRRGQPAPARRHLRRGTRSGAGQRHRHLQRPRRFPGGPQGSRGARPEGFRRDLPAGDQGAHGSGALQPRRPRMRADRA

SEQ ID NO: 21422 - protein, 197 aa, Pseudomonas aeruginosa
RAPRGGRHHGPVRCQQRWCHLPSGGRGRRRRAGGAQARSPALRDPDDPVDGRHLEGHRCPARQVPADPGTAQERHLLCHPEPPGCREGTGRPVRHGPGGGQPQQFQLQPPARTRRADGHAGLPDRRRRGHATRLVRRCASHRNHRRRFRAGSAGARRDRPATRVGGVGGAGTGGAGGEHYLLDAQGTAGQGFVNRAQ

SEQ ID NO: 21423 - protein, 419 aa, Pseudomonas aeruginosa
ASTLSATFRPWQAVLLLVSFRDGRISPDFPRCLNQLRDEAYDRLFCNPCVIVEALVSERVVVVGAGVIGLLTARELALAGLRVTLVERGESGREASWAGGGIVSPLYPWRYSPAVTALAHWSQDFYPALGQRLLDETGLDPEVHTVGLYWLDLDDQTEALQWARKHTRPLKEVPIEEAYAAVPGLGAGFQRAVYMSGVANVRNPRLARSLRASLQQFANLELHEQTEVRGWLRDGDRVLGVATSRGEIRGDKVLLAAGAWSGELLKPLGLELPVVPVKGQMILYKCAADFLPRMVLAKGRYAIPRRDGHILIGSTLEHSGFDKTPTDEALESLRASAAELLPELADMQPVAHWAGLRPGSPEGIPYIGPVPGFDGLWLNTGHYRNGLVLAPASCRLLADLMSGREPIIDPVPYAPAGRL

SEQ ID NO: 21424 - protein, 488 aa, Pseudomonas aeruginosa
GAKTKRPVFGQAFSLSVDAQLFQAVAHRAERQAQALGRGGAVPAGLLERLHDQLALDVFQVVLEVVYFAQARGAFLAGTRRIGQAQVVRLDLVVFAQGVGALQHVFQLADVAREAVVLQLLLCVAGQPGGRQAGVAGQALEDAFGEQRDVLAAFAQRRYAQLDDVEAVVEVLAEAPGADFGGEVLVGGAEDAHVDGDLLLAADRAHGLFLDRPEQFDLHGHRQVGDFVEEQGAAAGGLEQALLVFDSASEAAFLVAEELAFHQFGGNRAAVHRHERPLDTWPLLVDQARHQLLAATGLATDVDRRLAARQLADLVAQGAHRRRLAEQAVVHRRFLGFRVAQAQGGCHQLPQATEVDRFGEEVEGTGLERLDRGVQAAVRGDHGHRGLWMALLDVLDQIEAAAVRQAHVGEAQVERLAGQQLAGFLDVAGAAGVQLHAAESDFQQFADIRFIVDDQGFLSAHACGFRQLSLRGWAKVMRKQPPPSSRLR

SEQ ID NO: 21425 - protein, 529 aa, Pseudomonas aeruginosa
SSSSLEISRTSTRPMVRRYRWYRRRMRCPCSSLSRSRSARTVALVLAQVRLAAIPALFVGEGVGLRHVDAAMGAADHRRCARLVLRTLLLARSGTGKATPEPERDGDQGDPEQEAEKAHGDLGGWRKLQFSQAAGSIPAGKVQAVRRLALGEAWRRAKRREACASLRCFVRSVEETEGHVAPPGAAGVLVVIALRLLVVGAVILVFRFQFGGDLPLGILVLLDHVLGGLGFHVRRRLAALDQAQGGLGQPGAGVGLAFAGDELAILEAGVIRIVELEGFQAGAGQVVETQATVGFDHDRQAIADGRGFLEVLYHVATAVGGGDIGLALQVVVADVHFVGRQQVAQVHHARLGVRGVAAVGEAAGELGELVEGVAGGARVALGHVQRQEARQQAAVLVEGGQALEVVGVVDVGVLRMQADEAFGGGAGGFGLHVLVVGVDQLELGLLGVAAEGIARFEGFQLGDGAVVALVVEVVLRLLVQLALAQVLVDSLLVRGAGCGEGEDGDQQQVFHLHGGLRPWDGRLGLNRLL

SEQ ID NO: 21426 - protein, 567 aa, Pseudomonas aeruginosa
ASSPTHVRYDSTRGRGAVRAGWPASRPDRRPAFSRTLPLPSGRLDQGRTPDRRRRRAAPARHRPQRRATGPGGRAGSPGRVARTGHRAGNRLRGRAHPGDRQARRPGGPSGCRPSGRHPAECLALPCPGHRQCAARRDRPPPGQGHDRPDGSGQDAGGPHQAGGATAGTVGQPHLRGDRDRRDHLRRHHRCADRTAWRAAAEDGGGRRRQGGGQPLPRAGTLPCAHPYPGQAGDRAYPPDPRAHEPYRLSPGRRSGLRWALQDSPGGQPDPGPDSSRVPPAGAARALPRTGSPGHRRAHEVGVAAAGRLPLAAQPVAPGSRGVRRMNAWLTPGWPAPARVRACVTTRSGGVSQAPFDSLNLGAHVDDDPRAVEENRRRLTERLECRPSWLDQVHGVTVVEADPSRVLRADASWSAMPGVACTIMTADCLPALFCDRSGTRVAAAHAGWRGLAAGVLEATVDSLGVPGDELLVWLGPAIGPQAFEVGGEVRDAFVAAHAEARSAFVPSANPGRFMADIYRLARIRLGAHGVTAVHGGGFCTFSDTARFYSYRRSSRTGRFASLVWLQD

SEQ ID NO: 21427 - protein, 368 aa, Pseudomonas aeruginosa
  UNSURE (339): Identity of amino acid at the above locations are unknown.
PELTRAERRAVVRQQSLHGDAQAGVIGHGIAQEQDRLRRLLIGMHGGERQPCVIIDGHEQRLPACTIDRVATVACDAVAGPHDAPELLGVDVQQVPGRLVLVAHNGFDGLQVAQPGHARSRQNVRVPKANSGPFVIPDVMEDERVLFLSDILPTGYQAVRNAGVRQGSIVAIYGAGPVGLMAAACARMLGAERIFIVDHHPYRLDFAERTYGAIPIDFDQEDDPAAAIIERTDGHRGVDAVIDAVGFEAKGSVTETVLTALKLEASSGKALRQCIAAVRRGGTVSVPGVYAGFIHGFLFGDAFDKGLTFKMGQTHVQALLPALLEHIGNGDLHPEAIIXHRLRLDDAPEGYALFDEKREDCRKVLLRP

SEQ ID NO: 21428 - protein, 316 aa, Pseudomonas aeruginosa
PLDASQLDSSEHCTGERARITPVWFWRCVFETFYETGIRLNALLCIRKCDVDWKRKMILIRAETEKTHREFSVPITDGIAPHIRRLLQEAEQVGMSHHDQLFNVNRFSRHYARKEMNADQVEAMYRKLTEKTGVRMTPHRFRHTLASDLMKQHERNIHVAKDLLNHSNIQTTMSYIETDHDQIRAVLNERSLAQGAVAQTRKVDYSGSPQKAAHSRPALPRPTQRGSSPSTQVPTAEVTSTGSDQEIQAYNSPPFCTQRRADAVPPPADNSEQDLLFALLAQHLLRQASLTTTEGNCAPRWGTVVGKKASPPLADR

SEQ ID NO: 21429 - protein, 272 aa, Pseudomonas aeruginosa
PGGAPIRRATECFSMNSDISIRTSASSVSKRNSASALHNSVLPTPVGPRKRNEPLGRFGSARPARERRTALDTATTASSWPITRRCSSCSMRSSFSRSPSSIFDTGIPVHLETTSAISSSVTLLRSNWFSVLPCWSTICRLRSRSGMVWYWMRAMLSRSPLRRAASISCLACSIFCWICAEPCTSAFSDFQISSRSAYSRSSLTISSSSLARRFLVASSSSFFSASRSIFSWIRRRSRRSSSSGLESISMRMRLAASSIRSMALSGSCRSVM

SEQ ID NO: 21430 - protein, 371 aa, Pseudomonas aeruginosa
RSLRPRRMAIVSSSLGSSTSTFWKRRSSAASFSMYWRYSSRVVAPTQCSSPRARAGLSMLPASMAPSALPAPTMVCSSSMNRMTRPSCLPSSLRTAFRRSSNSPRNLAPAISAPMSRASRRLSLRPSGTSPLMMRWARPSTMAVLPTPGSPISTGLFLVRRCRTWMVRRISSSRPITGSSLPSSARLVMSTVYLSSAWRDSSTFGSFTASPPRRLATAFSSALRDTPWPSSSLPSLVFSSIAASNTSSLEMNWSPFCWARRSAWLSRRARSWDRFTSPVGLWIFGSASSSLLRPLRRAAISKPTCISRGLIEPPCCSSRAESRCTGSMAGWSWPTARDWASESASCSLLVKRSIRMGRPSFYRAGRNDGCP

SEQ ID NO: 21431 - protein, 61 aa, Pseudomonas aeruginosa
RKARRDDSVDKGDFPRFKRPDRDIGQLPPDNLRGPSPGARPGWQNGRYATSGGRNRSARYR

SEQ ID NO: 21432 - protein, 346 aa, Pseudomonas aeruginosa
PRHCAWSRRPAHGPAPASRGSARRSSDERLAILAQQAEQPEEVFRQRRLPLHAHAGGRVIQFEEARVQRLPGELAKSLDQGLAGHRGNPEAPTVDRIADQGIADMAHVHADLVGTPGLQLDPGMGVRTEAFQHAVMADRHLAGVDHRHLLPLHAMPSDRRIDGAAGGDHADHDRLVDAADRPCLQLRHQLGVGLQRLGHYHQAGRVLVQAVDDPGARHIGDVRDMVEQGIQQGAVLMAGSRMDHQAGGLVDHQDVLVLVDDFQLDVLCEPLALGFLLGLQDQLRAAVDDVARAQHGAVDGQASVLDPAGQTGAGVFGKKLGGDLVETLATQLERHLGRALNHIGHE

SEQ ID NO: 21433 - protein, 254 aa, Pseudomonas aeruginosa
GQADRPRDASRHASETPAADRHPRPHRSLLLEQGDCRREPEREPAVPAGAGRPQQQELQQRRHQAESPRIALSLRPLRRAGPARADLRQLQEHGARSRPRRRRTLHPPASAAPQRRLRLLPQGPVLLRPGPRPAGALPAAGHDQARPGRRPRLLQRVRPAHQPLPQQPLRPGRQGAHGVPAQPAGGLRSARRPLLPEAPGLCRRRQPRSLRGRELPGNPGRRRWPGDHGRSLPSPGSRRPGQHQPGNPQAQLSG

SEQ ID NO: 21434 - protein, 154 aa, Pseudomonas aeruginosa
TGYPRTAGNHSRPHEAGHPQRPQRQGSPRVAGPRAVRPVPHRHAPAGRQRPRSGPVHPAAPSTDPGGHDHRVRQPGHRDPGAQGRCLRLPHQTGRPRSLAGAGGNRPALAQPGSRGSAGGQPPARRVAADARPAQPDRQAGAQPGAGLHQWRVR

SEQ ID NO: 21435 - protein, 307 aa, Pseudomonas aeruginosa
RQGAGGAPDPRAGATYRAAVRAGELRRDSLRTDGKRVLRPQERQLHWRYRRQAGPVPGRQRRHPVPRRSRRPADGHAGQTAPGDPGKGRARGRRPAGGRRRRAHPLRHPQGPRRRSRRRALPPGPLLPPQRHRAARTAAARTPRGHPAARRTHPQAPGRRHRPAGRQADRRRTGEAEELPLPGQRPRAGKHAGARLHPVRRRPDPASRPAPGRCAGCQPGRRREPERNRQPRGLPGRHRAQADHAGARGDPLEPHRRGPAPGPDVPLDALPPEKAGHRLKVKRPVRRQAFWFSLLRGDQPGRRGPGR

SEQ ID NO: 21436 - protein, 265 aa, Pseudomonas aeruginosa
GFPAPRRSASCRSPNVPRCCRSGCGRRAAESRSAPWPAPCAAGNPPRTCRGSSALSPVPRAVPGQAASTTRRSRRPPPAAPCRHGSRHARSPRRALDRRRATSRAPPSAHAVRDWRIVAGMPAMSAPGEDCAHWPRPTCRPPAGSRRPARAPPRRPPRSALPSTAGCACVPTAVPRSGRPGPASTGQRYGPRDRARSRRANAAPGPGRSPATSAPGRSPPGCSATDRAARRSRLPPRMPHAHSRPAPPGSPAVRRAPAPGRSTGR

SEQ ID NO: 21437 - protein, 191 aa, Pseudomonas aeruginosa
GNGENPARYDRRGMIRAKGPPAMVERSQRALTLTELLFALVLLGILGSLALPGMAAWLDGNRERSVLHELSASIQLGRTHAVAYQRPVTLCPSTDGRHCGSDWGEGWLLAEDGGERLLVGRALAKKERLRWNRSNRLRFLPSGQLNIHNGRFLLCGRHTVAWQLILNRQGRLRTASARENREKRELCSTSG

SEQ ID NO: 21438 - protein, 174 aa, Pseudomonas aeruginosa
TPWSNRMSYRSNSTGFTLIELLIIVVLLAIMASFAIPNFKQLTERNELQSAAEELNAMLQYARSEAVSQRRAISIQALKDKDWGKGLSIGVLASGSIAAPLRKHDGFRAATLTAKEKSAVEHLTFTANGTLVPPTERTFAICQNGKTDGGRVLSISQAGRIQLEPSSKAPQSCY

SEQ ID NO: 21439 - protein, 128 aa, Pseudomonas aeruginosa
RATTTSAAARSRATATARAPCWKSALPGAASKAPASTPPTAAPTPPSATTPSGSSHEHEQPLPTAIGPVHDRTTGGPRHQQLPDSRDYPDLPGQQAQLPVPARPGRQPGKRTLRHDVPGPATGQGGFP

SEQ ID NO: 21440 - protein, 214 aa, Pseudomonas aeruginosa
QGPPLPDRQGQPDTQESRAMNNFPAQQRGATLVIALAILVIVTLLAVSSMREVVLESRITGNVIEQTRLQNAAESGLREGERRFVNTLRPPEPGTGCTADNVARPCLLDLAALNLKLADTHQNPVGVLKGIANTWMSYRGSDISSATTAGTLYSVQWNNLPIPSGGQVNEAESPEYGNLMRGIGTFYYETNSVARNQTNSETVLQTVLARLYTN

SEQ ID NO: 21441 - protein, 135 aa, Pseudomonas aeruginosa
TPVRTPVAARTGAPSKERTDMKVLPMLLALAVPGLCWAEDPQTFEGAGVVFEVQVEKNLVDIDHRLYRLPNSTVRNGMPSLFQVKPGSVVSYSGTVSQPWSTITDIYIHKQMSEQELAEMIEKEQPRQDGEEQPR

SEQ ID NO: 21442 - protein, 138 aa, Pseudomonas aeruginosa
LGDHAAHQHFRRGSACGDSDATHTVEPAALHVLGAVDQVGRRAHPLGEFAQAVGVGTVGAAHHQDHVALVGQFLHGILAVLGGIADVVLARSLDLRELGAQGIDDLRGVVHRQGRLGHVVQGFGLAHLQRGDVGLVLH

SEQ ID NO: 21443 - protein, 178 aa, Pseudomonas aeruginosa
VDGTTVAGIVLAHGAFHLGVPFMPDQHAFVAVAAVAHHFHVHLGHQRAGRVENLQAAPLGFLADRLGNAVGAEDDDDVVRHLIEFLDEDGAALAQVVHDELVVHHLVTHVDRRAEDIEGTVDDLDGAIHAGAEAAGIGEFDLHGGLVGDAVIGRMNLATALPAWEGRSDRRFRPAGRR

SEQ ID NO: 21444 - protein, 856 aa, Pseudomonas aeruginosa
LVAQLGQLGLQRVFRIQGDLGLQVAAHGLGRALVLQLLVDRGLHRHDLFPVLAIQRHVGRQFAEAVVPGGEHYRLGALAGQELPDFLGGERQDRGDPAHEGLGDVEQCGLAGAPGDAVGAGGVLAVLDDVQIEPAQLLYAEVVHLGIDVPEAVLAVRLFDLALQEQGAIDRPAIQGQHFLGRQQIRGRIETVQVGQQEARGIADPPVGIGATLENLLGYRDLARVIGRSHPQAQDVGAQGIDDGLRHHGVAQRLGHLAAGLVDGETVGQQLAVRRMVVDRAAGQQRGVEPAAVLVGTFQVEIGDRAAGMADPVGTTQHVPMGGAGVEPDVQGVVDFLVLRGVLAEQLGGVELEPGFDAFLLDSLRDLFHQLHGAWMQFATGLVQEERDRYAPVALARDAPVGTPGDHSVQTRLAPARDEFGLGDGFQRSLAQGSTLPGLLVHADEPLRGGAIDQRRLVPPAVHVAVIDGFVGQQAADLFQLGHHVGVGLPDELAAEERQRVDVDAVALHRAEDVVVAHPVALAGIEVVFAVGRRRVDDTGAGIEGHVVGQVHRRQALVERMAEVDQLQRLALGGGDHLALALVARQAGLDQGLGQHQVAIAGIDQRVVDLRMHVQRLVGRDGPGRGGPDDDLRRLVQGRQAEGRGQLVGIRHREANVDGRRLLVGVLDLGLGQRRTTVEAPVDRLQALEHEVLLDHFREGADFVRLVGEIHGLVGVVPLAEHAQADEVGLLPFDLLGRVFAAQFAGLVRRKILAVGGLDLVLDGQAVAIPARHIGRVVARQGLGADNDVLENLVDRVTDVNAAVGVRRAIVQDELRTVAANGPQLLVQTDVVPELQGFRLALGQAGFHWEGGFRKV

SEQ ID NO: 21445 - protein, 264 aa, Pseudomonas aeruginosa
MLAVGEPSCRPSFCPCRTRPLRLKGRPRRRSARCRSPSARAWRTRVLLTRTPSSSTVVAASTVNPCSRLAFTRKAKSPERSQPKRKSSPTSRCRTASPSTRTWRTNSAADSSRKRRLKARQSTTSTPCPRSNSSFSRRRVRRTGAESGEKNSRGCGSKITTQLGTPSSSERSRRRARIAWCPRWTPSKLPMVATQPPARGCRLCSPRSSCIARLLLRKWSIIRVPGAGQQAKRHDPAASPDALHSTARREKSRRRKPSSASIPK

SEQ ID NO: 21446 - protein, 117 aa, Pseudomonas aeruginosa
QPLEATALFAALICSLFTQFFSRSSTVANTPSAKKRAKQAEKRRSHNASLRSMVRTYIKNVVKAIDAKDLEKAQAAFTAAVPVIDRMADKGIIHKNKAARHKSRLSGHIKALSTAAA

SEQ ID NO: 21447 - protein, 435 aa, Pseudomonas aeruginosa
LTRPRATFAPALVHTDHHLAATEAALDRLDPNRQQALVILAHRLHRPIVQHQGAAHLQVAGQPLLARRLATAIRGQQGAEAFAGAQAVEDTLDTPADDHRMPAGTRRQARRPQLGLHSAAPQGAGTAAGHRIELRIIGTRLVDQLGIGIVARIGVEHPVAIGKDHQQVGLDQVGHQCRQGVVVAEADLVGDHRVVLVDHRDHAQLDQGPQGAAGVQVALAVGEVVMGQQHLGGLQAMQGEAGLPGLHQPHLPHRGGGLEFVHRARSGHPAQAAHTGGDGAGRHQHQLDAGAMQRHHLLDPNGHGIAIQPTAIGRQQGATDLHHPAPRACHLVPHTLNLRSPGFDSSAPPARPAGYHAIRERRRSPDRRRRLPHHRNHRHPPHRRSSDPNAAARAHRPGPADGPAPRPRYAGRVRPVPRHTADLLPGAGYARRDSA

SEQ ID NO: 21448 - protein, 341 aa, Pseudomonas aeruginosa
QSPPCHLACRAIFVELLSLMQPQAFYRVVAEDFTAVDGIIRRQLTSRVPLVEKIGDYIISAGGKRLRPLLVLLAGKTLGYKGDDLCLLAATIEFLHTSTLLHDDVVDASGLRRGRSTANALWGNAPSVLVGDFLYARSFEMMVELGSMPVMRIISQATRVIAEGEVLQLSKVRDASTTEETYMEVIRGKTAMLFEASTHSAAALCQAGEEQSEALRRFGDYLGIAFQLVDDLLDYRGDAATLGKNVGDDLAEGKPTLPLIVTMRDGTEEQAALVRKAIQQGGSQDLESVCAAVEAAGALDYTANLARDYAARAIACLDTLPDNEYRSALVELSEFAVARTH

SEQ ID NO: 21449 - protein, 140 aa, Pseudomonas aeruginosa
GTAPARCSSHRCGATSRSISAPAWRGPSPLPPSSSTTCRSASRNASRSARAASATRTQWTSRSTFRTSRARTSRTRSRTGRRTSVRWMPATDAAMKNAPSMRRRGVSLLPGADAPQRISSSSTSNTSTLCGGMLPTAWPP

SEQ ID NO: 21450 - protein, 216 aa, Pseudomonas aeruginosa
MPPSSDTRCKASICPAWTRPARSCMFIANLSRLRRQRKPPGFRQPPRSRQRRPDSRHRPAGRPRRCEGRPLPASARYHRKVLPRRQATQAGNTAARPFYNGRAARAKHWRGSSVTGLLIQVAHGERREHEGHVDDHVPHQLVVRHILRVHEDAQQVDRRDRHDGGGHLVLQRAGIHLAQPAELFLAFVDVQLRNEVLVAGDHHHDQQAANQSHVDQ

SEQ ID NO: 21451 - protein, 195 aa, Pseudomonas aeruginosa
  UNSURE (128): Identity of amino acid at the above locations are unknown.
GCTLIPEKPENPGNRNGKKIQRLEELVEEDPKGPHKGVGRFGRTGTRKTLEKLGQRYPQHGRADRRNPGKRPPRGRSASADAARSDGAPSDPPRRDGSWAQEDLAAILAFFVEQGVALRCVVQTQAVXDDRLGMQVAVADVFEQGRQQCLYMGLAHLEGQALVEGIAEQEAMDEAGIHARHAHRATPPDSRDALA

SEQ ID NO: 21452 - protein, 358 aa, Pseudomonas aeruginosa
CLAAAGFELERGEHGFGDAALGLKAHRVDHRVDAAVPVGALDDRRGGIVLLVEVDGNRTVGALGEVQPVGMVVDDEDPLGAQHPRAGGGHQADRAGAVDRHDTALADAGIAHRLVAGGEDVAEEQHAFVFHYVGNHERPAVGLGHPNVLARAGMSRLSDLEPVEAVVRYEHEAPGDLLHIDTKKLGRIVRPSHRVTGNRRDSVDGAGWETLFVAIDDHARLAFTAMHPDEKTAQAVLFLRNAVAYYARLGITVQRLLTDNGAAFRSREFRSTCVELGIKHNFTRPYRPQTNGKAERFIQSALREWAYGWTYQNSAHRTDALASWQHHYNWHRPHSGIGGIAPMSRLNSSRNNLLTLHS

SEQ ID NO: 21453 - protein, 118 aa, Pseudomonas aeruginosa
KSPAEAGLSLSVHEEVRRRRSRLLPPSPRYWHPARICRPGSVAPAGSRSSAGWPASAGVRHRPGRSRRRSACPAPPGSVPGSARARPGACAGDRAGSRRCRRSAREPAARIPPLRRSG

SEQ ID NO: 21454 - protein, 187 aa, Pseudomonas aeruginosa
TRTYRSAPAPPRYRRGTRPAPCTTRSCPPRSGRGRGTSRSAGSDRRGRRANGARRWTRRLPPRPGRSLADAAPAPCAAASRARPRASSTPGYRSTWKPLRRFPRRSPCCAATGSRSCRAGRPSAGCVPGPGWSGTGCAPCSRGRPCAAPPPSPAWPARSSAGSAPSPAPRPSRTSRYPRGRRIRARA

SEQ ID NO: 21455 - protein, 117 aa, Pseudomonas aeruginosa
CAGPGPRRWRSCRRRVRRSAPGCSWSAAAGPGWSGGFRRRDRSPDRACLPRRAWSCRRCTCPAPGATPRRSGRSPLRRHAGWPRHSPAPCATRPGRAAACRAWCSRPSRPAIPARWR

SEQ ID NO: 21456 - protein, 301 aa, Pseudomonas aeruginosa
IRAIFRGSSDRTVTSVSCRRITCAGLVLEPDQAGKTAGTRRAAVGIEARGIAEGAEAAAMHGGDAMGAQADPRESVDVGHEAARIGARYESRARLGVRSDECIADLAADLEGLRADRRPQPHQQFVAGHAQAVHRRLQHARRQPAPAGMGRGHAGARAVAEQRRQAVGGHDRTGDARHRAPAGVGPEHPARVGLHHRHSVHLVQPARPAFQALGQASAVFFHGARIVVDVGAKVQTVEGCLADPATARGHAGPHTGRRRPAGGQPGVHPTNASRSWRNRLSSQRKSSGSGDSHFMRTPVAG

SEQ ID NO: 21457 - protein, 356 aa, Pseudomonas aeruginosa
QTVEAKPTVPGTQAAMQVKHLLLIAILALTAACSSNKETVDENLSESQLYQQAQDDLNNKSYNSAVTKLKALESRYPFGRYAEQAQLELIYANYKNMEPEAARAAAERFIRLHPQHPNVDYAYYLKGLSSFDQDRGLLARFLPLDMTKRDPGAARDSFNEFAQLTSRFPNSRYAPDAKARMVYLRNLLAAYEVHVGHYYLKRQAYVAAANRGRYVVENFQETPAVGDGLAIMVEAYRRLGLDDLASTSLETLKLNYPDNASLKDGEFVARESEADTRSWLAKATLGLIEGGEPPPHMETQAAKDVIKQYEDAEREIPAELKPENQDHSADDEKPESDDDEDSGRSWWSYMTFGLFD

SEQ ID NO: 21458 - protein, 133 aa, Pseudomonas aeruginosa
SHETPKGGAGLPSFCPPPCLSQRQTPHSLDLPGWDRAGGLAKLQLSPASEITMGLFRLLFWIALIAIAFWLWRRFTRPTPRQQQRPQDEPSASPMVRCAHCGVHVPQANALAHEQRWYCSQAHLRQDQGDRAR

SEQ ID NO: 21459 - protein, 661 aa, Pseudomonas aeruginosa
DPQPAGRDQPRRPTAAGVRGTGCPGPTPDADHPGPVEADEPGHRERPAALPSPPGRTAAARPEGVASAVRRRIPRQAAQRQPTAPAARCRRHPDPHGPTPVEPGAEQPGAERSSLQRPGARARPGLAEPRARPGERPAGAGSHRRRSRRTGGQIEQPVRTLLYYRKQRHRPGPLSLPRTLREQPGTDRLPQSRGRRRLLPHHLRPPAQTQLTEAARMSRQKALIVDDEPDIRELLEITLGRMKLDTRSARNVKEARELLAREPFDLCLTDMRLPDGSGLDLVQYIQQRHPQTPVAMITAYGSLDTAIQALKAGAFDFLTKPVDLGRLRELVATALRLRNPEAEEAPVDNRLLGESPPMRALRNQIGKLARSQAPVYISGESGSGKELVARLIHEQGPRIERPFVPVNCGAIPSELMESEFFGHKKGSFTGAIEDKQGLFQAASGGTLFLDEVADLPMAMQVKLLRAIQEKAVRAVGGQQEVAVDVRILCATHKDLAAEVGAGRFRQDLYYRLNVIELRVPPLRERREDIPLLAERILKRLAGDTGLPAARLTGDAQEKLKNYRFPGNVRELENMLERAYTLCEDDQIQPHDLRLADAPGASQEGAASLSEIDNLEDYLEDIERKLIMQALEETRWNRTAAAQRLGLTFRSMRYRLKKLGID

SEQ ID NO: 21460 - protein, 477 aa, Pseudomonas aeruginosa
ASARPAGSNSNLPPRRPSHAIEIATQVAAPIRLQHDRSAGRPAADQHRRAGHDRHAGQDHPVHRRLGRAQQGSHARQQPAGKHAGEPEGAVRRQGPDGHAIRLLQGQGVGVPHRAVLLHAIARRDQGPPGMLGGTGEERTARRWRPAEERLLHLPQLEAGRLRRQGLHAGNPPCLARQARRLRQRRRQQRRHLPLLLHPQGRAMSMNNRSRRQSGLSMIELLVALAISSFLILGITQIYLDNKRNYLFQQGQAGNQENGRFAMMFLDQQLAKVGFRRRADDPNEFAFPAQQKTAYCEAFKAGSTLVPAVVKAGQSGFCYRYQPAPGEAYDCEGNSITTPSDPFATAQAITARVLFVPATADVPGSLACSAQTIKEKGQEIVSGLVDFKLEYGVGPTMAGKREVESFVEQANIADRPVRALRYSALMASDKNLRQGDSKTLDDWITLYPSSKTSLQGNDKDRLYQIAKGSQTLRNLVP

SEQ ID NO: 21461 - protein, 320 aa, Pseudomonas aeruginosa
RDLRLHPKRGLREAPQVDRPRLPGRRPPVLRRRLAGGRRRLLRWRLAYRADRQPARRRQGPVRPRRDRSRQHQAALGNRRGPGARPWLQLPQTHGRPAAQRQVGRGHRKRLFQPERQGRAADHRPGDRGHHPQTGSHRQDRRTQRPIQPSPGRQQQRRRSRLRLRRRPARQPLALRPDRRQGQPGRSVQPSQRRPGGGLELQGVFRWPAALFGSRLRRRGASDHRRALAGSPSDTQGLHRDLRYRQVFRERRRPGRYQPRPDALRHLGPANQGRSRGQHTPTDARQPAAADTGPPGRLDLRLDRSHHSHRQSEPGQLAEQ

SEQ ID NO: 21462 - protein, 184 aa, Pseudomonas aeruginosa
PTSSRWCQQRPHLAWVDLTTFSLRPATSLSTASAGAADSGARVAVEVIRTKRSSLPSLANWACSASSVYRVTSACRLPPTALAARWFSSSLLTAAFTAMTCSQYWRFSVTSAGSSLRPSYQVASITDSARSPGRNFQTSSAVNARIGAIQRTRASAMWNSAVWQERRATLLAPVVYWRSLMMSR

SEQ ID NO: 21463 - protein, 539 aa, Pseudomonas aeruginosa
RLRSERSSWVSNTWAVCRPCRAKLDSQACTNPICPTEAAAWSSCIALGRDTQPRRLIPAATAPDDTSTSSMPAQCSATICSTQTAMALRSSPRPSAVSRALPIFTTQRRAPVTLSRIPSTLEAQASTLQPRRPARRGITPSGNVEDLRTVAVVFLIIEIIVIHRTGVLQTRTPQRARIVQGLQTGPRLVLDTPVEFGQFLGILRIFFQAQGTLVEIAHDVLAERLGAIALQGGDHIDRAFPAQPLDHRLLARLALGRIEDLVHLVQHQPALALGQRRTEATQLANDDLGGIGRIAFVQRRHVHQMQKDAGPRQMLEEANAQPGAFGGTFDQAGNVGDHEALVATDADHAEVRHQGGERIVGHLRLGRGHCADESALAGIRQSQQADVGQHLQFQLEVTRLARLARGGLARRPIGTGFETGVTEAVPAALSDHQPLTGLGQVADDFLGIGVDHGGTDRHRQDQVVALGPGAVLAAAVLAALGIETAGVAIVDQGVQVDVGFQVDGTAVATVAAVGTALFDELLATKAHEAIAAVTGFHVD

SEQ ID NO: 21464 - protein, 517 aa, Pseudomonas aeruginosa
GNACFFPAPRLARRAVLHRSPAPCQRTDHGRCAHRKRPLRGPARRLHRLPYRPAGRADGRRPGAEDANGYHLLDQHHSRPGDRHRPLQLRRVRPRHAQGGDRRGSESLSGDALPVLRQDQRRRHACAVRLPDARRATRHPGEYAERDELAVQPALGPVAVELGVPRRRAVHPLQRRGPGDQPRRLPGTGTRPLRRLPYSARHRLPGKSHERSRSFRAALPRRRNRRTMASPEPAQPVDGGGHRAVAEDRAEPLRHGVRQHDRCHPPQHPALQRRRSAGHRQLPEVPAGRQGRPAHARQRTPAGSTGRPVQLAGRPRLRAVLLRLPPQGRQRRPGHVPAAGRQPHGRFGQPEHATAYHPDRLENRGNRNPLAGLHHARLRPAGGPRNRRDPQLRPQQLGQPGFVDRCRPGEETAPADRGRQRPGHDLRLSTPGGHARGAERRTGGTRHAPAPGDPRAAAGERRQPVELHQLPPERRNRSRRLALRRRLGVLPQLRATGGQDHRPGGTHQRLLPALDER

SEQ ID NO: 21465 - protein, 162 aa, Pseudomonas aeruginosa
ASAAGLCRHAGDGGLLRLDEEQHPAAGQGRRPRRRQGRPGAEARPGERPQGLRPTMRGVSWREWRGAEEQRRRDALPTAVGRRVVQYRRRHGADLHRCRLRQAQHAGRLPGTLPARPGRPQRPGRSGRRGVLFAPAAPGLPGQDQGLAEGQASAGCPLLMPQ

SEQ ID NO: 21466 - protein, 135 aa, Pseudomonas aeruginosa
PAGRDRPPPDRRGRPSAPPGHRCRPPATPGARRRYVRPGPGRRDPACSSRTSRGCAGSGSLQVSANRLGPDSAGPIPGIVRPAGPDDAKDARSRRPPDITGKSCPGGRQRKPETPPPVRFTTAGRRERNTGEGRQ

SEQ ID NO: 21467 - protein, 139 aa, Pseudomonas aeruginosa
  UNSURE (12): Identity of amino acid at the above locations are unknown.
PSGASSRRRRWXMIASGCRSPLPMCSSKAGSSACTWVWPILKVKPLSKASPNRKPWMKPAYTPGTLTVPPRRTAAMHWRSALPLLASSLSAVSTVSVTLPLASKPTASITASTPRCPSVRSMIAAAGSSSWSKSMGIAP

SEQ ID NO: 21468 - protein, 989 aa, Pseudomonas aeruginosa
RDSNSRHPAPKAGALPDCAIPRLEVGSATWTRTRDPMINSHLLYRLSYRGTSFFQPWTLPVLLDSRLRGAPFYGCARACQPSDPKSFSSFSTSGKTALPLHAAALSLLPDAHEKAPPKRGFPCPSTKRSGEDDLVSFHLRRDTGTRREFAGQDQLRQRVLDPALDGPLQRACAIDRVEADGDQLVQRLLAQFQAQLALGQALAQATELDLGDAGDLLASQRLEYHHFVDPVDEFRTEVCIDRVHHCGTLRLAVAGQLLDLCRTEVGGHHHHGVAEVHRTPVTVGQASVLEHLEENVEYIRMGLLHLVQQHHRVGLAADRLGQVAAFLKADVARRRADQAGHRVFLHELGHIDPHQRLLGIEEELGQRLAQLGLAHPGRAEEEERAARPVRIGEAGARTAHGVGHGDYRLVLADHSPMQLLLHAQQLLALALEHLRHRDTGPLGNHFGDFLVGHLVAQQLVLGLAVLVDHLQAAFQVRDGLVLDARHALEVALAPRRLHLLLGLLDLLLDLRRALHLGLLGLPDILEVGVFALELDDILLQLGQALPGGFVVFLLQRLALDLQLDQATVETIQFLWLGVDLHADAAGGLVDQVDGLVRQLPIGDVAVRQLGRGDDRAVGDAHPVVHFIAFLETTEDGDRVFLARFVHQHLLEAALQRGILLDVLAILVEGSSTDAVQLAARQSRLEHVAGVHGTFRLAGTDHGVQFVDEQDDPAFLLAQFVEDCLQAFLELAAELGTGDQRPHVQGQQALVLEAVRHFAVDDALGQALDDGGLADAGFADQHRVVLGPPLQDLDGPADFVVATDHRIELAFLGALGHVDGVLVQRLARLLDVRVVHRFAATQVGHGILQRLARHALAEQQLAEPGVLVHRGQQYQLAGDELVALLLGQAVSLVEQACEILGQVHVAGRALDLRQRVEFFVEAAAQGGDIEADLHQQGLDRTALLLEQGGKQVHRLDGRMVMANGQGLGVGERQLQLAGQTVYSHGSSFLL

SEQ ID NO: 21469 - protein, 203 aa, Pseudomonas aeruginosa
MSAMKRPGLALGTKAERASACAATNASRTSPPTSKACGPIAGPSHTSSSSPGTPRLSTVASSTPAASPRQPAWAAATRVPERSQNNAGRQSAVMIVQATPGIALQLASALSTRLGSASTTVTPCTWSNQLGRHSRRSVRRRRFSSTARGSSSTWAPRFRLSKGAWLTPPLRVVTQARTRAGAGQPGVSQAFIRRTPRDPGATG

SEQ ID NO: 21470 - protein, 596 aa, Pseudomonas aeruginosa
SPSRSGSGVALPVPLRASSNVRRTSRAHRRWSAAPIAASTCRRPTPSPTNNAGIAARRTCARTRATVRAERLRLSEEQGQRILRLYHLYRLTIGLVLVLLISSELEDQVLKLVHPELFHVGSWCYLVFNILVALFLPPSRQLLPIFILALTDVLMLCGLFYAGGGVPSGIGSLLVVAVAIANILLRGRIGLVIAAAASLGLLYLTFFLSLSSPDATNHYVQAGGLGTLCFAAALVIQALVRRQEQTETLAEERAETVANLEELNALILQRMRTGILVVDSRQAILLANQAALGLLRQDDVQGASLGRHSPMLMHCMKQWRLNPSLRPPTLKVVPDGPTVQPSFISLNREDDQHVLIFLEDISQIAQQAQQMKLAGLGRLTAGIAHEIRNPLGAISHAAQLLQESEELDAPDRRLTQIIQDQSKRMNLVIENVLQLSRRRQAEPQQLDLKEWLQRFVDEYPGRLRNDSQLHLQLGAVDIQTRMDPHQLNQVLSNLVQNGLRYSAQAHGRGQVWLSLARDPESDLPVLEVIDDGPGVPADKLNNLFEPFFTTESKGTGLGLYLSRELCESNQARIDYRNREEGGGCFRITFAHPRKLS

SEQ ID NO: 21471 - protein, 135 aa, Pseudomonas aeruginosa
WKASSSATRKAASLALSKTSRACSRPPAAAPCSSTKSPTCRWPCRSNCSGRSRKRPCARSAASRRSPSTCASSAPPTRTSPPKSAPGASARTSTTASTSSSCAYRRCANAARTSRCSPNASSSAWPATPACRPPG

SEQ ID NO: 21472 - protein, 393 aa, Pseudomonas aeruginosa
AMQHFRMIMDQLSCPTGRPSTTARRSQARLACFPGVDPLEQPHVISFQLDRLHPDRVADHRRPAGHHGELRHSELQAADRTQRTAERRRGTQCDAAVRSQRSRVPEARDQHPGAEGQGLGQGPEHRCPGLRLDRRAPAQTRRLPCRHADSEGKERRGTSDLHGQRYPRTANGTNLRNLPERQDRRGPRAEHQPGRPDPTRTFLQGAPVMLLKSRHRSLHQSGFSMIEVLVALLLISIGVLGMIAMQGKTIQYTADSVERNKAAMLGSNLLESMRASPKALYDVKDQMATQSDFFKAKGSAFPTAPSSCTPLPDAIKDRLGCWAEQVKNELPGAGDLLKSDYYICRSSKPGDCDGKGSMLEIRLAWRGKQGACVNAADSSADTSLCYYTLRVEP

SEQ ID NO: 21473 - protein, 223 aa, Pseudomonas aeruginosa
WPATRTCARATARPWTIGSRSTPRPRPACKAMTRTASTRSPRAARHSGISCHEQLPCTTARRHAGHRPGDPGDRHPAGGLEHARSGTGKPHHRQRHRTDSLAERRRVRTPRRRAALRQHPASAGARHRLYGRQRGPPLPAGPRRAEPEAGGHPPESGRRAEGHRQYLDELPRQRHQQRDHRGHALQRAVEQPAHSLGRPGQRSGKPRIRQPDARHRHLLLRDQ

SEQ ID NO: 21474 - protein, 1190 aa, Pseudomonas aeruginosa
RRAQPDQQRNRPADRSRPSLYQLIEPRMKSVLHQIGKTSLAAALSGAVLLSAQTTHAAALSVSQQPLMLIQGVAPNMLVTLDDSGSMAYAYAPDSLVNSRNNVYFASNSYNPMYFDPNTQYKLPKKVTLSNGQIQVQDYSKPSFTAAWRNGFTQEGRVNLSRDYRPTVQYQGGSGAGTESSIDWYGAPAFYYQYSGGRGCSLTTSSCYTRVEISGAAQQQNFANWYSFYRTRALATQTAANLAFYSLPENARISWQLLNSSSCLIGSGSSNCYNNYLRDFTGQHRVNFFNWLENLSVGGGTPLRQAMTRAGEFLKKTGVNGPYAYRPGTQTSPEYSCRGSYHILMTDGLWNNDSASVGNADSTSRSLPDGKSYSSQTPYRDAASNTLADQAFHYWATDARPDIDDNIKPYIPYPDQANPSAEYWNPRNDPATWQHMVTYTLGLGLTTSLTSPKWEGSTYSGGYDEIAAGRLSWPNASNNHSNNVYDLWHAAVNSRGEFFSADSPDQLVAAFQDILNRISGKDLPASRPAISSSLQEDDTGDKLTRFAYQTSFASDKNWAGDLTRYSLTTQDKATVQTKLWSAQSILDAMPNGGAGRKIMMAGSGTSGLKEFTWGSLSADQQRQLNRDPDRNDVADTKGQDRVAFLRGDRSKENSDNFRTRNSILGDIINSSPATVGKAQYLTYLAQPIEPSGNYSTFAEAQKTRAPRVYVGANDGMLHGFDTDGNETFAFIPSAVFEKLHKLTARGYQGGAHQFYVDGSPVVADAFFGGAWHTVLIGSLRAGGKGLFALDVTDPANIKLLWEIGVDQEPDLGYSFPKPTVARLHNGKWAVVTGNGYSSLNDKAALLIIDLETGAITRKLEVTGRTGVPNGLSSPRLADNNSDGVADYAYAGDLQGNLWRFDLIAGKVNQDDPFSRANDGPAVASSFRVSFGGQPLYSAVDSAGAAQAITAAPSLVRHPTRKGYIVIFGTGKYFENADARADTSRAQTLYGIWDQQTKGEAAGSTPRLTRGNLQQQTLDLQADSTFASTARTIRIASQNPVNWLNNDGSTKQSGWYLDFMVNGTLKGEMLIEDMIAIGQVVLLQTITPNDDPCADGASNWTYGLDPYTGGRTSFTVFDLARQGVVDSKSDYSYNKQNVAVSGTEQKGLGGLTLSTNEQGNPEVCSSGECLTVNPGPNTRGRQNWRPIEGKN

SEQ ID NO: 21475 - protein, 256 aa, Pseudomonas aeruginosa
YESAAYAAGPGRSRPLLGRRSPDLRRRWRGLRSPGREEPGGHRPPALPPAQQHRQERHAQPVPGQAGLRGVLLWHRQPAVVHHHRYLHSQTDERTGAGRDDRERTAPPGRGGAAPMRTRQKGFTLLEMVVVVAVIGILLGIAIPSYQNYVIRSNRTEGQALLSDAAARQERYYSQNPGVGYTKDVAKLGMSSANSPNNLYNLTIATPTSTTYTLTATPINSQTRDKTCGKLTLNQLGERGAAGKTGNNSTVNDCWR

SEQ ID NO: 21476 - protein, 106 aa, Pseudomonas aeruginosa
PSRCRPSTGSSGSRSAGLRACAPPARRRRPRPPLGRWHHRCWHRTGPWCLPPRGALHARSARIRGRRGCSAPLPCAPWSPAGRSRRKPSGRAPRLPCGPPGKRRGR

SEQ ID NO: 21477 - protein, 335 aa, Pseudomonas aeruginosa
LKSTVTCCSSNALTTPGSSVLAASLKITSRPSASSMSWNWSRGMICTFCGFGWPKPCSGRMLRVRLSPAFKPNSACSKPGSRLPSPTLNEAGCLSKVLSTTLPSSSLRAKCRVTRLSWPMRVDSAMGGFSGFLRSEHVERQHDGADGDGAIGQVERREVPAVLPVHQDEVHHVAKDHAVVKVAQGAAEHQRQGDGQPGLAFLQAFQPDHQDRADDDGDQGEQPALPARAVGQEAEGGTGVVGQGPAEQIGDHHDLLVHAQFGLEERLADLVEDEHQHGDPQPGQAPETIDVRHSGEPRRCLRCSRCSDRTGQDAQRADRRPRDGASNDRTWRGST

SEQ ID NO: 21478 - protein, 515 aa, Pseudomonas aeruginosa
SRRQPGRASQHRPAGKVAQAETQQREHTEIGQETGNHQQAEAQESLQHGALLPGRQPVHRGQQHRRHRQHRDHQLDQELRPARLRQVQTLLAQLPVEQAGIQAGGQADGQGQAGMLKRADEGQVHQLGGNQGEERDLHWRTDVLLGIEARRKNLDQDDAEQADGVGHQRALGHRRVHRGELAVLEQRDGQRFGEDRQGQGTGQHQQEAQAQAPVEQARVLMAILVRIGLRQHRQEDRPQRHAQYAGRQLHQAVGVVHPGHRTGCQERSEDGVDDQRDLAHRDPQDGRQHQLHHPPDAAVPEVQARQHEHADLPQVRQLIEELQQAAGQHRPAQHHDRRIEIRREEQREADHCDVQQGRHEGWHREAVPGVEDRAGQGRQRDQQYIRKGHPQQVGGQGELFRGIGEARSGDPDNPGRGEDAERRDQRQHQREQAGNVGDEGPRRLLALLVLVLCQDRHESLGKRPLGEDPPQQVGQLEGDEKGVGGEAGTEDPRQDGIADEAEDPRQHGDGTHRRQ

SEQ ID NO: 21479 - protein, 330 aa, Pseudomonas aeruginosa
QSLRTCVSPLNLLTRRFIEVGIGRHGCMGSDRTPVQLRKAGYAKEVQGPRLYGKVQAEASATGLSLTVPPLPPSMPRNLCGAIVTDATPGLLPRGGGRFHRRRRDHPSPTHLPRSPGGKDRRLHHLRRRQAPAPAAGPARRQDPGLQGRRPLPAGRHHRIPAHLHSAARRRGRRLRPAPRPLHRQCPVGQRAERAGRRLPLCPLLRNDGRAGFHAGHAHHIPGHPGDRRGRSAAIVQGTRRQHYRRDLHGSDPRQDRDAFRGLDPQRRRAVPGRRGTVRGTAPLRRLPGNRLPAGGRPARLPRRRRDPRQERRRRPRRRQAHPTADRHHA

SEQ ID NO: 21480 - protein, 88 aa, Pseudomonas aeruginosa
ELFSSHSLVTEMSAMTYLIDAWLDRPHPYLRILHRETGEICAVLEEDALDELRDQGGLDLHELNSSEPLILKELVRNLFLFCYARALR

SEQ ID NO: 21481 - protein, 712 aa, Pseudomonas aeruginosa
KPLQQRRDRRPVDGRITKKRMDRGRGDRPRPTPKDEEMPASFPRLGLLGALCSIVPLLHASEPTTDAALIEKGRYVAQLGDCIACHTGPQGAPMAGGLELKTPMGTIYSTNITPDRETGIGRYSFEEFDRAMRKGVTAEGVNLYPAMPYPSYAKISEEDMRALYAYLMHGVQPVTQANTPSAMSWPFNQRWGLSLWNWAFLDDAPFTPSSDADPAINRGAYLVQGLGHCGACHTPRGIAFQEKAMSEAGRSGQLYLAGETVEQWQALSLRNLWTVEDTVQLLKTGQNRFATVSGSMTDVIHHSTQHFSDDDLLAIASYLKSLPAGKDDLPMPDSERPLAAPVDLYSSRGGLGYAQFCSDCHRKDGSGVPGMFPPLAGNPTVASANPSTLLHITLTGWKTAETATHSRVYTMPGFAQLEDREIAEILSFVRSSWGNQGSSIDAGQVKKLRQRIEAGNGPATTFVSPRLADMLAAPNAEQVVRGMRLHLETRELLPANVGNQLNCTSCHLNAGTVADGSPFVGVSAFFPSYAPRAGKIIGLEERINGCFRRSMNGKPLPPDSADMQAMVAYFDWMKNNTRPQDKVAGRGVGKVDPALKPDPENGRKVYARQCAVCHGENGEGLRNSAGEMLFPPLWGDESFNIGAGMARTFTAAAFVKHNMPVGFQERFPLGQGGLSDQDAVDVAEYFSHQPRPDFPDKIKDWPKDKRPLDARY

SEQ ID NO: 21482 - protein, 466 aa, Pseudomonas aeruginosa
CRNEKRPVDASTGRFAPSWGRCASEDFQQFDVEHQHAVRGNAADRLAAIGQFARYVQAPLGAGVHQLQRFDPAGDHAAHRELGRLATLVGAVEYGAVDQGAVVVGAHGILAGRLGALASAQHFELQARGQHGHAFALGVLGQVGAAFASGGFGLGLGFGLHALADHLEAGRQRLAGNPAVDTCERIGQAGQDCVQGHARNRILAQLVAQLTADAVADTGFVSGQVEFAHGAAPLWGRKRAASLAQKALPPYRRSRLCSTLADRQRQPADKRPRLGQESTHLVIDIGAHQLHRNPVQPAQYLARMLHGAQADRLAEIVLHRIGAVAHLRLQDIDAALQRHQVQGVDMSGLDPAGEILHVHREPLEVAQAAEASRFPPTASVPTAPARFPASSGRQAPTMRRTPAPGVRPISQESLAQAAGNASRKHRRPSVLQRPGGASETLERVVSDGSAYPGSPWRTPRARRSCG

SEQ ID NO: 21483 - protein, 269 aa, Pseudomonas aeruginosa
RHLQRQRQHPPGPAQRPPVATGAGRQTLRHAQQRHPLHPARDRPRRPQPRGTGTQRRTGAAIQPAGDLHRAARAPREEAMIPRILGALLLCLACAAQAGVYTYIDAEGNRVYTDQPPSGRKAQRVELAPGNSVAPPGIRYRPPAAPLEVKPPAYQLLRILFPEPDATLRANSGDVIVTVTSEPALLPGHRYRLLLDGKPAGVPGRSPVFPLKNLDRGTHQVAVEIIDGDGMTVESTPSQPFHLHRVSIAGQPLPEVDTPLVSAIEPSER

SEQ ID NO: 21484 - protein, 387 aa, Pseudomonas aeruginosa
PAPRQKKRAFSAPGLLFAFSCPTLEQLPAMPTDTLHRLLLDNLTTAVILLNGELRLEYMNPAAEMLLAVSGQRSHGQFISELFTESPEALNSLRQAVEQAHPFTKREATLTSITGVSITVDYAVTPILNRNETLLLLEVHPRDRLMRITREEAQLSKQETTKLLVRGLAHEIKNPLGGIRGAAQLLSRELPEESLKDYTNVIIEEADRLRNLVDRMLGSNKLPNLAPTNIHEVLERVSSLVEAESQGSITLVRDYDPSIPDLLLDREQMIQAVLNMVRNAMQAIAGQNDLRLGRITLRSRTLRQFTIGHTRHRLVCKVEIIDNGPGIPAELQETIFYPMVSGRPDGTGLGLAIAQNIISQHQGLIECESHPGHTVFSLFLPLEQGVH

SEQ ID NO: 21485 - protein, 103 aa, Pseudomonas aeruginosa
ARAARWPGRPRGGSPPKNRRPSPAGRASLESAPRVRHAPAGTGCPITRPGCSRPGTASPGWSGYRRSAPAPHPRFPCLSWSRRAAVSAFSAGRRAACRSPGSG

SEQ ID NO: 21486 - protein, 261 aa, Pseudomonas aeruginosa
ETETAASYKPDTRRFERGRRPAAQAQTLWRNEGSPRQCRLRRTQPRGGAQRPPTCPSAHLRIPACRTMHGLPARRCGATLGRFTRRPSMRLITSCLLLAAALPAMAQIYQYTDANGNKVFTNQPPDGVQAQTVELQPTNTVGIDTPEKSSAGNAPAADSEAAAYEILALSDLPTEEALRANNGTFNVSVSIRPALHSGHQLQLVLDGKPYGTPSSGTRFTLHEIDRGDHSLAVQVLNGERVLQSSPPVTFTVQRVHLGKKR

SEQ ID NO: 21487 - protein, 346 aa, Pseudomonas aeruginosa
EGRLHRGRRPAPRTLRAGRWRHPVPRRDRRHAGRHPDPPAARPGRRRVLPGRRAHAGEGRRADHRRHPPEPGKPGARRQVPRGPVPSPERDPHPHPTAGRPPRGHPGAGPALPQPRRPGAGGGTQAAEGGNRGVPEEPRLAGQRPPTGEHLSLDHRDGLRPRGAHRRPAAGAADPAAGQRAGGELGTGPSPVGRPGAGPRPVEPAGQRRAGLRTDHDRNRPQAHRRPPPRCRRAARLGPQYPDPQDQGAGDERRWSRRRRRRLKRHCSHERPNGAFGPRFSWSVARPYQARRRPSLGRAPARNHRSNRNVGRITASRLSADCAGPRRITPMALFVYGLLPVCQCLS

SEQ ID NO: 21488 - protein, 515 aa, Pseudomonas aeruginosa
QRHRVVDRHARRHRPAEHRVAELARVVLDALDLAARDGMHHAVQVAQAHGTDSQALDRAKVAADVDVVVDRQRVLDDDEQAGDQVRHQRLRAEADGQADHAGTGQQRGDVHAHVGQGDDQGDHRDGGEQHVADQRQHGQRAGVRPALAAQAEAVLDRGIGEDPDQPGDQQGGAEADYLHADLLALAFRIANQRHAPDAQGDLDEEQHHEDVQQGVAEALQLLDVRRAAARAGADPTGTAADQPDHGHRHHRQHRADQRPAQRRTAVAGGNEGGEQGNPHQHQHRHEPQRADQLHQVVQATALEAALQRLVADQVGDRPAETHHEQGGEQRGAGVGQGTQADRGVLAEAGDQPRIVGDLAQRGEAADQPQRAERLAPQDIQGALAVRAAEQREGNHAQRGEQRAADQHIGHDHRQGLAQGVRQHHRQVQGDEEGHQPGAQLAQGEQQQVAGLRMLRQLRRQAEALAHAPAEPEQRAGQAGPEEDHHRKIEDHRRQVAPAWKALLEFGTRQLELVAP

SEQ ID NO: 21489 - protein, 495 aa, Pseudomonas aeruginosa
PSPCSACTSGRSDDPAHSRRPPAVPGLRRASGGLHLHRRRGQPRLHRPAAQRAQGPTRRTGAGQQRGAAGHTLSSARRAAGGEAAGLPATAHPLPRTGRNPARQQRRRHRHRHQRAGAAARPSLSPAARRQACRSAGTQPGVPVEEPRSRHPPGRSGNHRWRRHDRRKHPEPALPPASSEHRRATPAGGRYAAGQRDRAKRALAELPLPTPPWAGFSGFFPESPGENAAGHANAPDWCDYPHHFLYCPHFGSPLVAENLPGAPLASASAEKTRLFGAWFAFCIFLPNLGTAARHADRYPAPTVARQPDHRGDPAQRRTAPGVHEPGGGDAPGRERPAQPRAIHQRAVHRIAGSLELAAPGGGTGTSVHQARSDPDLDHRRQHHGRLCGDAHPQPQRDAAAARGPSARPADADHPRRSAVVQAGDHQAAGARARPRDQEPARRHPRRSATAIPRAAGRVAEGLHQRHHRRSRPVAEPGGPHARLEQTAEPGADQHP

SEQ ID NO: 21490 - protein, 133 aa, Pseudomonas aeruginosa
SAGAGQQPGGSGEPGQHHPGPRLRPEHPRPAARPRANDPGRAQHGTQRHAGDRRAERPAPRSHHPAQPYPAPVHHRPHASPPGVQGGDHRQRPGHSGRAPGNHLLPHGQRPSGRYRTRPGHRPEHHQPAPGAD

SEQ ID NO: 21491 - protein, 499 aa, Pseudomonas aeruginosa
MREPPRPYRVQSVPAPGTRSALTMSRSETVWIVDDDRSIRWVLEKALQQEGMTTVSFDSADSVIGRLGRQQPDVIISDIRMPGASGLDLLAQIRELHPRLPVIIMTAHSDLDSAVASYQGGAFEYLPKPFDVDEAVSLVKRANQHAQEQQGLELPANQARTPEIIGEAPAMQEVFRAIGRLSHSNITVLINGESGTGKELVAHALHRHSPRAASPFIALNMAAIPKDLMESELFGHEKGAFTGAAAQRRGRFEQADGGTLFLDEIGDMPADTQTRLLRVLADGEFYRVGGHTPVKVDVRIIAATHQNLESLVRDGKFREDLFHRLNVIRIHIPRLADRREDIPALARHFLSRAAQELAVEPKLLKAETEEYLKNLGWPGNVRQLENTCRWITVMASGREVHIDDLPPELLTQPQDSAPAANWEQALRQWADQALGRGQSNLLDSAVPAFERIMIETALKHTAGRRRDAAVLLGWGRNTLTRKIKELGMNVDGADDEGDD

SEQ ID NO: 21492 - protein, 450 aa, Pseudomonas aeruginosa
ICAMAGRAAARSRQLVIRRMDGLRVNLPSVAPHRRAGKPCIVRHAGIRRCALGHVGGRCAPPRGCVRLSRHWRGEPSLRQSVCACAAGRRPRSKRRVSGLYDAAVSVSHLGDCLSRADHRPLHPSLPRPGGPAAVPLRRPVLLAAGCRGAAEPVGGEFFRWREGQRCAVGTIAEPGHPDPGERQAARRPAEKAETAARRDQERQGKRGWGAGADRRYPDQPGEAVPGREQPGRVMGQPVPAGACRTRGALSKLARPAGDGLRFFGGDPPLGLPGQRAALAQPAHARALRPVGGVAAASEDPRPAAVLPAQAGPLAGGLPHHPVPVGGAAGLPEQDPGDGHGLCAGLRHAVLRAVRDFPLAAQRPAPPARPGYPAAPGVPPVVADRQPRRAGRGRPRSAADRRPRRAHLDLPEYPGQRQRRAVHRLVRDAFPPADRPPDPQPAAGAPPQAP

SEQ ID NO: 21493 - protein, 539 aa, Pseudomonas aeruginosa
ALSAAALHNRRITAMRLFALRYDLTGGSGRAPCRGWGGVSLGTGARRTMKNGARRPRWVAHGSSGASVVAFVVGSIDVHPQLLDLAGQGIAAPAEQHGGIAAAAGGVLEGGFYHDPFEGRHGAVQQVRLAAAQRLVGPLAKGLFPVRRRRAVLRLGQQLRRQVVDVHLAAGGHHGDPATGVLQLADVARPAEVLQVLLGFRLQQLGFHRQLLGGAAEEVPGQRRDVLAAVGQPWDVDADHVQAMEQVLAELAVAHQAFQVLVGGGDDPHVDLHRRVPADPVKLAVGQDAQQAGLGVGRHVADLVEEQGAAIGLLEASAALGGGPGEGALLMAEQLGFHQVLGDRRHVQRDEWRGCARAVAMQGMGDQLLAGTRFAVDQHGDVGMAEAADGAEYLLHRRRLADDLRRARLVRRQLQALLLLGVLVGALDQGDRLVDVERLGQVFEGAALVGGNRAVEVGMRGHDDHRQARMQFADLRQQVEAAGAGHADIGDDHVRLLPAEAADDAVGAVEAHRGHAFLLQGLFQYPADGAVVVDDPDGL

SEQ ID NO: 21494 - protein, 724 aa, Pseudomonas aeruginosa
TCQALHRIGALASRALCGMRVFEGVRWGTLAVAVPRRAAAFVSAGTGGANPRCARVSVLAPPAGGPVRNGGCPACMMRLFRFLTLGTAFLVPIIARFTLRSRVLAALLLCLCAALFYSPPGAAALPNPLAGSSSGGEKVSDAQLEQSLNQVIQTLENDRQRADLLKKLKQLRDVTKKGKESEGGVLGLIGDTLTSLEKQFQGANSPVALWGNQFQLARAELEERFPSWRDLPAMVFDFSVVILLWACLASALLWLSRRMRERFGLSAELPQHPKTRDLLLFSLRKLGPWLVAFLITLYLSVVLPDSLSKTLAMVMAYVLVCGTLFSALCVISLSLLSGPHRQRALDILRRQAFRPLWLIGSLAALGEVAHDPRLIAGLGEHTSICLSTLANASAALFTALFVMRFRRPIAHLIRNQPLERRLKRRSLHDLVQLVGSLWFVPVLVLVGISLFATFVSAGDSSSALRRALVCAVLAVVAMTVIGLIRRRSSRVGAGPRRSAPYIEQLQSFGYTLLHIFVVLFFIEVALRVWGMSLIRYAEGEGEQISMKVVSFGTTLLVAWLIWILTDTAIQHSLGLGGKSRPNTRALTMLPLIRNVLFATIAVIALIVALANMGMNVTPLLAGAGVIGLAIGFGAQSLVADLITGLFIIIEDSLSIDDYVDVGGHLGTVEGLTIRTVRLRDLYGVVHTIPCSEIESIQNYSRQFGYAMFRWPVPASMPIDDAVAL

SEQ ID NO: 21495 - protein, 228 aa, Pseudomonas aeruginosa
  UNSURE (14): Identity of amino acid at the above locations are unknown.
RSEEQQAVRSVHRXRSRLVRARTALCNEVRGLLGEFGLIATRRGRAATMALLETVTDTEPAPLPAPMGELLRELKDELQTLEARIARLERQIQAHVRGDARIQRLLAVEGIGPISASAVAASAGDARQFRTGRQFAAWLGLVPRQHSTGGQQRLGNISKRGDTYLRTLLIHGARAVVRCCANKTDARSRWLQGLLQRRPANVVAVALANKNARILWALLSRETCYRPG

SEQ ID NO: 21496 - protein, 167 aa, Pseudomonas aeruginosa
NSPSARTRSRRVWVSAGMSPISSRNRVPPSACSKRPRRWAAAPVKAPFSWPNSSDSIRSLGIAAMFSAMNGEAARGLWRCRAWATSSLPVPDSPLISTVMLEWLRRPMARNTSCIAGASPMISGVRAWFAGSSRPCCSWACWLARLTRETASSTSNGLGRYSKAPPW

SEQ ID NO: 21497 - protein, 305 aa, Pseudomonas aeruginosa
AQEPGDTIMRYAHPGSEGAIVSFKARYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIAKAAEGAMVFTTGR

SEQ ID NO: 21498 - protein, 736 aa, Pseudomonas aeruginosa
RQRRQGLADIRGQVAQADPAVLAECHQGPQHRAHLPDVARPAVGQQALANLAVELDALAPGLLGQQVVQQLLAVAALAQRRQAHDHAIEAVVEILAEASIGNQPGQVAVGSADQAHVDILRLAAQRYYPALFQHPQQAGLQGQRHVADLVEEQGAAVGLLQLAAHALLARAGEAAAAITEQFALDQGFRDRRAVQRDERLFRARAGQVHGLGEGLLAGTGLAVEQQRHVARVDLQRPAEIGGQLGVAQAQAGRGRRRLRCRGHRQGLGYRPRRAAQHGVQGPSLAGAQRPAGAGLRRGATEQVVETAIEEGLHRLAEQALARTTEQVQRALVHRADPPVFLEGQQSFAEQADIVALDMEAQQPGALEATEEIAALDDLRRQVDQRHGVELALPRDFLARRRHVEHRHQLALRIEHRARRAGQAGMAATEVLFLLDGQGLPLDHAGADAVGAFAGLAPVGTEPEAGVFEGLALGVGVDAIEDHPAGIGEQYRVVVAGKLLVEAVHLAIGDLQHLLQALAAFEHARVLQHHRRHRLAGIEMVLFQAAQPGAGDGRIGRRAARRDLALGDGQHLPRVAAHGTGRHCYGSPRGTGRLLPGRGGSVRESPDGYRCSIQQAGAQCNDGLTDESCAAPKTVQSVTHERPARVTGSVRKLPCETSRTLYSGHFATLARPLLQAYDKRDSASSPNKHKSQEIPSCVTPIPVAKAPSFPSRPATATTSAASSCLRSRASTSPTPRR

SEQ ID NO: 21499 - protein, 83 aa, Pseudomonas aeruginosa
RSPTASSRTWNCSPSPRPGTTARPCARPSTPTSPWPPTTSATSPAASAPRKAPPPRSTTAPWPTTSMSRWAWLGRSSRGTSRC

SEQ ID NO: 21500 - protein, 144 aa, Pseudomonas aeruginosa
RRRHRFLQGPLRQLHRRRVRASGQGPVLHQHLAGERPADRRVPPFHRRGHRQGPRRRPRRRRRLGPHLGAGALEHPAEDRRPHRAEPGTARRHRDLGQRQGRARDPQRRHPPGRRPLPLLRRLHPRPGRLRRRDQRQHRGLPHP

SEQ ID NO: 21501 - protein, 144 aa, Pseudomonas aeruginosa
AAGRGWADHPVELPAADGRLEAGPGAGRRQLRGAQAGRADPAGHLRAAGTHRRPAAAGRAQCRPGLRQGGRRGPGHQQAHRQDRLHRFHPGRLAHPQVRGGEHHSLHRRAGRQEPEHLFRRHHAGRAGVHREGRRGRHGLHNGE

SEQ ID NO: 21502 - protein, 316 aa, Pseudomonas aeruginosa
PPRCEDHGALGGLRDERRLGLHDVFEIDVRALAAQLDGGGNDVLRRALEDVRADRGGTGEGDLGDALAGGQGLAGLPAEALDDIEHARRQQVADEFQQHADAQRGLLGRLEHHAVAGGQRRGQLPGGHQQREVPRDDLPNHAQRLMDVVGHGAVVDLGGGAFLGADAAGEVAEVVGGQGDVGVEGLAHGLAVVPGLGDGEQFQVLLDAVGDLQQDVRALLHRGAAPGVGGGVGGVEGLVDVLGGGTGELGDRLAVHRRGVGEVLALDRRHELAADVVAVAGLEGNDGAFATGMGVTHDGISWLLCLLGEDALSRLS

SEQ ID NO: 21503 - protein, 426 aa, Pseudomonas aeruginosa
PPYRPDLLGEPGVRSAGRADGGARRVFGAPGSLAAEPVPHHGAGQPVGEDHRGLLFPPSLRGLLAAALPCPGRLCRPVQRRTAGLRGRRADPRGEPERAEPARLSAPAPARPAGGDLLRLPSRRPARSRLAATQRQLAAAHPRGTDPVRHAARRAAGDTPGPGGAHGSEAGACRARPVPGRRRAGRRFPPGAEGLRARRAAAAQRRDRFRQGGLRQGRAPGRPARGTGVRRAELRGDPGNPDRERTVRLSRRQLHRRAQGGHARQVAAGRRRHPVPRRDRRHAAGLADPPAAGAGRAPGSTAGRRAGGCRRAPDQRYPPRPGRAGCRWTLPRGSLLPPQWHGREPAAAARAQRPRGAAGLPAGRGGQGPAHPARRRGSPGPAGLPLAGQRPADAHGAADPGGTLRGRPGRPARPARGYPPGPGGAA

SEQ ID NO: 21504 - protein, 626 aa, Pseudomonas aeruginosa
LIGQSVVALRPGLLDAAPIAVRRLADRSTAPRQETARPSRRTITMPASSMSRHARQVLTVAQGKIPPGGPATDPSIARSWLRCLEQHHLDPGQPMAPMVLEHARMLERRERLQQVLEIADGEMHSLYQQLSGNDHAVLLTDARGVILNCVNADAQRQTFEHAGLWLGADWSEPCEGTNGIGTCVVERQALTIQQEEHFRSRHTGLTCSASPVFDPQGELMAVLDVSSARQEVSRQSQFHTMALVNLSAKIIEGCYFLRRFEGSWLLRFHVQGDYVGLFSEGLLAFEEDGRIRAVNQSALNLLGCPRQRLLGQPVETFFDCRLDDLLGRASPQPSASWPLRTREGRTLYAMLRGAPRAIPQALAVPTAAKPAPAAPGLCLGDAELAADFRRALKVYARDVPLLLNGETGSGKEAFAKAVHLAGPRAEQAFVALNCAAIPETLIESELFGYRGGSFTGARKEGMRGKLQQADGGTLFLDEIGDMPLALQTRLLRVLEERRVVPLGGEPEDVDVRLISATHRDLAGLVADGRFREDLYYRLNGMVVSLPPLRERSDREELLDYLLAEEARGQRIQLDGEVRQGLLAYRWPGNVRQMRTVLRTLVALCEDGRVGLRDLPADIRQALAALP

SEQ ID NO: 21505 - protein, 554 aa, Pseudomonas aeruginosa
GLTRGVEPGEQQAGLHLGAGHRHVVMHTGEALAAANGHRRTAFRPRLDYRAHLAQRLGYAIHRPLGKGSVAGQGAVERLGRQQTAEQTHGSTGVTQVDRPRRRLEAVQANAMDGDAAVLRPLDHHSHVAERLDGCQCVLALEEALHFGGAFGQGAEHDRAMGNRLVARYPDGSGQAAARLGQINQVVVVHGVHIGPTGQDFAEMLTGYPGARENAQQLVPVPSVDGLAQRVEVVTKNIQCTQHRLAIGEKDVVPHHRVAAGDPREITETAGGIAEDLQVLAALGQGVDQGEGQQVRQVAGGRQNLVVMLDLHVLDVRAQRAPQAVDQRQRVGIGLRGGRENHLVPAEQGRLRRGHSALLGTRDRMPRYQVPRHPAERDTRGTHDIALGAANVGQYSLAQVELRQVGQHPLHRQDRHRQLDHVGADAGAAKILLATVDHAELHRQAARLGIPIHADHFPEQPFAPQPLGEGAADQAQPHHHQAAQLRGRLLQRRDLSHAPAPCPAPGGNDRSLPAARWRRAGRSASRSQPPDARSHLRAAAPGRPDRHREPDPRR

SEQ ID NO: 21506 - protein, 451 aa, Pseudomonas aeruginosa
RSPQGRCPARGPVRPPACQGRRATAFAPPAGPGQGNRTWIVQPRRGTGHSSMTRLFGMTARSEHRFRIGAQDLQGDGFLADLLQDVLDQRFFMVADEIDEEHVGPFAAARRTGFDAGQVDTVVVERYQQLVQGPRLVAHGNDDRGLVVAGRRHLLIADDQEARGVVRAVLDLLVQLAQVVQAGRHVAGDRRRIPLALHPLGRVGVARHRHPLDARVVRVQPLATLREGLGMGIDPGDVVGLGGFADQQVMVDTQLDFAADHHVVLEEAVEGMVDRPLGGVFHRHHAEVHRAGGDLAEHLVDRRHRRADHRIAEMLECRGLGKGALGSEIGHFQRLLERQAGRHDLAEQPRDLFVVQRPLVQLHDVLEHPGFALGTVEHRRLALAQGLGLDSRHVLGATGTLADQLEQLLVEAVDAQAQGLELVLVRHQPCSFSNSAMYATSASTASRPRAL

SEQ ID NO: 21507 - protein, 310 aa, Pseudomonas aeruginosa
SSLRWLISMTERPLPRQSRSSAWARCRTASGSAAGPAQKLKARLLTSTLAIGRADSRELSADVIGRAGAGARPEPYSSLPSASAAGSDSDSADSPRDSAASSPSGRSSSSPPDGSWTRSRPTSTSSLASLIRVTPWVLRPDRETSSTRVRTRVPWSEISMISSPSWTCTAAISAPLRSLVTMAITPWPPRPRRGNLLSGVRLPKPRSEAVRICAPDSGISMEISCCPLPRRMPRTPRALRPMMRTTLSAKRITLPALENSMTSLAPSVIAAAIRVSPSSSLSAIRPLLRGRLNCTSGVFFTVPKAVAMKM

SEQ ID NO: 21508 - protein, 312 aa, Pseudomonas aeruginosa
QRGPRPGGDPGTGLPDPRRPRQRRGDPPGHGAVRRPQAPPAHPHRLRPARSLYGERRQAGADPGAHRGTRRQHPDARPRDRLRGGAGHGAQRRAPAGPPAPPRPARPTLPGGAHDPGGRRRPGDAGGNQQLGDPLPGIQPQAGQRLLPGGKTLAGRGQRSHRHRRRGEQQRSRPARRDPHRGAAGQGRVRPGHRPRRPPRAAHGHPERRPRAWPGAPDRLPGSRQGRRPGGLRSVRPGPATGLRPGFATYLCQRPRLRAARLGRRQATPRRRPPASSRRTAPDRQGPRMGGEDRRQRQVLNRGGPARCDKLT

SEQ ID NO: 21509 - protein, 495 aa, Pseudomonas aeruginosa
EGEPPPAPSLRQSWQHEGLDSAAAALPPKASLFNGNDYEQRRPRRDRQIRGTGPSLVGPRERVQAAPRHQPAARQLDRRARRPGRQEGARHRLRRRHPQRSHGPARRQRHRHRHGRSAARGGAPAPAGIRRRRRLPADHRRADGRGNARAVRRGHLPGDARTRAGPGLGDPRLPPPGQAGRTGFPLDHQPQSQGLPVRGDRRGIHPPVAAARDPRFPQVHPSVGTRRLVARGRSRGQGHHRPDLQPADQALQAGQRRRRQLHGPDPAGGVKRMRLKAVLFDMDGTLLDTAPDFIAITQAMRAAHGLPPVDEQRVRDVVSGGARAMVAAAFGLSLDSPELEPLRQEFLDRYQEHCAVLSRPYDGIPELLAAIEKAGLIWGVVTNKPVRFAEPIMQRLGYAERSRVLVCPDHVTRSKPDPEPLLLACSQLGIDPSRVLFIGDDLRDIESGRDAGTKTAAVRYGYIHPEDNPAHWGADVIVDHPRELIDVLDRALCDC

SEQ ID NO: 21510 - protein, 582 aa, Pseudomonas aeruginosa
SAAPPTDNDPPPGGSCIQRIRHVPVLRPPRPAERPRDPGHRRRPRHRRRRRQDLRRPRRHRAAAGQDRGVPERGLRRHRGRRPSAGRRDPVQPGDRPAAPVRGTGGNPGERVRPHRRPAAQRFDPRSALADAADFRGELHARDAGERQCHVHADHRHAAADEALQRRLDHLHLEQRGPEGPRLLGRLFGIEVRHRGPDADPCRRTRRYQRDPRQQRQPRRHPHQHARPRLPWGKPAEQPHRRGDHAGLPVPHGAGQRRRQRPGLRRPVIPRQPRRPARLPCPSLFPSGTSHSFCIFFPLSGKVVSFSGKSPSPCGSRSSHVEAFPHRSPAADPHCPRPGARSPVCLGAVADPGAAAEQHLPAPEDPVALGPGRRTGRPGPLPARPGLPATGEEIRSRGLADRSRQTGTQAPGRPEPGERGADGGQQPAGDLPGTVRQSAATALLLPERAGAAAVAWRLGQSPAGAPGGRTARGAVPRPGTLRRAYRQAGAGTPADPRTGLRRQPGRDRRRRLGHQRTAAGQPPAPARRPQPDGPRLARPVAQRTLAAMDPRRRRATFRAAGLTDRSFDVPRPRHEPLARPDR

SEQ ID NO: 21511 - protein, 407 aa, Pseudomonas aeruginosa
SHAMPTLHLDALSTTALALLLLALGSQLKKRSRWLTRLCVPSPVIAGFGFASLVWLLRDRGWLDIGLDTSLQTPLMVAFFTTVGLGGSLGLLRKGGKTLLVYLSACWALAILQNLIGVGSAGLLGLDPLLGIMAGAVSLEGGFGAAAAFGPVAEGLGAQGATTVALASATFGMVAGGLLGSPVARWLIERNRLPVQAESDNRLEALGQQERRQHAAATLDGNLLLRLLTCVLLVMVLGFWLGDALEERLGLVLPSYVGAMFIAIVLRNLDDRLGWLRIPDHAVGTLGDVCLGIFLTMAMMSLKFWELENLGLPLLGVLFIQVAVLLLLTIFVLFRLLGRNYDAAVLCAGFLGHGLGATPNAVANMGAVCEHYRVFSHKAFIIVPLCGAVLIDLVAIPAITWFINAFS

SEQ ID NO: 21512 - protein, 376 aa, Pseudomonas aeruginosa
RSASFPTSASATRQQNAIIPSKSLRNSYRMWKPFLGKPVCASDFSVLQLAGTKLALALLSPSFAPEVPRMAPPKQSNTIDFDAAKQKRGPQPGGNASGPRASNLTELRQQLTLQLQSSLEAERILGLFFEEVRQLIPLDALGYRHPGSDLRLEFGSSAKHSVSYRLSHDSDYLGELIFRRRQRLGEDEQRQLESLLGTLLFPLRNALLYRAAIQTALRDALTGTGNRIAMDQALGRELELARRNLQPLSVLMLDIDHFKRVNDHYGHAVGDEALKAVAETIKDHLRNVDMVFRFGGEEFLVLLSSTPLQAACMVGERLRQAVEELDYRHAGEPLKLSISLGCADLRPGEGSDDLLRRVDEALYEAKRDGRNRLRCA

SEQ ID NO: 21513 - protein, 180 aa, Pseudomonas aeruginosa
PRGTTPGHDRWASPAPPGCARRDRRRRGSRRCRRTPRPAWRSRRPAAVRHPPPRASRHRPAGRGSPCSGSRGVRGNAARPRRPTPSPALPGAGAAPASPGVRRERLRHGPGPGRGYRGAAGSHDRVGRAPGTACARRDRPAHRTALTCKAERGHQAFVVTNQILSDIEPSTAQLRQICSN

SEQ ID NO: 21514 - protein, 635 aa, Pseudomonas aeruginosa
RPDVRIGAAAGPSPPGRQNTRNPDEKPAGADPEPPGRTEQGGAQSRRGHPAEPAAGHPFQHRRPGPGGSGQRTDGEPLLSLLRHERLSGTEDPAGPEPGQRRCLRDPGGSRGRRAGSLYAEDLQQHHRLPRQRPQAARPTRHRPRRGPVDPGPADPLLRSWRLGLGSARRAAQVLPLQPGGERPGRRADATDDRLGGAYRRPVRGDFLYRTHPRAGGGGAPGAGERRLGARPDRRRLAAGQGQHPVPGHPVAGRHRHLHADDFADRPAHRARRTGHRSDPAPRRGLPAAPAADQGKPGADPLSPRRGQLTAHLLQAGGETQAHAFAGRQDQPARAVASGADTEEAFRFARLDLLHRAAAGVPDHAAGADVLVDPQAAVPAAVLQHQRSGMVEHLLDRAARYPGSRNPRSAALAASRLQLHAVHHHPAQRADPPVGLQGEAEQAIVVFLMVAAQLQLQALAKARIEAHVPVLQVQLPAHHHLAFVGVGIQQAPFALPRPALLRPFAAVRMAAEPRPADRDAAAHRRAAEGRPFAGAPQQRAFALRLEMQELRPLPTEYGLAQRMVDQQQIATLEAYPVERSLGPHGMKETLQRMLKHVRLSYPLPFPESPGVHPCSFTTFRTQAPNDRHRKSVVGL

SEQ ID NO: 21515 - protein, 173 aa, Pseudomonas aeruginosa
LHSRMGMPSWVVLRWRQASREATLAAPAKRHNIRSGILATRPCIVNSRAETSDVPTLPLAVPDDRLDHRLDAHFGGVQQDRVIGRFQRRDRALAVALVALADFFQQGRLVDIRALRLQLQVASTRTLLRRGGEEDLQRRIGKHHGAHVAAVGHQPRRFEERPLALQQRIAHGR

SEQ ID NO: 21516 - protein, 331 aa, Pseudomonas aeruginosa
GAGTDLLGTDHIGHFLAFENDALPMAAIGSDELHIEVRSQNLQRFFIGQVDTMVDRGERQQPIKRPGIQQVPAQAPGEQPGDRALAGATGAIDGEHRYSAVHQLFSTATRIPVWAHRARKLGKEVATLAQSWMRIGPLARSEATLKDMAIRWSPCAQTSPPPNAPPSMTMPSGVGSAFTPRAFRPSAMTWIRSDSLTRSSSAPRRTVRPSAQAAATKSTGNSSMASGTRSSGMSMPLSRAERTRMSATGSPPTSRWFSRLRSPPIRRRISMTPTRVGLMPTCCRTSSEPSAILAATRKKAAEDMSAGTSIWVALNLCPDSTLAVLPSTTTG

SEQ ID NO: 21517 - protein, 273 aa, Pseudomonas aeruginosa
CSTSMCSTSAPSARHRLSTSASASASVSAEGVRITLCRRNRVAFAAVTPLCSEPAIGCPGTRYRGIPPNATRAARTILPLALPTSVNTALPRSSFARSASTRSIARIGTANWITSAPTQARPRSSSQRSTTPSSTARRQDSASRSTPTTSRNNPLLRNPLAKEPPIRPSPTTTRRPSLGVDCCSGVTSVMRQHLAQRLEETIVLFRQPDGDAQEGRHPVASHRTHDHTFAQQRLVDRTGIASQIHGDEVALRGNPGQAQHVEAILQLRHAGIV

SEQ ID NO: 21518 - protein, 284 aa, Pseudomonas aeruginosa
AATLRQVVMVIQRRAGSRQGQAIDIERLAHAVEHIGHRLARKRVADPQRSQAIGLGEGPRDQQVGVPRQVVQAIGQLVALGVFDIGLVQHHQHLRRHLGEEPLQGVRTEPGPGRVVRVGDEHHASLPIDGGEHRFQVMPPGARLDRPPLGAHGLGGDRVDGEGMFAEHGVQTRREVGTGDQVENVVGAVAQGHLRRIHRATLGQLALEFETVAVRITGQFRQFGADSLQRLWARTQRVLVAGELDDRRRVDAQLAGQFVHRLARDVGRQLLHPRLGQGKEIGHG

SEQ ID NO: 21519 - protein, 175 aa, Pseudomonas aeruginosa
PSELTTAHAPAQGKGPGGDDLQSPRSMQALAAHQGGHALGVGTLDDATLGHDGIDKVRRGHVEYRIVGIDLGRYPSPADFQQLATVALFDRDVLAALQVHVDGRTRRHHHEAHAVVHGVDRQLVGPDLVGDIAIGGDAVGADDDPGDVLGLHQVRGGRIHVQADRDAFVGQLPGG

SEQ ID NO: 21520 - protein, 213 aa, Pseudomonas aeruginosa
SRALEPGPGFVGVDAIDQAFQVRGADHPQRGAEPAGRQGAGIAVGEDVLRAALLLADQLHAQLGHGQVGLAVAFMDGDRLGFQHRQRLVALFHSLQTVAHAVQRPEQVDRRGSRVGQQAEVLLQRGAPVAALRQARAGAKDDAVGGADADGRRAAHDHIANGLGHLGRRLVFEPDLLLGQQALIQQPQRTVPPLDRLDPLGRQQSLSHAHTSR

SEQ ID NO: 21521 - protein, 438 aa, Pseudomonas aeruginosa
PLRPPPAADLDRPRGARRGGAARPRAGHPRRPDSPGRAARAGHAPWRHGNPRIAGHAARPRSGQRPRPFGDESVPRSRRRPAADDLAAGPHLAGRRPMGQRGFIRDGTELAIAEQVKGGITCFSDMYFYPQAICGVVHDSGVRAQVAIPVLDFPIPGARDSAEAIRQGMALFDDLKHHPRIRIAFGPHAPYTVSDDKLEQILVLTEELDASIQMHVHETAFEVEQATERNGERPLARLHRLGLLGPRFQAVHMTQVDDDDLAMLVETNSSVIHCPESNLKLASGFCPVEKLWQAGVNVAIGTDGAASNNDLDLLGETRTAALLAKAVYGQATALDAHRALRMATLNGARALGLERLIGSLEAGKAADLVAFDLSGLAQQPVYDPVSQLIYASGRDCVRHVWVGGRQLLDDGRLLRHDEQRLIARAREWGAKIAASDRS

SEQ ID NO: 21522 - protein, 271 aa, Pseudomonas aeruginosa
HRKANRRRPHPSAKAGNMKDWIPPPRPFPQRLHSSTGTIMSNVDHAEIAKFEALAHRWWDRESEFKPLHDINPLRVNWIDERAGLAGKKVLDIGCGGGILSEAMAQRGANVTGIDMGEAPLAVARLHQLESGVAVDYRQITAEQMAEEMPGQFDVVTCLEMLEHVPDPASVIRACHRLVKPGGQVFLSTINRNPKAYLFAVIGAEYILQLLPRGTHDFRKFIRPSELGAWSREAGLEVKDIIGLTYNPLTKHYKLANDVDVNYMVQTQREA

SEQ ID NO: 21523 - protein, 287 aa, Pseudomonas aeruginosa
SSTTRANSSTFSTARSATADPQRRRQTTTRRQAGHAFKGFDMFQYSARPDLLKDRVILVTGAGRGIGAAAAKTFAAHGATVLLLGKTEEYLNEVYDAIEAAGHPQAAVIPFNLETAQPHQFEELAATLENEFGRIDGLLHNASILGPRSPMQQISGENFMRVMQVNVNAMFMLTTAMLPLMKLSSDASIIFTSSSVGRKGRAYWGAYSVSKFATEGLMQTLADELDGTSAIRANSVNPGATRTSMRALAYPGENPLNNPTGEEIMPVYLYLMGPDSAGVNGQAFDAQ

SEQ ID NO: 21524 - protein, 215 aa, Pseudomonas aeruginosa
ELSLTLEQPLSSTYRHLKTLLRWGLAEEQAGQGRYLPGPACLQLAKKFDREASLIGLAKPELKRLADLSQESVALMVASNQQAICLELFDSPQPLRCCYQKGLAQPLLHGASAKALLAHLEDERREELYLAQELSAERIDKLEQELRLIREQGYAVSQGEIDEGVWGISVPLLDSRQRLHGALSLMAPALRAQSRSERLRQWTLDAAARLSARLD

SEQ ID NO: 21525 - protein, 316 aa, Pseudomonas aeruginosa
PTGVSMYPAPDMSLWQGRIDSQEGADARRWHQWMRPYADDAEAASVLLGFASDEGVRRNQGRQGARHGPPALRRALANLAWHGEQAIYDAGDIVAGDDLEAAQERYAQRVADLLARGHRVVGLGGGHEIAYASFAGLARHLSRHERLPRIGILNFDAHFDLRHAERASSGTPFRQIAELCQASDWPFAYCCLGISRLSNTAALFDQAQRLGVRYLLDRQLQPWNLERSEAFLDSFLQSVDHLYLTVCLDVLPAAQAPGVSAPSAHGVEMPVVEHLVRRAKASGKLRLADIAELNPQLDSDQRTARIAARLVDSLVN

SEQ ID NO: 21526 - protein, 356 aa, Pseudomonas aeruginosa
SGRHKKTRPKPGMPRRAVSVSAVLGEALQGFAAEALDLGPVAAVDHGLGQHPGAADAHHVGYRQVVGEIVQADASGGAEADIGEWSRERLQRRRAAADFGGKQLEAAVAMAVGEHDLGSAGHAGQQRDFAVQGEAQQLVGATRGDHEARPGLFRGGEGLRVEHGAGADTQVRALLAEAPDGGQPVRRAQGDLQGGQAAGGEGIGHRQDVRLAVDGDHREDARLPAQRVDAGGLLFKVVHGYSSATQGYQWIVSCARRKARTGIRRSSSTASAAFRVASLDWPWIASSCTFAAASTARGRVRRWCGTLGAHIGRQRRVPWGSIARSRPGLFGNSEAVWPSSPMPRTSTSIGNGSSCR

SEQ ID NO: 21527 - protein, 585 aa, Pseudomonas aeruginosa
RPMKRAFAASPRSRWRRTRPALLSACDSGTQRSSARLTVIRDQSSGSSLKASRKATGLRPPDTTNSAWPCSASAERNRPATSAARPRACSAALPQTCRPTPAGSFNSEIAIPTPPIAGHQGHRGHRPPTPSRIRLGRFAQAFPASDQLVAPLPGELHLVLAHEQVLVALGDLQQQTLVGIGNPRRVVGLGKTQLQRAGTQLHALAQALVLGHHLQGDTFVRLQADDQPVADQRTLLGSEDVVRRLLEVDDDLRQLLRHALAGAQVERHARPAPVADVHAQGDEGFRVAVAIRMFLLQVARHCLAVAETGGVLPTHHARSQLFCGNRLEGAEDLDLLVANAVRRKVAGRIHGDQAEQLQQVVLHHVAQLPGLVEVAPAAFDADLLGHGDLHVGDVVLVPLGLEEAVGEAQGDQVLHRLLAQVMVDPVDAAFREEPGDCLVDLAGRLQVMTDGLLQHHPGALGETGGGEVLADAAEHRGRRGEVGDQRQFVIHRLAQADIGLRVEEVHAQVVEAFAETLPDHVVPLLRRHCQAQALLQRRQVFGGSAFVTGQGQDAGIAVQQVLTIELVERREQLAQGEIAQRTEQR

SEQ ID NO: 21528 - protein, 302 aa, Pseudomonas aeruginosa
APPPALPRRADRTRGTRMKNLLEQIQSRLDELNKAERKVAEVILQNPQQATRFSIAALAQAAAVSEPTVNRFCRSFGMSGYPELKIQLAQSLASGAAFVTQAVAEDDGPEAYTRKIFSNTIASLDSAHKLLDPRVIDRAVDLLIQARQIHFFGLGASASVALDAQHKFFRFNLAVSAQADVLMQRMIASVAHTGDLFVVISYTGRTRELVEVAHLARENGASVLGLTAAGSPLARASTLCLDIPLPEDTDIYMPMTSRIVQLTVLDVLATGVTLRRGVDFQPHLRRIKESLVPTRYPLDEDN

SEQ ID NO: 21529 - protein, 99 aa, Pseudomonas aeruginosa
ASSRRHSRCRAQPCCGHSLPFGWLPNHGQQTGMPPRTGALLRAGHSLAHHSNGRSPCGWKCRSCAPCRLNTAWHSGWSINSRSRRWKRTQSNGRLARME

SEQ ID NO: 21530 - protein, 418 aa, Pseudomonas aeruginosa
SVCNRQPGRAVAGKKRPARNARAGPGTTPEQATRRSEHRLDLDPRHQRVVDLVDPARLLDVLQVRPHRQPVGHMHPVVQLGVVLGVLQRLVQRVVVVVDAVHLVHQALALLHIVVDMDARDAQADVVLRPRVERPLVDHPELLVVVHHVGRLVVDRQVGEQAQPARGIAVVRSDLLLRHHPPAMLAAARLEVVAGQPLRLAVDVVVDVIGLRRAVVVAQPVLARQLLGADLRLPDQLHRQQRALGPAAAHLEAVAGLQVRRVLLVGADLHVPVRREVVLHPQRPLADRPVVPDAPRPVAHLRAAEGQVLEIAGEAVEVLALAETAEFHVQRAVEVLLLEPQLGQPPGLPAAPKLLHRTELSRTPVSQSVLGKGLAVALRDSELEIRVLPPERYSLKSLFPPHRANWSRGIPSGFGFSL

SEQ ID NO: 21531 - protein, 120 aa, Pseudomonas aeruginosa
RRRARSSAEAVRKIFRGASGNTTVPMSRPSATNPGASRNARWRCSNASRTAGKAATCEAPAPTCSVRITSVTSSPSRMMRCPWLPSAATNCTSRCAARTFSASSLVRSTPWLTAANANSR

SEQ ID NO: 21532 - protein, 145 aa, Pseudomonas aeruginosa
ESPCAGGTGSPSPRSLRSARNPRSDAPVPGTAASRRTRHARHARYCPWRCQRRSIQPCPGRASPGRPAPAPSPGSAPPTGSRRRRRRRGQDPPRNGRPRRAPPPGGKTRHPDPRRPLPGTTLCSATPWRRSRRSGPAPPPPGGPA

SEQ ID NO: 21533 - protein, 77 aa, Pseudomonas aeruginosa
SGSAWSCPGGPRSSRAACSGRTGWPPCRRRSPPNSTRSSPAWPRRRCSTPPPARRSGSASPATCDIARGIGHGNRSG

SEQ ID NO: 21534 - protein, 374 aa, Pseudomonas aeruginosa
AGPGPPSAVLLLELRHVCDQRLDRVQAKGVVDGSAHAADRAVAFQVEQPARLGAFQERLVETLVGQAERHVHPGAGARLDRVGVEVAGIDGLVQQVLLGAVALLHRGHPALLLQPFEDQAGQVPGVGRRGVVHGTVVRGDLVVEHGRADAAGAAEQVFANDHHHQAGRADVLLRPGIDQAEAGHVERAREDIGGHVGDQRHVAGLGNPVELEAADGLVGGVVHIGRVLGQRPLVLTRNGEVVVLLGAGRDIHGAIATSLLDGLLRPDTGIDIVGDAIFGQQVQRNLGELLAGAALQEQHLVVRGNVEQVAQVLLGLAGDGHVVITTVAHFHDRKALAPPVEKLGLGTLQNCVGKRRGTGAEIEGSLAHIHSRYR

SEQ ID NO: 21535 - protein, 961 aa, Pseudomonas aeruginosa
VIRRRHRPGGRRRPPRALLFVAFRFRRGLGLGLGRLAQRFGSFLPFGQVLVISARRLLDTLQTDQYLVAGELDQGYALGIAAGQGDFVDTRPHQGALVGNQHDLLAFLDLYRGDQRAVALVGDHGDHPLAATAATRELAQRGTLAEAALGGGEDLRPGLRNQHGDQLLPLAQAHAAYAAGVAAHDAHHALGEADHLAGAGEQHDFLGAIGDRGGDQGVALFQLERDQAAAARTAELHQRGLLHGTEGGGHEDVGAGLLGHQLGGLALDFLDLGGLDHLALEHRAFGFVEVVIGATVLLQRLQVDLQHRGDPLALIQRQQVHQRPATRGTRGFRNLEGTQPVDLALAGEQQEGRMAVGHQQVFDVVLVLHPGGGLAFAAATLRLVGGQRLGLGVAAVGDGHHAVFLGDQVGDGQVDLGSHDLGAASIAEFGLDRFQLLTDHLHQARRVGQDADQLADQVEDFLVFGEQLLVLQAGQAMQAQLEDRLGLFRRQVVLAVAQAVLRIQVFRATGVGAGTLDHRFHRAGLPGSGDQAFLGLGRGRRTLDQLDHRVDVRQGDRLAFQDVPALAGLAQLVDGTPGHHFAAVADEHLEHVLQVQRARLAVDQGHHVDAEHALQLGLGIEVVEDHLAHLAATQLDDHAHAVLVGLVAQLGNTLDLLLFHQLGDLLDQPRLVQLVRQLGDDDLLATAALLHLLDDGAGTDVDAPATGAVGLDDPGAAVDDAGGGEVRTGDVLHQLIDGQVGVVHQRQAAVDHFAEVVRRDVGRHTHGDTAGTVDQQVGNLGRHDRRDLLGAIVVGHPVDGFLFQVRQQFVGQLGHAHFGVSHGCGVVAVHRTEVALAVYQHVAQRERLRHAHDGVVDRGVAVRVVLTDHVADHTGGFLVGLVPVVAQLAHGIKHTAVHRLQAVTCIRQGPPDDHAHRVVEIGLFQLVFDIDRENFFGQFAHEKPGSFFWWNFAASILRQTK

SEQ ID NO: 21536 - protein, 143 aa, Pseudomonas aeruginosa
RAPAADARVYFRLPALRPGCAAMPNVRNPFDLLLLPTWIVPVEPAGVVLRDHALGIRDGQIALVAPREQAMRHGATEIRELPGMLLAPGLVNAHGHSAMSLFRGLADDLPLMTWLQDHIWPAEGQWVSEDSSATARSWPSPNR

SEQ ID NO: 21537 - protein, 130 aa, Pseudomonas aeruginosa
ATSTTPRSPNSRHWPIAGGTARASSSRSTTSTRCASTGSTSAPAWPARRCSTSVAAAASSAKPWPSAAPTSPASTWAKRRSRWRACTSWNPASPSTTGRSPPSRWPRKCPGSSTWSPAWRCSNTCRTRPR

SEQ ID NO: 21538 - protein, 128 aa, Pseudomonas aeruginosa
ASGKAGSIARKAPTRGAGTNGCVPTQTTPKRPACCSGSPATKACAATRVARARATDRQPCVARWPTWPGTASKRSTTPATSSPATIWKPPRNATRNASPTCSRAATGWSAWAAATKSPTPASPASPAT

SEQ ID NO: 21539 - protein, 539 aa, Pseudomonas aeruginosa
PFASTCSRPPRRPASARPRRTAWRCRWWSTWSAAPRPAASCAWPTSPNSTRNSIATSAPPGSPRAWSTAWSTDRPFAHTTTIEPRHADIAPGRPVHHRPRPAPARPRQPIEEAQPLADTSVRTVAGDRRLRLRLPGLAAQGSRLARHRPRHQPADAPDGGVLHHRRPRWQPRPAAQGRQDPAGLPVGLLGAGDTAEPDRRRQRRTARPRPVARDHGRRGVAGRRLRRGGGLRPGCGRARRPGRDHRGAGLGHLRHGRWRAARQPGGALADRTQPPAGAGGKRQSAGSPRAAGATPACGGHAGRQSPAAPADLRAAGDGARLLARRRARGTPGPGAAQLCRGDVHRHRPAQPRRPARLAAHSGPRRRYPGRRLPGHLPDHGDDEPEVLGAGEPRPAAARRTVHPGRGAVAADDLRPVPPARPQLRRRGALRRLPRPRPGRHAQRGGQHGRGLRALSGVLAQGLHHRAPVRRGTDRSRRHPGDHLVHQRLQLNHGGAPLAERQLSDERLGHSPAKRHYSVEISPKFLQNVETIPRKTCLCL

SEQ ID NO: 21540 - protein, 254 aa, Pseudomonas aeruginosa
QRLPRRTDLPSPPAPRRRRTTATGEPARHPAVPAAQRPALSRRDPDRPARRPDRHRQPHRHGPGARPRTGTGPAQPATALGADARYRPLQAGQRPLRSRRRRRSPQGRGGNHQGPPAQCRHGVPLRRRGIPRPAVQHAAAGCLHGRRTPAPGGGGTGLPARRRTAEAVDQPRLRRPAARRRQRRPAATGRRGALRSQARRPQPPALRLRLADSHTPKRGAGASGDGSSNGSHRRSYGFRQGPAAYGCAGSSGAP

SEQ ID NO: 21541 - protein, 668 aa, Pseudomonas aeruginosa
ARPLSITSPSSGGRKLSSGPAVASPRLAQLCAGIAASSASPATLHSMQSAIARILCISPPPCVRATIRHRFPGMKKAPKGPFQGAFRSAAEARTHTVAGRFRPPLDLRLAGRRLVARRAGRTLVARLARARLAVALAGPLGNRSALLAPLALGARLRTARGTRSRRATSGILAVLAPWRTLAPGFRTLAARQRTGLLALLAFGLLARLGGHARQRHRLEADFLAEDVDFALVHFAVAAHGQLGGQEHRAETHSLQAADHQSLGFPQPAHLAVAALHHYAVVPVVEAFAARRLLDIAELGRAVLEHHAVEQALDHLFGDLAAHPYRVFTVHLIGRMHQAVGQFAIGGEQQQAGGIDVQATDIDPATGAQARQAVEDGRAAFRIVAGADLAFRLVVDQHATDTLGGLFAADQVAIDGDRIVAVDPLAEAGHAAIDVDPTFGDPHFYVAPGTDAETGEDFLQFFPDRYVGILWGIVHLGTSRCGWQRIEGRASYALRQDKAPSPGGNPDNPARLGRVHPPRHPEAPVHDIPPFSGAKLALFYGDHLVVYKRDEKPGIPFPGYWDFPGGGREGLETPAECALRELEEEFSIRLEEPRIEWQRQYPSTSGSAPFAYFLVARLEDREFEAIRFGDEGQYWRLMEVDAYLAHAMAVPYLQSRLGDYLRERRRIGE

SEQ ID NO: 21542 - protein, 263 aa, Pseudomonas aeruginosa
ASMISEALATPGNSGTSLSRAKRSNSSVQPGVTTKLAPAFSAAAKVCGSSTVPAPIRRCGRSSLRRRMAVSPCVVRRVISRAVRPPAARASAIGRMSASRSMVITGRMRASRHSVSMRAVFCSRLCMATAPPLRGTNGSSAARGGRREPASAVRPRPPARRSGWPAWTGPGSPAAAPSPPPARRAAGSGAGAARSAPTSAGNGASPGDPSPGPGQGCSGTARRYGRRRPCRGPARRSAMAARAGDGRPARPLPPGSPPAGRGR

SEQ ID NO: 21543 - protein, 387 aa, Pseudomonas aeruginosa
RCGRTCNTSSSRAGSTRSTTRWWRGSRSRRCSDRRVACSGVVPGPARAFRAGRFFPATALPGCLLQTDYAFPVPIIWGLRAKCSKTTRMHARAFREGERVGQSDMLEHPLQRFFHSMRAKRPFDWVRFQRRDLLLIDHPLCQAVFSRQGAQLLHFQPQGERPLLWCASEWPALSSAPVRGGIPVCWPWFGSHPNGSEWPQQGWARQREWRLLDAYADESKVVVSWQLDLEDWHVRLDARLGQRLELELCSYHEEDDDCLFSFALQPYWRVGALSRVVVHGMELESARGQRGASRIPGTWIPRGAVKQVLYHPGSLVLEDGGWNRRLRIDKNVSAGSVIWHPGSRPVEQVEPGEAERFLCIGAAGYRPGGLILAPGERMRLSLAAGLQ

SEQ ID NO: 21544 - protein, 120 aa, Pseudomonas aeruginosa
SPWIRPATFRRTAFATRRSRSSAPSSRFPQNNWLRAWCVGSTPPVSATARQCRATWRRNMRIATATRKPSSPCAWTSATGAGRACRSTCAPASACRRSCRRSSSTSRSRRTTSSLPSSVR

SEQ ID NO: 21545 - protein, 266 aa, Pseudomonas aeruginosa
AKRPSRIRLGVGGRWPRWPWWPAMGGVGMAISELKLPAGVGLQVWGSAAEQARGLAAEVAGRLRSALAEQGQALLVVSGGRSPVAFLEALSEEPLDWSRITVSLADERWVPESHADSNAGLVRRHLLRGEAAKARFIGLYQPAASLEEAAELADHHLHELPLPIDVLVLGMGDDGHTASLFPNSPGLDLAMDPQGTRRCLPMWAPSVPHQRLTLPRAVLAAAKVQLLAIQGQSKLATLNAALAVEDERRMPVRAFLRAQLTIHWYP

SEQ ID NO: 21546 - protein, 91 aa, Pseudomonas aeruginosa
PPSGASARSARTCVSAPAPCSTRRPSPPRKRPGRASWSPRVAPTSCCASPWTAKSRCCPAWPALPRSCSPTAMATAASSCFPPKSAAARRR

SEQ ID NO: 21547 - protein, 259 aa, Pseudomonas aeruginosa
IRGTGARRGHRRDDRAPAQRRDARGRPGQVQRYPAGAGRRRLQPLVPLRSDGGPQPRGAPVVGIPGIGGQPPEASAFRPGVPDLRADHGPLPRNGPARNRHPQRGSRPQAGGAAGHDHQGAREGRTPAAQAGPSAGAQRASGSRAQACAKARGRRECRSSRAGFASRARSAAERRAQGARAGHSGCRAAPREQPQAAPEQAARRASGQRAGRQAGGPQAAGQAAAETGRRRYASGLPPLSGKRPGKAPSGPFSCLGIGV

SEQ ID NO: 21548 - protein, 336 aa, Pseudomonas aeruginosa
TSCTWLETARKPAAGCWRSASACARPMAPRTSRRSHKRQDLGGNRNCAGESRCYCRRPMRPLRASGCASRQASGAAQAVAAVALGFVERLVDPSQQVVAAFAGPQVGATEADRQLQRFAGVPVVQFLHRLAQAFADHAGSLQRRAGQQDEEFLAAEAEHHVDIAQVVLDGFRHGLEGFVADGVTVVVVDPLEVVDIEHQHRERLQVAPGQFQFAAERLVHGDAVAGAGQGVAQGGLDRGAIEQGVAQREQQGAEQALQLPLFVFAEALAATEDQFAEVVAVMAQAIAHRMLGAAAELQAQVGARMAVAKGIQRDQLADFLEEQAENPLRLQAALQL

SEQ ID NO: 21549 - protein, 533 aa, Pseudomonas aeruginosa
EWFPHSVGISERFRRNNGVLLASGRGARRKAGAPLAERRHGSTEGVDEPGDRRDGDEIDQYRAAQGHDDEGLVREHPIVLADRAHVGHRVGRGAQAVAEEAGAEHRGVVVAAEQAEQDEDRQQQQHRDLDEQYAEQRQAEVLQLPELQAHHRHGQEDAQADVAQGTDGVVRNAQPAEPVVEVAQDDGDEHRPDITGQHQAQAFLERVAEPEAEHHHQQHAGQQAQQEIAVQRGRRMLASLLLPEGFQPIVAFRLHRQAVAFDQPARHRAAEQPASDHAEGGRGQRHGGRALGAEPFRNRAEGRRRAEAAFQRHRAGHDPEQRVEAEQSGAAYADQVLQYRQRPAGRQVDQQGLAALAQQAEAATEADGGEERHHQGRLQAGVEADVEPAAIPEQPDQGGEAEAGDHRRRYAQTCQPAAALLQLAAEGEQEQGEGGGGQGVQVQCRHGVALLLLCGRKGDQLTRLSTRRAAIRAVRWSLSSCGLSSAMSARRSLPLALARRTRCSTTGISTPCAEGALTPGAWAAGSTSRQTVR

SEQ ID NO: 21550 - protein, 190 aa, Pseudomonas aeruginosa
TGCWARPDRSKATRSAALPASREPIRRSRPSARAPFRVAMRSARWASRAVAWPYTALASSAAVRVSPSRSRSLLLAAPSVPMATLTPACQSFSTGQKPLASLRLDSGQWITELLVSTSIARSSSSTWVMCTAWKRGPSRPRRCRRASGRSPLRSVACSTSKAVSWTCIWMLASSSSVSTRICSSLSSLTV

SEQ ID NO: 21551 - protein, 297 aa, Pseudomonas aeruginosa
ADAVHPRSGLPHRRHHQRPRRDHRGLPHRSRAHLHPCPRRRRGDGEGRRSRADHHHRAAVPVEQGAVDREDRRAGEREEDRGYFRAARRVRQGRHARGHRAASRRGGRGGPQQPLCPDPAAERVRHQRGGPGRRPAAHAEPEGHARGVRPPPPRSGDPAYRLRAAQGPRARAHPGRPGGRPVEHRPGDRADQEFADPGRGQGTPDRHCLGVQRGGSDGRACRRRRLSPGRPGSAVRPARRQVLPVAGTGPGDPRAAPASPDRPGAREAALRIPGNPQPDRRVDPHPDQPGAPDGGDP

SEQ ID NO: 21552 - protein, 239 aa, Pseudomonas aeruginosa
RPRRSRRRGARGRGGRGRRGRGSRGRDRRAGGRADRRLHLHGHRLRYREEDPAGAVQPSAQQRPDRAQAGRGRHPDRRRDHRWRQGSHAVLQRRQGDPLRRERGAHHGPQRPRRTRHAPGQGAAADLHADSGVRGADPHRLRARLRQAYPAEQVPASRPWRPGGDRHGHQRAQRRADRRGTGPGRRGDHADFRPGHPGADACRRSLPVRPQYPGRNPDQARQRRGTGRSGACPGAVGRR

SEQ ID NO: 21553 - protein, 681 aa, Pseudomonas aeruginosa
LRGHRQQGRAGPARPARHSLGLQGAVPAGRRQPAVRRDSAEPAARRWRRRLYRYRYLVEEGHRGGSSLWHRECRGQRQGVRLLRHSGSERVDADQGRGLCALRLQRDHRRPRVRLDSRDRRRAAGHRHVLRYPLAPARRVPLRPDLCRGAEEHRPVRPGGGDRSRRPARPRPQRLPDHAQLQDRRGQRFHVQHPGDLLLVPVRPGLRMAEGAGRGDRDGAAQPRQEGPAVQDHRCQRLLHQPDPAERPLLDERAVPPGRRASRQAVPGRRRGARAAQPERPPLGRRHARFHLQRPWPGRGRGAGRIHGGVREGARLMADQDQLKALRLRIDSLDEKLLELISERARCAQDVARVKTQTLGEGEAPVFYRPEREAWVLKHIMQLNKGPLDNEEVARLFREIMSSCLALEQPLKVAYLGPEGTFTQAAALKHFGNAVISTPMAAIDEVFREVAAGAVNFGVVPVENSTEGAVNHTLDSFLEHDMVICGEVELRIHHHLLVGETTKTDNITRIYSHAQSLAQCRKWLDSHYPSVERVAVSSNADAAKRVKSEWNSAAIAGDMAASLYDLSKLHEKIEDRPDNSTRFLIIGNQEVPPTGDDKTSIIVSMRNKPGALHELLVPFHNNGIDLTRIETRPSRSGKWTYVFFIDFVGHHKEPLIKDVLEKIGQEAVALKVLGSYPKAVL

SEQ ID NO: 21554 - protein, 782 aa, Pseudomonas aeruginosa
SCVRWLATGCRPSCASPSGCRKRTIVSSRRWARCWRMTEVTPLQQSTPKLGRLVVVGLGLIGGSFAKGLRSKGLFREVVGVDRDAESCRLAVELGVVDRCEEDLGRACVGADVIQLAVPILAMERVLADLAKLDLGKAVLTDVGSAKGNIVRAARVAFGGMPRYLVPGHPIAGSEQSGVTAAKATLFRRHKVILTPSAETDADALALVDSLWRALGADVEHMEVEHHDEVLAATSHLPHLLAFTLVDSLAKRSENLEIFRYAAGGFRDFTRIAGSDPVMWHDIFLANREAVLRTLDVFRDDLDALREAVDTGDGHQLLGVFTRARVAREHFSKILARRAYVDAMHNNDLIYLAQPGGSLSGTIRVPGDKSISHRSIMLGSLAEGTTEVEGFLEGEDALATIQAFRDMGVVIEGPQNGRVTVHGVGLHGLKAPPGPIYLGNSGTSMRLLSGLLAAQPFDSTLTGDASLSKRPMNRVAKPLREMGAVIETGPEGRPPMTIRGGQRLTGMHYDMPMASAQVKSCLLLAGLYAAGETSVTEPAPTRDHTERMLRGFGYPVVVEGSTAKVESGHKLSATHIEVPADISSAAFFLVAASIAEGSELVLQHVGINPTRVGVIEILRLMGGDLSLENQREVGGEPVADIRVRSARLKGIDIPEDLVPLAIDEFPVLFVAAACAEGRTVLRGAEELRVKESDRIQVMADGLKALGVKAEPTPDGIVIEGGAFGGGEVWAHGDHRIAMSFSVASLRASGPIRIHDCANVATSFPNFLALCAQTGIRVAVENN

SEQ ID NO: 21555 - protein, 404 aa, Pseudomonas aeruginosa
TEDRPHRHAVPGGAHPPGDHHRPRGGHPADGRCPRRRRPDRPGDHPAHDARADRHPAPQRGAPAPAYRRRHRARPADLRRRGKGRGELRGHPGLHRRVAALRPGQRSPAVARRGQRFRDHARLPPWLPPLQAVSRRSQRRPGGAEGVLGTIPRYPLLPHRRRQPEQSRRLPGGTQRDVRRRHLDAAQGRGRPRRLGPGRAPQPRSPGALRRAPQTLRLPAWACPASAGFFYAVRIIRGMERLTSSALFADAPAFPQIVAEPALQVGYGHGMREVGVHLHQSPVLSFVAEADGLELAVLQARHQEVGEGRAAAGARILSLPFDTRFFQADGELFLEFAQGAFGRRLQALTAAAGKVPVAGEGNAGFFVAFVDDQVVAIEQRQLGAAEGRDVVHRGLRVAGWVNPA

SEQ ID NO: 21556 - protein, 401 aa, Pseudomonas aeruginosa
CAPFDSLPATPGGAQMNDTPENPHVPVGEKLQKVLARLGVGSRRDVEVWIAEGRVNVNGGVASLGQRVDSHDAITVDGHLIRREEAAESVRRVLIYNKPEGEVCTRDDPEGRPTIFDRLPRLRTGRWINVGRLDINTTGLLLFTTDGELANRLMHPSYEMDREYAVRVRGEVTEEMIERLLNGVMLEDGPAKFSDIQQAPGGEGFNHWYHCVVMEGRNREVRRLWESQGLVVSRLKRVRFGPVFLTSELTMGRYREMDQREIDILSEEVGLKPVALPGMTTKAREKAERQQRKQARPLARSERPEAGRKRAPRREDGENAARRAPASRPARGPQPSAERKGREQGTPVAERPRESNRKPRPSKPRDERPASAPGDKPAARKPQVKRRPKPAGDGMRPGFRR

SEQ ID NO: 21557 - protein, 153 aa, Pseudomonas aeruginosa
LGSTRPRRSSSASPSQKPSTITSSTQVSRRSRRLPSSVAAACWRRSCCPRASSRLSLSACTGRRLRSISQRATGLPSSPPATMPKVAEASATVVAPWAPSPSATGPKAAAAPKPPSSDTAPAMIPSNGSRPSSPALPTPIRFCSIASAQQADR

SEQ ID NO: 21558 - protein, 185 aa, Pseudomonas aeruginosa
GYRCAAGAHADSSGGRGRRSWRRRFRGRRPGRPPGGRARAGRRRVARSVPGRLPDRRRRRCRRRRRSLARRARPGWPARDARLAVRGARPGDPGCGARLRRWRTRAARWPLRRRLRRDASIGASAARRRLPGYRSGLARGSCRGRGTSKLLSVSPAARKVARRRRGSIAASVRCATGRARRGPSG

SEQ ID NO: 21559 - protein, 953 aa, Pseudomonas aeruginosa
VGAARACADLLRLPQDRGGEVPPEKGTRLLMGELAKEILPVNIEDELKQSYLDYAMSVIVGRALPDARDGLKPVHRRVLYAMSELGNDWNKPYKKSARVVGDVIGKYHPHGDTAVYDTIVRMAQPFSLRYMLVDGQGNFGSVDGDNAAAMRYTEVRMAKLAHELLADLEKETVDWVPNYDGTEQIPAVMPTKIPNLLVNGSSGIAVGMATNIPPHNLGEVIDGCLALMDNPDLTVDELMQYIPGPDFPTAGIINGRAGIIEAYRTGRGRIYIRARAVVEEMEKGGGREQIIITELPYQLNKARLIEKIAELVKEKKIEGISELRDESDKDGMRVVIELRRGEVGEVVLNNLYAQTQLQSVFGINVVALVDGQPRTLNLKDMLEVFVRHRREVVTRRTVYELRKARERGHILEGQAVALSNIDPVIELIKSSPTPAEAKERLIATAWESSAVEAMVERAGADACRPEDLDPQYGLRDGKYYLSPEQAQAILELRLHRLTGLEHEKLLSEYQEILNLIGELIRILTNPARLMEVIREELEAVKAEFGDARRTEIVASQVDLTIADLITEEDRVVTISHGGYAKSQPLAAYQAQRRGGKGKSATGMKDEDYIEHLLVANSHATLLLFSSKGKVYWLRTFEIPEASRTARGRPLVNLLPLDEGERITAMLQIDLEALQQNGGADDDLDEAEGAVLEGEVVEAAEVEEVEGETAELVAEQTGAYIFMATAFGTVKKTPLVQFSRPRSSGLIALKLEEGDTLIAAAITDGAKEVMLFSSAGKVIRFAESVVRIMGRNARGVRGMRLGKGQQLISMLIPESGAQILTASERGFGKRTPLSKFPRRGRGGQGVIAMVTNERNGALIAAVQVQEGEEIMLISDQGTLVRTRVDEVSLSGRNTQGVTLIKLASDEVLVGLERVQEPSGGDDEDLPEGEEAAESLGESAESESEPAAEAEGNEE

SEQ ID NO: 21560 - protein, 390 aa, Pseudomonas aeruginosa
GSGRAPAPARPMTSADNSRLSALPIARVDVSKRAFNFCAGPAALPDAVLQRAQAELLDWRGKGLSVMEMSHRSDDYVAIASKAEQDLRDLLDIPSDYKVLFLQGGASQQFAEIPLNLLPEDGVADYIDTGIWSKKAIEEARRYGTVNVAASAKEYDYFAIPGQNEWTLTKDAAYVHYASNETIGGLEFDWIPETGDVPLVTDMSSDILSRPLDVSRFGLIYAGAQKNIGPSGLVVVIVREDLLGRARSVCPTMLNYKIAADNGSMYNTPATYSWYLSGLVFEWLKEQGGVTAMEQRNRAKKDLLYKTIDASDFYTNPIQPSARSWMNVPFRLADERLDKPFLEGAEARGLLNLKGHRSVGGMRASIYNALGLDAVEALVAYMAEFEKEHG

SEQ ID NO: 21561 - protein, 131 aa, Pseudomonas aeruginosa
RPSRPRMASSSRVVRSVAAKSGRTATTVSPCPSASLRCVPAGRSASTTAPTSPPPSPTSSPCVPRPVSGSPWRTIDERRCTDARHRWPQWRRQGHGRRAARPAPGLEPAGFRGALSAVGVRRGQPWCRPDQ

SEQ ID NO: 21562 - protein, 382 aa, Pseudomonas aeruginosa
EGETETGRYTTGPVCPVGGKQGLERISFGWKDTDFQFTVTERNGKTFSKDGLGDRRPGQFSSVQEFWGRGQTWRLTQLWLKQQYFDGALDVKFGRFGEGEDFNSFPCDFQNLAFCGSQVGNWAGSIWYNWPVSQWALRVKYNFAPDWYVQVGAYEQNPSNLETGNGFKMSGSGTKGALLPVELIWQPKVGAEQLPGEYRLGYYYSTAKADDVYDDVDGQPQGLTGNDFKSRGSKHGWWVVAQQQVTSHNGDASRGLSLFANLTVHDKATNVVDNYQQLGVVYKGPFDARPKDDIGLGIARIHVNDDVKKRQRLVNQVNGIDDYDNPLYQPLQDTEYNAELYYGVHVTDWLTVRPNLQYIKQPGGVDEVDNALVAGIKIQTVF

SEQ ID NO: 21563 - protein, 443 aa, Pseudomonas aeruginosa
GRRRLPVQLRPAALLAGRRAEPGGGARHGAGVGSRPARRFADSGNLDTARRGQAGALPSRIAGAGGRRLEPPLADRQERQRRQRDLAPRQPPGGAGRAGRSGTLPLYRRRWLPPGRADPGARRTHAPESRRRPAIGGRSVVLVEGIAGRHQAFLDPPQVRLEVHAAAQGHSGGQYVEHGELDDPRSHRHVDVGVFRQRDVQAQGAGPGQRRAGGGQAEHRGAVLPRQVRHLHQLAGASGIGNHHEQVAGMRHRGDHPLHQHVGLGAHRQVEAEELVLRVERYRGRGAKTEEVDLPGLDQQVHGAVDDAWVEQLVGAVEGGDGVAEDLPRIGFRPVVLGYRLGHEGSAAGQALGQLDLQFRIAAHAEGATEAVHRRFADRCRLGQGGDAETGGLLRVLQDDLGDFALRLVQFVQAALDLLQQVFHPGSSCSVGPAGKGRRRRLS

SEQ ID NO: 21564 - protein, 491 aa, Pseudomonas aeruginosa
QQMPDVRVLPCTLALFGALGDLALRKLFPALYQLDRENLLHRDTRVLALARDEGAPAEHLATLEQRLRLAVPAKEWDDVVWQRFRERLDYLSMDFLDPQAYVGLREAVDDELPLVAYFATPASVFGGICENLAAAGLAERTRVVLEKPIGHDLESSREVNEAVARFFPESRIYRIDHYLGKETVQNLIALRFANSLFETQWNQNHISHVEITVAEKVGIEGRWGYFDQAGQLRDMVQNHLLQLLCLIAMDPPSDLSADSIRDEKVKVLRALEPIPAEQLASRVVRGQYTAGFSDGKAVPGYLEEEHANRDSDAETFVALRVDIRNWRWSGVPFYLRTGKRMPQKLSQIVIHFKEPPHYIFAPEQRSLISNRLIIRLQPDEGISLQVMTKDQGLGKGMQLRTGPLQLSFSETYHAARIPDAYERLLLEVTQGNQYLFVRKDEVEFAWKWCDQLIAGWERLSEAPKPYPAGSWGPVASVALVARDGRSWYGDF

SEQ ID NO: 21565 - protein, 376 aa, Pseudomonas aeruginosa
QRRPGSPPPAPWRGGEGALHRPLPAGGEPGGSGRAGRPSPARAAIADRRAGPRHGRRRPYRLAVPEQPWPGPGDGSPGDAPLPADVGAERAAPAPDPAARRAGGGEGAAAGDPGPVQAGHPERRAGGRGRTADAGSRLPPRAADDPLVPLSGGAVAMHNLEQKTARIDTLCREARILPVITIDREADILPMADALAAGGLTALEITLRTTHGLTAIRRLSEERPHLRIGAGTVLDPQTFAAAEKAGASFVVTPGCTDELLRFALDSEVPLLPGVASASEIMLAYRHGYRRFKLFPAEVSGGPAALKAFSGPFPDIRFCPTGGVSLNNLADYLAVPNVMCVGGTWMLPKAVVDRGDWAQVERLSREALERFAEHRRH

SEQ ID NO: 21566 - protein, 278 aa, Pseudomonas aeruginosa
PPRRARRPNASSASRPVRWRAASVRKPGASVRQGARTARMPLVARRLRVPRAVRSRAPSARGASRALRLPSGPARATASRARASRATSVRPARRATSRRPASRRSSGGRNRPATVCVRASAAERKAPWKGPFGAFFMPGNRCLMVARTQGGGEMHRILAIALCMLWSVAGLAEDAAMPAQSCASLGEATAGPEDNFRPPLEGEVIDKGRAYFHSAPRADCVTGVFVIPGDFITVYKPSGEWLNVMYVARDGKETSGWLLEKRVRLRQAYGAPDEPAQP

SEQ ID NO: 21567 - protein, 957 aa, Pseudomonas aeruginosa
AARPGRRSRSRRSPATVRTDVSASGCASSIGCRGRAGAGRGRWWTGRPGAMSAWRGSIVVVWAKGRSVDQAVDQARGDPGGALVAIELRVEFGDVGQAQLAAGLGAADQVLHHRHLHAVRRGRADAGRLGGREHVEANGQVEVVDGLQEAVEEGFAAFQVPRLQLAVQQVAHTQALGLVEQRRGVAQAADAQAAVSERPVAGLAEFGDLAERRAGAGPFGVAQVEMRVEIEDTDARQALMPTQVAGEAGEAGVGDFVAAAQADHPVAAREQVGDALRVAFLGGFQIVAGDDVAGVVDRLLAVPGQVGQRATQGWRSVARALATLVAAHAFVAGEPEQHAGRFGVVCVGTHPLVPAPRVGAFLAIDPALPEAHVGGGVHRNSCRSVQPRGKSRGGVEGPLPQAFAARLGAQGGGHQAEGAVQALAAVQQRYADAPDAFVDLALADGVALFADQPEFLLQLVDTLGGEFLGEVQLLAPFVLQVRQQGFGRGAMQQRLRQPFLVAAAQWLRTVEQFQADRLLVAGHHQRHALLAQVGQALEFRFGETDQRGLAIEFLRQLQAGRAGQVAALAGLFFGQAPAQQGLQVPVGAAQRLLQGQRQLLGRQGFGRLAEGNEDLQQAIGGGMLRHGNSLTHRVKAISRKMKPLSHSVGKICKKNGKFRTGRGKDRAASPGGEAAGESLGVEGLAVDAGAVRPHEVQVDRHDLLAGGVVQRVFPRVGEGAHAGAGGAGVDAVGADRAGTVEFVGKGLHQALGGELRYRIGAPVGAALPAHAARGEDDRGVAGELHQRQHGGGQHEHGIDVHLHHAHEVLPGNLLHRRARTEDRSVVQQAVDAAELVLQGCRQFLELVRLGGLQVERDHGGLRMAGGLDGVVDLVQVLLGLAQQQHGGAVGGEGLGGGGADAAAGAGDQDHAVFQQVGAGGVLEHVESFECMTRLAAGRCLSAALRISSRRARGRERR

SEQ ID NO: 21568 - protein, 241 aa, Pseudomonas aeruginosa
AACASRLPLGLDHVVDVDVVGQLVVLGQRVVGQADDVLDLETGLARPGAEFRRTDELAEIVGPARQQLEDVFRADHREQVGLGIAVDGREENLSARLDQAVAGADHRGRVRHVFEHLQAGDHVELPGHFLGHLLGGDLPVVDGDAGFQLVQARHRERRFAHVDAGDVGAALGHGFAEDAAAATDVEHLLAGQAGALVDPVDAQRVDVVERLELALAVPPAMGQCLEFGDLGVVDVAHNRSR

SEQ ID NO: 21569 - protein, 643 aa, Pseudomonas aeruginosa
RVKPLGEGPRRRNPILHVASFGGGMGPAAVRLPMSVCRSGPARRGSGPVAGGDLRPPFAGPGDQALFVVTKQAAVVEELPAADPDVPHAVAAAGIDKLRNRVVDRLLGQAGQIEGHQVGGLAGFQGADQALQAKRAGAVQGGHAQRAVGVEGGGLAVHGLGQQRRGAGLAEQVEIVVARRAVGADGYVDPGLPEFFHRAEAAGQLEVGFRAVDHRAVGFHQHRQVVVVHLGHVHRLEAWAEQAEAVQAGQRALAVALRGLLHLEGGLVDVHLDAGVEFLGEHQDLLQLVVAHRIRSVRAEGDADARVVLEVVEQRHALADRLGAVAGAGDREVQYRDRHLGADPAVMDHAADGLWIEVHVGETGDAALYLFGDGQLRAVADESSLTHWPSAGQMWSCSQVISGRSSARPRNRLIAEWPWALTRPGASSMPGNSRISVAPWRMACSRGATRAIWPSRMPSAWSRSTTPAGSTGTIQVGSRRRSKGLRTLGMAAHPGRRAGSRKYTRASAAGARYNPQLFRDSARGVCMRERLLAAERVKAIEWRDGTLRLLDQRLLPQEEVWLEHESAAEVAKAIRDMVVRGAPAIGISAAYGIVLGARARLAQGGDWRAALEEDFRLLADSRPTAVNLFWALNRMRDRLERMK

SEQ ID NO: 21570 - protein, 240 aa, Pseudomonas aeruginosa
GDQPLAVLEAEAISIHESDREANLTMAQLGMELIRKQQGSPQNILTHCNTGALATGGFGTALGVIRAAHLEGLVNRIYADETRPWLQGSRLTAWELANEGIPVSLNVDSAAAHLMKTENITWVIVGADRITANGDVANKIGTYQLAVNAMHHGVRFMVVAPSSTIDMNLESGEDIPIEERDGRELLEIGGRRVAAEVDAYNPVFDVTPADLIDAIVTERGVVERPDAERMAALMSRKRLH

SEQ ID NO: 21571 - protein, 422 aa, Pseudomonas aeruginosa
RTADQGRPGEDRPGSRRPEGPGLLSESGALSALSFRRDGSSMNAPSRVEAELSMSDFLALAQPGVQKLSPYVPGKPVDELARELGIDPAAIVKLASNENPLGASPKALEAIRAELAELTRYPDGNGFELKRKLAERCAVDAAQVTLGNGSNDILDLVARAYLAPGLNAVFSEHAFAVYPIATQAVGAEGRAVKARAWGHDLEAMLAAIDGQTRVVFVANPNNPTGTWFGADALERFLAQVPAEVLVVLDEAYIEYAEGDELPDGLDYLARHPNLLVSRTFSKAYGLASLRVGYALSSKAVADVLNRVRQPFNVNSLALAAACAALDDHDYLAQSRRLNDSGMAQLEDGFHVLGLSWIPSKGNFIAVDLARDAGPVYQALLREGVIVRPVAGYGMPTFLRVSIGLPEENDRFLQALGKVLAHD

SEQ ID NO: 21572 - protein, 388 aa, Pseudomonas aeruginosa
PEPGKPARGRRRAGRRHPRALRAAQGHRHSRGPGATGHRRVPGTLRGCRLRRGAHRPAWRRRAAGQGVGPYPGHGRRPEGPGREGRADPGWHRHRGWCVRWRRSLGARRPPYRHVLQRRFAACQRADPHPRLRQRRHLLPQLPRPVCPDRYPGRRGEQLMNGAVPMLAIDGPSGAGKGTVAGLLARRLGWNLLDSGALYRLLAFAAVNHGVDLTNEEALKVLAAHLDVQFVAADGSHGQRIILEGEEVTDVIRTEQVGAGASQVAALPAVRDALLQRQRAFLEAPGLVADGRDMGTVVFPDAPLKIFLTASAEERARRRYLQLKAKGADVDQSALLEEIRERDERDSQRAVAPLKPADDAILLDSTEMSIEAVVETIIRHCERQGWDV

SEQ ID NO: 21573 - protein, 348 aa, Pseudomonas aeruginosa
GYPPGRCRSSCAGCAVRGLPCFVRLRGQRPVSAFHGAGGEAAHEVLAGQYVDHQRGQRGDHRRGHVDVVFLDPGGDVHQVVQGHGDRLRIAAGEHHAEQEVVPDLGELPDQADHHDGRGHRQQDAQEDGEEAGAVQARGLDQGIRDRHEIVAEEQRGEGQAVDHVDQHQATGGIGQAELAEGEGHRQEDHLERQEAAEQQRAEEQLGTAEAPHRQHVAVQRADEGGDQHAGHGDQHRVPEERADAVPGLEPADDGEGVGQRQQVAGADVVRRLEAGQQHHQQRHQVKRAGAPEGQVHGQAADAEARVQGRVTHGACLAVRNTGKAPRSPVQRRASASRSPRRAPSGHG

SEQ ID NO: 21574 - protein, 326 aa, Pseudomonas aeruginosa
AGPRAGWSAGATARTGWKALARPAPRAGSGAACARAASAAPATSAAVRSWLQVRPHLRRQQVATAAHGLDQPRRLAGVAQALAQAADRHVDDALKRQHLAAAGGVGDGVAVEDLLRMVEEQLEQGEIRAAEEELLAVLMEQSVADRVQPPVLESQYVATAHLGELRAAQQGLDPRQQLARAERLAQVVVGTQFQADHPVGLVGTGGEHDDRHAGQALVGANPATEAEAVLVRQHHVEDRQARLLLAQRLAEVGAPRDAADLEAGAAQVGLQQFADFLVIVYQQDRSSVRAHEAPPYAVARRRLSPRRPGPAAGRPRRRAGPDVRRS

SEQ ID NO: 21575 - protein, 740 aa, Pseudomonas aeruginosa
NGNRPPRPDRRRPGRPSRCSPPIRRSAPGSRARPVQAAGSRRRRAPRWIPGAARARARNAHWCRRYRRPGRGRQRFSCCRYSSSLNRNAPRQGGTVGRCCRRDSRQPSAGRISTYQNQRQPVDALGKGAGAFFRAAHGVAHEGEQLAAATEIAVVRRRLQAARLPFGVVDQHPQLAVHPIHPHPVAVAQARQRTAGDGFRTHMDGRGHLARRPGHAPVGDQRHLEATILQDPEERRELVQLRHAVRPRALETHHGDQVALQLAGLEGRGQAGLVVEDPYRRLDHLVFRRHRRDLHHAATEVALHQAQAAFGGERLVQRTQDGFVETPFRPFAPDQPAILEERLAGVAAQAGAGDGLYVLVKQPAVEQLADQEGHAAGRLEVVDVGLAVRIDARQGRHHMGQLGHVLPGQLDARRLGDRQQVQGVVGRASGGEQRHHRVDDGLLVDDLRHRHVVAVLGGQPAGLACRFAGEFVAQGGVRVDEGGTGQGRAHHLHQQLVGIGGAIEGAGAGCMVGGHFRGQQLFASGLALGEQLAHRGLFLVGDAGRHRPGRDEHGGQVAEAQRADQQARHDLVANTQAQRCIEHVVRQRDGGGHGDHVAAGQRQFHARLALGHPVAHGRHAAGELADRTDLVQRLLDQPRKALERLVRREHVVVGGNDGHVGLVHQPQGLLVAFATGRDPVGEVAARQGAAVRPLAGRSPDHLEVALASGRATGLDAAGDFEHTRVHGRFSYRLSIVVFTT

SEQ ID NO: 21576 - protein, 456 aa, Pseudomonas aeruginosa
SVRSGSLSWGVPGSMKRSGPASPARPDEFYRVKRRSAARPVVVGVQCLALLAHGLRQGALLVIGIGARDSLRDGRLDGLLRDHGNRPSRWLGGLVALLRGLRRVEQVVEVGLQALLHLVQFQQQAAEAGFLARLLRLAGLPLDLLEAFPGLGDGAIGQGLDRGRNRILVEIVARRLRRGRHFDRRFRLGLHLAQRRQRRQLVEALQVEIIEERLGSRQHRRAPRHLAVANDADPLPLHQRLDDLGVHRHAADLLDLATGDRLAVGDQHQGFQQRARIALRTLLPEAADPRRETLANLQAIPGRDFLQLEGAPRAGQCQDRQGVAELPRLRPLCLVEQLGQAFQRQRLAGREEDAFEQSGEFVGIGQVHRRNGYRSQEEGKIAESGMQLNRPRQGAKPEARKRRPSAGGRTASGALTRNRLPGLPPGFRLPPLRGLSAGAHGWRRKPRSAPVPPSAP

SEQ ID NO: 21577 - protein, 215 aa, Pseudomonas aeruginosa
LFQNIQRLLLCRFNRVLTATMKQFIDFIPLILFFIVYKIDPQNVEFAGFNLSGIYGATATLILASVIVYGALWLKHRHLEKSQWFTLGACLVLGGLTLAFHEDTFLKWKAPLVNWLFALAFAGSHFIGDKPMIQRIMGHAIQLPQGLWVRLNIAWVVFFLVCGFANLYVVFTYPNFWVDFKVFGSLGMTLLFLIGQGLFLARHLHDADTGEKPKD

SEQ ID NO: 21578 - protein, 150 aa, Pseudomonas aeruginosa
HPRFPGTPPGQPPGPPGPSRTAEGRRPPGTRRPAPGDRQQRPGRRRLHRQPDRRRIRFAGRGAELGRGRSLPGRRGVRRGGGQAVQESPALRQSPGTGGRPGRPPGKRFRTGRRFPVPAAAQPGRPGAFAKPEGRTGRQCNPSLHRYKES

SEQ ID NO: 21579 - protein, 108 aa, Pseudomonas aeruginosa
AWELPWPWPRNPRRHGFQPAQPSITQATAELERRLVETERQRDELVSRMRQENRQLREQLQAAQAQRQPPLLTEEQTWYVAGAATALLAFVLGALSRGRRRQRREWIN

SEQ ID NO: 21580 - protein, 476 aa, Pseudomonas aeruginosa
RPGTAQATARRPSRPAGADAVRPRRAAGPHPRSGTGRRRLPGQALRPARTHRTAARRAAANPPGAAQRADATGRPVAEPDARRGADRRPGDQPDPFRKPHPRSAPAPARRAAGQAGPGATGAGPQADPLRPQPGHARQQPAQEARQPPRRQPAHPRPARPRLLLQPLSGFRQPADTRSLPKLYSGLTALDLDLPRLGSSGKWPDPERRNTMRKTLTALFIAAALPTFAMAAPAANDLPPPPMEGGHMMGQHGPRHARPDEGTGPDPRTAPADGQTDGRTNEGPPRDHPALPGQAAGGRAEGPEGRTQGQPREDPEGHPCPAHPRAAEEVRRTAEEARAAQGRVGRIPAMEGRQEVQLTSEPPLPGPPVAVFRPAGIAYPRGLPSRPARHAIQQENHAFTLLANPRRLLAGPAAGRRAVHPAGSCAEPGHLDHRPPSWPEGSRRAVDRPLRRTGQLRGPGLAGATPSRLRDFHPGAR

SEQ ID NO: 21581 - protein, 142 aa, Pseudomonas aeruginosa
PEHRRLAGHVRTRGGQPAAQRRALQPRRPPPGGACQQRRRLPAPERPRPWARHRRRTAGAVGRAVLPRTQPEQPGTRPGPGHRPPRHRAPRRAPAPGQPSRRRLHRHPQPAATAQGDRMTPRPDEQFPRSIRHGSSRFVVPR

SEQ ID NO: 21582 - protein, 169 aa, Pseudomonas aeruginosa
TPARPGHRAAAGTSRRRTAIAGPGGRAGTGRPATAASLGAPRPEPAGTRHLAAGKLAPGLARGALRPARRRRAGPPVAAHHTESGAGRTPRPAAPGHPRPGGRRPALAAGGRGSRPTTGRLAGRTTALARPGRVLVRTPAVAAQPGQALTKADGSSSAGVRNSPIGVPR

SEQ ID NO: 21583 - protein, 172 aa, Pseudomonas aeruginosa
TQSPGSRPLSGDPSRRQVRLQRRGQRRQAVGGARGIAGRVGLAVGPGRLELAAGTRALLVDGAANAATDLAEQPDAACRLVLGTAHGNHLRADADGQFVGYDAACGTALAPIERHTKMRTAGAAGKTRIVSGHGWQNTRETGERRRAKRDSSDFAAAVKRGAAADLLSADGW

SEQ ID NO: 21584 - protein, 532 aa, Pseudomonas aeruginosa
NGRSATAQSPTIHGLADPTYPRFHHRHLPDHSGRQHAGPDPDHARLRPYRRHPGIHLVQRRHLRHRPRPGPAGTSRACPPAPAGHVHAHRIELGAGMHLRRPAVRPAAAHQLHRCLLRKHVGNHRHRLHRAQRAGRHVPGHPHLALSAALAGRHRLHRHGRGDPADAADRRHAPVPDRILGPLGKGPATLAHGRQVHRRHLCRHHPARQPGLLGRGHEPVRRGQPRHVGDFHRRFLHLRPIPGQVEAASGALDRGSGDDPRQPAVRALRRHPARTPQGADQGPAGPRPARPAAGDLAADGHLVRGNLQAALDGCFPHRRSERHLGGHHHRLRPRRLQHVGALLDHAVLLPRLHRRLLRFYRRRYQDLPLPGRLYPAQGQPLPVDPSARSAQAELQRPSPGRGNRPLDPDLLVLLRDRRLPARPRPVADRPGLDDRAHRRRQYRGRRRPGDGAHHRPLGQLRQPAGRRQVAAGRRHAARSPGDHHRAGPADPGVLAPLSAHGPVCNGSTQGLKSRCKLLHHDDTAATRPREPG

SEQ ID NO: 21585 - protein, 619 aa, Pseudomonas aeruginosa
LDARPLHGSGARGDAPAQRSGGQRQLRPEPTGRPGYRRRRPARRIARRRAPGRPRRAGARPAARAPGPAEDRRPRPARLLRAGETQAANHRHRTAGSHRLCHGDLLAAPQGTPRLHRPDPGDPVPQPGPPGQLAGHAAGGEHREERPGRGADHRPADLPGRRGDRLPRRHGAGQLRRDHLHGQPGGVLLPPRVRRAAHRDPHGRPHRQRLHRADRLDEGQRGNRRDPRPRPQPHRAAGAAAGAGAAGIATDADLRRHALRHRRRHDRLRLDPGHPAGDVPVDHGGRNRRTAFPGRYQQGPAVRLPDRRDRLPGRLQGQRQRPVGGRAHHHQRGPLDLRGDPARRPRRAVLHGDGLVNQDNPQAIIQVRDLCNRFGAQVVHEHLDLDVRRGEILGVVGGSGTGKSVLLRSIVGLRRPTSGSVRVFGEDLLQLPEERRSLVERRFGVLFQQGALFSSLTVVENVALPLIENAGLPRADAEHLAQVKLALAGLPANAGDKYPASLSGGMIKRAALARALALDPDILFLDEPTAGLDPIGAAAFDNLIRTLRDALGLTVFLVTHDLDTLYTICDRVAVLSQKKVLVVDTLERVAATDDAWVREYFHGPRGRAAHQAAAVPENH

SEQ ID NO: 21586 - protein, 526 aa, Pseudomonas aeruginosa
DGNPSPPCVDRPVQRDRDRRRPALRPVAGQVRLGGQVQLLRHRLQRSGQWPFPGQLGAVQRDQGRRRGLPPPRSEGPAQGLGTHPRGGQRADQAGHHRQAGAHRDHRHLDHPAQQRHARQPDAGGQGREDPGDRRHALAADPVTEQRRRPDGQHQPAHRALQQHALRGKHSAHQPHPRPSRPGHRRALRRARERQRGDAAVGPGEQAGQRRPGPGQRVDAQRQRPAQRARQGDAGKRQQDHGFAGAHQRHPRPVDQRESPLAGRRHPGTRRAGPGGQRTARYPGGTARNQPAPGREPGELPAGPGKNQGVHPMRLALRPLRRLSLAAGLAALATLGACSILPEAQVLQVYLLPVHNPPASAAARPVDWSLRIARPRTSLVLESPRIAVRPHGDEISVYQGARWSDPAPSLLRDRLMQAFQADGRVRGLSSDDSNLQADFELGGDLRAFQTEYPNGQASALIRYDARLVRTDDKRVVASRRFEVSQPVDGKKVAAVVSAFGKAGDTLSAQVLDWTLRQASAQPAVQP

SEQ ID NO: 21587 - protein, 416 aa, Pseudomonas aeruginosa
SCAATRARSRSRASAARCRSTRWWTRAATSAPRPATSSTNCPASPCTWTPTTSRTTTRNGSSRPCNRPPNACATRSSSKFVERRRQFVAPFRRSPWAARLQRQELLRRNPPGLLPRPAPAGLAIQRQRLAAGFAKILVHDPGHALLQYIQRPRHGEGRHRHATGQGFEHHQAIGIGQRGEHQHRGRPVGVGQRAAMAVAEKTRLWIALLQRRPLRAVAHQPFFARQFEIEERLQVLFRRQPPDIQEHRRPLFRRRCLGGMEQFGIDALAPQPQVLEAPGAELVAQARGAHQHRPARPMEGAQEGIAPGQRQPRTAVTQVFGKARMDRRGEVQAALAQPAPRGPAERPLGGQVHGIRGEGLDQPAEAPEVPGQGDFRIAGTGQAAEVGGRQHPYLVAQQFQLALQGQQAGDDSVDLR

SEQ ID NO: 21588 - protein, 307 aa, Pseudomonas aeruginosa
PCPIGPGPQRLPRLRGRGARQPRVAADLRGGSGASPACLLESLRQPLPGPRPALRRQPAAGPGRTRRSRQAAVRATAGAVADARPGPTGELAGQRPDQRPGDRPPGRRPAPRQPGQRAPAAAPAAPPATGQPRRLPRPPCRPSATGSRPGAAGRSFGGALPQPVPRRDRTDAHGLRAQPTPAPGPRTVAGEQPGGGRDRRPGRLRLAERLHRSAGPRVRRHPATTASRVPRQNRLAARQTNPSRLLTLCPSTEQESAWTSSNGRISNASNCASAPSSAPLPTPRHANPPMSSRSTSDRSACAPPARN

SEQ ID NO: 21589 - protein, 342 aa, Pseudomonas aeruginosa
AKSPLRRTRHRLPAAETPARHPCIRGGGNESATRNPGPMADPAGGGRPRRLRPGRGSPAPLAIVDQLYRGAHAGTARRAAAAHRRTQGGADRGRRSIAAPFAATGQAGRATGGAGAPHGTGLGTRGAPGGGRRLPHRADRPLAVRLHAAEPRLSRAAARGSALRRRGSADPGRRRPGDQRPDHSRPPRRRPQRGRVRRRGPPRPSAAPPATRTDPPGPGNPDAGGDPRQRPATAARPRLAGRRTALDGGQPGYRGDLRRQRPGLRLAAATHHRARTAEWPAQAAAAEPGRRAAEPLLPLHQQGKAARPGQPDPHGNAQVVRQRTAQRALRGARTGRRVNADA

SEQ ID NO: 21590 - protein, 274 aa, Pseudomonas aeruginosa
  UNSURE (112): Identity of amino acid at the above locations are unknown.
LPAPRLHPRVRRPPRSHRARAGPVAARSRFERPRLRIPVARPCWPNTALLGPRTCAGHGRSGKPRGGYSMAGFAEDCAALLDRLGCGPVHLVGISMGGMIGFQLACDRPDLXRSLTIVNSTPEVIPRKPREHLEVAKRKLLSRLLSLRTIGRALGRLLFPKAEQAGLREKIEARWAENDKRAYLASLDAIIGWGVQERLAEIACPTLVISADRDYTPVSLKQAYCERIADARLVVVEDSRHATPMDQPEIFNTTLLGFLADIDKTKEQPCSNVS

SEQ ID NO: 21591 - protein, 653 aa, Pseudomonas aeruginosa
SCPPNASESSRRGLIRRAQDGPAPEESHHALSSFRTSDRPVPQCFRTHAAQRSAAFLCLLPAPGLAGVPGPAGGRPDRRADRGGAVQLPRPHRRSRPEHAQRGVLPRARQRTDLDGGGGAGPAPAVQRPARHAGAPEHQPEHDQPDPLAEPPLRAQAEPRLLPERFRRAHRPAHHADRQLVARFGGAGGGRPLARADLYRQRPGAVRRGRLAPDDPSGAVGVRLRRRPRLLRSPGQAPLGGGLGFALEADGADRRRLHQHHHAEAVRPHPPGRGLRPRSDRRPDPQVATRRARSDLHGRDHHGDERRADHRHHRPGPVAVEPGADLGGRHRPGHRAGDPHQQHVRLDHVGGRRHLREHRPGPGWHADHRPAAQGGRPRGRPAAAGRARRGGVRAHRLPLRQGQRRDPGSRPEGPARREDRPGRTFRRRQVDPGQPAAAPVRPGERTHPGRWPGHRRGDPGKPARADRHGHPGHLAVAPFDPRQPALRPPRRQRRGTHGSGAQGSRRRVHPAAQRRRGPPRLRRPCRRTRSEALRRPAPAHRHRPGAAQGRADPDPRRSDLGAGLGSRIGDPGKPGDPDAGQDGDRHRPPPVDHCAHGPPGGAGQGPHRRKRHACRVARPWRPLCAPLATPDRRLRRRRLKPRHRAAARAARPG

SEQ ID NO: 21592 - protein, 167 aa, Pseudomonas aeruginosa
PCQRLCNGPFRGNHHRRRSRLARASIFSASETVFLSNPCPGSIPTPAASSPSTWRRPRTTKDASARYRGFRPIATENHRMKLASVVSAVITSLAPMAFAQDVDKDPGRGLPVEEYHYGMQLDVKNVLHRTDNSTRTGVVPVTVVYEDHSGELHKIRFLEWGGSTSNG

SEQ ID NO: 21593 - protein, 419 aa, Pseudomonas aeruginosa
RRNGWAGGSKASHSAASISARVASVWIGMRASLARDARQVKPVDGKKAPGGPAMKPPFTKRRLRSILRRAHNANGVIRRYPAATAERKLGTLRVGRITPEALSADTRRDGIPDRALDHAQQQQDQQHHQQCADDPRGPVAPVARMRKDRQTADQQQDQDDQKNRTETHGRRSCSAHGAKGGRFRPCSSRPPPSNEDSINPRPPASVDDLGRRPLEQTHEHQRHRLGVAEGGVATADRHIQGPRQGVEAQVDVCVGKMPADLPVVQRRNLDGGVVQLSVEELAQVPVQHGDIERQIVAQQRSVADERQHLAQGLLQLQLSLQVGAAQLVDADRLRIQARRRLDVEFQALAHDQFAAPHQHRADAEDVGTTRVEAGGLEIEGDHFFRLDRLVHPPVQPAAPARPAAVGQLDHGVHRVSRWN

SEQ ID NO: 21594 - protein, 176 aa, Pseudomonas aeruginosa
RWPRRSAAGAARRRSARRPRGPERRPQGRARQGDERSLLRLLEDFLVQAVELAVGATHVQAGQDERGKDQSDTHRDAPGHGRIGTDTRAQQLRLESDQQDEYHVEAKHDRRKYPGETLSLGHQLLEARIGINPLVDAVVHCFYPHSGVTRNVVDIHCRTLVQALQTTLVVAFRQPL

SEQ ID NO: 21595 - protein, 127 aa, Pseudomonas aeruginosa
RHASNCAAARCGCAPRQCDRSALCTRLDRPISAWPSAWIGFRQRGMILDQRRAAMLKTLTFTVMHFIIAFSVAYALTGSIAVGGLVAAVEPLCNSVGFYFHEKIWKRFEKDGAPRPASAHGWLHRHA

SEQ ID NO: 21596 - protein, 501 aa, Pseudomonas aeruginosa
LAHLLRGGAEQADPLLPAERLRRHQRRHALRLPAVKATPEQRRNGHADRHLVPLLRRRHRLHLGPGQPSRPDHPAELPDQRRHQPGALLQARATVRLRVLHDRATDPDVASPLRRRQPDPTGQPGQPLQAAGLSARQPEDRRDAQRRRRHPRPGRPRLPPPNLRRTPDRLSLWRSLRQPQLQGQRAGHAGLLRHARCRTDPGRQRGPHPAGRKLIDEPNRTLDVRPSAERCRQRPGRPGRRAGRTAATPARRRRFQPSTGPTQVQSRPGSTRIRARHPRRTEHVRSLGILEPPGLPLQLSLRRVGVPARGTRLRIRHPTLRPQRREQFLRQPRRRAQSAEQPRPIEGQGGDGNHRAAAVQHHLRCARPVGPCDQDGPAQAQRGFRPDPRLLRRGQRPLPGAADPRPVQPARHRRTGGGLRRRIPGELPQRSPGQRRPPGDHRPARGGQALQHQLPLRPDEFAVRVRETALHLYRGAQAADRRVRRRTAALVRRFLFLKTIQ

SEQ ID NO: 21597 - protein, 332 aa, Pseudomonas aeruginosa
LDRNHTKLASIYRAQRTIIEPYTNQEVPMTRYRDVLELHTGHPASDGAGVRLTRVIGGPSPERFDPFLMLDQFDTQNPDDYVAGFPSHPHRGFETVTYMLEGRMRHEDHLGNRGLPQARRRTVDDRRPRHHPQRDAGTGGRRDAWLPAVGQPAGEEQAGPGRLSRYRAGRRAAPGNRRRREGHGDRRSLRRRPGAADRRRGKAGHRAALLRPATACRRPHRPAPAGRPSRAAVRLRRQPDGGRRTPGGNRHQSPGSAVRRRGTEPAQRSRRPGTGARRQAVARADRPVRSVRDEQPRGNRAGATRLSRRCPGRLSRARAALRGGFFLPPVPS

SEQ ID NO: 21598 - protein, 118 aa, Pseudomonas aeruginosa
IRFTARSAGSAPVPPACPSHRGSPVRSVRCNSRARTTGSSIPPPRWRGSLRDRAGKAAAPATAPGSAARRSRPAAGSATPAIPPPAPAHPPGGAPPAPPTGRSGSSAATARCRLPGCR

SEQ ID NO: 21599 - protein, 149 aa, Pseudomonas aeruginosa
SAPAGTAAGSPRWPAGAEAPGGWECPGADGVPRDRWSRAPGRRSPPAPTRSRTRSPPPRATGAGAPPHESRKNPAHVPAAHATAGCPATPPAPAAPGRAGYGRGSARPGGSRPASRCDRHVRCGIPARPRSGAGSPGGIAGRRKPGQRR

SEQ ID NO: 21600 - protein, 273 aa, Pseudomonas aeruginosa
VPAIQRPTSPMSQADLLDQDPVFQLKGSMLAVTILELAHNDLARLERQLADKVAQAPNFFRDTPLVMALDKLPEGEGRLDLPALLEVCRRHGLRTLAIRAGREEDIAAAQALDLPVLPPSGARERPLDIKDSAPRKPAEEPSPSAGEARPEPAKAEEKPAEPVSRPTKVVKTPVRGGMQIYAAGGDLIVLAAVSPGAELLADGNIHVYGPMRGRALAGVKGDATARIFCQQLAAELVSIAGNYKVAEDLRRSPQWGKAVHVSLSGDVLNITRL

SEQ ID NO: 21601 - protein, 225 aa, Pseudomonas aeruginosa
PRPYHGLRTPRGVRLRQRRQRRGHPHPGPDQGQAPRKPACPGRQPDPRQGRPDQGRRRESHGRTAQGFRIHHLRLPGGHRERRPPGHVLRRRSDRRDQPRGFLGTRLRPHARPAGKQVAARRERRGADQGTPAADPLQPGARHQGRDARRRRRRGDPRHPPARGDPGIPGRAQGVEPGRAGDPRRAERRRPGVQRCGRPPARQGNTASIPRCAEERIPAKTVRRT

SEQ ID NO: 21602 - protein, 84 aa, Pseudomonas aeruginosa
MSLLDFFRSRKSQNSASIAKERLQIIVAHERGQRAQPDYLPQLQKDLLEVIRKYVPIDQEQIQVELENQGNCSILELNITLPDR

SEQ ID NO: 21603 - protein, 256 aa, Pseudomonas aeruginosa
TCEGSFSRSPILAEGAAGRRRVALLRYLDADMDGVVAPELQVAVDQPTTLVAVDPADAQGRAAHRHLQRRRSLGMQCGGHHVETHPPIVDAVLAGIEFGQRAGQVVAEDSGEVLRVQVVLDIQHQPPVHPPRPADLVDAGQRRQLQQLADRRARRHLPGRQNLGRRHPALFADHRMEVTADQRVVGQPLGGDEPAAALLAIDQALRLQLDQRLAQGDPGRREQLAELALGRQLATRRQQTMADLLAERPADRRYGG

SEQ ID NO: 21604 - protein, 382 aa, Pseudomonas aeruginosa
SRPHPRQSRPKERRELPRLPDRTSRTKEHRMKRMLASLLGTAIALGSGLALAAEADLQALEQAARKEGQVNSVGMPDSWANWKDTWKDLESKYGLKHMDTDMSSAQELAKFKAEKDNASADIGDVGAAFGPIAVQQGVSQPYKPSTWEQIPAWAKDQDGHWALAYTGTIAFIVNKQLVKDVPHSWADLLQGKYKVTIGDVSAAAQAVNGVLAAAIANGGDEKNIKPGLEFFGKIAKQGRLSLTNPVIATLEKGEVEVGIVWDFNGLSYRQQIDPERFEVLIPSDGSVISGYTTIINKYAKHPNAAKLAREYIFSDAGQINLAKGNARPIRAESLTLPDDVKAQLLPNEQYAKAQPIKDAKAWEETSKRLPRQWQEAVIINMQ

SEQ ID NO: 21605 - protein, 287 aa, Pseudomonas aeruginosa
RGARPPSPAAAPHRRIPRMRHDVILVLLDGLNHSVARDCMGHLQALCGAGRGQSYRLECELPSLSRPLYECILTGVPPIDSGILHNDVVRLSQEQSLFHYARAAGLSTAAAAYHWVSELYNRAPFDPARDRHTDDSALPIQRGHFYWSDHYPDSHLFADAESLRRRHAPNFMLVHSMNIDDAGHRHGLASPAYRNAARRADALLSEYLHQWLAAGYQVAITADHGMNEDRSHGGILEEEREVPLFVFGDAFSRDDLAQPLQTDLCGTLCEILGAAHDKPVCRELLAP

SEQ ID NO: 21606 - protein, 278 aa, Pseudomonas aeruginosa
SPWSTNGCCAGATMSRADRRPAALYHRLVVCALFLILVLPLAATLLYSLATQWSATLLPDGLTLKWYLTLWSDQRFLLAFARSLLVCFGALAFSVLLILPLMFVIHYHFPRLDGVINVLILLPFAVPPIVSSVGLLQLYASGPLEMIGTPWVLVGCYFTIALPFMYRAITNNLQAINLRDLMDAAHLLGASTWKAALLVVLPNLRKGVMVALLLSFSFLIGEFVFANLLVGTRYETLQVFLNNMRNSSGHYTSAVVVSYFVFVLVLTWAANRLNKDKA

SEQ ID NO: 21607 - protein, 355 aa, Pseudomonas aeruginosa
EGLIPTSRATCSRLRPRASRRSSRLAEGGAGAVVSTATLAAGRPAAASNAWYSAQGNTAYSASPSRVITWTFMSVSLQAAILSGTAPLRTGYTAALVTQSAWWRSPRVRRRSLGLCILLGVGQAFAGELRWGFSPADGMPYVDIVDHQLQGGFTRQLGERVAQRLGLSLRFVETPNRRIDGFMASGHIHVICNSNPEWDSKPERYHWSPALFEEQDVLLQRDDRPAIRDFAELRGKTLGTSLGYVYADDLMQAFAAGEIRREDTRDLASRVQMLKRSRLDAAVDMRRPLLYLTRQHPELGLSVSPLVLQSYRMHCIYGGQLPVPVESMDRVLDEMVRDGSIGRLLENSLQAPQEP

SEQ ID NO: 21608 - protein, 422 aa, Pseudomonas aeruginosa
AVRKDSGVLLAIAVQGGDLLRHHARRAHGHALAALRVEQQDPRGIEAQAHAAARGRRDVRRQAATDLDLVDGDEDQGVRPGRFEHLDLGTQVMGSAAIAQGDLLRSYAEDQLAPLLQAGLQAQRQFDTVLAAIEQAGPASVPALQAQRNEIHRRRTDEAGDEQVGRVVVDLLRRAELLDDAVLHHRHLVAEGHGLDLVVGDIHGRGLQPLVHQLQLGAHFHPQLGIEVGQRLVEQVDLGPPRQRPAHGHPLLLAAGELRGLAFEQVLDLQQPGHPRHLLVDGGLGHLADLQAEGDVLAHAHGRVQGVGLEDHGDVAVLGAHAADVLAVHQDRTAGDALQPGDAVHQGRLAATRGPDEDQEFAGVDLQPDVPEGIRQAAAVALVQVAQFEGCHVSFVSGVSDPSQPFTAPAVRPRTKYLPAST

SEQ ID NO: 21609 - protein, 392 aa, Pseudomonas aeruginosa
SAQAPQRVRCTARRLTLKLGFRDASRMALASQFGIQVRHHDRQYSAEHQHRARRAEPHLATGEGMRIHEHRRQVGGITRAAGGHRRHQVEALDRDMGEDHQRAEEHRAQARQDDAQVDGRQARTVDLGGAHDGRVDPAQAGEEQRHDEAGGLPHGGDHQAVDDPLRVHQPVEAETFPAPVAEQLVQAQARIEQPLPGGAGDDHRQRHGIQVEGADEAFAADALVQQHCEEHSEHQADGDERAAEEQQVLARHPPAVVVPQALVLAQPGPLVAGHEARVGEGQQQRPANVAIHAEQHHDHAWRQHQLRQPALQAIEWRDATRRYRSRGIDRGIGRHAFSRVRRNPPVPLGGTEPVGRIERSPGRDPRQGLTAPPPRWRPPVAGRPSADPRRGR

SEQ ID NO: 21610 - protein, 525 aa, Pseudomonas aeruginosa
RPLRLCLRLPQNAGEPRACPPRSRAHQASPSLQPQARQAQADPQAALATVLQTDFAAMGVRDVARDAQAQPVALPSRRQTEARLEDLFQALLGHAGAVVVDVQHHRFRPVLQAQAGAFAVFQRIVQQVADTALERQGLARIRLRGATDDLHPAIGQVGLGDVLEQQVEVDRLDVLVDIGVLHALQRALHQQFQLVQVAPELLLQALVLEEFYPQAQAGDRRAQVVGDGAEQLPALVQVAVDALMHGVEGARHLHQFAGAALLQRCRRTAQGQVAGGARQALERTALPMHQQTGEKQQQQAGENDREHLLRLQSLGFQADVRRRHQAGDVQPLAFADADLGHQHRRVHRLQGQRVVRPGTRQLVELQRAVEQAQLVGTDEFDLQLDLLAQALVQHVLDDLQHRLLVRRVRQGTHLQRPVVQRDEEARTAHAAQLVEHQRTVAERQGTEVADAGRHRVGQAARAGEQALALAGAQVRQPEQAGKPLRDQHREQGQEQHAPEQRARHRRPAPPFAHGCRCGRTCAASR

SEQ ID NO: 21611 - protein, 260 aa, Pseudomonas aeruginosa
TAMPRARAGRSADVAGETAASQAPGGYRPIRISASPLMLSVKVQAPSSALLMALRMKANSSRPQPRLPSCGAGSRLRACHSASWTSTRNSPFTPSTRTRSPSRRRASGPPAMASGLTWMAAGTLPDAPDMRPSVTSATLKPRSCRTPRNGVSLCSSGMPFARGPWKRTTATRSRSSSPALKAAARLAWSWKIRTGASTTWCSGATAETFITPRPRLPSIRRKPPSAENGLSSGRRMASSRLRSGPSRQTSRPSSRNGSRV

SEQ ID NO: 21612 - protein, 340 aa, Pseudomonas aeruginosa
KRDDLIMTIRLAINGFGRIGRNVLRALYTGHYREQLQVVAINDLGDAAVNAHLFQYDSVHGRFPGEVEHDAESLRVMGDRIAVSAIRNPAELPWKSLGVDIVLECTGLFTSRDKAAAHLQAGAGKVLISAPGKDVDATVVYGVNHEVLRASHRIVSNASCTTNCLAPVAQVLHRELGIEHGLMTTIHAYTNDQNLSDVYHPDLYRARSATQSMIPTKTGAAEAVGLVLPELAGKLTGLAVRVPVINVSLVDLTVQVARDTSVDEVNRLLREASEGSPVLGYNTQPLVSVDFNHDPRSSIFDANHTKVSGRLVKAMAWYDNEWGFSNRMLDSALALAAARD

SEQ ID NO: 21613 - protein, 176 aa, Pseudomonas aeruginosa
NDGQRRGQSSSASSASRSSRMASARARSSSSGSAPATASATAGSTACSATTGIGPAAGSADSSPCSEGSGGSSRSSKSVFRPCSISSSSSSRLRKLVSSRGFSGSPASPSISSRLSPASAMARSARAWIEAGIASSSRSSRGGCAAGATSTGGSGSGSISRSADSGGSSSRLFRLK

SEQ ID NO: 21614 - protein, 122 aa, Pseudomonas aeruginosa
SARACSWLATCTTPIPAKSPRTDMLYAIIARDIPASQERRLASRPAHLARLEQLKEEGRLVLAGPHPAIDSNDPGAAGFTGSLIVAEFDSLAAAQSWAEADPYRAAGVYAEVVVKPFKKVLP

SEQ ID NO: 21615 - protein, 242 aa, Pseudomonas aeruginosa
AAAAGDSDANGSIERHSMSELLLIDDDRELCELLGTWLVQEGFSVRASHDGAQARRALAEQTPDAVVLDVMLPDGSGLELLKQLRGDHPDLPVLMLSARGEPLDRILGLELGADDYLAKPCDPRELTARLRAVLRRTHPAQPSAQMQLGDLSLNLTRGVAQIDGQEISLTLSESRILEALLRQPGEPLDKQALAQLALGRKLTLYDRSLDMHVSNLRKKLGSHPDGSPRILALRGRGYYYSH

SEQ ID NO: 21616 - protein, 109 aa, Pseudomonas aeruginosa
WASTVPGMRGPMKELDLTREQRQQMGKLMGEQMKARHEITQRYLAKLPAAEQKALKDELKASHEKTQKDIRALLTPEQQKKFDELQKKREQRKAEWAEFQQWKADKKSN

SEQ ID NO: 21617 - protein, 472 aa, Pseudomonas aeruginosa
RSSDQPESHILGVYPRGRPDMRFNRKTMRSLFWRILAAFWLALLLVAGLSILLGRALNQDTWIIARHPGLKDLAEQWTALYEEQGSYAAQGLLEQRRRDYGISIQVLDESGQRLVDGTYLPRPHHRPPRTSDRNLPRFPWRQLSQEYVSPQSNHTYLFIYRIPHPELEAWHRGSLLWPLSALGIALVVLTLFSLLLTLSITRPLNRLRRAVHDLGQTAYHKDSLARLARRGDELGTLARDFNRMGERLQSLIGSQRQLLRDVSHELRSPLARLRIALALAERAEPEARAQMWPRLEQECDRLEALIGEILALARLDAEPGASQRIALLPLLQRLREDALLLAPEQDIRLEVAPDLSIDGWPDMFERAVDNLLRNAVRFNPVGHPLEVRASSAGDYLRLSVRDHGPGIAAELQEQLGEPFFRAPNQSSPGHGLGLAIARRAIERHGGHLRLGNHPDGGFIATLSLPLRRKATE

SEQ ID NO: 21618 - protein, 172 aa, Pseudomonas aeruginosa
RRAQMNNSPGASGMALPASLFLDERPLAQAIAPPPEPPGDEPQSLVLAVELGQVAQQLRHRWARLDLNLPERGTWPLESWRPALHEALYGLLGGAAQARPWQRITLNPALDARHGRLRLDILGQAEEGRRWLPAAVEAARRLAGWQGGRLLWHAQGAYWCVRLLLPLSPARR

SEQ ID NO: 21619 - protein, 511 aa, Pseudomonas aeruginosa
RGVQRQIYSPRTAGRMAGPPQPRAPRSMALPTLRILGFIIGIFLITLAASMLVPILTMLAFDRTEGIQAFIWSSVATFVTGLGLVLPGRPEHVHLRPRDMYMLTVSSWVLVCIFAALPFVLQQHISYTDAFFESMSGITATGSTVLSGLDDMSPGILIWRSLLHWLGGIGFIAMAVAILPMLRIGGMRLFQTESSDRSEKVLPRSHMVAKYIVATYVGITLLGSLAFWGAGMSPFDAVNHAMSAISTGGFSTSDQSLAKWKQPAVHWTAVVVMILGSLPFALYVATLRGHRKALIKDQQVRGLLGLLLVTWLLMGTWYAVTSKLPWMDAFRIVAVNVTSVVTTTGFALGDYSMWGHFSIMLFFYLGFIGGCSGSTAGGIKIFRFQVAYTLLKANLYQLIHPRAVLKQNYNGHRLDEEIVRSILTFSFFFAIVVCLLALGLSLIGLDWMTALTGAASTVAGVGPGMGPIIGPSGNFASLPDAAKWLLAAGMLLGRLEIITVLVLLTPAFWRH

SEQ ID NO: 21620 - protein, 389 aa, Pseudomonas aeruginosa
KAGVSFCTMTTQPQPGHVSLDSSTQPARVRAIGDWTLAHYTALEREVTRLRSEVAGNASFDLSQLGALDTAGAALLAELLGAERLADLAELEPGLPRERQALLKTVGHALHDFCEPEKPKPPTTAIELLARIGCAMETFWLHLKALLGFIGLTLETLFRSLVRPASWRVTPLVANIEKSGLDAVPIIALLTFLVGAVIAFLGATVLANFGATIYTVNLVVFSFLREFAVLLTAILMAGRTASAFTAQIGSMKANEEIDAIRALGLNPIELLVLPRVLALLVSLPMLTFVGMLCGIVGGMTVCAWTLDIPPAMFLSIMEDGIGVQHFLVGISKAPLFAFLIAVIGCLEGFKVSGSAQSVGEHTTTSVVHSIFVVILLDALAALFFMEMGW

SEQ ID NO: 21621 - protein, 350 aa, Pseudomonas aeruginosa
SIPWNGSPPPTTPGSANTSTGRAGAPPTKPPPCRRITEMETRAHHVLIGLFSVIVIGAALLFGLWLAKSGSEGKFNYYDIVFNEAVSGLSQGSSVQYSGIKVGDVAFLRLDPKDPRKVWARIRVVASAPIKQDTTAKLALTGITGTSIIQLSSGTPASPMLEGKDGKIPVIVATPSPLTQLLSNGEDLMGNINQLIARFSNMLSEENTARISRTLDHLDQATGALSAERENVSAVMQQLAQASRQANAALAQASELMRSANGLLNEQGKGMLENANKTMASLERTSATLDQLISENRHSLDGGIQGLAELGPAVSELRDTLAALRGISRRLEENPANYLLGREKTKEFTP

SEQ ID NO: 21622 - protein, 538 aa, Pseudomonas aeruginosa
ILFARAGLYRLWRQHRGGNLHPVFQLRHPLDGALCAALPAPGVPPRPALPPARPAQGDPRPARGRRRALWPGHGAARLLRGAQPDVPAGAELHRAGHRRPAPARHGLAGIGQQRPAGRRARRPAAAGQYPGRGGRGQHPVLRTVHLHHRLLRPPAGPAPGPGAPGDRPRAGKGRAARAQPGQVPVAAGLGNDLQRQEERAPGNPAQEAHRVLLRHPRLHRAIRGTGSRGPDRPAQQLPQRNVEDRPQVRRHHRQVRRRLRHGVLRRPQHPGREEGRRGCGIDGHRHAQAHEGATPAVAGPGHHQAAGNPHGHQHRLLHGGQLRRRHAHGLHHHRPRGEPRQPPGKRLGSRRNPHFPRDLLADQGRDHVPRQGPDRGQGLQPPGADLPGGGLAPRPRRRAQLRRARIARLLHVPGHQQHPELRQGTGHPGPATGRRTPARQGHPLSSSNAAGSSSRHSGAVRGPLACSARNSSAETRQDCSRAQRPQAWRSSASAWRQASPRSSCMTPVTPCCNTSSGPGTAKAATGTPQARASSITRP

SEQ ID NO: 21623 - protein, 276 aa, Pseudomonas aeruginosa
QGPAVCRRRQRVDWAPASGSFAMGSILSLRHYSHDQIVHSHDHAQLVLGLSGCLDFEVEGRGSRVLRQTFAVVPAQARHACSSPSGSRCLVLDLPCDGSLLLGLGEHAEAGRRLFERPQALSLTPAQGQLVNWLASGPINDPVIAHQGAGLLLASLASERQPPRQQPRLPLASLDAYLDRHAAHPLQVADLARLAGLSVARFHSLFLAETGQTPMDYARSRRLHQAHELLLESSLAVGEIAARVGYASQSAFTAALVREFGVTPRQLRRESRDKTG

SEQ ID NO: 21624 - protein, 360 aa, Pseudomonas aeruginosa
KPRHPVRQENGQLPRTGRRRHDKRSRPSGALVIACRPRKRRRGIPAFEEAEMKAPRVTLDQWRTLQAVVDHGGFAQAAEALHRSQSSISYTVARMQEQLGVPLLRIDGRKAVLTEAGEVLLRRSRQLVKQAGQLEELAHHMEQGWEPEVRLVVDAAYPTARIVRSLSAFMPQSRGCRVLLREEVLSGVEEALIQGAADLAISGLIIPGHLGADLSVVEFVAVAHPDHPLHRLQRELTHQDLETQMQVVIRDSGRLQPRDHGWLGAEQRWTVGSLATAATFVGNGLGFAWLPRHIIERELQSGQLKPLPLSQGGVRQSRFYLYTNKEKPLGPASQILMEMLKSFANVPLNAPFAAPEPAAE

SEQ ID NO: 21625 - protein, 624 aa, Pseudomonas aeruginosa
SGGPRTGPLQKRAIMLYRRFERLIDPFRSASERMPPSEVLRFYVYFLRQVWPVFLALLVVGLIVALIEVALFSYLGRIVDLAQSTPSAEFFRVHANELIWMAVVALVLRPLFNALHDMLVHQSINPSMTNLIRWQNHRYVLKQSLGFFQNDFAGRIAQRIMQTGNSLRDSAVQVVDALWHVLIYTVSALVLFAEADWRLMIPLVLWVFAYVGALAYFVPQVKRRSVEASDSRSKLMGRIVDGYTNIITLKLFAHTRQEEDYAREAIGDQTLKSQRAGRVVTSMDVTITVMNGVLITGTTGLALWLWSQELISVGAIALATGLVIRINNMSGWIMWVVGGIFENIGQVQDGMQTIALPRKVVDREDAQPLRVERGEVEFEHIAFHYGKGSGVIQGLDLKVRPGEKIGLVGPSGAGKSTLVNLLLRLYDLESGRILVDGQDIAGVTQESLRAQIGMVTQDTSLLHRSIRDNLLYGRPGASDAELMEAVRKARADEFIPLLSDAEGRRGFDAHVGERGVKLSGGQRQRIAIARVLLKDAPILILDEATSALDSEVESAIQESLETLMQGKTVIAIAHRLSTIARMDRLVVLDKGHIAESGTHAELLAHGGLYARLWQHQTGGFVGVD

SEQ ID NO: 21626 - protein, 142 aa, Pseudomonas aeruginosa
PWSTRTIAASCTRSASSNGAAAPATAERTPRPIVPAPFRPGGRATGRGPPRRRRAHPPAPVRGTAPRHRADRDAPGSARSASAPARNRGSACVRPGRRRRSAPGRRRWRIPGPGRSRSRSAAGRTRPGIPSSARTGYLQRPG

SEQ ID NO: 21627 - protein, 619 aa, Pseudomonas aeruginosa
RLVGHRARGAQAGLGTDELREEARPLLVGRRRLVGDGEEPDTDEGDDHREQRRVLVRVDGFLVAEDLHPDGRAEDHQAHRGDQAHPAADHGAAGGQLLPVHGEQQHREVAAGGDGEGQADHEGDVLLLEEDAEHDGDHAQGHGGHLRDPQLVLLVGLAALEHAGVQVMGDGRGPGQGQPGDHREDGGEGHRRDEAEEQAAAHRVGQVHRRHVVAADQRAGGVLEVRVGADQQDRAETDDEGQDVEVADETGGVEHALARFLGVADGEEAHQDVRQPGGAEHQREAQGECRDRILDQAARTHDRLALRMHLDGFGEQRADVEVDVLEHHDRHERGAGKQQHGLDDLHPGGRQHAAEQHVEHHQDAHQDHRDMVVEAEQQLDQLAGADHLRDQVERHHHQRAAGRQGADLLLLEAVGGDVGEGVLAQVAQALGDEEEDDRPADQEADRVDQAVVAGSEDQRRNTQEGCRRHVVAGDRQAILEAGDAAACGIVVGRRAVALGCPVGDAEGRADEGDEHDDGRDVQRLALHVAGQRVGPEGRSEGRKAERGKETSDHCCASLRISWFRLSNSPLARRTYRPVRMNAARISPTPIGMPQVTDESGLIRAPSSCGWKAISRMNIT

SEQ ID NO: 21628 - protein, 410 aa, Pseudomonas aeruginosa
RFASRSRPVFPGLPADSGASLRQGKTPCPVARARRSPIEPAVLLHPVLDPSRVGRHPLLRRILGFGALLDRQHHLADLVAILPAELLQELPDRLGLGLQRRVGDGVDMLGIAIDLLRIVEELQLPLGEHPVRNPAGHHHRLLLVLGTGQLGDHAAAGTGHQLVVEAILLDRLVGLDHHPGAGIDTHHAAAESVLLRLEVGDAVGAHVFGDDQADACVRVVDGKVDHLILHLLVVGAVGARQPGREHGIELAARHALPHDPRRHRHQLHLVAELLADHLGGHMGGRHAVRPAVHVTDGDHRLVRRGRHPHSRRHCQARTPAQQSSHHSHQTYPLFYADGDAPRRSRHSAVPPSIIGAPGRRTALRTTPIAPDNDMPRTALRHAADVLRDSAIEALYALDWTGRFPLGRAPG

SEQ ID NO: 21629 - protein, 548 aa, Pseudomonas aeruginosa
RSAGWWRRSSRCATRSVSTSTRRSGNASRKTARRARLAPMAGCTATPEGIFARHGKRRERPIGTLAAITHCTTEACSCHSGSIFTQYFSLEGIPPMPHFLRFAALLGGLALGCANLAQARDVDAASYGYPLTNPFEATIATTPPELRPELPHSEDIDQKDYSLKLRPEREFALPDNFWPVKKLRYRLARQDHAAPLIFIIAGTGAHYASSFPEYLKKLFYQAGYHVVQLSSPTSWDFMASASRFATPGFSSDDADDLYRVMQAVRAQQRDLPVTDYYLTGYSLGALNAAFVSHLDESRRSFNFKKVLLLNPPVNLYTSVSNLDKLVETQVKGITDSRTFYEVVLSKLTRYFRQKGYVDINDAMLYDFQQSKQRLSNEEMAMLIGTSFRFSAADIAFTSDLVNRRGLITPPNYPINEGTSLEPFFKRALQCDFECYMTEQLIPMWRARYDGGSLTQLVNQVSLYKLQDYLHDSPKIAVMHNADDVILGPGDLGFLRRTFGERLTVYPYGGHCGNLNYKVNAQDMLDFFATPAAGQTQVASAALTQQAGN

SEQ ID NO: 21630 - protein, 268 aa, Pseudomonas aeruginosa
SMSRTAHWMFALLLSAAASAQADQAAAPAELPPRQLDGDGFSRPLDQLKFNPGLDQREFERATLDALNMYDPWESWNRRVYHFNYRFDEWVFLPVVRGYEYVTPHFVRSGVSNFFDNLGDVPNLLNNLAQLKGKAAMETTARLLFNTTFGVLGLWDPATRMGLHKRSEDFGQTLGFYGVGSGPYLVLPILGPSNLRDTGGLVVDYVGEYQVNYLNVPQASGDHPEITALRVVDRRYNTSFRYGQMNSPFEYEKLRYIYTEARKLQIAE

SEQ ID NO: 21631 - protein, 217 aa, Pseudomonas aeruginosa
PTCSKGVCATKTTSAIAACLKPGGVQWMTAAHGIIHSEMPEQVEGAMRGFQLWVNLPAKSKLAPAGYRDIEPEDVPRLETAGGVKVTVIAGRFDDGQAQQIGAVERPDTEPHYYDLQLPAGGRIAPRLPDGHRVLLYVYEGSLTVEGERPVEIATNRLARLSEEGELSLRSEAGARVLVLAGKPLREPIVQYGPFVMNSREEIEQALRDYRDGVLAV

SEQ ID NO: 21632 - protein, 431 aa, Pseudomonas aeruginosa
GLPLDPQEALQFRPLAHRIVVAQFDQFAAIAALEQQVAQYPRPAGAGRSGTAQEKPQHPRQLPVVPRGDLVQRPARRHQQYLHRLQPTRLAAHLRRHQLADLVHPLQLLDVAFQAVDEGAVQQVGADLRQARRSVGRRQAGHGTVATGGRVAADADHQHPRGAQVQRRADGRLGTHRAVAEVFAVDPHRREQQRDRRAGQQVPKLQAGGNAQAPMAYPGIDGRAPLVEGHRLPRLVAERGHRHRAQLALAHRRMNPGKIQLTCQQLMQRPVVQQRHRHPPPQAEQAMAEEARGLAGHARPVAAIDMFGAESLPDRGQALDRLAELQGAASQANGVDGAGGGTDDDRERIAGAVRQQVGDGGQDTDLVGRAGAAPGKDQAGERRTWGKGIGHSGASVMNCGEYSQTPRASGMPVLSACAVSDRAWLRLAGGS

SEQ ID NO: 21633 - protein, 137 aa, Pseudomonas aeruginosa
PSSNWRTTTWRGSNGNSPTKWRKRPTSSATPPWSWPSTSCPKAKVASTCRRSSRSVAATACAPWRSAPGARRTLPPPRPWTCRCCRPRAPANDRWTSRTAPRASLPKSPARAPVKPGPSRPRRKRSPPSPSAARPRW

SEQ ID NO: 21634 - protein, 273 aa, Pseudomonas aeruginosa
ITLAKILVVTSGKGGVGKTTTSAAIGTGLALRGFKTVIVDFDVGLRNLDLIMGCERRVVYDFVNVVNGEATLTQALIKDKRLENLHVLAASQTRDKDALTKEGVEKVMAELRKDFEYIICDSPAGIEKGAHLAMYFADEAIVVTNPEVSSVRDSDRMLGLLASKSQRAEKGEEPIKEHLLLTRYNPERVTKGEMLGVDDVEEILAIRLLGVIPESQAVLKASNQGVPVILDEQSDAGQAYSDAVDRLLGKEIPHRFLDVQKKGFLQRLFGGRE

SEQ ID NO: 21635 - protein, 280 aa, Pseudomonas aeruginosa
SASTYRSTRSRSRWNWRTRATARSWNSTSPCRIVDSPRVHTAAAIGRRSRFTEPARQAPCRLPAMSPFAMPLSQIRIVHQDDALLVVDKPTLLLSVPGRADDNKDCLVTRLQENGYPEARIVHRLDWETSGLMVLARDADSHRELSRQFHDRETEKAYTALCWGLPELDSGRIELPLRYDPPTKPRHVVDFEHGRHALTFWRVIERHERWSRVELTPITGRSHQLRVHMLSIGHPLLGDRLYANPEALAAHERLCLHASLLCLTHPQSGERLRFESPAPF

SEQ ID NO: 21636 - protein, 485 aa, Pseudomonas aeruginosa
AFPAASRPAGTPPADFRYPVLPYNDQLPLFLAGPAANDLNPVGQYDRLHGLPSGATMRAELNQGLIDFLKASPTPFHATASLARRLEAAGYRRLDERDAWHTETGGRYYVTRNDSSLIAIRLGRRSPLESGFRLVGAHTDSPCLRVKPNPEIARNGFLQLGVEVYGGALFAPWFDRDLSLAGRVTFRANGKLESRLVDFRKAIAVIPNLAIHLNRAANEGWPINAQNELPPIIAQLAPGEAADFRLLLDEQLLREHGITADVVLDYELSFYDTQSAAVVGLNDEFIAGARLDNLLSCHAGLEALLNAEGDENCILVCTDHEEVGSCSHCGADGPFLEQVLRRLLPEGDAFSRAIQRSLLVSADNAHGVHPNYADKHDANHGPALNGGPVIKINSNQRYATNSETAGFFRHLCQDSEVPVQSFVTRSDMGCGSTIGPITASQVGVRTVDIGLPTFAMHSIRELAGSHDLAHLVKVLGAFYASSELP

SEQ ID NO: 21637 - protein, 198 aa, Pseudomonas aeruginosa
TRTRPDHVVRQRRTARQELRCHQHLPRYRLRRRPRRVRHPARPQRLRQVHPAALHRRADRGRQRAHPHRRRGCGAFAAAEARDRHGVPELRAVPQHDRATERRLRPAHAEGACGGTEAAGRRSHRTGGTGRVRRTLPAPTLRRPVPARGAGPLAGDAPAPAAARRAAVGPRRAHPQAPARTDSPHPAGAGADHGVRHP

SEQ ID NO: 21638 - protein, 436 aa, Pseudomonas aeruginosa
PGGSADPVRPHRPDERRTHRPERRRGDPLHRAGKRLRRRLHRQLQPARRRTGQPPARPALRATGGDPPGIPAPGQRTERRRAGAGTLAQSARQRDPLPRRGRRGGTHRRRPQPQRRPPVSGRQSADAGHRSQQYSRGSLMSLVIFDLDETMIHCDCSSLWSQRMASLGWVDESFVRHDAELMEQYAEGKLSMDLYMDYTLQPLIGRSVEEVEREVEAYVEEVIEPLIYSDACACLARHRSANDRVLIVSASGVHLVKPIAARIGVDEVLAIDLEVLDGQYTGRTLGHPHLSRRQGIASARPAGRRRSPTGRRLVLFGLAQRPAAAEAGRPSEYGQSGPDPARLRQGNGLAGQHLALTGSLRKRERIALSIASPKRPFRPATGPPPARPCPAPGCSPTPRTPPRRRRSGRFAPAARGVSRRRTMARPSTPVRRSTAP

SEQ ID NO: 21639 - protein, 396 aa, Pseudomonas aeruginosa
SGQADPWAERFPGTPGSDSGEQRAERPDQQDRRHHPRGGEAGGPGGEEIHHQGRPRRPQLQARRDRPAGLLPGLQGLPRRRPELQEHHPRREEAGRRIAEGQGRRHRPRPAQQRRRLPAGGHRADRPVHRPGPDRTGAQQRRPRRRAQRRRRQGLLYRPAGGTGQPSLGLRLGDLRRRHAGLPPRADPRWTDLRQGHRADHPAAQPRRTEADPGEVLPSLRSEHPAPGRDPGHQLPVHRRRQGNRRKRPARLDALGHHPPGGEGRGQPVQAVPRATQGPARRAHREQRRLRLRPRAPGAGPGADEGEDRQPERGQAPRPADQHREPPVGHGERPAQVQGPGAAEGTQARGRERPAGRGRQDQAAGRRLPHRVRAHPAGLPEPQLGGGQALSSAGAS

SEQ ID NO: 21640 - protein, 607 aa, Pseudomonas aeruginosa
NSHGTVVKYGAGCTTGPFSLRRERSMTVTEQLSALDSILAHGDLHCLFQPILSLSERRLVGYEALTRGPSNSPLHSPLALFAVARQCGRLSELELLCRQRAFSRFRDIQGDAMLFLNVSPESLLEAGHPPGRTLQLLQQLGISPNRVVIELTEQTPIDDFDLLDTALHHYRAMGFSIALDDLGAGYSSLRLWSELRPDYVKIDRHFVDGIHLDTVKREFVGSILKMARASRAQVIAEGIELPEELAVLSEMGVDLVQGYLFGRPLEHPASDVQQMLPSADAPSQSSSDEHGDLRALLLEQRAVDVRTSTQEVVEIFRRQANLNSLAILDEEGRPIGIVHRHALTDALLRPFACDLFLRKPISRLMSDDFLAVELGQTLQQVSRLLTSRARQRIEEDFIVTRGGHYAGMGRVIDVLRLITEEKLQQARHANPLTLLPGNVPIQQCLEHLLQQRREAVICYIDVDSFKPFNDLYGYARGDEVLLCLAQCLSERIDPGSDFVGHIGGDDFMLVLGPEDWRTRIDRLLETFQSQCRRFYSREHLDAGCFVAHNRHGQREEYPLLSLSVGVVHLPAEACQGMDAAHLATLASEAKRQAKAVPGYSLHLIETA

SEQ ID NO: 21641 - protein, 488 aa, Pseudomonas aeruginosa
TGELVAMRFLACEGTHPCRSAARSQSGGSSGALAGIRARDLLRRRLDGGRQLLGGLLRIRGGVVEEVGHHVEDRPLHVAGSGHAVGHARHQVAVLGSLLEVLHRLLGATVERRHVGVQANRDGALVEVEVLLEGRVEHAARQVFLGLAVLRVAQLEHHQRVDVVVEGFLRAGERQALVVLARHLAGGGELALRPVAHDLHPGLAVDHHRRGGAPFATGGVGIDIAAELLQRGEHLDHLRSGEGRLVLFDEGLAIAFRTHLAQHQVLEHGAVLPRLAAMGQRRETGGLELVGGDEQFVEGGRRGGAGLLEHFRVDVEPVHPVYVDRHCYVVAVVLHDLRHLLRQQAVPLAFGGHRVEVGEQAQFAPLLDIRPLDLRRGRRIAGHRAGLQHGHRRLAATAGHGEVLPGVALGFDQLLQGFGGALLAGGGPPVQHFDFAGLGQQWGETEGGKTDDGREATDRIHEENLLLVIRSKSALAMLRVYSSVPRRG

SEQ ID NO: 21642 - protein, 77 aa, Pseudomonas aeruginosa
RRTARGRNRDCRRAAPAPGCAPAIRRRGPAPATRRSPHPPAPGRRRAGAPADRRRWLPDSHGWPRAPCPTPRTCARR

SEQ ID NO: 21643 - protein, 155 aa, Pseudomonas aeruginosa
RRRHRAGAGPSPPPATGWYWRRHRRCRCRVHGRRPFPRPAALREWPCPRRTVGAPRPFPCWRCRSASARPGRTRWAGGRSAASRSAGPARSCRKHPGTALHRTCCETARWRWTWRSRRGWPATVPCPARPGSPRRTWPARRRRTGRPNRSRAAPA

SEQ ID NO: 21644 - protein, 179 aa, Pseudomonas aeruginosa
ILQGETTVSGAASRRRRPVPRAPRAWPPPGRAPRHRDRRPRQPPRRQARRLAPRPRESAQPLARRTRRPAPRAPEGRAGRRSRSSGPAPSRPVPAAGCGSWFPRAASPARRPPPRSPRGFPRPRRWRDRPGPGSRQESHPRRDRRAAAAPRAPLRPAVPARAPSRAAPTAAAARRGSSG

SEQ ID NO: 21645 - protein, 236 aa, Pseudomonas aeruginosa
QATAGSEAGSSEKATVRRRTNGQRRAHSKSSPRASSRVSPSSASRAIRRRTWMAPKASFCTSSTICSLTSSRIAMKVTTTPSLPSSRVNNWMKGTKAPPFRRSSTSLMRSRVDSTSRVTWWLSNRSARRSISPITSISSCSASSGSSLRARASGAATAGTSTSRPTRGSSSRSSAAFLNRSYSCRRRISSARGSSSSSSASAERGSNMRDLISASIAAITRYSAASSRRTAFISST

SEQ ID NO: 21646 - protein, 256 aa, Pseudomonas aeruginosa
TSASCSGTRSAAGSAGGVSALAGLSSCIARLVVGGFGRRSGRLHERRRIAATHADHFGIGVGQADHGGGLAAAIAPVHDQVDLVFQYLAHFIGIVQWLAAAGHDQAHAHQRLAQFLQQRTGDRAVRHAQADGAALGVQEHARHLAGGAEDEGVGTGGVRLEQAEQAGVDLGIDAQLGKVAADQGEVVLVVQLADAADAIHRGLFADAAAQGIGRVGGIDDHPTLADNFHRLLDQPRLGIFRMDLEELAHSAPLASE

SEQ ID NO: 21647 - protein, 351 aa, Pseudomonas aeruginosa
IRRWTHATAGCAWTSSARRKKAGAGCRRPWKPPDDWPAGRADDCSGTPRARIGAYACCCRSARPGADEGRRVEFRRRAQLAHRRPQVDEADDPLLLAEPQAGVHHRIGGHLAGPPHRPQSLGIGAQHQAVGGAAGSQQLLSVRHLRVVLQASDRHDQQRCAQRHVAGLGQRFLGGVRLAARQGAGVEVAQGPAAFALYQDEAPGPQLPVVRGTQGDPEQPVELLRRGRGIAQAGVGNASEQGVESLHGRTPVRNEIAIVDAIARLTPALRRPVPAPGAAAAAGSAAAGRRRRARHRRPGWAGRWPRPPRTRGRYSSAARRRCSERRNRPRRAARRSVPACSRYRSWQPSAG

SEQ ID NO: 21648 - protein, 175 aa, Pseudomonas aeruginosa
PCSPSTVPKASRHSSGPASPPSSPASAWSCRDVPSMSTCARGTCTCSPYRAGCWYASSPPCRSSCSSTSATPMPSSKACRESPPPAPPCSAGWTTCPRASSSGALCCTGWAASASSPWPWRSCRCCGSAACACSRPNPRTARKRSCHARTWSPSTSSPPMSASPCSAAWPSGARA

SEQ ID NO: 21649 - protein, 220 aa, Pseudomonas aeruginosa
SCSTPSPRCSSWRWAGEPGQPAGDHPGPRPVQPFRRPGGPRAPRPRRPSRRDPRRGRRLRHRQVGAAAQHRRPAPADLRQRAGVRRRPAATARGAPLPGRTALRRAVPAGRAVFLAYRGGERRPAADRERRPAARRRRAPGPGQAGPGRATGQRRRQVSGLAFRRHDQARRPGPRPGAGPGHPVPRRAHRRPRPDRRGGLRQPDPYPARRPRPDRVPGHP

SEQ ID NO: 21650 - protein, 280 aa, Pseudomonas aeruginosa
SARIATRWTAASRDSPSWARRSANCAIPWRHCAESAGAWKRTRRTTCWAGKKPRSSPHEARPSPAASPVPGRRPGRARHPRRLLDPAGGAGPPGLPATGAQPSGQRRRAAGRLVAADRPAAYQPGAGEPAHRGAPARRRNQRVPGRALERSGAVAAARSSDAGVPGRRPGPRPEQRRQQPAGRFRTGRRPSRLPDRVPERPGQRADPLRRAPGAYRRQARGRQPAFRGQPAGGWQEGRGGGQRLRQGRRYAVGPGSRLDPTPGLGATRRAALKRPAWPGD

SEQ ID NO: 21651 - protein, 130 aa, Pseudomonas aeruginosa
TGPVCHPRHRAARITLRGHNERRHSMSSPDDERFHSFAEFYPYYLQEHSNAVCRRLHYVGSLLVLAVLFHAVASQQWLWLLALPLVGYGFAWVGHFVFEKNRPATFKYPLWSFMGDWVMLKDAFTGRIRF

SEQ ID NO: 21652 - protein, 535 aa, Pseudomonas aeruginosa
PIRAAGPRAGRSPGTTVGPGSARFPELSISCHWPPRKRLVKIPPATWPPAIPQAESSRGRAGTKIHRDPLQRMKPTLPDRSPTSRSVASMREYYSRVLAYIACGASIAAGTYTQYFSYGILWMVPYALLYPHLAYHLGQRFRQHDPRKVTRALLAVDAVHCGLGMALLGFSVVPSLMFLLVLSFTALVIGGLRLLGMALLVSASSALLVAVLVAPPLLGNTPVEVAAVSILFCGLYICITAFFGHQQGLRLAQVRQEIAREQEKAARLARNLAKYLSPQVWEMIFSGKKSVRLETQRKKLTVFFSDIRGFTELSEELEAEALTDLLNNYLNEMSKIALKYGGTIDKFVGDCVMVFFGDPSTQGAKKDAVAAVSMGIAMRKHMKVLRQQWRAQGITKPLEIRMGINTGYCTVGNFGADTRMDYTIIGREVNLASRLESASEAGEILISHETYSLIKDVIMCRDKGQIAVKGFSRPVQIYQVVDSRRDLGAAPSYVEHELPGFSMYLDTNNIQNYDKERVIQALQQAAERLRDKVIL

SEQ ID NO: 21653 - protein, 189 aa, Pseudomonas aeruginosa
PRSRPAAIHPAAPARRRPPPARHRPGLRASPGHRYRSARGTPAPRPPGRRRPARGHGGSRENAPVDSAAPAPPAAGRRPPAIFRPAVRDRGTPPGSFPSPAARHTGTPAAALSPEVSRRDGTVRYRRPCATAAGAGSARRRTRRAGAGCSPAPPGSADGRCAGRHSPRTTAATDSGHAGIRESAYGSPR

SEQ ID NO: 21654 - protein, 221 aa, Pseudomonas aeruginosa
PTWRGWPVFRWRASTACSSPRPDRRPWTTRAADACTRPTNCCWRAAWRWARSPPGSATPRRAPSPQRWSASSASPRDNCVASPATKPASRTTDKSVTTPYSLPIDRTGVSMDIIEWQDFERVELRVGTILSAAPNPKARKPAYVLEVDLGPLGLRTSSAQLTAHYQAEQLVGRQVLCVCNFAPKQIAGVRSEVLVTGVYDSEDKVVLAGFDKPLPNGARLA

SEQ ID NO: 21655 - protein, 302 aa, Pseudomonas aeruginosa
RIPMNRRSALAALHGGALLFGLTGVFGKLASASPGVIVFGRALFAVLALGLFARLAGQAWRALGPAQWLRLALCGLLLAGHWVSFFIAVKTAGVAIATLGFASFPAFTVILEGLLFRERIHLAEGLLVVLVSLGLVLVTPNFDLASGATLGLLWAILSGLLFALLSLANRSNSGQVGPVQAALWQNLVVALCLLPFAVGELPALPALDWLWLALLGVFCTGLAHSLFVASLAVVKARTAALVFALEPVYGIAFAWLLFHETPGPRMFLGGALIILAIVLSARLGARGRKTAVGDERGDPERA

SEQ ID NO: 21656 - protein, 319 aa, Pseudomonas aeruginosa
  UNSURE (168): Identity of amino acid at the above locations are unknown.
ARAACGRAASTSTPTRKSRSARPARSSWKCSSRSPTYRSTRPSRRPNRPPSERRCLTSSTATAPSCTTTTPVPPCARRSCCCTVSVRAPATENTSCPALLAQYRLAGSPDMRGPRPFRQAARRIQHGRFRRGLRGAARPARLRSGTPGRHQHGRDDRLPVGLRPTRPXAQPDHRQQHSGSHPAQASRTSGGGQAQAPLAPAQPADHRPRPRPAVVSQGGTGRAAREDRGALGGERQARLPGQPRRDHRLGRAGTIGRDRLSDPGDQRGSRLHAGIAEAGLLRADRRRPPGGGGGLPPRHADGPTRDFQHHPARLPRRYR

SEQ ID NO: 21657 - protein, 192 aa, Pseudomonas aeruginosa
NQGTTMLKRLLIAACTLLFAGSLLAATPAAKPHVLIATSLGEIEVELDPAKAPISVKNFLEYVDSGYYDGTLFHRVIPGFMVQTGGFSAGMQEKKTRAPIKNEADNGLLNERGTLAMARTGVVDSATSQFFINLTDNDFLNHGARDFGYAVFGKVVRGMGVVDQIAKVPTTRRNGFADVPSDDVVILSAKRL

SEQ ID NO: 21658 - protein, 444 aa, Pseudomonas aeruginosa
RRAAQDPLPRMGRQHQQRLSGRHALSFRPPSGLAVGQQAVGLLGVGAHTRPLLFEELRHGIAQTGMRQVVPGARQHRLETADQLVFALGAGVEARQAGADGEFQALVEAGLEVQPVELGQASPVAPVQGISSDQAERHRHRLATLVGEDHADRLRHALGQQAEELAAQVGIAVAHQVGVGVAEIDEIPLQFGQLAAFPPFELDALSADLFALLAQLLALTRTEGLEEVLEVPIAAVVPVVLAPQAFEPTVTRGKQGVRPGVGEIHMDARQTARLGLLAKGREQPLQPFVLAQQARTGDRGEGHPYQQLRVVADTGPLAGVGPAPVEHVFAVRVRLHIGRQRRAQPPLRIAQHAMSRAPAGSGRHAVAVFQRGQESMTQEWLGGRQQGVPLGGVDIGKGGKRLDRHARQSGARRKASEAGRWKKSARRTRDETALHQAKASIHPT

SEQ ID NO: 21659 - protein, 633 aa, Pseudomonas aeruginosa
PWCSSGLQVELTGHALLELLHHMQAVAQHVAIVAAHAADVQALLATVALAGQLAGQAQLQEQLERLAQVVRQACFEDLVSLQRLDPCQGPAGLQAFAQGQGADAVDDGEDPAALEIEAGVLGFQLAEEGQRRIELQGRRRDIRQPALAAVGETAQLPTQRLEQLQVAGHRPGIGQDRQAQQLLRLALQQRPAQLRLPGHQRLAPFRPTGHHPSGTGRITELQQGRAEALHHRQGLFLRQIVGQDQGIVLVGLQQLLAASFAAHHQQAAAPAQGWRQQQFEKPFEQLLVERADQLHDEAQADTVAGQGSDQGVQGFRAAAQVAEVVGAGDAQRQDVGMGGEQAEHLGQVQQADHLTVLRDRDPLDTLARHEDHRVEQEIAQFDAGQRTMGQRPDSLQLAAPVAEVRAHEVGAGDDAELGPVPLQPHQQGIGAVAQLQARGVAEGQRGLHLQRRQQVLAGDAGKDELGKVLPVALGQLALGRQVGLEEPGETRVLPAQLVEATGRQFVDDAFLDRQVAMLAAAGKQPADVEQVVRGVLGEHSPVVAALLDHALEQDEQPGDRRTGLQQGFPRRVVAYAEGLLEGLALMGTQLVEGRRGEVETVRHGSSRCNRDAETKGGGPEIRPPPRATSSRSA

SEQ ID NO: 21660 - protein, 185 aa, Pseudomonas aeruginosa
MAFSWPRICTQMVGPRTIRPTAVIRPIQPPIMAPRVVSFFQYMESSSTGKLQLAAMEKARPTMKAMFCFSKRMPSTMATTPRATVVIFETRSSSFSLALPPLNTLAYRSWETAEAPARVSPATTARMVAKATAEMKPRNRLPPTASARCTAAMLLPPISAPVASLKSGLVLTSRIAPKPMMKVRM

SEQ ID NO: 21661 - protein, 518 aa, Pseudomonas aeruginosa
TAASIARPRARPECPSSALAPFRIELGFAWRAGLETPVRPQVLLGLLAHAALDPLVDPQAIGFLALAGEVLQRRVDGQAITAAIGQAALGERQHPRPAQAGELGGGGDGGRRDAEQRHEQALLGAVVLVRCVPDGAAATQHLEHRAHVLALDGGGIEVVPLAATALDVVEHRVVVLTVHAVDGVHLAEQRRADLQSGEMQGHEDHPLALRLGLAQMLQAFYMGKTGQARLRPPPAHGHLEKGDAAGGEVLLQQRLAFGGRTFPESTVRGCARQSRGASRPSGTSAPPGHGRASAGRDTATAPPARAVPGRTRAASSGDGGKRWRNGGDPWTVPTTIKARHSTLPAVPAGRRVADRCRPGYLPRLRASGVLVISPCNSTTDKPHEPSRPPRSRPRIPAQGQHARGDHPRTGAQRPGEARTATRRQSGASAQLLPRHPPGHGPRQAARRRRSPRPAGAPRGLSPPRPAHPGDPRRARGGHCRRPGPGPAGAAALGRPRTTAGHQGQRPAQACRRAQPERR

SEQ ID NO: 21662 - protein, 87 aa, Pseudomonas aeruginosa
SPSAWAVARPWKAASAWSARTPTAPACGSSRTRRSLATASSSSASKSMAAPSSPPGSTATCRWPGASPSAPMASWKAAWSTSARPSR

SEQ ID NO: 21663 - protein, 326 aa, Pseudomonas aeruginosa
EQVWAQAHGYRHEFGPGAGQVQGREGQRQRRHRRRRRRLRPHRRAAGRQPAVQAEHLGTDPGLGQGPGRPLGTRLHRDHRLHRQQTTGEGRTAQLGRPASGQVQGHHRRRQRCRPGGQWGARRGHRQRRRREEHQAGPGVLRQDRQAGPPVADQPGDRHPGKGRGRSRHRLGLQRPQLPPADRPGALRGADPLGRLGDLRLHHHHQQVRQAPERRQARPRVHLQRRRTDQPGQGQRATDPRREPDPAGRREGPTATQRAVRQGPADQGRQGLGGNLQAPAAAVAGSGDHQHAVTRSAAALPGGRPASTDTPNAPRRHPRPVGRPQP

SEQ ID NO: 21664 - protein, 485 aa, Pseudomonas aeruginosa
RHPAQRRGPPEPGTEPVPLRPRGRPEYRGSGLPLGQRTVQPRAVRPGPRPPHRRQRTADPARTLLLERPLSGLAPVRRRGKPAPPARTELHAGPLDEHRRRRAQARPRQPRLPQRRAARRRTAVGIPAPVAGGRLPGGDHRRSRNERGPQPRRHPRGGARGAAVRLRRRLQPRRPGATAADRPLRHALRNPRRRPRQTRLPGAARPMKRLSGKWLALLFLLPFAAFFVIFQIAPLAWVALNSLKASDAWSLANYLELFGSPFYRQAIRHSLEIAGWSSLLGLLIAVLGSHSLRHVDSRLRDFVMAFSNMTSNFAGVPLAFAFIILLGFNGALTLLLKQAGWIDDFNLYSKIGLIILYTYFQIPLGVMLLYPAFDALREDWRESAALLGANGWQYWRHIGIPVLTPALLGTFVILLANALGAYATVYSLTTGNFNVIPIRIGALVAGDVFPDPNMASALAMVLVGLMTLITLVHQWLLRRSYHVAR

SEQ ID NO: 21665 - protein, 593 aa, Pseudomonas aeruginosa
STSCRALPSPGGLRAVPDPGPAAGGDPALLAGHPVVGDPAAGRPDPEVVPDAVERPALPAGLRPLAAGLLRRPGVQRVADPAADVRHPLPLPAPGRRDKRAHPAALRGAADRLLGGPAATLCQRAAGNDRHALGAGRLLLHHRPAVHVPGDHQQPAGDQPARPDGRRPPARRQHLEGGAAGRAAEPAQGRDGGPAAVVLLPHRRIRLRQPAGRYPLRDPAGVPQQHAQQQRPLHQRSGGLLLRVRPGPDLGGQSTEQGQGLIMSFVSVEQLDKSYGATSIFRDIDFAAARGEFVTLLGPSGCGKSTLLRCIAGLTEVDSGRILIDGEDVVPLPPQKRGIAMVFQSYALFPNMTVQQNVAFGLRMQKVPAAELKQRVAEAIELVELGEYAARYPHQLSGGQCQRVALARSLVTRPRLLLLDEPLSALDARIRKHLREQIRRIQQELGLTTVFVTHDQEEALTLSDRIVLMNAGRIVQSGDAETLYTAPENAFAAGFIGNYNLLDAEQASRLLGQPCAQQVAIRPESLRLGNEPSEGVPALVRSHSLLGNVIRYRVEAAGVELTVDVLNRSADRLYPAGSQLTLVIDRNSIREVA

SEQ ID NO: 21666 - protein, 109 aa, Pseudomonas aeruginosa
SSPHPGCTWSSRSRRGSASTKSSPSISKCSTDNTPAAPSGTLTYREGKVLRLLDLLEGDDRQLADAWFYSDSRNDLPLLKLVGHPNTVNPDPTLLAYAKEMGWPVNTWR

SEQ ID NO: 21667 - protein, 983 aa, Pseudomonas aeruginosa
QLSQVQLRLAAAHQADDHPAPVAPQQLQVQPGIAGADRIEDHVERGEIAQRFQALLAQHAAGGAQGFAVGQAFGGTDADPAGVAERLAQLDAGRTDAAGAGVQQHFFAGLQRRQLEQVQPGRGVNLRNPRRLRQAQPCRDRQYVARVHHHFLGHAAAGEQRADPVADLPGAARAHLADHTRTLEPQRRAGAGWRRVKPGLLQQVGAVESGGRHADADFALTAGRGGDFRPLDTTFDTLQCVHAASIVGLSRPDHPESGFLHCAKGTRRRLIRPNMRHYSAISRISMKRFLPRTALLLLLGASSLPLFASTAVSVGSAQNSWDSLQPDREQVIASLNVVELLKRHHYNKPPLNDERSAKIYDSYLKMLDPARMYFTAGDIAEFDRWRNRFDDFLKSGDLDPGFVIYKRHLDRLKGRLDYALAMLDKGVDKIDFSVDESLLIDREKAPWAKDTAELDDLWRKKVKDEVLRLKITGKDDKAIQEQLTKRYKNQLSRLKQTRSEDIFQAYINAFAQSYDPHTQYLSPDNAENFDINMSLSLEGIGAVLQSDNDYVKVVRLVPAGPAAKSKQIATSDKIIGVAQGKGEMVDVVGWRLDEVVKLIRGPKGSQVRLEVIPASNAPNDQTSKIVAITREAVKLEDQAAKKSIIKVDHEGRSYKLGVIDLPAFYLDFKAYRAGDPNYKSTTRDVKKLVAELQKDKVDGIVLDLRNNGGGSLQEATELTGLFIDQGPTVLVRNSDGRVDVLNDDEGKAFYTGPLAVLVNRLSASASEIFAGAMQDYHRALILGGQTFGKGTVQTIQPLNHGELKLTLAKFYRVSGQSTQHQGVIPDISYPSIVDDKEIGESALPDSMPWDTIRPVVKDEANPFKPFLAQLKAQHDARTENNADFVYARERLALAQELMKEKTVSLNEAKRRAQQTSIENRQLAMENALRKSKGQEPLKELKREDENALPEEDDKTKPQDDAYLTESGHILLDYLNLNSAVAKH

SEQ ID NO: 21668 - protein, 234 aa, Pseudomonas aeruginosa
DGGLQGDRHECPSDHARRRGGIRGVALGRIPGVAGRRWSPGRQCRGGDDRAGAAFREPAGAPRGARPEPGTGGPGGRYQSFLHGDDRTRRTRGQRGHPVRPGACAGQSDGGLTLSVLISRKHWDSLLLEIEDARRQRHLLTYRALIERLQLPTPAMTTLTAALEHLASLDARSGRPLRSSLVISQGASRLPRTGFFECVERLGRFSGPPDGPAAAGWHAAEVVRVFEFEYPDEL

SEQ ID NO: 21669 - protein, 170 aa, Pseudomonas aeruginosa
MDLAPARPPRLRRGPAVAGLALAGQAAASLAVDAGAVLAHGQPRTPRRPGVLRSPAAVPWTGLRRARGGPAPAAPGCQRGRWESGLPARRAGAQGRQPASARRAGSQPPLGASGRGGPPAGGAQAGGTLPRWRPGPGAGQRARRALCATGVRARSIAERTVQAVSIRCRL

SEQ ID NO: 21670 - protein, 287 aa, Pseudomonas aeruginosa
ALLAGAGFPWRNAKSPTLGDRAVTTPLWRQRERIARYRRSCRVVGNRRPVLRSGRNPHPRGGRRTQPRRPVAEGRALPAATRRQPGAGARVCGCGQRGGRGQHLAGRRPGLRAARRRRHGRGSGGGRAPRTAGPGRAEPGGGGGDSGGLRHGLAEPVPVGGVAARRKSAAARRRQRRRFGRHPIVQGVRQPLLGQRRFRRTPGLLRIPGRRRRRAAQAEPGIAARFRPVRRDPRSGRRPLCRVEPGVAAARRALGDHRPDGRPRGATGPGSTARQTHPVDRLDPAYP

SEQ ID NO: 21671 - protein, 278 aa, Pseudomonas aeruginosa
SGLVLVQSIGRPGQDQDEHEVGDHHCAGVVAAAVAHVVEEHLQGLVAGTDQQVGEDEFADEEGERQQQGHHHALAQVRQHDQQRRLPGAGAEQVGGVHQVAQVDRLQVVGDRPVHERQGDGEVAADQHPGRADHFQRPAGIELQQAHRGDDRRHREGQQDEHVYHAVQAREVVVDDEHQRQDQQHAERQGAEADQQRAGEGQQEALVAPQRQVPLQGQAVRQQGRRPLGGQRVEQGRRQRQDQDQEQRADHQAMVERGRTSISARHGSSCAAAIGGPG

SEQ ID NO: 21672 - protein, 401 aa, Pseudomonas aeruginosa
AGRAGSTSRRSPGCGGSPGGRRASRTARGSWPGSRRRWPSGCSARPRPAALSGKSRRTPRRAAGTAAPAICRRVVSWGEQLPADGFVVGGAEDFAERAAEVGLQRLRQVVAAEGVAEDEQRHLALLLEDAAVAAVLVHSVIGGDRHLVAGRQPLVQVFRQQCVGAPRGVAVGGAGEAVPVPGVVDVHRVDQHEVRCVPAAQAFRVGEQVRVRIVVAPVEVSALDRQCAVVGVAVAGRVERRAVVQFADPVVGRCRGTQAGRAGVVEQALFLAQADHVVVQDAAIDRRHSGEDAFVERPGQRRQLAFQAVRLAAAGAAEGLEMPHAVAGDAMVEAVQQDEDDVVAHSGYPSMRGGRRGGRPRSASLHVDDHRFLPLPRQALGGFLPGLGVLDRLGLGVLLVG

SEQ ID NO: 21673 - protein, 293 aa, Pseudomonas aeruginosa
ALDSMGAGRLREDRCLVPVTSRSSGFPSIGRAGGTGRAGGNAPCWGWTRPIRKLSMRDEALPTVTAICRALSEQIGHGLLPAGGKLPAERKLSELFATTRITLREALIQLESQGLIYREERRGWFVSPERLAYNPLVRSHFHAMVSEQGRVPATEVLSARQMPASAAVCELLELPALSSVYQIRRARRVDGRLVLYVEHYLNAQYFPGILGHDLTRSLTELYASEYGIHYGRVRFDMVPTALHAEAAAPLKVAVGSPALRISRINRDQRGRLIDCDLEFWRHDAIHISVEVPQ

SEQ ID NO: 21674 - protein, 159 aa, Pseudomonas aeruginosa
SSSEPSMDRPRFSSAFLHPRYWPLWFGLGLLWLVVQLPYPVLLMLGRGLGALMYRLVGSRREIAARNLELCFREKCARRTRASAEGELRLQRHRLFRDGHELVVAEGAPGPSCPYRRPGASARGPGAGRGGDPHGPAFHHSGDRRGAARPGAHHRRHVP

SEQ ID NO: 21675 - protein, 130 aa, Pseudomonas aeruginosa
SRLERLHQRPTVDIDDIPRHPAVRIKTMNDSIYQRIDTNPRFKELVAKRERFAWILSSIMLGLYVIFILLIAFQPQLLGARISPDSSVTWGIPMGVGLILAAFILTGLYVRRANGEFDSLNQEILKEAQQ

SEQ ID NO: 21676 - protein, 804 aa, Pseudomonas aeruginosa
QFQLRLAALRPVASPSARDPQAGPQRRLLRAGGNLAGGRFGGPRAVRPAQGRGRGARRRRASVRPVRRGRPVRRPRAVFRQQQASLPGDRGKHRLRTAGQLLPPVVRGEPGFRPVLPGRPGGQAPVGPARRAEPCRVHPYPHRPRALAAGAGGGGLAVPRRRRAPAIEPRRRCPAGAAGEGRARARHRHPHRPHERALPRRAQRAGGYRAVGPWSAGQRRTGRFPVRRDDPHDAPAYRAGRGHGGRSGDRPVAPDPGAQPVLHPFPRPGAAHRPRRRPRRPAPLRGNPGHPDRYPGRQRYPPALHHAAGQRAQRAIARTAFRIVAAANPARALLLAGDGQRRTRRAVAEDRPGQCPGPGRRSAAGTGPGDDAALQRGLAGVRLSALSRRGDGQSAGMVQAAGGLAGGAARDAAGGQAGAAVAPVDPGRCLAGGRQPAAVRAVASATARFRRRRRALAGGYRGGGPAIRYAADLPRPAENPGRPPRSQARRDLPHRPRHPHPGPARRPGDPRDPGTDRGAEATQGPRSTPGGRPERVFRAVPATAPDPPVGRPTRRSPAGPGRQRHEPPRSRHAALRPACGEEVQAERGPSIPPGDPMNTMVKLPDSRWPGWRRRLYWWMHEAVEAEEVISLDLETTSLDPRRADILSIGAVLVRRGKLVMGERLELYVEPPPSLDAESIRIHKLRRADLEGQLQLEQALRQVLAFIGDRPLLGYYLSFDVAVLNRHLRQLLDRQLHNPSIEISSLYHRKVSRHFPDAHIDLRFDTLARALDVPVSGRHTALGDAQAVALMFMRLLKGPAPKVIH

SEQ ID NO: 21677 - protein, 80 aa, Pseudomonas aeruginosa
IFVARRGSRTTRAESPALCPMSRTGATPMSLGTILLIILILLLIGGLPVFPHSRNWGYGPSGIIGALLVVLLVLLLLGMI

SEQ ID NO: 21678 - protein, 136 aa, Pseudomonas aeruginosa
RPPWASNSACVPLSAMWPLSSTTRRSMRAMVDRRWAMAITVLPCIRVSRLSWIADSTSESSAEVASSRIRIGASLSSTRAMAMRWRWPPESFTPRSPTWASKPRRPSASLSSGMNSSARALRTASMSSASLAPGRP

SEQ ID NO: 21679 - protein, 127 aa, Pseudomonas aeruginosa
RTGCRGFQGVAIFPSVATGSPAMKRLCCFALSLLPLSAFAYPIEVDPQLNGTEVSYSTQDIGRDMGAILLTNLGGQAAECTAVFRNGPETPKVRKGVIQPGQNSNFTAQFGRDIIKLRIKLTCKIAK

SEQ ID NO: 21680 - protein, 527 aa, Pseudomonas aeruginosa
RIPAPLFEPDPRQHPPGRRGGAQYRRRPQAAGDTRRPVRRDHPLPPLAGVPRRFRLRVHPAPQPLAEPLAAALGLRLLVAVGVPQAQGQDRGELHQRLRGSHRPRVPQARARRGGLRAHPPCRDPPHRGRRLPQLRRLGGVLHGADRTLGRQHPALPPGRGAGAAGGAGRGGRAGGMRLLIVSDAWLPQVNGVVTSLLALQRELELLGHQVRVLSPADFRCLPCPSYPEIPLAWNLWRLGGLIEAFAPDAVHLATEGPLGWATRRWLGKRGLDFTSAIHTRFPEYLRDRCPWLPLSWGYAFLRTFHRPSRAVLVSTPRLRDEFCAWRFQHLRLWRKGVDTELFHPAETPPAKERPPVFLYVGRLATEKNLEAFLDLELPGEKWLVGDGPQRAALEQRYPQARFLGYRHGRALADAYRAASVLVFPSLTDTYGLVMLEALACGVPVAAFAVPGPLDVLQQGVTGVMHEDLGEACRQALALDRQACGRWAREQSWRVSAEEFLALQASGPRTAPEWRDELPAAFDELRG

SEQ ID NO: 21681 - protein, 168 aa, Pseudomonas aeruginosa
LNLPSEPDLASHRPKSRAAPITITLNRPINTWWARVSISVILRHGGGLVGGAPARPVEVFADPGVVGGGDPFQGIDYQDLLLRQHGDPVADGVQGVQVMGDQEHGQAEGVAQGTDQVVEGRRADRVEAGGGLVEEQDVRVQRQGAGQGGALDHAAGKRGRILVAGVGR

SEQ ID NO: 21682 - protein, 309 aa, Pseudomonas aeruginosa
PGQGQLDLGQVLGVGARQAGVLDQRQGDVLHHGKRGKQRALLEQHAEAPFDQGAALLWQLQQVFAEHPHAAGGRPAQADDAAQQHRLAGAGAADHAEDLAATDVEVEVLVDHLGAETVAQVADLDDRLRVVLVHQPISMKNSAARASSRITTKIEWTTLVVVCSPTDWALPLTLKPSRQPITAIRKANSGALLIPTRKCCTPIPSSMIDRNIAGGMSRVQAQTVMPPTMPQSMPTKVSIGSDTSSASTRGSTSSSMGLRPRARIASISSLAFIEPICAVKALAVRPAMRIAVSSTANSRRKENTTRLTV

SEQ ID NO: 21683 - protein, 155 aa, Pseudomonas aeruginosa
ICRCTPLHSCREIARISLRPPALAGFSGVLPTMSTDNPCLTCGACCAHFRVSFYWGECRSAGGVVPDELTVRISPQMVAMSGTENKPARCVGLLGEVGCGVRCTVYEQRSSTCREFEAAWANGQPNPACDAARAAYGLPPLTPPLQPHLAPGRVA

SEQ ID NO: 21684 - protein, 137 aa, Pseudomonas aeruginosa
SPALLARTSRGWPTGLKRTALRSRLSTARSNMSGQPSMLRSGATSRRISCSGASSRASSRSRWSSGSRAIRWLAPGSASSRARARISPISASRRSHSCSRRGHICARASGSARSARARAMRRRASGERSSWDTSRSN

SEQ ID NO: 21685 - protein, 222 aa, Pseudomonas aeruginosa
SSAPSSRPRMRSSGSPRADSISTGRSGWSPRSCLSSSRPLPSGSITSSTTASGVCSARARRAWAPSWLARTEKPSWTSQVPSSSQSSRSSSINSSSLIECRSIDPFASLSPAAAAQGTEDEREQGRGGAGDIPGLLFREQRRLPLRLGRLQLLAQLAVLLAHTTDQFVALAFRFHQAALQFGGSLRNGRLRRLESVPARVPRPGPGKLPGSAAGNGQRMDAS

SEQ ID NO: 21686 - protein, 398 aa, Pseudomonas aeruginosa
PAKRRKAKPWRKPWETISSERAAGRSSSCGRSPFPSFRLRSLPWPVKLHARFRYLSLFLAPVSVATMNLSDPHELATLLEGILLAAGKPLSLERLAELFDEAERPEPGQFRDALAILALSCAGRSFELKEVASGYRLQIRERFSPWVGRLWEERPQRYSRALLETLVLIAYRQPITRGEIEEIRGVAVNTQIVKTLMEREWIRIVGYREVPGRPAMLATTKAFLDYFNLKSLDELPPLSALREMEPEPEPPVEVAPAAQPPRDDLDEDAIPASIQALADRAIAEAGESLEEIEGEAGEPEKPREETSFRSLLLELDEMEQGLKTDFDDLLDPPEPSEQGDESAEPAAGPIPVVAEQAVEPAVAEAVAGADPDDEERALAEAMREEREALDADDDWPRR

SEQ ID NO: 21687 - protein, 650 aa, Pseudomonas aeruginosa
SVGESAMHPRVLEVTRRIQARSAATRQRYLEMVRAAASKGPHRGTLPCGNLAHGVAACGESDKQTLRLMNQANVAIVSAYNDMLSAHQPFERFPGLIKQALHEIGSVGQFAGGVPAMCDGVTQGEPGMELSLASRDVIAMSTAIALSHNMFDAALCLGVCDKIVPGLLIGSLRFGHLPTVFVPAGPMPTGISNKEKAAVRQLFAEGKATREELLASEMASYHAPGTCTFYGAANTNQLLVEVMGPPLPGASFVNPNTPLRDELTREAARQASRLTPENGNYVPMAEIVDEKAIVNSVVALLATGGSTNHTLHLLAIAQAAGIQLTWQDMSELSHVVPTLARIYPNGQADINHFQAAGGMSFLIRQLLDGGLLHEDVQTVAGPGLRRYTREPFLEDGRLVWREGPERSLDEAILRPLDKPFSAEGGLRLMEGNLGRGVMKVSAVAPEHQVVEAPVRIFHDQASLAAAFKAGELERDLVAVVRFQGPRANGMPELHKLTPFLGVLQDRGFKVALVTDGRMSGASGKVPAAIHVSPEAIAGGPLARLRDGDRVRVDGVNGELRVLVHDAEWQARSLEPAPHDGNLGCGRELFAFMRNAMSSAEEGACTFTESINGLALILIGRYPPGAWLAAVSPATSADRPALARGIAVQRR

SEQ ID NO: 21688 - protein, 168 aa, Pseudomonas aeruginosa
SSVPAPALASAACCRWAGDVGKCCPARAGTSTCRSLRRATSRSGRACRRATDMSPPSAHCPATACSPSMKSAVPWTGSPYARAVRRKSVPWPWPATPRRTPCWSTSSCGWRGSPATRCSPSARSVASTLPAASSRVSSSVSSPAASPRPSPAVARLAALTCRTYRYGS

SEQ ID NO: 21689 - protein, 276 aa, Pseudomonas aeruginosa
PPNIRACSAPGSPCSRPWTSRAESASSNRIRRSLVSANGRSILLVDDDQEIRELLETYLSRAGFQVRSVSRGADFRQALCEEEASLAILDVMLPDEDGFSLCRWIRSHQRLACMPIIMLTASSDEADRVIGLELGADDYLGKPFSPRELLARIKALLRRAQFTQVRGGDVLAFEDWRLDTVSHRLFHEDGEEFFLSGADFALLKLFLDHPQQILDRDTIANATRGREVLPLERIVDMAVSRLRQRLRDTGKAPRLIQTVRGSGYLLAAQVRPHLQP

SEQ ID NO: 21690 - protein, 473 aa, Pseudomonas aeruginosa
QEEGFPHECDPSPLCRHLSFLPLSLPTAGPGRRSRSAALVDLRRREARRRNPEEAGRSQGPHLEGLRRGRRWRRGGDDRAEDPRGVRQSAGRGADQGAGYPGVGRTGPARRPQRGGRRRQVGQPAAEAGGADHEVRRRLRSSADQRTPGELALHQPGSVQEGRRHPADHPRRTVRRRRQAQGRRFHAAGPWQPTVAGRHRVREPGAEQDGSGRLSQGLRRTGQGDPHRSADGRGVRRAEEAPRLCRCRRRRSRMERRHGDGDQRQGRDADHGRLGEERVHRRRQGAGQGLPVPAVPRHAESLRLQHRLAGDVQAEQRGEPQGPGRPGAQRARPVLPEGLQPQQGLHPGSPGRRHGAVRQLRPAVDEGLQAGFPGRQPGAEHGPQHGRFQLRAGGDLRRGDQLLQRPRRGSAEGRPATGGRHRGGGAVSPWRGSRPGLRSILPTGSVPPSGTGGFLRTRENAWRPIPLSIPRLR

SEQ ID NO: 21691 - protein, 302 aa, Pseudomonas aeruginosa
CSALYWRSWCLTCIPNCEASAMRDASLNPSFSVSRLAVHLTLWGACALYLVPLLVMLLTSFKTPDDIRTGNLLSLPDTFTVIGWLKAWDSVGAFFWNSVLITVPGVLISTFIGALNGYVLSMWRFRGSQLFFGALLFGCFLPFQVILLPMSFTLGKLGLANTTSGLVLVHVIYGLAFTTLFFRNYFVAIPDALVKAARLDGAGFFTIFLRILLPMSTPIVMVCLIWQFTQIWNDFLFGVVFASGDSQPITVALNNLVNITTGVKEYNVDMAAAMIAALPTLVVYVLAGKYFVRGLTAGAVKG

SEQ ID NO: 21692 - protein, 294 aa, Pseudomonas aeruginosa
TTTTRTLEMYKNKKTRPAARTVGCLFALGALGLGSAAHAAEAFSPNSKWMLGDWGGKRTELLEKGYDFKLEYVGEAAANLDGGYDDDKTGRYTDQFALGVHMDLEKILGWKATEFQFTVTERNGKNLSNDRIGDPRAGHISSVQEVWGRGQTWRLTQLWLKQQYFDGALDVKFGRFGEGEDFNSFPCDFQNLAFCGSQVGNWAGSIWYNWPVSQWALRVKYNFAPDWYVQVGAYEQNPSNLETGNGFKMSGSGTKGALLPVELIWQPKVGAEQLPGEYRLGYYYSTAKADDVYD

SEQ ID NO: 21693 - protein, 157 aa, Pseudomonas aeruginosa
PGEPRRQALERGGRMDAPRGFSRYLGIAERFLARGRVPALLIAVARKRSRLKLVKSDLRLLQELLVAWVRGEYRGLSRQALLSVIAALAYFLSPVDIVPDFIFGVGLLDDLAVLAWVVRRWQAELDAFKVWRDAQGVETQQALRELPAPRAERVQGS

SEQ ID NO: 21694 - protein, 121 aa, Pseudomonas aeruginosa
PVRSGAVPDKMAACKETDMNVQVITRDGEAEYAVLPWAEYQALLAAAGRPAASVAVETTAPAPPSASLLERREARGLSLEQVAREVGISPSYMAMIERGEREASEAILFALERVLGKATGA

SEQ ID NO: 21695 - protein, 234 aa, Pseudomonas aeruginosa
PPSQRLSSTWHRWMRARGVRCAVRWSSARAQAACRAPVSSSAWSASGVFPVRRTARPRLAGMRRKWSVSSNSSIPMNSEWIWRLRARLGYGVARQLLGWPWLVKQPRAWQWMQGQFSRMANLGHRDAQAFYGHLLLFRGQGFGAREEGLRLLRLAASAGDGKAAYQLGVQALKGDSRQAPDALAASRHWAQAAEAGHPLAARKLAELYRDGGPGLAPDSERAEHYAQRASALGL

SEQ ID NO: 21696 - protein, 748 aa, Pseudomonas aeruginosa
RSWNALVAMKKGRLCNRPRISRQSHDCFMTLPLNSVLGHRRVEVQVVQQDVPGLGEVGVVLRLGLVVLFRQGVLVLALEFLQRLLALGLAQGVLHGQLAVLDAGLLGAALGLVQADGLLLHQLLGQRQALAGVDEVGVVLGARVVLGLELREERLERVGLVLHHRADGVPGHRVGQGAFADFLVVDDGRVADVRDHALVLGALTGDSVELRQGQLQFAVVERLDGLHGALAEGLSTEDQRAVVVLHGAGEDLRGGGRETVDQYRQRAGIEGLAFVVVEHVDAAVAVAHQYGRALVDEQAGQLGGLLQGAAAVVAQVEDDAVDLVLLQFGDQLLHVAGGALVVRVAGAVGLEVQVEGRQVDHAELVAAAFVVDLDDGFLRRLVLQLHRLAGDGDDLAGLVVRRVARRNHFQAYLGTFRPTDQLDHFIQAPADHVDHFALALGDADDLVGGGDLLALRRRAGRHQAYDLDVVVVALQHRADAFQREAHVDVEVFRVVRRQVLGVRIVGLGEGVDVGLEDVFAAGLLEARQLVLVALGELFLDRLVVLAGDLQAQDLVLHLLAPEVVELCGVLRPGGLFAVDQQALVDAEVDLVDALVEHRQGIVEPTFQAVEVALVDDEAGIEVAALEEVVEPVAPAIELGDVAGGEVHPRRIEHLQVAVVDLGRAFIVQRRLVVVVPLEQFHDVEAGDDLLAVRLQAVPGILGAADGDGGRGEQRQRTGAEEEQQGGTGQKTLHADSTDRGVMTHIRPY

SEQ ID NO: 21697 - protein, 327 aa, Pseudomonas aeruginosa
QPHYGGSVNALQGIEGRVEWSEIAAPSCGQGEIRIRVAAAGLNRADLLQKAGLYPPPPGASPALGLECAGVVSEVGAGSTWQVGDRVCALLAGGGMAEEVVVDARHVLPVPAGLSLAEAAGIPEVYATAWLNLFQLAALQPGEKVLLHAGASGVGSAGIQLCKAFGNPCWVSVGSAERLAYCESLGAAGGVLRKQSLESLRDFAPFDVILDPVGARYAGLNLELLRRDGRWVIIGLMGGREAQLDLAQLLGKRIQLTGSTLRTRDAEFKAQLIAELGLKVWPLFSAGKLRAQLERTFPIGDAEAAFEALASNQVQGKVVLVVDPSLA

SEQ ID NO: 21698 - protein, 435 aa, Pseudomonas aeruginosa
PPRRRPPLPARLPRRCDRSAVAGCSPCTGPWTACLRRTAPSVRRRGGRRIRRPSRDSPCAGSTGWSSRSGSWSRPGRRSPGSSSYLSNTVAIDDQRQLTAGRIQAVCAAVEDVDGEFHPGGLDAVTDHVAEQTVRAYQRRHAFARFVAQAQGFRADRHLLRAGLAEQAAGLFGVEQVVVADEAGGEGVFRRGVEGLRVAALDDASGVHQDDAVGQGQRFLLVMGDEHRGQPQLLLDAANLFAQVLADARVEGRQRLVEQQQARARHQRAGQRHALALAAGELVRVACGVLAQFHQFDGFGDPLLQFRRRHLLHAQAEGDVLLHGHVGEQRVALEHHGDPALLRRQRHHILAVDEDAPAVDLGQPGDAAQQGGLAAAAGAEQGDELAAGGGEVDIAEDAGGTVALVELFDADERHDQALSLFSRLAAQVRTRTNTK

SEQ ID NO: 21699 - protein, 349 aa, Pseudomonas aeruginosa
SAAGRRSARDMVAPAQQPLVDQGDQGHQADQHHGQGAGHVRVGEHVAGDQRADADRDHVEVAGGQRVHRGVGAEGVGQEDDEGTQQRRGQHRDADVSPVLPAVGAEQRGGLAPVLAQGVEGRVEQHHPEGDLEIGVEDYQADLRVEIEVVDPAGLLEQQGQRAVEAEQDDEGERQRYPGEVAGHVGEGHDEVAQAAVDVAQRMAAEHRDEQAEQARPAGDLQAVADRLAVEGRAEQLEVVGQAPGVAGLQAVQRDPGQRRYLENHEERREGQQEQQRQPFAGESFHGASSSRQTGLSWAAPRISQSVPQRSVCSGCARSSRLKASPKTNSGTSRSSSRMPPWLRSSFIP

SEQ ID NO: 21700 - protein, 266 aa, Pseudomonas aeruginosa
CTAWSARAARLPRATSNCAFGKSAPAEREPLLKENFASSGIAFFEMAMSWWWPKARLARLAHIEGLEHLREAQAQGEGVILMALHFTTLEIGAALLGQVHTIDGMYREHDNPVFDYVQRRGRERHNLDATAIEREDVRSMLKVLRGGRAIWYAPDQDYGAKQSLFVPLFGIPAATVTATTKFARLGRARVLPFTQSRLADGSGYRLTIHPPLEDFPGESEEADCLRINQWVERCVRQQPEQYLWAHRRFKTRPPGEAKLYPKRRKR

SEQ ID NO: 21701 - protein, 412 aa, Pseudomonas aeruginosa
AGFFRDSCGGAPAPVARGGGDRVRLRVGAGGDLLPGARDHRSLGTPSAPGHSHPPGASAPAGQRGDPAAVPAGADQPRILRRRRGAFPGAHQPGVAPGRHAGAGDRRQRQPGHRWRQCHDRPAAVRPTAEPGADRRPPVEQHLHRQPGRRHRAVAADEPDRPVGGAGGAPPGGWAGAGGGIAGVAEPAAGRDRRAALPGAVAGAAAFPARSRSDPRQRGGGIELPVVRARLLQRTDRTGLPRCDGQAGGTGALPADRAVNLIQDGTGGRKKPPRRAARARLRRPGHRRDSRVAPARFPRGCSSRTDRTGRSARATACRRAPVPGRRLRCAGSVPLLRTAEPGDWWRFPPGVRLPPSGCLRRRTAARDGRPAGAGRCGRRQAVAGRSSAARCPAFPRRRSAAPGRRRSDRRSP

SEQ ID NO: 21702 - protein, 395 aa, Pseudomonas aeruginosa
TRKSSRRRSNDRSSPCRARPCGLRSGPLGRRADRRRAAPAAERLGHRHVRRLRRRDPLHHLLGIQAQPLGGRLLCRRRPHHRLPEWPGDRRRLHVGGILPGYFGAGLHFRLRRPDLLDRLPGRLADHPLPHRRAPAQPGQVHLRRRRLLPPQAEADPHPVGLRLAGGGGVLPDRADGRRRQADRAAVRPQLPCRGGPGGHPDGALRAVRRHAGDHLGADHQGRAVAFRRLVHGDHGAQARQLRRQHAVLRSHQGASEGRGDHESGRPGQGSDLGILPGLRADVRHRRAAAHPDALLHRQRRQGSAQERVLRHRFHRLLLHPDLHHRFRRDPAGQHQPGLQGRHRRADRRQQHGGGAPGRRGGRQPVPRLHLGGGLRHHPRGGRRADPGRGLGRLP

SEQ ID NO: 21703 - protein, 600 aa, Pseudomonas aeruginosa
AMPDSFNFASPPFDQLRPHQRETLKQALSVGYYAPGETLLEAGSAVPGLFVLLKGVVEERGDDGRVFAQYAADDLFDVRGLFSGSSKHRYLAIEESIVYELPASCFHQLCGENPGFARFFQADLAAKRQLAQRDGQNLAEFILTRIAREHLLPALEVEASLSLGDAARLQLSHGADALLVRLERDGPELGIVTRTDLMSAHFRDGRSELEAIGPLAHGPLASVELGDFLFDAMILMTRQRIERVAVTEDGQVIGLLHLTQVLSLFSTHSHVLALRIARADDLGDLRRCAETLDTLIATLAGNGIRLRFIMQLVSALNEQLLERLFELLLPPTLRGRCCLLVMGSEGRGEQLLKTDQDNALVLADDLPQEQALAMMQRFSAALLEFGYPPCPGGVMASRPEWCKPLVAWQAELRGTLLEGKPEQLLRLSILADAWPVAGNLQLFEPLRRQLRGFADGGERWLADIAAAALQFDTPLTFLGQLKTQDARLDLKRGGIFPIVHGIRTLALREGLETRGTLARIEALKRHKVLEARLADDLSESFELFLQLRLTRQLAGQRDGRQQGLDVSGMSRHDRDMLRYGLHVVKKFKQSVARQFHLETR

SEQ ID NO: 21704 - protein, 462 aa, Pseudomonas aeruginosa
SRARSGMPSRRVSADNASGVIRPTRRVPSFRSAVAAGYRRITPLALCALRRMDRSLRLVKGGFIAGPPGAFFPSTGFTCLASRARLARMPIQTLATLADIDAAEWDALLPPAQPFLRHAFLSALEDSHSVTPATGWRPAHRVLRDPQGRLCAALPAYVKAHSYGEYVFDWSWADACQRAGVRYYPKLLVGVPFTPVAGARLLGEDEGLQGLLASLGEEAEASGLSSIHVNFTDARADTLLAARDGWLERLGCQYHWHNRGYRDFQDFLEALSSRKRKQLRKEREQVGGQGIEFEWREGGQLSELEWDFVYLCYANTYLVRDRDPYLSREFFGLLAERMPEAIRVVFAHQRGKPVAMAFSLVAGDTLYGRYWGCLAEFDRLHFETCFYQGLEFAIGAGLARFDAGAQGEHKLIRGFEPVLTRSWHYLAHPGLRDAVAQFLEQERAGVRAYAEEAHGLLPYRQA

SEQ ID NO: 21705 - protein, 253 aa, Pseudomonas aeruginosa
WLSSGAGPSWARRIKPLRLDSEAFGGQDHHVVARHVGEAVAAGGGNLGDLVDHAHATHHLAEHGIAEVAGTMVEEVVVGQVDEELAGGRIDHSGTGHGEGAALVKQAVVGLVLDRCTGLLLLHAGAEAAGLHHEARDHAVEQGAVVVAAVDVLEEVLHADRRLGRIEFYLDLAEAGGDQDVRLGGRSGGQQGTGEEQGAGGDQETFEHGCSLVLSISARKPSRVVLKISGWSIGVAWRESSTTTRRASAIRSQ

SEQ ID NO: 21706 - protein, 348 aa, Pseudomonas aeruginosa
FADREWQQAQGDYQVLPERRLHRADLPAVATVGQRQQGEQQAGKDRPEQAEGGAAGEVEVRRDQHQAKADQDHQQSFREMNALAEEQPFEDYREGREAGEAEGGDGHAGGLHGDEETHPVAGQEQAAERQAQPLRGSQGAPGLAREAGEEAEGEHREQRTTEHDHPGGGAGQLAEHPGQAEEEGAAVQGGEGGTSIHGDPSGQARTVGQGLVEAGQDHLVLAIVDPGDQDLRAHPGDLLRSEVADAEDLASDQLLGLVVCGQLRAGGAQAERSEVDLEDIGGFACLGVGSGAEDGADAQFDAFEILPFDDVHADSCSVDGQRVRSRDGFVCRAASRFCRGTRDAVVAG

SEQ ID NO: 21707 - protein, 112 aa, Pseudomonas aeruginosa
RRSARRSRPGRRSRPPPGCSPATVRGPGAGVGCARSPWASVRSRRGTGCGSAPPKDRPAAPGRLPVADGRHGGRGRRRGWPVAGGAAGAAAGARWPGWRGAGRRPGGRSPGR

SEQ ID NO: 21708 - protein, 346 aa, Pseudomonas aeruginosa
GPGPIGHGHGCGRSGRGCSGAGKGSNPWRSSRRQAPSLPAGAGDRQPGPVTQRSPACHSRFTGAGQDRKNTVGDPPMSTAQRFTSNRKQRVRTLWISDVHLGTRDCQAEHLAAFLKRYHADRIYLVGDIIDGWKLRGGIYWPQAHTNVIRRLLTLSKRGTEVIYVTGNHDEFLRRYSSLILGNIRLVDEAVHSTADGRKLLVIHGDQFDVITRYHRWLAFLGDSAYEFTLLLNRWLNHWRRRWGYGYWSLSAYLKHKVKTAVNFISDFEEAIAHECHKRGLDGVVCGHIHHAEIRRIEGVDYLNCGDWVESCTALIEHWDGSIQLYRLAEEQARLAAQAAAVEPAA

SEQ ID NO: 21709 - protein, 509 aa, Pseudomonas aeruginosa
PLLAGHGVEEHRQHQQAADVVQAAAHRVAVFLQVVGVELGETVETLVIRAAHGMPPLVVSAQCNAGRTMSRMTYRASLVSLGRQAGRRSACLPPEQEETDAGTYNLVQLGPGHHPRPGAGRPRRTPAVRRAGPRLPGLAGPRRALPAGRHEPSVAACGGAQRQPGDRPEHRPGPAPGFPRRRLCADVEPQPGGRLRAPGALPADHRGSVRPDFPPHAAGLSNRRHGAWRSPAGATAECRMLAGLPGGHGPLDHRPVAGPAGGGTARRAPRAAGTLCRAVPRAAALSRRGVRAGVFPRRPRDAATLGQRGAGPVARSLRRRIPGAFQYQPHYPSDPADLVPAAAAGRTQARTGGPGAAPVAAHLATAPPGRRHQLPATARRHAPGYGRTVSPAARPDLAGSRLPAGFRRSEQFLPGIPPLVRLHAQRIPGAPPGAPGLVARPGGTLQGCTAGCAEAWRRVQSRTWADSVSPALPKALTTAATFLPSTGWLTSKRRLATTRLSSVRTRRAS

SEQ ID NO: 21710 - protein, 267 aa, Pseudomonas aeruginosa
FSGTAAAWWAARPRGPWKYSRTQASSVAATRSRVSTTRTFFCDSTATRSQMVYRVSRSWVTRNTVRPRASRRVRIRLSKAAAPIGSRPAVGSSRNRMSGSSARARARAARLIMPPESEAGYLSPALAGSPARASLTWARCSASARGRPAFSISGRATFSTTVSEENSAPCWNSTPKRRSTRERRSSGSCSRSSPNTRTLPEVGRRRPTMLRSSTDLPVPEPPTTPRISPRRTSRSRCSWTTWAPKRLHRSRTWMIACGLSWFTSPSP

SEQ ID NO: 21711 - protein, 222 aa, Pseudomonas aeruginosa
PRRCSRTWRRDGSPESGREPGDCVYNGDFVSDRSSPMEALDALLTRVSHARLSDPAPSPEQLDRLFRVALRAPDHGQLRPWRFILVEGEGRRALGDLYARALASRQPDAAEEALAKARNMPLRAPLLVVAVACLQDHPKVPHAEQLLAAGCAAHGLVLGAYAQGLGAMWRTGEMATDPVVHAGLGLGEQERIIGFVYLGTPMGELRTPAELDPSAFVSAWPG

SEQ ID NO: 21712 - protein, 193 aa, Pseudomonas aeruginosa
AVPGRYRPAASRRAPRHPVSARRGRDGPGRRRGWHARRNLPGPARYRAARRAPGHRRSTAVRSSSVAQLIHSRRCRRRPRLRAPRTNASRAVAAPATYQVCSSVSSGGCRCAWAACSCSRNWRFSWRIRLTSSSRWRSVSTRRRSSSAVACVMEGCAGWNPCRRGFLGQGQGSSQAQQQAMGSGWTHHDSLYR

SEQ ID NO: 21713 - protein, 251 aa, Pseudomonas aeruginosa
NSHPVFPNASGLCRRRIRQVEQAPRTHERYVSIPRGSESALLHHHSSLESGFSHACRSALPQYRLRWRARARRPGAAGPRERRRAAGADRPRHPGRPAGSPPGGRSTRYRTGQRCRAVLHLGRCHHSCAGLRFRPRRRSPAPGDRSPAPGPLGARRGNRPAACGQGYARCAGGRAGDPAGPGRQRQRAGAAAFRRVPGPGRLGQGSRRRVPQVAGGRQAGRRQAALADPGGSGRLPARGARLDQPGAPVSL

SEQ ID NO: 21714 - protein, 305 aa, Pseudomonas aeruginosa
FHPDQAPAPGRRLSPGRRTRHRGGQWRAAGRTGRYPVDPGPRVRPDGHRRQRFPRAGRLVRTGHVPCGSRGPSGHVAAFRQAFSRYRTSFRSQGGRMSQFFQIHPENPQPRLVKQAVEIVRQGGVIVYPTDSSYALGCRIGEKTAVDRIRRIRQLDDKHNFTLVCRDLSELGVYAKVDTGLFRLLKAHTPGPYTFILSATREVPRMLLHPKRRTIGLRVPNCPIARALLEELGEPLMSVSLIMPGSGEPLNDPYEMRQVLEHQVDLIVDGGYGGGEASTVISLTDTDPEVIRVGCGDPAPFMQPA

SEQ ID NO: 21715 - protein, 339 aa, Pseudomonas aeruginosa
PGQRRHPSSRTRRRAGAAATGAGLRRGGHRAAAGPLYPAGRAGGLPRGLRGPARPAAVPDPQAEHRHPGYPGGGNHPPVHGLCRADEGGAPGAGRRVPGDGGDAGGDQVAHVAAALGGSRGGRGRSTGRADPPPAGVRTVQEGRRRPRRTAPGRPRRAGAGGGCSRGAGAQAAAGAGAAGADAGDGRDAAPRRPVREPPGDPRGTVHPRTHERSAGAPERRRLRALHPVVHPGGGQARRGGHLHGDPRTGQGADGGTGAERGFRRHPCAPADSPRSGGRRNPGGSPGRRFRVSAPLAVRPPADGRLFRASGFAPCRGLLSCMPDSAIFPSSWLRYPLRR

SEQ ID NO: 21716 - protein, 125 aa, Pseudomonas aeruginosa
SAWNWVPTTTWASRSARASCWRGSRPCCAARSSPRCAVATYWLSRTGGWTRSATDCSMRTARSSSSAARISPCSSCSSTIRSRSSTATPSPTPPAAARCCRLSASSTWRSAACASACATPARRRG

SEQ ID NO: 21717 - protein, 290 aa, Pseudomonas aeruginosa
SRPCAAVATCWRRRCGRTCSHERTAALVAGAALAARAHAAPDPARGAGRARAFQPVLAVAPALQPARGPAHQLAQPGLLDGGQRQLLPFPAARLPSAGARPVAQHGRYALLRLAERPAAGDACPAGHAEQAGGAGDRPGRVAPTPGQGGRAAGRIRQSRRAAPVQRRAEARRAAAFLGALRADPGAGEPAGAGDPDPHRRKRVAVHRQPDAGAVRQPGTRGTATAAGALDRFHQPVAAAFHRFADALAEPSAQAPGARRPRPGPGQSVGSAGGARRQRTGGGGARLQHHA

SEQ ID NO: 21718 - protein, 440 aa, Pseudomonas aeruginosa
IDSKHCKRRLAPNNKKKVFLMNAIRRLSAVICLSSLCLSPLLAQAGEVEVLHWWTSAGEKRAAETLKKLVEAKGHTWKDFAVAGGGGEAAMTVLKTRAVSGNPPAAAQIKGPDIQEWGELGLLADLNAVAAEGKWDSLLPKQVAQIMKYDGDYVAVPINVHRVNWLYINPEVFKKAGATPPTTLDELFVAADKLKAAGFTPLAHGSQPWQDGTVFENLVLSKMGPEGYRKAFVEQDKATLTGAQMVEVFAALKKLRGYVDADAAGREWSAATAMVINGKAGMQIMGDWAKSEFTAAGKVPGKDYQCLPFPGTQKAFDYNIDSLVMFKLSNAENRKAQEDLARSVLDPSFQKDFNLNKGSIPVRLDADMAPFDSCAQQSMKDFKQASQDGNLVPSMAHSMAASSYVQGAIFDVVTNFFNDPAADPQKAAQQLAAAIEAAAQ

SEQ ID NO: 21719 - protein, 266 aa, Pseudomonas aeruginosa
PRRRTKHGNPRTAQPAQELRQRPGGYPQGHPAEDRLRRIPDPRRALGLRQVDPDELHRRAGEHHRRCDPGGRPGHQRHEPQGPRHRHGLPVLRPVPDHERAREHRLRPEDPQDAPGRHRRGGGAGGQAVADRAPARTQALAALRRPAAAGGHGPGAGAAAQGLPVRRAAVQPRCQAAGGNAHRAEADAPAAEDHDRVCHPRPDRGHDPRRQGGGDEGRRHPAVRHAAADLQRPGQPVRRQLHRFAADEFHSVAPAAPGRTLDRPAR

SEQ ID NO: 21720 - protein, 247 aa, Pseudomonas aeruginosa
PAYRGRGARTDRAGHPGLRHRQPGQGLLPPGAGRRAGRGQRHEPALRSRAGPAVRRAERRARGRAHGGRGGGEGHRLERQSPEELLNPFVLPRPQPRGRWKCTRTRKPDRPPGPLAACLPLERWAWGARRTPPRRSPRTRNGCSATGAASAPSCWRRATTSSWSTSARRRPTSTAAMTTTRQDATPTSSPWACTWTWRRSSAGRLPSSSSPSPSATARTFPTTASATRVPGTSARCRRSGAAGRPGG

SEQ ID NO: 21721 - protein, 465 aa, Pseudomonas aeruginosa
QQRVLLALAMAVVRNETAGVQVLAAVEAPALALEGFQQPVDPCAPVLGAEHQHEVVAADVADEVAARVDPFAQALCQAQQDLVAAGVAVEIVEGFEAVDVDVADHRLAPLLQQVFEALLDRHVAGKQGERIGVPRLLELFLGDQPEHVDHPAHARIVPAAGDDEIFLDTLACAAGQQAADLLQGLAEFHGEKIVAHQAADRLAQEQVAGEGPEQGVGERVAMDDADGTPFFVEDRQGVQVGLAAEDFHHFLGRGANVDRALFQQQRTQVAVLVAGRLAGGVSAGQHLLYVARRVFQRAAEQIALHQVDPHLAKHREFLGQFDAFGDDLGARGPRHLQDGADELAFHGVQVDAVDEVAVDLHVVRTQFRPQAQAGVASAEVVEGDGEAHGAIVVQRGVEQVEVVDGGLLGQFDHHPVRRDPQLLQQLQGAAGRMTGLEEGLRGDVEEQHGVALDVAEAAEGALSAE

SEQ ID NO: 21722 - protein, 165 aa, Pseudomonas aeruginosa
VRVPEGAAGVLSVEHFEIDGEDFVDADPRRDRLDQVHPGCGDDQHPVVGAAVARQAGAGVAVDQRLDDLLDVGLHFPLDFLDAATDQRLQGVVHVQVHGQLAFGVLLHQFGVVADEGFVDPAETRHALAPQAGAVAVDHGLVQVEDHQAHQATSRILLRSMTSVS

SEQ ID NO: 21723 - protein, 441 aa, Pseudomonas aeruginosa
RSATHRNGDLPGAQRADRPWSAAGGWQAAGRAQAQRAVRDDPDHPARGADPTGVAGPDLSRGAPRLVRLPRAAGLQPAGPQSLPCDGQRTGPGAGDRGSVGPADAGERGGLRAAGAAGAVQRLPDPPGAAGGRAAGAVCRALPERAVLPRNPRPRPDPLADRTLCQRVRHPLWAGAFRHGAHRTACRGCGAAEGGGGQPGPAHQPDQPRPAWSADRLRPGVLAPRRHPYQRRGTAVTPRVDDLRHLLRGWGSGKRSPRMFILPISSDLHLELLDQPRAEELFRLVRANSEHLAPWMPWVPLTQSADDTRRFIGESQRLWAERRSCRCGIVESGCLVGVIDLHDFTEDSRSASIGYWLAASAQGRGLLARALGKTIELGFLGYDLQRLVIRCSTENLRSQRAAERQGFRRDGVIRANEIIAGRAHDHAIYTLLRSEWHAAHA

SEQ ID NO: 21724 - protein, 752 aa, Pseudomonas aeruginosa
VAPGECPGRERGWRSGQLAAGVEGAEHLDQVRQVMAAGQLANRVHGEGRQAYVDGAHADLAGGDRADGRAASHVAAGHETLHRHFAVLTEVAEEAGGFAVGGIALVAVDLDHRTAVQRRAMIGVVLVGVVRVYAMGVVGRDQQRALDRPAEGVAFRQQAAQYLFEERAVGAAMRTGTDFLVVGADQDAVLVAFGVEQGFQAGVAGQQVVQARPGDELVVETYHRGGLGVVERQLVVQYHVGGDAVLAQQLFVEQQAEVGGLARRQLGDDRRQFVLRVDRPTLVGGAVEMDGQVGDYRDGLAEVDQAAFQLAIGAEGDAPGQRQVAVEPGGEEGAAIDFDAELEEAVASDLRVRLDPQAGAVGVRADQAEAAFQGRATAQADGDQRRVVTGHVVAAAGFGVPGVALVEAAVAGGFQAAGEAGGGMERRGRGLEEIDQALVEFCAHSGSGRQSMQSIVLSDGVQVVGGGAGQKKRKLVVVWQDGVPEIGGRRPGGPGRGGEGSERRRRLEAQAFAALRMGQAQQAGVQAQAFVGGEGFGVGVEAVAEQRMADGEHVHAQLVRTAGDRRQLDPAPAFMTLDHTPEGQGVAAVLEVHHVTRLGRRVVAQRQFDAPAVQFRQAPAKGGIGFLGLAVVELAGQLAVAVGVAGEHHQAGSFPVQAVDDAGLGIAVFLQAGDQAVLVVIGATGHRQQQGGLVDHQQGVILVNDSDLGQRHSERAHRREAAGSLAGRLGETTAAANGRRSMDPGRINDPAG

SEQ ID NO: 21725 - protein, 300 aa, Pseudomonas aeruginosa
SAVVLSRWKRCSAISDCERSLKGSFTSSEQSLQESFLLHIEESMRYFLAEQAVDRIAVRLAGVALLVEDHRHALVRRLEHGLGFRDHPEQADGEDLLDVVDAEHLALGDALRVVAGQQQVFLDRLLAFLGALRLACQQAEHAVGVAYRGNLGVGHDDRFVGEVHGQVGAFLDARRGVADDVFEILAQFGHDFLDAFLGQGVLVAGLAGGQDMQVFEALVLDQGLGEGGLAVDDVDEVVHHAAFAAHDKVEVTQADVEVDDDGLETAQGQAGADSCAGGGFTDATLTGSDYENFGQGDSPQ

SEQ ID NO: 21726 - protein, 126 aa, Pseudomonas aeruginosa
SSWPCISPLWRSARRCSARCTPSTACTVSTTTRCSTTSSAVAASGTTSMPPPSSARTCARCSRCCVAAAPSGTHRTRTTAPSRACSCRCSASRRPPSPPPPSSPAWAGRGCCRSPRAAWPMAAVIA

SEQ ID NO: 21727 - protein, 472 aa, Pseudomonas aeruginosa
PSTRRWRTSPARARKPIACGSTSGSSAACASSPSSTCGRTGVSRPARQAKPSSIRNGASAEDGHSGRARGLAILAAVHDGSPAVSDPLAPRPPLTGLILSGGGARAAYQVGVLAAIADLLPDSAGNPFPVIVGTSAGAINAVGLACGALQFRQAIQRLTAVWQGFRTEHVYRSDWPGVTRQASRFLGHSLLGLGRRVPVALLDNRPLHELLARELDFSGIHAAVRQRQLRAVAVTAFGYESGQAVTFYQGRATIDPWVRHRRLGIPTRLELRHLLASAAIPLLFPPVRINREYFGDGAVRSQAPISPALHLGATRVLVIGVSGNPATGGDSAMTGLPPSDRPPSLAQIGAHLLNSTFIDSLEGDIEQLQRMNQIGQLVAPEVRRQAGGLEPVEVLLVSPSRPLDEIAARHYRELSRVLRLFLRGPGATRASGAGVLSYLLFERGYCSELIELGYHDAMGKRAELERFLRIER

SEQ ID NO: 21728 - protein, 403 aa, Pseudomonas aeruginosa
EKETAAPGRRFFVSLGDLQLARLGIDVAQFLVLERRIHLAVAEAGVVAPVHHAQGGDLRVVAAGLGNVEVVHLVFADVVHHQSAGVAQVGRAEDRQHQVGAAAHAVEAEGLAEILAALVQAHPGRRVPQAEHTEGGVEQQPRGGFHRRLALQLGEVVQQIGHVAEVVEEIAHAAADEVWGDVFVASYHGQEHPLVEAIVEVVDPAVPGFPGIVHVQCVEGGALEFALIQAGIELELVQWTAETVAVELAWRQFGRRGGLVGLGAGGSAQQKGEHPVCGSAHRSVSCLLGEGRAGDLGLSGSGRGEEVQHVLRVDLVVEVAAVTAIGIDGQAFAEGSAEEAEVARAEDDVVGVVHHGDLRAVVQIVLQLVEADLVDQLGQAAAVVTGSPHRDQLLGHVALEVAL

SEQ ID NO: 21729 - protein, 384 aa, Pseudomonas aeruginosa
AWLLSFDRESFLFGESLSRRSAKRKSACPIECIERFDRTVSEHIRSVPQRSSRHVVIGCDGCRSQSSPPSGRADDGRRHRRVPRPPGSVPVGIEQGVRLMRMMRRLLCWSAGLAMSAAVGMAAAADKPVITIGYVDGWSDSVATTHVAAEVIREKLGYEVKLMPVAAGIMWQGVARGKLDAMLSAWLPGTHGAYYEKMKDKVVNLAINYPDARIGLIVPEYVSANSIADLQAQKDAFGGRVVGIDAGAGVMIKTDEAIKQYGLDYKLVASSGSGMIAELTRAENEKKPVVVTGWIPHWMFAKWKLKFLDDPKKVYGDTEHVDTVANPALEAKAKPVWEFLKKFGWKDGNEVGQVMLAIQEGAKPEDAAKQWVAANPGRVKDWVQ

SEQ ID NO: 21730 - protein, 644 aa, Pseudomonas aeruginosa
YQSALQGVGGQARAFRLDTFFDHAWPLRDIHPADRFPAAAAGRAYQSRFVRDLGHPDGCRTDPCRVHPDRPVRASRQRRVRQPEPGNPQGGAAMIARLLAALGLAAFAPALWADALTGDVQRQPLNVSAIVMFVAFVGATLCITYWASKRNRSAADYYAAGGRITGFQNGLAIAGDYMSAASFLGISALVFTSGYDGLIYSIGFLVGWPIILFLIAERLRNLGKYTFADVASYRLKQKQIRTLSACGSLVVVAFYLIAQMVGAGKLIELLFGLNYHVAVVLVGILMVLYVLFGGMLATTWVQIIKAVLLLSGASFMAIMVLKHVNFDVSTLFSEAIKVHPKGEAIMSPGGLVKDPISAFSLGFALMFGTAGLPHILMRFFTVSDAKEARKSVFYATGFIGYFYILTFIIGFGAILLVSTNPDFKDATGALIGGNNMAAVHLADAVGGSLFLGFISAVAFATILAVVAGLTLAGASAVSHDLYASVFKGGKANEKDELRVSKMTTVALGVVAIVLGILFEKQNIAFMVGLAFSIAASCNFPVLLLSMYWKKLTTRGAMIGGWMGLITAVGLMVLGPTIWVQILGHEKAIYPYEYPALFSMIVAFISIWFFSITDKSAAADEERARFFPQFIRSQTGLGASGAVAH

SEQ ID NO: 21731 - protein, 140 aa, Pseudomonas aeruginosa
ATTRRGKPCWRPVRRSPGCSSCSRAWSRSAATTGECSPSTPRTTCSTSAGCFPAAASIATWRSRKASSTNCRPVASTSCAGRTRVSPGSSRPTWRPSASWPSATGRTLPSSSLPASPASTCCRRWRWRPRCPSATPRACN

SEQ ID NO: 21732 - protein, 352 aa, Pseudomonas aeruginosa
RSSSRAWPVNSTWRPDEHHGQVARQPLAGLAPPAVLVDARGGRGGRSDLPRSRDHQPRPASCRHPQHRRGAGAARQTGHGRAPGTLRRAAAEPGCGVDPHPQAAPRRPGGTVAAGAGPAPGAGVHRRPTAAGLLSVVRCRRAEPAPAPAPRPTVAQPLHRDFVAVPPEGQPAFSRRTHRPALRHPGAGPGCAGQRSPHRPRRRPGGGADVHASAQGAGAQGHPLRLEVADLLNLRCSAGVENYKGGISRPLPHEPNRSDAHESRYDSSDHPDPAADRRSAGLSSFAQLGLRALGDHRRIAGGAVGPVAAGHDLGPDRECRRGGYRRITPPALFALRGGFPAFAPPLRRGIGG

SEQ ID NO: 21733 - protein, 764 aa, Pseudomonas aeruginosa
RWGEIPGTEHWHPWSSVADARWTGTMRQASGSSRGTGSIRTPFRWRKKSKRVLVEIDGGDDCREKARCRAFDKVTQAGRREPPPGAEASVDADEAAGLVLPEARIEAAMGEQLGMRAAFGDVALVQHHQAVHARNGRQAVGDGDHRLALHQGLQAFLDRRFDFRVQRRGRFVEDQDRRVLEQHPGDGDALALAAGELHSAFADMGVEAAAALGVAEQRDELVGASLAHRFHEFRVAGAGAAVEQVVADRTVQQRGVLGDHADLRAQAFLGHPGDVLAIDQDASALQVVQAQQQVDQGRLAGAGRSDQADLLAGPDLQVETLDHAAALAVVEGDVLELHLAALYPQRLGVLAVDHLARQGDGLHAILDLADVLEDAADHPHDPAGHVVDADHQPGGQGDGAHRDQLLAPQPQGQAGGAGDQHAVHHRDGHVHGGHYAPGALRLEGLVADRFAGVVLFLAGVGEQLQRDDVGVAVDDPPHQLRARIRGLHRAALDLGNEVGEGADVGEHPQHQRDHQAPVGLGEQHQGADGIDQHVPEGVHHLHRRIAQRVAGLHDALGDAPGEIVLEEAEALLEHVAVVLPADQVGHARVDALVHQHVVQGVEQRAQDQRHHRHPDQFVGVHAEELRAGRALGEIDDAAEVAEQRHLDQRDDQADHQQGQEHRPDLAQEVDIETQHFAGRHAFGSTAERVDQTFETTIKHDGSLLERARPGPAGSSPCGWTQRRLADRITTSSLGTSAKPLRRVVGTLAIWSTTPMPRTTLPNTA

SEQ ID NO: 21734 - protein, 241 aa, Pseudomonas aeruginosa
PAAVADHHLHLGFQVLVGQFALQAVQRMVGVGHGDELDHAEVGAEVAGNDQAADRQVGGALDQRFLDAGEHFLAQQHATAAALRHEGGQRADDPRGGVGGVHHQAHLGFPALFHVVRQLLQLPGLLDQLPRTAQQYFAGLGQHRLASVDAQQRHAELFLHARHGIADRRLRAVQGFRGLGEAAVVDHRLQGPPLVQGYAWRFHFRLLECRDASPAFPRPAGDDECAGGATSLIVSSASCTG

SEQ ID NO: 21735 - protein, 241 aa, Pseudomonas aeruginosa
QRFFQLFNRLIILYPHLHRCSAVGGGRVMSRVLVIESSARQRGSVSRLLTAEFISHWKIAHPADRFQVRDLAREPLPHLDELLLGAWTTPCDGHSAAERRALERSNRLTEELRMADVLVLAAPMYNFAIPSSLKSWFDHVLRAGLTFRYAEQGPEGLLQGKRAFVLTARGGIYAGGGLDHQEPYLRQVLGFVGIHDVTFIHAEGMNMGPEFREKGLARARERMRQALETDTSLCVPLPTLR

SEQ ID NO: 21736 - protein, 237 aa, Pseudomonas aeruginosa
PLSVAAVVLGLCLPAHLPSAEPGGAGEHPAPARRVLRLALPAPAAVAQGRRYRTVPSRRDTSGERAAAGVPVCRAAGDGKEPGGVPRSRTAGRKMAGGRRPAAGGAGAALSTGAFSRLPPWPRAGRRLPGGLGAGVPLADRYLWPGDARSPGLWRAGGGLRRAGAAGCIAAGRDRGHARGSWRSLPPGAGAGSPGLRALGAGAVLAGFGGGVPGAAGERPTDCAGMARRTAGGVRRT

SEQ ID NO: 21737 - protein, 358 aa, Pseudomonas aeruginosa
YPWAARPDDGRRASRQNKKRPMPERTTLSSWVQGIILALELEGLDGRQLFAELGLDYQALQDPDARFPQDAMSRLWQRAVALSGNPAIALNIARVRRPAFHVVGYALMSSRNLAEGFARLERYQRIIAEASDLTFRRTPQGYRIGVTVHGDRLPAPPQSAECSLAYLVDMVRWITGRSLDPLAVELPGAPREPLAPYVELFRAPLRFHAEEFALVFSRVDLETPLPSANEALAQLHDRFAGEYLARFSTSRITHLTRQTLCRLLPQGEPKRERVAQALHLSQRTLQRRLQEEGTSYQQLLDDTRRDMAEQYLQQPGLTLLEVAYLLGFADPSNFFRAFRRWFGCTPNEYRARRQERPG

SEQ ID NO: 21738 - protein, 488 aa, Pseudomonas aeruginosa
SHCRQARERSVAPERRGQQDQHGDDLQATEQHAGGQQPLGGVRQAGEVARGADDGPHPRAYAGHGTGGAGERGHPVQADQRQAEGEQADDDREEEREGQDRADDFLVQAMAVVVLLEHCARMDQLVEVGLEQGIGDLEAEDLDTAGGRTGATADEAEVEEQHDREVPPHAVVAEGEAGGGDHRGDVHCDDAESIHPGQLGGYRVPGAHQQPGHQQQAEQAADLLVLDQRLAVSAQGGDVERERQAAEDHHHYRGPVHRWLLPLGQGLVGGGETAGGNRRHGVVDRVERAHARAPEGQAAEQGDADIGGDDVLGDHVRAWQDLFRAVRGFGLEQAHAADPQHRQDRHGHGDEADAAQPVQQRAPDEDARGHVVQPAEHGGAGGGDSRHAFEEGIGVADVLLQDERQGGEDAYQHPARYGEHVHVPRAQVDMLGTSRQDQAEAGDEGGDAGPDECLDAFGTVEGEHGQDRDQHAGGQSDQEDADDETEDT

SEQ ID NO: 21739 - protein, 310 aa, Pseudomonas aeruginosa
RAKAAGPWATSTPAPWRAASRTPPRKRWPRPATCRCAHRCWSWRSLACRTTRRCRTLSNCWLPAAPPTAWCWAPMPRDWGRCGGPARWPPIRWCTPAWGSASRSGSSASSTWGRRWASCARRRNSTRRPSSAPGRAERQQQAYAPIRALGVPEQSSALPAGQSSGGFHGRRQPAPAFFRLAEDVQAQPAVACVQRRIQCDALPRAGLRGAAEQAVERLVQGRAPAFQRPGAAFRQVQVEARPAMPQLLGDLSQLDRQDQRLRFVAGRFRRRRDGLGERAFIEEQRSGKSHAGCSWGIVHLGAASFGRLAP

SEQ ID NO: 21740 - protein, 257 aa, Pseudomonas aeruginosa
GGQGQARSALSKAWVKTLCRRADETRSVAVVVAAAAQGEDARAAVGVAAELLAQVADVHVQAAVVEGQLAAQRQLRQGLLVQRLAGLAQERFEDAAFGKGQADLLAVDLRHAARQVQRQVAQLHLRAGLRRVGSPQHGAQPCGEFARVAGLGQVVVGAQFQTEDAVQRLAAGGQHQHRQVGMVAAQLLEQFQAATVRQHHVEHHGIRCLLGEGATGLGAVVAGTHGETFLDQPGTEQLAELPVIVDQQQFAHRVSLN

SEQ ID NO: 21741 - protein, 359 aa, Pseudomonas aeruginosa
NGIIATSGCSETVILSFRMRQACAAGAFARWSRLPGPMNGTSRYREAANRRCFITILHWNQDSAMRVDLHCHSTASDGVLAPAALVQRAHEKGVGLLALTDHDTLEGLPEAHQAAARLGIELVNGVELSCTWGGATIHVLGYGFDLDAAPLRQATEALHRGRWARAEEIDRRLAAKGMPGALEGARAIQRALGDSGNAPARPHFAEFLVQGGWVKDRADAFRKWLGAGKLGDVKQHWPTLEEVVGCLREARAWISLAHPYHYDFTRTKRRRLVADFLQAGGHAIEVVNGVQPAEQVGTLSILAREFGLMVTAGSDFHAPGDWSELGMYRAVPEDLPAMWPRFARHFRDTERHSEAKGAE

SEQ ID NO: 21742 - protein, 323 aa, Pseudomonas aeruginosa
SAWVAAIRRRSCSRPERRPNPPTTSLAMQDDNPANADTPPAEPAAERVPLQLALVYGEAVTELPQDLYIPPDALEVFLEAFEGPLDLLLYLIRKQNIDILDIPVAEITRQYMGYVELMKAVRLELAAEYLVMAAMLAEIKSRMLLPRSAEAEEEEEDPRAELIRRLQEYERFKKAAEDLDELPRVGRDVLVPAVAAPEARARKLLPELALQELMLVMGEMLRRADLFESHQVTREVLSTRERMSEVLERLKGGAFVPFIQLFTLEEGKLGVVVTFMAILELVKEQMVELVQNEAFGAIHVRLRIAREAEEGETLEEALGDDFE

SEQ ID NO: 21743 - protein, 325 aa, Pseudomonas aeruginosa
AACPIPLSFPLPGSGIRCDDEPVRSPRTRHSARRHPPRGRQAAVAGTPGRAVRRGRAAGAGAVPRRPGDPGTVLRGALLRAEGSRVRVSPADSRAFLAVGRPPLGGASAALFARAAGNPGADRLPPADHPWRDRGDPRRGGEHPDRQDADGAGVDPHRWLPRGAGAPGDAGDYQGVPRLFQPEEPRRAAAAVGAARDGARAGTAGRSGARGAAAARRSRRGCDSCLDPGPGRSRHRRGRGKPRGDRGGGRRAGEAARGNQLPQPAAGTGRDGAGPEDRLRRPARPSGALGAGRRVRRASGWADSRGRGASRRACRRGGCRGRRSR

SEQ ID NO: 21744 - protein, 229 aa, Pseudomonas aeruginosa
RGARPGGGHARGARGTGRRRRLAAPLTVVSPCRIHPAAPARPARSVSSTLELPMKETLNELITLISTGCMGAEEIRRIADEAAQAYADPAGFLAANPDINYDDSFPIPLGEWVVVGSLPDIVLFQADTYAELFARIVASFGKDVAFNIKPKQLLKTEPLVALNRIQVQLSSMYPEKGGYVLVDFSEPLDDELQAVLVYTQDLPRVMALCVEAGIYAAPAYESLRDAEAE

SEQ ID NO: 21745 - protein, 89 aa, Pseudomonas aeruginosa
SFPPGRRPAACREVTGEDRLRSAPKKGERLKSPCINICEFDADVCRGCGRTRQEIRAWKRADKAEQRLILAEADLRLLALQARGRRKFR

SEQ ID NO: 21746 - protein, 368 aa, Pseudomonas aeruginosa
GASVAGGGQRQGAVQHAVGEAPLVVVPGHRLDQPAADLGVVGVEDRRARVVIEIHRHQRLGVVAEHRRALAGLAQQAVDLVYAGIPGHLHGEIDQRHVDHRHPHRQPGKLAGEFRQDQADRLGGAGLGGDHRLGRRTCAVQVRVVHVGEVLVVGVGMDGGHQAVLDAQLAMQHLGHRCQAVGGAGGVRDDPMGGAQHLVVDAVDHGGVDVLAGRRDQHLAGAGLQVGSGFVAAGEEPRALEHDVHAEALPGQFRRVADGADGDAVAHHPQAFGIVLDLAGKASMDAVVLEQVGVDRGVAEVIDRHYLQLFAVVAGIQGAKNVSADATEAVDGQADSHNEVVSFLLVVVKTITFRPERKVNILQPMIML

SEQ ID NO: 21747 - protein, 959 aa, Pseudomonas aeruginosa
RGHSPALPRDGPGCGQQGAAPRHPAVRQPRPRGRGLWRKRQADPAADEPGQRGHRFRLQRHALGAPAVRALSGADQAGAARDRFGRPVRRRRAGHVRRGDPGRAGHGTVAGQPRRDRHVHRHRAVSQHVRCSAVPGCLRQDRAGPADRLAALRPPAHRVRPGRADADRHLQQGKGRGAPTVRRGQGHSRRAAGLGNGLLPCTRHLHLLWRRQYQPVAGGGDGPAPARCLLRQPEHPPARRTHPRSGTPGQPADPRERQLRADGGDRRREGHRQLGGGAARHRRLDQPHPAPAGDRPGGGHPVDLAGHVRAVPCGADPGAHLSERPGRHQPLPGGRRHVLPDPPTARRRAASRGRTDRRRPRPAPLHPRAVPRGWPAGLARRAGTESRRSHPASAGQAVLRRRRLAPDGGQPRSRRDEGLGGGAGTPGGRGAGTDLPRPGQPGRGLQGRRAGARPGRRGAFPGPAGERHAGAAQAHAVPRGPAGSWLQGGAGHRRAHVRGVGQGARGHPCESGSHRRRSAGAPARRRPGAGGWGERRVAGAGPRRRMAGAQPGAGAARRQSRLRPRAVRLHAQRHEQRGRRRLHLYREHQRAGADSDRSISARRLAGGCLSGNICRPSRPGAGHCGSTTMNNDNKRSAGGLGLVGDIGGTNARFALWRGQRLESIEVLACADYPRPELAVRDYLARIGESVANIDSVCLACAGPVGAADFRFTNNHWVINRAAFREELGLDHLLLVNDFSTMAWAASRLGADELVQVRAGSAQADRARLIIGPGTGLGVGSLLPLGGGRWEVLPCEGGHVDLPVTSPRDFALWQGLQARYGHVSAERALSGNGLLALYEISCALDGVAVRASSAAEVGALAMAGDAQADAVLEHFFLWLARVAGNAVLTVGALGGVYITGGIVPRFLERFIASGFAEAFASRGKTSGAYLQDVPVWVMTAEHPGLLGAGVALQQALDVEG

SEQ ID NO: 21748 - protein, 526 aa, Pseudomonas aeruginosa
AHRRHGGQPPAPAPARHRQGAAADPDRARQWLPAGGAGAAAPAAMSERRRWSPVPRSLLGRMLLLTLLAVLVAQGLSSLFWLSHLRSSQREGLLTSSRSLAYSMAASVSYFRSLPLGYRPLVLDQLRSMGGTRFFVSLNDRPLEMRALPDTPNKQAVLEIVQDVLHQRLGKEVELQVEFVSPDELRLFNGALKLDELPRSWAHYALTLEPVNPPVLVTQIRIGESEWLYIASLMPAPYVSLEPEGLQPQQVLSIVFTSLLLLLFTGLLMHWQSRPLKRLARAARDLALGSPSAALEERGASELVEVARAFNTMHERIDRYLNERGQLFSAISHDLRTPITRLRLRVELLEDERLQEKFGRDLDELELLVKGALQCVKDTDIHENVEPVDLNLLLQHIAEPYLADGRVEVVGRAAEPYPGKPLALKRCIGNLLDNALKYGERARLSLEDGPEAVVLHVDDDGPGVPEQRLEQIFEPRFRLSPRGQGYGLGLGIARNIAHTHGGEVSLQNRREGGLRVSLRLPRLGLE

SEQ ID NO: 21749 - protein, 128 aa, Pseudomonas aeruginosa
TRRAGTRFSRVLRQPQTEAERALWQCLRGHRLLGLKFRRQKVLGPYIVDFVCHERMLVIELDGGQHVGSPADAWLESRGPGYCGSGTTRCWRAGRCCWRSFSCCRRFLSRNRLAEFKSRFSCSASIPM

SEQ ID NO: 21750 - protein, 371 aa, Pseudomonas aeruginosa
PTSSTTPPRIRRRPPSNWRPPSRRRRSKSLARIPARAPLDPPDWLRAAERHGWVPSHARKRMATNSPVYPTAPVAPRRVSPLDRLQGWLPKLVLAPSVVVVLFCMYGYIGWTLLLSFTNSRFMPSYKWAGLSQYQRLWDNDRWWVASKNLLLFGGSFIAICLVLGVFLAVLLDQRIRREGFIRTLYLYPMALSMIVTGTAWKWLLNPGLGLDKLLRDWGWEGFRFDWLVDPERVVYCLVIAAVWQASGFVMALFLAGLRGVDPAIVRAAQVDGASLPTIYLRIVLPSLRPVFFSALMILAHIAIKSFDLVAAMTAGGPGYSSDLPAMFMYAHTFTRGQMGLGAASAMLMLGAVLAIVVPYLYSELRGKRHA

SEQ ID NO: 21751 - protein, 676 aa, Pseudomonas aeruginosa
RVPEPELQRQPPGRAPDPLGRLRALPGAAAGDAADQLQDAGRHPHRQPAVAARHLHRHRLAQGLGQRRRVLLELGADHRARRADLHLHRRVERLRAVDVALPRFPAVLRRAVVRLLPAVPGDPPADVLHPRQARPGQYHQWPGAGPRDLRPGLHHAVLPQLFRGDPGCPGQGRAPGRRRLLHHLPAHPAADVHAHRDGLPDLAVHPDLERLPVRRGVRQRRFATDHRGPEQPGEHHHRGQGIQRRHGRGDDRRAAHAGGLRTGRQVLRARPHRRRRERLRRVADPGDERNMATLELRNLHKSYGSGLADTLRDIRLKIDSGEFLILVGPSGCGKSTLMNCIAGLESITGGAILVDGQDISGMSPKDRDIAMVFQSYALYPTMSVRENIAFGLKIRKMPQAAIDEEVARVARLLQIEHLLERKPSQLSGGQQQRVAMGRALARRPKVYLFDEPLSNLDAKLRVEMRTELKLMHQRLKTTTVYVTHDQIEAMTLGDKVAVMKDGVIQQFGTPQQIYNDPANLFVASFIGSPPMNFIPLRLQRRDGRWTGLLDSGQDRIELPLSLEPGLEEGRELILGVRPEQIALGDGSAAHDLRTEVEVLEPTGPDTLVFVTVNQVKVCCRLAPDVAPAAGSGMSLRFDPARVLLFDAQSGERVAVRTAGVVAEKVTALNGNRQKNS

SEQ ID NO: 21752 - protein, 597 aa, Pseudomonas aeruginosa
SAEAGGPPRAGAVPAFSVLYVYARKQVGGSPWLRVGASSNGEGDGWLPASAVSDWKQSLVLKFTERSGRAPVMFLNSAEQVERLLGDTRAARDTLTQAVDHKGDPQVVAVEPNDRAIPQDQFYLLPIFDSKESFDADGQPAQLLEVASIDPGGSAAAPQAPGQAGHGGASGAASDTFRTGIVLVVDTSVSMQPYIDRVREVIDGLQRQIGERGDLDKVSFGLVGFRNNTDKTPGLEYVSKTLVPLQPGNDAQRFAELSSQVRATDVSSHSFNEDAFAGIMQAVDEMDWSPYAGRVVLLVTDAGALRKNDPLGRTQMNEAEVRQAALRKGVKIYALHLRTPAGKNNHGYAEQQYRSLTADANPKIADLYIPVAGGEVNAFGNTVKEIGTVFADLVHDAGNRKPQAPRFDAAPSVASKSSAIGYAMQMEFLGRRDPVRAPQVVTAWTADRDLTNPALPAFQVCVLLSKLQLNELQQSLKLIVDAAKRTQTSPKDFFQEIASASAYMSRDPAQLVKGSNLAQSGVLGEYLEGLPYRSKSLNMTQDLWLSLSVAEQQDFIDELESKIRLYETFHNDVANWVRFGDADAGDALYRVPLSTLP

SEQ ID NO: 21753 - protein, 542 aa, Pseudomonas aeruginosa
CACWWSRPASAAPAPWSPPTTSAWLAQPAWKSWPSAGNARPTTASAPASRKLADARRPAALAGLGRLSRRGAPVALRDLRPGGGDHPAAGAVRPQVRPGQHPHRAAGARAFCARDHSGRRRPLPCRGHRRPGRTRGRRLRRAAHPADRRHRRPQRRRRDRPERRDDSQRRRRPAAGRPAATRPADPRGAQPRRRGKTRRPAWRAHRRAHRPAHGWPGTEPAPGAGSARGAAAGAFRPRRAVRPAGPAGSRRGLSRRSRGGRLRLAGEGRRDPARTHLPGLPPVRPRPRCGGRAAPALRREWRGSRHPGRGHRPGAQPQPQPRPGVLDRRRAGHRRCLRRHRRQQPGRRRTQAPRPGGAASAGLPDRRAGRLRHAPGAVQRRLRPVPRRAAVRRHGRRAEPPVRQPERRVRLPPAAQPLPDGAARHAAVQRPGRRQRRLARGADRSRRGITRCLRKPFFRSPSAPAWHLPRRPGPKATRRTIPSRWPTTSPCRCRVAARWSSGMSTYSPKAPSTIARSTSATPSTKARRATSSRSSPATGATT

SEQ ID NO: 21754 - protein, 306 aa, Pseudomonas aeruginosa
DAMSQPSENRLITSARYALCLLTASGVLLSGCASSGVGSVAQTTRAEYYPSCYEPVSHLRSTDNAVRNSAITGAITGGLLGGLAGGLASDENRGRNAALAAAGGALAGGAAGYYMEKQKQISDDRARIGSYGTDVDRSTVEINRSVAYAKSAQSCYQSQFKALLDGRKNKSINEAEGRKRLAEIVSGLQETNALLVAANGRAGENISNYTQAYEKDLQQVGVPRAEVTKVAEAENRASTTKGGSKPKTGSNPKVPKEAVATEQTIRKAQDAQSEGNKVASQGQGMIREVCNSPDMGDWAPPSCAKA

SEQ ID NO: 21755 - protein, 180 aa, Pseudomonas aeruginosa
HSTRTARRPTSTGPRSGEAEERKAFFQGATDGGRVKGASESSMRTLLLAGGLLVLSGCSLLMPTPDPNRAWVDLDTQPDADLAAVEVDDKSWDRTRYFEVDPGTRELTVRYQFTVDPTNIGPVDSPLWRDCQLNLKFKDFSAGQRYRLEAGHIGFRPWAKLYDQDNRELARGREGRCAKV

SEQ ID NO: 21756 - protein, 255 aa, Pseudomonas aeruginosa
PVTPRRCLAAECCAAHPAAFDCGRPGPVRRAGEAFRSAVEAGVQADLRVEHLGYRATGLGLVGDLLEGLRVRPRHARPEHQVHGSDGETVGLLVEGDLGAGLDTFGGQAGLAEHHRQGHAEAAGVGRADQLFRVGSRCALEAGIEAIGVVLERAAFGGKGALAVFQAALPDRRCRLLHVDSSGAVDGHPLASASGHVYMGGRRSRTSSVRLRGGGIQAQPSMRQSGAAAPPTASLPPARRSCVSRRARQSSGWPR

SEQ ID NO: 21757 - protein, 341 aa, Pseudomonas aeruginosa
AVLQAVGSEACHVSCLKARKKPRNNHSFVAWIERIMDRLTATRVFVEVIDSGSQTAAAERLDMSRAMVSRYLAELEEWVGARLLHRSTRRLSLTDAGAELLPQCREMLAVADAMQATGQTRRDSPRGTLRITSSLSFAQAWLTRAAAAFVERYPGTAIDLQVNSQVVNLVEERIDLALRIANQLDPNLIARRLGECRSVICAAPDYLRRHGTPRRPEDLALHNCLTYSYFGRSLWQFERDGEPTSVPVGGSLSANESTVLLEAAAAGAGISQQPLYSAAPLIRSGRLVALLPEWSPQVLGIHAVYASRRQMPPALRALLDFLVERMAADPHWDEAGPLALA

SEQ ID NO: 21758 - protein, 254 aa, Pseudomonas aeruginosa
PSRCAARRSASTAATSSSASPCPTSSSTSPPPTPSSATTASNWARWTSSAAPEVPAPGWHAQGPWNGSENPRRHQQVPQLCPSPPARGHRPDAGRRRLGRHRRPDRRRGAGRPRPRPHAARRGGREQRQEALRPLRRWPAHPRRARPLACRGGHRLRPRGPARSALPRHRQPLPRLHPRARPGSRQPPPRPSLRPPRHRPGSRPPLRQPGSAGNRRARHASGRAPIPPGGERRLADRAGTRAVHPRGLRRRSTD

SEQ ID NO: 21759 - protein, 237 aa, Pseudomonas aeruginosa
GKIPTSAGRPMDLRPSHVHVFPPSRDLPAATSPHRETLLRSGCAWNGSLYLGYPLGQPQLTVQRLSLAAHERLDWQVHPMPSALYVLKGELRLETRDGAQSTRVLEGEGGGLPDEHHPSPDSRGRTGGSPAVPCRRGRHAGGARRTRRNARRLKTPAGRTAARTRHAPSHAQAESPYNMSQPSSASAVSRLWRLTWVLKYPSGCSSSAARNSRETMPNTGFAASSSRRRTLPRRKRS

SEQ ID NO: 21760 - protein, 391 aa, Pseudomonas aeruginosa
  UNSURE (307),(308): Identity of amino acid at the above locations are unknown.
WRQPPSPASPGRWQGFPLTWRVFHELRAESPTPTPAERPDPTADGRAIGRHREPVAALRNQGRAPVAGGAANHRRTFRGAPRLAGLRAQRAAGTTGRPAPAVRGHRPPAAGRAARHPGVARRPDPPVHGQAQRSGQAPPGGLHRGHGDVPVAPAHGSVAAVPRRARAVQQSARLAGREQARTGHPGDRITGVLHRTVDDLLDRRGDQHAHQAAVVAAVAFLAGGGRRAGPQGGAGSQVDQLGAGGDDGRAADHHVARAVVAHRDVQRRVGAIDLAQLGRGHLVHVAGAGQAVLAEGLVGQRHRHYVXXGLGQREGDLREHAVGRLHVGRLVQRRQDQDRARLGLLERRVVDALGRRAAAEQGQQGETGHQAGQSGEFQRAPPRALFRRKSM

SEQ ID NO: 21761 - protein, 76 aa, Pseudomonas aeruginosa
PSHWYSVFGPLHPASAMLPSSAAVHVIVLLMCAVIPWFLVDYWFCGFQAPLSTALTNLFTASRMARSRTLPLRVES

SEQ ID NO: 21762 - protein, 517 aa, Pseudomonas aeruginosa
CFPASLGTRRPSAYQDWPWFFYCWRPSEHAEREPSAAEKQRTFPTPAPVRLHRGGEPDGYRRQRRALGGRRTAVRAPRGRLLLWCAQARRHPLSRRMESSMTLSLDLLLSLCTALAIGLLIGAERGWQERDHEDARQIAGIRTFSLAGLLGGFATLLAGELGSAVWVALLLALAALAVAGYVSDVRRGGDQGMTTEIALLMTFLLGSLALTEQRLLAAAGGIVLTLLLSLKDKLHALLKRLTAEELSGTLKLLFISVVLLPVLPNQGYGPWAFFNPYLTWWMVVLIAALGFSAYLAIRLIGSRKGLLLTAVLGGLVSSTVMTLTLARLRERMPDALLACALLATSALMFPRILVEIGAIHPALLKELALPFAATTLVYLGGTLFHALRGGRASQEAPDEPGLRNPFELLPAMRFAALLSAILLLVEVGRRLFGDAGIYAVALLSGLADVDAITLSLARAAQGELDPGVASRGIALAALSNSLVKAGLVVLVGGKRLALQTLPFSLAGLLVGALLILL

SEQ ID NO: 21763 - protein, 1700 aa, Pseudomonas aeruginosa
AAEVYRDLSSKRISLGLKNPVEVLSRQPPGQARNSNLLQTVTTEAVFQHLPEIALVVDQADRCRARQASCRTNSCAHGEATGTHSCTTERSRCRHATDGCRRDGDSDLRRRPHARVAVLPAIVHLLHHAPVHIPALLGLLQPRQLRIRLHHRVDGLAHGLLVDMLEVDLQPFHGLDRQIPLGHDLALAHGFVGLALALRRLPRQVALALLVALLVQVLHRLEGHRAAADDGQVVARFQLRALVGLVAAAEQGEVAAAADLAAHRLDVGDFVAPGFLAAEVAFLLLVVQVVVAVVGGQQFQLVAGHQVGLVAGAGLARDQAQVLSGIDRQVAAGVHAGALLGNLVFLVGDLPGLAVGMLLVRRRRQGHVAPGGEGDVAARFEGAGHRRQVAAGADVQVPPGADFGAELGHALEPRRAPAGLALAVLDGGDGDVASGVEAEVAAALQHPAEVGDVASGLDVQAVRRLHPRGAVGEAAFPGAAVERAVVAGHAAFVDHVAGKRGEAHVTPGDDPALAVADRVAGEQVEALAGLDQAAVVEVVGRRREVVPRAQGADVMQVAAAHQLHVAALDQRTVGCQPTLRLGQVDHRREDLLAVHLDLFQPHDVVGQRRHLLRAQTHTQLQVQLVLVSDGVVHQVAEQRLVAAQPIDVALAGARHHRVADQPLLVETVAEALLASVRVHAQAAEQVVRVEELLQFGERRVGLDQVLVAGARRGVAGHALDPGDARQATAERAAALTLDVGRASQAVDSHALALPGTGGVAGALLADRDAATALGAVGAGTERGAAIAVLGEARAETEQAVVTLGQAEAGQGNRVDLAPRQVGRQLRGQRHDHRNPAAAHRAVAHLAAAADEGVAGAGDAVVDARAGIDRDVAGGLDHRCVGLVATADRGRPLAREFVLEGPVAEDRVERGGDLARARRVEIGALVPVEVGEVARLLVDAADIAAASGTQHADGFQLAGFQALVVEDFEVGGEVAAAADQTGKVVQGAAVDGEVASGQQLPHGAAGGDLGLVALGDGPDGVALAAAVARVDAFDAGGLLHLRGVQARLAFQHGATVLDQAGTQAEVLAALDHPGKVAQAGGTVAGIVAGDIQPAEAVHIPVEVGDVAGAQGHVGATEQQPALVEQGGRVQSQAAAAAQGAVVVQTRGAGHEVAGGGDPPTVDQQVAGAERDIGAAGEAGGVAEVEAGGVQGEVAEAGGAAVATVAAAQVEAQAAVAGQQAVVAPVAAAASEGLHRQQLALGRLAEGADVQVQASGLQHAAVGPFAGADVQQAIGGQFAAGADHLPGIQAEGAIAGVEDAPAGVGQAAQLQVEVLVGAFQHAVGVVQAASDQPRAAAAAEGAQAAAAVVDRGGAQVQLAFAFQLAEAVGQRAGQAEVDAPGADLAALTRRRALVEETLAVEAEQAAGVEAATLVVEVGGDDAVVAAQRREMALLVAHALPGANLQRLRLGDAGAVVEQPGDQRQPTLGAVEHAAGAVVEAAALQVEVAGPAVQAAALVVQRATDTQPVVALGLERALAVVQAAGLHLEGAGLAEDQAVLLVAQGAAAQAQAHVGLAGEGAGGAVVEAAGGDLQQPLADQLAAAVVDAGAAQQQVAAAGQARRAGVDQGAAEDGVEPALADQLAVAVIQAGALEQQAAAVDPAAGVVQQRIVALEAQRALRRDQAALAVVQLPGDAQGHVAFAGDDALGVIPGWRRPSVARPC

SEQ ID NO: 21764 - protein, 82 aa, Pseudomonas aeruginosa
TACHPGRCAGWRPPRARQPCRWRCRRRGCRRRLPWRSSRRRPPARRHGCPGWRRGRSTRCGSTAGRRRGCPVAPPSRAARPG

SEQ ID NO: 21765 - protein, 224 aa, Pseudomonas aeruginosa
RSASAASPWLAAQAGQAWGREAVCSSGSCNSRAAGAWARPVSCARRGLTTGPMRSGASSKTCMSAGQGGSANQSMASRPGRRGSNSPSLVDSCRRRSGRARLSWSSRGMNQRASRLPGTPRTNGASAVCRRSSAQTPRSRSNASPQASRRRTPESVSFTPRPSLPNRATPRSSSSNRTCRLTAPWVTCSSSAARLMLCNRAAASKARRAFREGRSRLMAIREFS

SEQ ID NO: 21766 - protein, 413 aa, Pseudomonas aeruginosa
ILPIRHFLEPSMTSYRNGPDAKGLFGRFGGQYVAETLMPLILDLAREYEKAKDDPAFQEELAYFQRDYVGRPSPLYFAERLTEHCGGAKIYLKREELNHTGAHKINNCIGQILLARRMGKKRIIAETGAGMHGVATATVAARFGLQCVIYMGTTDIDRQQANVFRMKLLGAEVIPVTAGTGTLKDAMNEALRDWVTNVDSTFYLIGTVAGPHPYPAMVRDFQAVIGKETREQLAEKEGRLPDSLVACIGGGSNAMGLFHPFLDDAGVQIVGVEAAGHGIDTGKHAASLNGGVPGVLHGNRTFLLQDADGQIIDAHSISAGLDYPGIGPEHAWLHDTGRVEYTSITDDEALEAFHTCCRLEGIIPALESSHALAEVFKRAPSLPKEHIMVVNLSGRGDKDMQTVMHHMQQESKA

SEQ ID NO: 21767 - protein, 77 aa, Pseudomonas aeruginosa
TRWNRGVASSFSRRLICWLTAGWVVPSSSAAAVKLSWRAADSNTRSRSRDGGMRCSHISPAYPTHPAPCGLPGISMH

SEQ ID NO: 21768 - protein, 390 aa, Pseudomonas aeruginosa
STQHYRITQSHGISRPMKTSPNILFIMADQMAAPLLPLHDPRSALRMPHLSRLAERAVVFDSAYCNSPLCAPSRFTLVSGRLPTRIGAWDNAADFAADTPTYAHYLRNLGYRTALSGKMHFCGPDQLHGYEERLTSDIYPADYGWAVNWDEPEVRPSWYHNMSSVLQAGPCVRTNQLDFDEEVVFKARQYLYDHVRQHAGQPFCLTVSMTHPHDPYSIPASYWNLYRDEDIPLPRQRFAQEEQDPHSQRLLKVIDLWDKPLPEERIRAARRAYFGACSYVDAQIGALLATLEECGLADDTIVVFSGDHGDMLGERGLWYKMHWFEMAARVPLLVHAPARFAPRRIGASVSTVDLLPTLVELGRRASRSTPAAGRPLAAAAPARRQRGMTM

SEQ ID NO: 21769 - protein, 427 aa, Pseudomonas aeruginosa
SAAATTSSSTPSRTPACSTTCATTRRSARTSPPVRPIAERSRRSSTRPGDAGTSPRSPAPYSTASAADAWWPPRWREDGWPAGTTSRGSMQASSTCATISTWTISSAARASRNPEHEGTSMNRLPTCLLAATLFLGSASLYAEDPACARVRLADPGWSDIAVTNATAAFLLESLGYQVKIDTLSVPIIYGGLRDGQVDAFLGGWMPAHQDYHDKFVASGQVERLGRNLDGTRFTLAVPRYVWDAGVHRFEDLAAQGQRFNRKLYGIGSGAPANQSIQKMIDANQFGLGDWKLVESSEQAMLAELGRAEKRQRWLVFLGWTPHPMNIRHDLRYLEGGEQYFGDRGQVYTLARKGYAAQCPNPARLLANLRFDLDMENRLMSDALEGTATPASATRAWLKANPRVLEAWLQGVTSRDGGDALAAVRGQP

SEQ ID NO: 21770 - protein, 636 aa, Pseudomonas aeruginosa
RHVDALAAVPRLATGAAPGHARARGLGRPEWRNPGTAAIDGLCADRRPASGVRPVRGDAASGDRLPVGLVALPGERSHRGDLGAAVQFGGPAGAAGQPAIRPGRAAADLSRRRLPVAARRPARRVAGQFRLAFGDARLHPWRGAADRPRPTALSSRPGRERGGRSAGKRLAAAGAVRRVRWPIAAGGRLQLRAQPAGQAPATALAGPAAWLAGRCHAGLGATRDLRLGSPCAGLIERTAGLESAGLRFPIDPRPATCGGGLRHARAGHQPVDRPRPGRAPGRRVRCQPGGPRPGPVEPARALAVGEPVGGLLHPLRAESGSRCALPAGGCVFGALGGTAGRARCAPDRACTVAGDGRRHPADRLGPDRPPDAPRALPQRPRRMPGGRPNRPGHAAVAAAERHLRGSAGVAGLLPAAHLDTTRTAPAQRRGRSAAHRRLDLLRRLRLPATPHAPMRQATAGAGRPPGELHRLRRRSAVAAGSPPPARRGPPPGIAPRPPAGPRSAGPAGRRRLPPALRRLTLRAPPAMSVRCRRAAVAAIPAAACRASSPTVQGRREPRRFPRRCARHPVRPPRSARGFPVSAVRRWCRPVPVRGSVVPRRPGTASDRPAPAPSRPGVVAGRRAAGCAGRPRRAASA

SEQ ID NO: 21771 - protein, 172 aa, Pseudomonas aeruginosa
TGSPARDPVPPPEAPPRTPVLPLAIAPAPAAADGRRPRAVPQASWLATEKTRKRPYRQAPATRRRRSGRSPARCSRGQRRASASQAFHPGAGQQVAQARLELRCQLLARHRLVHLEAHAAVVEGQLAILAATHPDDLERAVDAHRLGNRIGLLDQRSLAQQVEPAVLGPYQA

SEQ ID NO: 21772 - protein, 182 aa, Pseudomonas aeruginosa
PCRRVPAAHRTHGGNHCRGRSGADSDGAPACPAPGSSRPAALPGRSRPGPGGTRGSRGGCGSGPGAPGKRGCPVAIPPGPGRCRLRTAIAGRGPVPAGRETASRSARPRPPRGAASRPAAGCFPPGHGSSAPAPRANAPRSGPGAGAGMARGPRGSACRIPVRAGCRPRSPRWRRDRRGSAR

SEQ ID NO: 21773 - protein, 165 aa, Pseudomonas aeruginosa
GGSSGRTIPCSAGRRPRRTARRRRERPGANARSLPRGRSRGSDRSRRRTTRPAPRLPSRRRRNARWHGTSARGGFPDGSPATRRAPGNRARPVPADGRWPRAAGYRRRRGKNSPRPSRSMRRRRLPASVRRHRPDAPRRPRRSGPCRPPPRGRRRCGLAGRAGRF

SEQ ID NO: 21774 - protein, 207 aa, Pseudomonas aeruginosa
SSAATSASRSTSASPWPKQPGRIPNWPHGEPRARPYCCPEARTQAGRMTCPVTRSRIRLGLRRPPRAPPRIASSSSWKYCSTRSRVRAAGRPAGLAEVEISGPVRWHSSCTRGWSVTRTATLSWTPVTHSGRRSWCGTSQVFGPGQVPARRSSQTSGRSSRRKSSWWIFAATTIRPFSTGRAFSASRRYTASSFHGSQPSPHTASVG

SEQ ID NO: 21775 - protein, 408 aa, Pseudomonas aeruginosa
AITPPSRTTRAAHCARKLLIIDSLQRTGCAKCTVSAGAMHPGAGLAGDPAVEFQFAERRQHIGQRHAAGGGQAFAGVGRGAQQRQQRVGQGLRRRFRWLRLRPAAQCFEHVPDAFHQQRAIANQLVAATCAGMVDGTRNGVHLAPLFRRQPRGDQRAAGGTCLDHQHTQRESADDAVAPGKVCRQRRAVQRQLRNQRAATLDDAPRQRLVAPRIEPAQAGAEDCHGRAASLQRALVGGAIDAQGQPAGDGEAALRQAARKAPGGAPARRGWRGGCRPSPVAAVPESPERLRRTAAAGHRRLRRAVPGIPGRPTSAGACADLPASAGLHPPLPAPPGCAARRRPRQALPGCARRRLARQARKRPNRRPRSSAGSAWVPVRAGHAGAAVLPVRLENGSSLRLIHSRQVHR

SEQ ID NO: 21776 - protein, 192 aa, Pseudomonas aeruginosa
SRFQAARHLSSGFSIDSTSASQTHMAILNILEFPDPRLRTIAKPVEVVDDAVRQLIDDMFETMYEAPGIGLAATQVNVHKRIVVMDLSEDKSEPRVFINPEFEPLTEDMDQYQEGCLSVPGFYENVDRPQKVRIKALDRDGNPFEEVAEGLLAVCIQHECDHLNGKLFVDYLSTLKRDRIRKKLEKQHRQQA

SEQ ID NO: 21777 - protein, 332 aa, Pseudomonas aeruginosa
  UNSURE (205): Identity of amino acid at the above locations are unknown.
PHPPKACPGKPFSFSEPRMSQALRIVFAGTPEFAAEHLKALLDTPHRIVAVYTQPDRPAGRGQKLMPSAVKSLALEHGLPVMQPQSLRNAEAQAELAALRADLMVVVAYGLILPQAVLDIPRLGCINSHASLLPRWRGAAPIQRAVEAGDAESGVTVMQMEAGLDTGPMLLKVSTPISAADTGGSLHDRLAALGPKAVVEAIAGXAAGTLHGEIQDDALATYAHKLNKDEARLDWSRPAVELERQVRAFTPWPVCHTSLADAPLKVLGASLGQGSGAPGTILEASRDGLLVACGEGALRLTRLQLPGGKPLAFADLYNSRREQFAAGQVLGQ

SEQ ID NO: 21778 - protein, 466 aa, Pseudomonas aeruginosa
SKPDEPCPAMKIIILGAGQVGGTLAEHLASEANDITVVDTDGDRLRDLGDRLDIRTVQGKASFPTVLRQAGADDADMLVAVTNSDETNMVACQVAYTLFNTPTKIARVREPAYLTRTGLFDNEAIPVDVLISPEQVVTNYIKRLIEHPGALQVIDFAEGKAQLVGIKAYYGGPLVGQELRQLREHMPNVDTRVAAIYRRNRPIIPQGDTVIEADDEVFFIAAKAYIRAVMGEMRRLDDSYKRIIIAGGGNVGERLAEAIESRYQVKIIERSPLRCRHLSDTLDSTIVLNGNASDRDLLLEENIGETDVFLALTNDDQANIMSSLLAKRLGASKVMTLINNPAYVDLVQGGEIDIAISPQLATIGTLLAHVRRGDIESVHSLRRGAAEAIEVVAHGDAKSSKVIGRSINEIKLPPGTTIGALVRDEEVLIAHGDTRIESGDHVLLFLVDKKYIRDVERLFQAGLTFF

SEQ ID NO: 21779 - protein, 195 aa, Pseudomonas aeruginosa
GFGLRTPRGRVPPSQRPNPSVPCKAWPEPGTMADIVGRGQDDDRRSGKDAGQRRGQCAAALRPGQGLPGRGRRRTRGGTPPALRRAGPEVFRRLEAAGQGTPGCRRSRGRPAGLGAGPGNCRDAWRQAGRKGNDGVPAQARQGENLSVRPRLAQRVLATRRPEFRQTGRACSSSAGRTVRARPDDTFTKTCSTHS

SEQ ID NO: 21780 - protein, 688 aa, Pseudomonas aeruginosa
ASPNSRTSSTNWSRRSASTKPSTTTSPTGSGSATPTPATRCTACRCRRCHDPAPARGRPQPRRRSPALPPAGAGAGIARGSPAGHRRPQRLRQEHPARPAGAGPGAGPGRALRIPRRGTPAGHRRALARRPPGPLGGAAPAALRLRAAKRRVARIPRCAAQHRTALRVARRPIRRARAGAGRSAGNRRPAGQETGGAVGRPAPAGRHRPRPGACAAPVAGRRADRGARPAERRTGDAPAGGAGPRARRLHRGRHPRRAPGSRSRPGSPGHPLATRGRRQRRRLPRGSWLMRAGLLLSLAWADYRGEARLSLCAIFALAAVITPLLVLFGLKYGLVSTLTERLERAPSVREIIPVGGARYRAEDIAALAARADVAFAVPRTRQIAATADLSGGGETALSVEMIPSAAGDPLLAGLPQPDRPTRVVLSHGAAEKLGAQPGERIVARIGRRMDGQAQSQRLELEVLAVLPQERFARDALFAPLALLEAAEDYRDGRAVAAYGWPGKAGETPRARIYPGFRLYARDLDAVEGLRRHFVASGVEVATQAEAIAQVRSLSRNLGLVFWIVAALAIGGAFAAIAASSLAAVERKRRALAVLRLLGFPTAALVGFVMLLALFSAVFGLFLAGLLYAATAGALNHLFDNQSGEFVCRLLPSHYLTALLATLLCSVLAAASGGWRAARIEAAEGLRDV

SEQ ID NO: 21781 - protein, 388 aa, Pseudomonas aeruginosa
ESHSSARPRRLPGICRAGLGRRRLAGQSQAAGRRRRPAAAVWRRDGLPACLRTRRRRPRRSRGQPRLRLQRRRGGLPAVVHLRLPARLRERPVQPRRPGTGLAAEALRQPAEACRRHPAEADAVLHRQVRGDRPPVRRGDEPGGRALRPGRGAGLRRAGRDGRAAAQGQPLALRRRTLRRGVQRLAAEEPPGTAAGQRPRQESRGRRHRLRPPAHRGRVGVRRARRPGGQPPGTGRPAVPAQGRGQRPGRPAGRLGGVQPGRRRHRAGRATVAGRDEAAEPAGPVRRDRQCRGDGPGVLPTGPRRSPAGHIWRFRGEGRELSRRRDDSIHRDAPRIPAVRRRRQRTAQRDHRFPCRHRRAVRAALALSRAVRPMAEGRPTSGIDRCHR

SEQ ID NO: 21782 - protein, 166 aa, Pseudomonas aeruginosa
RFVDRPAARRGRRKPDTVGGTGRRDDQQLQHTPDQPQEGQGESRGSQGSGDRPALCRRHRQRAQRPRWRIGHLHRQPRHRHPLHRRGDPGAVPAHPGRTQSQPGSGQEPGQARDPVRQTRRRLSPAAPGRAGGGIEGIARVQRALKEFRPAPLGSRAVHQTRSEMQ

SEQ ID NO: 21783 - protein, 204 aa, Pseudomonas aeruginosa
PPAACCSAAAPAAASARSPRPPARNTTRPATSRCRTCAAPITQCAIRPSPAPLPAASWAAWPAAWPATRTAAAMPPSLPQAAPWPAARRATTWRSRSRSAMTARASAPTVPTSTAAPSRSTVAWPTPSRRKAATRASSRLCSTVARTSRSTKPKGASAWPRSSAACRRPTPCWSPPTAVPARTSATTPRPTRKTCSRSAYRAPR

SEQ ID NO: 21784 - protein, 170 aa, Pseudomonas aeruginosa
PDRPEGRAFAGTAASDVSGFPAAAVLPAGRIPPPARSAATPPYTKCCTAGKTLEQRHLRPRHGEPAAIQPEALAAVPARGASSPPRNDAPAGRRTVPGHESGGRSGCRRPRRHGIGGPGSSHARRVAGSAPPAIPRTAGRLRAAGAGACTRRCARRRPAPPGAGAPAPCR

SEQ ID NO: 21785 - protein, 150 aa, Pseudomonas aeruginosa
SCTPGRPPGRSAGPGRRAGGRGRRPSRHRRACWRGHRGRSRSGRRARRSRGSRTGVRRRASVRNRAVRGSGCRRGARRWRTGRKAPCPPGSRHAAPPGTRCSAPRGVSRRSSRRPSSAIRCSPARRRRRAAAPGRGRRTACCAPPGRGGS

SEQ ID NO: 21786 - protein, 266 aa, Pseudomonas aeruginosa
VRPSPAPGPSRSAARAGFPAGGRWRRGYRRGSARWPASRVPGEWRRKAAGRRPAEGDSRSRWQPWLRKYPTILNTIGGIRSLRKTIVTIRSYQGKTPLLGERVFVDPSAVLVGDIEIGADSSVWPLVVIRGDMHRIRIGQRSSIQDGSVLHITHAGPFNPDGFPLSIGDEVTVGHKVLLHGCSIGNRVLVGMGSIVMDGAVIEDQVILGAGSLVPPGKVLESGFLYVGSPAKKARPLSDKERGFFTYTAGNYVKLKDLHIAEDYHA

SEQ ID NO: 21787 - protein, 557 aa, Pseudomonas aeruginosa
RHAALPEHPLRSRRHPHRPTRGHHPLGAVRPRPPGHRRAGPGAPGTLHRPPAVAVLHADLRLRRSARLGGGEPLPRALQGHRSLREPRVRRHSRAARSPGRTRPHALRRDQQARRVRPRDRPPLRLRPSLQGDLRQRAGRHAHAQGRTDPPSARQRRPGSGALPDDRRPHARPARRQPQRCRLHRRRLRLRQRRRTARAPADPLLRRPRRPAAGIGIPLTHAPFQTRTPDMTDNPFATPTAPVQPPAREVPATTQPYAFIAVLALVTCLSFAVSLGIQWYNDIGEIRQRFSEHLQLMAPHWFTGLVFYAAANLLVLHAYREKRQLIEFRPLALLLIGYGLLNLVCGMLAGIGLAPLTLPFYQWVTAQSSYGVWLMAFNEAMSWVYLLLGSLLPLGLVLLGSRVNSPRLAEGEEARVAAWQVALGAALCFATLCFKLMQFLPYALLRYDEPWLYGLYLSGVALPAALLFGAVCTRLPARLQRFAAGRALLLAVVAMLLWSVALLAVGGGLALLMILGLAPAGIGYTLLVALLGVGLLALLWPIGRLATRWCYADQLAA

SEQ ID NO: 21788 - protein, 175 aa, Pseudomonas aeruginosa
PAAATAPGWRTRSIPRRAGRYRRTGDSCGCPAGRGVRWRIAGPFPPSPGVRASARRAAGRRSPRRPARGRAAGRTGRWPVARSRRRSSNRSAPTAPGREPNGAVEGQQADGEGGVAWAEHSTARGPPAALPAPVRDPARRRNARRFSKAQRMAAGLKELRSLLCVRCCLPVACSS

SEQ ID NO: 21789 - protein, 299 aa, Pseudomonas aeruginosa
GLSLSAPLSVERVPLPSFRPPCQTADAVFFMSTPPELWMDIRSRRRAGMSTWEDDAAGQVQSACAAAGFRRNRRCGRAAPRPRPRHRCRRQGAAAFREEPASRPAGRGSARCRAPAGGRRAPGRRSGSQRRRDGSSAADCRRSARAAARRSRRRTPRRSPRQAPVRHPARAAPDARRYAGPRRSGHAGSAPASPRRGRRALRRQARRRSAGPSRIPRWCRAAGRRSSPCRTAGRSVGRSAGHGASRSGAGRRRPAGGWHRSSCRRHAGVRPDPSPRRRRRAAARRRSTSRRADRRGNAG

SEQ ID NO: 21790 - protein, 336 aa, Pseudomonas aeruginosa
GRSSRSPRDAPQGTPRSAAIGGRGSGPLHLALEHLGAQLQAFLARQVRVAALHRLDQRGGIPGLGQFGFQGLQVVTGEAHAVQALRLLAGEMAGHHAPRLQRLDPVEHRHPGLARGLGLGIGGPDVRTGFHQHATNHRLQRRNPQHRAVRARPLQVDHLQGMAFQLQLVALQRLRHHQRRRRVVLEDRPPVGQLGVLGRLDVCDGLRRREDLRLGEGGLQHVEAEVEVRVAVADVDSAEGLAAGLDTLDQLLGVGAGELRVDQHRLALAHQQFRGHGEDRLLAGVVDLQPQRFGAGGEDAGGPQQGGGGEQGTKQSMARHERFSRQWDQRLAMLVA

SEQ ID NO: 21791 - protein, 446 aa, Pseudomonas aeruginosa
SVADAWWRCCRSGRRRCSASTRCTPRAGRCRRRCGRCWTSWSNGWRPIRTGTRRAPWRWRESRVDCWTRRLRRTFIPCLEHVHVPVDLPGFDPDLPAHPRQPLGDPEESRRPRRSEEHRSAHLHRRPAGAGHVPPGAPGADRQRRRQGRRRAAGRAGSAELRGYGNHLRRTPGTHRSHRRVPRGHPRGTTGRRRRAQRDPQGARPGDQLQRPRLPLRLRPAQLLLPRHHRLRHPPPQRRRTGQDGLPRRRLRFPRRDGTHKDHGMDRKTLDDTSKFLSYVLRHQPEAIGLTLDGEGWADIDALIAGAARDGRALDRMLLGAVVENNDKKRFALSADGQRIRAVQGHSHAAVAIAYAPAVPPAVLYHGTASRFLDSIRERGLVPGSRHHVHLSARRATALEVGRRYGSPVLLEIDARDMHLAGHLFHQAENGVWLTERVPVRFIREA

SEQ ID NO: 21792 - protein, 87 aa, Pseudomonas aeruginosa
AWPPTNAWTGRSIRCPARFTCSRANCAWRPATVPRARGCWKAKAAGCLMNIIHRLIAGAEPVEALLFHAGVEGMPVGLGERGEMPDA

SEQ ID NO: 21793 - protein, 188 aa, Pseudomonas aeruginosa
IRWTHRAGASKNAARVRSPAVHPPTPHNSKNNDRCIHGKGPDFPRRLRVVPQPSLRAPPSTGDTRPLAPPSRPPPQQPATHLASVPAPAAGGRRSPALRPPHRSTHEPNKNRSPPDALRPSRKPILPLRPGRLGSPAARRRLGRQRRPRRRPQAAQRRLLLEPRGSVVLRGAPARHAAAVQRRQRRHP

SEQ ID NO: 21794 - protein, 432 aa, Pseudomonas aeruginosa
  UNSURE (405): Identity of amino acid at the above locations are unknown.
PHALLDAPLHDPHPAPVGAILPPRQGPGPGAAMALRTRLARTAGHRPAAPLRRRRLALPADDHQRLRRLHPGHSRDGEHRPAQRQPLGRHRPCAGRPRVQAGRRQPAAYRGLPVAGQLRPVQPRHAGRHPGPLVPPRPAPGRRLHHHQPGRRQPVLAGGLERPLPRLLRRQRRHRLLPRRQRFAQLRASPGQRDQSRHRADFPAGLRLQYQPAAPLARLRQRQPLAAEPASTVLQGLAAGPPVARRRYLARHRAAAGRYQPGRGRLRRHLAHQLRLLPRLRQPAHRKRADQRGDERHARSLPGAPAEPTDLRAQRRWRRLPVQRERLPQHGAARRVPPGDSRRAHPCPGDEQLLHRRTGERRRRAQRQRHQRRPLRGLPQRHRGADPGAAGGRRQRPGAGGASGXVLARRKALASYRFAAEPNCRRRRPTGR

SEQ ID NO: 21795 - protein, 132 aa, Pseudomonas aeruginosa
LGEFSMSFAQNLLRLRQQNALTQRQMAERLGVTVSQLRHFETKGGHPSLVVLQTIAGRFAVPLDWLVCERSERQALPEDLRLQFEAIGRLRLDERRAIRALLDDLIRQYMAKRNAAAKPLPAACTEATETSP

SEQ ID NO: 21796 - protein, 174 aa, Pseudomonas aeruginosa
HQSRICRTGWLSCPGPRSSWQRWGPGRWRDSRRRGRPGPLSPPRRHPCPGCRGRSSRPVQPVRSFRTRQTCPGRSTPGPHPALAPDAGNDSGAGTRRWYRDRAPSPRHRCTARPGVRLGTAPPPARSAPPGHPPAPCRQARPLPRSLPRGATGRPCPLPHAVGRRFRAVAPGLR

SEQ ID NO: 21797 - protein, 76 aa, Pseudomonas aeruginosa
RKHMSKLLKNFIFYILTTPGKNVINMSMINKSLYRLDIIFESCHPAIKLFCLIVHLQYYRPPIQDKIRKNQFPQDQ

SEQ ID NO: 21798 - protein, 1650 aa, Pseudomonas aeruginosa
RPPPWLSKSAVTMRLSPPSAERWPCWLRTPCPARISSDCAWVTPALLSNSPVTSVSQPLALLSTPPAPLSRLPLCRSRLPARLSRRPPWLSSAPPIRSRLSPWAWSVPWRLSRLPACTSRAPAWLKIRPSCWLRRAPPPRRRLMSAWLARVPEALLSRLPVVISSSPWLTSLPPRLSTLALRSSRSPPLARRAAPALTRAPPRMASSRPWLINWPSLLSRLAPLSSRLPPLIRPPALFSSVSSRSKLSARCAETRPPWPLSSFPAMLRVTSLSPETMPWALSQAGGVHPLRALADPGALAVVVQRAAEGDGQLAVPCSKGCRRRCCPGSRLVTVRPWPSGEQAGAGVAQRVGVQAQFPGADDAPLLAVVDAPGQQLEALLAGNLAALAVVEDVQPLDAQRAASTDQATLVVQVAAPQVETDAALADQPALALHQALDRQAQVAPGGDFAAVGGVDAPCRQFQFAVAGQQAATVVQVGGAQAQRLLATEGAATVVEVGAADVQHALADQLATLGVVQRASGDAQAGVAGEQALAAVVQGGAGERQAGAGNGAFGVVVQRAVDAQVDAGAAGQGALGAVVQASGRDVQAGGAGDHPGQAVVQGLGDAQGQAGGADQAPAAVVQAGGGEGEGAVAGDFPAGAVVHRAELAQQQRAGRGDQAAVAVDQRAAIEVEGDAGFADQDAASALVEAFQVGVEQALGADPSLLAVVQPGGHQGDAGVAADAAVAAVVQHAGADIHRTLGADHAGTAVVEAGALQRHAGIAEQPAALVVQRGLAGQRQRTGAGEGPATVVQARGARRQAAFADQRAALVVQHAAEAHAQAVLAVEPTAVAVEQFAAVQAQAVAPGQHPLGLVQQALHGEAQAAVADDLAAAVVQLLAGVHGDLRGAGNLAGAVVDLPRLDSDAAIRGDQPGLAVVDRVGRDLQGLFADQFATLLGQAAKRRLQVALGGDTPSGVADGVRCEVQAAIAEQLATLVVAQAGDLHAHASLAAGAAAVAVVEGASRGAQAGVGHQHAATVVQAGAVDVQLAAARQQAAGAVVQLPHRHALRALAEQVAFIAVVQQAAEADLQAAPAAQRALAAVVQAARPQVEAVGCGEQAEAVVDGTAGDHQQVVADQLAAAIVEATDAGLDALAGDFAVPPVDQRLGADAGGLLAAEQALLAVVERRRADLQVVQADHLAATVVEIATGLDHGAVPALQQAVLAVVQAARLDPQFALGEQLAATVVQVSAVDPDGRPLQAAALVVQRLARLRFQRAAGHQAAGVAQGAAAQLEVAAGVAPLVRLDAGFDHPGVVEARGVQRDAFARRQALPVDQFLRAADLGAATGVGLAVQLHGLGRDLQVALAGGLGQAQLAAGVDADVAAAGGHVAGQPHPHALLGADQADRPGVHPAQRRAVDRQLWLLAAIGGARRGLQAVGLDVVAAGDDVEVLRVELGVELGAAGDQVELFEVADVQFGAFDDDVAAVHLEALQALAVHDRLAGGEGRARRVDEAAALAGDAVRVGDDHPRRLPGHLGVAGQGAAVAAGDLVEDHLRRLALEVGVAEDDPAELGTLGLAGGVVEDQPVGADVVVAEMVVRQPGAVGRGDIDDGHAVARLAQAGVAAGGLVQRQPRRRGDDRVEEQDAGQGQGDALVQRAADVHIVTPWRVGARRG

SEQ ID NO: 21799 - protein, 101 aa, Pseudomonas aeruginosa
TAGFPACCTATAPSCCRTRMARSSTHTPSPPASTIPASARNTPGCTTPAASSTPRSPTTKPWRPSTPAAASKASSRRWKAPMPWPRSSSVRPACPRSTSWW

SEQ ID NO: 21800 - protein, 228 aa, Pseudomonas aeruginosa
DAPGADGLLQPDPPLRRRTLHRRGEGGGGGRPDRGRPAAGAQRRPLPPGPGRRPRLHPPDHPDHRRPAPADGARRQFRVRLLRVGGRRHRRQRGDPGARRGSSGAPAPAYRPADRYRLRHPQRRTRRRGRAVGRRRGGRLGADRPDRQGPRQCPGGQGCPRPVRRAGRRRAQRTLTDPDSGILQAQATRCAWPCVARCQNREEKFTVTFRNVLLSADSAEALNSASPK

SEQ ID NO: 21801 - protein, 215 aa, Pseudomonas aeruginosa
PTHSKKVRMSKVLIVDDHPAIRLAVRLLFERDGFTIVGEADNGAEALQVARKKSPDLAILDIGIPKIDGLEVIARLKSLKLDTKVLVLTRQNPAQFAPRCLQAGAMGFVSKRENLSELLLAAKAVLAGYIHFPTGALRSINQQSRDNEARMLESLSDREMTVLQYLANGNTNKAIAQQLFLSEKTVSTYKSRIMLKLNAHSLAGLIDFARRHELI

SEQ ID NO: 21802 - protein, 326 aa, Pseudomonas aeruginosa
GSHANVRPDRRPGRPRQPTGDQPPARRAADDQQQRRHPQAATRPGARADPGTQRAGAPPGGHGLADPRPRRGTRLPPTGDRLRRKLRAQARRCRRRPGDGTGRAAMRTARLDDDDRASRHGEVIALRAFVQDRQVQRANGSHPDGSVAMVEQIVAGNRVDEHHQVLPMDGQPGHQLAEHLGSERQLAAPVRMRPYRPLMDPPHLQRKAPRRFFAKGAGSLDALRIEIDVSMEALDAGGGILVHRHLFKRRRPATRPAASRRNRRPAAGAACAPAIPHSTRIATGSSRQWAGKAAPVRAGRRPGGASRWPRPGRRWPPGSARCSCRS

SEQ ID NO: 21803 - protein, 160 aa, Pseudomonas aeruginosa
APPESAADRWPTLRTTPASRTSGRAAPASDAASAGAPGAPWPAATAIPRPAAGYRPGTPPRETAGALRRAWNDRRRTGSPRRYRRAGRPGRARWSPGSRPGADGPDGSAEGAASASRQRRRSRWPPGAPRGAGARPARRCRHRSSRGRRPRGGAEAGRRR

SEQ ID NO: 21804 - protein, 138 aa, Pseudomonas aeruginosa
RCDRRIHRRGHPQPADDDPPRRLQVHLLRAGPLPALRPAQRPAGAREPRRQSGPSRNVRGVPRRGPATLGHPRDHPRRTRQPAPPTPGGRRAGARTAGQLGPPAVGRCKPAVHAQPYRPGRSRAPRALPATLSTRALP

SEQ ID NO: 21805 - protein, 535 aa, Pseudomonas aeruginosa
PAATAATPWPRFAASHSAMWTRLLPFLAWLPGLHRGMLGREAWVGLNGAILALPQSMAYALIAGLPAEYGLYAAMLPVAIACLWGSSRYLVSGPTAAISVLLFSSVAPLAPLGSPQYVQAVLLLTFLAGAFQWLLGVLRVGSLVNFVSHSVMLGFTLGAALLIVLGQLPYLLGLAASGEGAAPGNGWRLLARFAEFDGPSLLVGGFSFALSLLVRRLRPRWPALLLGLLGGATLVWALPGTFASVAHVQALSSALPGWNPLVFDSRSILDLLPAAVACGMLGLVTSLSIARALAARQGDAFDANQEVRAQGLSNLLGPWLSASLSAGSFTRSGLNLEAGARSPLAGAFSALWVALLAVLGARLIEHVPLPAMAAGILLIAWGLIDRPTLRALYRSGRAECLVAGLTALATLLLPLQNAIYAGVLASLVFYLRRTSTPRVLRQRNDEEEVLRIEGSIFFGACDYLQRLMRQCDRPRLVLDARQVNFIDFAGAVLLQQEARRLHAEGRRLVLRHARPQVREALGRQADEGCRLHYEG

SEQ ID NO: 21806 - protein, 655 aa, Pseudomonas aeruginosa
PGFVIPTCQMEANLRRTSQMPPDNSDSCQLSAQRLQHWRRGRTHAAPEEECLGGLLHQHAQAIQGTRRTAFGGPAVEGSRFLGIHHVVADGTAGLDHALRQRRHVAGKTGRGAVDDQVERPFDLGETAAVHRAEVGEPLGQVHGLPRRAVGDQQLRRALAEEGFEHPTHRTAGAEQENPLAAQLDPGVRRQVPQQAGAVGVVAAQATVGEADQGVHRPGPGGPLAQLVHQAIGLFLERHGDIGALALLEEAPGEPGEIVQRRQLRVIDQRLAGLLGEQAVDQRRLAVADGVAEYAIAVHGSFLCRSGTGRADSSPAGGSGLAGEPIAVGEEILGQARFLAARLGFPVIAPAHLRRQRHQDRFGTAAGLQAEQGATIEDQVELHIATATIGLELSLPFIERRVLAALDDRQVGVDIGIADGADEGEAGVEVPLVEVVEEQAADAARLVAVLEVEVAVAPFLVARVDVRAERRAGVASDPVPMHAVFLVGVVGGQIEAAAEPPDRLLAFLLGAEETHVGMGRRHVGVFRMDHQRHAERLETAPGQFRPMGAGRGRQAIAEDVGKIHPALLDQCAVADYPRPSAATGRTLPGVLGEAGLAVLRLEGGADAVLQVEQVGFDSGDTVGHGVHLGAGRPRGARAGDETRAQAYHPGWVAGA

SEQ ID NO: 21807 - protein, 136 aa, Pseudomonas aeruginosa
GAARSSASKGWGRGCAGASAGSACAQPRSASSTCPTLSTSSAPSRISWWQPRAPGWWMEPGMAYTSRPCSAASRAVISEPLAGLASTTSTPSESPLMMRLRRGKFAGSGGLSSGSSETSAPPPSTMRRASASWRRG

SEQ ID NO: 21808 - protein, 383 aa, Pseudomonas aeruginosa
PACNCLAASHWPSPTSTTAAASNSPPARCSANEPASRRLPGAGRGARRTRLAVWRVAAATGQGRPARSRPDPGAGLRRGALATAPAGPGRAPVAEAVQGRRHRYPRPAADRPLPVALHADSAARRDRRDRRLRRQAEEGLGQGRAQRRAAPRAARRRDAAGRGRPRSLSAPGPSALAAESAQAGLAGAARRALRSEQRTPADDLAGQSAPRRARCLPGRTRRSRNQGPRLRLQPRRHPARRAARRARTTGLRGGSRQRPGRSRATGRRAARKRARPACPRRLLCAWRQDLPPAGNPAGTGRSGRRRPRGEPPGKGPGKPPAARPASQPGRRRRQGHRGVVGRQAVPAHPPRRAVLGHRGDPPPPGHQAGAQAGRHRRPGAPAG

SEQ ID NO: 21809 - protein, 110 aa, Pseudomonas aeruginosa
LEEGRMMIEGLEKMLAKGVDNALLRFGLGKGYLDAGDAERAAEHLQRCVEQDPKYSAGWKLLGKARQAAGDLAGARQAWEQGLATAATHGDKQAEKEMTVFLRKLDRART

SEQ ID NO: 21810 - protein, 447 aa, Pseudomonas aeruginosa
RRGWRPAPGRRGAGLLGALRVRPQAGRRQPLAARRRLQQRRGRRLAAGQRGERLEAEPGAEVHRTLRPRAGDVPQQRRAGRAPARRYPRSARHPDPGGGPQGRSAGGRGRAQRPGDPPGPVLPAADLRLEGKLRRRRPAGAVAGGRLDRPRRQRRGTPGAGPGRAWRRQRRGERHLPHRHRPGGGHLGVDAALHRPRARGDRRPAAADRRARRPGQGQLRPGRFPQQHRQDPRPGIRQQDPGAAATGQRRAALRRVEQPGARHRRLQPLVQRRRLRRDHAGGRRNGLVALRRARGAAGHRRRRAAQERPARAHPDERGRGPPGGAAQGREDLCPAPAHPGREEQPRLRRAAVPQPHRRRQPEDRRPLHPGGRRRGERLRQHGEGDRHGVRRPGPRRRQPQAAGAALRRRAKRGEQVVGHRLRHADGIPRSPRPGARAAGRHRLDRRP

SEQ ID NO: 21811 - protein, 387 aa, Pseudomonas aeruginosa
PDQPGAAGVPGLRAAEQAATQRTATVAETDRRRGQAHPDLAQGLLPGNRQRQRLHEPRPGATGEGQQPGAERRARRIPGRPAVPQQVAEHDPGPLAVAERRRTAGLHRRTGVEDPPLRNLPQRRRQLGPVRRRRRRRRAVPRAAVDAAMILRLHEVARSHGAGRQRYRLRVPALELRAGRQLAIVGPSGCGKSTLLDLLALALAPDPGGRFEFLAGERPQDIAALWRDGRQDRLAALRRQHCGYVLQSGGLLEFLDVRRNIGLPCALLGAPSAERVQALADRLEIGDQLDKKPAALSVGQRQRVAIARALAHAPRLLLADEPTAALDPLNAERVMRLLVEQARERGACTVVATHDERLARAAGLEVLAIRWQREADDSVGACLEEVG

SEQ ID NO: 21812 - protein, 232 aa, Pseudomonas aeruginosa
FPAPPATRCWPACRNPTGRPAWCSATAPRKNSAPSLASASSRASAGAWMARHRASAWSWKCSRCCRRSVSPATRCSPRWPCWKPPRTIATVARWPPTAGRGRPARPRAHASTRASACTPETSMRWKGCAGTSSRVAWKSPPRPRPSPRCAASAATSAWCSGSSPRWPSAVPSPPSPPAAWPPSNASAAPWRCCVCWASRPPRWSASSCSWRCSAPSSACSSPGCCTPPRPAR

SEQ ID NO: 21813 - protein, 601 aa, Pseudomonas aeruginosa
RRCSPRCCAASWPPPAAAGARRGSKPQRDYAMFEKAILPLALGACLAFAAPAWAEGDSPDNPKPLADDVALPLPCGGEMVFRHVYVLAEGALDDREVNLGYAFNEGEAGYQQSFISGYRRDYVNGQFSLADLAPAWQQKLSASLPKPAAGTPLKPMLYFIGKYEVTARQYAAVMSQAAALSGQGEAPACDVPDGMAARLPKVNLSRFDAERFGAVYSAWLLKNHPELLPVSGRGKNPEDGGIGFVRLPTEVEWEFAARGGQAVSRQELEGRLFPRKVEGSDQEGPLGDWAVYNQVAGGTGQAARLLPVGMKRPNPLGLFDVIGNAAEMVQESFQLVHAGRRQGTYGGFVVKGGNYLEGEMTLFTGMRREYPLFAADGSEQRNETTGFRVAIGALSAPRSRYPELFAQWQKEGRLAALTDAIDDAQDPTKQLDGIIAATRDPQMQAQLAQINEELKRNVSLIARQREEAAGNLIQSAALVAETINNYNIRLTNLKKDREKAVAARDQATAQLYAGAIANGRSALDGALAIYIDNLATGTRYTDAVIQAQFQRIQEELNRNPVLGKSLVKRATLFVKHVGDYRQQHRAEPEAVLKELLASSGR

SEQ ID NO: 21814 - protein, 180 aa, Pseudomonas aeruginosa
RGLRQVGAKLLPEPVQGSARRSQEQVDQRSRRAQAPGRDRQRPAGDQRLAGRRQRPCRREHQQLHPGLRERPAAGRRTARRGDQGRRGREPRQHYERRQQAQDRQQSQGAEGSGRHRADHPQGPGRAKRRQQGGLPGPGHDPGSLQQPGHGRLGAAELRQGLIGLVTGTNATATFGSPFR

SEQ ID NO: 21815 - protein, 411 aa, Pseudomonas aeruginosa
NNAICAPGTANRLQSSPKPWRRCQPEALHRHRETMRQQVGERSLATKAVAEAAVVDLAATALADQAHHMLGALRVVRRQPFLEQRGDFARQAQEHVRGAARAGVPRRLEQALQLHVVDHRDHRRAEHAHRDAVAAERADRPQSRRGRRRARFENALQLVVEGGQADHHRHQVLLRQFAQQVEVAKDQRALGDDGQRVTEAQQHLQHLAGQAAFALQRLVGVGIGAQVDRRAAIAGLAQFLLQRAGDVALGDQPGLEIDPRREVPIGMAGPRIAVDAAMLATTVGIDRTIEREVRRLVAGDHRAGDLLAHLGELDRRHVLLPAIVEGLAVGRGEAVEGVAGGTATARGQGSAHEGNPVKYCIWIQYRTGPRPTAIAAGRRRAVRRRASSSAWDWGRTAPTAPSGWPASARSG

SEQ ID NO: 21816 - protein, 227 aa, Pseudomonas aeruginosa
SPGSCGLPDQPGVTQQGVDGRLATAEIDEQQHRLAGAAAGQDRLAEGTPGIGVEHAFFLETREGIGGQHLGPLVTVVTGRVSAGENVREAVGEAVVRRRTHHRHFVADALEHLQHAAAVAVGGVQLEVEEGELQLADHHHPGLEVLRRQHLLQQVLRQRLAGLVVGGDQRQAFRFPAPVLHELAGQLDGVPGHPVDPGGGGMLDAGQQVVQAMAELVEQGSDLVVGQ

SEQ ID NO: 21817 - protein, 462 aa, Pseudomonas aeruginosa
RRLAVHRRGEVAHQVGHRVDQPALGVAPAVAGAVHPGTAALVGAGIEVEVEAADVLAVLEDLEQAYVGVPAFEIVQFADLDAVEALDDGEQAGKHLVHREVGTQRLLGHAVARLAEFLGVVAGVPALQFGAALLGGVGAQLLQVAGGERLAAHRQVAEEAEHLVAGLGHLGRQRQLGVVGEAEQASQLLAQVEDLFHHRTVVVLPGVRALVGGAGAVGGVYLFAQGAVIGIGHHCVVAGELQADQPAVQALGLGGLLHLGLGRIGQAGQRGFVGDMLGPGLGGVEQLVGETATQLGQARLHLGIALLLVRRQVDAGQAEVAQGVFEDGFLGHVEAGRLGALRQRLVGLEQGAVLPQLGGVGRQLRQAGLVGLAQLGAVAHRVEVADRTPGGAQTVVEFVHRQHQALPGRLLALGFQQAGDGGAVIGEDPLDGRLHVFRANGGERRQVVGLQKGIRAHVGNLG

SEQ ID NO: 21818 - protein, 232 aa, Pseudomonas aeruginosa
SSRTCTSPRTTMRDATLRYPNILFDLDGTLTDPREGITRSVQFALARLGIDEPDLARLEHFIGPPLLQCFMQTYGFDEARAWEAVNHYRERFRVTGLYENRVFDGIPELLEALVGRGHTLYVATSKPGVFAREIARHFAFDRHFKAIYGSELDGTRTHKDELIRHLLDSEGLAAEHCLMIGDRMHDLLGASRNGVACIGVGYGFGSEDELRAHQPTHYCADLAALRQVLESH

SEQ ID NO: 21819 - protein, 446 aa, Pseudomonas aeruginosa
SSAWRPLASAIRCWWRCSASACWRCSGRSAGWPRAGATPTSSPPEQASGRCGGQPLQRRLALRQGELAKGTDPRIERRPVAADLAEQHGERRHPLVVEAEGKQLGIVERRVDPGLERRLATPFALAQRRVLAAQALEFGSLAGTLGGIVQRPGIKCFEARTTGQDQRGELLAALLLAAVRRRQSTIFAPLAGTFLFDEGGEGFVEGGVVAQVELLVRQFVEDQGRQPFVVPAQHAAEDRIVEPAEGRVGLHPADVDVVAERPLARRLGARGGLAVVAAVGHAAGDGEAMGDRLQRQLRGGEHVPYHVGPADIGVQAIAAVVRQAEAFAGELPGLFRLRQAFAQARVALRVGDHRGGRLAGAQQGELAAGQLPVVGDGRATAQRQQRQAGNPTGQSKVSKRMAKAAWHGRNIAQHADRPPPYQHRSAIRRGGGTQGVFPRRNGWRPG

SEQ ID NO: 21820 - protein, 152 aa, Pseudomonas aeruginosa
TPSGARPMRPLTRLVPLALLLLAGCAGPLPQPDPQMAWVELRSAPANTLLAERLDGERLSDGRYFQVTPGRHVLEVRFQYELYGGSGGGGGGFGEPVQINCYQQVVYDGFEAGRRYRLEVRPQLRRALALLSDERGEVVARSNFQTSRCPPY

SEQ ID NO: 21821 - protein, 258 aa, Pseudomonas aeruginosa
SQLCCMDRANHGPPDRHSRLRRSHRQRQPDRRRRASGHVPGDGLALPRRVGGVGRRTPAAPQHPPPEPDRRRRGAVAAVPRDARRGRRHAGHRPDPPRQPARHSAHHQQPVLRPGLADPCRRRLRRALPGHRHRPAGQQPGGQPGGGAHRPSPAHRQPARPQPDRPPPRRMPLGDLRRAGLPAPPRHPAAPGGPGAAQLPDLLLLRPQSLAVRARRRADQRAGGWQSQRQRIHRAAGGRRRRCRDQPAAAVLGSPADP

SEQ ID NO: 21822 - protein, 186 aa, Pseudomonas aeruginosa
TAGRAAFDAPLSPVWSTSMSLSIYQASIPTFLRTLGNLSAILKKAAAHAEAKNIDPRIFIDARLAPDMFPLARQVQIASDAAKGAGARLAGLEVPSYADTETTFDELQARIARTVEFLEGIREEQLDGAEERNVTLKVRGQEISFNGRDFLFGFALPNFFFHVTTAYAILRHNGVELGKMDFLGGA

SEQ ID NO: 21823 - protein, 114 aa, Pseudomonas aeruginosa
LRKDTDKRRTPDGPSPQPRACVPTQPRPPGRNQSAPRNPAAQRLRLERLALPRLSPRPAAAHRAAPEPGRPRTPGLAGPSDAQRALRAQGRTAPGDPRRCPEHAGAGRRRRRVA

SEQ ID NO: 21824 - protein, 601 aa, Pseudomonas aeruginosa
  UNSURE (601): Identity of amino acid at the above locations are unknown.
HRPPVRHRSNPRRTLRRSRPPPPAGAARPRSARRTDRPMNRTRTGVHPMRYAPHASRYSLFALAVSAALLPGAGWAANGDLAGARKPPSVACSWNREAALSYEERRLDTPLPFSGANVVTHDQTPLAERIVKGAGFDGFEPAFAKRLCAADGRTPVSSYAKALKLVTEEGRALWRAAVDRAQGRRAIPAGALPASDDRMLYWTRLYMTRTLRQWAPSFHLGKAQAQALQWRFERASRGQLDIDLPRRYAADGSRYRRMIISGFDVFTLGTPGTANTGLRNGNPSGATALALDGREFRLADGSLLRIEAYLLPVSYDPFNRGMQEDTLGPWFRPGPRRVDASITISQGGANQFWLEAWNGRFHGSSAGNDGIVYCPADSALPNYVLPLGSVTNPGTAPISLRGSGCNINPPRRWLGYDSASRWRQNLPAQFSKASLPVRQLLAADTWRGIERPPGATSQAAEGFDVTWHTNYDFFPDCANPRTENVPTNGVMNAMPDPSLVLPPNRRICARNGGGGDYLSNESAYRNTVLRDAFRLEIPAGHIHVPVMNNYYTGVPASGGGARNDNAISDARYEAYRSAIVAQTRALLVGVGNALAQGAQAX

SEQ ID NO: 21825 - protein, 604 aa, Pseudomonas aeruginosa
RLLMFPRQSRNEAPLRLSGLAVVFLLLAAVGARGKRTVSGRKTADFPYASSRAPTPGRRTRWISAAATGSWWTAHRRAGASGSSAAMVRTGTSPSSLPANGIEHDAFPGSVVEPVHGPGHRPPDRRRARLAGARPRRCAADRRNPHLQPGRPARRLRHPARGRTGQRSLGSLAAGPRGAGRGRLRERCQAWRRPGHDHRDRPADDLPPRQPRPHRTAPAGCRRRHRADPAAEPQGQAPRPAEAPDRRGAIGHPQAAVHFRGPAAGAAQPGLWSLGVLQSLPDLVDGGADRRPRFLRLPGHPPDRLAQGPVADRGARRPGVLHGDDPDPGAPARAHARRPVGVRPAGDLGADVPAHPRRDRRDPPGLAEGTGPAIRRHHPRLPWRHAVPRPARRPRQPGGARRARPAQPLRTAPGHAFRRPAERDPAVGGGRPAAVRRRRHLCGRVALRPRRRRRDHPVPGPRGAGRTRSRRGQPRHRPCRPEQQPGQGRPGRAGGRQAAGPANAALQPGGAAGRSAADPVVRRRGNPGAPLDERDGNRLAPRINLRGYWLQRPGFEDRTRTRVRQGGLAITAERGEGTPPRWTEASLRGRRQGGGWLSQSPFAA

SEQ ID NO: 21826 - protein, 164 aa, Pseudomonas aeruginosa
PRPGGCGSSRRRAGRGACRPRSGRCCRGCRPSPRGRSARAGCRRYAGRRRSPASRRGPGSAHRWVPADPPPGPGRPPARGPSRRSPRPLPATRCRGSAPPSAPRSDPHPVAGAVGPCKRWRCPSGSGTAPRRCSAHRCSAGRCAPPPRRGSAAARRDRRRGASC

SEQ ID NO: 21827 - protein, 1093 aa, Pseudomonas aeruginosa
SGRRRCSAAYRRARSSARAAPRPGRPGRCPASRRCSGSRRFRRRRCPGRYPRLAASIRCAPLLTQAPWPWLSSAPPRVMASSPSLARKGAAGAVVQAPAWSPSGPGHPESRPAPALPSASASRRSFPALMMRPCWPLSMRLASSSKPCWLEISPPWRLSRTFSRSMLSGPRALIRPPWLSRSPPRRSRLTPRSPTSRPWRCTRRSTVRRRSPRAEISPPSAESTRPAVSSSSPSLVSRPPRLSRLAALRRSDCLPLRAPPRLSRSALLTSSTPWLINWPPSALSSAPVATLRPALPESRPLPLLSREALASVRRAPETVPSAWLSSAPSTRRSMPARLARVPLALLSRRAAAMSRPAAPEITPARLLSRAWAMRRVRLAAPIRRPPRLSRLAAARVKARSLEISPPAPLSTAPSWRSSSAPGVAIRPPSRLTSVPPLRSRVTPVSLTRTPPPRWSRPFRLASSRPLALTRPCWPLSSRAATRVMPALLPMPPLRLLSSTPVRISTAPLALITPERLLSRLAPCSVTPASLSSLPPWLSSAAWLVSASAPALEKVPPRLSRRAARAVRLPSLTSAPPWLSSTPPRLTLRLFWLSSRPPSPLNSSPPSRLRPSRPASTPLAWFSRRCTVRRRPLSPMTLPPRLSSCSRAFTATFEVLEISPARLSTCRASIAMPPFAAISQDWLLSIVSAATFRVFSLTSSPPCWARLPSVACRSPLAAIRPPALPTAFAARSRRPSLNSLPPWSLRRLATSTRTPALPLALPPSRLSKAPPVALKPASATSTPPRLSRLAPWTFNSLRLDSRPPARLSSCPTVTRCAPWLSRLPSSRLSSRPPRLTSRPPRLLSVPLPLLSRLRARRSRRLAAENKPRRLSMAPLATTSRSSPISLPPRLSRLPTRASTRLPETSPSPRLTSAWALTRVDCWLPSRPCWPLSSVAAPTSRSFRPITWPPRLSRSPRVLTTARSRLCNRPSWRLSRLLASTRSSPSASSLPPRLSRCPPSTRTVAPFRLPPWLSSAWLAFASSARLATRLPALRRVPLRSSRSPRALRRSSGSTPASITPALSRRAASSAMRSRAARLCRLTSSSALRISALPPA

SEQ ID NO: 21828 - protein, 424 aa, Pseudomonas aeruginosa
LERLQVAEGQAVLVVARMRIARLRVAATLRAKGADALLPAEVEVDETAADPPAMVEAELGLGDPRALVFQAGVFDIVVGALVAEPQAHGGLAHTVAVQHAFGAELVAAAVAIELEGEAAGLVARAVVALAVAVGEGPPAPGQAVEQALAVGMAPAVGHRVAVGAQVELVGQAQRAVPVQTQAHLLLASADVAVVVARGGDPPGLVALALETHPAAADLAAGHQLQLRLARRQATQLVDQLLQFAQVEQLAGPARKAHRQFARAGQRGAVQALQAAFDDDDAQGPGGQVLLWQVGTGGDVAAIQVMVGDGLEQRIELADAQAAPLVGRQQLATRAFAEVPGALQLDAADLEAALVVAGGIRSGGRSLAGQLLEFLQALALFVQQALLAVADQVAVAGGGEGGGAGHERQAQEDKGQAMESHDFIP

SEQ ID NO: 21829 - protein, 700 aa, Pseudomonas aeruginosa
VFLTGLSNLIGFFYPAGGLDSAHTSFPGALHDFLSQRPRRQGPVRPLRRPVRRRDPDAADPRPRPRVREGQGRPGVPGGTGLLPARLRRPAEPALLRRAPDRALRRGEDLPQARGAEPYRRAQDQQLHRPDPPGPAHGQETHHRRDRRRHARRGHRHRRRALRPAVRDLHGHYRHRPAAGQRLPHEAAGRRGDPGDRRHRYPEGRHERGAARLGDQRRQHLLPDRHGRRPASVPGDGPRFPGGDRQGNPRATGREGRAPARFAGRLHRRRLQRHGPVPPVPRRRRGADRRRGSRRPRHRHRQARGQPERRGSRRAARQPHLPAAGRGWPDHRRTLHLRRPRLSRHRPGTRLAARHRPRRVHLDHRRRSPGGLPHLLPPRRHHPGAGKLPCPGRGLQACAQPAQGAHHGGEPVRSRRQGHADRHAPHATGVESMSRLQTRFAQLKQENRAALVTFVTAGDPDYASSLEILKGLPAAGADVIELGMPFTDPMADGPAIQLANIRALEGGQTLARTLQMVREFRSGDSETPLVLMGYFNPIHHYGVERFIAEAKEVGVDGLIVVDLPPEHNEDLCHPAQAAGLDFIRLTTPTTGDQRLPTVLEGSSGFVYYVSVAGVTGANAATLEHVEEAVARLRRHTDLPIGIGFGIRSAEHAAAVARLADGVVVGSALIDRIAKARDNAQAVKDVLALCGELAEGVRNAR

SEQ ID NO: 21830 - protein, 125 aa, Pseudomonas aeruginosa
SEDPMRTFDLTAALGDRANQPEISRLLVAQLMTSNNEDTRKLRRAQEREQTQELNELAHRLAGMASLIHAHAVERACHQLEIACGESSVRKLADAVDDLVTALGELQCELHDWMTMTAPQGTAKS

SEQ ID NO: 21831 - protein, 863 aa, Pseudomonas aeruginosa
AWKPWMRGVEYSFIVTSSSAAGLQLGLQPVDETVDQPLAPLALRQYRIVPVSRQAALANGPAKQPLFEQAVDQVAPADGHALAGDGRLDQQGVVVEAEHRRNRLPIDGQRFEQRRPVEPAGVLRRLQMQHRQARQVRLGQRQLQSLDQPRATDREHLLAKQPVRFAVLGTTVAEQDRHVDIAALAGQAALAGHQAHVQVRMGLMEARKARHQPVGSEGVVGGHLEHLVALARAQRGDAGIDRLEAGGHVAEQKLAGVGEHDASMNALEQRGRQLFLQAFDLLADRRLGGPQFLGGSGEAELAGGGLEYPEQVEGWRHEVFSHKPGLSNASSPMRFTRDFDALMIDAALSHNPIAWDKPPDEDLAEHPVHHGRPDGRAAAAASRSALGAAHASPLAPRRTGRGVRLGILQQPALRAVALHPGQRSLAYPHRRLGQRCRFRRRYPHLRPLLAQPRLSHGAVGQDALLRSRPVARLRGTPDQRHLSGGLWLGGELGRAGGAPELVPQHVLGFAGRSLRAHQPAGLRRGGGVQGPPVPLRPCSPARRPAILPDRVDDPSARPLQHPGELLESLPRRGHPAAAPALRPGGAGPSFATPAEGHRPVGQAVARGAHPRRPACLLRRLQLRRRTDRCAAGDPGGMRAGRRHHRGVLRRPWRHARRARPLVQDALVRDGRARTAAGPCAGALRAAPHRRFGIHRGPAADPGGAGPAGQSIHACRWKAARCCRTCATAAGHDDVIGEYTAEGTLSPLMMIRRGDYKFIYSEQDPCLLYDLRNDPQERENLAASPAHRGTFEAFLDEARRRWDIPAITRAVLDSQRRRRLVAAALARGRLASWDHQPWVDASQQYMRNHIDLDDLERRARFPQP

SEQ ID NO: 21832 - protein, 213 aa, Pseudomonas aeruginosa
ARGHFHEPASHLPAGRHPVPGQRLAIRRRPRLCPRQAGRSRLERYRGNQRHCRVSPGKPRLPGEDRYPVGADYLWRPARRPGGRLPRRLDARAPGLSRQVRRQRPGRTPRSQPRRHPLHPGGAALRLGRRRTPLRGPRRARATLQPQAVRDRLRRAGQSVDPEDDRRQPVRPRRLEAGGVQRAGDARRTRPGREAPALAGVPRLDAAPDEHPP

SEQ ID NO: 21833 - protein, 252 aa, Pseudomonas aeruginosa
ACTSSRVCRSSKAWYCFGSASSCAVAPWRGCRPPSGGLRGSPSSRSICMNWIACSRSSSAAGGSASYAGAAACDRTGAGGGGRSSTAGSAASVLAGDGEDEEAAISAGASNTPAQVRAIASPLQPRATPSQRFTGLPPWRRPAGCAGASRTALPVARAPPPGSPRSARCGRRGATGDPRGYAPGRSRTRRRCASAGKPYRPSGSAQSCAAGRAGRPGAVSGLGRRAGRGPCRRPGNSGVPPRRRARPLRNSA

SEQ ID NO: 21834 - protein, 446 aa, Pseudomonas aeruginosa
RLPYTCSSRLPASISTLASRSARLCAVSWSSTARASRRFSTRPRRNCCGSVLNLTRDRACSSKSMLLPGSTSPSIRRSCGALAGTPWALHASSPRTIPHSARRQPRARSESSRCIEAVGALGQYGDGQGDGLGNQLLRHPQARLVAGVVKRLGARVGDLAGLGEQVADALARVVAPHQVGHRRRVVELLAGVVVVDPAFPAGMAVGRGDPHMVRLGHVAGGMQGIADGLQRRRGAELLEPVGGEVIDRLEGGGLEVAVVLLPVRAGALAVVRLGGVEVLALQLAVVEIDHGVPVDVGDAAVDLVVAVVVAAVGVAMGVAVPGQVEEVPVRGVVDDARSRAPQRRVFVADPPATETGVLEVVHVEGRLAEDLPGLRLAAGGAHVEPVGLAHLLGGVGGVHEGQGILDDVLVGRLRPGVGLAGDGADAETGGQAGEGFHRQRSRVSEA

SEQ ID NO: 21835 - protein, 331 aa, Pseudomonas aeruginosa
RSRSSSMAKRIQFAAYGGPEVLEYRDYQPAEPGPREVRVRNRAIGLNFIDTYYRSGLYPAPGFPSGLGTEGAGEVEAVGSEVTRFKVGDRVAYATGPLGAYSELHVLAEEKLVHLPDGIDFEQAAAVMLKGLTTQYLLRQTYELRGGETILFHAAAGGVGLFACQWAKALGVQLIGTVSSPEKARLARQHGAWETIDYSHENVARRVLELTDGKKCPVVYDSVGKDTWETSLDCVAPRGLLVSFGNASGPVTGVNLGILSQKGSLYVTRPTLGSYADTPEKLQAMADELFGLIERGDIRIEINQRFALAEAARAHTELAARRTTGSTVLLP

SEQ ID NO: 21836 - protein, 153 aa, Pseudomonas aeruginosa
WRSRPAPGCAQSSGRCPSPAGLARRLPTIASCGRSRVSGAPSTYSSGGASATSASSAGYPGSSHISRCLRGPSSQRRASPAASRTAGLRRAAAASAGTPRVRQAPAGAASAEEAEPKASIKRRKRMGPSSGRPCRRSRASSSAGEWFFIATHP

SEQ ID NO: 21837 - protein, 681 aa, Pseudomonas aeruginosa
  UNSURE (116): Identity of amino acid at the above locations are unknown.
CRGPGGAGGPARGPDGGGRLWPDPAPGGTRYPAPGLHQQPRLAAAALARRRADPARGGSRRRGERRHRDADGSRARHRPDAAQGEHADFRRGHRRQPARPARRARPESGGRSHRRXGRRHPAWRDPGRRPGHLRAQAEQGRGTPRLEPSGRRTGAPGPRLHPLAGLPHQPRRCAAESPRRQPGAGQRGARNHPRGQPRRPAGRLRRRRPAPDPPAIAWRQATGLRRPLQQPPRAIRRRPGARPMNPRLAACQALAAVLAGRASLSGALPPQLDKVAPRDRGLTQELAFGAARWQPRLQALAARLLQKPFKAADTDIHALLLIGLYQLLYTRIPPHAAIGETVGCADKLKKGWAKGVLNAVLRRAQREGETLLAEVDRDPSARLGHPRWLLKALKQAWPEQLDALCAANNAHPPMTLRVNRRHGERDAYLAELAEAGIKARACDYSRDGIQLAAPRDVRELPGFAEGRVSVQDEAAQLAAEQLESAPGQRVLDACCAPGGKTCHLLETQPELAEVVAVDLEESRLVRVRENLQRLGLQASLVAADARATGEWWDGKPFQRILLDAPCSATGVIRRHPDIKLARKPEDIAALAHLQGELLDALWPTLEVGGVLLYATCSVMPAENSDSIAAFLARTPGARELDLPGPWGMKQPHGRQLLPQVEGHHGFYYAKLIKISAPLIET

SEQ ID NO: 21838 - protein, 433 aa, Pseudomonas aeruginosa
RRDQHGRLPGRLHPVQHPDQDRPRPRAGLPDPYRAVRQRGDPGGRADQPGAGGHQLHQAPDRTPRRAASHRLRRGQGAVGRDQGLLRRPSGRAGAAPAARAHAERGYPRRRDLPPQPADHSPGRHGDRGRRRSLLHRRQGLYPRGNGRDAQARRQLQADHHRRRRQCRRAPGRGHREPLPGKDHRAQPAALPAPLGYPGQHHRAQRQRFRPRPAAGGKHRRDRRVPRPDQRRPGQHHVLAAGQAARREQGDDPDQQPCLCRPGARRRDRHRHQPATGDHRHPAGPRSPRRHRERTLAAPRRSRSDRSGSPWRRQVEQGDRSLDQRDQAAAGHHHRRAGARRGSADRPWRHPHRERRPRAAVPGRQEIHPRRRATVPGRPDVLLRHALSRTAIGLRPTNTKGPRASFATAESLCSVQSLAGAGHNGRHSWKRAG

SEQ ID NO: 21839 - protein, 120 aa, Pseudomonas aeruginosa
ATTAGPLASTHRFGQSPNATPDFNYFSGANMSKQERSVPSYVEYPYEQAILYVHRNASANEMLESVQERLRALLGLLHALERIEVRTGQGVPIQRVAHILVTLGGDALTLLTAAHRATTS

SEQ ID NO: 21840 - protein, 73 aa, Pseudomonas aeruginosa
  UNSURE (8),(9),(10),(11): Identity of amino acid at the above locations are unknown.
MKKGATVXXXXSFFFIVSLSLPLCSCGRPRSLLPGSPGVLRVRYWCYLSYCCSSSLPVGIFFAVVFLSLPLAY

SEQ ID NO: 21841 - protein, 485 aa, Pseudomonas aeruginosa
AEALSPFAIGRASEERQAGLEQSLDVADVFLVDQEQQHVVAALDAGVAMGDQHFLVAHQRADGGARRQLDLVDRATDHLARLGVAMGYHFDRFGCAAAQRVYALDVAAANVGQQGADGRQLRADGDVDLAALHQVDIGRVVDQGHHLARAEPLGQQRGHDVGLVVVGQGEEHVGLADVFLQQQVAVGSVAVEHDGAVQGIREVPAAQRAALDDLYLVAALDGLGQALADIAAAGDDDPLVAVVEPAHLAHYRADIGLGGDEEDFVVGLDHRVALGNDRPVAAVDRGDAGIHVRHVLAQLAQLLPYQRAAVVGLDPDQLRLALGEVDDLQRAGVFDQALDVVGDHLLRADQHVHRDRLVVEQPGTGQVGRLADAGDLGRGVEQGVGDLAGDHVGLVAIGHRHQHVGVVGAGLAQHRGERGLALHGADVEAVAEVAQAVAVGVDHGDVVGFAGQVLGQCAADLAGTEDDDFHGRTRLVRFRSTGRKS

SEQ ID NO: 21842 - protein, 569 aa, Pseudomonas aeruginosa
  UNSURE (193): Identity of amino acid at the above locations are unknown.
TASATGARPGPAGAVASAPRRRPAPGSGRDRAGRPCPVAAATRQTARRVRRAPRPAPGRRRDAGSLAEHLAGGELLAAAVVEVGEGQWLAARQLQAGQAQGAFAAGDQQAVAAGLEDGSGRPAALPQAGAEDFQRRIGEAGVADRPGGEGADLALQFDGRTAPVEACLVLVQLVRVGGQGVVLDLAMQGAGGXAGDGFDHRFRAERGEPVVQAAAGVRGGNRRAHLEQHRAGVEPCFHLHHGDAALRVAGFHRALDRRGAAPARQQRGVAVDAAQARDIEYRLGQDQAIGDHHHQVRAQGRQLRLGLGITQALRLHDRQAMLQGQALHRAGHQFLPAAGRPVRLGVDGDDPMWGVEQGLEMLGGEFRGSGEDDAQCLAHAGLAKRKRLAGASLWGMGSRLLSMLLFQLLADAVALEGGQVVDEQLAVEVVAFVLDAYRQQAFGDFLEGVAIAVEGLDPDLLRSVHVLVEAGYRQAAFLVLVHILGQRFELGVDEYPRLGLVFAEVHDHDALVHVHLGRGEADARGFVHGFEHVVDQLAHRVVDHLHRFGDGPQARIGEFENVQDGHMRL

SEQ ID NO: 21843 - protein, 376 aa, Pseudomonas aeruginosa
KSAAKMARSLKTASDRDSRGLRAFRVCRHDKGIHCMRKSLVALLLLAASGLAQAQVDLREGHPDRYTVVRGDTLWDISGKFLRQPWKWPELWHANPQIQNPHLIYPGDTLSLVYVDGQPRLVLNRGESRGTIKLSPKIRSTPIAEAIPTIPLDKINSFLLANRIVDDEKTFTSAPYIVAGNAERIVSGTGDRIYARGKFADGQPAYGIFRQGKVYIDPKTKEVLGINADDIGGGEVVATEGDVATLALTRTTQEVRLGDRLFPTEERAVNSTFMPGEPSREVKGEIIDVPRGVTQIGQFDVVTLNRGQRDGLAEGNVLAIYKVGETVRDRVTGESVKIPDERAGLLMVFRTYKKLSYALVLMASRPLSVTDRVQNP

SEQ ID NO: 21844 - protein, 278 aa, Pseudomonas aeruginosa
CGTTRDTRHCSPKSPMPRRCCTSKALRRLWNGRNWRWSAAAAPAPPGWGTARSFARSLAQGGFAITSGLALGIDGAAHEGALEAGGATVAVLGTGLRRLYPRRHEALARRIVEGGGALVSELPLDSPPLPANFPRRNRIISGLSLGVLVVEASPASGSLITARLAAEQGREVYAIPGSIHHPGARGCHQLIRDGALLVESVGHVLEALRGWAQAEPAEAPAQPLPHPLLALLRAAPYTSEGLAAASGMTLPDVLATLSELELDGRVACEAGTWVHRSG

SEQ ID NO: 21845 - protein, 133 aa, Pseudomonas aeruginosa
PPTTPTRKTACIGTGSLATPARRSARTSTRATRNGATATSTSSTATSRAASAACSSTTSTSGTSTPASPSSAPSAMPISTPTCRSSSAASTRRSMNGSESSRPIVAVAMWSSTWSSIVAPCSACSPAAVPNRS

SEQ ID NO: 21846 - protein, 194 aa, Pseudomonas aeruginosa
GPWCGTSWCAIAICTRSASTVISTMSPMRCGNSPARSATRTPRPTIGATWSVTATSRRCRRRISAWPTRRARTRSTPSCAAAWPFDEAVRRYSLADDRDRDPPGDLGLIRPQDGRLDLLRKTALIQKADTVSQPMRIDGAFEIVRVRSREDRQLPLDDRSVRFEVNQAVAREQLAAQFETRLRNLLAGARVEGL

SEQ ID NO: 21847 - protein, 156 aa, Pseudomonas aeruginosa
PAPACCWRLPIWPLPRLLRRQPGRLRHCPRSTTVRRRRRRCDRKRQHRRTRRSLRRRNWIASRRSSSCRCCATRATRAARRSAACNHARARRRRSWPIRSSTRPSRNDRPANWYRPTPAAYSRYRKSARGSRRPNRVASAAPRKSTRLAPPLDSWR

SEQ ID NO: 21848 - protein, 222 aa, Pseudomonas aeruginosa
SARSVGRSIRPQAISRMPAAIAGNGTCSIRRAPSTASSATQSAENAPASGERAPASRFSPERVKEPADRLADSQGPSRFDRPWARTSWLASNASPWRAARARAIDRLVTSPSMPQATAAGSRSRIDRESKTSGFQPGSALDKACTWATEAKVPGSAQTSVAPPSKPSSRAGQRGRRRLTSRLSAKLKPPTSSDGPSNSANRASSRQPFPGAAPSPLAARPRR

SEQ ID NO: 21849 - protein, 408 aa, Pseudomonas aeruginosa
GCPRRCIRRSHRHAPLPSRRCGSSERPSSGRRGSTGPPAQLHQGRQQVHGGYRSADAARREARRRMDQQRYARGHLEPVHLVPEAALAEHVAMVAGEHHDGVVGQPAFLQGRQQRTDLCVDVAAGAEVGTPGGADALLGQRLVPQVDDLQQALRMRVLLLLGEALARQRDVLVAVEIPVARRDAVGVVRMGHRHGQAEWLAGVLANMVVEVLAGLEHHLLVEVQLVGAHAGTGLQNRGHVVVPARAHLRLVPVHRPAIVRRIDVAGQAFLVAVQLVGTAEVHLARQRRAIAEVAQVVGVGGGIGGEIGSVVPGADAGRQATADQGEARRRAERAVAVCRVEHHGPFGEAREVRHAQRRARIVKRQQRRGHLVGHDEQDVRRGLHRAAYPMRLGYAIVLRRSSVHRNPW

SEQ ID NO: 21850 - protein, 183 aa, Pseudomonas aeruginosa
TAWGWMRWISRAYVRTPHAAIPRPAPGIRVRRPPTQLHRCRRGTGDHPACGQPADQTPGERAGDPSVPARSSRHRAHRRRPASAPPRGRRPRDDRCRHRRAGRAPAPRGAPGGHRLRLRCLLADAAPSALPSGPSAPGREPGDQRARPGRPARRYRRGDPVRRRSFQARRSAPAVSRGGVPGL

SEQ ID NO: 21851 - protein, 433 aa, Pseudomonas aeruginosa
AGRSGSAGGSCFRLLLHVVHDGLHVLVAATGQVHHHDVLLGQAGRTLEDLGQGMGAFQRRDDAFEAAAGVEGLQGFVVGDRGVLDAAGVVQPGVFRADAGIVEAGGDGVCVDDLAIRVLQQEGAVAVQHAGNPAVQAGRVLAGVDAVAGGFHADDLHPGVVEERVEQAHGVGAAADAGDQRIGQAPFLLGQLLAGFLADHRLEIADHRRVRMRAGDRADQVEGAVDVGHPVAQRLVHGVLQGTGAGGHRDHLGAQQLHAEDVGLLPVDVGSAHVDHALQAEARGDGGGGHAVHAGAGLGDDAFLAHAPGQEDLADAVVDLVRAGMVQLLALEVDLRPAAVLGQALGEVKRARPADVVALEVGQFLLERRVVLGLLVLAGEVEDQRHQGLGDVLAAEAAEQALGVGAVAIGSHGGLQEMTYGQNLIPPPGKRNR

SEQ ID NO: 21852 - protein, 240 aa, Pseudomonas aeruginosa
RLRRCVRATAWRLCRAAPADRRGPVRPRRTRQPAGALVHPAAGPAQPCPPRPAPATVHQRGRVRSASSRPGRHALVRRAALAGGHAGLRTGARAHGPGGQPAPGAGNRPGPGARRAAVAGAAAAYRLATPGLAGLGREPGAGGGGAALWPGVRASLLPAGSGGGGPRRGHRPGGAGPRRSRRGPPGGALGLHRDRCAPGPVGTGTPPRSACRAPGAMVAGAVGRLSAGDLLHFSGSASVH

SEQ ID NO: 21853 - protein, 589 aa, Pseudomonas aeruginosa
NRGSPSPGLYLPVPAAHGQRRPLHLPRRPRPDPRPPAAPAGRTAQAPGGTPATARQGSARRCGCLRRRRALLRDPPHRAGGRRAPRRKRASPTAGALPGALPGRRPAQCAAQGRHRPLPGSRLRHHPCLPATAGPGLRDPAHHRRRRPPGGPGQLRAGQPARTDDELSGQDRRVARPARTGATGRPVESPAVAPGATGAGARQRGRRQPGASQGRARQALAGLRHAQQRRRRQHWRAADGPGSGLGQPAGPGRPAQPARQPRRGDRPLAPFRQPEPVLQPALGLVDLHLRLQPERLPHAQRGQRLPLQARWRQPQPPVPRRTRAAPRRCEQDRHEPGAQPPAHQQLCRRHPPGRPEHADHRDPARLQPWPADRQRFRQPRPRLAAGHRRPWRAGSRPPAGGRSACALRQVQPDPQLPAAVPAMGRALQLRQPGHRAKERGRAVQPAAHQPRRQQLGARLQGPDPDRRQRRLLAQPVALAARGGMGAAAALAAGIRRGLRLRRRRDPPRPLQRRRQRAHERQRHRTGCPRPLFRRQRRLRPLAGAAQRHRAARAPDLFPGRRVLLKTRRPPERFRKAPTCIEALSLENLA

SEQ ID NO: 21854 - protein, 2291 aa, Pseudomonas aeruginosa
TSSTTARAARFPASRASSCWPGASTTASRGASSAPGNCAWTPTRWATPAPACSPDGQGLTVTRREPGQQRRRHPFEQGTASWPSPSAARWTTTARAPGSARARNGWTPPAWDNAQGIVSGESDVTLSIAGKLDNGQGGLVSAQRALSFERDDTLLNNAGGRINGGSLLLKGASLDNSDGQLISQGRLDAILGGALVNAGAARLASGGDLLLRSASVDNRGGKLVSQGLLEITTGSLDNSASGTLASQADMSLRLGGGALRNQQDGLIFSQAGALEVQAGSLDNRQGTLQAQGDNRLRIGGALDNQGGRLDSRAGNLDLQSGSLDNGAGGVLNSAKGWLTLVTGLFDNSAGVTQAQSLEIRAGQGVRNQQGHLSALGGDNRIVTADFDNQGGGLYASGLLSLDGQRFLNQGAAAGQGGKVGAGRIDFSLAGALANRFGQLESESELHLRAAAIDNSGGSLRALGRSGSTRLVAGGLNNAYGVLESANQDLDLQLGSLANAGGRILHTGNGTFGLDSGQVIRAGGELTTNGLLDIRASEWTNSSVLQAGRLNLDIGTFRQTAEGKLLAVQSFTGRGGDWSNDGLLASDGSLRLDLSGGYRGNGRATSLGDFALNAASLDLGNAASLAGGANVTLGAGNLLVNRGRITAAGDLVASAASLNNYGTLGGGGSLRLNAPALLNERGLLFSGADMTLRAGDITNLYGDVYSLGRLDIARDDAGNRAASLRNLSGVIESGKDFSLRASLIENRRAVLESKSGLYTAKMEQTACIEGVNAGDCSGKRNAIWTITQRDKTEVTASSAMGQLLAGGDFAIDGGTLNNLSSLIGSGGNLTANLEVLDNQGLETGELETIRVLRTARGGDIGGIDQKSRNFTNLYWYQSANFDPARAGEIPAALNAILSDWSFEYEFPSKGPTPISSGDQSYAAVIQAAGDVTVNASTRIDNGVTRPGYTFVGSGRQVGDSAVGGSGVSVVVPLTSQLPPDLARRQVNPVTLPGFSLPQGDNGLFRLSSRFAEDGNGSAALGAGADRTQGGSGVSVGQQGAGNAAGTWQGQGVRVDGLAGAANVQGQGGSTLGGSLPGVARVQGVPGNATPSASHKYLIETNPALTELKQFLNSDYLLSGLGMNPDASKKRLGDGLYEQRLIRDAVVARTGQRYIDGLSSDEALFRYLMDNAIAYKDQLHLQLGVGLSAEQMAALTHDIVWLEEVEVNGEKVLAPVVYLAQAEGRLAPNGALIQGRDVKLVSGGDLHNVGTLRARNDLSATADNLDNSGLIEAGKRLDLLAGDSIRNRQGGVIAGRDVSLTALTGDVINERSVTRYDSALDGRTWERSFADSAARVEAANSLNVQAGRDIANLGGVLQSRGDLSLDAGRDVTVAAVEDRQGQTRWSTSRLQSVTQLGAEVSAGRDLNVSAGRDLTAVASTLEARRDIALSTGRDVTLAAAANEEHAYSKTRKVTYQEDKVAQQGTRVDAGGDLAINAGQDLRLIASQASAGDEAYLVAGDKLELLAANDSNYYLYDKKKKGDFGRKETRRDEVTDVKAVGSQISSGGDLTLLSGGDQTYQGAKLESGNDLAIVSGGAVTFEAVKDLHQESHEKSKGDLAWQSSKGKGQTDETVRQSQIVAQGNLAIKAVEGLKIDLKHIDQKTVSQTIDAMVQADPQLAWLKEAEQRGDVDWRMVQEVHDSWKYSNSGMGPATQIAVAIAAAAIGGMAAAGALSGAGVGASSFAMGAGVGAAGSLSGTAAVSLINNKGDLGKVLKDSFSSDSLKQIAIASLTGGLTAEYFDGILQTKTDPLTGKVTVDLSSLSGVGRFAANQAMQNATSTVLSQALGQGGSLNEALKSALYNSFAAAGFNFVGDIGQEYSLKPGDPSMVTMHALMGGLAAQVSGGDFATGAAAAGANEALVAKLDQAFKSLSPENREAMVTMGSQLVGVLAAAVRDPDATGKALESAAWVAKNSTQYNFLNHQDVADLDNALQKCKSQGNCRQVEEEFKARSDENRRRLNGCVAVGNCAEIRAEIDAGSTALNELVARQETANPGGSDSDIAYGFLMGRNVVDWTTAGQLHLEQTANLWWNGNPQWQKEVGAYLDQTGFNPFGIGVPAMGGAAGKVTAKALMNALKAGELPKGEVAPGKANLPTIGALADAEAGMPYTHPVKLAAKATGTAGKIKIEAGAIPDANEVRAGQGLSGLGYDVTHQTTASAKGIQGQRTADLHVDGLGSIDVYTPKNLDPTKIVRAIEKKSNQAGGVLVQADLPSTDMSSIAARMWGKTNAQSIKTIFFQKPDGSLVRFDRPAGGG

SEQ ID NO: 21855 - protein, 60 aa, Pseudomonas aeruginosa
LVQKRQVEPIKLRAQSRMLIRVIQKLVELITVSIALLLLMQHWQEILHRPCQSTIRRVFR

SEQ ID NO: 21856 - protein, 173 aa, Pseudomonas aeruginosa
YTGNRRLPLNGRAPAPYHSQHTDPRKGSGMPRRQAAMEGEAHMPVLALRLTALAALVISVSGCVMEAYGSRARSDAQSWIGLPIQDVIKRFGEPERVTGDAARQKYVWKEYENYSHDYDYTYYEQGHGNTPNSSVLNQKTGTANQSGYYTCIYEFFADASGRVVDATARGECR

SEQ ID NO: 21857 - protein, 299 aa, Pseudomonas aeruginosa
VEPGRGRAPGTGRGPPGGHSPGGATTGPAPGSTEGRGPALPPGGRPRASLRGDHRVAGQTAGEPCPRLHPGAALPSGRAACRQSLGRRDQADDAAKGTAPDLGRTWQGERAGDFDSGEAGEGSHAPGQRRRRPALAGHRPGRDSRWQPDRGFPYPGCPPARTERWGDRAATVGDRGRCRQPACTQRKPGATARNRRPTACGNGQGRPVAPRGRERGKGRACRQGAGGWPGGALRAGGGAVPRRTPGRAVQRCRGDGARSLYQRRVPAPESFPASGARAGCGPGVDRPGHVCRVRKERTG

SEQ ID NO: 21858 - protein, 146 aa, Pseudomonas aeruginosa
  UNSURE (145),(146): Identity of amino acid at the above locations are unknown.
IQGGPGAGAGSRPREDPGEERRGAAGLPRPAGAALFQHRQGRPDGPRVRDREGAVSRVGDLHGLPPEQRPWRCPLKLARLSGLVAGFTLLALLGGCAPTKSVDYSAFKQAKPRSILVLPPLNESPDVKATYSMLSQVTFPLAEAXX

SEQ ID NO: 21859 - protein, 149 aa, Pseudomonas aeruginosa
YVVPVALADETFRQNGLTSAGDVHQVSPAKLREIYGADAALYVTVSDYGTRYMVISSATIVTASAKLVDLRSGTTLWTGSATASSEEGNGGNNGGLVGMLITAAVKQIINSSVEDAGYPIAGMTSARLLSAGQPGGLLYGPRSPRYGSD

SEQ ID NO: 21860 - protein, 167 aa, Pseudomonas aeruginosa
VDALLHQVDHLAVDLQVDGGARVALDEGGGGTGQPGLGEGQAAGDAQSAARAVAAGLAGGLHGVGHGEHLAALRQQLRAGVGQAQAAGAAVQQACADPLLQLGEVARDHRPGHVQTLGGGGLAAAVDDFDEDASGGQAVHDSLDPCNKAVIIAGLFARFQATNMASL

SEQ ID NO: 21861 - protein, 170 aa, Pseudomonas aeruginosa
TCPAASSSHVDMPARRRERMSIHSSGGVDMKKTASAVWQGGLKDGKGTLSTESGALKDNPYGFNTRFEGAPGTNPEELIGAAHAGCFSMALSMMLGEAGLTAERIETRAEVTLDKQSDGFAITAVHLVLRARVPGADAQTFEQIANKAKAGCPVSKVLNAKISLDASLDG

SEQ ID NO: 21862 - protein, 542 aa, Pseudomonas aeruginosa
PRPARRGIRRLLHPRLRPGPERRAERQRSGDGRDPRPAPGAGWPARLRQLRRAVAGDQDGRVQRPGAQLPPRPGGAQQAVRRPRPGAAARLRRRAGLHRIAELGRRLLRRETPRGALQRVPGGAACLLPGGQGAFRPVRHRRAPLRHPDPRTARFRTLARRRTPVRDPRERRARRPLLLRPLCPRQQARRCLDGRRPRPPARRPGPADRPGGLPGVQLHPGGERQAGATDPRRGHYPVPRVRPWPAPPADPRRACRRLRDQRGGLGRRRAAQPVHGELVLGTGRPGADLRPLRDRRGAAAGPAGEDAGGEELPVRDDDGPPAGVLPLRLRAARHPRRRPQRAAGARGHPRRSGGDASAGVQPLRQQLRAHFRRRIRGRLLQLQVGRGAVRRCLLAFRGRRRVQPRYRACLPRGDPGPRRLPRADAVVRRFPRSRAVHRRPAASLRAGRGGRMSPAITRKRFIAGAVCPACSEQDKIQMWEEDGVPHRECVACGYADTLNAQGQSIPKELGTRVNQNAPKPANPKVQSVQFFPNPKLKKKPDA

SEQ ID NO: 21863 - protein, 392 aa, Pseudomonas aeruginosa
PLAADRRRWLWAGARCDTVSIYSISPGFPHERSPAPARSRYRQQPPQPLRPDPQRGLRRWLGAGRAADPAHRGARGDRPHGDLPQPVAGPPFRSFDQSLPWLRAWLHLLLCAAQPCLLGPLAGDRFRDPADRQEQRRQRAGAGTEQARLSLRADQPGRQYRPLPAAGARTPPDPPGAGGAAALPSPADHRHQGLADPSRPRPAARTGGAEPGGGDDQPDHPRRRAEAHSRTARGGALGATAGDPHAQRQRHPGGRALLADDPDGQRHGAGAPAPGGAGRRRAQRRVHAPAPAARSRPAVRGMAGGALPATRRACDEPGPPMPWRRGLRQPLRPPLSWPGTVRRPAGASFRGGDEAPRAGTAARASGWIAAGSPCRGRRWRCSSVFPAVQHFV

SEQ ID NO: 21864 - protein, 314 aa, Pseudomonas aeruginosa
RGRSGLGAARRRPVAHVRAVADFPDHALALGGHLVAFALRVLGLADGLLGGDRFLRHLGIAAGLGLAAAFRSAGAVLGLGDLGHLGARYADLLQVFLVGLGVVADVLAGTAVGGDQQGVGLLQAADDLGQALAPFGFVDRLVLATVEQSLELALVAALRRLGVGHATVDLDGAAVDVGTVGADARAVIADLLLLLHVVARRAAGQGAACGSEGGIAAAVLVAGQAAGQAAQEAAGNGAGDGRIAHCVIGAAQVRHRLVAGRVVFRAGGLGDRADAAAGAAAEQHAAGGQQAERVARRGDQTVFAGLAHCISLLV

SEQ ID NO: 21865 - protein, 849 aa, Pseudomonas aeruginosa
SAQASESSRPARISQLPRGRRRRCRRPRVASGWPGLPGRLREPGARRGWRPRCRRRARGPAPPAGASPVRRSAGRAPRSARRPATGAAHAPGRGRWRPAGAGRPTAPPVSCPAGRRFPADRPAPARARRMGRRATRRAVRCCAAHRGIRATRRFAARSRSAAGAAPPSGPGGRRARARRCPAGVPRRGIRSARPGPAPGPAPAGRAGCSCRSRWGRRWPAGDPRAIPAPAPAGGSAGDRRRGCGRPRAGAGSWQRRQRHAVQRVAGVGVAEPDPVGDVVVEGFVEADLRLQFVDEVLLFGDAQRQPEVLGHVQRLAAVRQAFQVFAEHAALRQVAALHQLRRVAAHVGAGAGDFLEEVLGRGLGALGRVDDQFQRLLQFVELQLAQQHANLERRQRRVGQVTVGGPGGDDLRRAHRVAATEEFHLHGVADGRRLARHAWRGVEARRLRLAVAGVVDQVGEHRADLLHRVAEGVHLAAGHRDVEVGDLRVGVGGEAAVLLLGVAVVVLPGRGAQVQGIDLHALAQRRLADLGLVHLGAPERVVLAQRAGVGDQQHHAPGVGRPVHFVDRLHDPGEGVFVERVAGDVGGAHLAAQLGEALRVVARLQRHQGLADVFQAGGLVGVVAETDQAEADLVQVAALADLPLQAVDHLAHAVDVGLHRHRGVHHQDDAGAEGVARRAAGAAMPGLARRLGCRGAAAGVDRGDLQQLRRLAVGVEAFLRVEDRQQVELVLGDRPVVGLDRDHLRIALVVHRLGQGVARCAGIAEQALDLLGAVEEHHRRAAGAFGELQHQALLPVAHRAGRQPAVALAVAGGADAQPGAAADLLAGVHVEHREGRHRAGPGRAASLGG

SEQ ID NO: 21866 - protein, 95 aa, Pseudomonas aeruginosa
  UNSURE (1),(2),(3),(4): Identity of amino acid at the above locations are unknown.
XXXXDRCALLHSGGGSPVRGREQRQGIAAERDQDVRHALNGNALPCPHFDPFQGMEEAEESPEALLYGFEHLIGGGVPVNVENRLLVWVFDIGRD

SEQ ID NO: 21867 - protein, 313 aa, Pseudomonas aeruginosa
ATWQATMLVSSLLVTATSMSASSAPAWRSTVGNEALPCTVRMSRRSPRSRRRSPSVSTTVMSLASLARCSASVPPTWPAPRMMIFMAGHGSSGFDQRGGNLDQLGIVEAMVALHLRQQLAAVGLFHAPGAGKVQFAGAGRAGEEGGDAVAVFRRHHRTGGVEQYATDFQGRPQRVEQFTLQVRQGGDVFRLARQLDVRVAADHPGGRARRVEEDALERLAVPPLPGGPGVGGDQAGLQAEPLEVFPDPYQAALLEVDGDHFGQFRLGFQQVAGLAARRTAGVEDTLAGRAFELLGGQLRGFVLDADATLREAR

SEQ ID NO: 21868 - protein, 229 aa, Pseudomonas aeruginosa
RCPMCWRRSANWNSTAGSPARPAPGCIAPAETVHFAHPVRWSESMISSFRAQCAARVVREGGVIAYPTEAVWGLGCDPWNEDAVYRLLALKARPVEKGLIVVAANIHQLDFLLEDLPDVWLDRLAGTWPGPNTWLVPHQERLPEWVTGVHDSVAVRVTDHPLVQELCHLTGPLISTSANPAGRPAARTRLRVEQYFHDELDAILGGALGGRRNPSLIRDLVTGQVIRPA

SEQ ID NO: 21869 - protein, 461 aa, Pseudomonas aeruginosa
VRASGQQYGRARGSPCGQFGMRPGCFGQGEALVDLDADVAALDQAEQLVGHRLEFFRGIGVAAQGRPGHVQRTLLREDAEVDPGHRPRGVAEADQQAARRHAVQRGFPGILAHRVVDHRALLPVGQFEHPPRHVLVAVVDGLPGTVLPGQARLFRRADGADQLHSKGLGPLAGEQAHAARGGMEENGFAAPQFVGLAQQVLGGEPLEHHRGGLFEVDAVGQVDQLLLRQHMQFAVGAQRAGGVGDAVADLETGHFAAHRLDLAGPFGTQPRREAGGWIEAATVVGVDEVQADGAITHADFPGARLGGLVVAVFEDFGAAVGSELDALGHAGTPASSGFRTVAPGGRPWVKAFIQAFPLTAVKRRLPIQGGMLAPSFRRQPAPRAASPLQGELRDRPYRRCQNLPARPARPHLRRPRGGGRQGPLRRGRLGASGRWRRTDAGNRRRRIDREGRGEFFPRLRR

SEQ ID NO: 21870 - protein, 259 aa, Pseudomonas aeruginosa
RATGAAGRFPRVRPALLRAGQGRQCHRAVQGRGLSPGGRVERAGHPGRGGEHPDPPRRRSPARRQHRRRRPAAGPDGERRGRAARQAGSPARRRRCGAWGARTLPRRVPGGVADRQPHGAEGRGPGRAVRRPRRGARLRFRRGRRAFRPDRQRHLGQSCRRRAAAGAERDRARPYRLLRHDVCQGTDCLQPLGRRTRCGAYPGWPGHAGGAGRRGILPLARRASCLGASVGDAAPTVGNCLSCQAAFETYVSNWLPSDM

SEQ ID NO: 21871 - protein, 346 aa, Pseudomonas aeruginosa
ESQNRVKTSGFTHSRALPMKTFARLAAGLCICAIASQANAWSQPTHKNIVKDALAFMNSSYATEEMRQAYRFYVSAAGSEAQAGEILGQAAFDVDDFKDTRLGGWWVGYEHAPLWGAASGIVNYTSYWHFLNLARDGDSHGNPHGGYDYRYHKVDGGIADVDWYAMVYLYNRELKREDFDTTEAHYRQGTRSDWQEHYGDFQTAAFQPIDNLATYWFEQFRAAPSLQTIGYALHATGDVAQPHHVWITSANGHSSWEGWVDDHYASEKLNDPAAVANLVGRYDPSKSIRDLLTQTGQVAYARPEPLYDTSYETRLRVAKELIPESIALTVTVLTKGANSFDAPTAL

SEQ ID NO: 21872 - protein, 248 aa, Pseudomonas aeruginosa
SRPGLASRTVRDRPRAAGVERPWRPRQGAAGSADRRRGAAGEKHRLARAGPVAGQVQHRPAAVAPWPGGKPPAGARGGRPAHRAEPRRSRRQRGDRGRQPARTGIRQALPRGPRAIPAPAPGPERGAFARGAGAEEPWPGGKQPAAGRDAAPRGGRGRADRLAVSRPAGTGPRPAIAVRRRQRPGPGGIATGQPRLPGAPGPDPHPPRLPLVPPGPGRLRPGRAAGREDPGAGQAGAPSLSAPDRPLQ

SEQ ID NO: 21873 - protein, 281 aa, Pseudomonas aeruginosa
TRRWRASNWQRSSRRACATCWPAPGWKACEALARRCPRLQRAGDRPDLRRRVAGACRYGRFLVFSVASQDACGTARGRRPSAAAGAGAIASGSTGVRGGASGGGTGSRAGDPVHADAARRGRPAQPAARRPATTPGRDGAGAGRSEAVPGLRGTTDPRTGTGLHQRRTADTGNPRADRGGRTGWRAQRRGNRRGSRRPWTVGDDARQAAAGIAATAARRQRTDIAGGALSVSLRSAGGSLRRPAGPALRGPAGGRGAIPGGGPRRAGGGLPAATALRRRSR

SEQ ID NO: 21874 - protein, 160 aa, Pseudomonas aeruginosa
TAAPRSPRWDRSPGSATSPTGRRSPLAASPRTGRTPLAGRRSAHRPSIAAVPGLRHSGRPKPRARACPGAAPVARRGTAASASTWRYGWPRTAARASPPSRLVTPCSQASSTRGLALSQARVAEAGVAVPSSASLIRRFSMSRSKRRLASSRAGFGHCAA

SEQ ID NO: 21875 - protein, 302 aa, Pseudomonas aeruginosa
EHLMPPSLDLLRVFESAARQLSFTAAAEELGTTQPAVSQQIKRLEKELATPLFQRVHRGIVLTDAGQLLLRHVAAGLETIDAGIAALGARQRHEVLQVATDYAFAAYWLMPRLPRFHQAHPHLDVSLVTSERGLAGQRGDIDVAILFGDGRSKHGEAHRLFREEVFPVCSPRLVEGLQLPLAKAHLARLPMLHLKPAQHARWFDWPALFEALAIDRQPIPAVLSFDNYTLLIQAAIAGQGVAIGWRHLVDGLLEQGLLCRPIGESCLSRYGYYAVLPERKRRQRLVDGFVDWLQAELQAGGA

SEQ ID NO: 21876 - protein, 388 aa, Pseudomonas aeruginosa
IFPHGSGSVQRKARRSGLPAPGECRCQGLSACVAHAFGQLAAQGEDILDRLGIVAGLGDPVDQRRADHHAVGQPRDRGGVFGAADAEADTDRQVGMPAQARHCFLDVLQGRRVGAGDAGHRHVVDEPGTAFEHRRQALVAGGRGGQADEVEAGGLGRVAEVFVVLRRQVDHDQAVHPHLLRLGDEAFDAVVVDRVEVAHQHQGRLTVAAAEFADHLQRPGQGLAAFEGADVGQLDGRAVRHRIGERHAQFDHVGSGRRQAFEDFQGRRVVRVAGGDEGHQGGAVFLLELGEAGLQAAHAFDSCCMWCMTVCMSLSPRPDRFTTMMCSLGRLGARLKTSARAWELSSAGMMPSRRQQVWKASRASSSVIEVYSTRPVSCSQACSGPMPG

SEQ ID NO: 21877 - protein, 119 aa, Pseudomonas aeruginosa
SRPAEMECASMIWPSASCSRKVRLPCSTPGTPPFRLAACLPVSMPWPAASTPTICTPASSRNGWNRPMALEPPPMQATSESGRRPSFSASCSRVSLPITAWKSRTIAGYGCGPATVPIR

SEQ ID NO: 21878 - protein, 317 aa, Pseudomonas aeruginosa
SPRRVKETDKIAQTCQENSRIAMSRDLPSLNALRAFEAAARLHSISLAAEELHVTHGAVSRQVRLLEDDLGVALFGKDGRGVKLTDSGVRLRDACGDAFERLRGVCAELRRQTAEAPFVLGVPGSLLARWFIPRLDQLNRALPDLRLQLSTSEGEFDPRRPGLDAMLWFAEPPWPADMQVFELAPERMGPVVSPRLAQETGLAQAPAARLLQEPLLHTASRPQAWPAWAASQGLAAEALRYGQGFEHLYYLLEAAVAGLGVAIAPEALVRDDLAAGRLAAPWGFIETDARLALWVPARLHDPRAGRLAQWLREQLAG

SEQ ID NO: 21879 - protein, 609 aa, Pseudomonas aeruginosa
VFRRAQMALCLTPGLSDSWKTDFGIFLLTRCSRWANIAPFCISRNEIVALHRLAFIFLCLPLMASAAPFTSPGDRDLIRDRQQRLLDEQRKRLEELQQLPGKGAPAAADASGDDERCFEIRRIELEGAGHLGESARRQLLAPYQGRCLGVGQLNALLKAVTDHYLDRGYVTTRAYLPQQDLASGTLRIIVVEGRLEGLDSSALASPRELTMSFPGRTGELLDLRELEQLVDQLSRLPSRQAQLELVPGSEVGGSRVRLKGERDKPWRVSATRNNDGDVSTGEQQMGLGLDWDSPLGLADQLNLRANRDAVTDRWRHSDSQSLFYSLPWGWWTFTYGYSQSDYRTRNEASGFPFKLDGDSRSHQFRAERVLHRDGVSKTAMSLGLSHQRTNNYVEDTRLEDQSTRITETQLGFNHGRRIGSGFVNLDLGWQQGIGALGAQGRGHPQAGDPHARYDKYSLTLSYLQPFQLWGERFSFDSLATGQRSEDVLFSPQRISLGGNSSVRGFKDQTLTGDSGGYWRNQLRWRRAVEWAPLRPWLQEYGVAFAYDVGVIRHDRYNDGASGRMSGNAIELDARGRYFAASVGFARSLERPSAIERREHPIYFRVDAFF

SEQ ID NO: 21880 - protein, 516 aa, Pseudomonas aeruginosa
RYGHPQPAEPVHRPVPGRHPVPQPDRRRGGGAGAGQGRRRQHRPGPGGQRRAHRQYRHAQRRRAVEQPFPRLQRRRQRADPQQRHRQDPGYPARRDHPRQPQPQGPGGAGDPQPGHRRQPQHPGRLHRGGRAVGAGDRRQPARHHLPGLRLHQHAARDPHHRQADHGRPAPGALPGGRRRHRRRRRRTERRQPRTVRPDHPQRQAQRQALREEPQHRHRPQRRPGRQPAGHAARRRWQREATAGDRQLGAGRDVRRGDPPGRHRAGRGGAAGRRHGRQRRRHPHRRQRQAEPGPGLQPGRPEDRGPGRGAERQDLRRWQRRDPQRGGTGQPAEPGGARTHRAGRRAPRQRRGDRSRRRAGRAAQRPRRPRAAQRHPAQRRQPGGQPRAGSEGEPGAGQPGRQPEGGDRPGRRRTPGQPWRQAARRGRTAGRGEQPGQPPGRPVAEPGPRRGQDPWRSRQPWRPGDRPERPGGRRGDARQRPARPARQPAVHPRQRPGAGQPGGRRSLRQARRGPRR

SEQ ID NO: 21881 - protein, 720 aa, Pseudomonas aeruginosa
RQPAQPGRAARDGGATGQPRRRPAVEPQRVERPRRQPGQPWRRAGGRRRLERHGRRLRQPRRRQRQRQGWRARGGRQPAQRPGWQAVQRWPPGPRSERRRQRRRAYRRQGRPAGDAWQPGPARWRTGQRKDPEGRGRHDRQQPVLADRREWRHRYRGAAGRQPRRRDFQHLEGRRERPRATGQPRRQGHRRQRPAPHRAAPAEPGQGGAGRARRPEPGRRRTVQRRRRSARQPEQPEREPRRRAGQPGRRAGQRRQPDGARRAPGQPWRDLLQRRCAGADQPGRAGQPGRQAAQRCRRDAAGRQPRQQPFRRDQRQGCGGYPHRRAGQQPQRRHRQQRRHHPGGRPAGQRPAGTGQRQGPARRQPERPRPARRRRPGQRNRRHPRPQWRHAGQPRRRPDRHARRAAAAPARRGGQRRRRGNLQRPRLHPRRRQPGQPRRAPDRRRQPDPAHRPGPGQQPGRGDLRRRRPGHRGRSPGQQRQGHPGQPRRHRPARRRRAGQPRRRHRFRRPPDARQRLPGQQRQGPALRQRRPERRHWRAGQRRGWPVDQPGRAGRQQRRPRQPWRRPQWQAVAAPERRQPGQPWRPADQRRRTGTDGRARRLRRRRRNLRPGRPAPDGRAPGATPGPAGRRARRQSRPAGRRPGQPGWPDQCSRPAEHRAAERPRQPPGRRDFQPAGLRAAGQAHRQRPAGAHHQRRETAPGRRRAGQRRRRPALRMARA

SEQ ID NO: 21882 - protein, 136 aa, Pseudomonas aeruginosa
RWSPGCSTTAPASPRRSRWRFAPGKACATSRAISRRWAATTASSPPTSTTRVAASTPAACSASTASVSSTRARRRVRAARSAPGASTSAWPARWPTASASWKAKASCTCAPPRSTTAAAACAPSAAAAARGWSLAA

SEQ ID NO: 21883 - protein, 114 aa, Pseudomonas aeruginosa
RRESCPKERWPQERLICLPLGRWRMLRRECLIPIQLSSPQKRLGQQGRLRLKPAQYLTQMKYVQDKGYLVLGTMLRTKPLRQLKVFKGSELRTCMLMDSVPLMCIRRRILIRQR

SEQ ID NO: 21884 - protein, 94 aa, Pseudomonas aeruginosa
LMITYACALKKAKEHLMDSEVPLQITYEGEFSEGWYFCYQSKEFMETGNLSAQLAGNAPFLIDRQSGELHILGTAKPLESYLDDYIKNKSVKLG

SEQ ID NO: 21885 - protein, 143 aa, Pseudomonas aeruginosa
FSAAKGAVIPKVFSNADDFARFGTDAREGLAKAGYGNVEPILQGSAITGQSFKTGQAFDVGRVSDFDIASAGSELLQRAQSLGIGLRSGGTRTGPLSGRDLQALGLKDLARKLSAQAGREVNFMIYDSAATAASRAPSLVLPK

SEQ ID NO: 21886 - protein, 476 aa, Pseudomonas aeruginosa
AEGRLVPRLAGKHQETSIIMHIQSSQQNPSFVAELSQAVAGRLGQVEARQVATPREAQQLAQRQEAPKGEGLLSRLGAALARPFVAIIEWLGKLLGSRAHASTQAPLSRQDAPPAASLSAAEIKQMMLQKALPLTLGGLGKASELATLTAERLAKDHTRLASGDGALRSLATALVGIRDGSRIEASRTQAARLLEQSVGGIALQQWGTAGGAASQHVLSASPEQLREIAVQLHAVMDKVALLRHAVESEVKGEPVDKALADGLVEHFGLEAEQYLGEHPDGPYSDAEVMALGLYTNGEYQHLNRSLRQGRELDAGQALIDQGMSAAFEKSGPAEQVVKTFRGTQGRDAFEAVKEGQVGHDAGYLSTSRDPSVARSFAGQGTITTLFGRSGIDVSEISIEGDEQEILYDKGTDMRVLLSAKDGQGVTRRVLEEATLGERSGHGEGLLDALDLATGTDRSGKPQEQDLRLRMRGLDLA

SEQ ID NO: 21887 - protein, 242 aa, Pseudomonas aeruginosa
KPLRVDSVFFQENPMSHSAKKTLLPLLAVATLAGLAGCATETSTALPVQQVESVNRPYSGVRSPIAVGKFDNRSSYMRGIFSDGVDRLGGQAKTILITHLQQTNRFNVLDRDNMSEIQQEAAIKGQAQRLKGADYVVTGDVTEFGRKEVGDRQLFGILGRGKSQIAYAKVALNIVNISTSEVVYSTQGAGEYALSNREVIGFGGTASYDSTLNGKVLDLAMREAVNKLVNAVDSGAWKPQNQ

SEQ ID NO: 21888 - protein, 127 aa, Pseudomonas aeruginosa
STRNQGITAHMSKTITWTAALLGSMALAGCSGPKTLYQWEGYQAQVHEYFKGESKEAQAQALEADLEKIRAKNGAVPPGYHAQLGLLYSSIGKDDQMVREFETEKALFPESATYMDFLLNNARGGAR

SEQ ID NO: 21889 - protein, 642 aa, Pseudomonas aeruginosa
  UNSURE (35): Identity of amino acid at the above locations are unknown.
RLKRRATVPLAYVGGSLAPRRSDRTRGPCAWRGLXRLRPLRQGVADAHQQRPGLRHDGAAVGLVAGVADGVVVARAAAARRYAGVVVVHHRDMDVPGGNLQAERVAQHRVAVGALVGQVVAATAVARADPSVRREHQGGIGHGVHHPVGRHVFGARVGAIGEEVVVGVPGDVEAFRGLAGSARRPLDAAPGIGGEQLADRQRGLGELCWQVLPPAAGAVVAEPAARRVDIAAGAPQGNRRGAGIGHAAQGKHVVGQSAVGGAVDDAVVAGGGAVEAAVPGLQPELVGAALADGDGGVDPARAGAEPGAQGVFLHAAVERVVADRQQVGLDTQQAAVGQPELAAVQRKGGGARGVAVAQAGVRRPGSAQGEDVEAADDHPPVARAVGGVAARQVDVQLSARGAFEAPLQRLGLGLAEVEGWRPLAQGAGHVEARPVEHAVIAGRQRAGGNGAATLGPVDGGAPQRAALFGDQLQCLGVAADRGAAVGGAQALGEGRFEAVEAGALDDALGQRRLVMGDDVGAAERQRRVEPALLVGQRCLAVPGAGDAGRLAGAGEVAVGGPAGAGQQGCRDGQGEEGVSACVRGVAHRVDSCSCSVHGSIGAAGGARASGARRRRGPGPTQGASRVAAVADGRAVLGGACRR

SEQ ID NO: 21890 - protein, 228 aa, Pseudomonas aeruginosa
RRRRAVRWLRLVPRSAGGGCGALPLGLQGAPASRLHRRRFQPPLRSPPVPAGQLRRWAAPGRTPGRRQPGGAADARVQPPASEALDGAAARRKDRLSMCNGLEVRVPYTDHELVEYVYNVPWSIKSRDGEEKWLLKRACADYVPEAVLKRRKSPYPTSANLGYERFLRGSVRRLLEDAANPVFGIVSREFLAAELEHPEGYFNTQVSRHNLETALALEGWLMLYGLSA

SEQ ID NO: 21891 - protein, 194 aa, Pseudomonas aeruginosa
GRARAPGLGRTSEAGRERLCPGLRTLRKNLRRAGQGLSMSQDQQGIRYLSVADLVRLNELLILAQTPDEPIGVLKPNELESAQQRPANHRYYARTDDIITLAAVFAESLAMNHCFANGNKRTAAAAATVFLLLNGIELTGPAQDFVDIMVALVTREASVQDLEDWMFYWHRPFDAYNLPDSDAFERMVARLGIG

SEQ ID NO: 21892 - protein, 164 aa, Pseudomonas aeruginosa
TARVPARSARRRSPPGGIGARPDACRARRFPAEPGCRSGGRLPGRWRGGRRDGRGGGCREPGRARGWSRGSGWRCRGRALRAGPRGRRRWPPRHASGLARRGCAGHRRRGRSASCRCSRPPRRAACGRGRGRPAPRRRSGRRCRPSLRRPASGRWPRAGGEGHS

SEQ ID NO: 21893 - protein, 201 aa, Pseudomonas aeruginosa
GTCWCRRGFSDPFHGPCACHPGAGTSGAAEEVHLAQFDAVVAEDGVGGGDVEEEVGQGEAEEEVAAVEADLLAAHLEGHVALFGAVQLFLADALEELDGASDACLEFVEGGFRIRVARHFQPGQPRAGALGGVAGDLHLARQGEHVRRQPGVDEDARIDVLRFGVGGGFLQDRREVAEGAQEGRDRSLVDRQGHGRAPDRG

SEQ ID NO: 21894 - protein, 249 aa, Pseudomonas aeruginosa
PLIEASPAGRLVETEMNDLTLHYLYDPLCGWCYGASPLLAAACEVTGLDVRLHGGGMMTDANRQPVGAGLRHYVMPHDLRIAQLTGQPFGKDYFDGLLRDTSAVFDSAPPTAAVLAAEALDGLGAAMLARIQRAHYVEGRRIAERPVLLELGAELGLGEGFAEAFDACSGEPLRAHFADSRRLMNRLGAAGFPTFALERDGRLQVLDTGRYLGQPDDWRALLETQLRLAGGSDAVGGAAAPLCRIDGCA

SEQ ID NO: 21895 - protein, 212 aa, Pseudomonas aeruginosa
PPNVSRPAPRSPSTSSPTVSPSLPCTWCSGRACRGRTRRPSSRSPTRPRPVARYPRCSTRRSAWTPASTAERNASPARRTGPGLPQSNAAGCAAQHSAARHRRGVTGHENHRAGDCHLAVQRHGAGRAEAVRGTQGGDRDQDPVGRGDLLHPGDRAQRRSQRPEHGGRQLRERHQEDHLPEERRLSRCVSVRRAAAGLEVRTGDHLATLVAQ

SEQ ID NO: 21896 - protein, 459 aa, Pseudomonas aeruginosa
RVRSQLLSSTSTAARSASGWVSRSTQARFGSGVGISSEQPLRTSRPPASSSVRIEDSEAPLTRPPSVAPWKNALRSSASPDRGPVLVGRRAVRVLCYVPPMPRRLRHPLADLRLPRWVPCLALLALSGCSTVSYYGQLASGQFALLRAREPAAAVIADPQRDARLRERLAKAEKARQFASERLGLPDNRSYRLYADIGRPYVVWNVFATPELSLQPVTHCFPIAGCVAYRGYYSEAAARAEAARQRALGDDVYVGGVQAYSTLGWFDDPILSSMLRWDDERLATLIFHELAHQKFYLRDDTAFNESFATFVEQEGTRQWREYRGLPPADGREEKRREQFTALVLASRARLEALYAGPLDDAAKRAGKAAEFQRLRREYAALSQREWGGESPFKAWIDAPFNNAKLLPFGLYDQWVAAFAVLFRQVGGNWPAFYARVRALGQLPLAERQAALQRLAAAAP

SEQ ID NO: 21897 - protein, 705 aa, Pseudomonas aeruginosa
FSSGCGCRRLYLRWSGISLAKVANVSANPLLQAYDLPPFSSIRPEHVKPAIERILADNRAAIARLLETQREQPTWKGLVLAMDELNDRLGAAWSPVSHLNAVCNSAELREAYEACLPELSAYSTELGQNRALFEAYEALAKSPEAAGFDVAQKTILEHALRDFRLSGIDLPADKQKRYAEVQSRLSELGSRFSNQLLDATQAWTKHVTDEAALAGLTDSAKAQMKQAAEAKGLDGWLISLEFPSYYAVMTYADDRALREEVYAAYCTRASDQGPNAGQNDNGPVMEEILDLRQELAGLLGFANYAELSLATKMAESSDQVLSFLRDLAVRSKPFAARDLEQLRAYAAEQGCTELQSWDAGYYAEKLREARYSVSQEALRAYFPVDKVLSGLFAIVERLYGIQIRELHDFERWHADVRLFEILENGEHVGRFYFDLYARANKRGGAWMDGARDRRRDAQGRLIDPVAYLVCNFTPAVNGKPALLTHDEVTTLFHEFGHGLHHLLTRVEHAAASGINGVAWDAVELPSQFMENWCWEPEGLALISAHYETGEALPQDLLEKMLAAKNFQSGMMMVRQLEFSLFDFELHATHGDGRSVLQVLEGIRDEVAVMRPPAYNRFANSFAHIFAGGYAAGYYSYKWAEVLSADAFSRFEEEGVFNPDTGRAFREAILARGGSREPMLLFVDFRGREPSIDALLRHSGLVGEAA

SEQ ID NO: 21898 - protein, 402 aa, Pseudomonas aeruginosa
RRSPTPDRSPPTGGDGCGPGPGAILYPYTVFHRVSLMSAPLPPRGRGTASNPLNRFAPTHSEAFDDGWEQDVPPIQLTEVREEIARTVISRNQSPDLPFDRSINPYRGCEHGCIYCYARPSHAYWDLSPGIDFETRLIAKSNVASALEQELSKPGYRCAPINLGANTDPYQPLERERRLTRQVLEVLLRFRHPLTIVTKGSLILRDLDLLRELAEQNLVAVMISLTTLDDELKRILEPRAAAPSARLRAIRTLSGNGIPVGVLCSPMIPMVNDMELERLLQAARDAGARSAAYMLLRLPREVAPLFEEWLAAHYPQRAEHVMSLVRQCRGGEVYDSRFGHRFRGQGPFADLLAHRFAVAMKRLGLAPPPGLRAGLQPVRRAGGADGVVLAFSPRCSISYRAE

SEQ ID NO: 21899 - protein, 402 aa, Pseudomonas aeruginosa
SHLAFEIVPALHHETAICALPATGVDQLEGLLDHLRGIADHVEQAQRVRPLHPYRQQSRGLPGAAGDLVVHRPVAQRAFLVAALDLAREQPAFQFLAADRLAAARGELPLDLGGQADEADAAVLGILAAAADRQQFRVVLQQPGAVHRAEAFGVEAREVDLGQPRGHPVRHVAGRRLALAGERGRLAHHRGVLAGGHLVLADEVQHRLQRGAGGRLRQAGGELLLPGRCQVGEAELAVHVVAPVAGDERLLVARLAFVEGVAEVDLAIVEGAFGEYVDMPEDHLAATRQRQGDVVGQRLGIVRRVAFGPGRRGKCQAGAEGERKNGFLKHRVIPLRLRSAPRASRRWRRPGRCTAAWRAAPSGSGWAAGGRRTRRSGCRTGGSARRPWRRTAARRGTGRRRR

SEQ ID NO: 21900 - protein, 302 aa, Pseudomonas aeruginosa
SPPPGRRSRRATGAPRRDSRPRPARAAGRRASANFLEAGADAVVGLALPADGQDFQAGCASQALVVGGDHGAGAALAGLLHQQAHHPFGVQRVERRGRLVGQQQARRMRQGAGDGDPLALADRQRRRFLVQLVADFQPIGQRLHALGGWGAEQRAGQSDVAPHIEEFEQPAALQHVAAVLPAQRRQAVLAAVAPERGDVLRAFPGEEFEAPARVRRQGQRQQVEQGALAAAAGADDGQLATRAQFQRRHPQAVALATGAVAAGDLVQAQDHGSVDSGTRYSASPASASPNRTQLATSLWKVS

SEQ ID NO: 21901 - protein, 168 aa, Pseudomonas aeruginosa
SSTPPTSRVGHSASSNSPCRCARAAMSSGLRASLMSGWRRITPVAEHGASRRMRWNGLPSHHSPVALASAATRLACRPSRWRFSRTLTRRLSSRSTATTSASSGWVSSRWQVLPPGAQQASRTRWPGALSSCSAASCAASSWTLTRPSAKPGSSRTSRGAASWMPSRL

SEQ ID NO: 21902 - protein, 166 aa, Pseudomonas aeruginosa
REDLHQCAVHRRRQRRADRQRHRRPHLRSRQVRRRPAGLWHLPPGQGLHRSEDQGSPRHQRRRHRRRRGGGHRRRRRDPGADPHHPGSAPGRPPVPHRGACGEFHLHARRAEPRGEGRNHRRTARRDPDRPVRRGHPEPWPARRAGRGQRAGDLQGRRDGARPRYR

SEQ ID NO: 21903 - protein, 379 aa, Pseudomonas aeruginosa
VAMKNHSPAELEARLRLHGLPELGPMRFLRLIEAFGSASSALAAPAGAWRTLGVPAEAAAARRSPAVREAAGEALRWLEGPRRHLLMWDDPGYPALLAEVADAPPLLYVEGAPETLERPQLAMVGSRRASPAGLGHRPELCAQPGAGRLRHHQRAGPGHRWRRPRGRAGGWRRDRGSPRHRPAQALSAAPRGAGAAHRRGWRRAGFGAAAGQPAAAGKLSPAQPHHQRTLAGCAGGRGKSRQRLADHRAAGGGTGARGVRHSGFHPPSRRTWLPPTDSRWRAAGGKRRARARSTARLGAGGASGSAGAAPAPPFAGAAARRALHQRRPGRRQRHDAARCAGDAQRTGTRRPGRLRGRHLGASLRLKPYTSRTLSAGVSR

SEQ ID NO: 21904 - protein, 339 aa, Pseudomonas aeruginosa
RPSSAGYPSRVVCLRPRFVASPRPARPPRSKVNSVTDRIAAVKTYLLDLQDRICAALEAEDGKARFAEDAWERPAGGGGRTRVIGDGALIEKGGVNFSHVFGDSLPPSASAHRPELAGRGFQALGVSLVIHPENPHVPTSHANVRFFCAEKEGEEPVWWFGGGFDLTPYYAHEEDCVHWHRVARDACAPFGADVYPRYKEWCDRYFHLKHRNEPRGIGGLFFDDLNQWDFDTCFAFIRAIGDAYIDAYLPIVQRRKHTPFDERQREFQAYRRGRYVEFNLVFDRGTLFGLQSGGRTESILMSLPPQVRWGYDWKPEPGSEEARLTEYFLADRDWLAGQP

SEQ ID NO: 21905 - protein, 293 aa, Pseudomonas aeruginosa
PARRGRVRSSRPTPAKERPMDRYCVFGNPIGHSKSPLIHRLFAEQTGEALVYDAQLAPLDDFPGFARRFFEQGKGANVTVPFKEEAYRLVDELSERATRAGAVNTLIRLADGRLRGDNTDGAGLLRDLTANAGVELRGKRVLLLGAGGAVRGVLEPFLGECPAELLIANRTARKAVDLAERFADLGAVHGCGFAEVEGPFDLIVNGTSASLAGDVPPLAQSVIEPGRTVCYDMMYAKEPTAFNRWAAERGAARTLDGLGMLVEQAAEAFFLWRGVRPASAPVLETLRRQLATV

SEQ ID NO: 21906 - protein, 146 aa, Pseudomonas aeruginosa
SARTSTPPRRTTARAPARTGRSTTATSRPPPSSRSITSPPTGSSSSAPRLRCRPSAMPCMPPATWPSRTMCGSPRPTAIPAGKAGSTTTTPARSSTTRRRWPTWWGATTRARASATCSPRPARSPTRAPSRFTTPATRRACGWRRS

SEQ ID NO: 21907 - protein, 388 aa, Pseudomonas aeruginosa
PRAPTASMHRLLSDRARGWRRALCGIVLGLLAWSAHGVPAKAPQDLRIDGEVLPGRSIDLLEQALSRVKFNTDPQQLRRGLVENRLLARAVEDQLTAQSRADLDASVEIEAGNLLEQVYGRRYREDLGPYLRQPRALSAERLREVLAPRSRGLVENSLLLDETQRREAAGVELIGWQFPGQPAQVLDLLSLYEGDNVQGQVELQQGNLAYLARQVQTRIRRDYLWYRLARDGFGPAERQGVRTLVRDKLVRHRYLHQIGLYSDFHHESDALRELAGKVSDKDAEAYYRRNLERYRNVAQVQAAHIRLADQASADKVYAELRSGLALRRGGTPLFPGRRQGPRPARRPRPDTAPGRPARPAAQDCADPEGRYGFPADAHRRRVRDRPGA

SEQ ID NO: 21908 - protein, 246 aa, Pseudomonas aeruginosa
PRGSPVAPRRPQRALRGEPGGGARATGSAVRDAPAQPAGRRQGGRPVKRWLGVALGCSGLAIALTCAGVLLAPADMAASSSSPSPARTLAALPAVDDRPPPPAPVRSQAAAPAYEAEPPAAELDREQAIQFMQMLRDEGDPRSPPLGGLQPRQGATAQELADPKQYQAFEERQTRELVQAYTSGVQQIPEIRARIEAAEQGGERSAEEIDEARAALGQLEMMRDKLQRESPQLLPGDSAPTSPAAP

SEQ ID NO: 21909 - protein, 207 aa, Pseudomonas aeruginosa
RPDQRGTAQQAKQQGRPARSQAPDQQAEREAEAAHQQRWAIELGEPRQQPPAVSRRCALPARGQAEKIGQLAEDDQQRRAKGEAEHHRMRDEIDQRPDAQDAEQPLEGAGEKGQQQHGLDVLRAAQRRQRGHRTEQQHRDRRGGTAHQVARRAPQAGDRHWQHRRVQAVLRWQAGDQRIGHRLRQCQDCAIQADPSLAPEHAPVQPR

SEQ ID NO: 21910 - protein, 137 aa, Pseudomonas aeruginosa
ARRGSPRPESPCLPARRSSGGSPCPGRSAGWPAAAPGSGTARRSPCVPGCRPGRGRRSTARRLPGSAGHGGCSSGAASSRGTPASAGASRPGRVRRASPARWTPPASSRRGRTGWRRSSSGSTDWPARRSRSRTACG

SEQ ID NO: 21911 - protein, 101 aa, Pseudomonas aeruginosa
TPPPRRSPAGWCARRDRPAKPRTCCGTSSGAPPARPSSPPSHSPPDRCRWSGVPRSRATGRDRRSASCPTAPCDSRGCASSGRRWGYRRRNRQRCPRRRCG

SEQ ID NO: 21912 - protein, 156 aa, Pseudomonas aeruginosa
TGCSARSSSGGLSHAIGLCDSAASIISASKSLVNRMGLDALDKPGLCENTSCRHPSTCSGYSSPPPANSASPLPPRNWGPPSLRSASRSNAWRKSWRPLCSSAFIEASCSPTPASFCSATWPPASRRSMPASPRWARASATRCSRWPPTTPSLPTG

SEQ ID NO: 21913 - protein, 200 aa, Pseudomonas aeruginosa
SRRPSPARAWPSAGATWSTACSNRGCFAGPLARAACRDTGTMRYCRSASGASGWSTVSSTGCRPSCRPAALEEVTMNEYSTPRIQGFHAHVYFDAQSIERARALCEEAARRFPLKMGRVHERPVGPHPDWSCQLAFAPEVFGELVPWLAIHRQDLVVFIHPVTGNDLLDHRDRAIWMGAIRPLDLSILDEGPQRYDFAVP

SEQ ID NO: 21914 - protein, 186 aa, Pseudomonas aeruginosa
LVGAHGFLAEEQLLGDGLVGVAVGQVLQHGHLAVGKAFQHAGLVVAALLVDAAQRPGGEVDVAGQHGLGGEQQLGEVFPFADEAHGAGLQAARGELRRILPGQDQDLGVQLQGLQAGYHFETVDLGDADVQDGQVGRLLAGYLQGFGTVVGLADDGETVALEQQAHGQADSGMIIDDQHLTHANLL

SEQ ID NO: 21915 - protein, 157 aa, Pseudomonas aeruginosa
SGHPRPAAGRCGCRAARREPRRSGWPRACRCRCRGRRLPRRRSAPRRRRGTGGTGPWRWSRRRCRRPANRAGALPSRPVARGFPCRSPPGNRGPSPGTDAGRRPCRSGRRCCRRWSPSRAAPRSWRPSGYRCRRSPGSPRRPAASCGRRWPAAGRCR

SEQ ID NO: 21916 - protein, 247 aa, Pseudomonas aeruginosa
NSPIPAFACVTPAAMRSSDCVASVPSCAGRPPRPRSSSAYPAACWRAGSSRGWTSSTVPSPTCACNCPPARASSIRVVPAWTPCSGSPSRPGRRTCRSSNWRPSAWARWSARAWRRKPAWPRRPPRGCCRSRCCIPPRDPRPGRPGPRARGWRRRRCAMARGSSISTTCWKRRWRASAWPSPRRRWSATISPRAAWRRPGASSRPMRAWPCGYRHASTIRVPGAWRNGCGSSWQAERWRFAALFRLG

SEQ ID NO: 21917 - protein, 92 aa, Pseudomonas aeruginosa
CPLNRGARRARRTRHRPGREFMSNHHTYKKIELVGSSKTSIEDAINNALAEAAKSIQHLEWFEVVDTRGHIENGAVGHYQVTLKVGFRIANS

SEQ ID NO: 21918 - protein, 136 aa, Pseudomonas aeruginosa
WHPGNLSTIASALGRPPRLSASPDHAQAMRAACLHGRRARLNLAAFGKPDPFGSSSMQRGNVFMKKLMLAVGLFAVAGSAFAAKPCEELKAEIDAKIKANGVPAYTLEIVDKGSVTDKKVVGTCDGGTKEIVYQRG

SEQ ID NO: 21919 - protein, 1385 aa, Pseudomonas aeruginosa
ESAYLHRGPFLGKPCLTSPGPYPPRSNDMDIRSPLNQCIALSLAGILFLNPIVAAAAGLALDKAAGGNTGLGQAGNGVPIVNIATPNGAGLSNNHFRDYNVGANGLILNNATGKTQGTQLGGIILGNPNLKGQAAQVILNQVTGGNRSTLAGYTEVAGQSARVIVANPHGITCQGCGFINTPRATLTTGKPIMDGQRLERFQVDGGDIVVEGAELNVGNLEQFDLITRSAKLNAKLYAKNLNIVTGRNDVQADSLQATPRAADGSEKPQLAIDSSALGGMYAGAIRLVGTEQGVGVRLAGDMAASGGDIRIDASGKLSLAQASSQGDLKIAAQAVELNGKTYAGGSAEIRSAEELVNRQSLAARERIALDAARLDNAGVIEAGVEPDERRNARGDLELRSGTLRNAGSLVASRALEAKASQALDNQGGSLKGATVRVDGGHLDNRGGKLLAEGELRVEASSLDNRQDGLLQSRDRAVVKTRGDLDNRGGQVIGLNDLEVGAATLDNGQQGLLGSQQSTRVSAQALVNRGDGEVSGKRVEARVGSLDNRGGKLIGDDLLVVASGAIDNRLGLFSAANRLDLRARSLDNSGKGTLSSRGGLEVSLGGLLDNRDEGNLLSQGAQRVTVGQLDNRAGGLLSSRSELNVHGASLDNRGGVLVADAGLSATGGAFDNRDGGSASGKAGVRVEVASLRNDQGGKLFSDGRLDLAANAVGNAGGRIAAKGDLQATLGSLAQQGGELVSEKTLKVAADTIDNSQSWLIAANGGIAIEARQVDNRAGEISSTSKVAVNAREQLDNRGGKVIGDSGLRLTVQRLLNQAKGVLAGRDGLSLDGGELFNGDGGRLDSQNSLSVSLGGVLDNQGGALVSEGSLTARAARLDNRGGTFSSAGALALTSQAALDNQGGRLLSDAGVTLQGASLDNSRSGVISAKGAVDIRTGVLDNSRNGGIGSNAGITLVAARLDNGQQGRVSAKGLLDANLKGLDQRGGGVLVSETGVTLDLNGGTLVNRDGGLIATPGALLLRQLGAVDNGAGGEISSDRAFTLAAASLDNRGGRLIGAASLTLRIAQALDNSLAGVISGAAGLDIAAARLDNSAKGTLASRAGIDLRVDGALDNHAEGTVSGARLTLASASLDNSGKGLLSGNAGLSVATGALDNAEGGQLISQGVLDVSSADLDNRGGALSGKQSLRLSAANLDNRGGLLTSDGELELTAGRVDSADGGEISARGDLRLTVERLVQRQGRLVGERGVSLDLRGGDLDNQGGLISARGPLSIERLNVLDNRQGGEISSQQGFELLARRIDNGQQGRIISAGKLRLDADALGNAGAGLLSGWPGPDGDQAGAWTTAPAAPFRARDGELAITLGGALDNHGQGAWVSKGAQRMDAASLG

SEQ ID NO: 21920 - protein, 822 aa, Pseudomonas aeruginosa
QRRPVDQPGPARRHPRRRPGQRRRGAPGQRRRPAAAQRQRRQPRRQAGQPGAAGDHHRQPRQQRLRHPRQPGRHEPAPGRRRPAQPAGRPDLQPGRRPRGAGRQPGQPPGHAPGPGRQPAAYRWRAGQPGRPPGQPGRQPRPAERQPRQRRRRRAQQRQGLADAGHRAVRQQRRRHPGAVAGDSRRARRAQPAGPSLGAGRRQPHRHRRLRQPGWRPLRQRPAQPRRPAFPQPGRGGGSGRQGRRRAHRLQPGRRAGQPLRPVGKRKRAAPARRRDRQQRRQPARPRPQRQHAAGRWRPEQRLRRAGKRQPGPRPATGQPGQRRRAHPPHRQWHLRPGFRAGDPRRRRTDHQWPAGHPRQRMDQQQRAASRTPEPGHRHLPPDGRGQAAGGAVLHWPRRRLEQRRPAGQRRQLAPRPERRLPWQRPRHQPRRLRPERRQPRPRQRRQPRRRRQCHARRRQPAGQPWADHRRRRPRGQRRESEQLRHPGRRRQPAIERARPAQRARVAVQWRRHDPARRRHHQPLRGCVQPRQAGYRPRRCRQPCRQPAQPFRGDRERQGLQPACQPDREPSRRAGKQVGPVHREDGADRLHRRRQRGRLQRQAQRHLDHHPARQDRGHRQQRHGATAGRRRLRHRRRHPEQPFQSDRQRRQPHRQPRSPRQPGPGNRRAGNHPRAAYRSRRRYRRHRPEVAQLHQPLLVPERQFRPGARGRDPRRAQRDPQRLVLRVRIPEQGADPDQQWRPVLRSGDPGRRRRHGQCQHAHRQRRHPPRLHLRRQRPPGGRQRGGRQRGFGGRAADLATAARPGAAPGQPGYPARLQPAPG

SEQ ID NO: 21921 - protein, 383 aa, Pseudomonas aeruginosa
REPHRAYRRRDQRTQRDPLRQRARRPHLGTQLRRQRRAGGGGEQPERPGRTRHRQPRRGAAEPRRPQPRRRTRRHRRRRRGPPGPDPLEHVAAPERDPARRRSQRRAGPERQRRPRLDGGGQHPRSAPRHRPLHRARRDPGGGGERGACLQQDQEGHLPGRQGCPARHPRGRRRRPGDQCRTGPAPDREPGQRRRRGLPGGRRQAGTAGRQRQQLLPVRQEEERRLRPQGNPARRSHRRQGGGQPDQQRRRPHPAQRRRPDLPGREAGIGQRPGHRQRRRGDLRGGEGPAPGEPREEQGRPGVAVVEGQGPDRRNRAPEPDRGPGESGDQGRGRAEDRPQAYRPEDREPDHRRDGAGGSATGVAEGGRAARGCGLAHGAGGAR

SEQ ID NO: 21922 - protein, 158 aa, Pseudomonas aeruginosa
DTMKKIVSFKDLKCLSNYELWKSGWENKNEIDIFSYISYEIRPEDLLILGKLVFPDFILDRGAVILEMNYEAEKFNGWMARFEDDIQSVERFVNHTHIYDIFSGCSEDVEDEIFEQLAHMLSLSWRLILKEKFPDRDFSVLLSCSDQDYGPTITFFQK

SEQ ID NO: 21923 - protein, 177 aa, Pseudomonas aeruginosa
SRRRRRGRRATRPHRCRRRRTAAGRPPPTAGSRSAGRRNAWPGAVRRGCAGLARRAPPGWRGRRAGRGTACRQGRRGWWRRMAGPVPSARPGGSRRSRRGCAGTSAPRSPAGRTPTGRRACARAGAPGSGSSPWRTPGRRAPRSATGPCASRSGGWPGRRRNRGRRSAPPSTRSGRD

SEQ ID NO: 21924 - protein, 291 aa, Pseudomonas aeruginosa
  UNSURE (79),(80): Identity of amino acid at the above locations are unknown.
TTPVEVPVETRPTVRPGGRFHPAGPARRLRADQERRLLGVQAGQAALDPGPAAAERVARREGDLQHALAGHLPAGRGRXXRSAGGAGRRDLPPERPDQRRRRAPGVPGQAARDLWRRRGAVRHGERLRHALHGDQQRDHRHRQRQAGRPAIRHHPVDRLGDRLQRGRQRRQQRRPGGHADHRGGQADHQQFGGGRRLSDRRDDQCAPALGRPAGRTVVRPALAEVRQRLSRAPGLRGRLRGLGASRREGLGRCVALGHVLADQVVEQRPDGAPLVQPQAADGLELQAQVFR

SEQ ID NO: 21925 - protein, 64 aa, Pseudomonas aeruginosa
FSIPRAALLFPLVHRRVERCHEISVDGQLLYSIVVRSEFVVVICLVGYSYDCRKAIISLIGLAF

SEQ ID NO: 21926 - protein, 481 aa, Pseudomonas aeruginosa
RSFPMCGLAGWVDYTRKLDDEFPAIFAMTDTLALRGPDAEGIWKHRNALLGHRRLAVIDLSGGVQPMSYRFPTGQEVTLVYTGEVYNHDALRERLRRAGHEFRTRSDTEVVLHAYLQWGERCCEYLTGMFAFAVFDGRDGHLLLVRDRLGIKPLYYARHREGLLFGSEIKSILAHPEFAARLDAVGLVDLLTLSRGTSQTPFREVQELLPGHLLSWRPNSQAKLRRYWEVRRQEHADDLQSTVQRTRELVTRALGAQLHADVPVCSLLSGGLDSTALTGIAQRIAKAEHGGDINSFSVDFVGQAEQFRSDDLRPDQDQPFALLAAQYIGSRHRTVLIDNAELVCERAREEVFRAKDVPFTFGDMDTSLHLMFGEIRRHSTVAISGEGADELFGGYGWFRDPQAVAAARFPWASRVRLPAGFIDAGFNRRCDLLQYQQASYDDGLRQVEHLAGDSPEERRMREFSHLHLKRWMVLLLDARIA

SEQ ID NO: 21927 - protein, 75 aa, Pseudomonas aeruginosa
IFVPCPGQAGPGSGSLEVHMSRSLRKSKKLVIPPRPRDEVVRARPALGEHQKQVENAFALAFERYEKTFEELAKV

SEQ ID NO: 21928 - protein, 98 aa, Pseudomonas aeruginosa
IDRDMDVLQTGDKGASKAARPAVYPAFTPAPGGPPRPSADRPPSVRPGSPAAPAAPAASAGARRTPRGCRAPAATTPAAAPPGVRYGSAGLPSTAAAG

SEQ ID NO: 21929 - protein, 308 aa, Pseudomonas aeruginosa
HGKPLIPLPGEPLMSRHGLLRSLFAAAALLGAAGVFAASAEPLRLEVYNPGEKAIFAVSSELLVGQREAMLIDAQFSRADAEQLVKRIQASGKTLSTIYISHGDPDFYFGLDVLKAAFPEAKILATAQTVAHIQATKDAKLAYWGPILKDNAPTSLVVPEPLKGDQLKLEGHALKVVDLKGPSPDRTVLWIPSLKTVVGGVLVESGSHVWTADTQTQASRQAWVAMLDRIEALQPRRVVPGHFTGEEPKGLDGVRFTRDYLKALEAELPKARDSAALVEAMKRRYPNLPGEEGLELSAKVLKGEMQWP

SEQ ID NO: 21930 - protein, 79 aa, Pseudomonas aeruginosa
RVMKTIGLGIATLLFSATALAAPKPCEELKAEIETKIQSAGVTSYTLEIVRNDEVSDPNMVVGSCENGTKKIIYQKNDD

SEQ ID NO: 21931 - protein, 187 aa, Pseudomonas aeruginosa
ASANGVASRRSRPGSTRRSTMPSCFPSASTTNGWRRSPCCSARSAATGRRSMRGSVPLASSPWRSARRRCSGWPPQRPDACSGGELVGVAPARGQPADRPEQRQQADAEQRHQQRIADASGRQAEDHQQRQPPADRQQRDAPEQHGDHREQQRAAGGEALQARRQARADGAEEQRRGQRHAAQVQAV

SEQ ID NO: 21932 - protein, 168 aa, Pseudomonas aeruginosa
SRPSSGSSPITAPPSPACWKPSASSRPGRAWCWRWTNSTTVWAPPGVRSATSTRCATAPSCARPTRPACRSCRPTPPSWGRTAPCSRPTRRWRRAPRRPASTWPRKPSSNTPCATSACPASTCRRTSRSAMPRCSRACPSWVAVSPTSCSTPPRPGPSMSPTKPRWPA

SEQ ID NO: 21933 - protein, 176 aa, Pseudomonas aeruginosa
WKRSSTCARSWLACSASPTTPSCRWRPRWPSPATRCSASSATWRCAASRSPPATWSSCAPTPPSRAAPNCRAGTPATTPRNSARRATACPRRRCVPTSRWTRCFPACSPSSSASTASRSANCTISNAGTPTYACSRSSRTASTSAASTSTSMPAPTSAAVPGWTAPATAGATPRAG

SEQ ID NO: 21934 - protein, 218 aa, Pseudomonas aeruginosa
CVRRRTTASPTASRTFSPADTRPVTTVTSGPRCCPPMPSRVSRKKACSTPIPGVPSARRSWPAAAPASRCCCSSISAVASRPSTPCCVTPGWSGRPHEPGDHQEALHRRGGLPGVQRTGQDPDVGRGRRAAPRMRGLRLRRHAQRPGPVDPEGAGYAGQPERAEAGQPEGAVGAVLPQSQAEEEARRLTARRRPAAMAVGRGPVRYCIHIQYFTGFPS

SEQ ID NO: 21935 - protein, 539 aa, Pseudomonas aeruginosa
SLCGFDPRRAPAAAGGGQDAAQQRGEQRRQVVAGQQAADELAALVVEQVVQRAGRGGVQQPGEEQAEDGAEQRQEHDEADQRGGREAQQTQHRQGAALAFDGGQAAGGDGGEGTADGQRGDDPEHQAEVAAEAAHLGDGLGLGGDFHATRDEVPAQPFHRIEVSGVQAEARVDACARGLAGLPRPAVGGHRATVAIVLGGFQQGQRGEQRVAGETLLRQHREHFQLQALALCLAIHAPADARDDALARLGAEFFRGAVAEHHAGRPVGLRQAGQQRVAGGAGNHLDAQGGLAAAAEVGGGGDLPGARHGEGDVRACGQGGDVLGTVAGAADRNDLAHRRRALQPLGEGADQAVLEAEQHQQRGDHRRQGEDRAERQARLAAIVGPGQREQQAGAHQPTSSRQAPTLSSASRCQRMARTSRPAARARRSSWVATTVQAPRSRACSTSRRITRSAFSGSSAAVGSSASNRRGACARARAMATRWRWPTDSAAGFLSSWSPISSRSASACTRSADGAPSNAQGSPMLRRTSRNSSNPPLCST

SEQ ID NO: 21936 - protein, 142 aa, Pseudomonas aeruginosa
PCPGRRARRSAAAGRRSPRARGRCRAASTPRCPPPGRCRCGRCRSPRRWRRHARPGPAPGVPRRCRRGRSRRPPATAPAGRRRRSFPSSRRSAAGRTGPGGSPGRWARPRPPADRPCGPPPGSGCRALRGYRRAGARPARRC

SEQ ID NO: 21937 - protein, 244 aa, Pseudomonas aeruginosa
SRASLGGKRWATDVAAALSLVLVVAMTVAWLYLQDLDQGLMTLVQEHRNADMNPVMVVVTRLGDFRTQFIAGALLGGILLLTRQWRPAIFAIGTLVGTALANQTLKTLFARARPEVLAEPLSSFSFPSGHSSASFAFFLTLGVLASRQQPPRWRLTWVLLAVIPSLSIALSRVYLGVHWPSDIVAGALLATTVCAASLWLSQRRESLPALPQRVWWLLLPVCVATLAIAAGWALPEAIARYRPL

SEQ ID NO: 21938 - protein, 190 aa, Pseudomonas aeruginosa
GETTATSSRLLGHRQATSATANGSSTAVATPIRLIARAAKAPHSSPSCKAREVPTAWAVMPSAMPCAAGCRTPMARSSSGPRIAPSTPVISTNTAASAATPPIWLATSMAIGEVTDFGAMLISIRGSAPNNQPNAMPSTVASVPATTRVSRVGQNNWRIRRRLRNSGTARATVAGPRRMVRTLALALYSS

SEQ ID NO: 21939 - protein, 276 aa, Pseudomonas aeruginosa
SRRAPPWRSKARRNPPTSPRPSAFASSEPAPASAAVRLTARRLRAPIPLPKAPARGGALGRQGNTLLPGNDFSATLSPLHPRTEPLIGNAACFAPPGLSRSAPPWSSCSPPVARANRCSRPMRACRTARAIAASWWTGAWKARAGWTTTTAPGTPAASSMACCTAMAPGRAPTAAATAVASRPACSTVRDAWRWPMAASTRAVSARACSMAKAAWNNRALATAAVSARACTAARARWTAAMAAATRAASARAAWKAKAASATARATSTPVPSATGN

SEQ ID NO: 21940 - protein, 162 aa, Pseudomonas aeruginosa
PATAPATTSWPLDMPGLNLGDLPAAELAELLAPLRQRDKVLVVSACYSGGFIPPLKDERTLILTAARADRVSFGCSDDADFTYFGRALLANALNRTDDLSKAFELAKEEVRQREKEEGFEASEPQAWLPERVLAHWRTLRGQQAERALASREGKTGEGAAGK

SEQ ID NO: 21941 - protein, 324 aa, Pseudomonas aeruginosa
TTGAPGLAASRVRTVAQPLICTARTSSSTLLVADKVLFPPARQHILGNPQGVEDSRDDEVHQVLHRLRLVVEARRRRQDHRAEVGQLEHVFQVDTGERRLARHQHQRPALLQGDIGGALDEVVAGPRGDRRQGAGGTRADHHGIGRAGAGGRRRHPVVLAEHADLSGGGTAIFGEEGLHRLRLGRQGHVGLGGHHQLRGLGDQEVHLALFLHQAIEQAQAVLGAGGAGHRQGNAFRTAHRAPHSASAAASLPCKPPKPPLLMITTCAPGLACWRTCSMIASRVSQTCDGIAHCAAVAARSQPRFGGAYQSTWSAWRTLSGRPSR

SEQ ID NO: 21942 - protein, 239 aa, Pseudomonas aeruginosa
GTAAPPGPPWRGRGEWSGPWRWHCIRRSRCRKAAARRSPPASIPAPAAGTPSGSVHRRPGPTGRRPGSRRRRTADGGSPPRGRPARPSGLLPATLLAIDELLHHPAGEQERQHQRQYQRADDGPEVGGDLPRIGHHPDRRRHQQQRQVAQQRAGRLVDRLADLATRQEITEQQHQADDRTGQHGQQQNVQTCAEQLEQHQPGQTTKQHGHLQQGPTIMPSPPGHWHAPRLSISRSRGTA

SEQ ID NO: 21943 - protein, 486 aa, Pseudomonas aeruginosa
RPGAFAPLSPFQKPPLAGALWAGREIPYCQATIFPPHCLPSTLGPNHSSGTPHASPRQVSLALLRPGHPARRLWRGRTAAPGRCAPAGRRALSRRAGGRAPGRPGPAGLRQRRLVRRPLRAWPAARPWHLAGRRRQPLQRWLRGRPVRRSGTPGDGRWQRLPGRFPPGPVRWRRQPGTTGHSLPRRFPQGPVQRPGHAGRQRWQPLPGQLPPGPPGRRRQLQRQPGQPVRRYLPRRATERQGRWSGPDGRPLHRPVQGQPVPLPGALRKRSGDVWIGRFSEGALNGPGELLGADGSRYRGGFQFWRFHGQGLLEQLDGTRYEGGFAAGAYAGQGTLDRADGSREQGLWADGKRIRDAAGKALPDTLEIGLLAQGRLLDEELRKIPASTPASELYALSLGGDGRQGVFLREADYAGDLLGQRFAARGVIRLVNHRDHFGDRPLATRESLSRAVRTLAERSGPEDLVFILPDQPRLQRPPVGPWTCPA

SEQ ID NO: 21944 - protein, 298 aa, Pseudomonas aeruginosa
TAPTICPKRSNWRKRKCVKGRRRKVSKLRNRKPGYRNACSRTGGRCGGSKPSARSRPGKEKPARARRANRYAAHYAHWCGRGETHMHSTPKRVLLAGATGLTGEHLLDRILSEPTLAKVIAPARKALAEHPRLDNPVGPLAELLPQLDGSIDTAFCCLGTTIKEAGSEEAFRAVDFDLPLAVGKRALEMGARHYLVVSALGADAKSSIFYNRVKGELEQALQEQGWPQLTIARPSLLFGPREEFRLAEILAAPIARILPGKYHGIEACDLARALWRLALEEGKGVRFVESDELRKLGK

SEQ ID NO: 21945 - protein, 272 aa, Pseudomonas aeruginosa
QHCGGNAHQAHRQGGEGAALLAFLQGPRSAYRVGRHAQRHALRGGVPDADGAQQLRPEDRPEYPGDQYEHGGQRRHAADLAGHQHGDRRGHRLRRHAHQHPRLGTEQPAECDAQHRRQRTGDHQGQQGRPEQLADTPQVEEQRHRQGHRGGAEENGQDLGAGTVFVVVDAAKQQHADHHQHRYQHRLQEHPAGPFIGGQGQLVGAQGHADAEQRMVDHRLEGGLPGHQDSSRRRCWRSMSFCIIQPANRNDSTSDSTSAPTMAQKSAAISRA

SEQ ID NO: 21946 - protein, 173 aa, Pseudomonas aeruginosa
PGRQRVLIFLHHENNSHPPGGLMPFVPVAALKDYVGKDLGHSEWLTIDQERVDQFAECTGDHQFIHVDPEKAAKTPFGGTIAHGFLSLSLIPKLMEGLLVLPEGLKMAVNYGLDTVRFIQPVRVGSRVRLGLTLLDVNEKNPGQWLIKARATLEIEGQEKPAYIAETLSLCFV

SEQ ID NO: 21947 - protein, 294 aa, Pseudomonas aeruginosa
ARPSERCRSLDGQAPSRPYPPSKSPRSRGRSGPAGKYPTARQRFFRHTVSPPPSDRTTHRERRMLRPARSLSLCSALVILLAACGEGEPLLPADARLPDGARYRGELVDGRLEGQGRLDYDNGAWYAGRFEHGLLHGHGTWQGADGSRYSGGFAAGLFDGQGRLAMADGSVYQGGFRQGLFDGEGSLEQQGTRYRGGFRKGLYSGQGTLDGSDGSRYQGSFRQGRLEGEGSFSDSQGNQYAGTFRDGQLNGKGAGAGPMGDRYIGQFKDNQFHCQGRYESAAAMSGSAASAKAR

SEQ ID NO: 21948 - protein, 293 aa, Pseudomonas aeruginosa
CVPDRSSRPSLGQRRGQLAVQAAEAAVAHDHHLRAGPGLLAHLLDDRLQGIADLRRYRALRGGGGQVPAQVRRRVPEHLVGLAHAVRQAVAMSAELHRVGTRLDDGDHLGIRANLLAQAVEGGGDGGRMVGEVVVEGHAPDLRDLLHAPLDVAELAERRRALAGHHTDMARRRQAGEGVGDVVQAGQRPVHLALDDAVEQHLEARAVLGEQARLPLAAFAGGLHRGPAAHPEYALQGFLGARANDQALARHGAHQMVELPLDGREVGEDVRVVEFQVVQDRRARAVMDELRAL

SEQ ID NO: 21949 - protein, 496 aa, Pseudomonas aeruginosa
QALEVRPLPPAHGDPEQPGIRPRGHLPRPRGHRAAVPPSGAHRAGRGPDHSPERRESPGARTRDGLLDPGADHRRRRPVAGAPARRGRLALRGAVRRHRPGRGGLAADRPAQRRQRPRQPGGGAPCRCGAQPGRGGAQRVPQRQAAHGEGRGGPGRDPLRRLRPPSDRHRHHPRRPAQAGWRGYPGDRHRRAAFQLDEARRSSRRPAGQRAPGRPGALVRAAEPGLGPGRHRRAMRDTVAGLRYPGGDHRAGAPAGQARRASGDHEQRRLRRLARQAGRGAGRVRGAMSGPERITLAMTGASGAQYGLRLLDCLVQEEREVHFLISKAAQLVMATETDVALPAKPQAMQAFLTEYCGAAAGQIRVFGQNDWMAPPASGSSAPNAMVICPCSTGTLSAVATGACNNLIERAADVALKERRPLVLVPREAPFSSIHLENMLKLSNLGAVILPAAPGFYHQPQSVEDLVDFVVARILNTLGIPQDMLPRWGEQHLVSDE

SEQ ID NO: 21950 - protein, 211 aa, Pseudomonas aeruginosa
TDPLGVPAAGAGIDAGGDRRAAALRHRLRRIQCQRQGPDHSPRPRHGGPGGAAVPQPAAYPPIVLADPADPGGRRYAGDGAGHRIRLVVRCRAADADEHGAEVGDLADRHAGGQPDRRRGGAGRRVRTDHRGTRGDPRAGAAARHRRPAPRRAGHGAGHDGPRGRHFAGLAGRRGVRRLRRPGDEPDGRCHRSAATVGGSAGCLTMPEESR

SEQ ID NO: 21951 - protein, 296 aa, Pseudomonas aeruginosa
  UNSURE (80): Identity of amino acid at the above locations are unknown.
RTNTTISPRCSACWPSIRWWPRWRWAASPAASRTWPTSWPTCCRSIPNASSNCSPCPTRRCNWRGSRCCWSTCRASWVSXERQPSQRPVARNGFRQGPAGGDRQGRHADRQQQPPDPLRQRRQRLAALAQPQAGGADRSGEQGAGDDVRRPVHAKVDPRQGDAQRRDHRQQYPGQAPARRLLAAGEDAQGEEEGEGRRAVSAGEAEAAQRFGQHFRAGAGEQGLQGLVGQRGTHQGADGENGRTPLPGQQEDTAEQRAGDELGAEIAEPGDHHHHRVHVGVAMLLDQRHQALVEVL

SEQ ID NO: 21952 - protein, 283 aa, Pseudomonas aeruginosa
KRSKFVHYRPRTAILNNLEFDHADIFPDLAAIERQFHHLVRTVPGEGLIIRPSAEKALERVLGMGCWTPVQTTGEGGQWQARLLAEDGSRFEVLFDGIVQGEVDWPLTGLHNVANALASLAAARHVGVVPSQGAAALSEFRNVKRRMEKVAEVRGVTLYDDFAHHPTAIATTLDGLRKQVGADTQVIAIVEPRSNSMKLGAHRDGLPDSVRQADQVLWYAPPNLGWDLAATAAQCAIPSQVCDTLEAIIEQVRQQARPGAQVVIMSNGGFGGLHGKLAAALAE

SEQ ID NO: 21953 - protein, 141 aa, Pseudomonas aeruginosa
SCRRRRASTTSRNRWRTWWTSSSRESSTPWGFPRICCRAGGNSTLSATSRVLLLVLAVQMSGCATVRTLDAAKPGAPVVYAGTRLDWYSLHGGCCPMERFGAEAPAHPGLDLPGSALLDTLLLPFSLATAIGLNLGISGGM

SEQ ID NO: 21954 - protein, 329 aa, Pseudomonas aeruginosa
SGRSRHRRCAFVAPLAMELVVLELADVAVAHRARSSALAVQLPVAEGTGVLVALAVAEAAFAFQAALAEAALVAAAIAAVQRALAAVQALAETAAVASALLFQAAFAIEQALAETALVDAAIGHRQASLTVEQAGREATAVAAAVGALPGAMAVQQAMLEAAGVPGAVVVVQPALAFQAPVHQLAAIARAVRQARIGREQRFALATGGEQDDQGGAERERPGGAKHAAFPMSGSVRGWRGDSVAEKSLPGSRVFPCRPRAPPRAGAFGRGIGARRRLAVKRTAALAGAGSDEAKAEGLGDVGGFLLAFDLQGGARLDQPLAGILLVDVE

SEQ ID NO: 21955 - protein, 365 aa, Pseudomonas aeruginosa
WSALAGGAHVASWSDLAGAVPVARHRSERSVVAHAARSDHRPGAAVRLFPGAWRGRQAGQRGGRLVAALPAAAAGAGGGRGDGLCAGDRRRLLGHRRRAGTVAGAVVPVRRLDDAEAHRSPATSPGGVLMAWQAALEAVIHHPLFGVGVTLGAYQLALAAYERTRWVFLQPVLVSMLVVIGVLLLCGIDYDEYSASAKVLTILLGPATVALAVPLFLNLRRIRQLFWPTLLTLVVAGTLATVLGIAFGWLFGAEPRMLMSMAPKSVTSPIAMLVASQIGGVAALAAVFVLITGVLGAILGPELLRAIGVRHPAAQGMALGMTAHAVGTSRALQEGEECGAFAALAMSLMGVATAVLLPLAVALVA

SEQ ID NO: 21956 - protein, 212 aa, Pseudomonas aeruginosa
  UNSURE (204): Identity of amino acid at the above locations are unknown.
RCPRSRDEVAVVSPQRRAVPRLPPGPADLRGALPGHDQPLHEAGHRFRRGDHRRRAGGRRSAEPPGDGRLRGLGPRLAAAPERPAGHPRGGRSAFPGAVGGGPGRPAQRRRDRVVRRPAGATPDVRTQRSRRVAQRAGRASDGGRAGDGRRARRPAGPGQPVGLPAAVRYRTQARTARPARRADATGADPGAAGAPAGRVGYRXSANPHSGR

SEQ ID NO: 21957 - protein, 399 aa, Pseudomonas aeruginosa
AVAPPCAPWMRPSQGRRWSTPAPGWIGTACTAAAARWNASARRRRPIRGSTCRAARCWTPCCCRSRWPPPSASTSASAAACRAGPAPGSFPQLAQFVGLDEAHALAFLQRQAPERAGQVAGLDAVVLAGKDAGDRRSEDLGQAEFLARAEQQRWPGDGQLWPALFLQGLLQFALDPVVEDRRLGVGAQGADHQVMPGAHFQRALAHRQRQVEIDRAEGLLRAGFLDRGAEAAEGGIDAAVELRQQLGQRADRVVQPRMLGQRLAGRGDDLGQGRLAQYPIQQVLAGKTGRAGEQNALGRRVHVCFSPSTPMSVVRGVSICPPRPRRFFLPGTRARARLAAPAASASARARVPVTRLAVPKLRNLPPSPFDALPLSPVRTLWTDRRCGSAHWPARRGRNR

SEQ ID NO: 21958 - protein, 141 aa, Pseudomonas aeruginosa
ARSVPMSRRAGHNGRPLLEVPMLLRGLTWLVLFQLLGTGLNVLLLPMLPGPIIGLVLLFGYFLARGEVGKPVNEAAGSLLRYLPLLLVPAAVGVMAYAREIAADFWAIVGALVLSLVLSFLFAGWMMQKLIDRQQRRREES

SEQ ID NO: 21959 - protein, 208 aa, Pseudomonas aeruginosa
  UNSURE (208): Identity of amino acid at the above locations are unknown.
RWLPDDARGVAMKLPLFPLNAVLFPGCRLDLQIFEARYLDMISRCMKQGTGFGVVTIGEGREVGEAPSRLAMVGCEASVRDWQQRPNGLLGIRVEGGRRFQVLSVEVQADQLSVGEIEWFEDLPEQPLTYEHNDLAALLSVLAEHPMVAALEMGGEPGGQQDLANQLAYLLPFDTERKLELLALPDAQMQLARIQVLLEHLQGELGIX

SEQ ID NO: 21960 - protein, 131 aa, Pseudomonas aeruginosa
  UNSURE (93): Identity of amino acid at the above locations are unknown.
PPPSPGSCRRCDAPGPTSSGPGRGPVGTARRRSSPPPGPGSARPPHRLPNVCPPSWPWTTTPTSTSRHAATIPASLQNPPRQPEAPGCPRWAXPANRLANPQPGGGNHQTPKKPANGFFNFPANIGASVPG

SEQ ID NO: 21961 - protein, 132 aa, Pseudomonas aeruginosa
RRSQTARPTPQRRPRLHNKREDARNGEEEADRPSDGRESEQADQYTWIQETQGKRNSREPREQEDRRRAGKAARGTQARSERNRNQEAGKPERRQNGDGRDEEAPKRGGRRRKTDKTGNASNRQRRPKGSKG

SEQ ID NO: 21962 - protein, 387 aa, Pseudomonas aeruginosa
  UNSURE (48): Identity of amino acid at the above locations are unknown.
RDLRGAGAERRLTNRGGHPVSERLYVGTRKGLFELRRNAAGQWLPMAXHFLGEPLSMLLADPRDGALYAALNLGHFGVKLWRRDAGATDWMECAVPVYPPQPPAAEPLEGQAAEPPWSLQQLWILEPGGADRPGTLWAGTIPGGLFRSDDRGASWRLNRELWERPERAQWFGGGYDHPGIHSICVDPRDSRHLTVAVSCGGVWQSHDDGRSWTCTTRGMRADYMPPEQSEEAAIQDPHRLVQCQARPEFLWVQHHNGIFRSRDGGLHWQGVVAEPSSFGFAVAVHPRQPDTAWFVPATKDECRIPRDARFVVTRTRDGGHSFETLERGLPDGPAYDLVYRHGLDIDPSGERLAMGSTTGGLWLSENGGEDWQQLSANLPPIYCVRFA

SEQ ID NO: 21963 - protein, 530 aa, Pseudomonas aeruginosa
SLAHHVAGETHHLVAVVDVCVRLVAGEGMEVAGLDAPFAVGQFQAQATFDDQNHLPPAGCVGFRYVALARSQRPGPEFHLAPRRCAGEEGGAALGVVADPGHRIDPRAVGGRCLDQVGEQHAEGGGDTVEGRQADIDVAALDAHQHPPADTGRAGQRFLAEAGLQAQAADVAGDMFEDAGAFGRVGQYIAHCRGFAHYSAHPVSRSPSGCFPLPDLFHDLHLPRPRRNAVAGRPAIDRHGLDPERRLPGEKHVPPGRRPGHHGPAAVLRRADPAAAPASLAQAPEPAIAALGGGLRHRPGRHEPAVLSLGAHRAAGHRGGPGVHRAAAGGDPLLAAPAGLPLDLPGGVRHLAVAAAGQQRRAARPGRRRLCPRCRRVLGAVHPLRPARRRRPWRPGRRAGGAGGGDPGCADRRRPRRRRPPRPGADPVGAGRRGALHGLALHPGNGRADPPAGAHLRHPDEHRAGLRRALRAAVPRRAAEPDPMAGHRRDHPRLGRHYPQRQVAWRRPGATGQGLRRPPRPPAAGARAGG

SEQ ID NO: 21964 - protein, 108 aa, Pseudomonas aeruginosa
PMAKADDTSNPAITAQSPSTFIPLRRTSQCNQHPGCATLYLDSSAASEDLFDTARRRLESAIGTLSVLDLLDETEEPGESICRITGSLLSLLSDALSLFEAEYARRHR

SEQ ID NO: 21965 - protein, 530 aa, Pseudomonas aeruginosa
PTEAVPPGKAGGLSTGAKRGSLSALARQLRGRAKATCPLRTPTQAIPDDDRSFICDCFSFTLDPHSSEPGSFPGCIVPFDPAKPTLLSTLVRHYEELVDHVRRRFGDRGMAREVVHDVCVQLLERDEKEDVHTPLALLRKISHDAAVSRYRSDRRRTAWVEAVAELPEVACMAATPMGRHEAEREFQALVDAIATLPPRCQAVFVMHKIHEVPQGASRRPPRHLRQDRGKAPAPRTGGLPGTARPRRGTAMTQPSKRNGQVPLDDALERHRDALKDLFPLPPSRPKSRKASKAAGVALLLALAIGALAWLDPAYKRERFATAIGERRDVTLADGSQLLLDSGSQIEVSWHPLSRRVALRAGQVLFEVSPARYRRFVVSVGSTDIRVLGTRFNVRRLDDDVRVTLERGRVEVGTSATAQAPVVLLPGQQVDAIGGQLMPLAKVDAATAMAWKDDRLVFERTPLGEAVALLRHYRKAPILLDDPSLASLRLTGVFAAHNADRLLDLLPSILPVAVSRQEDGSVEIQRKSTRK

SEQ ID NO: 21966 - protein, 181 aa, Pseudomonas aeruginosa
PGWAAMASAASSSNTSPAPWGRSTIRSTSAPVTSALPTTPMATASPRNPARATCSTRTSTTSAASSACASTRTSACSSPSATTTPARTPTTPPTRGSPGCRRARSRPTRSRAWSWTSRTASATPWRTSSTRTSTSSAAGSPRSSTTVTISPASLRSTPAPSPPAAATSTRSCRTAKCSAAA

SEQ ID NO: 21967 - protein, 173 aa, Pseudomonas aeruginosa
DDPRRHDQRRKDDHGYTISEKTQGTVKKKRTGRATVEKASRQTSTRGSKRHRGNGTAENHESRKTDGEQARRREGHRRGANGTETRRPASQKEGRMETDATRRPQSEEADGARRTKQGTRVTDRDGRKGAKAERGKQGGSGTGGRPGPQEGRGTGSSTEAQPRVADATGPARS

SEQ ID NO: 21968 - protein, 177 aa, Pseudomonas aeruginosa
ISSAFSLLFCAMTARSGPPPELVERQAGGSTGDGGFFAGRGSIGGPRRAAGVADERRCGVCRPLGGPRQPWPAGLLHCSGRAISASLGMPRIVFAPAIQRHVAMPALDVGAATVAAALQAAFAREPRLRGYLLDDQGSLRRHVALFVDGVQVRDRRGLGDPLQDDSEIYVVQALSGG

SEQ ID NO: 21969 - protein, 328 aa, Pseudomonas aeruginosa
ISAISASSCGVATPARRTGWNARCRSIRRSRQRPNRWKARRRSHPGRYSSCGSSSQAAPTGPARCGPEPSPAACSVPTTVAPAGASTANSGNDPNAPSGSAAATTIPASIPSASTHATVATSPSRCLAAASGRATTTAAAGPAPPEACAPTTCRRSRARRRRSRTRTAWCSARRARSSSGCSTTTASSVPATAACIGRAWSPSRPASASPSPCIRGSRTRPGSSRRPRTNAAFPGTPVSWSPAPATVATASRPSSAACPMARPTTWSTATGWTSTPAASAWPWARPPAACGSARTAGRTGSSSPPTCRRSTACASPERAALDSLGALA

SEQ ID NO: 21970 - protein, 448 aa, Pseudomonas aeruginosa
RSPGPSDQAQSSTSRRAGALARRVARLSGWWPTQATALIRERSVAGAWTRSGNSTPRAAAIRSRVDRLTLTSPLSMPTSIRRLTLAARASASWLRPACRRRRRTLPETCSRTLGRSVGLGNILLTVAVLRIIVHIPFPAVHRAASHCRTSSMTSTSRGLAGTLLPVGLLLIAMASIQSGASLAKSMFPLVGAQGTTALRLFFAALILLLLLRPWRKRLSLQSLRSVVVYGIALGGMNLLFYLSVRTVPLGIAVALEFTGPLLVAILSSRRLLDFLWICLAVFGIWLLLPLGNSAEPLDLVGAAYALGAGVCWALYILFGQRAGADHGAQGAALGVLVAAILVVPIGVAHAGADLLDPALIPLALGVAVLSTALPYTLEMVALTRLPARTFGTLMSIEPAFGALSGLLFLGERLSPTQWLAIGAIILASVGTTLSVKSRGAAPALPAKD

SEQ ID NO: 21971 - protein, 483 aa, Pseudomonas aeruginosa
  UNSURE (345),(418): Identity of amino acid at the above locations are unknown.
GGLRVLPLQALVLADEAPRAARQADAEHDRRAGQAHHQALPQAARSGGFLEPVGEAEAVAHRQADAPVGEQGHDHRHPGVLVATQGPGGGDLQGVGELEQRGEHDQRGGDGDHRRVRRIHRGDLLAQQQHQARRDAGVAQRRGHPHAGGEARVARQAGAEVVADPHGHRHPQRIGNHEHQRAEVQGDLVAGHHVLVEPADQQGDHREDARLGEHRDADRQADRHQRADGRAIRPLPAREQLAGAVDRGLVHPEQHAEEHEPHHRAGGPAAAGATHLRHAEVAVDQRVVDRDVQQQPADPQHHARPGPSQAVGVAAQYVVQRRRREAQGDALEVQQARPRSVSGRXFIKPGIGSDNHHSTAPGQRSDQQRQPQRLAHQRPVPGWFAGAMALGDFGRGGEQGAVHQQAHRDPDGVAQRHXCQVVRTGAPGHHRIDEAHGGGRQLRDHDRRGEGQQFLEFGADAQATGKGQGGAVHGSPCLGRGTA

SEQ ID NO: 21972 - protein, 322 aa, Pseudomonas aeruginosa
RPEGAGQGRTYLHRRSGQRSRRARYASPQRTAGHGADGNHRLAHQQRPGLRHAPVHRHRACPTGGAAPGLRQPGHRAGQGGAGDVRFQPHHHRIRPDPARAQHAGDGRRRAVEHQPRLLAQPGQHRPGADRADRGHPWQQRHLRQRRHRRDHLHHHPSGRRREPRGNPPQRHLAADPAGQRWPRRPVPAILRRLPGGARLFVRLRHPSRRRFLRRPWRPHRPGTQPGRPVRLERLQHRRQARPAHRREPARAARPQPLRRPPGHRLRHRPEGRQAAAGLGPGQRDQGPGAGRAEPHPQHPGEPRVREPRHPRQPALRAALLP

SEQ ID NO: 21973 - protein, 498 aa, Pseudomonas aeruginosa
LFHPLHSVRRPRRLHPRRQRRPDHAEQRSVRQPPDPAHAAGRKRQYRTGLGRRLQPGTQRHAARRVRPGGLRRQRRAGLRQDRQAHLHAAATHPQRRRVRPVAASLRRTLVDRRRPALRILHRRIRRLRPALRVQGRLAGDRQGRRPRLRRGAVEPRHRLFAGGWPGNLCLLQPGLPAARCRHPAAQRPPWLRYRLLEPRTGEDQQLRTRLAWRHRRQHPGQPGAVLHHLQAGRRAELQQRPDPHPHQGAHLRRRGQRRLAQRRRSLGRGRQRHLDARTREAGRQGLAGHDRLPRAAAEADRLPAIQAGCRLEQPPAGHLLRLQGLPSRRRGKLRPAPGQHLHHGRPGQPVPHHPRRPVEPGHPEPVHPRLTPALQPVAAQQQQHQPPAGAGHGADGELYAQLVRGGRSHRGWAGPVGREGASRGKAAPLSWAGISVQCRTPIQVGQVMGKDRVRRPAQNTTCPDMPGCTSPPIQISPPICSTLIRPRRPKAVPWLAV

SEQ ID NO: 21974 - protein, 560 aa, Pseudomonas aeruginosa
  UNSURE (39): Identity of amino acid at the above locations are unknown.
AAVDQQRRTSGERATLCRHPQGPVRAAAQRGGPVAADGXPLPRRAAEHAPRRPARRRALRGAESRPFRRQAVASRRRRDGLDGMRGAGLSAAAASGRTAGRPGGGATLVATAVVDPRARRRRPARHAVGRNHPRRPVPFRRPWRQLAPQPRTLGTTRTRPVVRRRLRPSRHPFHLRRPTRQSPPHRRGVLRRRLAEPRRRPQLDLHHQRHARRLHAAGAERGGGDPGPAPPGAVPGAPGVPLGAAPQRHLPFPRRRLALAGRGRRAVQLRLRRRRASAAAGHGLVRPGDQGRMPHSQGRPFRGHPHPRRWPQLRDPRARPARWPGLRPGLPPRAGHRPQRRAPGHGLDHRRPVAQRERRGGLAAALRQPAADLLRALRLSARRWTASARLHKFVGFRQGAHPMSLESVRRFFAEKAPDLRIIELETSTATVALAAEAHGVEPGRIAKTLSLRVGERTVLVVARGDARLDNRKIKAAFGGKAKMLGAEDVVELTGHPVGGVCPFGLATPLAVYCDVSLQAFDEVLPAAGAVHSAVRIAPQRMAELVDAQWVDVCQEVLQEA

SEQ ID NO: 21975 - protein, 800 aa, Pseudomonas aeruginosa
GFPRAVAAIQEKPTCIGNRDVHFSLRSRHLRPSLLASSLLLAVSAQGQEKLDVDLPAAPLGQAINALAQQSSVQILFAGDLGAGRQAPALKGRFTPEEALRQLLRDSGLKAQARDEHTFIVVPASEAAVPATQARSEPLDMEQMEITASRTSSDLVSATRQSTVIEHAQLEELRQGSDSLATVLAKAVPGMSDSSRTITEYGQTLRGRSMLVMVDGVPLNTNRDSSRNLANIDPALIERIEVIRGSSAIYGSGATGGIISITTRPAGGENRAETRLSATSPLTRLGSDGLGGQFQQYFAGSLGALDYSFDFGTRHVGASYDAHGDRIAPEPSQGDLFDSNVYNIGGKLGLRIDENQRVQLALSHYDARQDTDYATDPRVARLPPGSVPANAIKGLELDEQNRIRNTLANLEYENLDILGSRLSAQLYYRDYFTRFTPFDARAVSTRGGNVDQIMQNSEVFGSRLTLRTPLGESGNTELVWGGDYNQERSDMPLDVFDPAAYDASGGLVFDKIGKLTYMPPLRTRSAGAFAQLQHRFDEHWSIDGGLRYEYSTAEFDDFVPLSESKAASPVTVKGGDLDYDAVLSNLGIVYSPVAGQEIYASFSQGFQLPDVGIQLRNARRGFDIGSSNLEPVKTNNYELGWRGAIGGNTLGSLALFYTTSKLGDVQSFNNGLILTRTKERIYGVEASADWLSDDEVWGAGGSATWMRGREKPDGKDWQDMTGYRVPPLKLTAYLQYKPDADWNNRLQATFFDSKDYRLDGVESFGRRQVSTYTTVDLVSQYRITPDDQLSLGIQNLFIRD

SEQ ID NO: 21976 - protein, 110 aa, Pseudomonas aeruginosa
WGRTGYAVPLRTRPAPTCPAVPHRRSRYRRRSARRLSAPGDPRPCPGSPCRRPGMTPVPISHCARLALRLPVTGSSLSSSPMKARTSTSASAWGPCQGATTPTLSPSSFA

SEQ ID NO: 21977 - protein, 219 aa, Pseudomonas aeruginosa
RHEFTNEGIRSRPSWAPWPKPGAEKPMGCWREFFGRSADRGYFKGEEILACHEAGITVFVPKTLTSGATAAGRFGKGDFIYDAAKNEYRCPAGQSLIWRFSSVEKGLKLHRYWSSHCQGCALKEHCTPSSERRVSRWEHEAVLEAMQSRLDQAPEMMRIRRQTVEHPFGTLKSWMGATHFLTRTLDRVSTEMSLHVLAYNLKRVLTMLGSGALMAAMKA

SEQ ID NO: 21978 - protein, 292 aa, Pseudomonas aeruginosa
TTTERSDCRLRRLRQGRRSSSRISAAKNSRRAVVPWAPTRGNMLFAREAPLWIEAMAINSRPTGNSVPARPREVEVMEEVRQWEAARWTAGNGMCTIMRKTATVSNILPNPTERPSVLEHVSGNVRRLRLQAGLSQEALARAASVSRRMLVGIESGDVNVSLSTLDRIAAALGVLFPDLVQAPATDRSRINAVAWVGHHPESRATLLASAPARREVELWAWSLGPGERYVSEPDAAGWREMVLVIEGRLRLELADGERRIEAGDFHAFASDQPYAYVNDGDEVVRFTRNVVS

SEQ ID NO: 21979 - protein, 392 aa, Pseudomonas aeruginosa
ASSRSAAISGSAVRYSRACRGRSCSERDGVPCPSPLPGRPGSASGIGRKCLPMTTGPPSLWKHPPCPPGPPSPGGSALPSPVVRIARRQHRARRRQVAGVVVVAQQLAVERVLVADEQVLDAQAQLVVGGDAVLADQVDRGVGADLAPAEAFHAVETVVLGVEEGGLQAVVPVGIRLVLQVGGQLQRRHAVAGHVLPVLAVRLLASAHPGGAAARAPDFVVAEPVGAGLDAVDALLGAGEDQAVVEALHVAQLGGGVEQRQAAQGVAADGATPAEFVVVGLHRFEVRGADIEATAGVAQLDADIGQLEALAEGGIDFLASHRRIDDAEVRQHRVVVEVAALDGHRRGGLGLGERDEVVEFGGGVFVAQAAVDRPVFVEAMLQLGERAGAAGA

SEQ ID NO: 21980 - protein, 487 aa, Pseudomonas aeruginosa
RRHVGELADLVEDQPAAGVVGRRVEHVERHVAAFLVVVAAPDQFGIAAFAQRRAQGQAAAEHFAVLHDLVDVAAAGGDGAGVERSEAGEIVTVVELRGEPAAEDVEVLVLEVRQGVADAVLLVQLQALDRVGRDRARRQPGDPRVGGVVGVLAGVVVAEGELHALVLVDAQAELAADVVDVRVEQVALAGFRGDAVAMGVVGSADVTGAEVERIVERPQGAGEVLLELAAEAIAAQPGQRRGGAEAGFRAVLAAGRTGGDGDDPAGGAAAVDGAAATDDLDPLDQRRVDVGQVARGVAVGVQRHAVDHHQHAAPAQGLAVFGDGAAGIGHPRHRLGQHGGQAVGALAQLLQLGMLDDGGLARGGDQVAAGARGGDFHLLHVQRFAAGLRSGHGGFAGRNDDEGMFVPGLRLQAAIPEQLAQCLFGGETPLQRGRLAAGAEIAGEKDLYRGLLREGVDRLAERRGGQIHVELFLALGRHRQEQAAGEQ

SEQ ID NO: 21981 - protein, 166 aa, Pseudomonas aeruginosa
SRRWPAIGSGSAARRGTAARRARRRPARCSSGCRRCAPAGGSARPFPGCRARPWRAPRRPAPTGSAPGRGGRRRRGRRRSAQPGSPPPAPPARRPGRHGRRRRAGRRGCTAPSTRRHRGHRRRRPGRAARRCCPAAATARCRTPPGRSRGSPAGAARRGSPPAAAR

SEQ ID NO: 21982 - protein, 186 aa, Pseudomonas aeruginosa
AIYCPTLPNAPASSNMSPATSAACACKPASARKRWPARPVSAGGCWWASRAATSMSACRPSTVSPPPSACCSPTWSRHRPPTARGSMRWPGSATTPRAAPPSSPAHRRGARWNSGPGRWDRASATYRNPTQPAGGRWFWSSKVACAWNWPTANGASRPATSMPSPATSRTHTSTTATRWCVSPATW

SEQ ID NO: 21983 - protein, 142 aa, Pseudomonas aeruginosa
PRASLPEETAMSARVRPFLMFQGVQAEAAMNFYLSLFDDAEILQIQRYGAEGPGPEGSVMKALFRLGDQSVHCIDSHVRHAFDFTPAFSFFVDCESNAQIERLAEALSDGGKALMPLGDYGFSQRFAWLADRFGVSWQLNLA

SEQ ID NO: 21984 - protein, 328 aa, Pseudomonas aeruginosa
SRSLTGCPPLLVNRRSAPAPRRSRYRLGADRPIPGDRGPARHRRTAPHAGADCPGRRAGSRASAARGRRPPARRRRRWRRRRPARAWRRAAGWPGRRRYGACRGSRKWLCRNSVKALQATAGAARPAVGTLRSDARRPPRPLGAGLLYCPGQRKNRRRLSIRRPAVRPVREAGQNGPSLRRTTRRTQMRFMVIVKATHASEAGEMPSEELLAAMGRYNEELVKAGVMLAGEGLQPSAKGARVRFSGNARTVIDGPFAETRELIAGFWMFQVASLEEAIEWVKRCPNPFDGESEIEIRQVFEAEDFGEEFTPELREREERLRAELEKRN

SEQ ID NO: 21985 - protein, 149 aa, Pseudomonas aeruginosa
TAPHSAKNEESAMQIVPYLIFNGNCREAFSCYHQHLGGTLEAMLPFGDSPECGDIPADWKDKIMHARLVVGSFALMASDNHPAYPYEGIKGCSISLNVDSKAEAERLFNALAEGGSVHMPLGPTFWAASFGMFTDRFGVAWMVNCEQDR

SEQ ID NO: 21986 - protein, 331 aa, Pseudomonas aeruginosa
LSLPRPPGTKKITQQLIAIACCVFTRSGPIAAPDESPQAPPENPHPGFRHPPPTLSSPAIIPGGPMPVSLPFEQVDVFSEQPFKGNAVAVVIGADRLSSRQMLEFAAWTQLSETTFLLRPTVAEADYRVRIFTPLRELPFAGHPTLGSCQVWLNQGGGNAADEIVQECLAGLIRIRRKGALLSFAAPPLLRGGAVEDEVLRRIESGLGLSPGQVRGSQWVDNGPGWVAVRLATRDEVLAIRPDYAKLDGLNVGVVAPWQGPQAEADVEVRAFMGEELNEDPVTGSLNASLAQWLIGTGVMPGRLHGEPGHGLGSPGADKRRADRRRYLDRR

SEQ ID NO: 21987 - protein, 154 aa, Pseudomonas aeruginosa
  UNSURE (77),(150): Identity of amino acid at the above locations are unknown.
PFLTTPSTRKLRGSPAQTRTAVNSPALPLSRGLRIRAELKELLTLAAPIMIAQLATTAMGFVDAVMAGRASPHDLAXVALGNSIWIPMCLLMNGTLLATTAKVAQRHGAGEPPGHGPLVRQALWLALLIGTLSGGGAVVVVRTDPRLDEXAPGN

SEQ ID NO: 21988 - protein, 344 aa, Pseudomonas aeruginosa
SGPSLLYLKGIALGFPAAALYHVLRCYTNGLGRTRPSMVLGIGGLLLNIPINYALIYGHFGMPKMGGPGCGWATGSVMWFMFLGMLFWVNKASIYRASQLFSRWEWPDRATIGPLVAVGLPIGIAVFAESSIFSVIALLIGGLDENVVAGHQIALNFSALVFMIPYSLGMAVTVRVGHNLGAGLPRDARFAAGVGMAAALGYACVSASLMLLLREQIAAMYSPDPAVIAIAASLIVFSALFQFSDALQVTAAGALRGYQDTRVTMIMTLFAYWGIGLPVGYSLGLTDWFQEPTGPRGLWQGLVVGLTGAAIMLCIRLARSARRFIRQHERLQREDAEAASVLGR

SEQ ID NO: 21989 - protein, 274 aa, Pseudomonas aeruginosa
RRGGATRLDAEGSADRGEDDRADGQPLGRAQPLAEEQQPGERAEGRLDAHQGAEGARRQAGQRDHFQGVGQGRGEHRDAQRQRDQRRVEEVGAGVGDADRHNQDRRHQHPQRGALGAMVGAGALAEEDVQRPAHAGTEGIGGADQVERLGAVAQRQQQPDAEHRQADPEEVQQAPRGEDRHQQRPGELQGHRDAQRHGAHREIEQQVHAAQGDAVDHHRAQRLQAQALAPGTQEQQQDQRGEEQPQGRGALGADQGEHAFRQGGAALDRGHGDQ

SEQ ID NO: 21990 - protein, 246 aa, Pseudomonas aeruginosa
QADRQQRSGEAAGGGGHGRGPAVGSSPMDCGKRDVHYNAQNRDSEQYIAQPYRTPQRPRTCLRQRPPPAPASRPQPGSAGPRGQCQPADAGGHRERRRQCQPVDPRPYRRRPRRAVPRPGPGTGHRPLADQCGGLGRPPPREPRHPPRQRTGAARGGTLGLVAGTGRALRIGTRRSRLAGDGSGHRRSPAPGTGRRRTAHRGRRLPCLRQRPAVRIRQRRRRGGAFHPQRGELGSSLEPAFQRRPR

SEQ ID NO: 21991 - protein, 240 aa, Pseudomonas aeruginosa
CRSATTASASVSPGWPTASGCPGSSIWPEPGSCRQASWRTSWHTSTHCASTSSAIRCGAMRTALCTAPAAGSTSSKACSETSQYTASGVARPNGQTPPTGCPVSSTTSSAPSIFALPPKAALILRLSSRASPRATTSTVRSPTRSDRVLAIRPGSTPWASAARATVAVLVSSSMMRRSGAFSAKNRRTDSRLMGWAPWRKPTNLCKRAEAVQRRALRRSARSRSAAGWRRAAASPPRRSR

SEQ ID NO: 21992 - protein, 302 aa, Pseudomonas aeruginosa
LSARGTPSILCRPLHTNSARAEQRREQQGIPMKVELVQIAGRDGDTAHNLERALAAIADCAADTELVVFPETHLTGFPSEDNIAALAEPLDGPTVSAVQRVARERNVSVAIGIAEADAGRYYNTTLLIAPDGIALKYRKTHLWASDRGIFTPGDRNATALWNGIRVGLLVCFDIEFPESARALGQLGAELIIVTNGNMDPYGPTHRTAIMARAMENQAYAVMVNRVGHGDGGLVFAGGSAVVDPYGQLLCEAGREECRQIVELDLGRLQDARRDYRYLEERRLVLPGERREHPDGLRELLIP

SEQ ID NO: 21993 - protein, 709 aa, Pseudomonas aeruginosa
RLRAPAGRAAVAVARARAAQGGLAADPARRHARGGRRAGPAPAGVLRPPGVERGAETPAEEQRIEHRFRPFRLHRQDRGGTRRLLRRYSSALPDPLGAERLGLHPHGLAGAARGTVRQHAELRRAGQVHRLAVVGARRGPRQRSQPDRHCDSLPPRHRFGRFPDRLWRWPVAQALVAGARAAHGRCRLAGIAAQKPGGGAQHRFPLDRCGPLQVLGVGALGGRQVAGVEPGDPQQGQGTGQRDQRVAGRGQGHADDATGTVENPLGQYRCTAADQQRAELVGQRQAGVAHPRREGSGEDTAHRAVEHRVRHRGQAHADRGDPVDLGFHGEEHRRHQDKLRQHHQACRLAHVDARSEQRPQWLAEELHHQRDHDDAEEGALAVAEGLGRPGEGEGALEVGDVDDRQHAGAEQDDLPVLAQHLGERQLHRALLRQHALHVFRLLQLQADHHADDDQHCGEQERRAPAPENEVRGGQGAEGEERQGRQQVAGGRALLGEGGVQDAFALGRAFAGDQDRAAPLAADRDALDDTQRHQGDRRPDADLRIDRQQADAGRGDAHHDQGDHQGGLAADAVAEMAEDDPAQRASDEARPEGDEGQQGGQARIHVGGEEYLAEHQGGGQTVDVEVVPLDGGADEGGDTGPAGLLVQVGVFGRGRARHGSSPVYCCSRRHAAPYRPSLKGGAETLVSVEGERASVLTRVPRSLGGTPANQ

SEQ ID NO: 21994 - protein, 94 aa, Pseudomonas aeruginosa
SMELTKPTRSWPTSPSADSWVRRFTFSACSSRLRASTSRTWPAPVSFTDLLLRSSNWVPSCSSSFLMSKLSAGWEMNRRAAARPKCSSSATAMK

SEQ ID NO: 21995 - protein, 505 aa, Pseudomonas aeruginosa
RSCLRSMAGTWFYDLFFLSSMIFFVLDAYRSTRLVSAQDKQEPRHDRHARSTSRRYAEHPRQPWAESLHLRSGPGAAAGGIPAAGVARRMAAAPRTARRPCRRRAGRAGAGGGQESAGAGAAHPPRRGFAEHSQASGLRRPRTGGLCRTWPGFHEPSPGRPAAAGEVCAHPPVRTGRVRPLLPGQHDRLADPHPAQVRRARTGRALPAVPRLAGFRRAVPGRHVHDRAGRRLRRGADPYRGAGGGRRVEALRRQVVLLQPGRRPGDGPGPPRRRAGRNEGRDPVPVAEGPRGRYAQRLSHRPPEGQAGQPLHGQRRSPPGRRQRLPDRRDRPRLPADGRHGQHVAPVQRRARRRADAPGAERGAVRRPPSARLRQAPDRHAADAEAVAEDDAAHRTGALDVHADRHAAAARRWRRGRGAEMRADPHPADQVPRLPRCASGHRRRHGGARRGRLHRGVERPAAGARRPPGVDLGGHQQHRGAGRRPCGEPRTGARILAAPPAPAAG

SEQ ID NO: 21996 - protein, 522 aa, Pseudomonas aeruginosa
QRPARGRPRPLRRTAGASGRDHGRRRRAPPGRAGAPGRQRPLSPVHGDLHGLGGQPPGTRPAPPGPGLPGRPAQAAAARPAAPGGLDRPGRTAGQGGRRGAAEPGRSHAIAAGLTARIPAHNNQRVAMTNQTGALRGLKIIDLSRVLGGPYCSQALADHGAEVIKLEPLGGDETRGWGPPFEGDTASYFKGVNRNKKGIAVDLATAEGIELLLRLLEDADVLLENFKPGTLARWGIGYEEVLRQRFPRLVHCAVSGFGAHGPLGGLPGYDAAIQAMAGLMSVNGEAGGEALRIGLPIVDMVTGLNAMAGILLALHERQVSGRGQSVDIALYDCGISLLHPHLPNYFASGRTPRRSGNAHPNIAPYDSYRTGTEPIFLAVGNDRQFARLCEYLGADELPGDPRFADNGKRSVNREALKRALEDYLAAHDGRELAERLIRLGVPCGAIATVDRVVEHPHTRHRGMVVELEGYRGIASPVKLSRTPASYRAAPPVLGGDTREVLAELGLSAEAIDALVRRGIVRA

SEQ ID NO: 21997 - protein, 399 aa, Pseudomonas aeruginosa
GWSARWRRMARHWIAPSNWLARSPACRRWRWRRSRKWSWPAPTCRWTRPWRWSARPSSCCSTATTRRRACVPSWKNAQRSTWENERATNRSHRYRRYRRHGPGHRPARCLCRAVGAALRQPPGCGTASTRADRHGPCPAGGARPAGGGGCRARDGQSAGGRGLAGLTRLPVGDRGDRREPGGQAGVVPPIGRGGRRRSDPRQQYLLAVGYRDRLGLSRSRPGRRSALLQSGAADASGGGDRGSRHPHRHRRATVRPGGDLRPPGGACHGQPRLHRQPCRTGLRHRGAAYPRRGRGAGGGDRRSPARGRRLPHGPVRAVRPGRVGRQPAGDGVDLPAVLRGAALSSASLAAPDARRRPPGAQERPGLLPLRRRWAGARRRPGGCARRGVAAGVAGRRRRT

SEQ ID NO: 21998 - protein, 439 aa, Pseudomonas aeruginosa
SSAADETPFPLEKEAPRRPFGVRMNNNKKCAFFLLPILAGDSVPALAEGFLEDSRASLALRNFYMNRDFRDGAGRAKSEEWAQGFLFDYRSGYTEGTLGVGLDLLGKLGVRLDSGAGRSGTGLLPLRDDGSAAGDYARLDATAKLRLSRSELKVGGLVPKLPTIQPNYGRLFPQVFQGALLTSGELSGLSLNLGRLTEVSQRNEAGTSDLALFNRNRRFAGAAQADRFDLAGLDYRIAPDWTGSYHYGELEQVYAQHFLGLKGRIGIAADSLESDLRLALSRDTGGARGGRIDNRSFSGSLTYRLRNGQAFGLGYQRMSGDHGFPYLEGTDPYLVNFGQYNDFAEAGESSWQLRYDCDFAPLGVPGLSLMTRYFSGHGAKPKGADGSREWERDSDLRYVLQGGALKGLGLVWRNATYRSAFSRDIDENRLYLTYELPLF

SEQ ID NO: 21999 - protein, 422 aa, Pseudomonas aeruginosa
AKLDSGADSLSLSHTPGAVDKRWPRSRRACDRGATGRRARHTGRRHGAAAQRRRATTPRPPGGIHQTVTLLWQRAGRNLIRIALHWGSAFWVFFMRAFIFLAALLCSLSSFAAARCDARVPTETVELGDVRLAYQSIGRDSDPALLLVMGLGGQLIHWPDEVVSALCEQGFRVIRYDNRDVGLSAWNVPVPSSRLTYEVVRYRLGLPVSAPYTLTDMAGDALHLLDALDIPQAHVLGASMGGMIAQHIADMAPQRLLSLTLVMTSSGAEGLPAPSESLLRLLARREAASREQAVEQQADLLAALGSPEVRDDRQQLLLQAARSYDRAFNPEGVQRQLLAILAEPSRVPLLNRLQVPTLVIHGTADPLLPVMHGVHVAAHIRGSELKLIPGLAHRFQEAFKEPLLAAVVPYLKAHRQASVVQL

SEQ ID NO: 22000 - protein, 418 aa, Pseudomonas aeruginosa
ASSSRLPGAAQGSALPATDAPRAERSMNLRILLILGALSAFGPLAIDFYLPSFPTLAKAFATDVEHVQLSLAAYFAGLSIGQLLYGPVADRYGRRLPLLVGVSIFTLASAACALAPSLEWLIAARFVQALGGCAGMVISRAVVRDLCDPIGAAKAFSQLMLVMGLAPILAPVAGGLLLDWQGWQSIFVCLTLFAALAGLGVALWLPETIPADGERPPLSGALGQYRRLFADRLFLAYGLSGGVAMAGMFAYIAGSPYVFIQLYGIPAEHYGWLFGSNAAGFIVMAQVNARLLRYRGPAFWLRRIIWGYLACGLALLGIASLQPATLWPLLVPLFGCVASLGCIIPNASACAMAGQGQHAGSASALMGSLQFSVAAGASALVGVLHDGTAIPMTLVIAVCGAVATLLAWQTGRLERQAA

SEQ ID NO: 22001 - protein, 190 aa, Pseudomonas aeruginosa
RNGTSTGCRRPPGVPVRGAHAGVRACKRAARRGPSCPRAAGAAAVAGRAGCAGGWRRAGSAGSGSRCGAPPAVARSRRAGRVAGPNGAAGCRGSRRCVAARWRCRRAGGSKRWSRVGGRRRRSRGPCPAAARAGRRCRPGIRARSRPRARATGPGLRCNRSAGARHGARGSCGGRGRAGSGPGRWGRGRG

SEQ ID NO: 22002 - protein, 540 aa, Pseudomonas aeruginosa
TTQFSRSRDLPPSDSFLAKARSESTSYQSATTIKAGLAGAGGFMSVPVRHLIAGAFVEGLGAQRIPVSNPLDNSTLAEIACASAEQIEQAVASARETFASWKETPVSERARVMLRYQALLKEHHDELAKIVSSELGKTFEDAKGDVWRGIEVVEHACNVPSLLMGETVENVARNIDTYSITQPLGVCVGITPFNFPAMIPLWMFPLAIACGNAFILKPSEQVPLTSVRLAELFLEAGAPKGVLQVVHGGKEQVDQLLKHPQVKAVSFVGSVAVGQYVYHTGTAHNKRVQSFAGAKNHMVIMPDADKAQVISNLVGASVGAAGQRCMAISVAVLVGAAREWIPEIRDALAKVRPGPWDDSGASYGPVINPQAKARIERLIGQGVEEGAQLLLDGRGYKVEGYPDGNWVGPTLFAGVRPDMAIYREEVFGPVLCLAEVDSLEQAIRLINESPYGNGTSIFTSSGAAARTFQHHIEVGQVGINIPIPVPLPFFSFTGWKGSFYGDLHAYGKQGVRFYTETKTVTARWFDSDSVAGTNFSIQMR

SEQ ID NO: 22003 - protein, 221 aa, Pseudomonas aeruginosa
KGDGPMTDIAFLGLGNMGGPMAANLLKAGHRVNVFDLQPKAVLSLVEQGAQGADSALQCCEGAEVVISMLPAGQHVESLYLGDDGLLARVAGKPLLIDCSTIAPETARKVAEAAAAKGLTLLDAPVSGGVGGARAGTLSFIVGGPAEGFARARPVLENMGRNIFHAGDHGAGQVAKICNNMLLGILMAGTAEALALGVKNGLDPAVLSGGDEAAFRCPPRG

SEQ ID NO: 22004 - protein, 830 aa, Pseudomonas aeruginosa
AVMARLKRTLSLGSVVLFGIAYMTPIIVLGTFGILAETTQGHVPAAYIAASLAMLFTALSYGRMAAAFPVAGSAYTYVRKAIDSRLGFIAGWAVLLDYLFLPMAIWLIGAAYLHSAFPAVPNAVWVLGVHRRDHDDQHRRPAPGEERQWPADAGAVPGPRRLRRALRALRAGRPGQAAMVTATVARWRPAGAAGDERCGDRLLLVPRFRRGQYPDRGNPRPAAQHPASDPADHPAGRVDLHRHLVLRATGAPVVRLRQRGLGGLRDRPQHRWRPVRDLLPGRPDRRPVHLRSLGPGQRLAPALRHGPRRRPSAAVLRSSRQALRDAGEQHRPVRCGGLAGATDGRDHLHVVHQLRRLPRLQPGQPVGGLPLLPWRRAPRSTGNPVVPGIPWHRPGRRPVVDGQPRPSGDHPRPLLAGAGRGVPGGDHPRFPRAAAGDAFRGGLRKNRRPFRGGKAQAPGLEWLSIASLIPEPAMSDAALFLPLPDDDTLYAALLARDPAYDGFAFVGVKSTGVFCRLTCPARKPKRENTLFFDSIKGCVEAGFRPCLRCRPLERLGTQGPLVSDLLQRLGRQPQRRWFEDDLAALGYDPSTVRRAFKREFGVTFLEMARLRRLGQVAERLSSGARVIDAQLDASFDSDSGFRSAFARLLGEPPSQLRGRELLKADWLQTPLGAMLAVADAQALHLLEFFDRPALSGELKRLQKSSGSSIGFGRFASIDRIEAELADYFGGTPVRFQTPLALNASAFTRTVWQALREVPCGSTQSYAGLARSIGSPSSVRAVARANGANQIAIVIPCHRVIGSDGSLTGYGGGLWRKRWLLEHERRMGAAG

SEQ ID NO: 22005 - protein, 585 aa, Pseudomonas aeruginosa
SRRKTSRSRAMTAMPEVLREDTLNIPDSRGLNLYTCDPALERLLEVYLPPALLAEWRPLLERLGARAGGELDVLALAADKNPPVLAPRTRRGEDLQSIRKHPDYVALEQVAYAELGLASMSHRPDGPPPLVKYALTHLFVQAEFGLCCPVSMTDSLTRTLRRFGAPELVERYLPSLASRDFDELFQGAMFMTEQAAGSDVARTRTVAREEGGEWKLYGDKWFCSNPDADLAMVLARPEGAPEGMKGVTLFLLPKVREDGTRNAYRIVRLKDKLGSRSMASGEVRLEGASAYLIGEIGRGFQQMADMVNMSRLSNGVRAAGLMRRALSEALFVARHRRAFGKHLIDMPLMQKQLLKMMLPTEQARSMFMQIATLLPRADGGEVEAQKCVRILTPLIKFRACRDARRVTGDAMEVRGGVGYIEEWSDPRLVRDAHLGSIWEGTSNIVALDVARAVSREQALESLQRHLRRLLDDSDLPGDARDLFDELLVRVVATMADVAERRQDEQVRQAGSALYHLCTAIFMAWEASRQAPDQRRLALAFLVARHKLLPRDPLRLEGWTDQAELLARVVGEVPLSQAEAMQLLPA

SEQ ID NO: 22006 - protein, 811 aa, Pseudomonas aeruginosa
APRRSTRWSGAASSAPETPHGTACAVQLNPRAIGDGHGFLPWGGEPRTRAAGAAGAGRGPVATEPPGSTQRPEHAPARGSGGARTAPRRVRRYPGHRPHRKWHGVRRRRRSQRTGGGVRAGDPAARGGAPLAGPRRLPQAADRRRGGPCPGRRLRVGDALRPDRRRCLGALRPAGNPCRRDARRRRHPAPGASGGQVPGAAHAVYRLHGTGAGGPGHRVGQRGGGGWPGIGSRPRTGSPDRRPAAAGAGADQGSGPGRRRPAAGPGPGAGAQGLPVAVRQPRPEGGHACLPGKTHSGVPGKMSEPPIVLIGIVGTGAMGQGIAQLAACAGLSVLLYDSRQGAALQAREQIATVLARQVERGRLEAEAAALAMGNLRVVEDLRVLRGCQLVIEAIVENLEAKQALFRQLEEVVGDEAILASNTSSLSVTAIASACRDPGRVAGLHFFNPVPLMRLVEVIEGLATRTGIAERLCALVATFGHQAVRATDSPGFIVNHAGRAFGTEALRILGEGVAPVAAIDEVLREGAGFRMGPFELFDLVGLDVSLPVMESIYRQYYEEPRYRPHPLLRQMLAAGRLGRKSGQGFYRYDGAGQVPVAAPAVAPGAALPPVWLGVDDEHDRAPLLMLLQRLGAEVESGERPSGAALCLLAPLGADVSAAARRFAVDPTRSLAIDVLSDLERHRCLMACPATRAELQQAARTLFARDGVGVTLIRDSAGFIVQRTLASIVNLACDIAQQGIASVEHIDLAVRLGLGYPLGPLEWGDRLGAGRVLRILERLHALSGDPRYRPSPWLRRRAQLGLSLRQPDSPLAS

SEQ ID NO: 22007 - protein, 121 aa, Pseudomonas aeruginosa
PRSASATRRAPATWRCSTATGVSPARRRRTVSTWPAWTTVSPRTGPAATTMANWSRSTPSISSVSRGASASLRTAWRATCAWRSAGIPAALAAGASTTVPSAGRSPTACATARPSAWATSG

SEQ ID NO: 22008 - protein, 352 aa, Pseudomonas aeruginosa
SIAQLLTSPIHQAFSISKGCPGATGLPVRAGTAPLPHAGKRPPRVVAHGQGSAGGFSETNIHGAERRRGRGNASDQVQVNLVLCHQAGDGGGRRAVADDPVDQRDRSQADHRVAPELARVGGQEHLPRVVDDRLGYAHFLVVEVEQAAILVDAADADQGEVDAELLDEIHRGLADDAAVAAYGAAGDQHFEVFLGAEGGGHVQVVGDDLQIAVVEPGAGDGLGGGAHVDEQRGVVRHQAGHGFGDALLLVTHLVGAHGVGGVLDARIVGRTAVVAAQQSLFGELVDVAADGLRGDREHLRHLLDAQVTALADLLDDALLSGGQVHGLFSCCRAGTLESRQECRTRGAVVSRA

SEQ ID NO: 22009 - protein, 194 aa, Pseudomonas aeruginosa
LWRAAVKIVQFRKNIFTKECCQSAKMNVCPKNDPPVSFSRPIEYRYRGTRAAASAPVQQGRRWLKVCAGFQPTFFSGSDHDPCHRPAEKGPRRAQGAQLQPRPQGTFLWPGGRGKARPGPAAGVQDAARRHGEGRVAGGGGAGDRQSRPEGPGPCGGGEEGRHGRSAGGAAGYRLPGGRDQPAGAEEAPAYLHR

SEQ ID NO: 22010 - protein, 385 aa, Pseudomonas aeruginosa
SRRPSGRHSSYFSICQVFHVPLSPRHRPGHHQLPRHRVQCPGLAGGELPAGIQAVLPEGRLGGARRRGNLADHPPGLSRRARPQGLARGRHRRHRHHQPARDHAGLGRRQRRPDPPGHRLAGSSYRRLLCRTQGRRPRGQCQRAHRAADRSVFLRHQAALDPRQRARRPPARRTRRAALRHRRLLPALAPDRRPLPSHRRDQRFAHPAVQHPQPGLGRGIAGAVRDPAQPAAGGTRLRGGVRRQRAVAAWRGDPGAGHGRRPAGRADRPGLLPAGHGEEHLRHRLLHDPEHRRAAGDLEEPPAHHGRLPSGRQGQLRGGGQHLRRRRRGAMAARRHQADRPRPRERSPGDPGRRLQRRLPGAGLYRPRRALLGPEGARRDLRPDP

SEQ ID NO: 22011 - protein, 105 aa, Pseudomonas aeruginosa
PMAKPNDTSNPEVTESSPRFVPLLPTSQADMCPRSATLYVDTHALPTHLFDNAKVRLRSAINILAMTRLLDEKEEPGGTLAYINGALLSLLSDALSEIEAGHPSL

SEQ ID NO: 22012 - protein, 222 aa, Pseudomonas aeruginosa
PIGAGSGCAQPPLAGCGSAASAGRAHAMAAVWSSGRRMGNMAGLGGGGRKEKLGRSRGPGQVGTGIRVPVRRWGQAPRCGSMARSTSSFCTRWCQMAAAAWPRISAKSRYWTVTWVPPANALKASGRSNGPICTSQNRSSGRLPASMPESGMTISTAYSRKCPALAAARCQSGFPSKVSGTPWTRRSARRVRVSRSTATPSDLCRVKTLPLPPSRPAKKSAP

SEQ ID NO: 22013 - protein, 335 aa, Pseudomonas aeruginosa
SAPPTCTRPFPRYPTRSGCWAFIGVTTTINIVGLRLAKNVNGLLMLVQFLVLGAFVALCVHYVLGDPGKPLWSLQPLLGGDLQVPLVMSGAAIACYSFLGFDAVSTLTEETRDPRRNIPRAILLITLLGGLIFIVTSYFVQLAHPSFAFDSADSAAYEIARNIGGDLFVTFFLVGLIVGQFTSGLSAQASASRLLFAMGRDGVLPRPFFGRLGKRFETPANSIVLCGVVALLALQMDVTTSTSFINFGAFLAFSLVNLSVVFHYYLGAERRGPRETLLFLVFPGIGLVADLWLMASLDHLAIILGLCWLALGAVYLAAITHGFREPPPEMRFEEG

SEQ ID NO: 22014 - protein, 229 aa, Pseudomonas aeruginosa
SYGSIRDSISTFSVSPRSGVVQAALQRRQERLRRPGRFAGRKDRVDLRTRAGRLDFQVAHLVPPGQAEGLRDQRDAHAETDHGGDGLPQARLVADARAEAGVHAAGDDQVVVVRGDMAREEDEVFVAQFGEVQTRLASQAVPGGQAAEERVADQGFGDDFRRQPAPVHEAQVDLPALQRLGLLRAVHFAEHHLHVRVLPFEAGHGPGQAAVEHGVDEADAQLADVALGG

SEQ ID NO: 22015 - protein, 120 aa, Pseudomonas aeruginosa
AANRRSNPCSATCAGCWMTATCQGTPATSSTNCWCEWSRPWPTSPSAARTSRCARPAAPSITCARRSSWPGRPAARHPTSAAWPWPSWSPGTSCCRATRCAWRAGPTRPNCWPGWSARCR

SEQ ID NO: 22016 - protein, 377 aa, Pseudomonas aeruginosa
AGRAADPSRRALRSHRHGGSGGGAPAHPPSRDGRRTRGLSRHRLAGEAFAHPGQLPRRAAGAGRRHSGSPGGTGIERRGDRRAGPARHRPRLKPRTARPAPCNSIPGQLEMAMDSSPGAVSPELVLLERPEQGVALLRLNRPAVLNALNMRLREALAEHVRRLDECADTRVIVLTGNGTAFAAGADLNELAEASALEIQQRGVERHWQALAACRKPLIAAVEGHALGGGCELAMHCDLIVAGASARFAQPEIRVGVMPGAGGTQRLVRAVGKFQALRMLFTGCTVRAPEALAIGLVSEVAADGQALDRALELARQIAGLPPLALAQIKEVVLAGADLPLDQALALERKAFQLLFDSHDQKEGMRAFLEKRTAEYLGK

SEQ ID NO: 22017 - protein, 510 aa, Pseudomonas aeruginosa
FATAPGSSSSAPSPRSSISPATSPSRVSLRWSTSTWRCASVSAIRWGRWSGATDWAPGACCASSNACMRSAATRAIAPVPGCAGAPNWAFPCASRTARWPPDPLAEKHTMLDAYIYAGLRTPFGRHAGALSTVRPDDLAGLLLARLAETSGFAVDDLEDVILGCTNQAGEDSRNLARNALLAAGLPARLPGQTVNRLCASGLSAVIDAARAISCGEGRLYLAGGAESMSRAPFVMAKAESAFSRTLEVFDSTIGARFANPRLVERYGNDSMPETGDNVARAFGIDREDADRFAASSQARYQAALEEGFFLGEILPVEVRAGRKGETRLVERDEHPRPQADLAALARLPALFAGGVVTAGNASGINDGAAVVLLGDRAIGEREGIRPLARILASASVGVEPRLMGIGPQQAILRALQRAGIDLDEVGLIEINEAFAPQVLACLKLLGLDYEDPRVNPHGGAIALGHPLGASGARLVLTAARGLQRIERRYAVVSLCVGLGQGVAMVIERCR

SEQ ID NO: 22018 - protein, 322 aa, Pseudomonas aeruginosa
AAAVLSRSALGGADPFEGGEGGVLGGEQEVAHEWRIEHVRADGGEERAVQALFTEAPGRHVAARAVLVQGPVRQAADAATGGHQLHHHHGQLGYAHLRRLHVGGVEEAGEDVETIAFHRIGDQGFPLQVLRDDVRSTSQGMLVGHRQQRFVGEQWHVGDAGQLDRVGGHHQVEVAAGQGRQRREGEARGQVQFDFRPGVAELVDGRHQPLEATVAFDGHVQASGGTAGEPRQVALGGAQLGQQRVGQLQQAQPGAGEAYRLGLAHEQLHAQALFQFLELVRQRRLGKVQALGGFHQAVGFAQRVQGLEVAKFEHGGLCMSKT

SEQ ID NO: 22019 - protein, 306 aa, Pseudomonas aeruginosa
RCGFVEFVSYARGCRQAMASIPQSVRSWSDGEKSPAHGTAARSSGATPQSHNATTAWRHSSNCHATVAARWTKFNQNRAPLGFCVLGFLHACFHLPGRLVVQPLLLCGGALRRTRTYRDGRTGRRAPGLPEHRPRQRSGPAAGDGPGRATDPLAGRGGQRPVRARLPGDPLRQPRRRPVGLERAGAQFAADLRSGALSPRPAGQRALYPHRHGRRCPASARRAGYPPGPCARRQHGRDDRPAHRRHGAAAPAQPDPGDDQLRRRRPAGAQRVAAAPAGAARGGQPRAGGRAAGRPAGGAGQPGSAR

SEQ ID NO: 22020 - protein, 432 aa, Pseudomonas aeruginosa
RLASCSVSASTLCICSPPGSGALAVQAGPKMGEKRLELRQRRFGQLAVGGQLAAEHREQRRLAVAGGERQGVVAGDRRRLVGLVVAQRTHAGEAVQDVGGRELLLEMGVHHLQQVGGFLFADRHLGRVALVLAIGGADHGETVQIGDGEDDAAVFVLQDVGVLAFVQLRHDDVAALDQADTVGRLLFQVVLDEARHPGAGGVHQGAGADRIQAAVAALQVQVPESLAATGADAAGAGMDVGAVLAGGDRVEHHQARIVHRAVGVLEATADLGLQRAAAGEAQAARGGQLLALAEVIVEEQAGADHPGWAQVRTVRQDEAQRLDDVRRLGQQDLALGQGFADQAEFVVFEVAQAAVDQLAAGRGGVLGQVVLFAKEHGQAAPGCVGGDPYTVDATADHGDIVDFGEWSGGGVRLTHVKGPEVESERSFVRIRK

SEQ ID NO: 22021 - protein, 851 aa, Pseudomonas aeruginosa
RAPRRHPAAARKRYPGHARAAPGNTPFAALRRTNGASSSQFAVVPAASALHRFLPAGIELFAPGLVALRLEHPLDHRLALQLVEAAPEAASQAGQVGGAEGGGLAHHRTFHAGAEDVGLELHEEVVGHRPAVDAQGAQAFAGIALHGVEHVAGLVGDGFQGSADQVVGLDSTGQAEHRAARIGVPIGRAESGEGRYQVDAVAVLDLGGEVFGIEGVVDHLQFVAQPLHRGAAVEHRALQGVADLAARAAGDGGEQAMGGFHRLVAGVHQQEAAGAVGVLRLARFHAHLAEQGGLLVAGDPGDRQFAAADPADPGVAVDLRRVAHLGQHRAGNVEHLEHPCVPVEAVDVEQHGPRGIGVVGDVDLAFGELPDQPGVDGAEQQVAVARAFAGAFDVVEDPLQLGPGEVRIGDQPGGFADVVFQPVALELRADRRAAPALPDDGVVDRPTAVTVPDHRGLALVGDTDGGHLVVLDAGLGEGLDQGRTLRGPDFHRVVLDPAGLRIELGELALGLADHVGIAVEDDGAGAGGALVQGDDVFLVVLVGHGCGLVAMAGKSGRSGSANLLRLGFGGRRGARQMARDQYTIAAGAEAGTEDRGEDRHQEIGNLAAAGEGDGPPAGQVGHQLGAEVARRVHRETGQRAHGATDHGDQQADQQRRQRTARQAVAVVGKGHDHRHEDGRDHHFDEERLADRQRRVRIGGEHRGQGQAVLAAADDVLRLFELDEQAAVEGVDQRCGAERTGHLGGDVERQLAPLEAGEQPQRDAHRRVQVGAGDAGAEVDRHAHADPPDDADFPQAEAGAGDLQGRDATGAEEDEEGGAEELGQALAEQGRGRGGGGHGASLVCSCNYGGQP

SEQ ID NO: 22022 - protein, 209 aa, Pseudomonas aeruginosa
TFVRKTTLRFRFRGQSNIATEARGPRHRRPCNRGGDGLRYAPVFSQRSSPGVTMTPAIDLLKKARAAHKVLSYSHDPKAPSYGLEAAEKLGLDPQRVFKTLLAATEKGELLVAVVPVIGSLDLKALAHAAGAKKADMADPQAAQRATGYLVGGISPLGQKKRLRTFIDESARQYPSIHVSAGRRGLEVELAAEVLAQLTQGSFAAIGRE

SEQ ID NO: 22023 - protein, 515 aa, Pseudomonas aeruginosa
AANPAGLAVGIRLTFQSVRFSMSHYLLAIDQGTTSSRAIVFSAQGLPVASCQQEFKQYFPKDGWVEHDGEEIWLTTLQVCRDALARKGLRAADIAAIGITNQRETTLVWDAASGDLIHPAIVWQDRRTADYCAELKAAGHEANVSARTGLLIDPYFSATKLRWILDNVPGARQRAERGELRFGTVDCFLLWRLTGGRSHRTDATNASRTLLFNIHSQDWDEELLALFEIPRSLLPEVLDCAAEFGVSEPSLLGAAIPVLGMAGDQQAALIGQACFQPGMVKSTYGTGCFMIQNTGEQPVTSKNRLLTTVGYRLDGKVSYAVEGSIFVAGAAVQWLRDGIKLIDHAHESEALAIQAGDSNGVYLVPAFTGLGAPYWDPKARGAIFGLTRDTGIKEIVTAGLQSVCYQTRDLLEAMRQDGTPPSALRVDGGMVVNNWVMQFLTDILGVTVERPEVTETTALGVAYMAGLKAGFYRDLDDIASHWHLQRRFAAHMAEERRGELYAGWQNAVRRVRSEA

SEQ ID NO: 22024 - protein, 326 aa, Pseudomonas aeruginosa
AAFRGKRRRFCRRLHNAGRSPQTPARAMGRRQGEVPLLRSEKIALYRPSRSLRRHAVAIVPRRSAMQLEFHQVDAFSSRPFSGNPAVVYRLDAWLADELMQMIATEHNLSETAFVVREGEAWRIRWFTPSVEMALCGHATLAAAHVLFEVYDEPGERLEFISRSGALRVNREDERLVLDFPAQYPSEVGSTVELEQALGLPPVDVLGSTDKLLVLLESEEAVRACRPDFAALARLPWRGVIVTARGLQKDFVSRFFAPAMGVDEDPVTGSAHCSLIPYWAQRLNKLSLTAQQCSARGGELWCRLEGERVSIAGHAVLVASGRIRLG

SEQ ID NO: 22025 - protein, 71 aa, Pseudomonas aeruginosa
PTGGNTMQVFKVQGMTCGHCVRAITHAVQAKDSAADVQVDLGAGEVRVASRLDSTQVLEAIREEGYGAELA

SEQ ID NO: 22026 - protein, 270 aa, Pseudomonas aeruginosa
LLGQSEVRIDLVPVRHNNKSRPGRCRRVHVSPSPPPHRGSLRRRSRRPAHPGQQSPRQQHPGGDRLRQRGADRAGGGQCPRNLRQLEGNPGFRARAGDAALPGVAQGTPRRTGEDRLQRAGQDFRGRQGRRLARYRGGRARLQRALAADGRDGGERRPQHRHLQHHPAAGRVRWHHPVQLPGDDPAVDVPAGHRLRQRLHPQTFRAGAADQRAARRAVPRGRCAEGRAAGGAWRQGTGRPVAQAPAGEGGVLRRLGRRRPVRLPHRHRAQ

SEQ ID NO: 22027 - protein, 242 aa, Pseudomonas aeruginosa
ARAELRRGEEPHGDHARRGQGTGHQQPGRCLGGRGRAALHGDLGGGAGGGRPRVDSGNPRRTGQGPPRPMGRQRRQLRPGDQPAGQGAHRASDRPGRGGGRATAAGWPRLQGRGIPGRQLGRPDAVRRGAPGHGDLPRRGVRPGALPGRGRQPGAGDPPDQRKPLRQRHLDLHQLRRRGADLPAPHRGRPGGHQHPDPGTAAVLLLHRLEGLVLRRPARLRQAGRALLHRDQDRDRALVRQR

SEQ ID NO: 22028 - protein, 155 aa, Pseudomonas aeruginosa
RLAVLRRRRSGDQHAAGRAARGKPVSRRRRPARAGRRQAPADRLLDHRPGDRAQGRRGRRGEGPDPARRAGFRRRRRRPRRHPELHRRRPRRRLRAGPAGPREHGPEHIPRRRSRRRPGGEDLQQHAPRHPHGRHRRGPGAGGEERPRPGGAVRR

SEQ ID NO: 22029 - protein, 717 aa, Pseudomonas aeruginosa
TPWWAPERRFITAGQHRRVEAVLHPQRQGLGGAGHEDAEEHVVADLRHLAGAVIAGVEYVPAHVLEDRPGPREAFGGAADDEAQGAGAGAADAAGNRRVEQGQALRRGGLGDLARGLRGDGRAVDQQGLAGDPREQAVVAEIQAFHVLPGRQHADHHFGAFAALQGAIGALRALLDQAQHGLGLQVEDIHPVASLEQVGGHRPTHVAQAEECDVGHRSVSLSAHLDREVGPGHAIAVEPARGHGLGLGVEAHALLAVGVQVAVERALPTGEGEERQRYRDRDVDAHLADLDVVLEGPRRGAGAGEDRGAVAVGAFVDQADRLLQAVDLGQAEHRAEHLFAVDRHVRAHPGEQRRADPVAVRVSLDLVAAAIQQQLRALLHALADQTLDARLGLRVDHRAVAGAAVVPWAGADLGQCVADFRNPLAGGPHQHRHRDRHAALPGRAHRGTDQVADDLCLVRVGHDHHVVLRPGEALHALIVRGAGVVDVLADGDRADEGHRLHLRVLEQLVDLFLAAMHHLQHALRRTGLEEQLGEPHAGQRHLLGRFEDEGVAAGDGQREHPQRDHRREVERGDANAHAQRLGDAVGVDVAGDVLHRLAHQQRGHVAGVLDHLDTAPDVALGVLESLAQLAGDDLRQFVVVFLEQRLVTQHHPRALGNRGFLPAGEGFAGTGHRLLDLLRAGAGDLRQGAVVEGIADRDALGAETFDEGSRDEVADWD

SEQ ID NO: 22030 - protein, 178 aa, Pseudomonas aeruginosa
SIAAKARACCACARARPGANTGSAAATCSGCRRAWPTTTPSTTANPGPSFGPTCAATAPPGCNTAPATATPRCAIGACNTPCSAASSNCWRCATAATASSTSCSPPAACAACSASYRCCARCARAAWTSTGCTLTCANTCMRASNWNAWRPSATCRSSISSVATRRSPAVRLSSTSCT

SEQ ID NO: 22031 - protein, 433 aa, Pseudomonas aeruginosa
NSERPDPRSGGLALQAPGLPGEQGRDRAADGDHQSHGDRRAVVEHADQRRSARRHAELQAAHQRRGAAGVLSLSGHGAGGSVGNDAAEAGHASEQRNQQRPQRGRLQRSDAQQGQAARQVAPDDPPQPERRPAIAQQPRVDLCHDDEARGIAAEQPAIVLGGNPVELDEHVGRTGDVGEHPGHRHPAGKAIGEKQAVGEQPPVLPQRAGKRRSLAVGRDGFRQPQRHAEAGQGGEQGQADEDRLPALPVQQQAAGHGGEDRRQAHHQHQLGKRLGGADRIAQVTHHCPRDDHPGAAAEGLDEARGDQPLQARRQGAGGRGQGEDTHPHQQRQAPAIAVGHRAVEQLADGQAGEVGGQAQLDVLDVGGEGLGQGREARQVEIDGQWPEGAQGSQYQQDAQVHGSLGTGRVGGRQGTSLRGSRQAGRRRLSLNRL

SEQ ID NO: 22032 - protein, 194 aa, Pseudomonas aeruginosa
TLQSTWLTCSPCSSRGRTMSIRRYSPSQIALHWLSAVAVLLIIALPYGADFFAGLLGGKGNVFTLHKSLGVAVLLLTLTRLALRRVQGVPDTLEGNPDWQRAAAKAGHFLLYAVLIVMPLSGMLAGKRPLDLFWLVQIGPFDLPEAFKAFAGGTHVTVQYLLFALILGHAAAAIWHHRVQKDDVLRAMLPQRGA

SEQ ID NO: 22033 - protein, 173 aa, Pseudomonas aeruginosa
PQRRTGTRMPVPTCPGPRLRPSFSLRPPPPRPAMFPILRPLLHTAAMACALPALAADPQPASGGWAQPDPAPIGYAVLNVSRERVESGTACDVGLYVHDELVGNLQPGASLALNLQPGAVDVRLAPNGPGDACRNGMTILAGQTLTLRAGEIRNVRITLGAGGLYLAPVADGY

SEQ ID NO: 22034 - protein, 200 aa, Pseudomonas aeruginosa
VSIFLAAYTAVNMSLDEYNDKLNFLAACTAVNVQQQRSKPWLHFLSCLYGSERPENSPASVFFFLSCLYGSEHGDGGGTGGGTFLSCLYGSERSWATCSGGRDFLSCLYGSERAPRQNDHRDKFLSCLYGSEHGERVTFWTGRFLSCLYGSERELMLFSMLVAFLSCLYGSELAPKTYNHLKEKEIPSFSCQKPSFFEVS

SEQ ID NO: 22035 - protein, 211 aa, Pseudomonas aeruginosa
TIFTAARHNYKNRQERPHDHRRPDPVPVRPMPGRVPRHRPPHLLRHRLRRGPEGRRRQLRPVGNQHHLGGRREHGDLPQRRRLRRPPEPGGEHRAVAVRRLRGAQAAVLHHRPGGRCVLRRSAGLHPLQQPVHRVRTGAEHRPRQPGQPGPGLGVLHLSAPGAVGRPGVPRRSGDHGHPHGGDHGPYRRRQRPAARSVGAAADRPADRRDR

SEQ ID NO: 22036 - protein, 580 aa, Pseudomonas aeruginosa
PQGHSHDRQAQQEIRRRPGPGHHQLPRHRLRPRCQRGQPGPARVRPVLSAGRLGRARPDGNLGHAEFDPGRGPRPGQHRARPGGRHRYHQPARDHGGLGPSQRSADPQRHRLAVPAQRGDLRAAQARRAGRLHPRNHRAGHRSVLLRDQAEVDPRQRRRRPRTRAQRRPVVRHHRHLADLEAHRRQGPRHRLHQCLADHAVQHPQPRLGRTDARGARHSPLDAARGAQLFGGLRQRPDRRGRRRRTADRRDRRRPAGRPVRPDVRGTGPGEEHLRHRLLPADAHRRQGGEIHPWPAHHHRLRPARRGRLRPGGRGVQRRLHGAVVARRTEGDQRLLRFRILRHQGQGQQRRLPGTGLHRTRRALLGPLCARRGVRPDPWSQGRPPDPRYPGIHRLPDPRRARRHAARCRRTPARPARRRRGGGQQLPHAVPGRHPRHPRGTSGDARDHRPRRRLPGRPGLRLLEQPRRAEEQGGDRAGVRAGVRRAPARKALCRLEESGGAHSRLGRRRTVTSWRHSSAAMRRMACSRAPLWHALGNVCARRPGAAAAPSTTHARLTTAPRVRHSWRLSRVPARQHENNP

SEQ ID NO: 22037 - protein, 575 aa, Pseudomonas aeruginosa
AIFEFEQNYVHFRLQGLSHESSAHPLRSTRRSLRCRRGRRWHQRCRDRRRRSRARPVRVPLRTARPGPAHLLGQQQADPRRPALPRTLRIPPGPRSPGRARGPAGQGAAHRQAAALRPAAPSAPAPSLDDPRRPVPLRSPRQAREAARLARPALHRQQPAEGRDPPWLRVLRLRGGRCAPGGAQRDLRPRARRPRPYPHPLRQRPSQQGTLAPAPGAQRRQPVFDPRPRPGERRRPLGGALHPGRPETEVALRYPPDPGQPHHRAEAVRRRARLHPAERRPPHRLRHPLSGPFHHDRHHRSRVPGRPGQGGDQRRGNRLPAASGERPFQAATRGRRHPAQLRRRASAVRRRVRRAFGDHPRLHPVALRRQRRAAAALGVRRQADHLPQAGRIGADAAPAVFRPSWARLGPPRHRCRAASRCRASRRSPSNWPTATPGSTAKWRCAGRARTAPGCGACWTGSMAKPISASTWAAACMPAKWTTCASTSGPRTPRTSSGAAASSACSSRRASRCASASTCRASIRIARGCMRPDRQPETSRPAFAGLVRYGRVRDDPGIMRDATKPVAPPQSRIPWT

SEQ ID NO: 22038 - protein, 215 aa, Pseudomonas aeruginosa
IDSITGRLTSNPTRSNSSNGPMRKPAPSRRTSSIAATGATPSPRIRSASVPKARPAWLTMKPGLSVARTAWWPKVATRAHSRSAMPVRVARPSITSTRRISGTGLKKCRPATRPGSRQAEAIAVTDSEEVLLARIASSPTTSSNWRNNACLASRFSTIASITNWQPRKTRKSSTTRRLPIASAAASASSRPRSTCRARTVAICSRACSAAPWRLS

SEQ ID NO: 22039 - protein, 532 aa, Pseudomonas aeruginosa
VLPGGSVATGPRPAPAAPAARVRGSPPQGRNPWPSPIARGLSCTAQAVPCGVSGADDAAPDQRVDRLGAQSQFRQDFPSVSAQHRRRGAVAGRGARKLHRRGDAAIALEFDDHPAMAGVRVLHHPIHRGDGSAGHAETDQPLGQLTAVVGRQVVLQGALQRLAVDRALAVVGEARVPRQFIGSQVLTQAGELAVVADGEEDRLGTGAVAVVGRDVRVGVAATPGRTSGSEVVRQVRVQQGDTAVVQGDVHRLPAPADLALVEGEEDAGHGVQPGDHVDDRQADAQRLAAGLAVHAHQSGHRLDRRVVAGQAAERAVGAEARYRAVDQPREALAKHLLVADPPARQGAGLEVLQQYVSVLQQAQQQLDALRRRQVDGDALLVAVHALEVGRRVALEGRPPATGLVAAEGFQLDHLGAVVGQRLGAVGSAEDPAEIDDFQATQGARLIGHGDSLVVVSGNAGSQAGSNCMASAWLSGTSPTTLASSSAWSVQPSRRSGSRGSSLCRATRKARARRRWSGAWRLASQAMKIAVHR

SEQ ID NO: 22040 - protein, 513 aa, Pseudomonas aeruginosa
TPRHPGQHRRTLSLHGNQRFRPAFQRRAVGRGVSARTTINRTRPMPRTPSPEDADLHKKARRAGIASFIGTTIEWYDFYIYGLAAALVFGKVFFPADMDPGLATLLSFVTLWSGFIARPLGGIIFGHLGDRIGRKTTLVITLIMMGIATTCIGLLPVYTQIGIWAPISLVALRIVQGIAVGGEWGGAILIASESAPKGKGILYAAFAQQGSPTGNLLATLAFFALSALPASDFILWGWRAPFLLSAVLVIVGMVIRLKLEESEDMKRVLAQKRTVKLPLAEVLGKHWKIVLLGAGVLPIIHVTYFKSTFALSWATKTLGYSQGTFLSIIVVALVVQFLSQPLGALLTSRIDMRKAACLMVLPEFILMPAMFFAVETKVYWIAAVGMCLATVPHAMFYGAVGGILARAFPARVRYTGLSLAYQLCSLLVGGGTPVLAQWILNSTGSIVGVALASACYALVSLACTLALLRITGFHASDLSTAERADAEDLQRPAAVEREPVLRAPARLLGGDPG

SEQ ID NO: 22041 - protein, 151 aa, Pseudomonas aeruginosa
NPDQRPALRRTHPLPVARLAAPLHPRATRRARPGAALGGRADAPAPGLRGRSVEQPRGAGAGLAGFAGEGRGADGHAADGARTGGRQADAQRLLEQGDRPQAGDLGGNREGPPQAHVRQARHQVAVRAVRPVPPGPGLTGRATVPSPLSGA

SEQ ID NO: 22042 - protein, 195 aa, Pseudomonas aeruginosa
SPAWNMFRPMFSRTGRARAKPSAGPPTMKLRVPARAPPTPPETGASSRVRPFAAAASATLRAVSGAMVEQSISRGLPATRASRPSSPRYRLSTCCPAGSMLITTSAPSQHCKALSAPCAPCSTRLSTALGCKSKTFTRWPALSRLAAIGPPMLPRPRNAMSVIGPSPFQRIWIEKLVPATLSLSNQRAVTVLVSV

SEQ ID NO: 22043 - protein, 84 aa, Pseudomonas aeruginosa
LAPLSSHGPGRTLASASRISGIHSRAAPTSTATEIAMQRCPAAPTEAPTRLLMTCALSASGMITMWFFAPAKLCTRLLCAVPVW

SEQ ID NO: 22044 - protein, 197 aa, Pseudomonas aeruginosa
RAPADLLQRRPGPVARARGRDLARIPGRQRRPALAAAGHGPRLRRRRPPTLDHLLDPPARRQRHLAATQRRLPRHPAAPLGPATRPARRLRATAGGAPQRLPLPALPARRQPPAQPALPATAAAPAARGQLGPRRAARLHARTPACAPRTGTPGGLLQPVEVPFRQSLQGDHRPYAYPALPAPEDRVRLPVAGQQRP

SEQ ID NO: 22045 - protein, 144 aa, Pseudomonas aeruginosa
ARNRRSANSRRYCPSAPESGGRSPSAGMVSGSHNATPRPARAANRVRQTKIDCQPCQSSSRPPATGARIGARPITSINWENALAAPIGSHRSRTTAREMTIPAQPPRAWTKRAAISHSRLGARAQAAEARVKILTPTSSGRRRP

SEQ ID NO: 22046 - protein, 60 aa, Pseudomonas aeruginosa
VFHHLRPASFRPQKQRAVPFVLSLRDGFAGPSIILLLGFYPIPGLLREPTEMSGGAVRRF

SEQ ID NO: 22047 - protein, 318 aa, Pseudomonas aeruginosa
PRAVIHPTDQGFSMWRSGMHEVIPLLKRPSAQSNPSARHQHRMPGDTHPLALQPAPQLAAARRALLGGQRQFVQALGPVGNQAAMRGAGDRVFVDAHRRGEEARDEILLQAPRGDDHSTPGQPRQGREVGATGAHRLFGLEQHQQLVGGAQHVHRRQAQGLLQLDGATDLARILRGEIQDQPLVLAVDPQRTGARDEFQALARLVVDLEQYVGRSQCGVAAERHLDARGEPADPPGLSFANDEGGLGEVVLGRDHLHQLVRQPGVEAIDHGGIATERAGRKRVDLVELELHGRPPGNDRHSMPPQAPGWAIQCDLFRS

SEQ ID NO: 22048 - protein, 546 aa, Pseudomonas aeruginosa
QWDFALPSTHCPSGRLRRPAGVVKPPAKTPPFSAKRRSGLAAHPSHRVLPAGVEFAAALLGHVRGEAALQVPVAGDVVQVAIEAGLQPGHVGHAEGGGLGDFRALHGDTKDVGEELHHPVVHHHPAVHPQRAGRRAVLAHRFEQVAGLVADRLQTGGDDLLDSGVTGQAEDRAARLRVPVGRAEAGKGRHQVDAVGVAGLDRQGFALVGVVDQLDAVAQPLHRGAGDEDAALHRVADLAVQTVADRGEQAVLRGHRLLAGVLDHEAAGAVGALHHARLEAGLADQRGLLVAGHAQHRDRRAKQRRLADAELRRAVEYLRQQAARDLEQRQQFLVPVLAVDVEQQGARSVGRVGAMGAAAGQAPEQEAVDGAEAQLAAFGALAGAGHVVEDPAQLGGGEIRIDQQPGARADIGLVAGGLEFGTVVGGTTILPDDGRVDQVAAGGVPDQRGLALVGDADGGDVGRAQALAGERVATDLEGGQPDFLAVVLHPAVLREVLLEFLLAARHRQALGTEHDGAGAGGALVDGEEIVGHGKPDRLKSKTNADR

SEQ ID NO: 22049 - protein, 178 aa, Pseudomonas aeruginosa
AGGISGSFTADGGERTLGQLGQHLGRQLHFQPAPSCADMDARVLPRAFIDEGTQALLLPQRADPAHQVAGSPLRRLRIGHVGLLRPRRMGQGLQVETADHRHHRHQQLALLRGGEQRLEHPLRVQAELFRGLQAIGRCLGVVAVAEHLVRGAGLFQQVDGRGHGHSRRRTLAENRRIP

SEQ ID NO: 22050 - protein, 303 aa, Pseudomonas aeruginosa
IYFFETEQFSRLPAIITRTDKRGPMTTAAPTPSLFGQCLAEFLGTALLIFFGTGCVAALKVAGASFGLWEISIIWGVGVSMAIYLSAGVSGAHLNPAVSIALWLFAGFEGRKLPFYITAQVAGAFCAAALVYTLYSSLFIEFEQAQNIVRGSQDSLALASVFSTYPHPALSVGQAFLVEVVITAILMAVIMALTDDGNGLPRGPLAPLLIGLLIAVIGSAMGPLTGFAMNPARDFGPKLMTYLAGWGPIAFTGGREIPYFLVPIFAPILGACLGAGGYRVLIARHLPSAAAPAEAEPEKVRAS

SEQ ID NO: 22051 - protein, 518 aa, Pseudomonas aeruginosa
PPALSCHSHKATAMTDKHNKKYVVALDQGTTSSRAIVFDRDANVVSQAQREFAQFYPQAGWVEHDPMEIWATQSSTLVEALAQASIEHDQVAAIGITNQRETTVVWDRHSGRPIHNAIVWQCRRSAAICAQLKRDGLEDYIRETTGLVTDPYFSGTKLKWILDNVEGARERARNGDLLFGTIDTWLIWKLTEGKVHVTDYTNASRTMLFNIHSLDWDARMLEVLDIPRSMLPEVRNSSEVYGNARIGGVGGGELPIAGIAGDQQAALFGQMCVEPGQAKNTYGTGCFLLMHTGDKAVKSTHGLLTTIACGPRGEVGYALEGAVFNGGSTVQWLRDELKVINDSFDSEYFATKVKDSNGVYLVPAFTGLGAPYWDPYARGAVFGLTRGVKADHLIRATLESIAYQTRDVLDAMQRDAGERLRALRVDGGAVANNFLMQFQADILGTRVERPVMRETTALGAAYLAGLACGFWSSLDELKSKAVIERVFEPECDEPRREKLYAGWKKAVERTRGWDDGEL

SEQ ID NO: 22052 - protein, 226 aa, Pseudomonas aeruginosa
REAAHRRSRGQPGAGQRLAVHQHGHHHRGHRPRLVQPPQSEDHHQQPARGRHPQRQGRLRSAGRRRHRTQRRRHRRPGRGGFHPAVPRRLRPGRHQRHRRGWQPARLRLPGSARIPGDHRQRAASVPGRRLEQVRAQRGGPPGTDLAGQPGHQRQPAARRHRPPDGTAQGSPGPGLRHFPCHGAVRRRECSFQKSHLPTPAHAPRPSAAAFPHAEEGRFPRGRANR

SEQ ID NO: 22053 - protein, 580 aa, Pseudomonas aeruginosa
RPGTPSKLKKPGESGWSITAQSTKLFSNSNKTTFTFDFRAFHMSQAHTPSAPLAEVYDVAVVGGGINGVGIAADAAGRGLSVFLCEQHDLAQHTSSASSKLIHGGLRYLEHYEFRLVREALAEREVLLAKAPHIVKPLRFVLPHRPHLRPAWMIRAGLFLYDHLGKREKLPASRGLRFTGSSPLKAEIRRGFEYSDCAVDDARLVVLNAISAREHGAHVHTRTRCVSARRSKGLWHLHLERSDGSLYSIRARALVNAAGPWVARFIQDDLKQKSPYGIRLIQGSHIIVPKLYEGEHAYILQNEDRRIVFAIPYLDRFTMIGTTDREYQGDPAKVAISEEETAYLLQVVNAHFKQQLAAADILHSFAGVRPLCDDESDEPSAITRDYTLSLSAGNGEPPLLSVFGGKLTTYRKLAESALTQLQPFFAHLGPGLDRQGTAAGRRADAERRGAHRATGQPLRLARPRNGAALGAHVRHPGVAPAGRGQWRSRSRRAPGRRPVCPRSGLPVQARVGPGRRGHPLAPQQARPVPLAEPAGAPRPVPAERASASPAGACGLIASQKRRGPLLRASFVMEGYGTIRA

SEQ ID NO: 22054 - protein, 67 aa, Pseudomonas aeruginosa
ARRTSPSSTVSVGTRASQRAAAKEERLHNKAARKMKARMKKTQNAEPQWSAILIKFRPARCHSSVTV

SEQ ID NO: 22055 - protein, 324 aa, Pseudomonas aeruginosa
DKLNESAPLSSFAHTEAAMLELRHLKTLHALREADSLVEAAERLHLTQSALSHQFKELEERLGMQLFVRKTKPVRFTSAGLRLLQLADSLLPQLRTAERDLARLAGGTAGRLHMAIECHSCFQWLMPTIDQFRDAWPEVELDLASGFSFAPLPALARGDLDLVVTADPIELPGITYVPLFTYEALLAVANQHALAGRPYVVPEDLERETLITYPVERDRLDVFTRFLDPADVEPAQVRIAELTVMMMQLVASGRGVCCLPNWALHEYSSRGYVTARRLGEKGLYCTLFAAIRTDMFDAPFMRDFLLTAKDTSFATLEGVSAAKG

SEQ ID NO: 22056 - protein, 498 aa, Pseudomonas aeruginosa
KLRKARLARESSRKPSAKAGTLSPARIGSRKNAHFLLLFIRTPNGRLGASFSRGNGVSSAALDHHRHALAEPDAQADHRVAPLDALQPAGGGEHQARTGGAERMAEGNGAAMGIDPRVLVVQAEQLQAGQDLRREGFVDLDQADLVQVDAGALQRAEDRLLRADAHQPGLHADAGAGEDPRQRPDALALADRAIAQQHYRRPVVDPRRITGGHYPTGEQRRQACQGRQVGLRSRMLVALHQPRLALASGAHLHRKDLAEEKALLQRSLVARLGRSGETVGILAIDAEGAGHVVAGLRHAVVAIALDQPGVGEARADGAVEDLQRAAEGALRLGHDERRPGHAFGAAGQVQPALAATDRARRVDHRRQSAGTQAVDRLPGQPRRQAGCEQRVARQVAAVFAGLVGTTEDHILQVVDSEPGGFRETRQQQAGQVVRTHRRECTGMPAERRTQAGVDIGIEHGVFLRQGIRRPTGCPAGAGKGPVGRAGAARDWGDSAGRR

SEQ ID NO: 22057 - protein, 117 aa, Pseudomonas aeruginosa
PTARRYCWRGSLRRRPPLPIGGTTPAWPPGSRRSPRSPTGSRVRPASPRPPADCPSRARQPPPPAGLAPPAGQGPWRSARVLAVPHPGGCRRAAPTARHRQRAGRCPGPWRRYRRYR

SEQ ID NO: 22058 - protein, 280 aa, Pseudomonas aeruginosa
ERLVARSFSQVLRCAFFQEGTHALLLVVAVEQQLEGLALQRQGLVQRQVGAGQDHFLDLRQRQRRQAGDLASQFEGAIQCLAIRRHLADQPYGQGLRRPYRATGKQHAQRLELAHRSHQALGAAGAGHHADTDFRLGEARRGTGDDQVAVHRQLAASAQGMALHGGDQRLAAGGEGLPVALHPALLDLQRGRLRQFVEIGAGGERRAISGEDDDPGIGALVEAPYVLRQSLAQAHVQGVEYCRAVQSQQGHALLRPLQQHEFGAHRPRGGIHGHLQLPGD

SEQ ID NO: 22059 - protein, 300 aa, Pseudomonas aeruginosa
NQVPAMDLRQLRYFIAVAEELHFGRAAARLFISQPALSFDIKKLEEQLGTQLLLRNNKSVKLTGAGQVLLVEARNLLLQAEKVKRLTQLSAEGDVGQLRVGFVNSMLYRGLPRAMSRFEREHPNMEVVLGEMNSAEQAQALQRGQIDLGFVHWGRLPAEIVSEPLISDPFLCCLPAGHRLAGQARLDLAELRDEDFILFPRHVSPHYHDLIIARCVDAGFSPRIRHEARLWQTVAAMVGLGMGVALIPETLCLAWRNEVRYLEIEPAGARSEIHAILPASEPSRAAQAFLATLKSGLDDA

SEQ ID NO: 22060 - protein, 160 aa, Pseudomonas aeruginosa
RQQGHHTAQDDAVRRRLEALAETTEERPRKDAVAAHGEEQARGAGLGRETGGELADDQADQEEGHEQVATDVAGDLVGRRVRAVEGERRVRQLHEVRGDDEDQPAQQGDQQDRSRDVAPRVAGFLGQGTDRVETEERVAGDRRTAHHQRHLQVATEQRLQ

SEQ ID NO: 22061 - protein, 262 aa, Pseudomonas aeruginosa
KMSFTLQDIAWHRSVGQLVEALDAPDFWIRLVRLLEQYVPFDSWVALLFSQGRPQVFAECPGADGGPDPLFQDYLRGLYLLDPFYIASRENPCSGLFRLADVAPECFEQTDYYQRYFRLNVVADEIQINVQLSGERTLCLSLGSRRRFTPEQLAVLGLVRPWVAGLMRQRLAFEDEVLNSPAAPEPGWQGSLEKVAEQMGTPLTARELEVGRLMLSGCSSKEIARKLAISAETVKVHRKHMYGKLGIKSQSELFGLFLQAQG

SEQ ID NO: 22062 - protein, 311 aa, Pseudomonas aeruginosa
IVLFMDYIAEPATDMSHTSDWPLPADSLRLPIPAALLEKLAVHPLSRDLYPTSLGHYRRARDHRMSRERHDEHLLIYCSEGQGLLRVREGETWREYRVGSGDLLWLPPGMAHDYAVDDRQPWTIFWTHLRGDSATWLQHSAGYRDTPLRHWGLQHALLGGFEQLLEVRHSGYRFQHFLLAASRLRSLLCQLPLLRPLREGSLDLDGLHAYMREHLHARLELERLAAFCNLSKFHFVSRYKAITGRTPIQHFLHLKIEYACQLLDSSDHSVARVGQAVGYDDSYYFSRLFSKVMGLSPSAYRQRVRQGEGGA

SEQ ID NO: 22063 - protein, 60 aa, Pseudomonas aeruginosa
IAMNILVRPSQTPKGQCWQVCLDQQAVNFRSESEARRFVDRLEARLRAPHVLPELKQRTA

SEQ ID NO: 22064 - protein, 230 aa, Pseudomonas aeruginosa
NRYTPRPVAETDSTTQHSMRRTKEDSEKTRTAILLAAEELFLEKGVSHTSLEQIARAAGVTRGAVYWHFQNKAHLFNEMLNQVRLPPEQLTERLSGCDGSDPLRSLYDLCLEAVQSLLTQEKKRRILTILMQRCEFTEELREAQERNNAFVQMFIELCEQLFARDECRVRLHPGMTPRIASRALHALILGLFNDWLRDPRLFDPDTDAEHLLEPMFRGLVRDWGQASSAP

SEQ ID NO: 22065 - protein, 383 aa, Pseudomonas aeruginosa
NHVHPPLFPVTDRPALAQRRRGPADHRPALRRRLLRRPARRQGQRLHPAQVAGRGGTPADPDTPGAAPRPGCPGYLGGEPGLAARGRQGRAFPAVRGADRHAALRHARRQASAGPVLAGADRPVRPAGSLQGVRRRHPRHRPVPAFRADPRPRRRGHLAPPRAEGRRTARHAAATRRLTPATDGHADARPDLSRAPASAKLFLTPPAAEARHVPHPSPAAPYRRHGMRPPGARRGPATGQRWLGATRPGADRLCGAERFPRAGRVRHCLRCRPVRPRRTGRQPATGRQPGPEPATRRGGRASCAERSWRRLPERHDHPRRTDPDPARRRDPQRTHYPRCGRALPGTGGGWVLRGSDLPWSIGHDAGHEGGVSAPGARGLPGGP

SEQ ID NO: 22066 - protein, 143 aa, Pseudomonas aeruginosa
PTSTTRNTSSPWTRAPPAPAPSSSTAMPTWSARPSASSPSSIRRPAGSSTTRWKSGPRRVRPWSRPSPRPASSTTRWPPSVSPTSARPRWSGTVTAVGRSTTPSSGSAGAARRSARSSSATGWKTTSAKPPGWSPIRTSPGPS

SEQ ID NO: 22067 - protein, 102 aa, Pseudomonas aeruginosa
SGSSPKARSTSPTTPMPRGPCCSTSTASTGTHGCSRCSTFPARCCPRCATLRRSTATPGSAGSAAANCRSPGSPATSRPPCSARCAWNRARRRTPTAPAASC

SEQ ID NO: 22068 - protein, 294 aa, Pseudomonas aeruginosa
RLRAAAGCRRGALYDSCTADNGPPRAAFLATFQGPGPAAREQPMNLPPRQQSIIEEVRERGYLSIEEMAQMFAVTPQTIRRDINQLAEQGLLRRYHGGAAYDSSIENTAYTMRADQMRDEKQRIAEAVASLVPDNASLFINMGTTTEAIARAWFNHRNLKIITNNLHVAATLSAKEDFEVLVAGGTVRSDGGIVGQAAVDFIQQFRVDFALVGISGIDEDGSLLDFDYQEVRVSQAIIDNARQVFLAADSSKFGRNAVVRLGPISLVNRVISDSPPPAAIARLMAQHKVHLDLV

SEQ ID NO: 22069 - protein, 70 aa, Pseudomonas aeruginosa
RPRSAVASSTPTARWTMRAWWCSTRSPPASTAPTSIPAPAASAPVAARDSGTCTWSAATAACIRSAPAPW

SEQ ID NO: 22070 - protein, 136 aa, Pseudomonas aeruginosa
RSSSRFSPILGPAWTAKAPLPGGEQMQSVEALTEQLANRYAWLDREMALRWARTYGTRVWRLLDGVNGEADLGEHLGGGLYAREVDYLCKHEWAQDAEDILWRRSKLGLFLSPSQQVRLGQYLQSEHPHRPRVHAA

SEQ ID NO: 22071 - protein, 153 aa, Pseudomonas aeruginosa
SPARNVEARFCGPRSLWKGTGRSGHNARRHQAGGAAAVENPVDLMFKALIGAAVVVLLAVLSKTRNYYIAGLVPLFPTFALIAHYIVGKGRSLDDLKTTIVFGMWSIIPYFVYLAALYLLVERFRLETSLALAALAWLVAASVLVGLWVRLHA

SEQ ID NO: 22072 - protein, 179 aa, Pseudomonas aeruginosa
QFDECRQAVVALWLCGVAPLLRAAVPCAGLFSPSLHDRTLCGIEAIACRQPLAYETNSTNPHRYQVLLIQRPPCSNFATSRPCTRCAKPTAWWKPPSACTLPSRRCRTSSRNWKSAWACSCSCARPSRYASPAPGCACCNWPTRCCPSCAPPSATWRGSPAVPPDACTWPSNATVASSG

SEQ ID NO: 22073 - protein, 215 aa, Pseudomonas aeruginosa
PRSAVPGSGSVRSVHRKSAARPGTPGGIAARSWAGWSVASVPGRRPSVRCATGAAWRSRPAARSRPPRCHRREAEAGRCRYAPRRNRAGRRACPAGRDPRRGCPRYSPSGSRRESPGPTPRFSHAPRHRGSRGSCRSCARPGWPASLRGSPRPRRERYRRQGSAAGKTRISCCCSYALRTGAWAPLFLGGTVSHRQRSITIATPWPSPTHRLTTA

SEQ ID NO: 22074 - protein, 148 aa, Pseudomonas aeruginosa
SRPSNFRQARTCGAKASLISIRPTSSRSMPARCSARRIACCGPMPINRGSTPTLALARIRASGRMPSRSPIARSPSSTTAAPSLIPDALPAVTTPPANNAGKRARAARSACGRGCSSRSTSRVSPLRPARTSTGRISPRKKPSSSAAW

SEQ ID NO: 22075 - protein, 149 aa, Pseudomonas aeruginosa
RSTSLGLAKRAPMVLSKTSSVRLKALSALAMTNGARDMLSAPPARYSRPSPQLIARAASITADSPLAHKRLTVCPGSRAGRPAASSALRARLRLSSPAWLVQPRITSSRSSTANPEVSARRASSRPARSSGRTVESAPACRPKGVRRPA

SEQ ID NO: 22076 - protein, 197 aa, Pseudomonas aeruginosa
ASSMVCFSAKGSGGQRAVRLAQGKAQLGAPAQPGTGAIARVAAERMQAFEDAQHAPGAQSVAPLQRPQRIAETEAHRQVDVLHRSDTLLGDVAGEIDDRGEGALDDEPGAVANQRDAHAVPCEQGASRLLQLRSGRRAGHQAAVSLQVRQHVDGQAARRIDGEPPRCGADVGAQWRKQAQRRPGRTLAALHLGAQTL

SEQ ID NO: 22077 - protein, 241 aa, Pseudomonas aeruginosa
QHQQWRAVMFVVDAQPHRRQRRAWRNRRGGDGHLPSAVVAVEALAALAPQAAGGEHLAQQGMRTITRLLVVLPVDRLHHRQADVQPDQVEQLERAHAEAGALAQDFVDRRHRRHALAEDTQRLGAEGPSGMVDDEAGAVRGTHRLVAEGRHQGAQSLGDAGAGGETLDHLHQTHQRHRIEEVQTGDPAGIATGRGDRGNRQRGGIAGEDRFVADHLFQLAEQRLLGLQVLDDRLDHQLAAA

SEQ ID NO: 22078 - protein, 478 aa, Pseudomonas aeruginosa
DPQVLDHPQIAHRERGSLRLQPASLHLPGKDRGDLLACLQCRTLAAVVEQHRQPGTGSELGDALAHGAGTDDTDENDWWLAHFPRYSAVRFSRKARMPSFWSWLSNSNWKALRSSARAWSSGRSAPARTTSLICASASGGRPAIWRASSRARSNAWPSAATSLTNPMARASGARTVQPVNSMRSAWNLPTARTRRWVPPAPGITPTRISGWAKRAEAPATIRSQCIANSQPPPRAWPSTAAISGLRQAARACQWRSTPRCWISSADASASSLRSAPAANAVPFPVRTMTRVSAHSSRRRTCSARASRRRMFRALSTAGRFSRNRATPCSGRSSSTSSGLTAPGEESMAISNCPGIELHGAGRAVRGFRRGRCRAGPARRSPRRSIPVPPGLPECLRPAPAARRGSWPGCAKASPARRCRDSPRVRRPSRDGGCAGAPPPDPPWRWLRRARRDGSAARPAHGRRGPPGSPPGRASAPRG

SEQ ID NO: 22079 - protein, 670 aa, Pseudomonas aeruginosa
FSGHAGRPSDWSWRLSGCCERECGQSGRQQLHGFGLAQRHLADHPGQQFGLVGPALQAQRVARQQLVPGDQEGQGQAALVGCLAAGLPGHEDRRAQVIEGAAGLAHLLVLAALGDVGHGRDHSHQQFVEEVAGVPWQVAVIQQPAQVALQGFERLFAAHRTGDVQRHDVAGALPDRPQVGVAHQPRVAPLLDVADPAAHLHGVAGDPTRIAAGAELDQRGEDPHAFLRLDLAAIGARQQRGDLHEHRARLFGGQHHLQQLLLHQRHVDQVLAEGAPMAGDEQRLAQRPAHQPGGAHAVGQARHVDHVGHLLEAAADLADQVGAGAFQADFAAGHGAAAQLVLQADDAIGVARTVLADLRQQEQGHALHSFRRAFGAGQDHRQVGVRVGAEPLVAVELPLAALLPRHGTGPRHVGAGGLLGHEHGALEQLVEIPRGEGRQVALDQFWRAEPAQGAGQRVGHADRAAKAELGLYEQVGERILHQRRRAVRAMAHGSQAKFGIGHLFEGDVVRMLANALQILAAAGARRQHRRILVRRQRQHVQLAAGTGAEPFEERPPFGEQRRRQVYLQQPLQGRIAGVEIQPTAVGDVQRIFAKYFGHGGHGAAPACLAPRLGECFDKHPIQKKSSTIRKTDRRTRCLPWISDSFATSSRSPRNCISVAPRLACSSPSRR

SEQ ID NO: 22080 - protein, 454 aa, Pseudomonas aeruginosa
KTIDLRGCHLDSEAPGSTPTHALPPRKPAFPPRLSAKGGRARRVGENNNKQDSTHAAHALSRRRRPAQEGPQGRYRLLHRHHHRVVRLLHLRSGRRPGVRQGILPRRHGSGPGHPAVLRHPLVGLHRSPAGRDHLRPSRRPHRPQDHPGDHPDHDGHRHDLHRPVAGLYADRHLGADLPGGAAYRPGHRGRRRVGRRDPDRQRKRAQGQRHPVRRLRPAGLAHRQPAGDPGVLRPQRPARLGLHSLGLARAVPALRSAGHRRHGDPPEAGGVGRHEARAGAEAHGEAAARRGAGQALEDRPARRRRAADHPRHLLQEHLRPLLGDQDPRLQPGHLPQHHRGRAGGAVPQPATGGAAHFAHRHAQGGMPDGAAGVYPDAGDVLRRGNQGLLDRRGRHVPGHGAARDVLRRGGRYPRPSLPGAGALHRPVAGLPALLAAGRRRYTGTGPVDSQQYR

SEQ ID NO: 22081 - protein, 436 aa, Pseudomonas aeruginosa
HRRRGPGLGLLRAGLAGLYPGPVADHRVPRQRPVDRRARRRRGLAAARSGRAGTGVARPRPASGRRSRLAGSAHAPLVLQQPALAPQATAIAGQGTVRTDDAVAGNHNGDLVGSVGAGHGAHRRRRADGPGQPGVALRAAARYLAQRLPDRAGEGRGVQRQGGLEAHWSTAEVVGEFRLDPVDGGETAETDARSAALLQAFQLPAQRRAVEELQQVQGLRVGHREHGAERGLQPVRLEQLAPAQLRRRLAQQAREGATEAAVGVEAGIQLRVDHPRARGQPLGDLAKTAQASHFQKGHAELALEGTAHGGRVIAQRRQVVFEPAPLRLPTEALEQVADQRPLRAEPFQRPATQAGPEAGLDAALDRIEEQGVLALRLARRAGQAAEHPGALHPDEGEAIVGGVARQQRGIQGVVIGKGKEQRCIGHGRLRNQGGDG

SEQ ID NO: 22082 - protein, 231 aa, Pseudomonas aeruginosa
CTQSATKAPRTRNCTSISRPLTFFARRRPTMLIVVVTPMNAQHPDRVGYRGKGRVQVGGADQPDRHRQEQVVEQHRPAGDEAEPGIDGLAHVGIGRAGHGEGRGHAPVAEGGEEHRQGSGDVGGGDVSLGGLGEDAESPEDDDGGHVGDAEQHHGTQRQGALESGHYCLLRNYRLLWQWPAAGRAAGRRGLPSPGRPADARAPIVVLRLSGPILARSLADGGRRDAPVAPR

SEQ ID NO: 22083 - protein, 163 aa, Pseudomonas aeruginosa
VSPCRTSPGTAPSGNWSRRWMRRTSGFAWYACSNSTFRSTAGWPCCSARAGHRCSPNARAPTAGRIRCSRTTCEASTCSTRSTSPAARTRAAACSVWPTWHRNASSRPITTSVTSASTWWPMKSRSTSSSPANAPSACRSARGAASPPSNSPCSAWCGPGWPG

SEQ ID NO: 22084 - protein, 448 aa, Pseudomonas aeruginosa
PGARRADQVASTRLGGGLRLGYTARRFPQVSLVVHMPSQASSPSPQVAIVGGGPAGLMAAEVLSQAGVRTEVFDAMPSVGRKFLLAGVGGMNITHAEAREQFLGRYGRRQKEIAALLGEFDADALRAWIHGLGIDTFVGSSGRVFPSDMKAAPLLRAWLKRLREQGVLIHTRCRWLGWNADGTLDIQSAAERLSIRADAVILALGGGSWQRLGSDGAWVPLLRARGIEVEPLRPSNCGFEIDGWSELFRDKFSGAPVKPVAMGLAGETPRQGEFVVTRDGIEGSLVYALSAAIRERIEARGSAEVWLDLLPNRRREQIEASLARPRGSRSMANHLRSQLGIDGVRAGLLRELTPAATYTEPARLAAAIKRLPLTLLRPRPLDEAISSAGGVRFEALDRNLMLDGLPGVFCAGEMLDWEAPTGGYLLTACFASGRVAGLGALAWLRGRR

SEQ ID NO: 22085 - protein, 160 aa, Pseudomonas aeruginosa
SLSAKRSGAGSGSANWLASRLSTGTSWITSTISCGWLWRNMPVSRSATSIPPATPAAVCSAPPRKPLAREGAAAAAGAIPGRMSPAAAAGLEKRVSPQPAGRPDWLGAGSSRAPPPNRPERKPPLLGRLCCNWATCASSSFTRWSRRFSAASWISTTCAM

SEQ ID NO: 22086 - protein, 389 aa, Pseudomonas aeruginosa
FENMNPGWHGSFIDTGPRPYPEIPPMSQEQQPIRFAYWVPNVSGGLVVSKIEQRTSWDIDYNRKLAQLAERNGFDYALSQIRFTAGYGAEYQHESVAISHALLAATEKLKVIAAILPGPWHPAVVAKQLATIDQLTNGRVAVNIVSGWFKGEFTGIGEPWLEHDERYRRSEEFIRVLKGIWTEENFTFKGDFYRFHDYTLKPKPIQQPHPEIFQGGSSRAARDMASRVSDWYFTNGNSIDGIRAQVEDIRAKAAANGHSVKVGVNAFIIARDTEEEARAVLDEIIAKADYEAVNAFGDAVKQAGKASPEGDGNWAKSTFEDLVQYNDGFKTNLIGTPRQIAERIVALKAAGVDLVLSAFLHFHEEVEYFGKHVLPLVRELEQAQAREAA

SEQ ID NO: 22087 - protein, 147 aa, Pseudomonas aeruginosa
SNGAKPVSEPSTTICPRRSSRLGSAARVQCTAPKKFTAMTLRKTPRPVSAKVPRWVMPALLTSTSMPPKRSTASATARSTASASETSQRRPSASPPRWSRRCWTKLSSAAWSRSRIAQWRTGPGETQRQRPTDAGNSRRLTSTTLGR

SEQ ID NO: 22088 - protein, 193 aa, Pseudomonas aeruginosa
NARRQALCSGPFQHSLDCDVTAPSTQPAVRRPAPAGRRCPARQLPAELATRRSRSRAPALPGRRAGAEAGAGPEGDDLEHPVPGRQTLRLLGRPAGCHRPGPAPHRRRPGVHPRRGGPGDPRRAAGPGPAPGDRRRLQRHRRSGPTGADPGAHQRSLPLQRPGLRVEVGLRADAAHLRQRRPQAGHPEPLSHR

SEQ ID NO: 22089 - protein, 196 aa, Pseudomonas aeruginosa
GWRHAVARFTTAAPAGHAQTSRFPRLRPGRRFSNQWIFRPMMLGVSTLQILLHLYIGASPEVRQILSNLHGPTSRRQKMQNQRLPALGYAWCFCQAKQLLQPHREDRWMLRVIDADIRTRRHLNRLRRLDFQLLRKRPRQKVPDYRRQIQLAEVTEPRDFTQVRREPLFQRVEEVGIAEIRPLTFCLATLDIELTQ

SEQ ID NO: 22090 - protein, 230 aa, Pseudomonas aeruginosa
WRLVEPGHLFWLHSPPGQLECQSCEIRLQDLWGAVAGHLLVLRFRPQAIADTWLQAPCPPRTLGSTGLRDTLSVESGHATARIELRHSLQTTVHHDPDAFDGQAGLGDVRGQYDLPGALGCGVNSSTLGVQIEVTVQRAYDHLWTAAQLLLEVFCHPPNLCLPRKENQNASRLFIDGGQAGVCDSRIDSLARLIGATPNRRDRKHPPFTGDHRSVIQHLGKASTFQRCGH

SEQ ID NO: 22091 - protein, 302 aa, Pseudomonas aeruginosa
QKRPMSPDSPHARLLRLATLASLGVAVTLVIGKAIAWWLSGSVSLLAGLTDSLLDSAASLLNLLAVHYSLRPADDDHRYGHGKAEALAGLAQAMFIGASAVLVAIQAVEQLRDPQPLGAATWGIAVMLLSLLLTALLLAFQTHVIRRTGSTAIRADSLHYRSDLLLNASILVALLLARYGWPQSDGLFGLGIALYILWSALQIARESVSILMDRELPTDISERMRELACSVPGVLGAHDVRTRISGNHWFVQLHLELPGELSLSVAHALTDRAVLAIKREYPKAEVLIHADPQEVVGKETVS

SEQ ID NO: 22092 - protein, 135 aa, Pseudomonas aeruginosa
NKGVAMNAADRVMQSYGRCCASTGFFDDFYRHFLASSPQIRAKFATTDMTAQKHLLRAGIMNLVMYARGMSDSKLRALGASHSRAALDIRPELYDLWLDALLMAVAEHDRDCDAETRDAWRDVMGRGIAVIKSYY

SEQ ID NO: 22093 - protein, 162 aa, Pseudomonas aeruginosa
SFRARWTTPLSSVQPRRHFPPFPEAQAVQAPGADPHPHQPQRRQAHRRRHPPHLAIAPLADHQFQPVGRHRLAKTHRRHPLPQRRLIQQTRLGGQRRAVVERHTLAQAPQLLLVRRAFDLHPVGLRQLVPGVGDARLQATVVGQQQQALAVAVQAPGRIHAR

SEQ ID NO: 22094 - protein, 367 aa, Pseudomonas aeruginosa
PQEHPLMPSLRPTWLISLLTLAGCAGSAYQGPPSDHFDGERFRNIQPTAHKSLRDLLKWQWNRPPQRPWVALPPTATPPRVNERARGEELRVTYINHATLLIQHRGLNILTDPVWSQRVSPLAFIGPKRHHPPGLTLDQLPPIDLVLVSHNHYDHLDLETLRQLHRRWPTAKVVSGLGNAGLIRQTGFADVVEIDWWQAVPLGAGLTLHGVPVQHWSSRTRSDTNRTLWLGFVIDSPDGPLLFPGDTGLGPEFGLIHQRFGAMRFAALPIGAYEPRWFMRDHHMNPDDAVQAHRTLQAQTSMAIHFGTFNLTDEQQDDPPKALQAALRSQGVDPATFGTPKPGEQWRVAPRNVAQEAEATRREQQLR

SEQ ID NO: 22095 - protein, 645 aa, Pseudomonas aeruginosa
RGCACIATRLRPVRGGASQQRLDLDAAREGAVDPPAVPQATADEGVGHRGVAGFQQQLGLQGDRHVLGELAGAVLDVGGVGEARLEVADVRGETGVAMAVAQFGEQRVEHPRLLRQGTQHVQALHVAGTFPDRVHRGLAVQPRQDGFLDVAGTAHAFGGFVDHRRGTLADPVLAHRGDQAGELLLLLVVATVQGMPHAQGQGQRRLAFQGQVGEHVLHQRLLGQHPPADLAVGTVVGGLGQRLTHQCAGADHAVEAGHGDHLDDGRHATALFADHPGQGAAILDFAGGVRPVAQLVLQALDVELVAAAVRPVARQQKAGQALVGVGQGEEGVAHRRRAEPLVPDQFVGLPRPGNPHRVGPRGIGPDVGAALLLGHRHADGDARLLLHRHVARVVLAGEDLRQPFLGQVRLQANRRHAGVGHGQRATGAGLRLAVQVGQPGPRHLGAGARVGPGQRGQFVLDGGAHQLVVGGMELHQVDAVAVAVVAMELRLVLVGQEAGRHQRAAGQLTVALQALLGPAALVATHPLLERQIEAVEVGAIQRRYLVGHFVGFGVLVQVHEGSSQTGAPTARRQKFTRAVLTGSRLGSGWPLSRAARAGGDKGPTSASAMAPTRQAAASGTRESWNAPLRRPSSSSSTNSAAYASR

SEQ ID NO: 22096 - protein, 305 aa, Pseudomonas aeruginosa
SPADTATKAKCTIACTAATAAAAPSPASACPAATMAPAAPWPAPWPVASPSAKRCTAPCRAPSTTPGGPCATPRVRATANTCRAACPPTSVTESQPMKLRGLYAITDSQLLDDGRLLPYVEAALRGGARLLQYRDKSSDQARRLREAESLRELCERHGAQLIVNDDAELAARLGVGLHLGQTDGSLSAARALLGRQAIIGATCHAQLELAEQAVAEGASYVAFGRFFNSSTKPGAPAASVELLDQARPRLHLPITAIGGISLDTAPGLIARGVDLVAVIHALFAAASAAEVERRARAFSALFEPA

SEQ ID NO: 22097 - protein, 398 aa, Pseudomonas aeruginosa
RASHVPFRNAVQQRPETHSRRGQLPGARLQERRRHPAVLQARRRRLCTGRGRQALRGLCRLLGPDDPRPQPSGRARRGAPATRPRPVLWRADRAGSGNGRPGLLHGAVDGDGAHGQLRHRGDHERHPPGPRLHRARQHHQVRRLLPRSLRQPAGEGRLRRPDLRRAELPGRSGGLRQAHPDPAVQRHRGGAQDPGRSRQGGRLHHRRAGCRQHELCAAGAGLPRRPARSLRRTRRGADLRRSDDRLPCRPRRRPGLLRGHPGPVDLRQDHRRRHAGGRLRRQARDHAADFPAGPGLPGRHALGQPAGNGRRPDHHAPDQPPRFPRRTDRLHHAHARRPATARGCRRHPLRHHPGGRHVRPVLQRRRRHRHLRGRDGQRRRTLQALLPPDARRWRVPCA

SEQ ID NO: 22098 - protein, 213 aa, Pseudomonas aeruginosa
GGVGLFHNVRVSAFRWPGSPCPPRSRRCLPLMFRTGRTLALGCLLILQPLLAQAGGNSLLIPATGRCALNTVPEELQQALAACQQVANGGDAEAQYELGEFFYDGERIPRDLQAALNWFEKASLQGHAQAQYHLGTMFFRGEGVPANNVQAYIVLKMAAVNGAEDALDSADLVAEQMNRDELDIATRVLGQIFRNYLIELQTAGGVTPFAPLP

SEQ ID NO: 22099 - protein, 215 aa, Pseudomonas aeruginosa
SRSCRTSPASASPTSSPRMWSATRWCSVSSKPTSVTRAASKARCGRSRERARAVTMPLELDLQVASAAPDLPSEAQFRAWCELALRQRPESELTIRLVDEAEGLELNSTYRHKDYATNVLSFPADVPDELLDIPLLGDLVICAPVVAREALEQRKPLQAHWAHLVIHGCLHLLGYDHIDDAEAEEMETLERELLAELGHPDPYACDDEEPPSKEK

SEQ ID NO: 22100 - protein, 378 aa, Pseudomonas aeruginosa
  UNSURE (377): Identity of amino acid at the above locations are unknown.
PVAGTAGRAGAGGWRMAVLLRHRPQRGPAGEPAAPLPARCQPASGAGPAARPVGGRPLSQGPRLDPFGRRTAEGSGDPGQHRPGAEMGPESGPRATRPLPRPEPAAAGRRPDRLAGNRGADSPGHGQRLPRRHGPGRRREERRADHRGPGARTSRRRQESLLQRHHRGRRRRGHLPQAEAGAVRRVRAAAGPAARPDRLLRPADVRLRSRPGRPAAAQGQGLRDRPVHLLRSGLPGVRCRARGAEPGVADSEQRHLVRHFHRPVAAPADGADARPGKRSLDDPRDQQRRHRSDRSLWPNRPADPAVPAGHPARRGDSHAGPDALSAIPRLAAGRVGRRAAAMGSARPPVASAGATPVRLKPAPPGKTGAPAAPVASXR

SEQ ID NO: 22101 - protein, 346 aa, Pseudomonas aeruginosa
RHARAISATRDRNPGPELLERTPVLPRQGATRQGEVLLPVDVPVSERQAAHGPRAQLHHRRRDQPLPPHAGPQRAAADGLGRVRHAGGKRRDEEQRRPGGLDLRQHRLHEVAAGQPRPGDRLEPRGHHLQAGLLPLGAVAVHPPVRKRGDLPQERHGQLGSGRPDRTRQRAGDRRARLALRRADREARDPDVLLQDHRLRRGTAGEPRQPARLAGAGEDHAAQLDRQVARDGDRLPLRPGLHRPRRPTEGVHHPSGHPDGRHLRRRRRRTPAGHPGSAERPAVAGVHRRMQARRRRRGRHRHPGEERHGHFPVRRTPADRRQAAGMGRQLRADELRRRRGDGGARP

SEQ ID NO: 22102 - protein, 284 aa, Pseudomonas aeruginosa
RQGQGRRRAPEERRPAGRDRRHREDVEVEEQRRRPAIDDRPVRCRYLPPVHDVRLAAGHEPGVVGRRRRGRQPLPPPRLAPGSRPRQRRPPRRAGRRRPERRAEAGPPRHPPGDQAGQPGCRPAPQVQHRHRRGDDPDERAGEGAEPGRPGPRPDPGRPGNRGSAAGAHHSAHLPRALGPARPCRSGDRCALAERRRERTGAGHPATGGAGQRQAARTHRRGRQRQPRGCRGRRARQRERAAFHRRPEHPQGHRGTGQTGQHRRQLIRDSIGRPRPSGGADQQE

SEQ ID NO: 22103 - protein, 224 aa, Pseudomonas aeruginosa
GKLDETYPDQRRADRYDHPAGRLRLPTARPGRCAIRAQGNRRVRAQRLRPDRARTEGNPGKQRREGHQQRALPPGAGPRGQPAAHRQLHRFRARRGVRADQHDQLRDRRRQRPGPDEQPGTGAEGLRARRKQPDRFRPGSRAAAQRDAARPDPAVVHAPPGADPGATRRSPAPGRSQGQGGSRSPARRRRGGAPAPRRRAAAVADRVPHPVMPRGRFRRPRLLL

SEQ ID NO: 22104 - protein, 66 aa, Pseudomonas aeruginosa
CARWRAPARSPSRTYAMAKKSKRPNKAKSLVAQPLFRSRQEQAKKGKGSYRREASRNWEASFVMAA

SEQ ID NO: 22105 - protein, 106 aa, Pseudomonas aeruginosa
KPPAGSPDNPGVSKSACRQASTIPWRNSPSASPWANGKGWAYKASTAAPCPPDSPANRPRCCCRPGTAARPSWCCTTSAPSSSTTTPAPTPWPSACSPTASRAAAG

SEQ ID NO: 22106 - protein, 414 aa, Pseudomonas aeruginosa
AARSASSCNGNWPPADTIRARWMASSAPIRARRSAPASRSSAGRRTAIRPRRCSTACGRHRATGGAYDPTSAATARGTPVRRADNAMGVIRRCGVQDLVIRAEPQDSVRHLGGRLALRKMADALQHQPLVAPAEVVLASAGAVGVGAGIRAAVQHQGRQRQARCREQALFRRPVARLPRDEAPAMPVIVQHHGDPVRPGEGLGGLLEIALGIPSRRRPGVPHLPGECLALLAQRALSAWRSHEPLVPEATGLRQGKNLLRIVAGVPHREHHQVRGYALAQSAGTSHRASPPVMADQQGTLQCQAVDECQQIASQSRQLPAARSRRIAEPGRGESPEGWCQHPIAGVRQGLRQVFPGMRAVRPTVQQDGAARPLRIPLQVGDIQDIGGNEGIAAHRTSPRERRDILGRLPRVIHE

SEQ ID NO: 22107 - protein, 360 aa, Pseudomonas aeruginosa
KTPRPCAGTRRRKALARRRSADLVAVRLLVGMVGRTHQRAGRDVLEAHLLAFLGEPGEGVRMHETLHRQVVARRLQVLAEGQHVDVVLAHPLHDLDDLVVGLAQAEHQPGLGRYVRNHLLELLQQVQRPLEVRARPRGAVQARHRLQVVVEHVRRLVGGDLQGDVHATAIVRHQGFQLDPRRQLADLAQAVGEVLGAAVAQIVAVHRGDHHVLQPQVGDGDGQVGRLVDVQRLRPAMTDVAERAASGADIAHDHEGRGAAGEALAQVRAGRLFADAVQLVLAQQLLDAVDLGGNRDAHADPVGFLRQFLGGNDLHRNPRDLFRAAQLHADFHLARLGFSGLLHNSAHVSSIPPVRVFCSA

SEQ ID NO: 22108 - protein, 391 aa, Pseudomonas aeruginosa
QQGNQRSSAITNERQRYPHHRQQPAHHTDIHEDINEKRHGDATGQQFAVERLRLGGDHQATTDQQQVEHQQQADADQAELLAEDRNDKVGVAFRQKIQVRLGAQQPALAEYPAGTDGRLRLDDVPAGAQRVAFRVEEGQHPLFLVVVHDEEPHRHGDRHRRRHRADDPAPAQAADEQHEAAGSEDQHGGAEVGLFQDQHERGDDDRQADHHVLEPRRQVALGQVPGHRHRHQQLHELRGLEADHPGDVDPARRPLGVVADHVDHHQQRDPHQVAQRHPAGHEARLDLGDDHHHAQSQAERGGLLHQHVPALAARRIEDEQAGGAEDQQQQQENPVDVQALQQAGAPAHHVFVGQGAVEVTVQGRAPPARLPWVRAWPPPPRAARRVPRIRP

SEQ ID NO: 22109 - protein, 324 aa, Pseudomonas aeruginosa
QEILDVQSETELRAPVDRRDEAVYPAAEDGGEGRFGESMAEPDVPGVMGAGRDVGTVDTLSFNHDSGSCCYHSPAYDCHGPSDNPMSRDPILSLPWPDARPLPDTFFDRDALLVARELLGKVIRHRQGNLWLAARIIETEAYYLEEKGSHASLGYTEKRKALFLDGGHIYMYYARGGDSLNFSAGGPGNAVLIKSGHPWLDRISDHTALERMQSLNPDSQGRPREIGRLCAGQTLLCKAMGLKVPEWDAQRFDPQRLFVDDVGERPSQVIQAARLGIPKGRDEHLPYRFVDATFAAFCTRNPLRRGQVAGRDYHLLGHQDPHLQ

SEQ ID NO: 22110 - protein, 518 aa, Pseudomonas aeruginosa
PPASPAGAWPDSARWPGCAAGARDRYASASLFAGRPLLRLARRTRAEARCLAHRLDRRRAAVEPTAQVDLAGLADALRGLGFLRLLRFLQHHAARCGLRHPVLRLEVGLLAALQGLPDQCFDRRQQLHFVGADQRHRLAGGTGTAGTADAMHVVLGDDRQVEVDHQRHFLDIQATRGHVGGYQQVYLAGLEPLQGAQPRRLRLVAMDRVGGDTLPLQQSDQFLDALAGLGEDQRLAPAIGLQQVAEQLGLALLVHRHQPLPDALRRGIARTDLDGQRVAQQFTGQRADGVGEGRGKQQGLALARQRGEQFVQLAGETEVEHAIGFVQHQRLELGELHRVLPIQVEQPPGSGDEDIHSLAQLHHLRVDADPTVGHRGTQRQVLAVVADAAVDLLGQFAGRNQDQCTHRVRSDLRPLQGQPLQQRQGETGGLAGAGLCCGEQVAALERRGYGLGLDRRRRAVAEPFEGLEQGGEQTEGSERHERLGKKETDGILADSPSPIVLWSAAGQPLSSSPPSIGT

SEQ ID NO: 22111 - protein, 215 aa, Pseudomonas aeruginosa
RCPALRTVPGRPADRRPATRHAAPRPAAAQQSRRRGAHRRTACRLARRRLAGGARPARIPAARLALRARPAWRGVPASAGAARRRGGVREERSRRLHQQRPATLAPCPRHPPGGARRGSHGELGGSQRTQRRQPRLPDLGSGRRLLHLRQARFPRHPAQRRRGACDGVGQPARRVRRGSARRRTVAALAGLTVCRATAGQQGCPAEDRPVPPYPP

SEQ ID NO: 22112 - protein, 387 aa, Pseudomonas aeruginosa
PAPPWGGRPGWLNTLRGMRYPPARKNANPCVNSTCKDEMRGGKLYALVLSSIVSIAMSLPRLRNLLFVGLLLLVGGALLASYLLSWQPADREAAPLHCQGAAPALKPGQALKVMTWNIQYLAGKRYVFWDDLPDATGPDQRPTAEDLAFTLDEVVRVIRDEQPDLVLLQEIDDGSSATDDQDQLALIQERINDLYHCSAQAYEWKSAFVPTPHIFGSVGRKQATLSRYRIDSAERRQLPPRDGGLFDRLFGPRPAILVSHLPIDGGGELAVLNARFDRPQANDDTLERQVETTRTLLDELQARRTPWLLGGDLNLLPPGQYPYLLAPLRAPYREDSELGILSGRFPMVPSLEEASGVDQVRWYTHFPNDPRVQGPDRTSTTCSTAPR

SEQ ID NO: 22113 - protein, 447 aa, Pseudomonas aeruginosa
PVSMPGSGAAIRCRSPTTCRSPRASCCPIDRARAGLDKRPGAPHASPPFITTKNGKAAHHAPTHHNAPARAAGVRPAGRPAAPCAGRKAVVERRLLRIPPLHLYRPGWPRRRFRRPPGPPAAGAGRLSSGVPRPAQRAPVPGAAGWQRGAVGRRGQAGAGRRHPPGAARARPRQPEPVLPGAPAGTAGSPGPGRTPADPDQRLQLLETGHRLHPGPQPAPAPVPHRHPPRRLAHARTRARRLPARLPGAGGSGQPPGVGKPGTVPPAAADDRLAPHSRRRSAARPPGPGLRPVAERRRRPVPAVNRPRRRSPMHTAIPCCTINGEQPALRGQVCQSLLIQEWWWEGRPADPVNVVYLQFEQRWYRLYFEGETVFWRSGEAPRPCENDEGPGEYRLHDLGRQRGLVGVRLLALEFVLNGPTLDSHFDFADGQRLSFRHFLDDDLTRVL

SEQ ID NO: 22114 - protein, 170 aa, Pseudomonas aeruginosa
IHDQDYPRPSPKPFCEGFWLAPPGDGSREPNPGCAWFWPCGLPSSGDVVHRREVDASARQRPHSKRSPPLHPKWAGKREIAARQRSLEIETLVTWQNKGVEMNLQLELMNKNISMLQTEIKYLQIKMQESRHVGDQEKHSQMLEQQNNAAYYLEHATKTKTKIIMNIHKS

SEQ ID NO: 22115 - protein, 471 aa, Pseudomonas aeruginosa
TLPGEQAIGNQSVDSFGGTAMSDFSPLSIFKSQAKQHARKHGMKLSAAQEALSRRAGFEKYHELAVVAQRNPTDPRLMLAAFGVRDFKDAIHEDDVFSRLGHMLTGSMAKANASEFSIGESEVESATYDHATGVLALSMSITYQKHQDLDRAFHSSAFLLKADVELIRRDGKWSLGEDGVSITSNDSDRAAHWHVLVTNEAKNMYQKDHSPHEKPIEKLSEDGKRIKNPNEITVNQHVIPQAHLKQWLGGEDLLTVVDKSSGKPLKRSPKNSFVVSRLWDQPTEQGMIKMNEDNYQQQLTLLAETGSIAQSPWITEYFVMLAARAYFAAKERPLYDSIMEPPSWAPSQAELEDDEVEQVHDTVRIFRGAGNPHATARTVVSMALTQFFIRARELLKDAVWVPFKTTGEKFILPDSNVALYEKRFMALPVSPELVLLDEKLLAKLQEAGQLTPEYLNKRFLESSVRYYVAPK

SEQ ID NO: 22116 - protein, 60 aa, Pseudomonas aeruginosa
AKPTLKRKRSALGVRMEARKGGDTQWLDSRQPLPQGTPKPQGFLGFALAVASATNGSSGQ

SEQ ID NO: 22117 - protein, 82 aa, Pseudomonas aeruginosa
ACSPASPTPCWTVPPRCSTCWRCTIRCARPTTTTATATARPRPWPAWPRPCSSVPARCWWLSRRSSNCATRSPSARPPGASR

SEQ ID NO: 22118 - protein, 140 aa, Pseudomonas aeruginosa
IPTTRCRPIARCRRRPAWPSTSVPSISPTNSRTTRPRRSRRRCAAKAWTRRPSARRNPASSGASHRATSLRRPRPPGGSSSCGSACRCRTDKPGRHGRPGPASFPGARPSRPGARGPHRPGRRGPVGAAGRGSLPAGHRG

SEQ ID NO: 22119 - protein, 702 aa, Pseudomonas aeruginosa
  UNSURE (626): Identity of amino acid at the above locations are unknown.
KRAAVSARKPRRVRSTERRLVETPQLARVQRVELAAQQVEGGDADPQVLVHRALVEGVGRAGQLDLAVQRLVRDAQQRAVGHPQAVALGGDGAALHVHRDGPRQVDQWPLLGPAQLPVAVVVGEHGAGAQASLERLAALAGDFGGGFLQGDLDFGQRRDRDVRRQRAVEDAVAAHVGVRQYVVADGLRLPQAAAVADHQPAMRTQHRQVVGDVLRVGRADPDVDQGDTVAIGGDQVVGRHLVAVPDHPGDDGVGLAFVHPAFDDHVARQDHAHEARVLAQAGQAEADELVDVAVVVGQQDPRLHVAPVAAGVVHQAAQGEVHPRGVEQRQRQLVGAFPFVEAVGDVVGSGGQVGAGEHPRQLGGGHPGAGQLVALLDHVGIGDVLLARADLHLHGEIVHQRTQLFQQVLAEGVGVGDGDAVFARHLDLGVGAGGGRHLALAAVADAQLRVVEVLPLGLAWLDALLDVALERLAQRRGGLAVQLGKTVDGLLGRAGDDEPVVGIDTHGGLPVGSHGKHLACTDRKTQRFSPVISFGQRHHRHGHGGLAEQVPPTVPLGEHLGLDHRHLAPGLEHLGATQQALAKRRAQQVELELQGQHRLPLLHQGRGGGPGGMVRHGLLDPGMDEXFLLGVAGPGCPAPLRPNPARSPADGCRGRRRNWPRRSPARPAPGSADAPASRRASGQCGVARANSASTSTPRGRVP

SEQ ID NO: 22120 - protein, 233 aa, Pseudomonas aeruginosa
RLAPSSDGTWLVTSWVSAYWCRFMRVPRRQARPPRAGRSSPEPYSPAPDSVPAGRCRERRAPGETRGRPAPRRWPRPGRPRQAAPGKAGMRHCAGPPRAVRRTVRRMPRDSAGAARRLQDPPARRSGRRPAAGCSRRARQSAASPRPGARRARRDRAGPRPGHRPHAGWRGGRFPPPARPCPGSGGTGCRWQSPRRRPGPAWSARRNRPPRHAAGLAGGCARAARNRVAGGVR

SEQ ID NO: 22121 - protein, 339 aa, Pseudomonas aeruginosa
CPAVLLERTGSPTSLVMVRPWRALYEYSPKFSTRQSTSGPGRVTQGPGAAPERWSAQPPRSAFSGKLTRHENTDFPPRSALPVRSRPQWWRRTASRHRSPARPGLPRRPGGHRADRAGHRQRQRLPRPRPRVGAGPGQRRTRRPARRGGQAGYARFAGDGRHGGRDPRRPPALAGGLRSGAARRRRRCVGQGRRRLRHARAAAAARHHRHAEPAGSAPARRPARGQRRPVRRAPAGTLRAPVDHRRTRRRKRSAQSPVQPRRQPPHLHLPAPARQLPWLRLHPGQRPGRSHRPRRSAARRRAERPRLHLADPARRRESGPRPIRAAPPAHRLLSLRASR

SEQ ID NO: 22122 - protein, 487 aa, Pseudomonas aeruginosa
SMRCSPPRPPPRWNAAPAPSAPCSNLPDASAPRPRDRELAMSRSETLFNNAQKHIPGGVNSPVRAFKSVGGTPLFFKHAEGAYVLDEDDKRYVDYVGSWGPMILGHSHPDVLDAVRRQLDHGLSYGAPTALEVEMADLVCSMVPSMEMVRMVSSGTEATMSAIRLARGYTGRDSIIKFEGCYHGHSDSLLVKAGSGALTFGVPNSPGVPAAFAKHTLTLPFNDIEAVRKTLGEVGKEVACIIVEPVAGNMNCVPPAPGFLEGLREACDEHGVVLIFDEVMTGFRVALGGAQAYYGVTPDLSTFGKIIGGGMPVGAFGGKREIMQQISPLGPVYQAGTLSGNPLAMAAGLTTMRLISRPGFHDELTAYTTRMLDGLQQRADAAGIPFVTTQAGGMFGLYFSGADAIVTFEDVMASDVERFKRFFHLMLDGGVYLAPSAFEAGFTSIAHGDKELEITLNAAEKSLRRAEMILFAAPFPGAALLPAGTPS

SEQ ID NO: 22123 - protein, 421 aa, Pseudomonas aeruginosa
TFPPPRCTNVSAGTGKAPPRYGNFARRYPAVILFSINQPLASTTEHLERPPGTSSLYPRAVRRPQLRDTLRAVRRASPPDRETPRHRDPQPRQPVRTGRRTAPDQGCRTPAAASLPRGAERHRSHSRHRAPVPAGVRPGRPRGIAERAAGHPEIAQGAHPPARRQPAALRQGDPRPRHQLRHRPGRHRQDLSRRGLRRRRPGARADPPHPAGAPGGRGRREARFPSRRPVAEDRPLPAPALRRALRDARLRTRGQADRAQRHRGRAAGLHARAHAEQQLHHPRREPEHHSRADEDVPHPDRLRLHRGDHRRRHPGRPAPRHPLRPQARDRGPAGRPRHQLHPLQAQGCGPPPAGAAYRRSLRASREPPARPGAAGRGNGQGRSRCRLSSTCRSLAPPRTCPPKRSSAPGANWPCASVRSRS

SEQ ID NO: 22124 - protein, 514 aa, Pseudomonas aeruginosa
GHSMRWISRPGWPGHLLALAAGALTPLALAPFDYWPLAILSIALLYLGLRGLPGKSALWRGWWYGFGAFGAGTSWIYVSIHDYGAASVPLASLLMLGFTAGVAFFFALPAWLWARCLRRDNAPLGDALAFAALWLALELFRSWFLTGFPWLYAGYSQLQGPLAGLVPVGGVWLSSFVIALSAALLVNLPRLFPHGASLLLGLVLLLGPWAAGLYLKGHAWTHSAGEPLRVVAIQGNIAQELKWDPNQVRAQLDLYRDLSLPQQDVDLIVWPETAVPILQDMASGYLGAMGQVADEKNAALITGVPVRERLADGKSRYFNGITVVGEGAGTYLKQKLVPFGEYVPLQDLLRGLIAFFDLPMSDFARGPADQPLLKAKGYEIAPYICYEVVYPEFAAALAAQSQVLLTVSNDTWFGTSIGPLQHLQMAQMRALESGRWMIRATNNGVTGLIDPYGRIVRQIPQFQQGILRGEVIPMQGLTPYLQYRVWPLAGLAGVLLLWALLGRQLRPQERRLFG

SEQ ID NO: 22125 - protein, 145 aa, Pseudomonas aeruginosa
  UNSURE (18): Identity of amino acid at the above locations are unknown.
NQPLLERPAPLRRRLRLXGRTGDSRPGRSPRSAACRSARRPALPAASRRRAAGWPRRGNRPAPGSPRTPGARSSSVPAACARPGSPAPPGARRPPRNCGGAQGGVFPGGTAENFLPARRHPQILHQGIGHQRRLAGRGSVMPTRR

SEQ ID NO: 22126 - protein, 187 aa, Pseudomonas aeruginosa
RNNGSASPPPCRKRQSKGLRDAWRNFREGDPSGRCPNGTVASRNGRTATRHAPCSTAPAHRRAHRAVAAVSTRRADGAPAVAAGVSCRAGARAAPAPRRPHASRATSAGPGRDRRVSAPSPLRSNHATRAPWDARHAGARPYPLHPEPGRDAAAASRTAHLPSHSRVAAQPSNTSEGTTGQPAIDGP

SEQ ID NO: 22127 - protein, 913 aa, Pseudomonas aeruginosa
GKLSVPVRLNRPRRQTARAIDRSGGHVCYEAFEQSRLSSAMHEQYQPLEIETQAQNYWKEHQSFLVRELPDKEKFYCLSMFPYPSGKLHMGHVRNYTIGDVISRYHRMQGRNVLQPMGWDAFGMPAENAAMKNNVAPAAWTYDNIAYMKSQLDSLGLAIDWSREVTTCKPDYYRWEQWLFTRLFEKGVIYRKNGTVNWDPVDQTVLANEQVIDGRGWRSGALIEKREIPMYYFKITAYAEELLESLDNLPGWPEQVKTMQRNWIGKSRGMEIGFPYDQASIGHAGQLKVFTTRPDTLMGATYVAVAAEHPLATQAAQNDPQLQAFIDECKRGGVAEADIATQEKKGMATSLFVEHPLTGDKLPVWVANYVLMNYGEGAVMAVPGHDERDFEFANKYGLPIRQVIAKVEGDNDFESSVWKEWYGAKDESVLTVNSGKYDNLGYQAAFDAIGADLEAKGLGQARTQFRLRDWGISRQRYWGCPIPIIHCEACGDVPVPADQLPVVLPEDVVPDGSGSPLAKMPEFYECNCPKCGQPAKRETDTMDTFVESSWYFARYACPQFEGGMLDRKAADYWLPVDQYIGGIEHAILHLLYARFFHKLMRDEGLVGSDEPFKNLLTQGMVVADTYYRTTANGGKDWFNPADVEVERDAKAKVVGARLKSDGQPVEIGGTEKMSKSKNNGVDPQSMIDQYGADTCRLFMMFASPPDMSLEWSDAGVEGANRFLRRVWRLAHAHVSAGLPGALDVAALSDAQKQVRRAIHLAIRQASQDVGQHHKFNTAIAAVMTLMNVLEKAPNQDAQDRALIQEGLETVVLLLAPITPHICHVLWGQLGHAEAVIDARWPSVDESALVQDTLQLVVQVNGKLRGHIDVAASASREDVEAAARANENVLRFTEGLSIRKVIVVPGKLVNIVAN

SEQ ID NO: 22128 - protein, 229 aa, Pseudomonas aeruginosa
YAIPLDAPGHPGALINRSEGSLMKRILTSAALIGMTTLLAACGFQLRGLGDAQFALKEIDVSARNAYGPTVRELKETLENSGVKVTSNAPYHLVLVREDNQQRTVSYTGSARGAEFELTNTINYEIVGANDLVLMSNQVQVQKVYVHDENNLIGSDQEAAQLRSEMRRDLIQQLSMRLQALTPAQLDEAQRQAEAKAKAEAEALRAADEAERQRRAAEPQQSPIEFPTP

SEQ ID NO: 22129 - protein, 199 aa, Pseudomonas aeruginosa
TAALPGSLRCHSPGLPRARLRRAPGIQCRSQLRLGLAAGGRRQPVAVRREAPDRTAPALRQARRQRRGDSPGIPATAAGRHRAPAQSAQARWQHAEDQVGQGPDRWQRRAVHPGLAGRRPPVAAVDSPAPVPGRPVRQPRSPGADRRARGRQPARRRPGNRKAQAARRGQPDRRRHRTGRGRRQRTLRCLRPDRRCPWR

SEQ ID NO: 22130 - protein, 136 aa, Pseudomonas aeruginosa
DERTSGPDATFLKPIFSPSSANQAKVSGCTKRCTGRWLRDGCRYWPRVSMSMSCSRIRCMTSMTSSSVSPRPSISPDLVGTCGTICLNFCSRSSDHSKSEPGREERYRRGTVSRLWLNTSGGSLAVISRAMSMRPR

SEQ ID NO: 22131 - protein, 628 aa, Pseudomonas aeruginosa
VDLHRQHGGRMLRRRRSVGLDRLGHRHRLRLRRGGSGLGHRLLGLRQDHRCRPAALGPPLHRVDAFDLDPRGAGLGITELLRRGEGQVDDPVGIERAAVVDADDHALAVVQVGHPHIARQRQGLVRGGHAVEVVGLAVGGGLAVELGAVPGRGADHPVGPRIVHRVVGLAQHGVGVGLHRTVVRHRYRIGDPRHVDVPPGGAVAMRTGIVAPPGNARLAWPAAGAPCWSNCSTARPPARRRQTAGRIREERDTLAQWAPGARGISPRQLINRHGIHGAAIIAGDHVEVRQTDPILDALVADETHRRDLLVVAQRIVGAPAAGTQLAQAHGRVDAPGHRALGALVVDLGHRDHRLAGDPAVLLEVAGDATDGVGRVAPDIDVAIAVEVHRVGAEAARHELWQAHGAGVGAGQAERVDLLFAGEQEELAQLLAEEVGPRRVVEAEGGQRVHHPVTAGVAAEEGFHADDRDDDLGRHAVFLLRPHQVFGMLVPEVDATTDARVADEDRPVFLPLLDPLGRARDRIEDRLLAVHVAEQPHQLLSGEAVVAGHFADELGHLRRAVVVPRLGRPGQANDAGYADPLDAPGRPCTQYLHCVLHSWSQTWAIHFRWVWIDIRTPNPDNRVTSEVPP

SEQ ID NO: 22132 - protein, 906 aa, Pseudomonas aeruginosa
RTNRPVAPRISNSSRRIPSMCRRCNRLARRRITSSLDRVRSKLLFKGGRLRLGCRGFGLGHRRRERRDGFRVFGLELAVLVEQPGVHHLLDHRGGDAGAGLAVLHHHRHRDLRVVGRREADEQGVVAVPLEQLGAVVALVLLDRHHLGGTALAGDQVGRGGADLARRAAGAMHHLLHAVVDAVPVGRVAQHDVGHRVGVDRRLAVDGLGQVRADPVALVGQQRGHLRQLDRRRLHVALADAEDQGLARVPDLAAGLALPFARGHQPVGFAEHVQGDFLAEAEAAHEGVQAVDPQLVREVVEIGVVGPVDRRLQAHPAIAVAVPVTVLVVVVGQLVVAGVEDPRGRRDHPGVEAGQRHRRLHRRARRIEPAQDAVVQRPVDGVTQLGIGLEADAGDEQVGVVARLADHRQHVAGGRLDRHDGAPPPGQGVLGGLLQAAVDAQDDVLAGNRVGALEHPQHPPAGVGLDFLVANRAVQLALVEALDAGLADMVGAAVVDRVEVLQFLLVDPPDVPDRMGEVLLQRVVADELGRHVDARQAEGVHRDAGDLFPLEFEHDGNRLERTPPWLPAPLQKGPVVPGQGEDLHQRVEGLLQVLSAFAGDGQAEARPVVGDDHAVAVEDDPAGRRDRLHMDPVVLRQRRMVLVLGHLQVVHARHQHQGQQDHRHRPDDDAPTHQAGVFLVVFQVDRLRHRDWGLFVVGVPGQHGPGPVDLLADQDPHQRVRQRQRRQRPALLAARADLRRQPFRAADHEIHGACVETPAIQFASQLLGAPGPTFDLQGHHPFPRLHARQHGLAFLTDQARHVGVLAAGVERDLHQFEGQLGRQALDVFLPAFLDPARHARANRDQAQPHAGVTLPAGAGRGSARRPATGAPGRRTGGSPGASRGPPRRPGRAAPIRRTPGLRCPGA

SEQ ID NO: 22133 - protein, 134 aa, Pseudomonas aeruginosa
DGLSRCSSRGSTVNRSTPATARSTIANRCAADTCGVSRCGGRALGSRRSSSRANCSAISTALRICPICTGSKVPPNRPIRLPIRCARDRRRRRRTSRWSGLPGRPGRGRAACRWKSRSRRRGRTRSRRRSGSRR

SEQ ID NO: 22134 - protein, 184 aa, Pseudomonas aeruginosa
SRPRPAARASCRSGCPRAHSACRGSRRSGRAAWRPGAGPRSCRRCAPGSAPGGPASPAPGHWRGRRRGPARWRGTTPRGRRPAHRPRPAGRGSSARWRRARATARRRGHRGQGGSYSRGRTRSWSRHLASGKCAIIASQPRRAQPQQPVGRQCVPSPPAVTRQPRCAWGCARDGDTWAQAPAEG

SEQ ID NO: 22135 - protein, 247 aa, Pseudomonas aeruginosa
VNKIATSVYLRGEPGHCHPPAPARQNNNNDAHTAGPRHALPYRLQRAVAEQRTGYPLPRRLATALPGLRRPRRRPAPAGAPAGRRLPELPLIHRRGQRTARRAPGDPARPAEPGRQPATGGGTEPGRPRRPDRGLRRTARPAAVDAHRPVLRLGPGRAVRRPPSAPLRAPATGRHHRIRPPRCAAAAGRSPGPARRGRPERLRPRRTDRPDQPATAGTYRRLPGISQGHAAPVATPDRGGDRTLPAE

SEQ ID NO: 22136 - protein, 218 aa, Pseudomonas aeruginosa
SSATIGRSKLTTSGISSISRPRAATSVATSRSTSPALNRCKARSRAGCGLSPWIESAAIPCRCNSPTSSSTLLRVLAKTSAWRQRLACNRWQNSSALRFLSTGTSHCLTLFAAVLRGLTSMDSGSRSSSRASVRMASEKVAENSRVWRLRGSAANSSSSSRAKPRSSMRSASSSTNAWSWANFTAFCRYRSSSRPGVATRISTPLRSFIICGLMLTPP

SEQ ID NO: 22137 - protein, 466 aa, Pseudomonas aeruginosa
RSGEQIVVAEEAGVVVEIAVAEIAIGETAVGGIVAIGEALGRRLGIGKLAGVEVIHRDVLDHLDDFLRLAVAEHAGEQVGHQHPASDPSGRLQRTAEKAAGPRRRGRRGGRHTRTHVAGRRRRIGETRLAPARRAPRLARRRLVARAAAEQAGEEAAAARTALLQLGDLRLELLHPLVEALQRGFLDQHHLRHVVRRRRLPHQVLVDLRLGLGVTRSGLPLGLAQAAEQAVDQGFLIGFHRTPRLHFEKEGWIAPKGNIGAPCTISSSSGEFPMNDDAQRSARSQVALLIVDLQRGMQRHDLPPRNNPGAEARIVELLAAWRAAGWPVVHVRHVSRQPGSPFAPGQPGVEFQPALAPRDDEAVFEKNVPDAFINSGLQRWLHVRDIRQVALVGVATENSVEASARSAGNLGFQTWVVADACFTFAKPDFHGTPRSADEVHAMALANLHGEYAVVLRAAELLQRLPA

SEQ ID NO: 22138 - protein, 663 aa, Pseudomonas aeruginosa
LSAGQQRDNRAVRQKTGRFRHIPHKPLIRKHESGMARFLHRHRTTPLPGDTPDEPRATADPLRLLGPQRQRRPGGEQDRATHQLGHRLQPQAGPVGGTQRLRLRPLADPLHRRLRRRVPARVGGHQPRPAGGHREAQGDRGDPAWPLASGGGGQATGDDRPTDQWPGRGEHRQRLVQGRVHRHRRTLAGARRTLSALRGVHPRAERHLDRGKLHLQGRFLSFPRLHPETQADPAAAPGNLPGRQLAGGAGHGLARVRLVLHQRQQHRRHPRPGRGHPRQGGGQRPFGQGRSERLHHCPRHRGGSAGGARRDHRQGRLRGGERLRRRGETGRQGLAGGRWQLGQIHLRRPGAIQRRLQDQPDRHATADRRAHRRAEGGRGRPGAVGLPALPRRSGVFRQARVAAGPRTGAGPGSRSGLNGNGGRQALASAAGWVRVAGSYPICRPAMNPLLPLRDAWFFFTRHLTTLVPLCLPWIFLESLLQQQIDEAVGPQQMGAWSLVAGLLFYPLYTAALILFMDARGRDERPRVGQLWSAALRLWPAFALLAALTSLLIVLGLSLLILPGIFVMVKLSFAEFCLVLRGRSPLQALRESFEFTRGRFFLILACSLVILLPVWSLEAWLADSAGDAVVLRVALHALSGFFQLLLTIVAFRIYSLGPAPRNGM

SEQ ID NO: 22139 - protein, 166 aa, Pseudomonas aeruginosa
TAPRADSPRWPMLDEPCLEERTMSDESANPSCISHLSIGTNDFPRARAFYDAVMAALGCKVILEYPGAVAYGKLYPEFWVQAPIDGRPASVGNGSHVGFFADSKAQVDAFHAAALAAGARDEGAPGPRPLYGEPYYGCFIRDLDGHKVEASYWDMSQGFDAHDHAH

SEQ ID NO: 22140 - protein, 115 aa, Pseudomonas aeruginosa
AAIASIAPSGASCRHAMAGCSTACSGRARRSWSATCRSTAAASWPCSTPASTARRRTTTPSSARSRPPVRCSTNCRPGARPGCSAATSTCCRPASIPTCWRRCARPTGKTANWAS

SEQ ID NO: 22141 - protein, 253 aa, Pseudomonas aeruginosa
QQKTARPHTMPLRTTTPLLALLAFALLAAPQLHAQDARPSLNVGYYEFPPYIYTARDGHAAGSGARLVRLLLERAGYRPAFRALPSARLYLGLQDGSVALWAGAAKPELAADTLQARRVLGHVSLNLYYPAHQPAPRVPQDLAGRRLILISGYSYWKPVTDFIQDPNLHLRLYRTGTHHAALRMLELGRGDYLLDYQAPVEAASRQALASQELYRLPLRMIVSRHIPGAEALRDRLDQAYDQLRSDGADLSLL

SEQ ID NO: 22142 - protein, 265 aa, Pseudomonas aeruginosa
VMDGVTFKQAGQYAMCCIENLSDELITALRDNLTRICHGADLGSRNIVIFKYEATLKSFWDRYSTKDLNTRTGMLGELLAHVIILKKLDSFDVVSPFFNMEEKHIRKGFDLVLYESTSNEVWITEVKSGGAGKKTSCAATKALLAKARDDLKGRLAEAEMNHWLNAMNAAQKSINDKTRYKESVLEILGMEGEKAYGNSAVASDNNVVLVSALFNDATQKVEEATISGFTDSLLTTPIFKTVLVLSIQKGTLQKLEDFLRTEAGC

SEQ ID NO: 22143 - protein, 826 aa, Pseudomonas aeruginosa
MQELTIKELAKTRFKDIYLELLRGGQMSDGDIVKLLAIAVLLLNHQAPEIKRLGYRITLFYGNLTGRYEPLYDVAVNSGLLPVTAVIGKSFAQDERLSRSFIQNIVSSYVDTFRDQGMVLTEQQDTLRVFVQDEYENSSVVIAPTSYGKSELIIKSVKDNPSKRILILVPSKALLAQTKKRLIYADIPKLGKVVTHPEMFSPERNNRAFVLTQERLNRLLNEYSTLKFDMVFVDEAHNLLQGDSRNELLATMLCILGARNPKTSFKFLTPFLCNELNVRVRYLDMTPKGFRVDEYIKSERFYTRDFRTGKNDGKLKLYDHFLNQWLEIDRKYKSGFDLIKGESLAKNIIYGNTKKKIEQFALELAETLPNIECPLVQTACDELEDAFDKRYRLISCLRKGVMYHHGSIPDTIRLYLENLFHQSKAMKYLVCNSTLLEGVNLPIERLFVFDYSKGRGNLTSSQFKNLVGRVNRFSEVFAPEAGTTLKKLESSIYLLGMDGYTNKKSNLQTFYEKAVNVSKVDQDSVSNVLLEATTILEGEVADRHRDAVSRLENLQPGVVTGQECKYVKTEVGRLLIANSVSEIDVFTSEEEIDDAISMSVDANGMIDNADRLLLEIKTCFIDKFDDKRKYSDLKRLQNKATIDFYAMFLDWKLKKYSVKQILRYTLKYWSELPEKKGTDYVYVSNWGDTKYGDSHYAYWVRISTKNDVEKVNLAIVRLKEEDDFFDNKIFKFVEVLNGVGAVDPGFYKRIKYGTTDDAKIKLIREGYSRGLAELLLDRYPRYVRLDNNGEIEVSSRVIGLMRENEESDLLIFEAQMNLKSTPESVA

SEQ ID NO: 22144 - protein, 506 aa, Pseudomonas aeruginosa
ISIKARNLQQLIFAERICKLLKPINKEASVNESEKILATIASNTFFSLWCYPSLYRSLGKGKELTDLTVYFNNTVILFSDKGHVKFQEQNDPKLAWSRWYRAAVKESAKQLHGAESCIRNHPNKIFLNSKLDERFPFDLSRTDLKIHLIAVTRGIGKHAKQHFDAIRPGSRGSLGYLYGANEEQLLDKPFFVGDVDMSKTFVHVLDEGGIKLLLEELCTPADFIRYLEVKEDAIRNKDLLISAGEEETLACYLQEDGGNGFGKITNPPHNKGNFLMIPEGEWDHYRKTVIYALRYQQRKEAKLWNEIISRFADGIVDAQVGEASDLPFITHANAVQVLASENLLSSSLLATALFDKFHTVPSGTRSARTTYSVCNPGRVYVFVFFPWSHKFNSYDEYRQERTAYMQLYACVARYKFQKAKEIVVLGADTKGHQGGSETIFAIDASVPLTGDERTTAQQIMKTYNILDNISQRATPGNGATKNVSRNAPCPCGSNKKYKKCCLNPEP

SEQ ID NO: 22145 - protein, 75 aa, Pseudomonas aeruginosa
ANGLRIRSLISRIPCRALRALGDGFSPNNSSTFSFHVLDMKALNPSAGKGTPVKARSKFNLCSKALKYASTMATE

SEQ ID NO: 22146 - protein, 148 aa, Pseudomonas aeruginosa
FAVMFTRRSYMRLATRVSCAVLSAALLSQLSACGTLFYPERRGQIDGRIDPAIVAFDAIGLLFYIIPGLIAFGVDFATGAIYLPDAKYSVAPEVLKDAVGADGKVDNRKLKAILEREIGRELPLDDPRLLRHSGSVEQLAAYGLKPAA

SEQ ID NO: 22147 - protein, 330 aa, Pseudomonas aeruginosa
SALRARPCVSARSPPGWFTVAPSLLTEAPHESRFPPRPPAAPGHPGLARSRRHPGHRQGHRLVAERFGEPARRPHRLPAGQCRLAAQPAGGALFAAPGRRRPPLRPRQGRGPGRPGPGHVHRCQRGAGGYPGGRAIARPAAPRRGHLGHRGDAAVAAAHGPSPGLPDPRHPPHRFHRDTRRLAALPLGPAAQRQHPRGTAPGPLRLAAERRSVRPGHRPVHPLERPADRSRVGVDPDGPGTAHRHQRAHARTCLQRAGSARRARRAHADLRQPLVRPVASRAARRAEPVGGPRPDRPRSAGDQARIPESRGADPCRPTGSGRQGNRQLTL

SEQ ID NO: 22148 - protein, 108 aa, Pseudomonas aeruginosa
GTRRCPRGKASTTRPGRQSGCGPQLPPYASPRPGPGCPWATPRSPPGPPRPPRPSSACAWTHRLSERAPTPSIRHHPPFIVCLAPGLVARPRSNDPGNDFPPFSAKGG

SEQ ID NO: 22149 - protein, 180 aa, Pseudomonas aeruginosa
LRNKSLKFSLPMAINLKEIFAMNKLDRYDLRILEELQRDARISNQELAERIGLSPSPCSRRVKQLEDDGYIVRQVALLDRKKLGLSLTAFVLIGMDRHTPERFEHFQEVIGKCPEVLECSLVTGMDADYQLKVVVPDMDHYQKLLLGTLTRIEGVSSVRSSFVLNQVLASTELPLEHLRD

SEQ ID NO: 22150 - protein, 98 aa, Pseudomonas aeruginosa
NDKRLARPPWHAPSDREPDFVCLKIRRLPMDPELFEEWMMTGLVTVLILFMAFIVWDLAKKSKAGKFGTLILFFALGLGVLGFIIKGLVIGSLEGAGM

SEQ ID NO: 22151 - protein, 162 aa, Pseudomonas aeruginosa
AARPRRQPFARRAGYPPGTLRPVAGRPADGGRRARPRLRRRDPRRLARRDGSWHRRDQVVLLIVPRPLDDAPLVSPAAPALPAIPRGPGRPGSRGRSAPAPAAASASPPPPSSAAPGDCAPRGSPVPASRSAPTCENAPAAPAPTTSAHPADAPRRAASGRR

SEQ ID NO: 22152 - protein, 555 aa, Pseudomonas aeruginosa
LETSWLDRGTGRHARLSESLTARASPHALPASHLADQPADPGRLRWQRLSGSAFGPFRRRTFPQYPADRAQEPARPAQVAVEPPAATPVGRPAADGNAAKGERTRPRRRTAGHLHQPRHPADPAPRPEHPHRPGLVATGQPARLHRPEAPPSARVDARPVAADRPGAGEPQPLRPPRPGNPAPAPPALADGQGSQRPGQRRADPPDRFRRRRGDRLVAGRAAGRWPDAAWRTGAALVVAHPQRHQPHALARLRHRLAGRPAAVSRRYRARPGVRADPPALRGDALRRPADRRLRAALVHARPPHESRRRGAGPSHAAGADQHGHPLRYLQSHRRTAGRPAQGAPGGAAQPRRGPGDLRHAETRRAVARRTAQRRSGGRGHQAGAAVAVALAAAARTSLVATAAQGQPAFQARGHPGQALAGLIVQAGAGQLAPQAEVVFQQDIAAERLVLVGQRHAFVAPLRVGQESDGAACGRTFHRLPRGSRQQALKRARRAKPRHSSRIQPSTRSPPRASTARPTENHGSPARLSGIGNGAATSGAASGTRRRAKRRSGLLR

SEQ ID NO: 22153 - protein, 178 aa, Pseudomonas aeruginosa
RPPSAPSARCAGRTRGRGSSAAISRPGPPAGESPARWRRSWSTGNRCRPPPGCAGRTARPAPPGRRGAGRSRAARAVRARWRRASARGRRDGTPPGRRGCRSGRGYGTPACAGWPGSRPPSAGRRPAHRSAAGAPRPSRPGSDAPTPGEADRGGRGWRHPATVPGWSLRGFRRTGAGS

SEQ ID NO: 22154 - protein, 455 aa, Pseudomonas aeruginosa
RDIQVAQAGISASRGTASGGLGDDRLAQQPIVQQGLQLFELDRLGHVVAHARRQAALAIAAVAVGGQRQHRQFRAAGQRADRPTGGEAVHHRHLAVEQYAVRPLARQQLQGFATVVGGAHPVAELEQHAASHQLVDGVVLHHQHRALLGTPHRLPAGAPRRRRQALGRLGQLQAQEEAAALSRPGLVGQLAAKQLHQLAAQSQADAEASVATGQRAVGLDETLVEVAAGGHVETDAGVDHFHPQRHPVMGTPGGDAQGHAAPGGELDRVVDQVAQRLGQLAGIAFEGVRQAVVQLQGEAQALLLGARRVLRAQAVEQAAQAERLAARVELAGLQFDEGEDVVDHPHHVPRRTGGGALVLGEFDVHRHRLHQLQRTDHPAHRGAQFVGDGGEELLLQAVAVGQFLVQRFQLAAGLLEDSRALLLHRVDPVGQRQRQQAHLQRRTDLAGIHGEEHVR

SEQ ID NO: 22155 - protein, 692 aa, Pseudomonas aeruginosa
VAEDHQGVDDAAEKEGGPGDDEIARHAHAAQPGEDAGGEDQAGEGQRQVGGQAQGHGVAHGQRHQHDQRADRHQRQQAAVDPHAVVAGMQEAARELAAEQRRRTDQEWRGGVRPPGAVGPEVLDAGAVHRDLVEPERSDIEDVVEIAGIADAEEDEQVVDQHHQQHAIDDAEHIDAFGLLLQVGLGRPQGQRRLDRPLAFQPQVDTLRLVRLEAEFEQVVVLPDRPTGERQCVAGALGEAVAALAIGQVEVELVQRRIGQLQQPGARIAGGDRPVVQVQAQPEHRARIAGIEHVLVMAAEAAVDGPRGDVVDIGATAHVLEHVDGLPQRQALDLLVEAHRTRQARQRKKKENQPVPHDAPQCSSNGPGAPPPSSWSALGERCMNIPRSLAHASPRRARDVSRRARARRPKGGPRSRHEALLVVSSRAMKTPTSRPVVLCLSGHDPSGGAGLQADIEALLAQGCHAAPAVTALTVQDTVNVSDFRVLDREWVLAQANAVLADLPVAAVKLGMLGSLEMVDTVAEILAAHPHLPVVCDPVLRAGGGGALGKGDVGFAMRERLLPRATIATPNLPEARLLADLPEGSADQCAERLLEHCEHLLITGGHGDESEVHNRLYSRDGSRRTFTCQRLPGSYHGSGCTLASALAGRIALGEALHGAVQSALDYTWRTLRDAESPGHGQYVPRRLPTDFCH

SEQ ID NO: 22156 - protein, 209 aa, Pseudomonas aeruginosa
PATGRRPPAALRRSRAPRRRAPAAIPRQIQRPGAAPARGGKPARTLRTPRRAVDRQRRRRTRRAPGRRPAPRPDRRFAVGGARPARPPGDHRRHLPRPTGTGRASGGRGRQLRRLRPLLQFQHQTRRPRRQRRTARPGPAAPAPADHRHRRHQPRHRARPDRPRRRSGRRDPCAVRRRVRRRGGTPRPRLQRPVRTCLTPPRLAREIES

SEQ ID NO: 22157 - protein, 502 aa, Pseudomonas aeruginosa
GKSPCRWGFRACSWRGKQCRKMKGANHSTAFRPATLGTGGPALYNARSFSNCPTKRMAKKLFIETHGCQMNEYDSSRMADLLGEHQALEVTENAAEADVILLNTCSIREKAQEKVFSKLGMWRELKQQNPDLVIGVGGCVASQEGAAIRERAPYVDVVFGPQTLHRLPEMIDAARSTRKPQVDVSFPEIEKFDRLPEPRVDGPTAFVSVMEGCSKYCSFCVVPYTRGEEVSRPFDDVIAEVIHLAENGVREVTLLGQNVNGFRGLTHDGRLADFAELLRVVAAVDGIERIRYTTSHPLEFSDALIQAHAEVPELVKFIHLPVQSGSDRVLAAMKRNHTVLEYKSRIRKLKAAVPDICISSDFIVGFPGETEKDFEQTMKLVEDVGFDFSFSFIYSARPGTPAADLADDLPEEVKKQRLQILQSRIHQQGYEISRRMVGSTQRILVTDFSKKDPGMLQGRTENNRIVNFRCDNPRLIGQFAQVHIDDALPHSLRGTLIDSTLH

SEQ ID NO: 22158 - protein, 396 aa, Pseudomonas aeruginosa
GRRPYGGLAEPSRRHGAPTFQREPGKRRRDTATLRDDIQRLFSSLSISHWRVRQNTLNAPQELHRFILEPFDARSFATLCGQFDEHLHQIEKRLDIEIRNRGNQFELAGEPRRTKVAERLLQRLYREAQNGTDLTPDTVHLYLQESGLEDLEELQSAPQVTLKSRKAHIRPRGANQQRYVKAILDHDINFGIGPAGTGKTYLAVACAVDALEREQIRRILLVRPAVEAGEKLGFLPGDLSQKIDPYLRPLYDALYEMLGFEHVAKLIERNVIEVAPLAYMRGRTLNNSFIILDESQNTTVEQMKMFLTRIGFGSTAVITGDVTQVDLPRGTRSGLKHVIEVLQDVPGISFTHFKPKDVVRHPLVQRIVEAYERHESRQQGQVRPVEGTGKGGHDAA

SEQ ID NO: 22159 - protein, 302 aa, Pseudomonas aeruginosa
IAGGTGSSRSVRLRRRRATEQGKMSEDRSSNGHKSWLDKITQAFAHEPRNRQELLELLRDAHDNKLLDSEALSIVEGAIQVADLQVRDIMVPRSQMMSIRSTQTPKEFLPAIIEAAHSRYPVVGESLDDVMGVLLAKDLLPLILHNDERPFDIKELLRPATFVPESKRLNVLLREFRANRNHMAIVIDEYGGVAGLVTIEDVLEQIVGDIEDEHDVEEDSYIKPLPSGDFIVKALTPVDAFNDFFGSEFSDEEFDTVGGLVMSAFGHLPKRNEVVELGEFRFRVLNADSRRVHLLRLSPLQN

SEQ ID NO: 22160 - protein, 189 aa, Pseudomonas aeruginosa
TGSKDIRCVGFLVPAGPDTCWHSPQARSHPWPWRPSITGRWRSSRSPCSISACAAFPASPPCGAAGGTVSARSAPAPAGSTSVSMTTAPPRCRWQASSCSASPPASPSSSPCRPGCGRAACAATTRRWATPWRSPPCGWHWSCSAVGSLPVSPGSTPAIASCRDRWPGWCRWVAYGCPPSSSPSARPCW

SEQ ID NO: 22161 - protein, 257 aa, Pseudomonas aeruginosa
GRFAFEPAPHPLHAERHAHQPQTEKPADTAQPRQPRSAGAPPESEKQQQQQAARRQQQLLEEITDRHRPLPVGRGNLKDCATPGETSGKETLAVVARTEQLRAAMAARQHAMPLAPLHRRTAERTEQLPLFQRDVPTGRRRLRPGCPAGLALEQRQLLGGRMPAAQPVQVLVEIGAYQPHLRFAQTTQLELRGMLVTQALGRIRFIQSQGETLQQPLVQPTSRHTRALQLSHRTPLKVPLGSQPSTAHRASLAFPFG

SEQ ID NO: 22162 - protein, 195 aa, Pseudomonas aeruginosa
SPRSRATTTSSPASGRSGTAPRTSPCSPSTPASTTTSATRPPSTPSAPTSRPRAWARHAPSSACATGASAASATGAARSRSSTARLAATSRCRPTSCRWCCRKTWYRTAPVRRWRRCRNSTNATARNAASRPNAKPTPWTPSSSRPGISPATPARSSKAACWTGRRPTTGCRSTSTSAASSTPSCTCSMRASSTS

SEQ ID NO: 22163 - protein, 406 aa, Pseudomonas aeruginosa
PRRNSTKPSARQKPRPRRKPKPCAPPTRRSASAAPPSRSSRRSSSPPRDAPGPVSPAPSSPMKLTPAQLAKHLQGPLAPVYVVSGDEPLLCQEACDAIRQACRERDFGERQVFNAEANFDWGLLLEAGASLSLFAEKRLIELRLPSGKPGDKGAAILQEYLQRPPEDTVLLLSLPKLDGSTQKTKWAKALIDGNAAQFIQVWPVDVHQLPQWIRQRLSQAGLSASPEALELIAARVEGNLLAAAQEIEKLKLLAEGNQIDAATVQAAVADSARFDVFGLIDAALGGEAAHALRILEGLRGEGIEPPVILWGLAREIRLLAGLSQQYGQGIPLEKAFAQARPPVWDKRRPLLTRALQRHSSSRWNQMLRDAQLIDAQIKGQAPGSPWSGLSLLALSLAGQRLGLPAA

SEQ ID NO: 22164 - protein, 480 aa, Pseudomonas aeruginosa
RTRGPAGASNDGRRVLAGVLRWPVPRTLLRRAMRNPERSALLKVSGLLGSTVVAMGLGLSSACAQKNPTVEYNQPAAPQQTKAPFSGAGPAASVPAGAPNEAQPGQSFEQWRDAFRQQALAGGIDAQTFDRAFAGVQPDPAVVEADRSQPEFTRPVWKYLEGALDPLRVRQGQARLAQHARILGEVDARYAVDADAVVAIWGMESNYGSHMGNKNVIRSLATLAYEGRRPEFAHAQLLAALKILQHGDVPASFMIGSWAGAMGQTQFIPTTYNQYAVDFDGDGKRDIWGSPGDALASTANYLKASGWIAGQPWGFEVRLPAGFDYSLAELTIRKPLGEWQGMGVQGVNGGPLPSGLSGEQASLLLPAGHRGPAFLVLHNFRAILKYNNSSAYALAVGLLADSFKGGGRIVGAWPLEDVPLSRSQRIELQRQLAARGHDPGAVDGIIGANTRKAIRACQQEFGWPADGYPTPALLDRLRTP

SEQ ID NO: 22165 - protein, 304 aa, Pseudomonas aeruginosa
NEMNGRPHGACRPHLQSLDIVLLRTFLEVVDSGGFALAADNLALTPSAVSGHIKRLEQTAGVSLLSRTTRRLELTQAGETLYAYARNIVELEREARARLHGTPIRDRLRIGASEDFASAWLPRVLQRFRRWHPEASIELKVGITTDLLRQQAQGRTDVVFGKQCRRVGDDGELLWEEPLVWAAATAIELPAGEPLPLALFPEPCVYREAAITALGAAARPWRLVFESASMAGCLSAALAGFAVTVVARSQMREGLRELGPEQGFPTLPEARFYAFSRQPSLAADALIEAVRQLGQRSRFVTAQG

SEQ ID NO: 22166 - protein, 274 aa, Pseudomonas aeruginosa
DELSAQSGTHLGKIHWPNQVAQLGHGHPGVAAGIDSLERSQVHVQVQRQAMEGTAVTDAQAEGGDLRPVDVDTRRVRLGHGLHVIGRQQADQALLDPADQLAHAQSQAADIEQQVGDQLAGAVVGHLAAAIHLDHRDVAGEQHMLRLAGLPLGEDRRVLQQPGFVHYRFVAFGNEALHGMPGRFVGNLAELTEAQLESHQSTMCTRPVARRSLWMACSWSTSVAVISTCTERNRPLLLSRTTRVSTSRSGAWRWMISTTRSEKPSPASPITLIG

SEQ ID NO: 22167 - protein, 214 aa, Pseudomonas aeruginosa
TSGVSVMAAADPWSAGTGARWPRERAGAGRSVEQTVEEQADAIPQAAEETTLLDGVEGDQVGAADDLVVQLHFHLADHLALLDRRHQLRLQDHAGLQLLHLAARQGHGQVFGEAGFHFMLGTLPDQALGQLGALLVEVAAFEEAEAIGQQLLGLGGAGLLAVGAEHHGDHALAVAYRGSHQAVAGFVGVAGLQAVDGLVAPQQQVAVRLLDVVP

SEQ ID NO: 22168 - protein, 191 aa, Pseudomonas aeruginosa
EFLLRVDRVVARLAVDDRAGQHRHVAGGGIVVRVGQAGGVHEVGVGQAQLLRGGVHHVGEGVFAAGDMLGQGDAGVVAGLDDDAMQQVAHRYLAADLDEHPRTAGAPGMFADGDQVVLADAAGLDLLGGDVGGHQFGQAGRRQALVAVVLDQNLAALAVHQDVRLGGQLRRRRNHGFSSPASRRGDEQDKQ

SEQ ID NO: 22169 - protein, 163 aa, Pseudomonas aeruginosa
PPSCPVPGRTRWPASSACPSSCRSPNRGRTGRWRRGSATAAGESRRCAGAATGWRAGASRLRWTGCGRSYCSRAGASGSAAVGSGLATAAASGATGSAYSALSLPCSSSSQASITCLTTGAATPEPDSPFSTITATAICGLLAGAKPTNRAWSRCRSSSLERS

SEQ ID NO: 22170 - protein, 175 aa, Pseudomonas aeruginosa
RIRRATSAFLPRVLSGISTSSRDSSAGRRLTYSCQPSSTQRGMREPTAIRRNRMPASLFRLVLGAALLGALPQALQVVELAGRREHHVDHHVAQVEQRPFAGLQAFAAQGLDAVFLGLGQDVVGQRLDLAAGTAAGDHHVVGDAGLVPHIEGHDVLGLEVFQGIDGHLDELFGLH

SEQ ID NO: 22171 - protein, 536 aa, Pseudomonas aeruginosa
TTGRRPPVPPAPTPGCRWCRTACRAAVRGDRPSIARLPPPPARPSPTAARPTPAGFPGAAAAHWAAGAVRRGRTARPFPRRCAYVRYARGRKCRRTGRYVCPSGAHVTVAEDDVLLAGQAFQADRAAGVQLVGGNPDLGAEAVLEAVGEAGRGVDHHRSGIHFGEETPRIAEVLGNDRVGVLRAVGVDVLDRRVQPVDDADRQDRRVVLGTPVLLGSLQHVCAEQRAGRGVAAQFHALLAVDRGQRRQHLLGDAGMHQQRLHGVARCIALGLGVVGDANRLVQVGGDIDVDVADAVQVLDHRHLGLAADALDQALAAARDDHVDVFGHADQRADRGAVGGFHHLHGGGRQAGLGQALLDAAGDRLVGVDRLGAAAQDGRVAGLQAQAGGVDGHVRPRLVDDPDHAQRHAHLADLDARGHIAHVADLADRVGQRGDLAQALDHVVDARRGQRQAVQHRRLQAIGAAGGEVLLVGVGQLRAGGVQRIGRGQQGAVLLRGGGAREQPRGGAGIAAKAAHIVEDGLGHGLGIWRQGNARL

SEQ ID NO: 22172 - protein, 443 aa, Pseudomonas aeruginosa
TKLLPLFTFEASLATATHRHPLGRTTITTHTPRGLAMRYRTDYSAQSLSSEPDILFLDGWQLRYQAFAARADDPRPPVLLLGGAFQSFRSFTGEVSELLAEHPVILLDLPSQGGNLQLAAELSLEDLADLIAAFAEQLGLPPLMPIGLSYGSALAALFAARHPRRCARLLLAGITAFGRPGARLLLEEALARLDEGDQSAFAHGVLTGLINPLQLERTGVSPVFRKAMLRQLQRLTAAEIERYRQNSRRLLAFGGFERHPTCPTLVLAGEYDHFTQPWEHAVFAHACGNAEFALIHDADHLAQFERREACARLYGPFLRGEALPERAEGSTRIPRTRLLGLERRFEVRHRPAQGHARLEHPQFGVYAAELMELGYFGGRLHAELPESRPQRGWRLCCDGLADLDILPLRSTAGGFAFIFPHSDPAASAGLADLLAAWERAEVA

SEQ ID NO: 22173 - protein, 412 aa, Pseudomonas aeruginosa
FALARRPAAPRHLLRPRCVAGRPRVAGQGDPPSPGQSLAGGANHRDRGLLPGGERQPCLARLHREAQGTVPRRRAHLYVLRARRRLAELQRRRAGQCGADQVRPSLAGSHQRPHGAGADAEPEPGQPGPAPRDRPPVRRPDPAVQGHGAEGAGVGRTALRPAATVRRRCRRAPQPGDPGRSAGHSEGARRTPAVPFRRCHLRRLLHPQPTAPRPGRRARLSSTRTSGPAPAMSLDSFNAWMAANPEWLGLAIFLIAFLECAAIVGIVLPGVVLLFGVAVIAGSGALGLGETLLLAYAGGVLGDLSSYWIGRRFHQNIRRLPGLRSHPQWITAAEVYFERYGIASLLVGRFIGALRPMLPMVAGMLDKCDPCLDYAEKRNLPWHAHRLRQGACCLRPVIVSCCSPQWMVIQLA

SEQ ID NO: 22174 - protein, 108 aa, Pseudomonas aeruginosa
  UNSURE (42): Identity of amino acid at the above locations are unknown.
CKMARCSRRATPAETKMPRWPTCWCNRYTTRWPAATKSAVVXYTALSQPNAWWGRVMLVPFEQKTTAVRQCREIPREWPSNKNSPLLKLITTKKIAGDRKLSSPGNLV

SEQ ID NO: 22175 - protein, 286 aa, Pseudomonas aeruginosa
IMVERERVDSAHITPSAHYTGYVWFRHRLAEPAFATVFGRWVHGFVAPINWGAQLGFGLNIEDFLLQRHLMIDARLTQAVEREGVVQVVEMACGLSPRGRRFRQRYPQLRYLEADLPPMAARKAALLREQGWLGPKHAVAAVDILAEDGERSLAALFAGLDRERPLVVVTEGLVNYFQRPVIEAFWSRLATELKRFPQGIYLTDLYPDLREHPRYRQIRWGVGIIGRLTRGSYPLHYRNAAEIEAAFARCGFASTLVLDPQREGAALGLPQGRLPSLVRVIESRTA

SEQ ID NO: 22176 - protein, 705 aa, Pseudomonas aeruginosa
TEVAILFTYPSAGACAQVSPSRAQPQAQRGCRVTAGGDGTHCLPTGCCGWARRGWLAIIAHFPDARCRDHDRVRPRLYEPPWPRCPRRLAVARARRHRAEEPRPAGRGRCAGRRPRGVVPRQRAGPRRRPRQWPGAGDAGPPGADPGAHRRHDRGPAPGRHAARPDRRDPRHALCALGHPDRQDARAAGRGRDHLRVAAERDHRRRQPVPEVRQRDHPARRLRGDPLQPGDRPLHPAGPGRGRPAGRRRAGGGNHRPRRGRRADQHARIRRRDRPARRQGPDRAHQPRGQGAGDQAPGRHLPRLHRCRRRPGQGDSRRRQRQDPALCTVQHHGDAAGACRHRRAGAAAAGHDLPREGRGTARRRRDPRAARRRRAGGYRGGLAYRVQRADPVDPHRRRAGRGDRAHQHLRLAAHRRDHYRELQRCAAFPRRSGFRFGDGQRLDPLRRRLRVRPRRRDRDFHRQAARPRPGRPGRPDQREVRRLRRRSRAHLMGKRIGLFGGTFDPVHIGHMRSAVEMAEQFALDELRLLPNARPPHRETPQVSAAQRLAMVERAVAGVERLTVDPRELQRDKPSYTIDTLESVRAELAADDQLFMLIGWDAFCGLPTWHRWEALLDHCHIVVLQRPDADSEPPESLRDLLAARSVADPQALKGPGGQITFVWQTPLAVSATQIRALLGAGRSVRFLVPDAVLNYIEAHHLYRAPH

SEQ ID NO: 22177 - protein, 132 aa, Pseudomonas aeruginosa
RNRDRLNANRTTRPSGHRCPGRPQGPGHRDPRCAGQDQRHRLHGDRLRQFQPPGQVAGRQRPDQGQGKRRQAPGQRRPGVRRMGAARPGRRGGPRDAPGDPPVLRPGAPVAGRRAEPRPAPAGRVTPACGCA

SEQ ID NO: 22178 - protein, 422 aa, Pseudomonas aeruginosa
WTPGCSTSTASSRPNTRNPSRRSRRRWPSPNPRQPSRRRPPLNSNFDRTLSNEDVMRRRASLLQRLHIDGILLLLLLILGATGLFVLYSASGKSWDMLMKQATSFGLGLGMMVVIAQIEPRFMARWVPLGYLVGVALLVVVDVIGHDAKGATRWINIPGVIRFQPSEFMKLLMPMTVAWYLSKRNLPPGLKHMVISLAIIITPFVLILKQPDLGTAMLILASGGFVLFVGGLRWRWIVGAVSAAVPIAVAMWFFIMHDYQKQRVLTFLDPESDPLGTGWNIIQSKAAIGSGGVFGKGWLLGTQSHLDFLPESHTDFIIAVLGEEFGLVGVCLLLVLYLLLISRGLVITAQAQTLYGKLLAGGITMTFFVYVFVNIGMVSGLLPVVGVPLPFISYGGTSLVTLLSGFGVLMSIHTHRKWIAQV

SEQ ID NO: 22179 - protein, 273 aa, Pseudomonas aeruginosa
IHGSGAAATGRQVVRPDGRRERPGSGREQRRPAPAAGQPDQTDDRLHRHQGDRGRPHRRERPGHRQRTCLAHRRFADVHQGRQPGIGERPAAWHHHPVRQRRQRRPGRAYRRQRRRLRRHDEHHRAEAGPDQLPLHGRHRPAQPGPLFLRPRHGGAGPRDHLRRAEPLRDLRAEGIPMEQHQAAEPQPAAVARQDRRRPEDRPHRRSRLLPGGFRGTRRPAHDRRGVRHQQRAGPRRRDPEAADLWLPLLRKPQLLQEGHRADQGPGLEGFRA

SEQ ID NO: 22180 - protein, 338 aa, Pseudomonas aeruginosa
TEDPYGRDRTDMSTVVEKSGEAKPGKVEVGVKLRGAEKVARIPVKIIPTEELPKKPDWIRVRIPVSPEVDRIKQLLRKHKLHSVCEEASCPNLGECFSGGTATFMIMGDICTRRCPFCDVGHGRPKPLDVDEPTNLAIAIADLRLKYVVITSVDRDDLRDGGAQHFADCLREIRKLSPGIQLETLVPDYRGRMDIALEITANEPPDVFNHNLETVPRLYRSSRPGSDFEWSLDLLQKFKQMVPHVPTKSGLMLGLGETDDEVIEVMQRMREHDIDMLTLGQYLQPSRNHLPVQRFVHPDTFAWFAEEGEKMGFKNVASGPLVRSSYHADQQAHGNKIG

SEQ ID NO: 22181 - protein, 306 aa, Pseudomonas aeruginosa
DVPSFSWRGPMSRYAFVSADVLDIAYLEWNPQGARSAVLLHGWPDSPHTWKDLAESLADAGYRVLAPALRGFAPTRFRDASTPRSGQLAALACDLLAFVDSLALQRPLLVGHDWGARAVASACGLREGVASHLVMLSVGYASNDPQQVLSLPQARSFWYQWFMATPRGERALREEGEAFARQMWDTWSPPGWYAERDFQEAAQAFSGPDWVAVVLHYYRHRWGFVAGEPRYGAAEQRLLPAPRLALPTLVLHGGADACTHPDGSRGREHYFSGRYQRLVLESVGHFPQREAAAQVADAILRFCADD

SEQ ID NO: 22182 - protein, 216 aa, Pseudomonas aeruginosa
SCPARTCARCSIGLRSFFLARWLFVVAGVRIGMTQFRQQFTFQCFHFFRFGVVDVVVAEQVQAAVDHQVGPVGLQRLALFQGFAGDHRGADHQVAEQRDIEKLVRDIGGEGQHVGRVVLVPVGAVQFQAFGLVHQADGQLRLRTLAQGQFAPGAELRFGGQVRGGASDLQVELKRHRDRPCPFPRPAAPGLAGGSRDARRLRRYAAPAGGGPHPWA

SEQ ID NO: 22183 - protein, 158 aa, Pseudomonas aeruginosa
KASWPCASSDSSKRTAHYRGRGPRFLALLAERLCYDSRPSFSGIAFPAMNKRENPIYKVIFLNQGQVFEMYAKQIYQSDLWGFLEIEEFVFGERTQVVVDPSEEKLKAQFEGVLRSFVPMHAIVRIDEVERLGTPKISEAKGAGNVMPFPMPMPGKSD

SEQ ID NO: 22184 - protein, 250 aa, Pseudomonas aeruginosa
APSACLKNSGVPPTLLKARTGELTPPGMCFWALLNSVSERDMASSLSLGRGAEASGRFEQGAEGAGAAFHLGGGRGGEQRMDHGDQIDAAGDQAGRGVEADAADGGDRQVQARPGLVEQFDAGGGGAGFGAGIEEAAEGDVAGALGHRLLGQFQLGVAGGADDRLAAEQGARRRQRTVGLAEVQADAQARGEFGVVVDDQLRAVAFAEFAQAFRLAQAPRLVAGFVAVLQQARAAAERGFDVGQQAAVVQ

SEQ ID NO: 22185 - protein, 503 aa, Pseudomonas aeruginosa
QGRAQCRLFALGVLVAPGPGLPAGRLQRSAHLAAGAGLSAAGQARPLPARWPGRLPPRPAHRRHIAVRQSADPAEQLPVRTRPRAEQAAACLPAAGKPGVDPGAADPVVAQGLPGGAARTHLCARHHLWRAAGDADLQPVHLPQRPRYQLSLLHPLYRFVRALPGLGERRRHRVLLARQPLVGERRHAIPDRFGGAVRLPVRAQLPAYPRPQRVGRPRPAGADGGRRAGHADGADHELRRGPAPGHLPGAGLHRPDLRRRHPRLAARHARGALFHHRLDRLPSRRHRQHPDGPRLPTEHVPHHVCQPDRFGAGGGLAVAGAGRPDQRDEGGARANPPGVQPQAGSAEPGTGQQQPPEGGVPRHRHPRTAHPDERGDRFAGADADGADGRRTRRVPAHRRRFGAGHDADGQRHPRPHRTAGRQALPAPRAVQPARPVRQPARAVRAARRGEGPALRPATGRQPAGHPRRRCRQAGPGAGLPGRQRDQVHRQGQRDPARRRRAYP

SEQ ID NO: 22186 - protein, 134 aa, Pseudomonas aeruginosa
RGGAAGGSDRHRHRFRHGRRQRPLPAFRPGRQLVDPWLRRPRHRPGSVPQAGGAAWRRADPRVPAGTGQPLPPAPATDPAGPGPGAAAAARRRAGGAASRGVHGAGGGGQRHQPVGDSRHAAQARLPGAHRRQR

SEQ ID NO: 22187 - protein, 728 aa, Pseudomonas aeruginosa
  UNSURE (699): Identity of amino acid at the above locations are unknown.
SRRAAPALSRGIRRTVRRTARGGPAQWRIPAFPGAACRGLPGRGHRRGAGRPLVSPGARRSRQRPAGTESGAGEYGSGELLPARGGRACLRGTLMNLHQYAETHEVTNQVPSLDGANLYRLDLPLQEWVRRYQGGWAEERLQRYGELAGGPLMAAGFLANQHKPEFHSHDRYGNRVDLVEFHPAYHELMRAAIEHELPSLPWTDPRPGAQVARAGLSYLHSQAEAGTGCPLTMTYASVPAIRLQADLAEKWLPKILSREYDPRNVPMEQKAGVTIGMAMTEKQGGTDVRANTTRAYPVGIPGPGQAYELVGHKWFCSAPMCDAFLTLAYTDKGLTCFLLPRHRPDGSRNQFYIQRLKDKLGNWSNASSEIEYRGALAWMVGEEGRGVPTIIEMVAMTRFDCMIGSSALMRQALTQAAHHCAYRKVGGRVLAEQPLMQNVLADLALESEAALALTLRMGHALDRGHDEQEEKFARLVTAVGKYWICKRAPAMINEASECMGGAGYVEETILPRLYREAPVNSIWEGSGNVQCLDVLRALSKEPGVLDALFAELGDGHGDARLAAHIGNLKAGFADTADIQYRARQLTEDVAIALQAKLLLEAGNSAVSDAFIGSRLGDGGRVYGTLPRGVEVEALLARATPHWPEARRDAGASALPGAGRAGLRRGQFRRRPRHPSAGLRAGLGRSGAGHPGPATPSRKXSSMPGSRRPWRTMPPGPPPRPWWRRGRRC

SEQ ID NO: 22188 - protein, 407 aa, Pseudomonas aeruginosa
GPRAPGRDGRAPGKLAGPGRPWRPGLSVRQRQALPQLLLPPGGLGLLSDVARCDAPLLAGFRRAEGRRVHALAAQRRLERLGRVVLLFVGEIEGTEVDGHAGLRLQRAMGLHRVVGIHVVVAHEPARLVGADRQGGEAHRPEALVDQPELRAEPGIAGKQQRAVRRVDDEAEPERAVGVAAGARRPVLHRYAMQRQASAQRHGLPPVDLHDVGETCLADQPGVAQAADYLGRRPAPVELAQGFQVEVVVVVVAHQHQVDRRQLVERQPGRMVALRADEGERADPLRPDRVGEDVQAAVLDQQGGVVDVGDPQFFAAGAFVHPWRRCRRRQGDPRALRRAVPLPLEQVAQALVRGRLDIAETFAVEMVRRRTLIGAASAAGQGQQADQPGGTQGGHEGMLLRSGSRTT

SEQ ID NO: 22189 - protein, 222 aa, Pseudomonas aeruginosa
HAARYPDQANSFPVMSRPPRPSPRHPVRPAPRRVAKAPPSEPKLLLFNKPFDVLTQFNDEQGRSTLKDFIPLPGVYPAGRLDRDSEGLLLLTNDGRLQARIADPRHKLPKTYWVQVEGTPDEEQLRRLREGVTLNDGPTLPAEARLLDEPTLWERVPPVRFRKSVPTYWLELVIREGRNRQVRRMTAAVGLPTLRLVRVRIGPWSLDGLGLGEWREVPARLD

SEQ ID NO: 22190 - protein, 209 aa, Pseudomonas aeruginosa
ACASRRRPTTAEGDAVDPAASAVLPTDNRDLAAAKRTAAVGDRIPTGVRAGWWRPCRAGTCGCPIAAASISSTTATGTDTTARAMCWSCRPAGCASAACHPMRSRSGWAACCTSLPPALTTCGMPTPVSTKWSARRRRQRDPVIRSACRPPATTWWPTRRAARGPTSRAAIATSATAGRWARAASTRRGRPMRRPPRSPTATAGPWPPA

SEQ ID NO: 22191 - protein, 316 aa, Pseudomonas aeruginosa
AGAATASTDGFLADHFLWVGMDQHLGFRVFALDRQHCAVGQGVGHRQAQLAGQLEMQLDEPVVAGDPRAHVVRAEHSRHAAGKFAHALADVGGQFPVHQDRHRLASDLQGAPEDVQGDAQAEQTVALRPAVAGQEQCHEDAGVEQQVRAVVQRVGAYRGGTGAADDVGLEGQEKGREQQRQQHHRDAPGGRAEGLRVAQLLDRLDSHQHRAGTDEHGLGQAGQGLGLAVAVAVVVVGRAQRIVHRQQVEQRGGTVQQGVGEAGEQAHRTAQPPGDGLADDQGDGDSERGQGGQAQQAGVGGIGTHGALLSGGTAPL

SEQ ID NO: 22192 - protein, 172 aa, Pseudomonas aeruginosa
RRTIAIDQRSAIFCRDDDDKTAESARRFAGILRRSVRSQHDFPTHRRRCSRPAPGPWRTTPGRSGSPAGRRQDHPRAAGPARRALARRPTHPHARTAASGGAGGGRAAGRRAGRKGRRDRRLPDPPGEQGRPEDPHRSGHRGYPCPSPARRPGAGRCRPGDLRRIPRFADCT

SEQ ID NO: 22193 - protein, 876 aa, Pseudomonas aeruginosa
IIIFLSKTPILPFTVLELSQLSTEPVVYCLPDLGASMISLPIDLVLPDLREALANRNEVILEAPPGAGKTTRVPLALLNEPWLGDQKILMLEPRRLAARAAAERLASELGEKVGETVGYRIRLESKVGPRTQIEVVTEGILARRLQDDPALDGVGVVIFDEYHLRNLDSDLALALCLSGRELLREEPPLKLLLMSATLEGARLSKVLNDAPVVTSEGRMFPVSTVWGSPYQPGERIDARVTDTCLAAINEQSGSVLVFLPGQAEIRRVAEDLKEQLSSRPEVIVCPLYGDLDLNAQRAAIDPAPKGSRKIVLATNIAETSLTIEGVRVVVDSGLERVPKFDPRSGMTRLDTQRISKASATQRAGRAGRLEPGVCYRLWSESQHEQMAGYSTPEILQADLAALALQLARWGMKPEEMTWLDQPPSAPFGQARDLLKRLGALDDAGQLTPHGSAMSELPAHPRIAHMLIKGNAMGLDDLACNIAALLGEKDILRGAGADLHTRLSALSGEQHSRRSGGSLQRVKQSARQYRSLLRGKASSPVSEPDHPRWVGCLLAFAYPDRIGLQRRASASEYRLSNGRAAVFSEPDALTKHEWLVVADLGSRQGQREERIYLASDLDPALFDDELADLVRSVDEVDWDEREGVLKAERQLKVGQLILSTKALPSLDEQTRSLALVNLVRRKGIELLPWNPELRQWQSRVDLLRQLDIQSGQAESKWPDLSDANLLDTLEEWLTPYLGKVTRLSHFSQLDLSSIVRNLLPWPLPQELEVQAPQAIQVPSGSNIRIDYSQHPPILAVRLQELFGLAETPRIAQSRQPLILHLLSPARRPVQVTQDLANFWRSTYVEVKKDLKGRYPKHHWPEDPLVAEATARAKPRKP

SEQ ID NO: 22194 - protein, 62 aa, Pseudomonas aeruginosa
IYDSRGKIRRRTLGLDYRRSKSFVLSVFRWGLYGIYRIGQLQGDYSTEGFPTPTPAQHLHAL

SEQ ID NO: 22195 - protein, 229 aa, Pseudomonas aeruginosa
RGRARAAPGGCRRPAPAWPRRPTAPRCHPAAPGTGARWAGRGTPDDSRPAPAAGGPGGRRNRRRGHPGRYRCRGGIRSSRRSTTALRPAHGAAGRPAGRTPAARAGALWCVGAWCAALPFFVVMNGGEACGAPGRLSSPARARSMGQQEARGERQVVGDLQRIAAPDPGIETGQRGAVEQVVEVRSGPWTRGSLGKCVYQRTWSTPLASSSDGTIGKRPLRMPSSLSSR

SEQ ID NO: 22196 - protein, 336 aa, Pseudomonas aeruginosa
SLPPRISSLQVELTQGFAFFRAGGYRMPRKVFSQPGLPPQGGAGQAAAVPGIGRALALRFARAGAPLGDPRPRPGGAGQFGPAPARPSRRRGARPALRRLRRRCGGACRGAGGGALRRHRRAGQQRRHHPPRYLRRNRPGGFPQGHGGELLRRRALHPRGAAEPARTARTDRRARFADRFRPVALPQRLQRQQACLARSVRHPADGAGRHRRQRDPGLPGIHRHRPAQERAGRRWLGDSPAGASAGQPGGIAGGGRRGDLPGRRAAPAPAGAVQRQLAGAAAGALLSASLRKAAGAAPVGTQAATLTVLSGRGRGRRNPGSCPSRRPRPCARRGRG

SEQ ID NO: 22197 - protein, 477 aa, Pseudomonas aeruginosa
PSRPPRPTPGGRRCRSGRFASLGLLQFADQRQHVLAEILHFFVEVQEGRQHQVDPGRLQRDDALGDLPWRADQVGLEAVVVLHQVFEGGFGPVAIALRRGLAGLFHRVAEGVHRLVVGLGDDLVEHRPRFLLGVAGNDEGVHSDLDRMAVGRRLGADVLDLGADAVDAVAVGEVPVGHARGHVPRRPRAAALEDFRVRLLDRLGFQGVVVETIEIALEGEVFLGPDAFQHADELLGAPIAFVVLQPGFADAGELSLEPAADDVHRDPAIGQLVDRRQLLGHHRRMPGARQDRRDHLELLGGRQQGVADGHRLVLVLGAVAGGEADLREGVVEAVAFRQLGQLAVVVDVPAGALLDLAHHQAAADVGDPVGEADRLLLLAHRGYLRVGAWSGVYEGTVPSRIHVFESMAYGGYGGTGLSSAGQPCCPAVARQTVRPASAATVRRRAEPRRTRRAGWPTPSHAPRRRCAGCRGNRAWRR

SEQ ID NO: 22198 - protein, 178 aa, Pseudomonas aeruginosa
WWPTAVVPEFPLSRPESPAAKKIAVFADVQNLYYTVRQAYGCHLNYAALWADIARGGSIVEAYAYAIDRGDPRQQQFQQILRNLGFTVKLKPYIQRADGSAKGDWDVGITIDVLDAAPRVDEVVLLSGDGDFDLLLEKVIRAHGVVATAYGVPGLTANALIRAASRYVPIEGGLLLKG

SEQ ID NO: 22199 - protein, 150 aa, Pseudomonas aeruginosa
SSPSSRRWCWTKPIACSTSVSPASWTNCSPRCRASARPCCFPRPSPTPSARWPVNCCATRCPSRSVRAIPRRRASGNGWCRWTRSARPSCSATCCRPIAGARRWSSPRPARASRNWSDCCSGRVSPPTRSMATSRSRRGCAPCSGSRPAR

SEQ ID NO: 22200 - protein, 538 aa, Pseudomonas aeruginosa
RNRRSRRNPRPRRASASPARSTWAVGSTAARRRSRRCARHRASARVRRASRRSGRPANSEALAYRSLAPAAQPGQRAESGHAPAGEAGGQQVAAGGRLPVEHFPSAEHAGQAIEHQVAVERLEAYAAGAADRFVQRTRAQQRQRQALDRRRQAGRLGIGGGGGEFTQEAGPNPIDAQLAAQVIGHRPGTARASQGCLDLLATPVRQQVQPYFGRAPCLDPFADGGGEGIDQAALDTVAGHDEFALARRFARQSHGHRFDRSAGELVAKQLAPAVDLETAIAWPQGLDLDATGAQQGHPGAVGAQALPTAATERQDHGVGAYRQALGGALDVQRTVRVPAQPTAAGVDEHALLAQALEPGTEQRRGLHVGGEHPAGTADEGVDTQAVDPGAQRIRVEFAEQCGDFLLAPAIAAEELFPGLGMGDVHAADAREEEFPADRGHGVEHFRAYARLAQDLRGHQACGTAADDGDLGGRGGCLTGHVDDERDLGKPACSVTEAKTASEPCRCHLVRSPCAWSGTDQPSQGQARCAARSVFRTLS

SEQ ID NO: 22201 - protein, 193 aa, Pseudomonas aeruginosa
ACVRAGLCQLNDHPLGAATRDDHGSQAARSLSEAMRVPRQISLFSVVQARITLVEHAGDHRQHRSQGADEAADQQAGDTVAFEVHLGGGDPLRMAAQAGQAADVLVEAAADPVRAEVAQHPAGVGQQQGFAEAEGAAAGDHRDAEQQHHAGEDDTDDGRAFEEGDEEDGQPQPLGVGGHPGVEAVETHCRCGS

SEQ ID NO: 22202 - protein, 432 aa, Pseudomonas aeruginosa
SRISLTPDAETMTESVLDYMSRLGRDARAASRLLARAATAQKNRALLAAADALDAARAELSHANEQDLAAGRANGLEPAMLDRLALTPARIDDMIEGLRQVATLPDPIGEIRDMRYVPSGIQIGKMRVPLGVVGIIYESRPNVTIDAASLCLKSGNATILRGGSEAIHSNQAIARCIQQGLAEAGLPAAAVQVVETTDRAAVGALISMPEYVDVIVPRGGKGLIERISREAKVPVIKHLDGICHVYIDVAADLDKAIRVADNAKTQRYAPCNTMETLLVHAGIAEQVLPPLATIYREKGVELRGDAATRALLGADVLEATEEDWRTEYNAPILSIRIVDGLDAAIEHINTYGSQHTDAIITENFSDARRFLAEVDSASVMVNASTRFADGFEYGLGAEIGISTDKLHARGPVGLEGLTSEKYVVFGDGHVRT

SEQ ID NO: 22203 - protein, 139 aa, Pseudomonas aeruginosa
TTSRRTTCIVRHTDKETETDSMQTEQLVQVAIDALEDLKAQDIVTLDVRDKTSVTDYMVIACGSSSRQVKSLADNVLTKAKENGVKPLGSEGLESGEWALLDLGDVVVHVMLPATRQFYDLERLWQGAEQSRAQHQPEE

SEQ ID NO: 22204 - protein, 257 aa, Pseudomonas aeruginosa
RRHAVAPDRGWLAHASLGRGRLAGIRQAPAGRAVPRTGGDPAQHPRQERRRGAPDPSGRRGHAGARAAGGTGGDPGGRRSALEHRATGSRTGSLASRRTHRESHGRRPGRAGAGGLRAQRAALVAVAVDAAAPVGADPGRRADLPGLDRVVRAPLPQIVPSPDAAADPPERPRERRPPGASARHRRGGGGGLADPGAGGAHVPPAGDPVRVPFDAVGEQPGPCAADPADPRDHLRPQRRDHRRQPAELQPDHHPRTH

SEQ ID NO: 22205 - protein, 312 aa, Pseudomonas aeruginosa
SCPPSAASGLAAVLLSSCSSKAPQQPARPGGHFRAGRLFPSASRRRPLVGRRRVADPRCGTDAAQRFGEGQPLHRAGQDLLPDERCAGLPDGRHRVLVRHQVPRPGHRQRRDLRPLRHDRRAQDPAVAELCAGDQPGQRQERDRPRQRPRPVLFRPGHRPVLRRGEEARLCRDRHRAGQGRRHRPGAVVGPARPAGTDGPGAAQAGGGPGRSRRGADAGGGDGPADRDLHSAAGAACGRRAAGADRLKKKRFITSRWPVSPGGRLRQPGCGGAAEGQAERRDGCAGVYQLGRAQPADSAPGAAGTDRFGGRG

SEQ ID NO: 22206 - protein, 394 aa, Pseudomonas aeruginosa
PLVEPERRMNITTIAKRLSLLVLFIAPTAGWAAESMVPAPPQLAAKSYVLMDGESGQVLVENNGDQRLPPASLTKLMTAYIATKEIEAGRIGENDLVTVSEHAWRTGGSRMFIKVGSQVSVSDLLHGIIIQSGNDASVALAEHIAGSEDAFADMMNTTAQKLGLTNSHFMDATGLPNPDHYSSARDMAVLARAIIYGEPSHYAIYAQKEFLWNNIKQPNRNLLLWRDKTVDGLKTGHTDEAGYCLVASAVRDGQRMIAVVFGTNSEQARAAETQKLLTYGFRFFESRNFYKKGTELTKGLVWKGSEHEVKAGLAEDLTMTLPRGQMQKLQASMVLEPQLMAPIQQGQVIGKVEVKLDDKVIRSADLVALNAVEEGGFFRRLWDSIRLFFYGLFN

SEQ ID NO: 22207 - protein, 230 aa, Pseudomonas aeruginosa
RPARDRTRAHGALMGLELGFRELGEVPYEPTWHAMQRFVAERDKSVMDEAWLLQHPAVFTQGQAGKAEHVLFPGDIPVIQVDRGGQVTYHGPGQLVTYLLLDVRRLGLGVRELVSRIEQSLIGLLASYDVQAVAKPDAPGVYVDGAKIASLGLRIRNGCSFHGLALNLDMDLRPFQRINPCGYAGMPMTQLRDLVGPVDFAEVCTRLRAELVSRLGYAEQKTLTGGIELT

SEQ ID NO: 22208 - protein, 255 aa, Pseudomonas aeruginosa
PLAHLAARHHRHGETGQRGGQAAGHAGALEHQAPGTRSGAEGCNRRFAVDAGFGEQRQRQRFARGQLDRGRRGPDQRFLPEQFAVVSYPPALLAEHHVGAPLGLLAEQVGGDTDLEFDGCFGVPAAKALQDAWQPGAGEVLRSADAQAVADRRAVQPGAGLALQLDDVAGIGVERLARLGQLQAASGAAEQADAGCLFQALDMPADCGGGEREIVRGEGETAAVDHFEKGTQQHDIQGLEVGTASSMRSSIHLVS

SEQ ID NO: 22209 - protein, 494 aa, Pseudomonas aeruginosa
VLEGDRAGARQRAHHLPVAADCPVPVAPSGCRQAEALAGEAQGEKRETAPGAAGCLSLDLRVDQLGIPQHLVPAAAGVALQGTGQQRTALVPDRRTRLGEGFLQRDALAVLLGQASQQADLAGQAPEDHRRLDAFAAQSFQDAQGVGRFTAKGSVDQAEDIEACAVGDRGLYGGGVDLVALGEQLELFDFLGGGEQVAFHARGDQLQGFGAGGQAGLGQALANPLRQLVDVDRPDLDELRGVAIDQGLGPLGLLRAAIELGQTEQEHGVFRRPLQVFLENRRAFVAGLAGGQAQFDQALLGEQRQAGAGLQQQAPIEVGFGIEYLALAEVALAAGLANGIAGFLAEQRFIAADDIDGRQGALEVLGELRGSQLHRRRRGRRNRPRGITGWGTRSATAAARRRGAGAPPRRRRAGLRLPPWPWLLPGAGLRRVAPGSAPGGAWTTAGSGRAASRCAAARLPGRNRSGCFRRARRPSAPVPGCSSGPGRWRRRSRS

SEQ ID NO: 22210 - protein, 159 aa, Pseudomonas aeruginosa
ACPMGRRWLAAQWYLQRCSMAELQRASVTGGGLYERLLQRLALALDEADTAERLRDEHPTELELRGLSEAEMGLIRAYLDQDLHWLRGWHAAAEELALLERQPGRTPRPQPPAPRRHVSLKQRQLLCALCGAPVQWSKGHGVLPCGHCGSQLFRSGNDR

SEQ ID NO: 22211 - protein, 263 aa, Pseudomonas aeruginosa
  UNSURE (263): Identity of amino acid at the above locations are unknown.
IASSDREGAMPIRYFFKQLLLPPGGLLLLLFFAFWWRTSRPRLARLCGVCGFFGLWLMSMPLSVEWMGRWLESEPALLAEDMPGLAQRADAIVILGAGRQTNDPAWGDDAPSLLAAERMRYAARLAKTLALPVLISGGLALRSPAQRGGVDGQCLDAGFGGADALAGSFQPYHLGKRHPERPRSCGGAGVRRVVLVTQAWHMQRARWSFERQGFEVIPAPVGFLGGANLRPFGGWLPEAQAFWQSGMLLNEAIGLVGYRLFYX

SEQ ID NO: 22212 - protein, 273 aa, Pseudomonas aeruginosa
RRGWRDARRTAREDAPSAAAEGARSVLQGRQAQQMDAAAVGVEYAETELAQLDHFVALGQVAEGAHHQAAHGIEFLVREFRAEEVVEGVHGGQRLDDEIAAGQRLDVAVLLDVVLVLDITDDLFQHVLDGHQAGHAAVFVDDDSHVVAVGAEFAEQHVEALGFGDEGSRTQQFLDVEGTLVVVQDQWQEVLGQQYAHDVVEAFADHRVARVGGFDDGRKEFLRRLGRADAHHLRARHHDVAHLQVGDLDRPLDDGQRLAVQQLVVVGIAQQLE

SEQ ID NO: 22213 - protein, 401 aa, Pseudomonas aeruginosa
VLFSSRPSASSTRRMVSSDSGRWRRASSHQARNCASEGRSGAALATCRSSSSGIVTALARSLDRPHLALLAALVTLVGFDDTLHQRVADHILGLEVGEADAGDVLQDLDHVLEAGAGAAGQVDLGDVAGDHRGGAEADPGEEHLHLLDCGVLALVEDDEAVVQRAPAHVGQRRDLDDVALDQLGHVFEAEHLVERVVERAQVGVDLLRQVAGKETELLAGLDRRAHQQDAADLLALQGVDGAGHGEIGLAGAGRADAEVDVVVEDRLDVALLVGAARADVRLARFQGDLRRALQFLEVFQAGLLQVQVHGVGSEIGAVLRLAVETLQQAFGNLGPARFAGQFELVAAVADLDVEAFLDLVEMLVELPAKCREAAGVERLEDKAMKFLGGVQGVLSYSPVAD

SEQ ID NO: 22214 - protein, 507 aa, Pseudomonas aeruginosa
PLDIVAQSCRIAAALSRFPLKRWCTVAAGRFSEPAVRSSASMQGAVDQGTAQRVRQRVVDVHLGELADQAWIVAAEVDDPVVLGAPLEHAWVLLREVGDQDPLGAADHAPADLVALLVDAALEDLQALFLHFFRQVVGEVGGGRAGPRAVDEGEGEVEADVLHQLHGLLEVLLGFAGETDDEVGADADVRYRGLQLADTRLVFQHGMVALHRRQHAVGARLHRQVDEFHQLRHLGVGLDQRVGEFQRVRGGIADALDTVDGGDHPQQFGEVGQAAIVGQAAEAVDVLSQQGDFADAVLGQVDHFGDHVVEWSADFLAAGVGHHAEAAVLAAAFHHRDEGGGAIDPRFRQAVEFLDFREGHVDLRLARAARGVDHFRQAVQGLRAEDHVDIGRALTDRGAFLAGHAAADADHQVGILLLQLAPHAELGKHLFLGLLADRAGIEQDDVGLGGVFGHLEGLVFTEQVRHSRRVVLVHLAAVGFDEKLLGHALRRTVRKGPRIIEGGAPGS

SEQ ID NO: 22215 - protein, 293 aa, Pseudomonas aeruginosa
GSRRPSSSSWLSVMAYRPRSFIGWLSVTEVGGQAARHVLAVARTLGVAQGPPGVVEGALHGAVQRFAEGDATGQGAGQGAAGAMVAAGQALAGEGAAAAVAAVQAIVHFAFVAVSAGDQQVLAVFQQALGALVGAALGQVGEQARFRQVRRGDGGARQQPLAHGEADVALAQRTAAAGAQHRIADHRQVRVGGEDLGHRVDHLQRTEHTQLDRRDGQVGEYGVGLGQHPLAVEDAEVADVDGVLHGQRGDRRGGVAALGEQGFDVGLQSGATTGVVTGQAEHYGAGSRCFHGA

SEQ ID NO: 22216 - protein, 811 aa, Pseudomonas aeruginosa
RGRWGSRSVRGALRGIMRHWLILFLLALPCLAGAVSFNEQVERLPLGQSIDVFEDVRGSADINDITSRAIDSSFRRHDKDVLNAGYSRSVFWLRLDLDYRPVASSDPRTWLLELAYPPLDKLDLYLPDGQGGYRLAQRTGDTLPFASRPIRQNNYLFELGLEPNKPQRVYLRLESQGSIQAPLTLWSPKAYLEEQPERIYVLGIIYGVLLVMLIYNLFIFLSVRDTSYLYYILYIASFGLYQVSVNGAGIEYFWPDSPWWANAATPFLIGSAALFGCQFARSFLHTRDHSVWVDRGLLALMAVGALVMLMALTMSYAVALRLATYLALAFTGLIFAAGILAWLRGMRVARYFIIAWTAFLLGGIVNTLMVLGYLPNMFLTMYASQIGSALEVGLLSLALADRINAMKEERARILQESSRKLEALNQELANSNRLKEEFLATVTHELRTPMSGVIGSLELMQTVPMDVELAEYQRTAAGSARDMMRMVNDILALIELQAGKLYPRREPFSLRGLFDSLRAQYAPRAEEKGLRFALQLDDSLPDTLEGDAGKLAQALGYLVDNAIKFTARGSVTLRVAAGRTHDGVALRVEVIDTGIGFDMAAGSDLYQRFVQADSSLTRGYGGLGIGLALCRKLVELLGGELTHESRPGQGSRFLLRLQLTQPAQGLAPPPRRAGGQAVRRPEECTVLVVEDNAINQLVTRGMLLKLGYRVRTADNGSEALELLARERPDGVLLDCQMPVMDGFATCRAIRALPGCAELPVLALTAHSHSGDRERCLAAGMSDYMAKPVKFEELQTLLHDWLLCQPIVTKSA

SEQ ID NO: 22217 - protein, 228 aa, Pseudomonas aeruginosa
SVIHWEKVNPDSVMVYRVTERRLQRDSALRERILQLGLRRVAEGGFAALTMQALADDAGIATGSLYRHFRGKGELAAEIFRRASQREVDALAVVLRGPGAPAWRLAEGLRRFAARAWSSQRLAFALIAEPVDPEVDEQRLRYREAYAALFVELLEEGRRSGAFQLSLVPLAAACLVGAIAEALVGPLSPPARAARDSGQPEPSLEPVSTALVNFCLRAVGAPVCEEPS

SEQ ID NO: 22218 - protein, 273 aa, Pseudomonas aeruginosa
  UNSURE (180): Identity of amino acid at the above locations are unknown.
TRSGKVPATCSAWTCCVPCRRSRGCSTRCSPNWATAMATPVSPRTSATSRRASPTPPTSSTAPASSPRTWRSPCRPSCCWKPATPRCPTPSSAVAWGTAGGSTAPSRAASRSRRCWLAPPRTGLRRVAMQAHPRYRELVEQGFAAASFVGDLGIRPLDCGPGWVEAGLDILAPPRPAERXHPCRDPGDHGGPCRRGRRRDPGGGGADGADPGVQAQPVAPGALPAPVVSRRGAQGRAPGDGGRGRGVRRAGRSAAPVQQGHRDHGGGGAGRMR

SEQ ID NO: 22219 - protein, 540 aa, Pseudomonas aeruginosa
REKSAVFSCRYRQDVFHANRQEAHHEYRFRRRVRRRPHGRGGRRPSCRAAPPGHRGAEPGAQALHQGAHRAKRGRAAELPLPATAHRLPLPGRGAVHHPRLRQGPGAGRIQRHRHPPRRLPQVPAGTVASADGRFHRAGAGRPEPTGHPLSLRGRAGRRAGRLRGDRRRAGAGVPQHRPVRRFRRHRRRPLRMGTRRPVAAGAVRRRAGGLLPAPPGALHRQRLAPRAAVDPADQLPPLRRPVHPPRPDPPARGPALRAHGPAGQRDHRTRDGRRRGQRHRRRGGLAPLPDAGLPPDRRRWRRYHPGQHRGRPVQREEHHRPPGGVASALLADDRPLRRPAAVADHRRLRTGARLHAPRRHPRPRAAAAHPDPGAGRSPGRLAGSRRRSHRRARRVAQATLAHRHRAHLRRPQLGVALGPGAATDQPGAGHRGGHGERHHRRPGLPPAGALRHVAVRLGQAAAQRDQAARLGQRLLRARGEPAPADRHRRPRPVAQPAQLAALAQAAEFRRAAVPLIGRAAVSVRKPRRASTPCGAEALQ

SEQ ID NO: 22220 - protein, 213 aa, Pseudomonas aeruginosa
WPVALRGTAAPSAGRNDHACHRCEPHAVQRPHSSQQPAPSLRPPPGTRCRAGSGSAVADAGKPGRRTVVLGRAGGRGPRRRAGRWLDPGRMAWLGPARAFQRLLARSARQPVECPAAGGAIAFLADPQRRYEGVPLADQYQALSRDVLLEDYLGLRRQLARAGLDDEARERLAGMAARLESWLALGGRGDQACPCGSGKRYRNCCSRLVASAS

SEQ ID NO: 22221 - protein, 199 aa, Pseudomonas aeruginosa
QLKQAADYTACRLFRVMSQVSLRSIAQVLQRQFGTRQHLVEDEAGAHAGDPLDARQGTQQELLVMVHVRHHDLQLVVRVHPGDQAALQHFRAFADDFLEMFEAFRGVSVHAYEDEGGEAQAEFLAVQQGYLADDVAVVLELLDPSRTGRWRQAYPFCQFLVGDACVALEFFEDTQVVAVEFVHGEDFFQVDCHWQGEFE

SEQ ID NO: 22222 - protein, 186 aa, Pseudomonas aeruginosa
QSTSVRQSSAATMTIRPPKAPAGSPVYFAGQSGASMISLPIDAVVPALRQALGAQHQAVLEAPPGAGKTTRVPLALLDEPWLAGQRILMLEPRRLAARAAAERLADELGEKVGETVGYRIRLESRVGPKTRIEVVTEGILARRLQDDPALDGVGLVIFDEFHVLPIARKSSFSCQKLPSFPSQSLS

SEQ ID NO: 22223 - protein, 77 aa, Pseudomonas aeruginosa
GFRKVHRPLASYVGASRQHGLLAHVAVLEGQVFIFHAIRFYLRYTFCSGLLTPDTHLGENARHREVSDDQATPYLYP

SEQ ID NO: 22224 - protein, 217 aa, Pseudomonas aeruginosa
TREIDTKKGYRALDVGRSRAYALIRQLSDHEPVDCLCEVFEVTRSSYYAHRHRRRTPDVERLRLRSRVNELFTRGRSAPGSRTIMAMMQEEGEQIGRFKVRSLMRELALISKQPGSHAYKKATVERPDIPNTLNRAFDVEAPNQVWCGDITYVWAQGKWHYLAVVLDLYARRVVGWALSEKPDGDLVVKALDVAYEQRGKPQGLLFHSDQGSQYGSR

SEQ ID NO: 22225 - protein, 89 aa, Pseudomonas aeruginosa
FRQRLWRYRMRQSMSRRGNCWDNAPMERVFRSLKSEWIPTTGYLTGQQAQRDIGQYLMGHYNWIRPHQFNDGLAPAKAEEKLKTVSGMS

SEQ ID NO: 22226 - protein, 127 aa, Pseudomonas aeruginosa
HVNEGFAHVYIADEERFVEQLFFISSIKVAERATAAGPYGVEMLLGMFTYSSGYRYQVYFEVSPTQVKRESLIKFAVEEDFVRVIPNATFCSMQLLCRFLDCGSVPSAPSKFWVILLLEFNVPLVGK

SEQ ID NO: 22227 - protein, 83 aa, Pseudomonas aeruginosa
LHTSERLRSCSEHPRWLYWLSMRMRKGVNVLQRAGGEGGFGASMVMAGKGDFSQSLELELTVNHRRTPIELGPGFPGGRGCQS

SEQ ID NO: 22228 - protein, 292 aa, Pseudomonas aeruginosa
RKGSRFFEREGTACRARYLASRAYRPKVVLVKRRLFPASVGRWRCVSPGPVRHWAILDLDQAALDSLVQHLRDHLGGEALGLRCDVSDADAVERAVALAVERFGGIDVLVNNAGITHRGTFAETGLGVFRKVMAVNFFGAVHCTRAALPSLLERRGQIVVLGSLTGFAPLLYRSAYNASKHALHGLFDTLRMELEGTGVSVTLACPGFTATDLRKNALVGDGSVTRQPVQVLGSQVASPVEVAEAIFQGAARRRRLLVLSNVNWRARLLARFFPRLFEKLLVPRLSGLKPQP

SEQ ID NO: 22229 - protein, 290 aa, Pseudomonas aeruginosa
RCSVGVVVGVETLAHVPVGGLDLVPVEVADETPVVGLAVQRTRARRALVACAGGQGRGVEGVDLGLAVGEEADVAAVADAGGTAVDRRLHPELRIELAVGYGAGVFEDHLAAEGGHHRVVEGSGTGKVVGADGQVGNAAGVGRFVAHGPFLEAGLVKHRPARRIGARRRSHPVAWRRTEAVDAEGDDGQQQLEEPAERMQGDPQHDGVAGRIGEPGFQAPDRQQDHQRTGEDQEESPTGELEAFPQRLQRTTAAQHQAEFGEGQLHHDEDARQDQQRQAEHDQQRSQRRE

SEQ ID NO: 22230 - protein, 263 aa, Pseudomonas aeruginosa
DRAGCSNISLWCNPSFLLEMQSRRAMKSDEKTLIDGLFSRLREAEGQSAPRDAEAEAQINQHLVRQPAAPYYMAQVVLIQEAALKRLDQRVKELEAQVAQLQQSRPSSGGFLSGLFGGGARDEPAPSQSGRPAGWGETRFSNPAAAAGDMRPGMAPAAAAAPSRASGFLGGALQTAAGVAGGMLVADLLTGMFRHSQPQEIVEVIQDVPVDNLDASQFADPEPAPERFADSDYPADGGFADGDFSDSDFNDDSSFLGDDDLFT

SEQ ID NO: 22231 - protein, 299 aa, Pseudomonas aeruginosa
  UNSURE (94),(163),(195),(206): Identity of amino acid at the above locations are unknown.
RKRKVFRPPEEGGDSLSGIWGVGGMDYTRLPGEESFRSPAIFLVVINLRSGEFLLDGHSRGISRHWRTAVVFCSNGTNITRPHQAFGWLKAVYXTTADLVAAGQRVVYLLHQHVGHLGIFVSAGVARREHRAILHHAESIQALKPGLYEMVLEDSASSESAAXAQFQPRRLEDLPYDANPAGFDKVEALSEITEXFYSQWVSPWVXFAVTPDSARELRALHPMRVSRKVWSEQVTPALALLPWVQRWLEQWSAQDPHRVENPWYQLERTGADAIGQAMESWRKSRDLWAELVFEQAYAN

SEQ ID NO: 22232 - protein, 165 aa, Pseudomonas aeruginosa
TLPPGHLPDRPLSRSPRAPALPADPLGSGDHRAADAGKLSVALPQCRGNRGGLRPLRLRLHPGARPAARRRRPGLAAGTPAEPGAGNRKPHGIAASQATSARSQAARRSASPALAAGSECGKMKAKPPAVERRGRMSKSARPSQHNRQPRCGRDSGSSACSRPPK

SEQ ID NO: 22233 - protein, 187 aa, Pseudomonas aeruginosa
CSRRPASSTTWSACGRAPSRAAPSTSRKSDAGMRLRLIAVGSRMPRWVEEGWQEYVKRLPAELSLELVEIPLNTRGKNADVARLIRQEGEAMLARVQPGERVVTLEVEGRPWSTEQLARELDRWRLDARTVNLMVGGPEGLAPEVCARSEQRWSLSPLTLPHPLVRILVGEQIYRAWTVLSGHPYHK

SEQ ID NO: 22234 - protein, 650 aa, Pseudomonas aeruginosa
SPVPMPQPIHLKDHEKDARLVRRRVIVGAVAVVLLTLVLVARMYHLQVTQYEYHSTLSENNRVHVQPIPPTRGIIFDRNGVIIADNRPSFSLTITRERTEDLQKTLDTLVEILALTGDDRAFLERRRKPGGGPFEPVPIMFEFKGEQIARIAVNPFRLPGVDVATQFVRHYPLKEHFAHSVGYVGRINEQELKNLDPINYSGTHHIGKTGIERFYESELHGTVGYEEVETNARGRVLRVLKRTDPIPGKDIVLSIDSRLQEAAENALAGRRGAIVAIQPSTGDVLAMVSQPSYDPNLFVTGISFKAYAELRDSIDRPLYNRVLRGLYPPGSTVKPAVALAGLDAGVVTPTSRVFDPGYYQLPNYDHKYRNWNRYGDGWVSLESAIYRSNDTYFYDLAHKLGIDRLHAFMSRFGFGQKVALDMFGEADGLMPSREWKRKTRRQVWYPGETLILGIGQGYMQATPIQLAQMTALLANKGHWIRPHLAKTIDGQPPVDPDPMPDIVLRDPANWDRVDYGMQQVVHGARGTARKVGATSAYLIAGKSGTAQVVAIKQNERYDRSKLLERHRDHALFVGFAPANNPQIAVAVMVENGESGSGVAAPVVKQVMDAWLLDEHGKLKAEYAEPVAPLAAAVAKPEPTAAEPEAPALEQ

SEQ ID NO: 22235 - protein, 397 aa, Pseudomonas aeruginosa
LWRNFAGYPVVRVRGSDVDPYPSEVDRPGLRPRVKNAMQVLRTWAARGVQWVGVAGVIGLSGAAQAGDYDGSPQVAEFVSEMTRDYGFAGEQLMGLFRDVNRKQSILDAISRPAERVKQWKEYRPIFISDARISRGVDFWNKHAEDLVRAEKEYGVPAEIIVSIIGVETFFGRNTGSYRVMDALSTLGFDYPPRADFFRKELREFLLLAREQQVDPLSLTGSYAGAMGLPQFMPSSFRAYAVDFDGDGHINIWSDPTDAIGSVASYFKQHGWVTGEPVVSVAEINDESAESAVTRGVDPTMSLGELRARGWRTHDALRDDQKVTAMRFVGDKGIEYWVGLPNFYVITRYNRSAMYAMAVYQLAGGDAPRARCPLSKRVPLFPDPARRLPPPGWRPCC

SEQ ID NO: 22236 - protein, 318 aa, Pseudomonas aeruginosa
AVAPARRPSSRPGQAGISGRGDYSRPHRDGAPWWDVDVSRIPDAVPMPHNGSVKANPYTVLGKTYYPMNDARAYRMVGTASWYGTKFHGQATANGETYDLYGMTAAHKTLPLPSYVRVTNLDNGKSVIVRVNDRGPFYSDRVIDLSFAAAKKLGYAETGTARVKVEGIDPVQWWAQRGRPAPMVLAQPKQAVAQAAPAAAQTQAVAMAQPIETYTPPPAQHAAAVLPVQIDSKKNASLPADGLYLQVGAFANPDAAELLKAKLSGVTAAPVFISSVVRNQQILHRVRLGPIGSADEVSRTQDSIRVANLGQPTLVRPD

SEQ ID NO: 22237 - protein, 157 aa, Pseudomonas aeruginosa
SWTTRSSAAPTWSPSTPSRRVVSSAACGIASACSSTVCSTDRPAPARSRGQRAPVPADHGSAAAMTDTPDVQPPKIEFPCERYPIKVIGDAGEGFSDLVVEIIQRHAPDLDVETLVVRDSSKGRFLSVQVLITATDVDQLQAIHNDLRATGRVHMVL

SEQ ID NO: 22238 - protein, 403 aa, Pseudomonas aeruginosa
RKKPPSYGRLRGGSCLCLSSPVPGGCGTVAGRPGIWPCSAACFSLPWHRSSKVIGLALASARIICLSPRIVQCRLRLQAAGRPRRWPARLRARSERPLQGLPGACPLICASINWASLSIWFQRLLEWRCRARVSSGRRLSQTGGRAWAKAFSSGMPWPYCWDRPASRRISRARPQRITGGSMPSPRSPSRMRRAWAASPPRAASIRPKTSKRALSATAACTVAASIWLPSASSLSFSISWAAASRLPSTRAAISSRASGLADRPAWDRRWRIHCGNWWTSTGQTWMNCAALPSIRALAHLVFCVLPSSLGRLSRSTVSSGGRCRYSWRIAAPLSPGLPEGRRSSIRRFSANSDRLAPASSSKPQSKLASALNTWRSPKSRSRQAWRMASQASWQSSGSSPLTT

SEQ ID NO: 22239 - protein, 1106 aa, Pseudomonas aeruginosa
TGARGPWRCLASCAGVSFIGEDGAGETGPGASRGGELDRRLLRLGGAALALRLVGGAQGFGFRLGLGFCLALGFVELRRGQRLEAHGQLLDQVAPHLAAQLRGFLVGTDQVVFVVHVDLLHLYLVAHQDQVVGADDLVVDRVGQLELRAARGTGVADGALLVVLADQHQVVGRVAGDLHAAVFQGFLQFAHGRAVGVARGHVDFLERELRIAQAAQLEAAGGQQGGHTDQRGAGQDTFHQASLTPVDQRPRMAGGVQWNRVSVGDDVDQFARYHDDLADAQAFGETQHVLVGARGGLDILAAGAGGHVDVSAQLAVDLHHQLQGVLHQCALVDARPARIDHRFGMAELAPEHVADVRSDGRQQQNHGFQAFLDQGAVLGVLVRRLLQHVHQGHHRGDGGVELVVLADILAGLPDRQVDGAADLLLRVAQGGDVQRAGEAGADVGVSQAPDAAEEAVGALDAGVRPLQAHVRRRGEHHEQAAGIGTVLVDHRLRVDAVVLRLRHLLGAADLDRLAVALQARADDLGLGVTLDLDVGRVEPVLAAVGGGPVVGIGDHHALGQQVLERFVAADQAFVAHQLVEEARIEQVQDGVLDAADVLVDRQPVVGRLPVQHAAFELRAGVAGEIPGRLDEGVHGVGFAFGRLAAFRAVAFVEFRHLRQRRTGAVRYHVFRQHHRQLVGRHRDVAASLAVDDRDRAAPVALAADAPVAQAELGACLAQALGLEVGADGVEGGLVAEVVVLAGVDGEHGLVLGAVPLLPDAGLEVVVALDLGDHLADRQAVLVGELEVALVMAGHRHHRAFAVVHQHVVGDPYRQLVAGQRVFDEQGSGHAFLLLGGDVGLGDAAALAFVDERLQLRVVLRCLGGQRVFGGDGDVGGAHQGVRTGGEHLQLAGVADGGLVVGEADLHPARLADPVALHGLHLLRPAGQVVEALQQFLGVGGDLEVVHRDLALLDQRAGAPAAPVDHLLVGEYGLVDRIPIDRAVLAVDHPFFEQAGEQPLLPAVVVRLAGGDLAAPVDRQAEAVQLRLHVGDVVVGPGRRGDVVLHRGVFRRHAERVPAHRLQHVAALHAVVAADHVADGVVAHVAHVQLAARIREHRQAVELLLVG

SEQ ID NO: 22240 - protein, 61 aa, Pseudomonas aeruginosa
SAAGWHYGAPPSEAALMANALMQDLGVPTRWQEVFSRTTWENATLSAPAVAGGPACAGWCW

SEQ ID NO: 22241 - protein, 637 aa, Pseudomonas aeruginosa
QQHAGQPGQRPDAVLQIGRQALHGNHLAAQDALLELRDLPDDSAIGIDQTGDAVVGRADHPATAFQGAHLRHLQVLQRAYGSAEPGVVAHCQQHLALRRERGSELRVDHFVADVRGDLVALGLEQRLVGRAASEVGHRQVEEGDQAAQQVLQRHVLAERHQLLLEVGARAFADHGDAVEVATLAVGETFAHRDPGDQRGVLLVGDLAHGAEVAAGHVLENRHRGFRPDDQVDVLLRQAQVAVEVELRADLIRVPFQLLGDVALDRHYPQRFAGRMGPGVALEIEAGRPRAEQQDQPQKQAGTVREEARQVHQQGRAEGDDEGGQPYATHRHQPGQRSLQLAIAGVEPGETGKEPTAEQLQCQPQGGERQGVAQRRVVAAQAARPQPGRQGEEEGDAGGEAEHEEACQRHRGGAVVMDTDVDPAGAGAERAETVPPAAPQGGLAGKAAQAEIEQGDREDRQRPVIEGRQGQGCERACGECQQVSGPAGTRNPTHRMSLEPVQCPTAQTGAAFGCRTATSAATGESGARRKSKGGAGETPEGRRGKMPPPPRRRGRAQFCRGDRRSRWTRRLSALSTRKRNSPSSTTSLRLGRWPKALITRPPTVSNSSSENSEPKKSLKASTGVSALTMKSPLGSGLM

SEQ ID NO: 22242 - protein, 245 aa, Pseudomonas aeruginosa
REWAASMMAGRNSFGVWVERMLIICERGTMMSRTCRSATWIAPSTMDSASLSSSLLSWASRSSSSSSWRFLGSWAKAWVILSSQDLCPLLDRSSLIFPCSVALRRRRRTDRDDPVPPAIHVPVFPFLPLRRRRCGRSRAGAGSRGSPGGPSGPATACAVPGLRGRPPGRRSPGRRAAGYREARPGHRRGRTARWSRSPCAGRCCSVPGLRPRPPGGWSAPTPDAGAGPVRTRRGTALRRAGPGRR

SEQ ID NO: 22243 - protein, 89 aa, Pseudomonas aeruginosa
RRRQSAVRSGSCGRSAPAPGWRCPVRRGSSARLPGRRCPGRPRRRSPLPSSARCRPVRCSPEPLRHGRTWCRGGTGPGHGPVARLSRTS

SEQ ID NO: 22244 - protein, 387 aa, Pseudomonas aeruginosa
HQVEEALEAFDVAGHHVLEGDDGVGAAEVQAEHAARLGGDEGDAGGIRALLQAVEHARGVGGQFVVETGAADQAHGGQAGGHCQRVARERAGLVDRAQRGNLLHDLALAAEGAHRHAAADDLAEGRQVRGDPVVGLGAAEGDTEAGHHFVEDQHHAVFVAGFAQAFEEARRRRHTVHVAGNRLDDDAGDLLADFAQGLAHRLDVVERQGQGVLGEGRRNARGVRHAEGQGAGAGLHQQAVGVTVVAAFELDDAVAPGVAAGQADGAHGRLGAGADHAHHLHRRHHGADQVGHFHFQRGRRAIGQAVVELPAHRVEHVRMAVAEDHRAPGADIVHVALVVLVQYIGAFGVLEEQRGAADALEGAHRGVDPAGNVFLGVVEQRFGTGHG

SEQ ID NO: 22245 - protein, 190 aa, Pseudomonas aeruginosa
LPGRRWQVKVRRLPSRLYRRLCTSLSSPCPPVINRCSQCSSRRSAHWSALPSGRSASRRASGRFGVAMVARGSSRSRMAKPTSPLPNAPPPPARSTGSQTTGKCGWAARISATVSTISSEPSIPSLTAATGRSASTALAWASTHSRSRTRKSLTLTVSCTVSAVTAGAAWQPWASRASMSACSPAPPLGS

SEQ ID NO: 22246 - protein, 147 aa, Pseudomonas aeruginosa
ASTSRSSACRWGSPSTCSRTCAVAPISTTSPRGPSTAASAAMTRTCSMPAIRARCSGCAWTWTTGRSPPAIRAPGCWSWPIRRWTSSTSTCPMARAATASPSAPATHCRSPVGRSGRTTTCSNSASSRTSRSVSTCGWKARGRSRRR

SEQ ID NO: 22247 - protein, 475 aa, Pseudomonas aeruginosa
PRPLRQPRRPGGVPSRLPRADARRHRARTALAALDRPAPRRPGGAGRAVLPAQPGGGRHRLPVDHDLRQRAGDSPAGGPGREMAAEDPLPRVRPAQRADGAEGGRHHRHGDDREAGRHRRPGQYHAGLPGGDSRAGAGLRTGRAQVVLLGADVRRLPHPGLHRQGPDLLSAAAPPAGRQPQPVLHPAPEGQAGQLVERLQRNRVSRRPGLDGRRRGPWRADHHRDGRHDPLRLHDRLQRTDASGVDPGRPPLCLPQGRRAGAGRATADAERARRPGPGKRGGAGPDPAHGACPGPWPRRAGGEVRPPGHRGGQVLDLQACPGDDQRSLRMHGRCRLRRGNHPAAAVPRGPGELDLGRFRQRAVPGRAACPVEGAGGARRVVRRTGRRPWRRPSRRAHRQPQGGLRRHRRHPVPRPPAHRGRGDRPAGQAVAGSRQLRGVRRLHRQSPGGRRAGLRHPPARRRGRGAVGSRHPALA

SEQ ID NO: 22248 - protein, 147 aa, Pseudomonas aeruginosa
  UNSURE (55): Identity of amino acid at the above locations are unknown.
GASRCRRIRATGSWSSRASPRPVSSATSASVRWTAGRVGSKRGWTSWPRHAQQKXFIHAGIQETMADHAAGAAAATLVEEGQTVLTLEFKLNLLRPALCQRLLCRAEVLKAGRQVTVVEAEVFAERDGRRHLFSKATVTMAVVALAE

SEQ ID NO: 22249 - protein, 517 aa, Pseudomonas aeruginosa
DNGRKALCFPVGTGKMFSMRTDRKPTMSIDSDDGFVVARTAEEAVDRLAELHRQATAALSQALKRYIKERIEPSEAERQNFHYPQLRIGYRCQGEVPSTTRAYAKVQVPGEYSVTVTHPDAFRKYLLEQLRPLMDDFTVQVQVGPSQQDIPYPYVVEQGDELAGSGVTAAELARVFPSTDLSAASDDIADGLYEWERADQLPLALFDAARVDFSLRRLVHYTGSDWRHVQPWILLTNYHRYVDQFIRLGLTRLREDPRFVRMVLPGNVIIERGMDEGEANAIVAGVVWHRYQMPAYHLIAADGDGITLVNIGVGPSNAKNITDHLAVLRPHCWLMIGHCGGLRQSQTIGDYVLAHAYMRRDGILDRALPPHIPIPALAEVQVALQEAAAEVTGERGESLKRRLRTGTVLTYDDRNWELRWAQERPLINLARAIAVDMESGTIAAQGYRLRVPYGTLLCVSDKPLHSEIKLPGSANAFYERAVNQHLRIGIAALDLLRSQLNSLHSRKLRSFDEPPFR

SEQ ID NO: 22250 - protein, 303 aa, Pseudomonas aeruginosa
AVANSAEPGQLPQKGGRRASLFLCPRSGPCRAFTHSLPGVYPPLAENGGKSFPGSFERGRATRPGARQTMNGGWWRMLGVGALSLSLCVQAQADDGRGGRGGPGGERGVAHGQPGPGRGEAYGGSWGPHPDWRPGRVVEALPRGHLRVPYRGGEYFFDDGYWYRHDGPRYVLVVPPRGVRVRSLPPYAEQVWLGSVLYFLAAGTYYLWHADTREYEVVSPPPQAAGPGYPVSVPATGYDVVAYPARGQGPDQQSRDRYECHRWAVGESGFDPAGATYAPAAEVANGYRRAMAACLSGRGYSVN

SEQ ID NO: 22251 - protein, 406 aa, Pseudomonas aeruginosa
VPHIIRARRSKVSENGEVERDDLELLRADLSKRLNGFNSNYPDVSVYELRSSRLSREEFPVPEMLLLMLRNVLGWRWSGTGEKIRWTVYGSFNGEPLSIELGKFGLTMRSSPVLDESRRRIEGQLKSAVNLVEQFIKPMIDNQITNGELTIGNHLTEFMSRYEFFRDKADKAFRRADRKAREKPKESGEFPEGIISALMHGYSRSMSDQQEGFYYSVAMVDAYFSALEHRLNLLRAFTGVPLPAEGFKAFMSKTWNEKVDELLGENPSPRARKALQGMRDIKERIRNPFAHGGYENDKGALHVHIPTIGAIPGNITKFGKSARFSFIPVGVNDHKLNCTVFDEVDKLLSTDQLAAPYRLMVAGIDPSFNEKSLCSYRDAISGGDKALERFIDRWHHMWERHANMDY

SEQ ID NO: 22252 - protein, 112 aa, Pseudomonas aeruginosa
ARMLATERCPMTKQRRTFTPEFKREAACLVLDQGYSHAEAARSLGLVESALRRWVNQLQQERGGVTPASKALTPEQQKIQELEARITRLEREKSILKKATALLMSEDLERTR

SEQ ID NO: 22253 - protein, 420 aa, Pseudomonas aeruginosa
PTFNDGLASCAWSCGAASRANASSASRGVVVRRGMVCGLAVFCCYEWGRSMRRAGPLVQPGARPVNGAAGSARRAAGGWRSAAYRCAGPGHRDGSARGCGTGSRGPIRPLDPWVVGEVRVPANLVDATGLFQRRHHREAPAQDAQFAVFPVGRAQRRQQVGILAGRQQVEVAAEQPGRAPGLQFVEQRTGGLDLALEGVVVRLRAVEAGVEHGQLAAAVDRQVADQDRRARPEQAVEQPAIAWRQLAPLGAIDAIAAQGGLLAADAAEDVRRRHEGRLPLVGLGAAMVEIVDALLDQRQLVLIVGGAGAVVDLLEQDQVRLLVADHPDHLVEGERQVFGGGALVRAGGIRQVVPEDVAFAGQVLDVPGHHLQGLPRLQRRRGALAMQGRGFAIGGLPAQQVAGEQGTADQQEQADEQQVA

SEQ ID NO: 22254 - protein, 144 aa, Pseudomonas aeruginosa
MRKATMVNSSWKNPLSACRATRSTTASPAESASQASRLQTGSRITSEQARIRKNRPRVNSKLSRSACSGLRPRSTRQNSAKDSFTMTKMPGRISSDRPSTISSEVSAASSAKAGHRRSAALHSWPTRGRSSRPRASMNRIRAAV

SEQ ID NO: 22255 - protein, 460 aa, Pseudomonas aeruginosa
NAVRFLFSESLMTFASLGLLAPLLKALEGLGHGTPTPIQAQAIPPALKGRDLLAAAQTGTGKTAGFALPLLQRLTLEGPQVAANSVRALVLVPTRELAEQVHGSVRDYGQHLPLRTAVAYGGVSINPQMMKLRKGVDILVATPGRLLDLYRQNAVKFAQLQALVLDEADRMLDLGFARELDELFAALPRKRQTLLFSATFSDAIRTLARELLRDPLSIEVSPRNTAAKSVRQWLVPVDKKRKAELFCHLLQANRWRQALVFAKTRKSVEELVGLLQRQGIAADSIHGDKPQPARLRALQRFKAGEVDLLVATDVAARGLDIEEMPLVVNFDLPIVAEDYVHRIGRTGRAGASGQAVSLVCADEVELLAAIETLIGQTLQRREEPDFEPEHRVPQTAPGGVVLKKPKKPKKPKAAESVGKPGKIHLGSWFDSSAPTVKAVRKAPGFGAGAAGKPKKRPSGK

SEQ ID NO: 22256 - protein, 729 aa, Pseudomonas aeruginosa
PRPLADTVLLFQSGTRLARTTRSFPATGQRNREMADSFRSRPCLSPLNSVFLIHTCLTATPPHHRTFVMKTSCDRPFARRRRGRTGIHPRIDQRLGSSPKKRPSVGRAWRVSCLRGGALQDQVAALFIGQLAARLFAEGSGAEHLHGAVRVVARRTTGAVARRLQALVAEPEHLHRDHRRHALPRGGLLLATDVLRRLGRGTRRGAGGGQRPGIHRSHQRNAAGLALGLDVRRVDHLQRRHVDVAGNPDARLAGIDGAERGDQVDVARCHFGNRVEGGDTGAGAGHLWRQADVAPGVVDAPRRGVDHGGLGTATGVDVAFRRPGQYAAAEGGHDAALAEQDAVPRVGLDIALALGDDTCGGRRRLALDTEHLAPAGAEQLDVAAEVGVHAGTAIHDDIAFVADRIARRIALGEQRGDRVAPTQVATLAYPADFVVLAAAGPEFGEVHLAGEDPLLLGGQAGEERLGLFRVAGEAEALVQPLGQLAFVGPDHLARLLGQRGAGLRQVGRIQVALEEGLIVGPRRAGLEHDIGTRPAVARHHRAETGDRCAVLHEDVAPGADLQGTGAGDVEVAVEDVAAGLDQREVVGVVVDEEVAGERGIRTDLTGSADTLSQWGSGGNDVAPGAHPDGTRTFIPGLPGAVPRLLAETNLRTAIEPDDISCQRIETRRLQIARQARSAIGAEVEQRQSANDGRIPVRTAVARYRVEQRGIGVAGKCRRPDRWQVRRIGT

SEQ ID NO: 22257 - protein, 554 aa, Pseudomonas aeruginosa
EHFVIRATGAQYRPIEQTARLIESRRDIGGLRSGGIDAVRRPLRKVTGTGQVKIASAGAQHTEQLVLRCDHGFAEILDTQGRIDTAPPQIALADRRTSRHAQVIAGRPGPAGRLGTIRPQPADPFIALVDRSSRGDPPVGSLIGEHQPSRALFDLRLIVRIGQVQAGRGVRTHQTVVGSREIGTGDQAHGPGLATGRQHLGQCPVASLADTVAGPQLDERRIASQYHLGLRRDQRTTCQGQLSIEQQDIGSAGPLAQDARQGHARRPGHRLHAGRCRQQGTGTQPAADLQRHPVAQQAARGVQQVAGGIVDVRYQHAAGGQGIGLFEYCLGGQTGAGGQGGALDRQVVVEGAAAEERGTVAEHHARAGNHQVAAERLHPRGEDPALVVRRVRRRREAVVDTAVEVQVTAGAQHQRADLAGTVDLGQRRVRIEAGVAVAGQIEIALHHQVAVRRCADDLHPWTQVESIRVGGIGQSGQLAVEQLAVGQRRGDERAALGMPRIEVSLVDHLVGPPGRPPDRCPRAHRRNAAPRSGRCCRRRGCPARRWHRWRCRRR

SEQ ID NO: 22258 - protein, 160 aa, Pseudomonas aeruginosa
ANVSLSSGASSRLLHKPLASSRTPSPTRKMPSSRPASTKPSIVPFGEICANTLPACRLPPWAVMSASIATSLANRIASPPLARVSAPSTRMLSPAATFRPPSWKPLSSSLSRLRRPWRSAATGASRVGSSAAASPAPMTTCLRLPASAPRAYSSRPLLFT

SEQ ID NO: 22259 - protein, 711 aa, Pseudomonas aeruginosa
RRRLAQRYRAQRPRARAQVVGGLRDALLRRRQHRSLHVADAPVVARLHALLGAADEVVAVEGDAAAGGGVADDVGTQEDHQVGLGPRALLVAEQRTDAGEAGESGNTVGVVLHVVLQQAAEDHDLAVVEEDAGIDRALVSDHPGGGAGALVDAADLLVDVELDRAALGDLRTDVQLQADVLALDGLERVVAGTAAVGDVLAADEGYGLADHDARRLVVQGQQVRGRQDVGAAAALQRPGEHLEVEDLADPGDVHGAIHQADVEPLGQHVDGVLAGRVQRRLAEVDPAEHAVAAEVAGLPLDAELAGVVFADLDDQAFDHHLGAALVEQVDDFAEVAVQRLGCGNQQGVGGGVGLYGDPAGGERRVLLAHRTGSGAALAAAHRTIGAAAAVAAAQPAGTAARGIAAGSQALATSTAVAATEHAAAAQARALLVALVALAAAVAGDQPAQGLGQAGRLGVAQVDHMEVAGIALHAVQLADQVARQLRALGARRADHDAVGAWVGEHHGLLALLGAAAALAVEQFGDGAGDVHRDAVLDRHHVGVAGAGDVDAGDDPGDPVEVFRVVGDHHGVVPRIGIDRVVLRDDRAQHRDQVHRVLVAQAEGPRDHAVGRRPVGAVDRPAEQLGVGLRHHLADPVDVDHAEALHAQGAGEHAVGGARRHLAFGNQGQLALHPRVDQELPAGGARQRAHHRFHLGIDEIQADRLLAEFGRCR

SEQ ID NO: 22260 - protein, 272 aa, Pseudomonas aeruginosa
SIPPVAPLPHRKAPRTSVERRPRRWAAERRRPRPGPRRESAPATDSPRTAGRRGSPARRRTGPGGADRYGAWPAWRALLAYGRRAPRTAPRHQPSAEFSPLCFTRRSSSSGTLETSLFAERHPVRRPRQGGFTLIELMVVLVIVGIATAAISLSARPDPTGLLRQDAARLARLLEIAQGEARVRGTPILWQPSAKGYRFSPQAYRGKTDAFAADTELRARDWQAAPLRVSVRPPRPVLLDAEWIGAPLRITLSDGQHSVTVLREANGHVRVR

SEQ ID NO: 22261 - protein, 223 aa, Pseudomonas aeruginosa
TRDDAAPANRLHPDRGDGRDHAHGHRQPDGLARPGQHRPGQRAPGGQHRAGRRATARAEPTGARHRPAQRHPGGDRPAQRRRADPGRRQPAARTRTEAPERDPIAPGHRPRQYRARRAAAARALVATGQGPLPRRLAQRRPPAVAAAGGAGGCAGRRESVRDPCLGAGKRLGAPAGTQQSPRQRTGDQPGAGHPQRRGALSTGGGPAMKRWLSRAAPPRPAGG

SEQ ID NO: 22262 - protein, 126 aa, Pseudomonas aeruginosa
HVFTDCRISGKPPSQRGRIAMHRSSQVLPALILGLAMNATLADEPTPPANCINTEVNGYQALSYECLSQQMADPDSAARARREQELDSAAIVRRPPNQLGLYNQSATRIRLGTSFGNSVEAQRPPR

SEQ ID NO: 22263 - protein, 606 aa, Pseudomonas aeruginosa
PRRNVVSSWSAPPTYLIRRPGWPPRSTCATWSCCRPADATPCGLPNSACARAVAPQCCAGRSRPTTAPCAASRSPPKAVRPWVSPIAPCAKRSILRRQRYACASKPAPHACASSSAGAASRRRPPCRPAPGNEAAMLWACILLPQLAMDSALRQRSNPDAPLALLGGPAQRRQLQAVNPAARALGLKPGQSLIAAQALSRDFATAEYDLAAVERWQAFLAAWAYGFSSQVSLHYPRALLLEVQSSLALFGPWPRFEARLRKELTALGFRHRLCLAPNPVAARVLANSHDGLAIEDETALQRQLSALPLDRLGLSRELAVALGRMGLRHLRQVLELPRAALARRFPAELLLHIDRLCGRSPLALEHYRPPDTFDLRIELNFDVESHQALLFPLRRLSADLAAFLAGRDSGVQRFTLHLEHHGRADSQVTVGLLSAEREAAMLFELTRGRLEQLQLPAPVHAVRLEARELPPFTPQHRELFDERPQQYLGWEQLRERLRARLGDEAVQGLSAVAEHRPERSWRPHSCDRAQSPAACGLRPGWLLAEPRPLGEALPTVLAGPERIESGWWDGEDIRRDYYLVETRSGQRAWVYREVGSEGPLWLHGWFA

SEQ ID NO: 22264 - protein, 292 aa, Pseudomonas aeruginosa
IPRRQLRPAHLRQQLAETSRAGGLRLRLDQQLADGLLQPRPVAPGRPPPHPADTPGGCPPQRLGLQPGAVRPGATGHTPRPADDPRLSRGGCQAYRAGPGGPAVPRRARSRPTRQARRPGPGVAGRCRRPARSRRTPAQGALGRRQRRAAIATVRRRDRHRRNHGQPAAAFARRGTAERLRSPRHHPRPASAETLAWTAQGLPLPRLPRTGETGTWTTDTGRRPGGRPAAPTDRQRHYLHHPGGRVRHAQRGGPARPRRTAEAAIPRVPAAAGGGHPGVLRRGAPRHRRAPA

SEQ ID NO: 22265 - protein, 629 aa, Pseudomonas aeruginosa
SPRLAGWYRPRPACGTASRPATRHWRWPGPAGPGRSAMSAISDTCGVTPGSASEARLHAEMQARVVFVGVRPFQQREGPVEAAGQPVGELRAGADADAGQAEVVVLFGQRILQAQLRALGEHVEAPVVDVAAGALAEEASEGRRTPFLGEQIAVVGGVLRRQVATHAGGTAGGELFVGNQRPGGELEGRLGRHLPVAAEGQGVVEIALEHAEAGLGAITLAVEFLVVVAVAEETAGTGHQAQAKGQLGTFGVAETVVAEGQRGVLDRHPVVVAADPDLFLEVLEVDAEGERVRPEAGHRQAVDRRHAIGMALADHIHAAHRGHVAVGLVAGQLHAPALAQRRGIGAGPDLGVVLVLRRGEIGQRDGVAELPEVVVAQRNHRAQVTGVGAVVVVQADAGVPGILVFHLQVDVHGAGPLALAHHRQHLAAGGAVDLRQLALDLGEVGHLALLQGRHFLAQLHRRIVLGADHPDATDSGLGDLQVDHPAAHLLLRQLDVDRLVALLLVGGLQRIARPLDVAQAALRSEEGIHRRLDGAVVQHGVAAYHVLVDVHQTLGLGSRRGGRGLVGQRSARQCDSQATDRPALAKRVRTIEQRTLHTVPRSSIGTYCSNATSPFIEQFCERQQTSGDA

SEQ ID NO: 22266 - protein, 309 aa, Pseudomonas aeruginosa
RDRAIQADLAGAEGQLGTKPGGAAVEGHRGSARRSRQAEATATADPTQRTGLAGQQRRAQAQVAAAVVQAFAGDVAVQALVDPQAALVVGADPLAGVQLHLGEAQRQARLVGLAGRLGIRAVAQGDALGVHPQGSAAATGAAGDRCRSRLAGAAPDQAGGANAGDILAGAMAVDGRGAQHQVGQAGFAGGRVVGVEADATVHVDRVAGAENQVFQGRNTRPALAAQQALEHRLVQRQAVRQHAASGRVGQRLAGADIDRTQRQAEIACPVTNVVAKRHRTIGGDTQSALRIEFGVGAARPFRTTSETNR

SEQ ID NO: 22267 - protein, 285 aa, Pseudomonas aeruginosa
SVRDRAGRWRAPDRPRPANRAPAPASGWRDRAARGYCRRRLPAGTGPPLRVGSSVRPRHPPGTAAVSRPPAPLAAPRQPRPRRPRWRNGRPAARPAPGHPRLPSIRSDRPPGSWRSPAGRNLRPVAGCHPRGRRRRSAPCRSAATACRRRSCRDHSMCRPTAIGHRWPAPARHWRARRCRRRDRPVACRRPAAPPRTTRRADCPVPGSGRRRCAGKSVRRRGRPTYRCPPAPAAGCSTSRWHPAVRRRPRARCRLRGRHRRNHRSSRSEKSAPTRCRPAGCRHGR

SEQ ID NO: 22268 - protein, 155 aa, Pseudomonas aeruginosa
GCRHRRRERTPAGRCSSRSRGCSARRPTVRRAPRHSATGCSRPGRPVALRSAARRGRCRRPPGRRAAHWRCRSPDCRRRGRRCSRSRSAGSARSADCRNNGSGPSARCVPRSRGRCRRRAGRPAPTRVRRGVRPSPSARSGGCSRPAHRGFRRTG

SEQ ID NO: 22269 - protein, 137 aa, Pseudomonas aeruginosa
GSAGTPAACAAPRPARHLREPARWPPPPPARGSRWPASGAPHRARAAAVRQRCRGSPGWRRSARYSPRARSVRAEAGAALAGASRAAPAGRAGTSASPSKRYRWRRRRASPRRARSRWPGASPGSAPAGPGAPGRRR

SEQ ID NO: 22270 - protein, 656 aa, Pseudomonas aeruginosa
GSCRAGRCVPRCSRPGAPSPGPGRRTPRPQPPAPGRFPGSPAAVRQGRRPGACRRARRCARRSGSGRCACARPGRGWRSAPPPAAGWRPAGWPAGGWPRPGRRRTGAGRTARPPLARSRRQPARGPPAGSGRGRAVGRGRHAGCPPPGCRSRSGPGRRRLRNGRSASGVPGHAEDFLQGGGAAGDPALAVLAHAAHAGRAGGFAEILLGAALVDQAADLVVDHEQFVDAGAPAVAGLVASRAADRAPAAVLFDPAMRAQAPHQALGEYAKHRRGEQERLDPHVHQPRHCRNRVVGVQRGQHQVPGERSLHGDLRGLQVADLADHDDVRVLPEDRPQGYGEGHVDARVDLDLADPRQVVLHRVLDGEDVAGAGVEPRQGGVEGGGLAAAGGPGDQHDAVRLADQVVQRRQHAGSHAQGLQPQASGLLVEQAHHHPFAVAGGHGGDANVDRPPGYPQGDAAVLGQAFLGDIQLRHDLDPRHQRRVQRLARRDHVAQGAVDAIAHHRMGLEGLDVDVAGLIARGLGQQRVDHADHRRAILGVEQVGNLGDIVHQAVEVDLALRRADHRRGAAGIGVGAGQQGVELVVADALQAGRRMPLAHLADRPAGRARADQQGRAMLARPQQGALRLGPGVGQQAHSGAASPSGTARSGRGLGRKS

SEQ ID NO: 22271 - protein, 191 aa, Pseudomonas aeruginosa
AVRAGTWPSETRVSLPFTRGSTRNCRPVARDSARTTASTSVSTKFRLTGCSPSSAAAAETGATAPERATPRPALSARRACSAWGRSRTSALRNGAPERTLLSGRPTSSSAGGTPGTFGVSLHAATSSAPSATPSTGQRRRAWWKADCLMGNPWERKTTANGSRRTPARRTARSKSQSAPRKERRDASPAPR

SEQ ID NO: 22272 - protein, 120 aa, Pseudomonas aeruginosa
TLARSAPGIAPGHRRRESCARAAPVAASRPAAAAAGDSSAAPGYSVGPPGAYSSSSAAASAVPLSAAPAAGAGGASMARTCQPLSEASACNPCLPNSPCQAAASPPGGPGSSSRSSSPAW

SEQ ID NO: 22273 - protein, 278 aa, Pseudomonas aeruginosa
LLCRCKDWPCPASCPAYRFRPATHTSKARAAQNRGIFQVPLPALVAGAFSANPHGLAGPLQRSASSSISARSRAAERHAGRSPSQNSRNSCGTSARPCSGKGWTTASLSERRNSRWPSHSPATQASSRNGRRNGAACTSRTSSRSRCTACSSEASADASSHPKVRRPSAPRGPWARRSCAGSPRTSASAAQFTAAASFAAGSAGSSRLTRRQSRGCRNSATGNPWRRRASSASETSIRSCTAPRASRRKQCSGAASANSFSGGSRQRQAAFMSPPSSS

SEQ ID NO: 22274 - protein, 230 aa, Pseudomonas aeruginosa
RSPTANTASPCCARRTAMSGYAERATTRRRQTGFTLIEVMVAIMLMAIVSLMAWRGLDSIARASAHLEDSTEQGAALLRALNQLERDIALHSAIREETGLPSGDEPIRAGDSLPPGLALKRLSEIPLRLDIVRASTEPGAPLQRVRWWRQGKVLYRAASPSGDRLPLPPLAERVAVLDDVSRFEIRAWVPGKGWARLPARSKVRASGLEISLARVTRNGVERYRRVVALQ

SEQ ID NO: 22275 - protein, 235 aa, Pseudomonas aeruginosa
ASRWPILTARPGPAANRSWIPPPSSGVRQTSSACTTNRRRAFAWAPRSATQWKRSGRLAKGLRRSAFLAGGARQKTPATRPGQSSSARLAADQRTRNAPQAKVRSSRSPKRLKASLAPLAARRSSSSFSSMPSRIATKLFQPCARPPSGSARWRAPKFSSSSSAAAFLNRNAAPSFEPSETNSQPSASARLRSASRTLWSPSGTGWPRSARSARAASSRAREARPGNRRASASLR

SEQ ID NO: 22276 - protein, 244 aa, Pseudomonas aeruginosa
DLERPVRRTGRRFPAHRACAPGRTAARRRLAGACPERNPPCPRRCRRTATTDADPRSPDPGATSCRPGRRPLRTLSAGLAGRRGRPAPPGPAAGQRTRRLVGCRTVPALGQLRRSAVLAAAGRRPRPAPPPGRRRKRSGPGFRLSPPARSGQSFAGSATPVHRNPPPTPAHPQVPGRPRAGDRPAGQRLAMRRPCSGLAFSCRNWPWTARCVNGAIPTHRWRCSAAQRSAGSCRRSTLRHARSA

SEQ ID NO: 22277 - protein, 252 aa, Pseudomonas aeruginosa
APSPNTVRSEAGGRTAATGRNRRQPAASAPAGCWRSHAPSARPCPPCWPARSGSSRAGGMAKTSAATITWWKPAADNVPGSIARSAAKGRCGCMAGSHERLRRTALPVQLQFPARRLQRRGTLRPCSTPGLSGPGDHRRMQPGRYRAGLAGGAGASGTTDRRQRNPPRTGAQAGPPGGGPGGLPEPLSPHHPRPATSRQGPLPAAARRSATAARRPVGDLVAERPWGRAGCLAPRTLPPAPLAGRRVASRRR

SEQ ID NO: 22278 - protein, 719 aa, Pseudomonas aeruginosa
  UNSURE (65),(69): Identity of amino acid at the above locations are unknown.
KLFPHRAGHRRLRPGPENPLPGPRLGGQLGSVLRPRHHRVGPGPDQPAVRALPFPRAQRTTGNRXGFFXTRGPEEVIPYVFTRYGRQRAALTAVVSTYHGAGAVRDVAKALGLPPEQVDVLANCCGRWSDQAPSAERLEEAGFDPQSPILRRVLALTDELIGFPRHLSQHPGGFVISEQPLDTLVPVENASMAERTVIQWDKDDLDAVGLLKVDVLALGMLSALRRSFDLIHALRGGKRLSIASIPSEDPATYEMISRADTIGVFQIESRAQMAMLPRLRPQKFYDLVIQVAIVRPGPIQGDMVHPYLRRRNGEEPVAYPSAELEKVFERTLGVPLFQEQVMELAIVAADYTPGEADELRRSMAAWKRHGGLEHHRERLTRGMLAKGYEADFAARIFEQIKGFGSYGFPESHAASFALLTYASSWLKRHEPAAFACALINSWPMGFYSPDQLLQDARRHTLQTRPVDVRHSGWDCSLEPFGQAQPAIRLGLRMIRGFREEDARRIEQVREAQPFLDVHDLGRRARLDARALELLADAGALRGLAGHRHKARWAVASVEPQLPLFAEGTVIEETTVSLPLPSRGEELLSDYALLGTTLGPHPLKLLRGQLKACRCRDSRELAKLGHGRPIRVAGLVVGRQRPQTASGITFITLEDEFGMLNVVVRHDLAERQRRPFLESRLLQVEGILESSGEVRHVIAGRLHDLTPLLTGLDVRSRDFH

SEQ ID NO: 22279 - protein, 694 aa, Pseudomonas aeruginosa
ASRNTWPASFTEIALVLGCDSATVALAFGRLIWIPATWAVAVRMNITSTTISTSTSGVMLMLSTAPSSSSSWLLFTEAMAFSSGRQRLAVATMGHFAELAFAMHLGEAGDELVDEHPHVRADFLVPRDQAVVAEQRGDRDEQAHGRGQQGGAHARGDGIDVDVAGHGGAEEHHHDPQHGAEQADVGAAGDGVGQARQARAELLVLLGAHAVHGGADRLDGGRGDGRGVGALLAAGADLLHRHLVQAPQRGVLQAGGQLAVVGEQFQARADLGEALAEQPVGATDTADVLVLAVHDDPRLDHHQRQDRDDHPGIQRHCVEQEAELAEAEAGLLLVDPVGHQARLGALGGGVGEEQRRRAGDLRQAQLVDGALEGLQGRRRGARLTFPACRFGGDRRRGLAFRADGDRTAERRQRRRQAGDFAPPEIQRQPGTVGDQRQMLPLPLRQGLAGGSALTVQLDEGRALGQADQQGVAAFAARQQDLFTGQLVGTHPAAEAEGATGAHRQRWAGRQQQRLAQQLRGATDDALHRTAGGGLRIVGVGGGVPRRSARRTVEVIDQGVVRVEHRLAVAALRRLGVAVVHPDVLALATLHPRHVDPDQGHAHQRVEALDLVAQHGLVVGGDEADVRAVLVDPVEGEVAGMQAHQQRQATETLVDRRALRGGIDRDLLAVLPVVLPPGTGAGRGQQAQADQRCQQ

SEQ ID NO: 22280 - protein, 119 aa, Pseudomonas aeruginosa
LSRRSRLPCASSSALPPRLRPRPPARRISPTCAPLASTVPLTPSWPLSRDTSMRCAFRPSPICRSPCLSWKRRAPKTSPWFRRWFKAVNCSLRLPPSPRRWARISSSPPRNGTRVPPAS

SEQ ID NO: 22281 - protein, 163 aa, Pseudomonas aeruginosa
SPLAPPSMRPCRSTIPASSANATALRVPPRLLRADRSISEPAAWRMSPARLLSSRSPPQLYLSTSLKLALRPARSMRAPSPSSRSSSALRLSLPLGSETALSRRISRALRDNSAPSPAVPLSKVTAAAPAGAARLRLPPLLIRLSEPASPVSNGVLRRRSPPL

SEQ ID NO: 22282 - protein, 1409 aa, Pseudomonas aeruginosa
KLVESAARQRLRPNSALAIAQSRIVHSRLQQGRQSRIGMPCRQDQLAHGQYPVIHDSKTLVQGSVRNDLQAAARRSRAAGCGAQRAVKIQPIVGTESDAPAVAGQQNPSQSRYIQLCLAAGGLQSCTGAYDDERIRRGRDRLARIDLAADDDAAAGLHFSIAATAPIHGSDSAAGNIQQCLLSNPDGACMGLALRLGLIVLSNVERAELLLAHVDASAPSVQSAIQGDLSGTAQDDGAPRIDLDQRTAPQLQRLAGGIELPEDIAVAACLQVQVRPFALDQASGQGILQVQRRCPGLQRLSRRLASRDLAGPAGETVDRPRDPHLGILGYRQSGATDHPVAGEALLEEIFGQLQAAIPEVVAADPHLAALQRQRAGAARAETIQCAAQLQLAIAGLRQPGTGVQGDVAAATAQSLAVGQQRRPGRHVEQTALSQAQVAAAAQGNPSAVAVGQRIVVLRRQQQVAPQAAGIQPYAVAHAQDAVFAAGIDETIDRPVRRNLRQHVAGLQAAAMGGDVGVDRHVVGEQDCLAAIGQGQRAVDADALAGRHLQAAQLEAVEQFAVQAQAALALGGHRSVQGRLLGRRLAGTDDHLLEAAGIGAESVLQQAAALHVVGGVAPDDQLCAARHGILRLVVAVQAGLWRFGLPLAAVGVADHLAVEPRIGAADHQTAGVAADDVAVLVALGRRDQRIVEITGLVPALAVCLVAAVDAVVEQVARRRPEFVEASVRALQPGLADVAALHIEGSAGQVDLRTGLGHHVVAGETDDAALGHPLARRVALGAQVATDLQQAAGGVPAVAGIAVGAGRHPYQVAHVDPHILAVQTAALAVDRGVALLVAAHVDLDAVGLHRHLHALRAGDIDHRAVTQQRALASVDRHLAAAGEGDGAVAEIDAAGGVDLHPRQVAAVVVAPADGGTGAVQRLEQGLALAVEGGAAAAVHQDRAGGTFGQGDPLAGLQVQGAAAVHRTAGKQYAGLLHLAAAEADIAGGGLHQAAVAHPAGTAVGGEARQHLVAAGGGGQVAVGALATADDEVVAGGQDRLPLRRDDAAGVVHLAAEQQDVAAAPGRAGRRCRAQLCALLHAHGTSRVGEGRTAAGIVVVEAALTELFVRDVRRRHRQVAHVHLAAAGKHHAVAVDQHHRAVGLDLPLDLAGPRAGVVDPASRAQSACCWKSTVVLRPTLKVSQLSTALSAVCSMLTVVLPPAWVCTGPLAFCHACSNGIEASTLRPPSPSPSGTSCGRFSAAWRPADWAACWAAMAETVLFKLAIERCNCWLTRCCCASGGGAPGLLRSRSRRPGSAALRHTLGSEPSGAERLPGGLGAPCDQQQGDGLGQRLQARRVKRAGGTGGRRRTGRHGEGVLEHEVGRAPATTPVTGRRPGGGWAEDLSWKVHGAERGAWANGNTTAAGFQPPSC

SEQ ID NO: 22283 - protein, 383 aa, Pseudomonas aeruginosa
AKRLRAAFGVADVGVADGQVFAGAGVEGAHDGALPGRSQRDEAMGGNCGVGGSATVVLVDEGADVGGNAGVLVALAEDEVGVTDDGVAGARIGEHRNPLAGVRTVGGVGRRSHAAQGSGNVSLGRQVAVHTGNLGVAVDVHRIRADIAEGTVGCLDGRHHGGSGGDANPVARQRTAGRQTGVGKGRVGGEASRADRVQVAGEQFGGAAATGAVDDADRRAVGSAQQLTPGGLGAGEGVAELGAGQVERGVAVLAIGHGDRGGYRRDLDQRTVGAVVVAVVGGQFATAQDRVATSIVNGTGGAEQRGVVGQESVLAGAAAGHGIAEVGRQDAVGGAFVQLGRQGSATAGDGHGLGGYEGGHAQRGSDQRALEHEESPFIVVLVR

SEQ ID NO: 22284 - protein, 515 aa, Pseudomonas aeruginosa
GGLRQRRYPPIPLFGRLLRRPIPTADSRERLIAQHGKGLFRHGLLDQLVHLDDRHQHRHHDGQHHAAHDHDHQRLEQRGHAHGAALDVARQGLRRAVEHRRQRTGLLAAGDQVGEDRREHLPRAQRRGQRDTFANLRGGLLHRLREAVVGQRLARRIERAQQRYASAAEDRQGGGEARGIHPEHEASEQRQAQHSPVPAEPRLRVAQVQAPAPVSATDGAGAEPAPGAHEVAGLEHRPGQRRQVLARLGEGADHLRHHVAEEENDDADGDHADHRRVDERGEDLAAQGVAFLDVVGQALHHLGQVAGLLARSHQRPVDFREVPRPCGKGVGQAHAAAHVAAHGAQGLGDVLALGLVEGGAQRRLQRQAGGQQAGQLAGGPGQVAVGQARGEQRARPLPGPAASLLADLQRGQAAGAQLAEGATLAVRLQGAGLDPALGVGGFVTEGLHQASRVTRRISSRVVEPLAIQRSPSSRMLRMPAARAASRRSCSARPWWTRRRISSSITNSSWMPVRPL

SEQ ID NO: 22285 - protein, 145 aa, Pseudomonas aeruginosa
PVWLQAGQPTARQPPSSSTRQCVHRRRTRRWASTPSIDEASRNGSTPMSTSRVTAETASLVCSVASTRCPVSEACTAICAVSRSRISPIMMMSGSCRRIARRATAKVMSMRALTWIWLIPGRSYSTGSSTVRMLLVLASSRARAA

SEQ ID NO: 22286 - protein, 344 aa, Pseudomonas aeruginosa
ARQALIHLHRQPPRQCHCLPRQRPALAALPWRAPASPCRRHRPATRACPTRPARQRHRRLAVPAAAPGPVRRRGSPVVAGVRRGTASPRRRHAAARPAPVRHRHRPCRPDRRRVAREPGATDRAPPAVPGRPAARVDCSAVARTGPARPVARRTGSDRRPTPARPGQRRTGASSRCRCRRSSPALSAPIPTDWRARSSAALRPASRPAPGLRSATPDARPARTAATPAGPQRGPAPARDGPQRRSASGATADGRPTRRPPKRHRATAGGTARPAPPARRAAAAARPAPARPAPTPPATPRSGARRHRAGRGPGVAAPDRRGPAPRPRSSPRRRASPQAAPAVRD

SEQ ID NO: 22287 - protein, 207 aa, Pseudomonas aeruginosa
TARHPSRHSSAWFDSPRIVSGRYVNDIENPRVRRSSGGARKALEPGFPAGAGDGSRGRPPELLSGIGQISRLAWKSPFADLSAMSTRLSSRGFTLIEVLVALAIVAIALAAAIRAVGLMTDGNGLLRDKSLALLAAESRLAELRLGVGAAPGNSDFECSQGRLRLYCEQRVEATDDPALLWVEIRVRTQREQAVPLARLNTLLSRSR

SEQ ID NO: 22288 - protein, 182 aa, Pseudomonas aeruginosa
SAPASGPSAVHEPARHPPEPPFPSPRCRSPAPMPGSAEEYRTRAPPGATAACRHRPARRRTPAAACRDRATTLRTTLPPRGSTSTDSSPNYPVQARWPSPRRDILMALCDCGVTVPAVTCFHRLPYKRETTIPARENRHAPFIAGSAGPDPGPGHERHPGRRADAAGELHQHRGQRLPGFVL

SEQ ID NO: 22289 - protein, 264 aa, Pseudomonas aeruginosa
RFSIIFVIESQCHMKGCRPTAIDQKRTTANTVFTYSIRVISLASLSSVADITPPAAVAGRGNGIALSALLDARRIWKGQSAVPAGASLPTGHARLDALLPGGGWPEHALSEILHARDGVGELQLLMPTLARLTQAQRRVVLVGAPYVPYPQAWLAAAVDLRHLVLLQASGRDALWAAEQCLRSGSCAAVLCWPQQADDRALRRLQVAAESGQALGFAYRPLREAVNPSPAALRLCIETRPPRLRILKCRGGLAPATALPASAWQ

SEQ ID NO: 22290 - protein, 869 aa, Pseudomonas aeruginosa
  UNSURE (843),(848): Identity of amino acid at the above locations are unknown.
GGHALGLHSPAATGHGQRAASTEQSRRTAGAARRPSAAPAVAGGQPCGTRARPEARSIADRRPGPEPGLRHGGIRPRRRGALAGLPRRLGLRFQLAGQPALSACAAAGSAVQPCPVRPLATLRGPLAQGTHGAGLPPSPVPGAEPGGGEGPGEQPRRPGHRGRDSAATPVVRPSAGPPGTLAGAGRRPRTHGTAPSAPGPRVAARRPGPSLPSRTAVAHRPPLRPQPTGAGALPAAGHLRPAHRTQFRRGIAPGPALPPATAERRSRRLSRRTRQRRAALHPAPGTSRARRQPGHGRPAQRRTRGGHALRTDPRPSRTAATARPRACRAPGGPRAASFHAAAPRTVRRAPTAVSRLGTVAGTPARAAGRRGGTGPERRRRTPSGAKLAAAQLRQGAIAGSLRPPPRLAAGGATPPRRGLAHRAGRPGADRVGLVGWRRHPPRLLPGGNPQRTTCLGLSRGRQRRAAVAAWLVRMSAYAELHCLSNFSFQRGASSAAELFARAARLGYRALAITDECSLAGIVRAWQAAREHQVQLIVGSEIRLEQGPKLVLLAEDLEGYQNLCRLITRGRRQADKGHYRLLREDLQQPLAGLLAIWLPNDHGDEQAAWLRERFPQRLWLGVELHRGADDDARLDKLLALASHLRLPPVACGDVHMHARGRRALQDCMTAIRNHLPVSEAGAYLFPNGERHLRTLEALQGIYPQALLAETLKIAERCRFDLEQLKYQYPRELVPAGHDPASWLRHLTEQGIARRWPNGASAKVRKQIERELELIAELGYESYFLTVQDIVAFARGRKILCQGRGSAANSAVCFALGITELDPDRTNLLFERFLSRERNEPPEIXVDFLXRGGPRRSSRTFSHATDASARR

SEQ ID NO: 22291 - protein, 504 aa, Pseudomonas aeruginosa
SWTGNAVRRRRSCEPAMQPQRPFAADLAIDPGTLSAAGFHQVIVAADVFAIPPARLDPLRAGQHGGQGLAEGAWLRQQPAGAEAAGCRRLRPVAAVRPPASLRTVFGDGAQALYRLVAQPRAQAFPQLFPAEILLWALVEQFAVLRRERRQLAGLQAHGMHGGGQLQLFETAAGQFEEHGRLAFGAEQADRDLAVGAPVMFQVQGEALHAAVASGEKGGEIGAQPSQGEEQGLVRFHVEIEFDAQVEGVRRPVVLQRQWAAAAEAVDVQQQFGWEATGQGGARQLEDLAQMAQSHASEGDGQLPRESQAVQRKGGQLALQRCLVLDGQAVVAVRQDPRRHRVRRQAQAMAEAQRREFLAQAGLEAWPGAEQGKAGLHFQQQRTRIVQADLRAETVGPGGEEGLPALHGGEVVFRRGEVPAQGLGGDQRLTGLQAERACRRVDRLQLPALRWAAEQRQRCVGIAPLTQRAVHGQLRQENASPEHGRLIARRWPAGRSPARGRPGT

SEQ ID NO: 22292 - protein, 222 aa, Pseudomonas aeruginosa
LRIVIDPGRAMSAQCVPSLERNSPMDTLAPESTRQNLRSQRLNLLTNEPHQRLESLVKSKEPFASRDNFARFVAAQYLFQHDLEPLYRNEALARLFPGLASRARDDAARADLADLGHPVPEGDQSVREADLSLAEALGWLFVSEGSKLGAAFLFKKAAALELDENFGARHLAEPEGGRAQGWKSFVAILDGIELNEEEERLAAKGASDAFNRFGDLLERTFA

SEQ ID NO: 22293 - protein, 296 aa, Pseudomonas aeruginosa
TVHGDSPALGWWFPAYTAIGENMSPQVPSHHSHTVPSGCPSWVMAIWPEPGSSDWNPLMSILGVARSCAVSLLGLGMLLPASGAVPGDGGRPPLRLAVHAFDIPPQSLASALVTYSGVTGMAVLVDGELARGRRSARLQGRFTASDALTRLLGGTGLMARYTSQEAFTLLPAQAVRNAAPLPAEMPKVEQPLDRRYAGAVQAALEEQLCRSPRTRPGTYRAVLQLWIGRFGEVRHSRLLGSTGDPQRDSALVESLRGVRVMQATPATLAQPLTILLLPKTTGKAMECKLTEGVGGS

SEQ ID NO: 22294 - protein, 167 aa, Pseudomonas aeruginosa
HIFLKQSAANRTMPRSVEMDVVQFSSSPKGHRGQRGFTLIEIMVVVVILGILAAMVVPKVLDRPDQARATAARQDISGLMQALKLYRLDQGRYPSQAQGLKVLAERPADASASNWRSYLERLPNDPWGKPYQYLNPGVNGEIDVFSLGADGQPGGEGINADIGSWQL

SEQ ID NO: 22295 - protein, 311 aa, Pseudomonas aeruginosa
ARHERSSPARHGDHQRAADRHRGRGHSRRPDRPPERIHPRPGKRAATHPGRLDAARRPGMEPPVAARGQPPRPADPPRPALGATDAWLASEQRRIAVQRPTGRRAGQVQPAQPVGRPAPRSPGTSELRTPRRSARRAPEGGAADRRAGPRLLCTAARRSAAGRDATRRLRQRPRDFAGRRVACASGAHAGAQASRRPGAAGHSAGDPGAPAALRHHPARNHLDQRQHRARRSARRLCPRPRAGPGAAGARRARPGPLVPQSRRLRQPPEHAAIAGAVGEGRDHQRLVPAHRLCSARPARGAPASPGAAQGR

SEQ ID NO: 22296 - protein, 414 aa, Pseudomonas aeruginosa
KHGGQLDEGGLMKAAWRCLLPPLNEFAEAAPLHCLRLDARGAVQERIEVSLAELARRRQGLPVALFLHPRDCRLVSLELPALPAAKLAAAVNCAAEALVLGDPAQLRLAHGPRGADGRLTLGWLEASALASLEQAVQRLRLDVREVQAAPFLLPLRDDAWVAGEWDGHLLLRRSLSDAVVHPLPEQGLAEVPQELRLFWLGERPAWRSAALERAEMLDEALRWSGPASPWGLALKAPATSAGNGTWKMPLFCAALALLVWVAGLNLYAGQLAGQGQSLQRQSSQRVQQAFPELPVVLDPLRQARERRDAYLAGKADGDAVPGLAALLHGAGEAMPFLAGRLQRLDYHAGELDLELLPGPPGGDAAAWQGELGKHGLQADASDKGWQVRAMEAPPAPAAGAADSGTAEAAADEDE

SEQ ID NO: 22297 - protein, 995 aa, Pseudomonas aeruginosa
APGGPTEYPGAALESPAAAAAGLLAATGAARAQDSRRRWPGAMPGADLASVHRSAAGADRALASRAAAPACAGRGGGRRVARGRGVARSDPERYGGRRGDPSQPARSGTRRFPTGRPATGPMATGLRQRVRRGLAALAGAQPGGVAPERQRGAGDASRRSFRGALWLFERAVRRAGVRLDPFAVVFRSQGFPMRQSAFHHARRRWPVLGVALGALLVAACSETPKVPGVPPADEEVGRPLSSVRSGAPLRSADVRERPQAEQARRALSAGRGVARSGAVAPVSAAAAELGEQPVSLNFVDTEVEAVVRALSRATGRQFLVDPRVKGKLTLVSEGQVPARTAYRMLTSALRMQGFSVVDVDGVSQVVPEADAKLLGGPVYGADRPAANGMVTRTFRLRYENAVNLIPVLRPIVAQNNPINAYPGNNTVVVTDYAENLDRVAGIIASIDIPSASDTDVVPIQNGIAVDIASTVSELLDSQGSGGAEQGQKTVVLADPRSNSIVIRSPSPERTQLARDLIGKLDSVQSNPGNLHVVYLRNAQATRLAQALRGLITGDSGGEGNEGDQQRARLSGGGMLGSGNSGTGSQGLGTSGNTTGSGSSGLGGSNRSGGAYGAMGSGQGGAGPGAMGEENSAFSAGGVTVQADATTNTLLISAPEPLYRNLREVIDLLDQRRAQVVIESLIVEVSEDDSSEFGIQWQAGNLGGNGVFGGVNFGQSALNTAGKNTIDVLPKGLNIGLVDGTVDIPGIGKILDLKVLARALKSRGGTNVLSTPNLLTLDNESASIMVGQTIPFVSGQYVTDGGGTSNNPFQTIQREDVGLKLNIRPQISEGGTVKLDVYQEVSSVDERASTAAGVVTNKRAIDTSILLDDGQIMVLGGLLQDNVQDNTDGVPGLSSLPGVGSLFRYQKRSRTKTNLMVFLRPYIVRDAAAGRSITLNRYDFIRRAQQRVQPRHDWSVGDMQAPVLPPAQQGIPQAAYDLRPSPRPLRAVPLGEAAPL

SEQ ID NO: 22298 - protein, 236 aa, Pseudomonas aeruginosa
PGTPDADLPLRSRRRPGPDRDRHPGGGQPAWRPRPTARPRPDPAGGPRAGWRRDRARGGRAVRPAPVRRRPGLGHPPAGQPAGRQPAAGGGAERHPRPGRAQAHRPDPERRAQRRARRHAPGRRPCRTAAGLPGNLPGAGGCGRGVRRPGPGDGAPGRLHRGTQRPARQDPHRVHLPGGGRRGLHRHRHFPPRLRGAAGGQRLLPGAPGPAGADPGDAPGQRLRARLGLALRRRHR

SEQ ID NO: 22299 - protein, 175 aa, Pseudomonas aeruginosa
RLLGLALVPARPAGAARLAPASAAPASARTLRARGEYRALRLHPGDPRQRWRTAAARARCGAPDAGQRLPRAGGGGGHRAGSRRCLAGLGAAHAAGVPADPHPPDRQRREDRCAAADARPRGADPVARHRAPRHGHDRVARAADDRGHGRRGADHRDGGADADHRDEPTGPVVRA

SEQ ID NO: 22300 - protein, 775 aa, Pseudomonas aeruginosa
RRGDRCLRRARRAGGDGDQQHQGQRARQRAARRLGQPRGRRSEQPGCVGRRARPGTGACRHQRLCQRPLVHRRRPAGGRWLPGHPGPLGGRVDGPGRHRQFHRQRRGDPGRFADQPVRRNPRCAGRLHPPDLAEGLGRTPLRTRVGAGRPALRRHLPRLRGTQRALGPDPLFLQSADRADPALRERLHRRPRRRQSGDRQRQCAARRPGGRRHLPRRAADRSATGRPGRLQPVAECRGARRTVGRRALHPLLREEQRPAGVRSRRRCRQPQAGGHRCRRGGGRGADPGRSGGRRAPGPPEPGQRTAQRLPAGRPEGGGRREHPRRRRADPGQWRRGNPVRQRRGDRRRHHRPWRQPAGRQRVGADFSERDDRWFRRCRPRRRHLARGRRRTAGCQRLVEQPAAGAGGQRYVGLPRRRTDFPAQRRRPEPGTGQSARRVVRGGAAGRRQATGRSRRRHRLARQCRAGAGQRWPIAVGRHIEWSRHERRRHAVAAERQGADRRRRPRGWQPATGRRFLPAGLRQLPGGRSLRIDGSRGCPGAGRAAGLPFRQRGRRGRGWRGAARGAGGLDTAAVPGGCLGRTLDPTRRGGPVPAGRRRRQYPRAARSRQPDAGAGARFAGRGRSGARHRPARSRTDHLGWHSERLGRTHRRAPAAVRRARRYSGQSAQGARPAPCTLHLDWRAGIAGCCRPRCHCRGWARSPLWRSAVRRQHRHRRRDRSGQGDRDLGGCVRHRTPRCTTGGLRQPGTAGCTGTGKGFAGRRRRAHRSQFLQWAVS

SEQ ID NO: 22301 - protein, 1548 aa, Pseudomonas aeruginosa
TRCSVTTMRPGATIRRPAGRPYQVIDQAYLDARHAESSAFIAAALANRELLDGKLAGLTNATYADAFHLRPGVEIVSATADGDLVVQGDLDLSGYRYASLNPNTPLTEVYGSGEVGALVLRAGGDLNLYGSINDGFAPPPDSPDDKGWILTPGVQPFGGDLVVPGPGVVLGDGTAFLGGRTLNYDLPIKGTTLAAGTRLATEAVLEQPYTLAAGSVLVADIHDAAGNLLYAAGSLLRDGVTLEVGSRLGAGTLLAAPASVQAMTWPAGVPLPSILREGPSRPNVLLLNGELALARGSLIPSQTEVVLAGDAPFIELRPSDGVRQGRNWALAEMLPAGSQSWSMRLVAGADLAAADNRLVRPDSSASLNLADTHYQAKIEQSSGGLVFTDQATDWGITPGTPVDESNEWICGLGPYCAEPPRWTWAPGNYLGMPAGTAIGEGDLWWCSVDPSLCIENLGKTVVTPQNQLFSVLRTGTGDLDLASAGNLTQWSPYGVYTAGTQAADVATGFNQPRGLFNGSVLGAGGADYEVLSTSQYQAWYPEHGGNLDIAVGGDVVGDQWAEKLTSSDPIRPLPPSAAVGNWLWRQGSADREGVPTAWWVNFGSYVRGAEGDAPYLVGFTGFGTLGGGNLSMRTGGDAGNIAPRGDGSIPSSGNLNPRSQGLVLAVAGTGRLTSDGALQLGGGGDLNVRIGGEVNPSREARATQTYSSSGFDGLYSGGTIHDLQGALINLRGSASLYSGALGGIDPRYDTLLRDPAEVRSRDAFSPTLASSTGGLTLVAGDTGMRLETRGDLVLGGVTDPGRVGVPNTVGFTAPDGSVYQGGGIGWFSLWTAHTSIDLFAAGGNLTPSTQLVEATNAIPMAGRNLSPSDGRFIYPSIVRAAAPEGSIYLGPSSGYMGGVSLNVSTTPYSLLLAPSLNGELELLAGDSIYAGGYSVQRSGADPANLPSIWTPAFAGYSDAALLNPIAGNGSPDGNPAVIGGLPLFYFGPDSAASLARDLQPARFYALTGDIVGLNSGAQIRFGEQAGNRAGQTWYEGAGPVWMRAGRDIVASGTPLGQRISAPSQISTDASFTGNLFVHDDPNDLSLVQAGRDILYGNFNVAGPGTLEISAGRNILMEDRAAITSLGAVVPGDSRPGADIVLQAGAAGADYQAFLERYLDPANLAQAGTPLAEQPGKVVRTYESELAKWLNERFGFAGDAEQAQAFFAGLPAEQQRIFARQVYFAELRAGGREYNEVGGVRQGSYLRGRNAIAALFPERDPAGNPISYEGDIVMYGGAGVHTDFGGDIQLLSPGGRQVFGIEGEAPPSTAGIVTQGQGDIQAYSRDSILLGQSRIMTTFGGSILAWSAEGDINAGRGSQTTVVYTPPRRIYDAWGNVSLSPQVPSTGAGIATLNPIPEVAPGDIDLIAPLGTIDAGEAGIRVSGNVNVAALQVVNAANIQTQGQSSGIPLVASVNTGALTSASAAASSATQAAEDVSRQQQAAARQRMPSVITVQVLGFGNERLEPSRDGASRSPGYNPDSAVQVLGAGALGEQARSQLTDEERGNLIL

SEQ ID NO: 22302 - protein, 350 aa, Pseudomonas aeruginosa
FPTNSSPPAVPPACVATWRRRTPPTTAICSPRNGVRRPSDASSASAPAATSTTGASTCSPRARNCACRMRCPNRTTTSAWPASASAPARNSPTGCPAASTGPSRCWKGRTPTNTTRACISACRRASDADPGVTPHVSLIADIADLPGPAGPGQRQCLVAGRLAVPQAGLGRYHPARRGDQRESRSPAVAGAPAYRQLHLRRGQRERLGHPLRRRRRQDRVAPPGRELRPADGHGPDLGRRAAGGGWPAPGHLDVLRQRQGAGERQRPVGVRPGLHPGLSLRRCAGHSAAGLHRLRQQCADRRRQSGGGRHRSLRATAGPAAAAAGQPIAGGERRWHLQLQRLGASRPTGR

SEQ ID NO: 22303 - protein, 200 aa, Pseudomonas aeruginosa
WSAATPRCSTRRSSRSSTCCAAWSCPRSAWSPANRPEARDEHVRRSQAHPRAEKCRATVHRRPPGEPDPALPQVGPRRAAARRPRLAGLGVGQRHERRAPRGAQGAGDHPAAATASAAAGKTAGTGAAGGRGKDRRAGTATRTGGGQAAGGSAAVAGRRPGRPDADGWRRPVRLRRFQHRRRQGRRDGRFRRRSRRQRQL

SEQ ID NO: 22304 - protein, 129 aa, Pseudomonas aeruginosa
RSLRRTVAIAARRWRRPSAPCAGVRRDRAGRRHRPATPGPGRRAWRVGRDRARRGTAGPPGPARYAWHPPRESLGSSAGRGVWPVAPGRTAPGCNPNRCGGHPPGVSAGCGGGRPGATGRGCRSPSANC

SEQ ID NO: 22305 - protein, 155 aa, Pseudomonas aeruginosa
SRRMSSPSHQPDSIRSGPASTVGKASPRGRGSASSQPGRRPQAAGDCALSQLCGRQLRSGRCSATALRPCTASSPSRARRRSRNCSQPRYCCGRSSNSSRCCGVKGGSSRASRRTACTGAGSCSCSRRPRVSSKSMAASRSALSRPTVTWLSARP

SEQ ID NO: 22306 - protein, 353 aa, Pseudomonas aeruginosa
TVRSTCSPSAPTGSRAARASTPTSAPGSSERAMNGHRQRGMAIISALLIVTVVAVIAAGLIARQSAFIRALESEQLRIQAGWMLRGGLEWSRQLLLEDSRRDPLTRLDQRWAQPMRGLRLSSAELPFNGQLEDEQGKFNLRNLLVDQRPDLQERANFERLAGLLGVRPKEARLIVERVLASYARLPAEAPPAETQPAGFDSGRETSPGAVLRALPARMPALRRLDDLARLGIPPATLERLRPYVTILPETTWINGNTARAEVLAACVPGLGLDQARRVLGERDRGRWFLNRGDFVNRLNMPQLQAQSVKVGITSDWFLLTAYARRDRQEVRLQALVQRKAGESTAVNWMRVGS

SEQ ID NO: 22307 - protein, 343 aa, Pseudomonas aeruginosa
TCTPGNWPGRASPCNGRAVNACSRPSRNCRWCSIRCARLASDATPIWPARPMAMPYRGWPRCCMAPARRCRSSPDACNDWTTTPANWTWSCCRDRQAAMPLPGRASWASTGCRPMPPTRAGRCAPWKRRQRRPLARQTVALPRRLPMKMNKRLAGLLNTPAQRWSPLLLRLQAYWRQLAPRERKILAGGGLALCLALTWQVFIDPPLARIEHWQAELPRLRAQAAAVDGVLREVEALRGPTLSGTADAEAIRRSLRDQGLDGFQLDAPQPGQWQLDFASVSGEALLRWLARSPAALRLSVSEAQVTRLDAPSEERSGSSSEPSGGLVSASIHLQSSSAPKDSP

SEQ ID NO: 22308 - protein, 199 aa, Pseudomonas aeruginosa
WSSCVPTSSATPPPAAASPSTATTSSAAPSSACSRATTGASATCRLRCCRRRSRASRRPPTTCARARGRCARYRWARRRRYEPAALRLGQGAARLAAAGRAWRDPAGQPAHARLGDQRGAPAACAGQPGERPRRRARHPAGQRLLRYRQRRGGGRRGGERGRPRPPDGRYPRGYRPARHPGWRAGDPHDQRAADPGRAR

SEQ ID NO: 22309 - protein, 754 aa, Pseudomonas aeruginosa
GQRHPHRALRDPFGGALSRRRRPARRGRAAQGAARGAGVADQDHGAAGYRRETPAPGRPHRLAGSRAADRHSRLHRAHRPRRTGGDAPARQAGRTPEAGDPGHGSRRAGAAGQPDPPAARHRAGHRAHRQRQDHHPLRRPGAARRQHQQHPHRRGPGGVRPAGDQPDPGQRAHRHDLRRSPAGDPPAGPGHHHDRRDPRPGDRADRRAGFAHRAPGAGHAAHQRRGFGSDAAGGHGGRAVPARLVDAWRTRPAPGAAPVHALPGRRGRRLARGRLPGLQPDRLQRAHRHPRTVRDRRRDPPPGPPGPRRAGSPRSRPRGRHAQHARGRRALDRQRLHHPGGNPPRDPGRLMQTFRYEAADAQGRIETGTLEADSQRGALGQLRARGLTPLEVREQAGGGTGQGAGALFAPRLSDGDLAWATRQLASLLAASLPLEAALSATLDQAERKHIAQTLSAVRSDVRGGMRLADALAARPRDFPEIYRALVAAGEESGDLAQVMERLADYIEERNALRGKILTAFIYPAVVGVVSIGIVIFLLGYVVPQVVSAFSQARQDLPALTRAMLQASDFVRAWGWLCAGAIGSAYWGWRLYLRDPQARLGWHRRVLRLPLLGRFVLGVNTARFASTLAILGSAGVPLLRALDAARQTLANDCLAQAVEEATAQVREGVSLASALRTRQVFPPILTHLIASGEKTGALPPMLDRAAQTLSRDIERRAMGMTALLEPLMIVVMGGVVLTIVMAVLMPIIEMNQLVQ

SEQ ID NO: 22310 - protein, 498 aa, Pseudomonas aeruginosa
SALREGPVQAGLPLAVINPCGLSPGLGCMFQRGCPEGAPWPSRAGRREALAEPRRSREKARRRACEHPRKGCENNSMLPRFFPRSVTGTCEFYPQRPLRPARDAKPGKHGAASCKTTSSTYQHHDERRFFMFKRSLIAASLSVAALVSAQAMAVTGGGASLPAELYKGSADSILPANFSYAVTGSGTGKNAFLTNNSSLFGTTGTVHYAGSDSVLSGSELTTYNSNYNGTYGPLIQIPSVATSVTVPYRKDGNTTLNLTSAQLCDAFSGAKTTWGQLLGTTDSTPIRIVYRTGSSGTTELFTRHLNSICPTRFATNSTFTNARLPAGGTLPSNWVGVAATSTVVSTVKATNGSLGYVSPDAVNINSNAEVSRVNGNLPTQANVSTALGSVAPPANAADRADPSKWVPVFTNPSAGYSIVGYTNFVFGQCYKDASVSTDVRAFINKHYGGTTTNAAVAAHGFIPLTPAWKSAIVSAFYTGTSENLAIGNTNVCNTKGRP

SEQ ID NO: 22311 - protein, 98 aa, Pseudomonas aeruginosa
QVFGPPSARPSTSNGRRCGRPTDFMLKDPFAMPSRSPSSARSSRALYAPRLKPLAQAIALLLVAGGAQAAGQPFSAAWFAAKGVAQGGAAGAPRPGAQ

SEQ ID NO: 22312 - protein, 1646 aa, Pseudomonas aeruginosa
PGGAAAAGAAAAGQPAVAAFDGQLEQHRLRHSRPAGRPVRRTPGGAEPSAGCSGRTRRGRPQGRRLDAVRAGVAERQGTGADPGRRQDHGEHRADRRQGGAQLGDLQRRPQHHRGLPAARRLGSARRVNDPSARPSQIQGQIKADGTVMLVNRNGVVFSGSSQVDVRNLTVAAANISDEQFRQRGLYYDNAGSRPTFTDAAGAVRVEQGAQLRTAAPSGSTRGGGYVLLLGSEVDNAGSIVTPKGQTVLSAGDNFVIRRGQGTDGNLTSTTRGNEVLPGFAADSSAGRVRNSGLVQAATGDISLSGREVEQAGVLLSSSSVDSRGTLHLKASERITLAEGATSAILVDSSGSAALDSQREALLKPLNGSSAAVSRGDDDRRDLSRVEIDSAGSVDFRDGSITLASGGQVAVNAGQRALLRDGAVIDVSGAQGVQVAMETNSIKVNVRGNEQRDASVNREGGGLNSQDVWVDVRDLVRVPAGTNGYASDRWYTAGGLLEVGGYLGTQGHSAGEWMAQGGIVSFTGNDVVTQAGSQINLSGGTLDVQGGYIRQTWLKGSDGRLYELGSAPGDLLYDGIYRGYEAHSERWDQTRYFYNPLIAPTQRYENGYIVGRDAGSLVIGSANARLDGQVVGDTYRGERQTEAPQAGLDGYNQSQNAVARGAQLVVGRYTPYYVKSSGLLEYALGADAGSLKQVVIGAGEAAAEEPTLDAPVAAERQGRLSLDSELLNGFQLGGLKVAAGESIRVDGALTLANGGEAILFANDVAIDADITAHGGSLQAGNVLAQISPNGTIDGFVDAGREDGILRVGDGVRLDASGLWSNLLLAPEDNDTLAYRDGGRISLRSGGDLSLGQGSLLDVSSGAALLADGKRLGGRGGDIALHASAGLAQASDGQLQLGGTLNGLGTSGAGTLSLQSGKVRIGGDDLGDGSLQLAEDFFQQGFASYRVVGRSGLTVAEDAQVRVARPVYRFASGAGEVAAGEAPREALEAWTPPLYLEDALAGRLIQREGADLYLQAGGDGNILGQLDPASQTLELGRGSLVEVDPGRAIVLRGPGQITLDGTLNAWGGRIDVRQQQFGALDVTQDNQPKAQGQPHARSIWIGEQALLDVAGRAVTAVDGRGRRYGEVQSGGSIVIGGEIDPGKAIATSADAFVIVRPGARLEASGSQAQLDVPGLGRVLLAGDGGRIALSSYNGLYLDGSLRAAAGGSGAAGGSLEIIADAPLYQGFTVVDDRVLAMRELILTAGHADSGLPTLLQPGMDDSALRYGQSRVGTQSLTSGGFDQLSLFSNGPLSFEGNIDLAMGRSLNLYAGTIAATGGGPSEVRLQAPYVRLSGIGMYGQQASGEFRPRLTYGPTATAEQVRLQVSAGRLLDIAGRLSFGSDGVINGVNAEAVRYQRPGFEKVTLRSEGDLRFAGDYPENGDPSGRLITHGDLQLTAAQLYPVTGASSTLYAGYGLDEGGQAVFDAERHLAIERSGESLPDTPLSVFGSLAFMASNIEQGGVVRAPLGLIQFGSNLDRAPGTVRLLPGSLTSVSGAELVMPYGGTTDGINYLVNQVPIQLTGAGGALAAGTLVAGVGLYASEVDVQQGARLDLSGGGELAGAGFISGRGGSTDARFHPLVQQDNDGFRLPELSSNPVYAIVPGHQGR

SEQ ID NO: 22313 - protein, 194 aa, Pseudomonas aeruginosa
IQLGWRPAAEQSRRRHPPGRRFADRPVGAQQPRRYPERRGVGRGRRDGGPAGPHTGWRQRRLRCRRHPRAVPRWRAGDPRPAPGRWRQPERAVHRLEPAPEPGRGLRRAALPAQARRPADRRRPEGASHRGVPRQWPARRERNGGRQRRAGRRDPPGRWPRPEPGRQRAAGCAWEPAAARQLRADHRQPEPGDG

SEQ ID NO: 22314 - protein, 182 aa, Pseudomonas aeruginosa
QEISSGSIAVRRFVSASRRGTAPGKPGMKVRVPSGCAPGATSLPPEPHWDSVSALPVRSVRMPRSPATSSSTTTPTTSRWSRPAATSSTATSTSPAPVPWRSAPGATSSWRTAQRSPVSARWCRATAGRVPISCSRPARRGPTIRPSSSATWIRPTWRRPAPRWPSSRARWSGPTKASWPSG

SEQ ID NO: 22315 - protein, 145 aa, Pseudomonas aeruginosa
TSASASPATRNRPRRSSPACPPSSSGSSPARCTSPNSGPAAASTTKSAGYARVATCVGATRSPRCSPSAIRRAIRSATKAISSCMAVPACTPTSAATSSCSAPAGARCSVSRARRRRPPQVSSPRARAISRPTRGTASCSARAAS

SEQ ID NO: 22316 - protein, 202 aa, Pseudomonas aeruginosa
VLMESYSKVGMQELDQRLSKIVEAARKKPVSVYRYGAPWVWIVSQEDWQGALKEVSSYMPPGHSLALLKPQIESLLGEEAKVLSALAREHGMQLAPEPLIHALLLQLLYAIPSEQQLYEQLNYNLLYRWFVGLEMKQKIWNFPVFVSDITVLLNSAEAVRIIGRIIGEVISGDLMQMPEFSLNFALLHTWQARHGGARRLNI

SEQ ID NO: 22317 - protein, 561 aa, Pseudomonas aeruginosa
NNKSRWNFGGPCEAFAVQLCAPVSPALVDRLPGCRIVVRFAGRRGPSRRGGSRDPASGGHQRVRGTRQHRAGQPRHRGGGVSLPRTAAQPGRHRGGARCAAGRLPGEGLPVGLRRAAGAAGERRGGLPAGHRDHCRSRPGGRRQALFAGGVARGSAGPGGGQGARLRPGPARAGAGQPHPRPPGAADGARGPAARHHGRRPAGGRQESLARQHRPEQRLQRRHPSLALGGFAGLRQPLATRPRHLADLFHRAAGPGQRQGLVRLLYRAAEPALERAAVRLPVRQRRGHGGQHECGRPGPFLWRGGDLQPAGDRPLVALVLLRRRLQGLRGTDPDRRQQRQGADQVRPADPRLQRFPLHRTFPVGPWPEPGGRYRQSPRLRRRRRGIRPQALSRQVRLRRAQGRSQPHPDLRRRLAGGDQGGLPARLRAADFQRTVRRRRCHQRAWLPGGGEHRRRRLSALPGMAYAVPRTLPRQARRRLRQRLALLRVRRGRATAPAGCAARTGRRLQPGQRRHRHPRATRRLAVRQPRLGLPAAGRDEHRQTRLAPAFQRAGELLTLTPE

SEQ ID NO: 22318 - protein, 617 aa, Pseudomonas aeruginosa
PHMYRLLLTSLICLGLLAPASASAWWQDDWQYRKQVSVDTTPQGAAINESLGRLPLLVRLHTGNFTFDGVNENGSDIRFVAADDKTVLRHQVESFDPLMGMALIWVDVPRVEGGQRQDIWMYYGNAKAPESGNGQSVFDPDYTLVYHFDGAPGTPPRDSTAYANNAQTAAGSPVEGVIGRSAQLLGQPLLLPASPSLAVSAGGTFSFSGWVRPDQLAGEQVLLSRREGGNALLVGLAQGAPFVELNGQRAAASQALAQGQWQHLALVADGTRLALYLGGREVASLAAALPAFSGAIAIGAEGQAAPAVATEAASGEGEASAAAPTLQPFQGAIDELRLSKIARPAALLLADATAQGAESRLVAYGVDEKQSGFGFGKLGFLLNAVPLDAWVIIAILALMMVQSWVIMYRKNQNVGRVSRANGLFRERFAEVGTRLELLADDRELAARLQHSSLWRLYQVAVKEIRTRREQGADTSSVSAATIEAIRASMDGVRTKENQQLGSRLSSLSNAIAGGPYIGLLGTVLGIMVVFLGTAMAGDVNINAIAPGMGAALLATAMGLFVAIPALFGYNRLVTRNKEVSADMRVFVDEFVTRLAEVHGESQLSEVAHGRNGQPLPA

SEQ ID NO: 22319 - protein, 380 aa, Pseudomonas aeruginosa
  UNSURE (375): Identity of amino acid at the above locations are unknown.
RRRRRRQHQHHPAGGRADGGAGDVHPHRHRPGRRDPDQPAEGQCHRGAVAAQDQGDLGERRRPGVPRRLPGDPARAGGPPAYGEGPQPRLPGSGPRRRHGAVPEGHRGPRPAAPPGAVPGRPGHRQTDLRPGMNMSADPKHTPEPKNAAPLSIDGRPANPTLRYLKWGLGALLLAGLAWLVWEWANDMSGVRREAPKVPAIIPLPPPPPPPPEKPPEPEQPVEEEKIVEPEPQPELEEVKPQEEAPPSPADDLADPMQMDGDAQSGSDAFNIGAGKGGGMAGSGGGRAGNASYSQYLAYAFQRLLRDNPELRNLAFRLQAEIWLSSSGDITRAELTRSSGDPETDQKVLAALRAAGRLEERPPASLTLPVRISLXGKRPG

SEQ ID NO: 22320 - protein, 704 aa, Pseudomonas aeruginosa
  UNSURE (638),(642): Identity of amino acid at the above locations are unknown.
RGQVMQAPCDDVAHLAGGLQDALHLQQPGLEEWPPLPFGEVVPDHHVEHAELVLQGDEGNAAGGLWALPADHQAGDPYRSSMSQFRQFAGVAAAAGLELSTQEFQRMRAEGGAEESVIAQQFLAARRQRQADRGFFDDGPFGEQWQLRLDAGDGPARLVPVSGETAQGAGIGQQLQGPGVEPGASAEIVHVEERLGLPDLLDTPGILLAKASDHPQAEAYGRLRLAERLQAAIPTAVADIHRACLQGVAAGVLEQLVGAVEAHRPTVDQGAGEGRRLVTFQPTAGVGEQGEAGGVGFRETVAAEAFDLLEDARCEVGLVALGEHAPGQPLAVVFQAAMTLPGGHRTTQFVRLARRVVGGDDRQFHDLFLEQRDAQGTFEDLLQFGRWIGHRLFTVSPAQVRMHHVALDRPRPDDGDLDHQVVELLRAQAWQHGHLCARFDLEHTDGIGAADHFVGGRVFARDTGDAQPLAAAQRVDQVEAAAQGAEHAQGEDVDLEQADRVEIVLVPLDHRALGHAGILHRDQGVQWLFGDDEAAGVLREVARKTDQLVGQGQHPAQDRTLRIEAGLFQAFGAGGLVAPAAAAVGQDVDLLGRQTQGLGYVAHRAGAVVGADHRGQRRALASVACENVRDDLLGPPRXKKSXSISGGSLRSRERKRSNSRLVRSGSNSVMPRAKHTAELAAEPRPWQRIFRPRAKATMSCTVRK

SEQ ID NO: 22321 - protein, 425 aa, Pseudomonas aeruginosa
FGLESVDVDPRGGKVVRSVVARSRHAAAGVRRRAGRWRQAAVAPGGARVRYSSAEPGIGAGDLQRGDGNGGSGGWRAGSWTALGPLAGALHRQRRPDPTARRNRPDGALHQPGSVHPAAGAGRQERCAAAGRDAEGRAAAGSALRGSGPGGAGRTVVSLAAHSSGYLSRGAATLDRSLRRGSPQSPARFDRRPAAGQRPGGKPARRAGDAGDARYAGPAADHPVAAEDDGQGHGMQADGGSGRVMSDSRQSAMVKLFLASYDDFKARLKRRLGSEDLACDVLHETYLRVDRLDDALEVKKPQAYLFRIALNIAADRREGDARLLTGEEVAELLQVADEGLDPERIVGGHAEIRRLLEALCELPARRRQILIASRLEETPHAEISRRFGISTRTVEKELKAALWFCAERLERKVIQRFGPGAGKPS

SEQ ID NO: 22322 - protein, 340 aa, Pseudomonas aeruginosa
AGGKPPPYPSHEPFRCPYSTVMTASDSAADETGDLRPEAHAWVISLTSGRVTQGDARAFRQWCARSPQHLRAFVEARDLWQALGSAAALPLESPAVAQIAPRRFGRRWFVGGALAASVALFVLRPSLLDHGLGGADYVTAVGEQRQVQVSGETRIEMNTRTRLNVRRNQEQQETIELLGGEAEIIASHPPQSSLRVMAGSAWLSASRARFNVRSSGDVCVVTCLEGSVRLEHLGQRLDLQAGQQLTFDERRNGPPVPFDVAEVMAWRERMLVFNDVPLATVIDEINRYRPGMLLLLDKALGRRRVQARFSLDQLADVATLIRDAYGIEVTRLPGGVVLLG

SEQ ID NO: 22323 - protein, 162 aa, Pseudomonas aeruginosa
AGAGAPFVAPVAHTPGEPAMPAMPRIDPPRLVQFAAVLAILAGLLFWGYLLLAPIPGVVQAEVADVPPPSGEDAAQRWFAAPSGEVEVQLAGLISGGPAAIAILSVNGAPAQAYREGEVLARAAKVRRIEADAVLIEQNGEVRRVAMQRLAEPPPLATLKRG

SEQ ID NO: 22324 - protein, 149 aa, Pseudomonas aeruginosa
GWAHEGRLALPAAAAERVRRGGAAALFAPGCARRGAGTNRGLARGTGAAAPGIAGGAVPASARLPPGQSRTAGAACGEARRRGELRGRGAGPRRSGAATPGPRPARCRRAPDLGVAGGVGAGLAGAGRAAAAARRAGGAGRAVPPAVAR

SEQ ID NO: 22325 - protein, 221 aa, Pseudomonas aeruginosa
GPAGVAAVLAGRASGVALRSPGAGRDAGRSAALERARQSVGIGAESAGDERRQRHLEDAPVLRCPGLAGVGRRSEPVRRATGRAGPVLATAEQSTRAAGLPGTAGGARSVAPGSRATRRLSGRQGRWRCRTGAGRAAAWRRRGDAVPRRTPATTGLPRRRTGPGAAAGTARRRCRCLAGRVGQARVAGRCLRQGLAGARHGSAASAGRWRGRQWHCRGGCR

SEQ ID NO: 22326 - protein, 355 aa, Pseudomonas aeruginosa
RDAEGPRRAPGRRGSRPAAEQCPLRCAVAQRRRPRAAPGRASPPRAECRARRSALRCRGSGLSGSGRTRRAAGQPEFRRYRGGSGGARAVARHRPAVPGRPAGEGQADPGFRRPGAGAHRLPHAHQRPAHAGLQRGRRRRGQPGGAGGRRQAARRAGLRRRPAGGQRHGHADLPPALRERGEPDPGAAPDRRAEQPDQCLSGEQHRGGHRLRGKPRPGRRDHRQHRHPQRQRHRRGADPERHRGGHRQHRLRTARQPGQRRRRAGPEDRGARRPTLQQHRDPLAEPRAHAIGARPDRQAGQRAKQSRQPPCGLLAQRPGDPPGPGPARADHRRQRRRGQRGRPAARAPERRRHAR

SEQ ID NO: 22327 - protein, 608 aa, Pseudomonas aeruginosa
QARDRYQHPPRRRPDHGPRRPVAGQRAGQHRRCSRTLQPPRRRFAVPLPEALADQDQPDGLPASLHRPRRRRRPQHHPQPLRLHPPRPAARAAAPRLERRRHAGSGAAAGAAGHPAGRLRLAPEPAAAARGTAGRGGAAMSLLPYAWAKAQRALLRPGEHGATLLVSPRTPGWAISEVRQRHAPASLESVRDDELDTLLASAYSDTGSAAAVVGAAESEVDLDRLMDDIPEVTDLLDTQDGAPVIRMINALLTQAARDEASDIHIEPFETHSVVRYRVDGALRDVVAPRKALHAALVSRIKIMAQLDIAEKRLPQDGRIALRVAGRPIDIRVSTVPTGHGERVVMRLLDKQAGRLRLETLGMAPGVLAPLDNLIRQPHGIVLVTGPTGSGKTTTLYAALARLDASTSNILTVEDPVEYDLPGISQIQVNARIDMTFAVALRAILRQDPDIIMIGEIRDLETAQIAVQASLTGHLVLATLHTNDAVSAVTRLVDMGVEPFLLASSMLGVLAQRLVRRLCTHCRVEEDGGWRAVGCPACNQTGYSGRTGIHELFVIDDEIRRLVHQGRAEQDLREAARAAGMRSMREDGERWIASGSTTLEEILRVTRDA

SEQ ID NO: 22328 - protein, 394 aa, Pseudomonas aeruginosa
ANRYEDRQPYGCRSFFLWGTQEVFMLKPMFGVVALTLLTSHTTLGATVTGGGASMPAKLYKGSADSILPINFSYAASGSGIGKTAFLMNNPMLLGATTGTVHYIGSDSILSSSELSAYSTNYRGAYGPLIQIPLAGTAVTIPYKKPDITDLNLTSAQLCDAFSGAKVTWGQLLGNPADRTPIRIVYQRGGSGATELLTRHLNSVCPTRFATNSIFTNARLPAGGALPSNWVAVQPYESVRNAVDNVSGSIGYEGPDGVDLSDNSKIARVNGLLPTLANRVIAVRSVAPPGVAADRADPSKWIPVFVNPNAGYSIVGYTNFVFGQCYKDATVAADLRAFLTQHYGGTTTNRAVADHRFVPLVASWKSAIMSAFITGTSENLAINNPSVCNGKGRP

SEQ ID NO: 22329 - protein, 195 aa, Pseudomonas aeruginosa
SRWPRPSPCCWSQGAPRPPGSRSAPLGSLPRVWRRAALPGRRDRERSSPGAPPPLAQQQRVNQQLQRSMANLNNTVSAIAAQQAAQSAGRQAALNLPQDVPDGLGEGGLKVDASMPFEQAWQNAKGPVQTQAGGKTTVSIEQTADKAVLNWETFNVGRNTTVDFQQHADWALLAGSTTPARGPARSRGRSRPTAR

SEQ ID NO: 22330 - protein, 1129 aa, Pseudomonas aeruginosa
PVPGALSLLGHWLRESAFMPARSMCNRARGWTCPAAANSRGLDSSPAEGVRPMRVFIPWCSRTMMGSVCRSCPATRCMPSCLDTRAVSAPLGGEAGAIQPLVGQQVTIGGGVPGLAAGTYTLLPSTYALLPGAFRVEINGLAGQGAPMATQGLRNGSWATSGQLSIAGTSIRDSLSRQVILSSADTLRRYSQYNEMSYADFIRADAARKNIPRAMLPVDARSLYLGLRADEELRENALSFEGKVDFTPEESGYGGSLIVDAEAGIEILPEGGLPDSDFAGVSLVADDLNAIGASRIAIGTLPYVEYGEQGNFVQFGGSNRLFPVVLRKGAHLSAPEVIIGRDITLEGGSGISTLGKGKTAYDSSDGFIYQPGGRNLLLLSNGWLNLLAPAADSSLPVRLGGCAEGAGCADTELYSEGTLGIATNGTVTFGDNVRYGTRNLSLALSTINIGSSQSLADAAARGVLPNGLALDQTVLQRLLRGERGAGIPALENLILSARDAVNMYGSVSLDTYDPATGKSSLANLVLGTPAIYGHGTGEDVASIRTASLVWSGSSQPAAAPVTGGAGSGSGTLRVDAERITLGYGANTQPAGETDEARLALGFAEVQLNASERISANHKGSLRVYQRLDGYVAGEGLHYSGGDLRLSTPLLTGEAGSLSRISSGGSLSLAAPAGAAAVTFDSGTAGLGAELSLSAREIRLDSAVSLPSGKLSLSAEDDLELGDGARIDLAGRKASFNDVDKYSWGGDLLLSSRAGDIRQAAGSLIDLSARNNRGGTLSAVALAEDAGMVDLQGRILGGASGDYDAGGTRVPFLGGELEIRAQRLGDGGSLSEQFTALNQRLNQGEVFGARRFQLKQGDLQIGDGLKAHRIEVSLDNGQLGVSGTVDASGAQVGEIRLAGGRGLSLGGNALLDAHGSLLRRDSYGQIIDSPNRAMVELSSGSGTLVLASGARIDLRHGTAAPAEQVDGVARGTLELNAPRLGGVSAGDIAIDASGALDIRGAGSIALNAVQRYDDAPWGNDPAAGRAALPGDRPGLPRCAACREQRVHRRGAGQPRVARRQAGRTDQCHLRGCFPPASRGGDRQRNGGRRPGGAGRSRSVRLPLRQPQSEHAADRGLRFRRGRRAGAARRR

SEQ ID NO: 22331 - protein, 212 aa, Pseudomonas aeruginosa
PEPLRQYQRRLRAAAGLAGRQGLDPHPGGAAVRRRPGGSRPGRGARRRYRVPRRPHPQLRPADQGHHPGRRHPSGHRGSTRTALYPGRRQRAGSGHPRCRRQPAVRRGQPAARRGDAGGRQPAGCRYPAGGTGQRAGDDLACGRALAEHPARGAQQTQCPAAQWRAGLGTWFSDPFADRGGTGWRCAFHRVAAQRRCPPGTQLGIGRDAAGR

SEQ ID NO: 22332 - protein, 63 aa, Pseudomonas aeruginosa
GKRNSVVKGRDGNERNRPFPGCADRLLEMSVSFEQDAFRSETREQYPLTAVVTPVNTAKDGEY

SEQ ID NO: 22333 - protein, 586 aa, Pseudomonas aeruginosa
GRAPFLTGCSCVAASLLSFTELFDERTCCIRTISPDGTSGDRVKRSLFNCAHPFRQRWSIGCLAVALSCASLADEAPPAAAGAETQRLVDINEYVVRGNTVLDNRAIEAAVYPFLGPQRSLGDIEGARDALQAAYQEKGYQSVYVELPEQQVSGGVVYLQVTETTVGRVRVVGAKHYSPVELREEVPALEEGKVPDFAQVQRELAQVNRTPGRQVLPMVREGQRPGTMDVDLQVEDKNPWHASIGLNNDYSADTRHLRSVVSLGYDNLWQLGHAISLTYFTAPQDQDNAKVWSGSYTAPLSQRWSVQLSGYQSDSDVATVGSMNVVGQGHSYGVAAIYSLPVTGLWSHSFSFGVDFKDFEEQIRIGGNNDRVPIKYAPLTLGYNGFRYTERSQLALGLSLVAGTGSLLGYGDDDEEFDRKRYRAKSGFGVLKGDLNHTLTFGGDWQVATKAAFQLASGPLISNEQFAAGGATSVRGYLAAENTADDGYLLSQEWRTPSLGRFLGKRAGGYVNDWRFYVFAEGAQLRLQDALPEQDDDFSLASVGIGTRAQLADWLSGSLDWAFPLLEGTNTDKHDSRLHFSVQASF

SEQ ID NO: 22334 - protein, 145 aa, Pseudomonas aeruginosa
TVSALPPARPWRRGNGSIWRWSPTVPGWRCISGGAKSPAWRRRCRRSAVRSPSARKARPRLRSPPKRQAGKVRRAPRRRPCNPSRAPSTSCACRRSPARRRCSSPTPPPRAPSRAWWPTGSTRSSPASASASSASCSTQCRWMPG

SEQ ID NO: 22335 - protein, 299 aa, Pseudomonas aeruginosa
RRSAPAASRAPTPLPSPRPPSRRSAPPWTACAPRRTSSSARACRACPTPSPAAPTSACSAPCWGSWWCSSAPPWPATSTSMPSPRAWAPPCWPRPWACSSRSPRCSATTAWSRGTRKSARTCGCSSTSSSPASPRCMAKASSAKWPMVATASRCRPEENAMASVNSSHDDDDDGAVDSINITPLVDVLMVVLVMFILTATAQVAGIQINLPKASATVALSQPKTKAISVNDAGQVFLDAYPVTLPELEDRLRTEKALNPDFPVVVRGDATVQYQKVIEVLDLLRRLELSQVGLVTGKPT

SEQ ID NO: 22336 - protein, 135 aa, Pseudomonas aeruginosa
AACAARRPRCRRSSRCRHRLRRRRKNRRNRSSRWKRKRSSSRNRNPNWRRSSRRRKRRRRRPTTWPTRCRWMATPSPAPTLSTSAPARAAGWPVPAAVAPATPAIASTWPTPSSACCGTTRSCATWRSACRRRSG

SEQ ID NO: 22337 - protein, 428 aa, Pseudomonas aeruginosa
FRLHFKTKIPSLRFSFILKPYGALRMPSSPSSLPSALVLLFAVACGLSVANVYYAQPLLDVLGAEFAIGQAGVGLLFGATQAGCALALLLVVPLGDLLERRRLMFVQLLLLVLSLLLVGFAGDTLGLALGLLGLGLLGTAMTQGLLAYAAALAAPGERGRVVGAAQGGVVIGLLLARSLAGLLADLGGWRSVYLVSAASMGGLGLLLWRVLPAAPSNELGLTYRQLLGSMFDLLASQRVLQVRGLLGLLMFAAFGVFWSSLVLLLGAPPHSLSHSAIGAFGLVGALGALGAARAGSLADRGHAQALSGGALLLLLLSWLPLALGAHSLAALILGVLLLDLAGQAIHVLNQSLVFAIDPRAHSRLVGCYMLFYAAGSGLGASAGTAMYAWAGWDAVSLLGAAISLAALAFWWFTRGVGGEARTACANGA

SEQ ID NO: 22338 - protein, 661 aa, Pseudomonas aeruginosa
PARQSHRGDRPCQDPDLGRPARLHRHRRHRYLHLHATLGVVHLARMGRDLPAAFRPLGKRNSRTDQPLPEYRQVPQEQHLPEGRLQLHRRLQGTRPAKEVELLYPADLRQRQVHHQSLVAPRESLRRAGRRFCRRNRAVRMDKDNSMSRNNPSRHSILVTSNINAANDANRLSELCRQLEIRGYRLFQAPSRKVALDFLGNAAHPAGILLLVAEPTGENEAAQLAALDDFRQVAPSIPLFLLFRQLRIEQLSSQLLDEVQGCFNLAAGPARFIAERIDSDLREWRAPAGPRRLRDYAPPVPRTPVSARYNGRARLDLAPAKQWRIGSESTAEHLATPLNDLSTAYRKTSAGAPAAHAGDIAEAFRRALWEAAARLAREDGDTWFFEILRGNPGPGIEAGRETPAKRWHGLAETLDSSPLLDPLRVALSAPGLDSRGRPASFGVPAAVVCRYLRRHGIAPLRTGDYRFLLLFPQGARAEHAQPLVDRLCEFKRRHDDNAPLKQVLPELLDSSPLYRYIGLRELCAMIHEASLRLHLTALADAAARAAGHAALAPATVYGHLVRDETEAVAIDRLGGRVVASLVGVHPAAAPLLLPGERVADESPALIDYLLALQAFGEHFPGFAPELQGIEIDERGRYRVRCVRPAALARGSGLRLATRRPD

SEQ ID NO: 22339 - protein, 512 aa, Pseudomonas aeruginosa
VPGAGRRPGGCAGRVRRRAGPSSTPASIFGLSLTSMTSTLSPACFRFHPVEAVADQPGGLQGQLQHRRRHLLQRHGAALAVDVLPVGLVVVDLPVAARHEVLAGVQRLAVEHADAPVVLGVEELLGQQQDRALEQLARRRQQFAVVVDLDHATGEAAIGNLQHQREAQAPGHPLPVLRAFLVEDLGERHAQLPATKQVGQVDLVGAAQDRCRVVHHHQAFALGLLGEAIGMVVDPGGLADQQGVELGQARVVLASDQFDVDAEAGADPYEVGQRLRVGRRQRFVGIVEDRHVVACHPPRTRHAPGAPAETVEGIGEDILLVAAQAVQHARAHALDMPALLATELHQQDRTGKGFEQLAREVGQRLELGMAEIQGQGEAVGGAIGRTAQRLVQGLVEATQGQPVHRLASQFADAAQRRDHPVATGLGQQRTVLAEAEVLVAAAQVDHLHAAAAVVVRRLLEVFLGGEYFLAGQVGGPVLASLDDDHQAAAEVGESRRSGLLDGGHAERPVEGG

SEQ ID NO: 22340 - protein, 410 aa, Pseudomonas aeruginosa
HEWRYPLNDGTCRSRPAGASCRASLRKLYERRRQTPARQPARAAGYRAASAEEHFYAGVARSSGQAVEHPAVDPQGRAGGRRGLGRAGVDHQVGDFLGRRQALDDRTGTVLPDKGGAGLFYALPGLLRILAEHLGDAFGEGRSGQHRIHRHPGAGQALGQAARHREVGGLAEAVVDHVRRDVQRRFRRQEHHSPPTPLDHSRDVGAGQAYPGHHVDLEEAAPLGVLDVEEVLQLEDAQVVDQDVRLRLGRDEGRAAFRRAQVAGDAAYPGIRLAVPDRRDRTVHRRLAASVDHHGGAGGGEAAGDGEADAGGGTADDCQFVAQIDLHGSLLSSDEPLRNAARGTDDSLDQPAFRARPGPQRRRPRLIIAAELPSSTSSLPSGPKRTPTEGMIAGATPKRFSGILSRYSPR

SEQ ID NO: 22341 - protein, 668 aa, Pseudomonas aeruginosa
AGMHPATTLFGKHDTLVASPAGENRETPCPGEARRSRLNKNQNKSRKKFMRIAPSLLSTAIVAALLSAPVVADELTGTLKKIKDTGTITLGHRDASIPFSYLGTEPGKPIGYSHDLQLKVVEAVKKELNLPELKVRYNLVTSQTRIPLVQNGTVDIECGSTTNNEERQKQVDFSVGIFEVGTRLLSKKTANIKDFDDLKGKNVVTTAGTTSERLLKAMNADKKMGMNIISAKDHGESFMMLESGRAVAFMMDDALLYGEMAKAKKPDDWVVGGTPQSFEIYGCMVRKGDAAFKKVVDKAITDTYALRRGQQDLRQVVHPADPAEGPEPQLPHERRAEEADRQPDRQGRRADVTSAWRSSRSASASRVAPASQRGLGDAGRGLPLPSRLPRKSSAAGPHGRAGACLPRQCLQPIEPRGNPNMNYNWDWGVFFKSTGIGSETYLDWYIAGLGWTIAIALVGWIIALALGSLLGVMRTVPNRLVSGIATAYVEIFRNVPLLVQLFIWYFLVPDLLPEGLQTWFKQDLNPTTSAYLSVVVCLGLFTAARVCEQVRTGIQALPYGQTSAARAMGFRLPQIYRHVLLPQAFRIIIPPLTSEFLNIFKNSSVASLIGLMELLAQTKQTAEFSANLFEAFTLATLIYFTLNMSLMLIMRLVERKVAVPGLISVGGK

SEQ ID NO: 22342 - protein, 268 aa, Pseudomonas aeruginosa
PYDFHQECQQVVWRLPGPDRLLHRGCERRSGGGLRAVGLGQVDPDQVRQRTGTLPEGRHRRRRHLHRRSEDQPAQAALAGRHGVPAFRAVSPPEHHREPDHRADQGTRPQQGRSHQEGPGPARARRSQGARAQAPRPALRRPAAARGDRPRAGDGPGGDAVRRADLGARPGNGQRSARRDGPVGPRRHDHDVRDPRDGLRAQGRQPGDLHGPRADRGRLREGGVLRRRQRPLRTCPAVPRQDPPALMYPPSPARPAGACSTLACDNNK

SEQ ID NO: 22343 - protein, 560 aa, Pseudomonas aeruginosa
GKPMQPVLFRTLSLGVAIAAASSSAFAATLDGGAVAAPDEYGAKVAAQILKAGGNAVDAAVATAFTLAVTYPEAGNIGGGGFMTLYMDGKPYFLDYREVAPKAASKTMYLDDKGEVIENLSLVGAKAAGVPGTVMGLWEAHKRFGKLPWSELLTPAIGYAQKGFKVADKQFQYRQDAVALFNGKTNFGDYFGHMKAGEAFLQPDLAKTLERIADKGPDEFYKGHTADLLVAQMQQDKGLITHQDLADYKVRWREPMRVDWQGNTLYTAPLPSSGGIALAQLLGIKENRAADFKGVELNSARYIHLLAEIEKRVFADRADYLGDPDFSKVPEARLTDPAYLKQRAAEVNPTAISPTEKVRPGLEPHQTTHFSIVDADGNAVSNTYTLNWDFGSGVVVKGAGFLLNDEMDDFSAKPGVANAFGVVGSDANAIEPGKRMLSSMSPSIVTRDGKVSLVVGTPGGSRIFTSIFQVLNNIYDFHLPLEKAVAAQRVHHQLLPKDTIYYDAYAPLAGKVAEELKAMGYTLEDQGWNMGDIQAIRVDGKALETASDPRGRGVGLVVKP

SEQ ID NO: 22344 - protein, 915 aa, Pseudomonas aeruginosa
RRRRRHRDHPRYRHPGRDRLLPDPGRAHREAYRGGRLDAPGHRDVRRRHAQPVQRRGGGRRQVGTRQGRADHHERRDPLRPRREQDGQHQDRSVQEPVGPAGHGGRGQELLVPRTGEAAHGELRVRHQADLRAGSGGNRLQLRQRQRHRLQGPGPGRRQGDHPCRHRQRLGARARGADPAGTAQAGRADHPLLARQCRRLRPAQRRAAGRQERLDRRPRPEPAEGAHPGRGRDDQDPGQQGAATDLLGILSEPFRRRLPAVPENRPLRRPSWRRAGLSATTVMESPDPPCSVPPSLTVKPRLVRQLLLPIPLLLLMLGFGYGGYRISESAGIRALAENGERQLELHARTVESEISKYTYLPSLLELERSVSHLLTDPTPYRRNQVNAYLEGLNRRAGSRAVYLLDTNGRVLATSNWSDPDSYLGEDLSFRAYWQDAMKGKPGRFYGIGSTRGEPGYYLAHGLVHGGRIIGVAVVKVKMDALEERWEKARLEAFVSDENGIIILSSNPALRLKAVRSLSADDKERLARSMQYYWWALNEWQPLQREPLAAGVEKLSFPADEQHPRGEAVTYLAQTRALNDTPWNLTLLSPLEDLRRDAVRNGMLAAIGFALLAFLLIAWNERRKVLATRLAAREALQRANGELEVKIAERTADLQASNARLTAEIHERQQAEDTLRKAQDKLVQAGKLAVIGQMSTSIAHELNQPLAALRTLSGNTVRFLQRGKLETASTNLATINELVDRMGRITASLRAFARRSDDAGQASLAKAVDAALLILHGRLEQDPPTLHRHFDDVRLGIDQTRLEQILVNLLANALDAMSGQADRQLWLEGRREEERYVLRVRDNGPGIPPAARVHLFEPFFTTKPGEHGLGLGLTLSASMATAAGGSLSVQHPESGGTAFELSLSLVPDSPTASPAR

SEQ ID NO: 22345 - protein, 68 aa, Pseudomonas aeruginosa
RSTACNRPERPLRPARLAQGAMLHPTFLTRLRFRSADNAGGVIRPTRLTQRVIGHSSSLGAPALSGHS

SEQ ID NO: 22346 - protein, 444 aa, Pseudomonas aeruginosa
IELKCHFPRQLFFARIVPPIMRPPSSSTPRRGRPHERDRHHAVQPLCPWPPDPPQSHRHAADDPFPRRQWRSRHRADGRVLQPARRRRPDRFRRHPDQPAGPGLRLDAGHPQRRAGRRLAPGHRRGARRRRAHLRPALARRQGLAHLAATGQRRPGVLLGAGGRRREGLRRSPGPRSAGRRRRDGPALGAARTGRGGNPGDRRRLCPGRTQRPRRRLRRGRTARRQRLPDQPVHRLPGQCAQRPIRRLAGEPPALPPRSRRGGHRGGRQGAHRRAPGAADHPAGRGRRHPASHLPGRGAATGRDRRGLHPHRRGRLGRRPGHAGGVQGSVAHRLPWQPDLLRHVHQGARRGSPGQGLGRPGRLRPAVHRQPRPALPPGARPGAGRRRPLDLLRWRRRRLHRLPEPTAGGRLKPLADRTASARPVGETCRHNLAFGRLEPTAGGT

SEQ ID NO: 22347 - protein, 99 aa, Pseudomonas aeruginosa
TQFARYSLLIGLISWTGGTTDSIEEHFEESAMSKSLIVSLAASLVVLAGCANPPRSVERPYSDAEIKSYALDSLERSDLSPKRLDQYRSVLGTPHRQTL

SEQ ID NO: 22348 - protein, 517 aa, Pseudomonas aeruginosa
AHMEWIADPTAWLGLATLIVLEIVLGIDNLVFIAILADKLPPHLRDRARVLGLSLALLMRLGLLASISWMVTLTEPLFEVFGKSFSGRDLIMLFGGVFLLFKATMELHERLEGHVAQHAGNKTYALFWPIVAQIVVLDAVFSLDAVITAVGMVEHLEVMMIAVIVSIGLMIVASKPLTRFVNRHPTVIMLCLGFLMMIGFSLTAEGLGFHIPKGYLYAAIGFSILIEVFNQVARKRRKKSLQGHRPLRARTAHAVLRLLGGQRLEADEVGEEVADLFEEGDDQVVFDRRERVMISGVLQLAEKPIRSLMTVRAEVDCIDLDSGREAIRAALLESSYSRLPLVRDGRVEEPLGYVHKKELLKEQLAGAQPDLESLARQPLNLLQDCSILNALEQMREASTHVAFVVNEFGEFIGLLTLTDILESIAGELPDASEIDGPDVVEENDGYLVSGAMNLSQVRRRVGFDARATEDYQTLAGLVMSLLDRLPVIGDRLQWQDWELRVVEVEERRVTRVLLRRG

SEQ ID NO: 22349 - protein, 536 aa, Pseudomonas aeruginosa
CRGFPPAAERHAARPLRAGRRPARRRARRRSSDGRGRPGATPLPDRSRCRPRSPGFASVSSRLPLDCCHGHGGLGDGLVLGRAGAGDADATQAGTAGIAQRHAAGEAGQPAVALLDAPQRLARPGESAQLAAGQAEQRGAARLALGQVDGTGNAVVHPYERQQVGMGVDHRDADRQALPLRFGNGRRDAALGMLQRQVGRHGRRPHRVLAGQSRKVEALTEPAFSYVDFQVFLTMNRRDPLAGLHVFRQVADTGSFTRAAALLGVTPAAVSQAINQLEAELRLKLFHRTTRGVSLSEAGQRYHEQTEQPYRDLVRAREALGESLAEPSGQLRISALHLAKNLVIAPMLNEFVRRYPKVQLEIRYEDQLVDIVRERLDAGIRLADALQPGMVGVQLTAPLACLLVATPAYLAEYGTPASVADLDGHAAVRFRFPRSGRLHKWRLREDGRELEVDLPARFVSTDTEAIIEAARAGAGIAQAFIRERVAADLAAGRLVEVLPGSCLPLPPMWLYYLNRRHVPAKLRAFIELLREWRQPA

SEQ ID NO: 22350 - protein, 729 aa, Pseudomonas aeruginosa
TSAALAGRPRPAQQEVVRSVDLDEATAFQRLLQRRAGEHVGLAQGAGETQVGAGLDLRQRHLVGLERTVAEAFAGHHPFLPQQVGGHSQFAAVGVDHRHHLPELQRHLHALVERIVVAEHRAGEHRDAEALAPGVLQHVVLQRQPAALVELRHLGHRVGVDEGVVLSLPGDGIAVAPAGILATHHVALVERSRAVEVLVSDLRGRLDARVEAPGILALERTLERAVDIHRGEDRQAPAGAHHHREMQIVQARALAHRQHLVALARLGQGRLRPEEGLVETLALGQVGDAALLFLEARHAALQLRPGHRHPGATRQQAADHAGLHRIVGLAELAAEVQADHLAAVDRKHRRAGIAAQGRAVVGQVPGVMGQSHDFAGSEALDVVDVAEDIFHRPGVVAAVARRIADHRHRLARLGILAREDQRRRQQVALHYLEDRHVRRLGDVRGDPQDPRDHMLVAFRLAVFLAEVHAGAHLLAGLVETEAEQAALAFGEQAGDMPVGDDQVVLDAPAGTAPVHAVVVDQFQPTDRADRRGQRGAMLLQALLQAGQRRFVEDTVLHQQHRPALEQDDRLAEAPRVEERGVGFRRHALAQVVGDLLAAGVVRRHVAPLTAGGEVGEFLAGALFLQYRADPQFFRRGPPGVALAHGHVPRWADIPGRSLAEGHDRAMSRWRTAAPLNRRTAGRPGCGFPPSTDSRWLATPPPARRAPRPAPVIRPAPDRRRRRGCGSGTG

SEQ ID NO: 22351 - protein, 171 aa, Pseudomonas aeruginosa
GSRRSSAGLRARRHRGQQVGAVGVVHRAAPLAIGLLAEHVGGPTLQASGLRLDHRLGHDQRRISRLDHPQVVLAHSQAVLEVPGDGVERLADLRLAAGVEARLDHQGGVVAIEIHQGIELPGIDQGVGPANEVLEGLVLHAVLPVRWFWPRRQNEEPASRAGSEWTLANPP

SEQ ID NO: 22352 - protein, 356 aa, Pseudomonas aeruginosa
PTAESRNRGLAARPFCQAATASLPSRRQKKSPANRPAGLSLKRVASEQRGDQMGGGRHLEVDGHHHAQRGDGDDGEGEQLARPDPVVGGPVAGQGDGQPPQAHRHRHQQVAVAGVAAQAQGEGRRHEGEDVEHDVDLGHRDAARHRQHRDASRLVVLQAEDGDGIGVRHLPQAEDRQQRGGAGVELAAHRAVADHRRHRPGEAADQRAVLRTTLEPQAVQADVDEVAEAGQRGGQRVGPPPQQAEAGDPEDQAVGQGSLQRDLPGHGDPPAGPLHVPVDVAVDAVVQHAPTGDHQRQADDRGQQQHRLDAAAGGEEVSPRHRDQVAEDDSRLGHQEIAFQLHVMALRASASSACRR

SEQ ID NO: 22353 - protein, 704 aa, Pseudomonas aeruginosa
GSPRARSRSRRNPGCRGRRRGCRVQRCSLQGPHQVDDGEDADPDDVEEVPEQAQAHHPGVVLRGEAAGPDLRHQHQHPQQTGADVQAVHADQGEEGRQEGASARAETFGDQVVELVDLHPDERGAEQEGDPEPGDRLALGALVRREHGQAVGAAGNQQDGGFHQHVGQLEDVLAAGAAGGVVNQHRVGGEDAGEQHAVGHQVEPETEYGVAAAIVCMIVVVAHFVGVGQMLVQYCRRHGSDLLGELLETGAFDLLDLFGLDVVVDVLVVAAHDEGADHADEADRHEPPDMPDGGEAEDEGEHGDGEARGGVLRHVDRLVGRQLAVGGAGLLHVVEGIHVLYLRQLGEVVERRRRGSGPFQGAAFPRVAIDVGQLLAVADRDEQLDQLAGDAAEDQHGAEERDHQVGLPQRVVVVVQATGHAHEAEDVERHEGHVEAHQPAPEGTLAPLLVEGEAERFREPEGEAGQVAEYRAADDGVVEVGDQEQAVVQQEVRARDGQQDAGHAADGEGHHEAQGPQDRRAEAQAALVDGEQPVEQLHPGGDRDQHGGHAEEAVDVTARTHGEEVVQPHGEAEEGDRGAGPDHRLVAEHALAGEGRGDLGEDTEGRQDQDVHLGMAPGPEEVDVHHGVAAELVGEEVHVQVAVERQQAQRSSEDRERGDDQDVGEGAGPGEDRHLHQLHARGTHLEHGDQEVDPREQRAHPGYL

SEQ ID NO: 22354 - protein, 664 aa, Pseudomonas aeruginosa
RPDVVVHPYPGAIGQLRQRRIGHPAGTGEFAQAQRHVDQHGADHEQPEAQRVEEGERHVARADLQRHGQVHQAGHERHGHEDDHDHAMRGEDLVVVLRRQVAVVGAFGQGQLAAHHDRVGEAADQHDQGDDDVHHADLLVVDRGQPLGPQVGPLAVVGDRTDHAEAQQGDDGQCDHDDGLVVRHGRECQFPEHLRLLLGTRLHVHVLHVFHALHGLHVHVLHVVTGHGGFVLSPGVLAVRGTLGVAVVLVLGEDVAKQFRADRREVGRRNVLARLDQFRIGADRQACRCRLDLGDPVLEALLGGGDGLEAHAGETAAAVVRGDTVEHAFFVGDQVQLGHHPGHRVDLAAQLRDEERVHHRIRGDLEIHRGVFREGDLVDRGDTLLRVDEQPLPIQRNGLDGDRLDLGVQRTVRVELVGAFPGDPAEDRDDHAGHQPDHRLDAVGMVPVRLVLGLGVRGAVLPGERQGHHDHRDDHDQHQQGRGNDQGALVHAHLPFRVEQGHVAAAEQQRGRQGKPFQCGKRVCFGHLPALIDGRSEWSLMDVSLQGLWRRPLASASSRHAVAAGVRNGHCPATGEGKRIPFPIPVADSFHALSRSLMNSVFEAVPEEAKGGQGTCMPGREGLPFPPGDQVAVIGRLFVVQQARQEPIYRDAEQRLARRSLDRN

SEQ ID NO: 22355 - protein, 183 aa, Pseudomonas aeruginosa
PESQCLSACNCTPAVRPDAPTVSAAGPALTRRRQSSAAASRALAPATSIARRKPSASAAGSSASSPAREPGKRWDVTAWVASRCASAIPSPSSRSPRTTIARPLSSAPSNAMPTAMPAWRRVFMVAEAIPERSRATLAMTARPVPGTARPMPRPSATSNRPTQGYAVPVPQAASASMARPITR

SEQ ID NO: 22356 - protein, 141 aa, Pseudomonas aeruginosa
VNAPSQTTLSSCPRGSKAACSGCAVSSMPHRPRASASRPSGRLIRKMLCQPACSTSRPPSSGPRISDSALKEVQPPITWARWPGSWKAWVRIDSAPGINSAPAMPWTARPNSSSASEVASAQSSEPKLNRPTPSSQVSLRP

SEQ ID NO: 22357 - protein, 460 aa, Pseudomonas aeruginosa
RESGGEQEAVDEGRGVGQRLQQVEQPTEHGHAQAERQLPIDVPQGAGMAHARRRDVEQGHALCRAATQAAAESHGRVGPRQLPEAAPLPASSQPQQAAGLYRHARQQQGFRPPAIEASPGQADGQAGRQRPGQHQRTGTARAEAEGALQIEHGDQVGAHEGSRHAEIDQHRRTQQWRLQQAKVEQRVGTSAPVTPVAAAQHAGQQRQEQATPAAAGRSQPGERHQQRGQRRRAEQQAAQVQALRRMLVPGQPAHRQGQHQQRRRHAGEEDPTPGQAVHQPAAEGRRHGGNDQRHQHHPCGQAGPCRRRDIPIGHGLAEGDQQPAGQPLAQAPDDQRRRRSSQAATQRSAGETGQCQQHQSPFSQARSEPDAQRNHQGQAEQVGVADPRQGRHRSAKGTPDVRIGDAGDEDVHQVQGEPQQVQSGQAGRLIHGRSGGLPGSIARRSRYLERLIAHRLSNRI

SEQ ID NO: 22358 - protein, 63 aa, Pseudomonas aeruginosa
RCSTRRAWPSTTPAPSMANCVAACASPPPRNTACANWCRPCRHSPGCTRRCRYNCRPHRCMPT

SEQ ID NO: 22359 - protein, 262 aa, Pseudomonas aeruginosa
  UNSURE (182): Identity of amino acid at the above locations are unknown.
LANASTSPSAWGAWRTPPTMRCNWPASRSWRWPARPAWRRSANRRRPTWRVWSACRISVTAGWRTPCPGKYAPPTAPCAATADRAIPCCWPTTPRPCAPLPSTAWVSPCCRTGWCRPTCAAAHCNACWRTRVSAPGRACRLSADPPPAVEGPRVHRLPQDSPGAPGRRLENRGRRGLSPFVXPLPRSVLLRLLFGSCACLLFAGTFWLSSITAVSAVTRSLILTGRSISFGFVWMLSAISLVQLLFMLLAVIYDYALARVLL

SEQ ID NO: 22360 - protein, 231 aa, Pseudomonas aeruginosa
PMTLLDIEKLLDMTHHMSVHIPIELIISWEQSEEAWSVKDNCLNFVYVNRRYTELITPRFGQKNSLLSPFSASIEEHDKLVIQTGKRIEALALLRPDDHPAPCCLYFERMPLYDRRGNRTGVIAHAKTLTSVAPRGFIATDGIGTFTFTPPSELFTSREWDVIYLLLSGLSEKEIAEQISRSLSTVKFHKSNIFQKVGCSCIGAFKALARQKKWNFYIPPTFASAKYIINH

SEQ ID NO: 22361 - protein, 101 aa, Pseudomonas aeruginosa
WTTRCSTAKWPRPRSRTTGSSAAPRSPSRSTAAWCARATRRSRKWSTRPSPIPTPSGEVNKIYDKWFTQPIPPKGLNLNFPMSEELKKLIASPTDKAAEQM

SEQ ID NO: 22362 - protein, 170 aa, Pseudomonas aeruginosa
ITTGTGACSSSPPGSAAKPTSTGTSPVWAGPSPSPWSAGSSPWRWARCSASCAPCRTAWYRGSPPPTWKSSATCRCWCSCSSGTSWYPTCCPRACRPGSSRTSTRLPRPTSAWSSASACSPPRGSASRCAPASRRCPTGRPRRPARWASACRRYTATCCCRRPSGSSSRR

SEQ ID NO: 22363 - protein, 468 aa, Pseudomonas aeruginosa
EVNDGLQWNRSRPAEPLGRHADDPQADGPRRPRRRRAGYRAGADAAVAQQVAVEHRRLLRQLLPLNPAAAGDHLVLLRGALHPALDHRRGHPGGGVHLLPGGLHDVRGGLLLRDRPRRHPGHPERPDGRRPGTGHDLRADHAPGDPAAGVPQDDPAAAATEHHPVPGHLAGLYRRPDGLPQFGPFARRHHRPGQRVPDFRRPGLLRRKLHRLVRRQTSAEKVNRMISIKNVSKWYGDFQVLTDCSTEVAKGEVVVVCGPSGSGKSTLIKCVNALEPFQKGDIVVDGTSIADPKTNLPKLRSRVGMVFQHFELFPHLSITENLTIAQIKVLGRSKEEATKKGLALLERVGLKEHAHKHPGQLSGGQQQRVAIARALAMDPVVMLFDEPTSALDPEMVNEVLDVMVQLAHEGMTMMCVTHEMGFARKVANRVIFMDRGQIVEDCEKEEFFGDVSARSERAQQFLAKILPH

SEQ ID NO: 22364 - protein, 393 aa, Pseudomonas aeruginosa
NPDRTAGGRRRPRLIACNDDNPTNLPTRDIAMKPLLHAFAPGVMALMLLLPQAAQAKEVAPQQKLSNVVILATGGTIAGAGASAANSATYTAAKVPVDQLLASVPQLKDIANVRGEQVFQIASESFTNENLLELGKTVAKLADSDDVDGIVITHGTDTLEETAYFLTLVEHTEKPIVVVGSMRPGTAMSADGMLNLYNAVAVAGDKSARGKGVLITMNDEILSGRDASKMVNIKTEAFKSPWGPLGMVVEGKSYWFRAPVKRHTVNSEFDIKQISALAPVEIAYSYGNVSDTAYKALAQAGAKAIIHAGTGNGSVPARVVPTLQELRKQGVQIIRSSHVNAGGFVLRNAEQPDDKNDWIVAHDLNPQKARILAAVAMTKTQDSKELQRIFWEY

SEQ ID NO: 22365 - protein, 204 aa, Pseudomonas aeruginosa
ACPWFPIPRLRVPPDERAAFRPDRRRRSACLARLPAGAGAGGHPLHRRRQRRGGAATGRPRLRRHRRQRHPPARHRWPDPAGASQGPRPEPAGGADHRSRRHLHGGTGDARRRLRLHGEALLSGTPGRGRPPRPGAARAGPRGQRAASPVGRPPGPGATDHRPLAGDPGVARADRQRRRHLGQRADPRRDRHGQGAGGALPPRL

SEQ ID NO: 22366 - protein, 292 aa, Pseudomonas aeruginosa
PAPPACLRRAELRRPAGEPVRQRDIRPRGARLHRCQQAADRQDRACQRRHAVPRRDREHAGQPADQAAAGVAGTHPGTPRLEPVDPGGLPGDRGDQGRPRRHGQERPVPQRPLLPAQNSEPGTAGAARPPRGHPAALRTLPPAVLAALRPPRAGTRPCHRGQPDGPRLAGQRTRTAQRRRTLRPRPAGVQQGRPGRTDRRPALRRSGGGIREGPARRRPGPPPRQPDPGQPGPGHGQDHAVRQGEEVRPAIGRSALFALPAWRRARCFIRHFSPACDSARRITPGALFALPA

SEQ ID NO: 22367 - protein, 390 aa, Pseudomonas aeruginosa
CAHLLPVRRAAAGLTSEIAIMLFSPYALGHLTLPNRIVMPPMTRSRAASGEVATALMAEYYSQRAGAGLIVSEGTQISRQGQGYAWTPGIHSAEQVAGWRQVTDAVHAAGGRIFAQLWHVGRVSHTSLQPGNAAPVSSSALVAEGVKVFVDPQGRGAQAGGGEMVQHSAPRALAVEEIREIVADYAQAARNALDAGFDGVELHGANGYLINQFIDSQANARNDQYGGSLENRLRFLREVAEAVTAVVGRERIGVRLAPLTTLQGAVDDTPQATYLAAARLLDEIGVAYIHIAEADWEDAPAMPAAFKEALRIVYRGSLIYSGMYTKARAEEALARGWADLVGFGRPFIANPDLPYRLEHDLALADGDRSTYFGGGAAGYTDYPSLPQAAG

SEQ ID NO: 22368 - protein, 445 aa, Pseudomonas aeruginosa
PGSCCAGAERSGGRRSGRRPPRRSGRPLQAALPGLRLLVLHHLDESFRQQGAERAFVSLGQLDHPRDHFLRIVLLEGKAHAAVVGEVALRVVPAFPGFHHAIVEAGLVRAGIDGANLDAERLQFGMQGLGEGLQGMLGGAVGAGIGSGDQAGDGRHEEHLAATLLLDHAPDETLGQFQVGEHVGLEQRAHQFQRDLRAGPGFGAAGVVQQHVDIPFPGAFAIGGDVDVEGFHPQRNATPPGLFAQVGGLPGAAHAGDRPMAAGGQAQRHFPTEAAAGPGHQDSLLFHLDYLWIVAMATAASAMDWSWAALAPETPTPPRQEPPASPSGMPPAKQASPPLLCSMLHNGWPGPASRPSSPLGRRNSAALRALRWARSMAPGTLSSIRTNASRLAWASTTATQTARRCRCASAMAAAMQRWACCRDRWVDMAGVLIECLRASLERSKL

SEQ ID NO: 22369 - protein, 495 aa, Pseudomonas aeruginosa
SGQHPTVGGAVVAVVEQADVPARAELVEEVQQGPGAFGKLEAEQPLAAHLGTVAADHVADVQLGHLVVGQVEYREALLAQAGEQVGAAVGERMGLHADEQVGLAVAVVAVVELGDLAPAQRRAEGLEAARPLGHGDGDDRFALFAQFGALGNVAQAVEVDVGTGVDGHQGLPLGAFAGHVLLDPRYGQGAGRLGDRTGVVVDVLDRRADFVAADGDHLVDMVLADLEVASADLRHRHPVGEQPDLAQHHPFAGGQRRLQAVGILRLDADHANIRTQVLDVGGDPGDQAAAADRHEDRVEAAAVLAEDLHRHRALSGDHVRIVVGWDEGHAFALGQLQGMGQRIGEGVAVQQRLAAARQHALDLELGSGARHHDHRPHAQALRRQGQALGMVAGGGGDHPAGLLLVAQARDTGVGAADLEGEHRLQVLALEQHPVAQALGQLRRDLQGGFHGDVVHRRGQDAFHVAGQQGFACAEGRGAHRLASALAATEASRSVP

SEQ ID NO: 22370 - protein, 479 aa, Pseudomonas aeruginosa
GRAPRGAVDPVVAQAQAEVPALVQGDGVEGVQRLDLQFGPVARAVALVGGAVPVARRVVQVEAVGRVELAQVVGVGGAVVGLAGQLEAADQRMRQAEGIEAAGEVGLVDPHPRLRIAPVGLRSRRQVATRRQALLVDVGGGDHRVPMQVGIADEVLQLEVVAEIVFELEGGDVVVDPFLVQVAPAEIIVAADAVQLAPVQRRHAIVGKVVVALVEVAQGQAGRGVQAEGQGWRDAPALLVDLFAPGDVVVVGHEVEAEGGRFAKPFQRLVGVQGQAPVAVRAQPGAQVGEGFGLGLLADHVDAAAAGAGAAEHRVRSLDHFHRLQVEQVAAAGLGAVAQPVHLHVGVGAEAADVDAVAGTAAALAGVEGDAGDVGQHLAQAQGVLLLDHLLRHHRDGLRGIQQRHGVLGRGRAFDPGRGLLAGDRVGSQFQGIVLARRVLGQGRRGAGGHQQHQRRQRAFGGQGGRLVATIHEVLHLGY

SEQ ID NO: 22371 - protein, 71 aa, Pseudomonas aeruginosa
SRAFTCLRQVVAGHTLAQQLEYANILRFEQHNARKSPPRQHRDPRVSVYRPATVPLPFVQMRQLYPPPGRR

SEQ ID NO: 22372 - protein, 175 aa, Pseudomonas aeruginosa
PPDRCRERPGPCPGRAPPATGRPRDTRFPYRKRPAPAWPGRSPGSPAPAGVAAVRAAATGRTAWTVRPWRGTAAPGRSRPAAPRHPAPAGRTGRGRTGWRSRKNRGRTRPGCRRRTRPGGTTPGAAAVGRSAARRRGSQAGRPRPGAAPARPWETTSRPLPRRSGRRSTPPARPR

SEQ ID NO: 22373 - protein, 244 aa, Pseudomonas aeruginosa
SIDRRSVNKYRETFSSSCHASSSPPRSFTLRPTQPPDPRSMPDRHAEQPARQPRTKPAEVRLEELMAAAQQLFLDKGVDATTISDIVAAAGVAKGTFYHYFQAKADILLALRERFTQAFQQRIANAVEACPANDHPGRLRAWTESGLAGYLEGYRLHDVVYSEHHHHQRGNQERDRVLEQLAELLENGAAAGAWPLRNPRLNALLLYSGLHGAADDAIAGGRLDTQPLAGELADAFLRLLGASD

SEQ ID NO: 22374 - protein, 318 aa, Pseudomonas aeruginosa
SRIDCQIEFDNRVAFHGQPRPLRNLSRRGRLRFPQRRRRHPRPDACGSQLQPQAAGGRAGRFSAQPQHPADGPDRCWRTLLPALREGARRGAPGHRRRPRRAWRTAWQPARHHHPGIRPAPTGAGPAGIRPAAPGVAGTIVDLIAACRPDWRTLRRRHPPGAPGGLHPPCGATGQLRGPGGGQPGLPGGARRTAADRPGESGAPAESRSQPAGGLPALASTRPRRRPAQLPRTAPSHAAGRQRRGPARLCPRRPGYRRAAGLAGAGRLALRRTATPAGGHGFPLQGVHAVYPPTRHLPSKVRAFIDFLKTRLGHPDAG

SEQ ID NO: 22375 - protein, 442 aa, Pseudomonas aeruginosa
FHIETLRSASHAILAILPPLRAGAAVRRRLRSQRGQRLLRPAAAGRPRCRVRHRPGRGRPAVRRDPGRLRPGAAAGGAAGRPAGAAPADVRPAPAAGAVAAAGGLRRRYPRPGAGAARTGPARHRHDPGTAGLRRGAGGAWRARAGGRRGAGRRGDRPAAGAQPGRAARRPRRLAQRLPGLGSEHGRARPAALAGTAGGAEQRTGADLPATARLDVRPAGEPARAAGARPARAVDVRRLRGVLEQPGIAARRAAAFAVAQRHRRLRPGRRARRAGRGAGRQPGRSRPRPGAQRRRPAAVAAVLAAARPRRAFAGGADSRRAAARSRRPGDPCAQPEPGLRHRPARPQPPGGLLHAVLRRRQRPRRQRRHRHVRLGRLGRGEPARRGDQPGGPGVLVVHPWRWRRSAYGLRQRRLSRLQSSSRRRCSMKRRSGSWRARASAAR

SEQ ID NO: 22376 - protein, 197 aa, Pseudomonas aeruginosa
GIRASRILFLARTMRWAMALGAARKARAISSVRRSQTSRRVSATCASGVSAGWQQVKIRRSRSSSTASPSSAGASACSSSCSASSRCEASKRARRRRLSMALKRPAETSQARGLRGIPSRGHCSTAAMKASCKASSASSKSPSRRTRVASTRRDSSRYSASMRLRNGSPCSLNGWPAHGSRRFSAPRRSGRGDAASP

SEQ ID NO: 22377 - protein, 334 aa, Pseudomonas aeruginosa
GRAPRSGRSHRVAPWSRRTARRSSPAARPGGAGWWRSAPTAGRARRCSGRPCPTGRSRSCTRRRWRQAPRPARRPASLRRNRSGRGISWRWAPGADRRSVRSVVARRGRLSTAAGKKARGADERSALAVERCRPQHKPRPARPPGAGRRSGLARCVGIQAGIAQRAFPGRPGIVLAQAETAVADLQAVLGRRLPVGAGRVAARQVRLGGLRLRLWRAAHGRRRDRRRGGQGCRQLVRQGRGEGRLAQAGEHHGQEQEKHTRHDKASIGLGTSTIAAQRPRRAKYGPAASRIGKREFLELFDRTLATSVSCQSTFRTTRPPPIRTAQKNSIKSTA

SEQ ID NO: 22378 - protein, 317 aa, Pseudomonas aeruginosa
MARPGGPQAAARLCPAGPAHAGERPLQRPRTPRSGAGQAVADRLGEHRGAPGDAAERPLHGLPQDVRRSPGGARRRHRRGLSPGALGSRRAARQGGWRYVVLRDTAGQPGAWHRGRPGDAGEALARARRDTRQQSSAGPAARRPERPRPRFARSPGQLRSTRRGGLPLPAPARHRPVAHRRLSLPAAVSPGRQGGTRAAAGGQAVRIQTPARRQCAAEAGVAGVARQLAAVPLHRPARTLRDDPRSQPAAAPDRPRRRRRQGCRPRRAGAGHGLWAPGQGRNRSGGDRQARRPCGRQPGRRPSGGRAAAVARRTGGR

SEQ ID NO: 22379 - protein, 188 aa, Pseudomonas aeruginosa
PGHLADPHPAGAERHRGHRVRLHHQQRRAPEAGRLLRRHLRGRHPPAVEEDRQHQGLRRPQGQERGDHRRHHLRAPAQGHERGQEDGHEHHLRQGPRRVLHDARIRPRGGLHDGRRAALRRNGQGQEAGRLGRRRHPAVLRDLRLHGAQGRRGVQESGRQGHHRYLRPPARSTRSTTSGSPSRSRRRA

SEQ ID NO: 22380 - protein, 253 aa, Pseudomonas aeruginosa
TEGKPQHELQLGLGRVLQVHRDRQRNLPRLVHRRSGLDHRHRPGRLDHRPGAGLAARRHAHRAEPPGIGDRHRLRGNLPQRAAAGAAVHLVLPGTRPAARGPADLVQAGPQPDYLGLPQRGRLPRPVHRRAGLRAGAHRHPGAALRADLGGPRDGLPPAADIPPRAAAAGLPDHHPAADLGVPQHLQELLGGVADRPDGAAGADQADRRVLRQPVRGLHPGHADLLHAEHEPDADHAPGGEKGRRTGPDLRRR

SEQ ID NO: 22381 - protein, 222 aa, Pseudomonas aeruginosa
MMDFSGIVPALPSLWEGMLMTLKLMVLGVLGGVALGTVLALMRLSHSKLLSNIAGFYVNYFRSIPLLLVITWFYFAVPFILRWITGEDTPVGAFTSCLVAFMMFEAAYYCEIVRAGIQAIPKGQMGAAQALGMTYGQTMRLVILPQAFRKMTPLLLQQSIILFQDTSLVYTVGLMDFLNSARSRGDIIGQANEFLIFAGLVYFVVSFTASFAVKRLQKRLTV

SEQ ID NO: 22382 - protein, 573 aa, Pseudomonas aeruginosa
IGKAHATCALQNPVPRRRHCRRILLGLRRHARRRRRRRARRVRRQGRRADPQGRRQRGGRRGGHRLHPGGHLPRGRQHRRRRLHDPVHGRQAVLPRLPRGGAEGREQDHVPGRQGRGDREPQPGRRQGRRRAGHRDGPLGSPQAVRQAALERAADPGHRLRAKGLQGRRQAVPVPPGRRRPVQRQDQLRRLLRPHEGRRGVPPAGPGEDPGAYRRQGPGRVLQRPYRRPAGGTDAAGQGTDHPPGPRRLQGQVARTDARRLAGQHALYRAAAKLRRDRPGPVAGHQGKPCRRLQGRRAELRALHPPAGGDRETRVRRPRRLPRRPGLLQGPGGAPDRSGIPEAACRRGQSDGDLADREGPSRPGAAPDHALLHRRRRRQRGEQHLHPQLGLRQRRGGQGRWLPAQRRDGRLQRQTGRGQRLRRGRQRRQRHRAGQAHALLDEPEHRHPRRQGQPGGRHSRRLADLHLDLPGAEQHLRLPPAAGEGRGRAARAPPVAAQGHDLLRRLRAARRQGRRGAEGDGLHPGGPGLEHGRYPGHPRRRQGPGDRLRSPWPRRRPGGETLTGRRAADAARA

SEQ ID NO: 22383 - protein, 796 aa, Pseudomonas aeruginosa
AASARRSGHLPGADPRAERHTVEPDPAQPAGRPAPRRGAQRHAGRHRFRPPGIPADRLERAAQGTRHPPRRARGAATGQRRAGSEDRRTYRRPAGQQRTPDRRDPRAPAGRGHPAQGPGQTGPGRQAGGDRADVHQHRPRTQPTAGGAAYAVRQHRALPPARQAGDRQHQPRHHQRTGRPHGPHHRQPACLRPAQRRRRPGQPGQGGGRGAADPARAPGAGPADPAPAFRRRAPGHRPDPPGTDPGQPAGQRPRRHERAGRPPALAGRPARGGALRPARARQRPRYPAGGARPPVRTLFHHQARRTWPGPRPDPLGQHGHRRRRQPQRAAPRKRRNRIRAEPVPGSRFPDCESRPMNEPLSVLIVEDDPHVLLGCQQALELEDIPCIGVGSAEEALQRVDRDFAGIVVSDIRLPGIDGLTLLERLKALDPSLPVVLITGHGDISMAVQAMHAGAYDFMEKPFSPERLVEVARRALEQRGLAREVSALRRQLAGRQDLAQRIIGRSPAIQALRELIANVGDTSANVLILGETGTGKELVARCLHDYSRRHQHAFVALNCGGLPENLFDSEIFGHEAHAFTGANKRRIGKIEHANGGTLFLDEIESMPVNLQIKLLRVLQEHTLERLGSNQSIPVDCRVIAATKADLAAMGKSGQFRSDLYYRLKIVSLELPALRDRREDILLLFEHFLQQSSLRFDRPAPELDRATVASLMAHDWPGNVRELRNVAERFALGLPVFNKGGQAVQTGGPRFAEAVEAFEKALLGDALARHHGNLTQASQDLGMAKTTLFDKVKKYGLQ

SEQ ID NO: 22384 - protein, 424 aa, Pseudomonas aeruginosa
PDCLARPGDPDRAGDRPRHRQPGVHRDPRRQAAAAPARPRPGPRPVAGAADAPGPAGEHLVDGDPHRAAVRGIRQELLRPRPDHAVRWRVPAVQGHHGTARTPRRPCRPARRQQDLRAVLADRRADRGARRGVLARRGDHRGGHGRASGSDDDRGDRLHRPDDRRQQAADPLRQSSPDGDHAVPRLPDDDRLQPDRRGPGLPYPERLPVRGHRLLDPHRGVQPGRPQAPQEEPAGPPPAARAYRPCGAAPARRPAPGGRRGRRGSRRPVRGGRRPGGLRPPRAGDDQRRAAIGREAHPQPDDGTRRGRLHRPRQRPRGDPRGAARIVLLAPAAGARRARRGAAGLRAQEGTAQGAARRRPAGSGKPGPPAAQPVAGLLDPQRPGADARGLDPRGLRGQRVRRVHRPADPDRHSRIHRRRAARRQ

SEQ ID NO: 22385 - protein, 280 aa, Pseudomonas aeruginosa
GPVIKPAMDDTKSTLPPRFCSTMRRTKPWVSSRLANTLVSNSARTSSSGISALAPASALPALFSSTSISHSQARSRSAATLMSRVSTRSGTPRRPASSRRSAACPAPRTPAIVRWPRAARRNATSRPKPLPAPVTRIRFCFISITSGLLPWPRRPRRWIGPGPRWRRRRRRHPGRNRRHRPAACRRRSRPARRCSARCSTTAGPARRVGPARRWAGGTARRCAPCAGPGRWHRERCRPSVRTPAGWHGRRPPRRRPPGAAAALRQWPPRCSVGHVAETGG

SEQ ID NO: 22386 - protein, 346 aa, Pseudomonas aeruginosa
KGRSFNRTGLLLRRLSSFSNNESTRSPRRPARLQAGRRHRQLHPRRRPARGDAGSGEPGDQPTGSRAASQAVPPHHPRGQPERGRAALPRTDRTALPRPGARPRSARRKPRGTLRAAAHQRPAPGEEPGDRTDAQRVRATLPEGTTGDPLRGPVGGYRQGTTGCRHPPGRRPAAGHGRGATDSAAGVPAGGHSGLPRRVRYAGQRRRPRWACRRALPFPAQRPPAQVALAGRRAGTGSGPAGTLRQHRHRGDHRGGPRRRRDRPGIHPRAGRRGPRRRAPGGSAAWQLPAAAADVAVLPEPPPRTGQAARLHRTATRVAAAGLNLSGPCRPAPAGSAGGRPVRRSR

SEQ ID NO: 22387 - protein, 148 aa, Pseudomonas aeruginosa
GSASAGWRSSPPRNADSPGACPCPPAAPGGSCPAWARPPSARGRPRRNPCARPGRRRCAAFPGSAARRASAPPRPPAPRRDAPAGCGSRWPSPHSWSCGTGRRSAGRPPRRRRSKAPPSRNCRPGSSSRGSGTRRHGAIPRLRRERSA

SEQ ID NO: 22388 - protein, 90 aa, Pseudomonas aeruginosa
LNSVIWRRPSAAQKALKLPGRSATVTAMIASRCSPSSARSATWRRRSKLMLAPESMATRVCPSVRSRATYFLIPATARAPAGSVIERVSS

SEQ ID NO: 22389 - protein, 143 aa, Pseudomonas aeruginosa
PRARRSPGPWRPCAQRAWPGRRCSWKPAGWRFPPARRAARRCPCRWGRRRCGEPAPRRWRRRWRTARSRSSGRARNRIRCCRRYRVHDRGRGPLRGRRPDACSILPSTWFRPAWRVAGNGRFRSSRSLRAGRSSRRPGCSCAR

SEQ ID NO: 22390 - protein, 620 aa, Pseudomonas aeruginosa
HNSWNTRIFFASSSITQGNRPRASIVTRESVSIGLQLYPCRSSRCANCIRRRAGANAQAPEQRGGQQGAGSGHQHSQTEALGQRGRQLGVEPRQGTRQAMGRDRLGGEPLRIGNPQPLQPIAQDDDRPPAQQRSQQRDADGHAGLAQGIHGRRGHPGTLAGHARHDRQTGAGNGQAHAQAERHQQQADPGIRGSRTASGQRQHGQADHQVAQHQQASQRYVPLQPAEQHGQCAHGEELRRQVEAGLLRRGTLHLLEEQGEEEQAGVAGKTEDERGQVADGEPGLAEQPQGQQRSGGPPLDEEEAKQADPGQEQRRPGRGRQPAALSRGDQGVGQRPQPDHAEQLPQRIEGGVLGVRGFLDAPQAQGERQQAERQVDQEDALPAGVLHQQAAEQRAEDQRQRAEGGPAADHLGALAGIVESLGKDRQRAGYQQRPGDALDRASEQQQRQRGGQRAEQRTEAEQADPEQPGELATVAVAQRSGRQHEGAQAQRIGVDHPLQAGQVGIQGVLQRRQGEVDNADVERGDEGSQVNGGDQGDTTRRVHGSTPMRGRWPRNNPLTDGQSINIAKHSHLPVMPRLPLHALLHCGQPNHRTRAPCPIATPNSLPANRAPSLLRFVSRN

SEQ ID NO: 22391 - protein, 248 aa, Pseudomonas aeruginosa
RLPARRDRPASPYAAMAPPASQGRAARRYERARHASSSSPARRPAAPGAGHARRRRAIPARRAPPAAWPAPPSRAAGRAGPGAAPHACAWAASASPGPAPAAPAPRWRRRSHARTGCPPASRRGQAPRRERSAPPASPVRSGRPVPTPGHSDRPWPGRGGSATRRPTPGTGARRSTSPPIQPGRNPAKRWRNRPVPAASVAVLPGAKRARRSTESPGSSRAGRCCRSTPGSPPKRQGNARCPDRRRWR

SEQ ID NO: 22392 - protein, 415 aa, Pseudomonas aeruginosa
  UNSURE (328): Identity of amino acid at the above locations are unknown.
TVKSNLTIGSPSMVSLDRFETFRAVVDCGSLSAAADTLGQTRAVVSFNLKRLEAELGVSLLSRSTRRMALTDAGERFYQRCVKVLDEARLAIDDARAEHGELRGSLRVTTTQEYGLRQLVPALQAFARLHPALQVQLSTSSLHADLIGERFDVAIRLGRLEDSTHHAVQLASFEVLAVASPACLAALGEPPPTDLESLERLQNLGHSRLADSLPWQVRAPDGALRSYRGPRHPMLLADNAAALRAFALDGLGIAVLPDWLVQADLRCGALQRLLADTGFRSRACMPFIRRPATCRRRSARSSTSSRLAWGTRTPVRKPRPPWFVALCXSSTSICSPSASLWILCMPPICWDFLVVFDYGGICCYSFSYSNWSVNIVRVRLDAVCYLFGPAPLYAARGYLRLCLGSRASLSFVSVC

SEQ ID NO: 22393 - protein, 471 aa, Pseudomonas aeruginosa
PLQIARAPRYAPRQTSGAPMNQPSRLATLYLLGFALDLVNIFIASVAYPDIGRSLGASVATLAWIGNTYLLGLTLVIPLSVWLASRLGERRLMLLALAGFASASLGCGLAGSAATLIVWRLCQGLAGGLLIPLGQAMAYRNVPASARAGLTARVMLVALIVPAVAPALGGWLVDSLSWRGIFFASVAPALLVLALAMRWLPRHKHAAQRLDLRGLLLGSAALATLLVALAWLGSPGGGGRGLLLALLACVLGCCYWRDGRARTDALLDLGLLEAPLLRTAMLVYLCVPGAFMGANLVAMLYLQGPLGLSASRAGALMLPWALAAGLAIGLTRRRFNRWGPKSLLLAGMAIQAGGLLWLARSGEGSGFWQLAGAYATMGFGGSLCSSAAQGMALLDVPAARMGHASALWNINRQLAFCLGMAVLGGLLNLLQALADPAAFVHCFLFAAAFTLLPLPWVRRIDSAGVRALVQT

SEQ ID NO: 22394 - protein, 491 aa, Pseudomonas aeruginosa
EYSHVPFASCRPGRRHLPGNLHRLARHQHCQPRPADAAVRPGYRPGRPAVGGRRLCAVPERLHAVFRTAERPLRSQAHLAARGRPVQLRFAALRAGHLAGAAAVRTRGPGHRRGAVDTRRAVDPYPGFPRSRPARPGDRRLDLLQRAVADPRPAARRPAGGARRLAEHLPDQPAARPAGARPGPVGHRGNRAPRARRLRSSGAAAQRGLAGGVDLRPDRRGRGRLVVSHGLAGAAPGRGRPAWLPLRRAADRPTAAAPGVVPPGRVRRLQPGLVRPRFFRLRQPVLPLPVLPAGAGCLGAAGRLLPGAAVPRHGRTVHAVRPVAAARTAATPAGAGLPGDRPGHAGAGRLRYGNRVSLGRPVAGGARPGHGPGRSRHRSGGHGERGPRAFRDGLGDHEYPAPGRHGRRHRVAGSAAERAGDRRPGRSAGGAGDCRCATARHPGGHVPSLAWFPGGARRRAAGRAGRGLPSGYAGGRSQRPAGRRAALAPAR

SEQ ID NO: 22395 - protein, 334 aa, Pseudomonas aeruginosa
GRKMTKANPFAALKWLSLAPALLLGGCDMTLFNPKGQVGMDERTLIITATLLMLIVVIPVIVMTLAFAWKYRASNTQAEYKPDWHHSNRIEAVVWLVPCVIIAILGWITWESTHKLDPYRPLDSEVKPVTIQAVSLDWKWLFIYPEQGIATVNEIAFPKDTPVNFQITSDSVMNSFFIPQLGSQIYSMAGMMTKLHLIANEEGVFDGISANYSGGGFSGMRFKAIATSEQGFQDWVAKVKAAPASLSIGTYPELVKPSENVPPTYFSSVSPELFGHILTKYEHHGDAKGAAHGEHAGAEHEAAMTGHDMQDMDMQAMQGMKDMKDMHMQPSTQE

SEQ ID NO: 22396 - protein, 660 aa, Pseudomonas aeruginosa
AQMFGKLTLSAVPYHEPIVMVTLAVVALLGLGVVGAITYYRKWTYLWTEWLTSVDHKKIGVMYIVVALVMLVRGFADAIMMRGQLALAEGANHGYLPPEHYDQIFTAHGVIMIIFMAMPFMTGLMNLAVPLQIGARDVAFPFLNSLSFWLLVVSAMLVNVSLGLGEFARTGWVAYPPLSELAYSPGVGVDYYIWALQISGMGTLLTGINFLVTVFKMRAPGMKLMQMPIFTWTCTFANILIVASFPILTAALGLLSLDRYLDMHFFTNELGGNAMMYINLFWAWGHPEVYILILPAFGIFSEVTATFAGKRMFGYKSMVWASAAITFLGFTVWLHHFFTMGSGGDVNGFFGVATMLISIPTGVKLFNWLFTIYKGRLRFSTPILWTLGFMVTFTIGGMTGVLLAIPGADFLLHNSLFLIAHFHNTIIGGAVFGYLAGFAFWFPKAFGFTLDEKWGKRSFWCWLVGFYMAFMPLYILGFMGMTRRLNHYDNPLWKPYLVVAFFGAVLIFCGIACQLIQLFVSVRNRKQLADVNGDPWECRTLEWATSSPPPFYNFAELPKVQDVDAFHDMKKAGTAYRKLPAYQPIHMPKNTAAGFSIAVFAFVFGFAAIWHIWWLMAVGFVGMIGSFIVRSYNQDVDYYVQPEEIEKIESARFQQLAKQV

SEQ ID NO: 22397 - protein, 210 aa, Pseudomonas aeruginosa
TMSTAVLNKHLADAHEVGHDHDHAHDSGGNTVFGFWLYLMTDCVLFASVFATYAVLVHHTAGGPSGKDIFELPYVLVETAILLVSSCTYGLAMLSAHKGAKGQAIAWLGVTFLLGAAFIGMEINEFHHLIAEGFGPSRSAFLSSFFTLVGMHGLHVSAGLLWMLVLMAQIWTRGLTAQNNTRMMCLSLFWHFLDIVWICVFTVVYLMGAL

SEQ ID NO: 22398 - protein, 304 aa, Pseudomonas aeruginosa
CRCPEGHDVKLKRYLLVAKPGIIFGNLIAVAGGYFLAARGSVEPMLLLATVIGLSLVVASGCVLNNCIDRDIDRHMERTRGRVTVTGQISLKAALAHGLVLGVAGFGLLWWRTNPLTTALAGFGYFVYVGLYSLWFKRRSQYGTLVGSLSGAMPPVVGYCAVSGQFDAGAASLLAIFCLWQMPHSYAIAIFRLKDYEAAGIPVLPVARGIAVTKIHIVLYILAFMAATLALCLGGYAGYGYLLVAVAVSLWWLAIALTGYWTADDRVWARKLFAFSIVAITALSVMMSIDFQVAPATHLVASLF

SEQ ID NO: 22399 - protein, 183 aa, Pseudomonas aeruginosa
PSRPCLPAAALLPPFQLWRVSQRPLRTRPRGGFFVLSPGPKPPNRENSMQHQTLQNLVGRADALINAGQFDALMDFYCDDATLVVKPGLNACGKAQIRQAFDAIARHFEHSLRVRQHDLRVIEAGDTALVMAEAVIESKAGRLQRRATYVFRQEADGQWRCAVDNSYGTDLLASVAASAEASR

SEQ ID NO: 22400 - protein, 655 aa, Pseudomonas aeruginosa
TPARDIRPARDMAMRKRNPRRATPEELRVCSVLKEKGTREELAHLAARGEWSNVPAYNASREQIADHLGKSVSPESDASFFDSRRFSEAIVLLKSRPVLLVKNGIFDEAPLAGLEQRLKKHRAALATPIRSVGRLELIDHDSMDWCGTGWRIEDDLIVTNRHVASLFAERQGSLFRFRLNQAGKQVRTRVDFREEYRQPESDEHVIARVLWIAPDVSEAPDMAILQVVKGDLLPPPLVLARQDAEPRQAVAVVGYPARDSRNDAGAMEDIFGNIYDVKRFAPGEVVGLPHDAWYLTHDCSTLGGNSGSAVLSIDGGEVVGLHFGGQFRKTNYAVKASVIRSLLARRAWVPVAGAELKRGVPRFQEKQRSVADLAERKGFDEAFLGPKAALPKPGKSHQVLPVGKGTRLDYLHFSVVMSASRRLPILTAVNIDGALKRSLKRKDSWGFDPRIEAAAQVGHKDFYGPASFDKGHMVRREDPGWGDSDAVARQAEDDTFVYTNAVPQVAQLNQRSWLSLEDYVLQNARSEGFRISVFTGPVFRDDDPLYQGVQVPLEFWKVVAMIDADSGELGVSAYLLGQEGMMPSEGFRYGAFKTYQVPLAKVEASADLRFSRALRKADVLAGTPLEEALESGRFIEIDGPDDLLLSRPGPAGKGR

SEQ ID NO: 22401 - protein, 295 aa, Pseudomonas aeruginosa
QFDEGAQLGRYVAAVQVIQPHRRQRQATARQHFHQAPGGEVRGDPLADECLGDPCAGAGRLDDRLGVGADEACRQVHFQFPPVFPQAPLVQAAAARETEAHGGMPIEVGDAGRRTVLGEVGRSGHQQARQRRCQLHPDHARLQGVGQADAGIQSFPDDIHQLVLVADLQLYLRVASHELVEHRCDHQVLRQVQGADAQLPGGFREAFAERFAGAHQVAVGLFGLFVVALPGLAQADPAGGAVEQLETQLGFQLVDRLAHRCRRHPEQGGGAGEAAGVGDLPEDVQAGEGIASIHC

SEQ ID NO: 22402 - protein, 155 aa, Pseudomonas aeruginosa
SFDLSRLARKHSMRTPAMSTHLSLQHAQRCIAAAIAEAQRQRLAVCVAVVDAHANLLAFVRMDDSVPGAIDLAQRKARSAALFRLPSGELGRLAGPGQPLWSIEQSNGGLACFAGGMPLGDAGGSCLGGVGVSGASAAQDQSIAEAAVAMATIQR

SEQ ID NO: 22403 - protein, 70 aa, Pseudomonas aeruginosa
PGPAAASVGKWRCAWPPAAIGRSPACAAPGRPPTCAKRPGGVAFRCGWKPSTSTSPPIANAPGNGISTCC

SEQ ID NO: 22404 - protein, 357 aa, Pseudomonas aeruginosa
RTSRRRPGSAACSGLPLRRGGRRPDRRPPLRSAPAQQDPGHPAFFHFHHPQFPVLPLQAVADHRQAVEQAHHQPGEGLVVLRGARVEPHASTHLAEVHGTADQIAVVLLDHVRTVDLTGVGQLAGDGFENVGQGQQADELAELVDHEGHVGRGLAHLLQGVEDRAVLQQVERLAGQAFQIRLGAGELLLEQFLLVHVAQRLLDAPVAHQRQARVGRFEQRRADRLAAAVEVDAVDLGAYRHQAADGLLGQLQHAADHHPLAAVEDHLVVALLEQVGDFLADLVGLQALAAEQAQHRMGGTRAQRAVALQALLAALAGDLVEHLDEDREADGRVQVAFRDMEAQALGGQAEADHHQEA

SEQ ID NO: 22405 - protein, 255 aa, Pseudomonas aeruginosa
AQHDHRRVTIDEAGQRLAGDDHQADGDDHRDHHHFQMLDHAHRGDHRVEREHRVEHHDLRDDRPEQRVGLVAGVLGDMAFEAFVQFHGGLEQQEHATEQHDQVAAGEALAEYLEQRLGEGHHPRDARQQAQAHQQRQRQAEDPGAVAQVRRQLVGEDRDEHQVVDAEDDLQHDQGRQAEPGSRVSYPFHVRLPPGPAGRRAGATLHGAAAAAGGDGGGRGEGFGVEGRTQVAKAKRGGLSGRTTGGLRKGGHDGH

SEQ ID NO: 22406 - protein, 311 aa, Pseudomonas aeruginosa
TGRNPATASRHEHRGFRRDHRHHPGRLPAQRRRLPRGHPRPRREPERRGAAAPYRRAAAVPDPRFRLRSRARPGHLPPPRPPAGGTRRHAALRRDGQGRQRLRGMATEFPGAATAGRALRRHLRQRQPVPCARQRLAAGARRTLRSAAAGRRAVQLQPARRQPRGLEWPTLRCLPRLPGLETPAGGSRFRRAGALLPAAGPAARAAALAGERLAAPRLKALQGLPVRRAEHAAVLVEALRREVAALQAVEGVGLDFGVAVGAFDAARRVGATGQDDQAGGQGDDQGLAHGGFLEMFLDAIGGPPCPGNQAY

SEQ ID NO: 22407 - protein, 672 aa, Pseudomonas aeruginosa
RRCRRSRGRPVAAPPRRCRRRCRGCPPAPAPAGSRARHADRLRRSGRKAARSSGGTRSRGIGNQGQAQLECGSAAFGVLHAEAAAGGGGHAGREGQAEAQAMFAGLGGEKGFEQVDARRRRDTGAVVAHAQDVALLLAPAFQPELAVGLPAHGVEGVGQQVDQDLFQAGLVDAQAHVVEMPVQGRRVLLQAPVQDQQRRVHRLGQAGLAGVVAAPGEGTQAGGDAAHAVDQFVDGGEVGAGGLQLAALEEAHGVAGQRTQRRQRLVEFVGDAGGHLPDHRQLAGLDQFVLGLAQGVLGLLALVDLGGQACVAGLQVGGTFGDLHFQLAVGPLQRLARGEAGGEYLAPLVPGDQQECQEGETDGGQHAVAHRVAAQVFQRAEQGQVPRCVVQRAGLRQVGDRFAARMLLIGGEAELLHTGGQRLALQRLPLVQRPPVVLHAARQALLVVGAQGAHRLQAQGGVAGEDDDAVLVADEGFQARLLPAFLEGVHLHLDYRHADDPAAVDQAVGQVVARLAAGAADAVEAARLALHRVLPVGAERQVLAEVAVRVAPVAGGQDPAVGVQQVHRAAAGAAVEAFEVGVDLVAPVWRRVGEQVTDAALQLQQAGQVGVLADLALDRPCMQLQLAFAILGEGTDAGALADPVAAVAEAEHQQEQGNGEQQLADEAGLHGQ

SEQ ID NO: 22408 - protein, 89 aa, Pseudomonas aeruginosa
LLPSTTMPSGPHGLLNASVLMLTILLASRPERISSFMVISTPLPRADLSPATATALYRLSMPSADIAVPGRIEPTTTIGFSVCSTRVRK

SEQ ID NO: 22409 - protein, 923 aa, Pseudomonas aeruginosa
VALLAALAPAPAMVPPVARMTTLDSFCCGATSLAWAACGSRSIRAITPGANAWSNGFMAISRVGRLVGLSSLHAIRRGRRRPPAVLSGFHHQADAAATGIGGGLQGLAVDADGLDIAHVPALVLQGVAHRLQLLGDLAGERRVGVVVDRVLGQQLVVHALRGHGLLQRQVEVVDVVQHLEDRGEDPRAAGSADHQADLAVAGDDARAHRGEHALARLDGVGVAADHAEGVGHARFGAEVVHLVVEQEASALDHHAAAEVPVEGVGVAHRVAVGVDDGEVRGLVRLQAGTDLLGRRDRRRIDLGGTLLQVCRIGQARLRDLGEVRVAEVVGAVGEHAFLDLRQQVDVARGVQLDALEVGGTVFLDAQQLGQGDPAGAWQRRGIERVALPVDAHRFAPPDLVVGEVLVGDQSLVLLHLCHQQVGGMAFVELVRALVGDTLQGLRQVRLEERLAGLHVAEVVAEVGLAVEQGDGVLAVLELLVGDLEALLRVADGRGQQLAPGQLAEPLVGFPEAHHGARHAGGLGADQAEVLDHLALVVQVHGLARGLRRHLAVVEEVRLAVHVQGHEAAAADVAGLGVGDRQGEGGGHRGVHRVAAGLEDLRGDLGAVLVGRGDGAAVERGGEGRGGCGGNGDAEGQGSEEHRLHGLSLFIVIAGEGGAGPRRAGRRGRVHQCGRILARNCWARSERALTSPKNSSFSQSSTICPRSMKITRLATLRAKPISWVTHIMVMPSWANWTITSSTSLTISGSSAEVGSSNSITTGSIASARAIATRCCWPPESWPGCLCACSLRPTRSSRARPFLVASSLLRPSTLICAMVRFSVMLRWGNSSKCWNTMPTRERSLGRLVFGSAMEVPSTTMSPFWKGSSALTHLIRVDLPEPDGPQTTTTSPFATSVEQSVRTWKSPYHLLTFLMEIIRLTFSADV

SEQ ID NO: 22410 - protein, 358 aa, Pseudomonas aeruginosa
SPSFTSYGDQARYGDLSLHQAHDQHQAHVQREVDQRGQGEGLEQVGGELGGLLGLRQQLHQADQRRHRGVLEDVEELRGQRRDDDPEGLRQQHVAVYLRQAEAHRAGRRGLPVGQRLDAGAHLLADPRGGEQAEADDHAEVGRGSRVEVLLEPGLQALGQQVGYQEVPDEQLHQQRHVAEDFHVGGGDPRYQAVRHGAHDAEQRAQRQGDDPADQGDGDGPAQTGDVPVEVGFAADPGGLEEHAPVPVVIHVGVSPRFNRLQTLAGKAGAGAAVRAGGAALPGETAGEGQAPPRVPEAPLRGGGDARSAGAPGGTPGARYICSAALSVGLAISFFSSSLMGKLRFRPFGGIGWVNHLS

SEQ ID NO: 22411 - protein, 313 aa, Pseudomonas aeruginosa
ILLTSPEGVGIGDGLVDHFLERRVALAHHAAVDLEGLRGAADDPVVRLLGLGHFAVEQRVVHHEGHRAAGFEHHEGLAVVLGGDDVHAHLLVRVHGLEQALGGGAGGGHHVLALEVVEVLDVGGLLRQQAGADLEDADGEVDLLLALFVVGGGAALDVHGAVLHQRDAGLRGDQVIADLQLGEVEFLLHRLDHFQLQVVGVADRLARLGAEVGEGNRSVTVTEGDGAGVLDLLQRAGELVSDDRSGQQSGHDGGAQQTGSDTHEFLPRLVLIFIEPRAPGLSGTGCFAVFPGGGSHESIVLAEQCSGRMHASL

SEQ ID NO: 22412 - protein, 284 aa, Pseudomonas aeruginosa
AVVCSPSRVPERFVTRQETPMQIDLSDKLAIVSGSTAGIGFAIASGLAAAGATVVVNGRSQAAVDRAIAAIRNGQPDARIRGVAGDLGTAEGCAAFVAAEPKADILVNNLGIFELKDFFDIEDAEWSRFFEVNVMSGVRLARAYVPGMVERGWGRVVFLSSESALNIPADMIHYGFSKTANLSVSRGLAKRLAGTGVTVNAVLPGPTLTEGVAEMLREDAQKAGQSIEEAGTAFVRQHRSSSIIQRLATPEEVANLVVYTCSTQASATTGAALRVDGGVLDSLA

SEQ ID NO: 22413 - protein, 109 aa, Pseudomonas aeruginosa
RGATGGAGRSRTAGTVIQRIPPLMSAASLATLDGSLRMTPVEQPRPPALADLGSRLMIVVERREDWASYLPSEEVLTAQEYLEQSAHDHGGRRVQMINLCRGYKYLGLG

SEQ ID NO: 22414 - protein, 437 aa, Pseudomonas aeruginosa
YCSLLAEARGHRVIPSLRCISELARKSVYGLALGGLDKALDKALCRTPYGATDGFTLTLYFGHTEFEPLADLARQLFEAFPCPILLVEFRRQQGWHIEGVRPGVLNRLRSDQEDVFADALDGFSRRAWRMPRSRRVARYDMAILHDPDEALPPSNPQALANFVRVGASLGIDVELIGRKDYARLAEFDALLIRETTRVDHHTYRFAEKAEREGLVVMDDPASILRCTNKVYLADLLGCRQLGMPLTEILYKERPQDWQRVARRLGFPLVLKIPDGCFSRGVVKVNDDSELLAAASELFERSVLLLAQEFFYTEYDWRIGVLDRQPLYACQYFMSRGHWQIYNHKADGQDVNGECRAVPLEQVPPAVLELALEAAGLIGDGLYGVEPEAGRRQGAGHRGQRQPEYRCRRRGRASSATNSTGASSRPSSSAWNSSTVAS

SEQ ID NO: 22415 - protein, 416 aa, Pseudomonas aeruginosa
ARRYAERRASVRPARGQAQAGAAGEGGRPDATDPVAAALIDLDALQLGSETGKVLAEGLQGQQVVDQRRRFIGHPFAGQQQRRGRRMDADQAGDHTAAEPVDRHRFGFVPDQVPIDRGRRQRGVAGSPGGGVGEGGQVQPQAGFVDHRAEFAQADVAVQRRAVEQLRQHLLQRRIVVVPAFEFAQPVHQRLRVFRPGALGKQQQEAIVAGAQRGDAVPAQVAADHRGGYSEAGRATARIEAGGAQGDAQRVQQRTAVECLGEPVPALRRRLPAGLDARPRVAPQYLEEPRIAILPGEPRGGFPERPAKGLGDVAGVRRRGSCGRLAVGRGEVVQRRRQVLRGALRADPPLLGRRQIEACAAVVAGAHRRARDRRGIVAQPPGARRGAPFTQVAVDALGDEACGAGGQVEASLDLVQ

SEQ ID NO: 22416 - protein, 165 aa, Pseudomonas aeruginosa
ACAAVGSVPRRAPTVRPRRGLFSPPLSKGALAGRLPNERIVDPHQEPTAMKYLCLIYFDEAKLAAVPAEELAAIVDECMTYSDQLGKAGHYIASHALQSVQTATTLRHQGGRLAMTDGPFAETKEQLGGFYLIEARDLNQALQIAAKIPPGRLGCVEVRPVKEWE

SEQ ID NO: 22417 - protein, 307 aa, Pseudomonas aeruginosa
GRPAPEVKYVPPVHRIPVPGVRRRRFAGRLRPGDRAPAPLAERPRAGWKTENFRGESAMNPSLQDHPVSSREQWLDARRRLLAREKQLTRLRDQVAAERRELPWVRVDKDYRFQGERGERSLAELFGGNSQLIVYHFMFAPGWSEGCVGCSFLADHIDGANRHLAHHDVSLVAVSRAPLEEFQAFRRRMGWRFDWYSSYGSDFNSDFGVSFDKAQLAAGSVDYNYQPTPDAGEEMPGASVFLRNPAGEVFHTYSAYARGLDILLTTYTFLDLTPKGRNEDAIMDWLRHHDRYDEAPKSACCHAQASH

SEQ ID NO: 22418 - protein, 618 aa, Pseudomonas aeruginosa
SSRGSAWSSGPWPAAASGPTPCRRRSLRCMPRRRAPRTPTGHGSSPSTTRCCTWRRRRWSNSTAPWPWPCAMASRSGWPWSMRCWREVNWPITTWRTRRVPTSAAVSVAAARPARPTARRWPWRARSRSGASSSSACANSIEAGSGAVGAGRTRFAANATGEPPERQGRQADRRAEQAHRVPAGPGVHGGAGAGAEAAAGGVEQHVATHQAAVGARVDGEDQALVEHMDRLAGEIEQQHAENQRRQRMRAEGERQPGQQQQQQGAAAERLGVAAIGQAAGPRRAQRAERADQAEGADGAVRQRMRRRAEQQYQAAPEHPEGGEHQQPEQAAHLQHALARQQVEHRAEQLPVGQPQFVARRRRQYPPEQQAEPAHARCRDQVDAAPAAEVGEQPGQAARQQQAYHHAALRRADHPPALARRRQRRGVGQQSLGHGGAEQAQSEQPQRQAEGIAGEAHQQQRQHQQQELDEHQPAPLQQVAQRHHQQQRQGATGLGRAEQQADPGLADGELGTEDVQQRLGVIDVGHAETAGDGEQQHQRGGEGGWRGWHAKRSVRFQYETKAEARNFGFKMQPKLSQQCVYRSRLAHSGTRARSSNSLIGPGGVSGSTRRGFPLAPHPG

SEQ ID NO: 22419 - protein, 147 aa, Pseudomonas aeruginosa
GRQLYLQRRVQPGECLQGRHQLAQAVFLGGGDAQAATQFAMLGAGVVDGQARLVEHLHAALVEAFASIGQGHPPGAAAEQRNAQLGLQPLEVEADYRTRLAEGVGGGAEGTAVDHGAKGFEAVEADHGRRPYCQIRFDSLCAISLSR

SEQ ID NO: 22420 - protein, 147 aa, Pseudomonas aeruginosa
GVSIPPGFAPWSRPERSYTMTCAYRREIHHAHVAIRDWLAGDSRADALDALMARFAEDFSMVTPHGVVLDKTALGELFRSKGGTRPGLRIEIDGESLLASGVDGATLAYREIQSDAAGRSERLSTVVLHRDDEGRLYWRHLQETFCG

SEQ ID NO: 22421 - protein, 532 aa, Pseudomonas aeruginosa
LTVGQWIIPGPAPSHRSTPMYPSRRVALVAAIYLGTFIASLDISIVNLALPTLQYALDTDLAGLQWVVDAYALCLSAFMLSSGPLSDRYGRKLTWLLGVGLFSFGSLLCALATSLALLLFGRAVQGIAGALLIPGALSILTQAFHDPGQRAQVIGGWTSFSALSLILGPLLGGLLVEHAGWQSIFLINLPLGLLALALGLWGIEETAHPEHAAFDPLGQLLSVVWLGALTYALIAAGEGGWLSPTAWPALLLAGVGLLGFLFVERRTARPLLPLGLFRQAGFAVCNLASFVLGFSGYASLFFLSLFFQQVQGASAQQAGFYLAPQFLAMGALSMLFGRLQRHVPLRRLLVLGYLVIGLAMLALAACGTGTAYPWVGLLLVALGLGMGLAVPGTGLAVMASVARERSGMASATMNTLRQAGMAVGIALLGALLSGRAIVVLGDRLEGLGIADAQRLATQAVTSHRLPGSLAGLDAELPAALAEGFRLAMLVAGASALLAAALLWRLRVSAGPAADTVGASGRTAGVQLQADRH

SEQ ID NO: 22422 - protein, 639 aa, Pseudomonas aeruginosa
KKPSINQMPMILNNQDGVLHGSSQRAVPLAHQTPAGAADAVDGRLLLAGPGRGRGAQGRSPGTGSRHGHRRAGLVQGRTLGLGQVRRAAAGYPADRHGGAAKGDPGAERPEPAPGAVQRLRHHLQRRRGRRRFRRQHQHPRLQRQRQHAGGRAARQRPDQPQRPVQPGGGGSDQGTELGVRRRRHQRRQHQHGQQAAQGRSLHPPGRRAGHGPLPAPDPGHQPAAGRAWRIDRLPPQPHGPPQRRRRARTDRQAALGHRAIPDLRPGHPDPPDPELLPPARRQPSRLWRAGAERAQAGRRQPPRLFRLAQPGRGTDRQRRRHPQARTRFQRRLPVAEPHPLFPPASGHGDLRLPRQPEGPAAGSLPAGGTASLRARFEDADVDQPDQPHRPLRYLRPGAYADRRLRAVPRDLRPHHLLLQPGQVLPGQRLRPAQPAGLLERPHRQARQRAQPDRTGGQGAVRLRHHRPGRALGPQPGPALRLDRRHLAEHALRQADGARRQFRRQAEHTGGAGIQAAGERAGVLLLRHLLQPLGGTPGHYRLGRDRGDRRPGAGEEQYLRAGHQVGVPRTAPGAGRGAVPGEEGGRSRTPGRRQLRACRRTARAWPGAERQRQAERALGPLRHLHLPRQRNPEIQQPAA

SEQ ID NO: 22423 - protein, 130 aa, Pseudomonas aeruginosa
TFSLRRLSTPLQVIFQGASSMARKNAVKDNLEQIQHQSYSELQELLSEANSMLADSAAFAGDKADSARARIGALLEKANDALGKGGSAVAERSRHAVDATESYIGANPWQTVAITTAVGLLAGFLLGRRS

SEQ ID NO: 22424 - protein, 613 aa, Pseudomonas aeruginosa
SSRRPDACNVGPPTCSARRPMASGAARWTTPTAPTCWPRWRRARRPADERLDPQRKQTPAGRLRGKHPGRAGVRRRRGNPLAGRAAVVPAPGQPGAAQARGPAAGVLLQDPRRLHPCRAPERRAEGPRGDHRLRRQPCPGPGPGGAAPGRAGGDRDAAHHSRAQGQGRAGARRRGVAARRRLPRCAGPCPATGRARRHDLRPTLRRSGRDRRTGHGGDGDPPPAQRPPRRDLRAGRRRQPDRRDRRLRQAPASGYSRDRRRAGGFQLPAGGAGRRRTGGAGPGRAVRRRGGGGADRRLQLRGLQGPCRRGDHRRQRRNLRGDQGHLRRHPFDHRAGRRPGRSGDQEVRGPRTHRGADPGGHRLRCQHQLRPPAPRCRARRTGRTARSDHRRHRGRAAGQLQGLLRGAGPAPDHRVQLPLPQRPPGPPVRRRADPSAHRQPRRPARRPARAGLPGTRPDRQRDGQAAHPPHGRRPRYRGAPRAAVPLRVSRTPRGLAELPRQARLALEHQPVPLPQPRRRRRSGAGRITGAGRGARRAGGGVASHRLSVLGGNPQPGLPAVRRLSGAAVRQRDMALSCPSARLLPGISAQRGTWPCASATPGGPRRKNCGSARY

SEQ ID NO: 22425 - protein, 374 aa, Pseudomonas aeruginosa
GRRPCLPTCLCNMPNAASRRPLPKRSGSAWRSASRWSTPMPTCWRSYGWTTAFPVPSTWPSARRAAPRCSACPAASWADSPGRASRCGASSRATAGWPASPAACRWAMPAVPAWVASASPAPARPRTNPSPRPPWPWQQSRGNRDETEANPGDRGRQRLRSGSGVAPGRPRPSDDRRRARRRAGRRPARRGRAAWRSAAGGNPRHQRRRRSRTRLGMGYRRAAEQRRQRRSRGQRGDPAGTGARAVRDQRVRQPGTDPGFRPAHGRAEAWRQGALRVVHRRLDHRTLYRPLLRLQACPGGLRRGPACRTEAVRHPGWHHQSRPVPDRLQRSHDGNLETLVRPAAPLHRPQRRALSLRAVRSGGNDRADGRAGRG

SEQ ID NO: 22426 - protein, 436 aa, Pseudomonas aeruginosa
VLLPACWATWPSRRSCSSMVALNSRNTPPNSMIRSRPEKLLPNTSNSGSVRVTIHEMLASRPRRISSASDRPRTRARSRRCGGSLSARIAMNTRLSMPRTISSTIRVARPSQAVGSAIHSMCAYLPVRLAVALARRCTARLRQPAVTEGDEARDSASRGGRRWRRRSGEGCPEGRLGGSERVVMMAIESQREVDPTVSRALATAGNYYKTLGETRAGARLGGTPPLRADMSTEDFDAITATTLADYQRNAEGFREGTRGHDVSQNVEALLRHIDGPPPYRILDFGCGPGRDLATFRRLGHQPVGLEGTPRFVEMARADSGCEVWQQNFLALRLPAGHFDGIFANASLFHVPGSALPRVLGELFEALRPGGVLFSSNPRGDNREGWNGQRYGAYHDYPAWKRLLEEAGFVELEHYYRPPGLPREQQPWLASVWRRPV

SEQ ID NO: 22427 - protein, 538 aa, Pseudomonas aeruginosa
SIAPCARRAGRRGRSGLLQAVLLHLVEQRGLGHAQVLAGLGQVAVVAGQGVAEQGLLECLHRFGEARAAGLYGLAALVEHRQAEGEAFGDVAQFAYVARPVVGHQAGHGGTVEFRRGAVEAQRGLLEEVFEEQQDVLAAVAQRRQFQAHYFEPVVKVAAELAALAHGGEVCLGRRDHPAVHRDRLVRAEAFQGVFLQHPQQLDLQVDRHALDLVEEQRAAVGMLDLADPPLVGTGEGVRLVAEYLAVEQVLRQAAAVQRDEGMLVAPAIVVEATRHQLLARAGLAEDQHVGRGVADVGDQLAQRLDRRRAADDPLRQVLAAGQLATQRADLAGQPALLQGAAGDLDQAFRREGLLHEVVGAGVHRLYRHGDVAVTGDQHHRQARVEGLETLQQGQAIDAGQADVADDDAGEVAVDPLQRLLGAADADAGDVLQLQRLLAAEQDMRIVFDDQDGKRLVHRAGLAVGESGTRDRLSSNAVPPLSGCCTLRLPPAAVAMLAERVRPRPRPCSPGLVVKKGSNRWTRAAGGIPGPLSRTRRT

SEQ ID NO: 22428 - protein, 156 aa, Pseudomonas aeruginosa
PFLQTFDGERGGEAYDEVDQAGENQELVGLADDVAARTGRIEEVHQADGIDQRGVLEQDDALLQQQRGHLAERLRQDHQAHGLPVGHAQCLGGAHLAFRDGLDAGADDLAVVGRLEHHEGHQAGGERPHRGVLAGDPAQDEGHREVEPGDHQQQRD

SEQ ID NO: 22429 - protein, 195 aa, Pseudomonas aeruginosa
RFVQKLFRLRSGPIQAGFSRIHAARRKPSRLAFLTWRRPPGVPMRYLILSLLAVLAAPAWAADDGDFWYLQTSVYTRHFNPDPEHNNHQDLLGLEYNRADGVLAGGATFRNSFSQRSNYAYLGKRFDSDSYPVYLKLTGGLLQGYRGEYRDKIPLNRFGVAPAIIPSVGVRFGPLGSELVLLGNSAAMINLGLRL

SEQ ID NO: 22430 - protein, 64 aa, Pseudomonas aeruginosa
KRPAPPLSGSTVPVRSSSAWRRPRKSPTWWSTPARPRPRRPPARPCGSTAGCSTAWPDERATPA

SEQ ID NO: 22431 - protein, 244 aa, Pseudomonas aeruginosa
MEERWRGECVPGCSLGPAEVSLASAIFFSVAFDSCVCEVLPEQLRRGAIRFQVISATSCSGCTFDRVFLRCSNRGRARCSKSRLTADGGGQGPIEQFQEFPFSNARCRWSVLRSPGPLRGYGGSPEAYRGFVMSRVLFLLLAMVLAGLGQPTLAAPLPDELPAALPAAPPVAPSPMGSAPQPQPEAAEPDLPGSDAASADGEATTKDGLKIGNGSLRLRQDDPGPTRESPLRDPRLNPYAPRQP

SEQ ID NO: 22432 - protein, 139 aa, Pseudomonas aeruginosa
SSTTSCSRRAGAKAASAVRSSPTTSTAPTGTWRTTTSAWWRYRARPWKSSRRSAGAWAGVSTGTPRTAAISTVTSGCPSTRRNWPPAASTTTTSRPPTPARKCRVPACSCAIRRARCSTPIRPMRAASTSCSPPTPSST

SEQ ID NO: 22433 - protein, 395 aa, Pseudomonas aeruginosa
RPRGATRTRSWTGCVTTTATTRRRKAPAAMRRPAIEGARRAVAQPHRGAVPRGVAARAGDPCPPARRFRAGRGGLARRLHRRRRAVAARRYPAQPARLAGFRWALQGHRQPAPASALRRLAATARRATGRAGRGAGGGGRCGGRRPATPDLHLLPPGADPRGTGGADPARGLRPAHRGDRPRLPRRAQRHRPTHRAGQEQDPRGPDSLPGTDPGGTPRAAGQRPASDLPGVQRGLLGLHRRQPDPRRSQRRGDPRRPPAGRAAARPRGPRPARPDVAARLAAPGADLGQRRTGAARRAGPRSVGSWTDRRGARPGRAGPGQPPRRALHPAGGDRCGACPGAARRGHRLGTDRRPLRRAAVPGAVAGGRTQPRRGLGHARWRRGRAGRGRCVAGAR

SEQ ID NO: 22434 - protein, 144 aa, Pseudomonas aeruginosa
QPTRRLWARGSMAKTRLWLSTWIAWPARSSSSTPRISAASECAPRASGSQDSSNSSRAPPLSAWAWPRSARLPARAAPSAPSAPTRPKAPMALCDSECGGAPSSNTRLLQNTPKAANINSPSRPRTCSTRWLASRSNIEPSSCR

SEQ ID NO: 22435 - protein, 338 aa, Pseudomonas aeruginosa
KRSPASVRAIRRVLRLSRETPSSASSRLRLKLTTARVWPRVSAAALREPQSTTARKVSKRSRLTMEGDPIVKFDLTVYARLASPDSASASLCSPANLRSAHESTVPPGHFVPAGVRPGPGEHLHRQRRLSGHRAFPWRFGGDPGVDRQHLPARLDPGDSVERLARFAPGRTATDAAGTGRFRQRFAGLRPGWIGGDVDRLAPVPGVGRRVADPPRPGHGLSECPGVGTGRPDRTGDAGGADRSRRGACPRRLAGGQPVLAWDLLRQRGAGAAGAGPGDALAAQAQACGAAPGPARPAARLGGAGHAAGGARLAGIARRRRAWPAPGAAGLRAGLLLLA

SEQ ID NO: 22436 - protein, 121 aa, Pseudomonas aeruginosa
SPRERAAGCLPRPGRRCSWPGSACLASSSSSGGPPDRCCPWGCSARPGSPSATWPRSSSVFPATPACSSSPCSSSRCRVPRRSRPASTWRRSSSPWAHCPCCSAGCSGTYRCDACWCWATW

SEQ ID NO: 22437 - protein, 219 aa, Pseudomonas aeruginosa
ARSRHDRSRHAGHGHASHAGHERHEGHAHATEYPGVSADVRETDTLGRALPRAHRHGHTGRRRPAGPRRGRCDHLLPQVDLPVDRVADLGRPQEDRRDVHRRRPGHAGPRLRRRDHDARPTGPGRRRQPRLPAAGALRPDLHRAWRDHDHLHGHAVHDRPDEPGRAAADRRARRGVPLPQLAELLAARGQRHAGQRVAGPGRIRPYRLGGLSAAVGAGL

SEQ ID NO: 22438 - protein, 342 aa, Pseudomonas aeruginosa
RQRLLRRGHHADLDPHRGEAVQLAVHHLQGPPALQHADPVDPGLHGDLHHRRHDRRPAGHPGRGLPAAQQPVPDRPLPQHHHRRRGIRLPGRLRLLVPESVRLHPRREVGQAFLLVLAGGLLHGLHAALHPRLHGHDPSPEPLRQPAVEALPGGRVLRRRADLLRHRLPTDPAVRLGPQPQATGRRQWRPVGMPHPGMGHFLAAAVLQLRRAAEGTGRGCLPRHEEGRHRLPQAAGLPADPHAEEHRRGLLHRRVRLRLRLRRHLAYLVAHGGRLRRHDRLLHRAQLQPGRRLLRPARRDREDRKRPFPATRQAGLNHVDGSIEQASGRRPRSGPRPRSCTR

SEQ ID NO: 22439 - protein, 295 aa, Pseudomonas aeruginosa
RRQHRIRFLALPDDRLRAVRQRLRHLRGAGSPHRRRPQRQGHLRAALRAGGNRHPAGFQLHLRPGHALCAQGRQGPGDRLARGHLPARRRVHRDGDQRVPPPDRRRFRPEPKRLPVVLLHPGRHARPARQRRSAVDAGADGADLDPRPHRAEQHPDDVPEPVLALPRHRLDLRLHRRLPDGGPVMSSAAHDNHGAGHGSLGSYAIGFVLSVILTAIPFYMVMDGGFSRHVTILTMVVLGLVQVVVHLICFLHMNMSSEGRWNVMAFIFTVIVILLVVGLSLWIIFSADMLMMPMP

SEQ ID NO: 22440 - protein, 741 aa, Pseudomonas aeruginosa
FSITKMEYFMDRRNEPSPLPTKRPLAPLMLLMAACSSPALAEDAARKDDPLELGADTVTGEQASSRVERSASAKYAVPLLDTPQTVTVVPQKVIQEQNALSLRQVLSNVSGITFNAGEGGGGSGDSINIRGFSANANMQVDGLRDSAQTSRSDLFNLEAVEVIKGPNSVFGGAGTSGGSINMVSKQPKAEAFTHLGAGLGTDRYRRLTLDTNQPLEGLGESTAFRLNLMAHHNDVAGREQIDKQRWGIAPSLTFGLDTPTRLTLSYFHQRDDNLPDYGVPALNGRKLDGVSRHDYFGWRNLDEERIDNDVATLKLEHDFSDDFQLQNLIRYSHLHRDTVISASHVNQKGLPPGRYLPAGPQAYGRDSKTRMWINQTNLTGRFDTFGLAHTLIGGFELSRETYDRTTYSYNLGKFYPANGFDLHNPPGYWNGPTDKRDSARNRTELEVKALYAFDTIALDERWDLSLGLRYDWIDGTSRSTPSGKPTVRADSSDGKLSTRAGLVFKPLENGRVYFSYGTSFNPSAEHLVTTGSGVTEATGGLAPEKNSTYELGTKWEFLGRRLELDAALFQVKKEDARERLADGSYVLAGEQRVRGLELSASGKLNEHWDLFATYTYLDSETLKSSNPQREGQALGNTPPRSLSLWSTYELPEGVTLGYGARYVSQRNVTSVDNGKLDAYWVHNMMLGYQATRDLKLQLNLDNLFDKAYVERVRQVYGNQSRSSAIEYGDGRTAILSAIYAF

SEQ ID NO: 22441 - protein, 293 aa, Pseudomonas aeruginosa
KTTSSRFSTRATASCRNCSPKPTACSPTAPLSPATRPTAPVRGSARCWRRPTMPSARAVAPWPNAAATRWMRRKAISAPIPGRPWPSPPRWACSPASCSGVAPEHAVGAAQRTRYLRLKKELPMLSIKKNLGLLAMTAALAACASNPNDLPDFPEHEYAATQQVGEGVINGDLYLTSASGAIQKGTNTKVTLEPATSYMKAYYAKFGNLDAAKRDPDVQPPVLDPRRATYVREATTDQNGRFDFDHIPNGTYYISSELTWSAQSDGKTITEGGTVTKLVTVSGSQPQKVLLTR

SEQ ID NO: 22442 - protein, 677 aa, Pseudomonas aeruginosa
PASTPNPPSRRVLRSVSWAKTTEPGEQHAAPDPPEPRWPGRRPDQCRAVRCPDGFLLRRRHPGGQAGPQRLRQGADPPGVRRHRPALRAQPASAPARPAGDRGGRYGAGHGRGGDRVEGRTPATSGHLRVPPGGRWPVALRGGQLLRHRPAGLGGGERGGQPMSASTLSASKPLLAGYVESILAAPVYDVAVETPLQVAPQLSQRLGNRVLLKREDLQPVFSFKIRGAYTRVARLSDEQKARGVITASAGNHAQGLALAAQRLGVRAVIVMPRTTPELKVKGVLARGGEALLHGDAFPDALAHALQLAEREGMTFVPPYDDPDVIAGQGTVAMEILRQHSGRLDAIFVPVGGGSLIAGIAAYVKHLRPDIRVIGVEPEDSNCLQAALAAGERVVLGQVGLFADGVAVAQIGACNFEVCKDHVDEVITVGSDEICAAIKDIYDDTRSITEPAGALAVAGIKKYVARERTEGQTLVAIDSGANINFDRLRHVAERAELGEQREAIIAVTVAERPGSFKAFCAALGRRQITEFNYRYHSDRQAHLFVGVQTHPLTDSRADLLAGLREQGFPVLDLTDNEMAKLHIRHMVGGHGTEVRRERLFRFEFPERPGALLNFLDKLGSRWNISLFHYRNHGAADGRVLAGLQVPDEERGELEAALQAIGYPYWEETHNPAYRLFAG

SEQ ID NO: 22443 - protein, 240 aa, Pseudomonas aeruginosa
VEQRAGVQRQPRADRRPPGQERVAGIRRLVLRLAALQRGDRPAQEPAGAAGEERYLRRSAAGRPGAAPEEASRRAGHADPLGRSAGTDRPRQHGLVRYRLAHRGRPDRHQPACRQPVRRTPGQPVPLPSQPGRQAGAHPRGLPRGIPPAGKRRACDRAGPVDRPGRLRGAGHGDPPGSEGRLAAAAAGPRAPGCRAAPGGGGGRLSGARQPQRRRGDGRYLRQHLRRQALRSRRSRGIAP

SEQ ID NO: 22444 - protein, 177 aa, Pseudomonas aeruginosa
GRHLRLHQRGAPGGAAQPAQLAVAGGLRAAERQERGLPHLGVHRPGVPRRRSALPGRAGAAGVLEGGGDDRRRQRRTGSVRLPAGAGRDDAQRRLPLRCVQDLPGAVGEGRGQRRPAFLPRPAQGRRARRHAAGGGAGKRSLHRDRRTGRPPAEPAGAGRQGPLRFRPAAATRVAVR

SEQ ID NO: 22445 - protein, 411 aa, Pseudomonas aeruginosa
TGPQALDEDAGHVYPPVSATCPTLHRGGHCRSAAAAPGGLRRGGRRPCQPAGVRTDGRQRSRCHRPGPAQGAQRRAVPPAQRRAGPTRRAGPAVVEHRAEQRRAGLLRRRHAAGRCRRFLPGWRRRLRRQRGPGPIHRRGRRGHGNNPEVIEMKQKRILVTGAGSGFGREVALRLAARGHRTIAGVRGAGQAADLREEAGRRGVPLRVETLDINVAADRERAWEWDIDVLLNNAGSAEAGASAEIPLELVRALFETNVFANLELTQGFVRRMVEQKRGGKVLFVSSIAGLITGPYTGPYCASKHALEAFAEALHAELKPFGIQVGTINPGPYQTGFNDRMMETWKRWYDPQRHFTDHSGVRFPFEQYDPEEMIARMVELAEADEGPFRTLLPEAFVEVVKDEQAQAWQRRL

SEQ ID NO: 22446 - protein, 210 aa, Pseudomonas aeruginosa
ARTSRRCCAISTGRRRTGSSISAAVPGATWPPSAASATSRWDSKARRASSRWPGPTAVARYGNRISWRCDCRPGTSTASSPTPACSMCPAAPCRGCSANSSKRCGRAACCSAPTRAATTARAGMANATVPTTITRPGNACWRKPVSSSWSTTTGRRACRASSSPGWRASGGAPSEGATGSAGAACRARCGTGRGASARGRCAPGCRGRRT

SEQ ID NO: 22447 - protein, 296 aa, Pseudomonas aeruginosa
PRRGQVGGLRGVVDRALQGGQRRQAHADALPADHRGDRLGDFAEEAQAVLQRAAVLVVARIGLGVDELVDQVAVGAVQFDPVEAGVEGVACGLGIVGDDLPDFLHGQCARRRVLDHLAAAGLRSAALGIDEDLHAFGHQRRGGHRGGVARLQRGVRDPADVPELGEDAPAGGVHRVGDLAPAGDLLGAVDARRPGVALALPADLGAFGNDQAGAGALAVVLGHQRGGDFATGGAGTGHRRHDDAIGEGQVAKGIGAEQHDGDLAREAGRGAAYWKKVGALLAERFVRKTAAGENDT

SEQ ID NO: 22448 - protein, 444 aa, Pseudomonas aeruginosa
SGSRRSRSRASAGAGEWGAATGGRGGASRSVTEVRCRAGRGIPSQSSRIGQPAATMGGGAGGFPARPAGGAGRVHSVFPEDPLQLLAVLGLGHRDRGQDARLLRVQVVGDDPVVLVVRLLGVAQDEAAGIDVRGADDLHALLAQFLQGRHHARGHRAVAGAGMDDRLGAGLGQGLVGGVADVAVAVGDFHRSQRGDLLDVELGVHRVPLHRCAEPVALALDHHAQRAPRALERFGLDVDHLARVAAGEDLVVHGDQHALAACRLVAGHRHGVVQVEHAVGGHRGARAHRADHHDRLLGVLDQGQEVGGLFQGVGTVGDHDAVDVVAIGQLGDGLAQFQQVLVGEAFRGDLEHLFAADVGDVLELRHAGQQLVDRHLGGGVGGAVGGAGAGAGDGAAGGQDDHVGQFLLRCDFLGLGGLRQQEHQGHNTGGERVEQWLHGDISCR

SEQ ID NO: 22449 - protein, 296 aa, Pseudomonas aeruginosa
RAQVAWAFPIYCYRRRGWSRPPPGGPARAGTSVREDLGEELLGTFGAGADVAEELLLLAVFHDLPAVHEDHPVGDLAREAHLVGHAHHGHAFVGQLDHHVEHFVDHFRVERRGRLVEQHHHRVHRQRAGDRHALLLAAGELAGVLVRVLLETDALEQGQALLGGFFLAAAEYLDLRDGQVLGDAQVGKQLEMLEHHADPRAQLGQVGLRIGDGGAVDDDVALLEGFQCVDALDQGRLARARRPADHHHFAFRNLGGAVGQDLEVAIPLADILDGNHTVNLFCRRLTANEAVKLTTK

SEQ ID NO: 22450 - protein, 485 aa, Pseudomonas aeruginosa
NGRYRHSEDTATHVSCLVSHPRRVAPHDPRRATPTAGSRRPRQPPDDRRRATRGLGLLPAQRGSTHRPGIPRAIGARPRRPPRADDQPVPRLQVPRPRLILFAAGRGPWPPGDPVAALHQRTGSQVGVRAGPGWPRQGPGQGAVPYALWRHRRLHPDPVFRPYRVRAAGRPRAPVVRSLSLSDPAGGVPSPAGLAYRGRAPWRAEPLAQRPGGCLRRCPRRFQPARLAHAAFAAGGTLRHGDPPRSRRSAAAVQPAGAGQLRTGRRQPRHRRRTDRTQGLRAPGRVRRPADPRDHPGRPPYLSLRREGRARRPGGDGRPGIDPALHQQGLPGRPAWLPATGHAAHRDPLQGTPAGLAAGGPAPGLPAGAEDSRWLLLPWRGQGQRRQRTAGGGERAVRALGPVAGPGVLLHRVRLAHRRARPPTAVRLPVLHVARPLADLQPQGRRAGRQRRVPRRAAGAGAAGGAGAGPGGRRADRRRPLRGGT

SEQ ID NO: 22451 - protein, 515 aa, Pseudomonas aeruginosa
LRGVLRQGATGRRQRRLQLPADPRRRRGNAGCQRVPAQSGGRGVPHLFGLCARPRHPAHHLHLPRPDAQGAQRGRDHGLAASPRPLRRGAEKRLLPCAGQPLREHGEPLRSRIEALYREESRRVLATLVRLLGDFELAEEALHDAFIAAVEQWPRDGIPRNPRAWLVSAGRFKAIDNLRRRARFDASQRLLAEQLEEQAEAPAEEGDAVEDDRLRLIFTCCHPALTPEAQVALTLREVCDLRTEEIARAFLAAPSAIAQRIVRAKNKIREARIPYQVPTLEELPERLGNVLQVIYLVFNEGYSASTGASLTRADLSGEAIRVGRLLVELLPDPEALGLLALMLLHDSRRQARISASGELVRLDEQDRALWDRGLIVEGLGLVERALASRRVGPYTLQAAIVAVHAQAPRAEDTDWARIVALYDALLYLAPSPVVELNRAVALAMRDGVEVGLAVVDALLARGELADYHLAHSARADFCRRLGRRREAREAYRAALALARQEPERRFIEQRLRELD

SEQ ID NO: 22452 - protein, 258 aa, Pseudomonas aeruginosa
APGRGRDRPGCRPAPRPARRARRPGRRRRWRCATANAAARRAAIPGCSRTPRRRRTSTARAGRAPAARAGSPAGRTSSRAVAGRSAPVRCSAPPAVPARAAGRARPCSLPRPGRRCASRRGRRAARPGCAPAAGLSPRRPAPRRPPARARQAPPAPRRRPAVPGSWRCRAGPVRAAPAPGRGYRRRSPPAAATAPAAGAGRTSAGAAPAGRPAAPPAAAPGRNRPGSRRTAGRPRPGRWRTRHRGRPAAAGRNRRWPR

SEQ ID NO: 22453 - protein, 341 aa, Pseudomonas aeruginosa
GAFRGVPIHLSIQRNSYPHSGPPRGAGFVTRDVFDQGLLPRSPTSRRDHPELAQQATHLIAQRRAGPHQTTAHPMHGLHGLLLCALHRDIAHVRTTGGFADRLGVVCIVLVPLDVGFDELRCDQAYRVAQLPQLARPVVRTAAGLHRHQARRQLAKEIPHLCPLELATTYHMLVTINAVHLEYLFCQIQTNATKVHADSPSGTCGCTISLALDAVGGRSPFHCPTWCCAGYGRANNARGVIRRCSAGRRITALRLCALRRGVARGTVGRYPPMRRWGGARGSDHLAVAQPFQRGRVQAEERLEDLVGVLAEGGRRVAVFHRRLGQADRAGYLRHRPGQRVR

SEQ ID NO: 22454 - protein, 316 aa, Pseudomonas aeruginosa
PGRHRCETGTPESSMRRKIPSTAALVSFESAARHESFTKAAEELSLTQSAICRQIATLEEFLGVELFRRSRRGVKLTEAGLSYSRRVAVRLDAVERDTLAVMGHQGGGAIELAVVPTFGTQWLLPRLKRFQRLHPEVTINLTNRTRPFLFADTEFDAALYFGDADWSGTVSHFLMRENPVPVCSPELLGGRRTLSAEQVAGLPLMQQSTRPYAWRQWFHSQGLNVAHDMSGPRYELFSMLAQAAMHGMGVALIPPFLIQDELADGRLIVPMQHAYLSENAYYLIIPERRVESAMLNAFRDWLVEEARQYREANGLG

SEQ ID NO: 22455 - protein, 247 aa, Pseudomonas aeruginosa
STCRPATCPTCCARLDGRSLRVGERALTLATAGATVERPGTGLARAVAGGAHRSQRGADPDDDRHLRADLRTGQSRHGAARRARRHLPAARPVRPADAAGQLRRAGADRAGPGVHGGRGVRRQLRRARHRWNRLVRGRRADPDRYRGARLRHSARPGGGPGVAQRRADRRSAGHGPAYSPASGGKWHRRIGRQPGDGGGGGFRTTLRRLGAAPGRALAGARRAAAGGGPAGLGAGAQGPAPGSRAGR

SEQ ID NO: 22456 - protein, 185 aa, Pseudomonas aeruginosa
RRWMMGISYGLAMLLVFLALLLFSALRILREYERGVVFQLGRFWKVKGPGLVLVIPAIQQMVRIDLRTIVLDVPPQDVISRDNVSVKVNAVVYFRVLDPQEGDHPGGELPGRHQPVGPDHPARGAGQARAGRDARRARAPEPGYPASARCADRRLGHQGGECGNQARRSQRIDGSRHRPAGRGGA

SEQ ID NO: 22457 - protein, 273 aa, Pseudomonas aeruginosa
WKYHRAATRGHACPGSGWLCCGDPLPGRSFMLRCALLLLTLLLPCALPAANLRLVGDSWPPFVDSRLPGNGLAVELVTTALKRAGFDSSFQQVPWSRALYGVRSGDYDIALSAWYEPARSLYGQFSRAYLSNRIRLLQRKGRGIEFSRLSDLRPYRIAVVRDYAYAPEFDRDSRLQKVNVTSFANAARMLEAGRVDLAVEDELALGVAFKGELADLRDKLEVLPIPLGENGLHLLVSLRNPRHDEIVDGFDLAIRGMRDDGSYQRLLERYGAR

SEQ ID NO: 22458 - protein, 107 aa, Pseudomonas aeruginosa
ANLSRAQRRRSVCVNEEGGMGAECYPMVRGSAYVACPANSIGRFRATGSPLPAAVAGSAAVGNSVEPGIWRMQASCLRTLRRRRRAERYPAAISRAGAGPASEAAAR

SEQ ID NO: 22459 - protein, 270 aa, Pseudomonas aeruginosa
SRRTLNERPLILPSLRRLRAWWARPRSMATKAWKSKMAILPTALPGSPASPVRAPSRSPGRTLSLRPPAMHRVLIGGSNGSGLAFNWPRAYQASGCFCRSSMACARLASAGATSDRARPFSPARPLRPMRWMWTSGSRASSTLITVSRAAMSSPRAATSVATSTLQLRLANTVRTWSRSRCSRSPCRARAEIRCAFSASASSWHCWRVWQKATLDCGRKCWSRRTTASMRCFGSISKKRCSIWLSACSDSTLTCRGSRMKVFASFSMPSG

SEQ ID NO: 22460 - protein, 417 aa, Pseudomonas aeruginosa
RLQDPGRRPEGQLRSRTRPERHAGRARSGDQLRSLGPSPKNPDGSIRVFYCPEKTVTLSSPAVHPVLTSSRPEWPGPVRSRFDEACAIPSSGLRRAVVAVVLFRVLPCRHRALGLDRAVLADARAHAGQGQAGYRRADLVAGREEYPSLQEGRRALGALRCRAAHRRQQGAGQRDLRAQGAAADQGTRRRRQRQPSGGGDGHLPGRQAAARAVLPARPRQHELSGAARSPHARTPRRGRRVPNLYPQTYLQRARRSVEEPAQQSSAQRHPEQHDQRSHPQVARVRLDLASPRAALGEQRGWGEADRQPDPQRHQQQVVEVAEQRYEVRDQVDRTQRIGHHQQSHQSGQPGHVRMAAAQPEGDDLGLQLASPALERSDPGHPRGPGPFPDRPGAGWCDRPRCRAGRRSPRPASTSGRR

SEQ ID NO: 22461 - protein, 568 aa, Pseudomonas aeruginosa
TNAAKRSRPIAAWATATARTTPDAARRSDLPGLLPVRRSHRLLRAEHGDGRSAARRAPVHRGNPGGHRQPARRDPPPGREERHPGTERPAGDARGLRQARAAGGYLGLAQGGCEPPHLRHRRQRQGAAGLRRGGCRPGLFALERRLPDSPGPVRRALQPRRPGRPGFLGDVRGGADQGWWEDHRGGFGGQAEQQPATLHRPLAAAPGLARCRADRPRAAGRRPALLVAQRRAAAPHPVRTGGQRGAPRRAAALSRRRDGATGGRGGTHAHATGRQGLRRALRAYPDPRTEEPIGGDPWRRRVARRRDAGRAAGALRRQHRRRERAPATTDRAPAEPGPGGAAARPGGGRQGRPAGDRRVPAGRPGGAYPAPAIAGGEPPGRSLRGSRRAVPAAPGAGQPARQRPRLHPARRHPSPARRGRRRGYRLAPVQPGAGDSRLRPGAPHRTLLLAAAPGQRAQEHRAGTELRRRGGATAWRPVAGRQPRRRRRGAALAAARLRRLHGNSIDSPHGDPKPAIAAPQTFRHHPDGESPHEPHAGLQARCHRPTHPAIADSPVDDRRPDPRSPGGS

SEQ ID NO: 22462 - protein, 514 aa, Pseudomonas aeruginosa
CRTDSGKASAASRAPPAIRTCAPSWSFAWGSDRARCCWACCCSAWCAGNERVCRPARRPSRRRAPGGADRPAVPRPLGGLAATRRAPAAAAGVGGPSGSGAGGLHRRALADFGEPGGESRVAAAPVPLRLAQVEIAQGAGDADGGDVEARLQFGDAVALQPRQGPRDLFPLCFEPGVPALLLGADEGFVAGQHRGVEDGVRQRGDGQASPADAAFAGDQRFADVLLVEVVADHPAVVQHLAVRQAQGGNLAGRVAGVELPDGRDRRRRDFLERHALALAGFVEQDQDLAHEGRGGGVEQRMGSAHAGSLEGSVADDAQTIGGRLGAPGFSGATAEQGVAGRRPVAGQDAECRLRTVETQERPAGGVVQPDTVHGVDPQAVRAGLAVRQRPALPRGIAGIVAVQPGATAVAGPEPADGVGADPAQGLRAFRRGQLLGAAVERIDMHQRVVLRVPDLAVRGDADAVRRLALGRGPDLHQAPGWVEATVEAAAAGEPEAPVVVEYRGVEPGRRGLGR

SEQ ID NO: 22463 - protein, 402 aa, Pseudomonas aeruginosa
RETFAAQALAADAKDGVEAAVEHPGVAALVADDGSRPRAFAERHLHALAAGRVETPQRMPAVRAVPDRTLCTGRDRVGRGALVQRVVLFAGQGGAGRRQGQEQAQQRVGQVTHTVLPERRAERGKALSCYSGSALSIGGTANGHSGNTRGGMPRGGRGERRCAGLHGAGRLGDRRCHQHRSQRAGRGKRRALAGPGGGPAPAVAAGSRARAIQRDPAAAPAQRYPGRLPRPERPRLARPRRHAGGLPEPAADSRRRNRTAQHRRQPDPRRRRRRPGTQLRRFGPTRTGSAIPGAFLPDARGTSAVGSRRTVQGQPPARAAEPPADEQARGLLGAGHQRPLARPGAARDLAARRVAFLRADDRRLRPAGRAFPPLYRRTVAAAPRGRRSERHARRVARDRTGR

SEQ ID NO: 22464 - protein, 557 aa, Pseudomonas aeruginosa
SVRCRTAGRCAPARWRLSPGAGRGRRAVPRRVRVRDAPRTSGGRRGDRRDGLRRSRAAIARRWLRRAPARVPANDDHRRSPGLSVEGDVALAQTLGQVLAHARHRDSETLGDLRVGHAVQAAIEKRATRLQRQRAKQAIDLAEVLENQVLLFGRRLLRFRNQRQFGEIGLLKGGAAEVVDHQTARHLRQERARFAQAGQLRAAEEANEGVLAEVFGALAAAEVAVQPGKQPAAVVPVQATHEFAVADVTRRHDRSPSRNGIEWKNENYSQMIAKCDYPCNWRPSGSHLSRPAGLPEDRCSHNKNRSLAVAEPLLIIGSYLSPYVRKVLVLLELKGIAYRIDPIVPFFGDEAFERLSPLRQIPVLVDGDFVLNDSSVICQYLEERYPQPSLYPVDIGQRAQARWLEEYADSRLGQVIIWQLFHQLVINRGIWQREPDQAILQRTYDEDLPSICNYLEGRVPPSGWLCGELSIADVAVACLFRNAQLARYQVDGERWPRLARLLADAFALPAFQHLARFEKATAQTPVAEQRQALREAGAPLSETSHARERPVRGPMSR

SEQ ID NO: 22465 - protein, 557 aa, Pseudomonas aeruginosa
NRLGKSCRFDQVRISNRFIGLCGRTRERGKSGTPGGRIGKIVHNNCAQCYRRARRRCAARSSARPGNIQALQLPDHPRMGVTPDMLDVAVEPQHVGRNVERRGIQGEAGGFRQGPCGMSRSGEQEIGGACQEQRRQHRRQLHRHFATQAGAGQQPVDHPAVLVPRRHHRMPFGQVALQRRRPGEAWVVAPRYHHVAVGEPVMGLDAFGQALVFLVVAEGEIDPPAGQGLHRQLAFRIDQAQAHSGRAVLQAVHQRRKQGEGGVVGGGEDEGALALSRYERPPLFQPLAEGAQGGGHRSGQVLGTLGRLHAVALAQEQLVVQPLAQAPQRMAEGRGADRQFAGCGADVAVAIQGVEDKQEVEIEAAQQGMHVIQLPMRRMHFMHLSSRTRMAGSPTGRLPMTLEIRPAVPADAEQILAFIIELADYERARHEVVTDVEGIRRSLFAEGSPTRALMCLSEGRPIGYAVYFYSYSTWLGRNGIYLEDLYVTPEYRGVGAGRRLLRELAREAVANDCGRLEWSVLDWNQPAIDFYRSIGALPQDEWVRYRLDGEALRKMAE

SEQ ID NO: 22466 - protein, 287 aa, Pseudomonas aeruginosa
FFPGTVATSLACMAITLTPEAPMGNLSFLATSDGASLAYRLDGAAEKPLLALSNSIGTTLHMWDAQLPALTRHFRVLRYDARGHGASSVPPGPYTLARLGEDVLELLDALEVRRAHFLGLSLGGIVGQWLALHAPQRIERLVLANTSAWLGPAAQWDERIAAVLQAEDMSETAAGFLGNWFPPALLERAEPVVERFRAMLMATNRHGLAGSFAAVRDTDLRAQLARIERPTLVIAGAYDTVTAASHGELIAASIAGARLVTLPAVHLSNVEFPQAFEGAVLSFLGAD

SEQ ID NO: 22467 - protein, 161 aa, Pseudomonas aeruginosa
LRYRRAFSLGAGADMNEPGSFIWTWYGQDEHRWVLLSAEAFLALDFLALDGAMQRETIGSCPGCSTWSEKVVPLHEWLEGCPGHQAGSFRDALRRVWALCNELPEEALGCFDFDIYAHPGWQAVRREAREALRQNGWDSIRSHAEELRDDCWERVHGYPKK

SEQ ID NO: 22468 - protein, 194 aa, Pseudomonas aeruginosa
TRPGVSPKAWAPAACNWRRRRPTTPGSRSTSASAMSVTNSSTLTGCSSELPFVPAGGKLMDHLVLTVIATDHPGLVERIAQCIASHGGNWLESRMSRMAGQFAGILRVAVPAEGYDELVEGLQGLSSHGIRVLLAESGIEPVCNWKPIHLDLVGNDRPGIVRDITRLLAEHGVNLESLSTEVRPAPMSSEPLFH

SEQ ID NO: 22469 - protein, 218 aa, Pseudomonas aeruginosa
SFPSAGSNRRCSMPSATGWWKRPGSTARPTGWAERAGTSGGAGRTRRPGTGPIRRVPRSRGGDTAGHPPRRPGWRPWGTTPGVHMNFHTRKWVKPEDLNPNGTLFGGSLLRWIDEEAAIYAIIQLGNQRVVTKYISEINFVSSARQGDIIELGITATDFGRTSLTMTCHVRNKITRKSILTIDKMVFVNLGPDGLPAPHGKTEITYIKDQFKEDEVLP

SEQ ID NO: 22470 - protein, 80 aa, Pseudomonas aeruginosa
SRTVRRHGPGHPGRQHMGGGYRQAIQVRRANGQHRHGFRRGALGVGQVGLADLLADRHHDAFPADHGAQAEGDGHGDLHP

SEQ ID NO: 22471 - protein, 431 aa, Pseudomonas aeruginosa
RDELGGVVDLPLERLQLAAGVGVEAADVVLVHQADRLGGQVHVVAHVAHGLRRYPRERAIAFHFLADRAGQGGQRRDQLRRCLLAAHVVGEYLARIGRRRLRRALHQRLLGDLGDGGELHCLVRRHGAVQGVGHRQGADQDQHDQAHAFLSVVGAVGEGHPGTGQDQQAADPPGRRRLALRRLVQRAVLHQQAQRQEQQGGAGEADQRREQQGIADLGCLAPVHPAGAVAPVHQRVGHADADDRADQGVRGRRRQAQPPGPEVPRDGGDQQGEDHGEAGRGTDLQDQFHRQQGDDAEGHRAAGEQYAEKVEATRPDHREVRRQRVGVDHRGHRVGGVVEAVDELEAEGDQQGHAEQQEGRPGGDRGTDVIDVLHQAVGAEQQSGGEHGEEYEGGEAAGTLLEMGLVRVAGGTGDGVGGKDIGGHGAGPRWG

SEQ ID NO: 22472 - protein, 252 aa, Pseudomonas aeruginosa
TEKCAAGPVACRPGARDERLRPGVARPGGRGGRYADAVPARAGAVAVLRRPGLSRGLRTGTGALGGWCDRPGQRRLPGARHRACRRGRRATGGAGTGHARRPGRIDAAHRQGDPRQPGAGRRFRRAQRGAGGERRHLHPVCLPYRGDGAGHQPRRRHPGAPGDAGQARREAPGAGRRTHGAQAGQRRRRLYPWPRAVARAQRRMGRARGARGGQPGGARGGGAEGDRPAGPRHARPAAPGWTAAACASASAR

SEQ ID NO: 22473 - protein, 224 aa, Pseudomonas aeruginosa
PWLPPAPRSSGQAPDWRARLLAVLTDPSVALILMMIGIYGLIFELANPGMALPGVLGGICLLLGLYALQMLPVNYAGLALIALGLAFMVGEAFVASFGVLGIGGIVSFVVGALILIDTEVPGYGIPPGLVVALALLSAALIVGLLGMALRTRRQAVVSGTAGLVGSLATVAAVDSEQPCAGWVQLQGERWRVLAARPLAVGQPVWVLARKGLLLEVALADEGGG

SEQ ID NO: 22474 - protein, 181 aa, Pseudomonas aeruginosa
RSTRWCTSACSIRRKAIIQVENYLAATSQLAQTTLRAVLGKHELDEMLAERERLNLDIQQVLDAQTDAWGIKVANVEIKHVDLNESMVRAIARQAEAERERRAKVIHAEGELQASEKLMQAAQMLGRQSGAMQLRYMQTLGAIAGDKSSTIVFPMPIELFGGKYAGAAPRNEKAAGEEEER

SEQ ID NO: 22475 - protein, 75 aa, Pseudomonas aeruginosa
FQGELAMSRQNGTVKWFNETKGYGFITPESGPDVFVHFRAIEGNGFKTLAEGQKVSFEVVQGQKGMQAERVQVIN

SEQ ID NO: 22476 - protein, 189 aa, Pseudomonas aeruginosa
RVPAQSGPVPFGVVSMKPVQSRRLAFAALLSLSFSSASCHAATEHWGWIEQSWLMPERMQAKAKLDTGALTSSLDARNIHRYRKDGERWVRFDVVLPTADSKAPVSVTFERKVLRLIKVRGAGGSDSRPVVAMDICLGAKLLREQFSLRDRGNMNYPVLLGRRTLEHLGAVDVSRTFTRKPTCSALAAQ

SEQ ID NO: 22477 - protein, 270 aa, Pseudomonas aeruginosa
ATTSRATSRASQGMCGWRLHSQRAMTSVFSSRAQRLSVAIQAILEVRVLFRIDPARAGATVLAAELEEDRRGQHRHQADADIGGVEGAEYGVLPRIQVGLETAQQRRRASHAEADRQLHDHRHQAVAAAGVAVLQVDQGEGVHRRELQGVHRAEQAQVQQQPDVGGVLVDQAEAGDQAAEDQGVADQQLAIAEEVQQWLGHRLGDHREQRQRDHGHARGGGRVAQSHLQQQRGEEGQGAAAQAGEQVAEDADGEGPRLEQARWEQRLVDA

SEQ ID NO: 22478 - protein, 710 aa, Pseudomonas aeruginosa
RAQPVGGEQDQSADQQQDHAQVRQVQLAESFQGDGDQHHGAAEEQEADAVETARHRAAQVRHQLHRHQAAEQADRQVDQEDPVPGGVLHQPAAQRRSRQRAEQAGNGDEAEHPHQVLARVDAQDHQPSHRHHQRAADALYDARPDQQFEARRQRAKQRAEAEQQYRAEEHPARAETVGDPPRGRYQQGHREQVGDHHRLHAQRVFVQRTGHARQRGVEDGAVEGLHEEGDGNQPGQLAGDAGGELERLAHGRAPSGGQGPSIEKFSPRWDGRRPDRGEQRALRRKSRPERSPFIVLGQAEALALAGCCASTQESPRQWLRMRRRRFVIARTCPALHARRRVLHRLVAMFSTQRSATPVAAAVAEAHLPWKQESSHGPGTLRYLPRTSRRRPRQPGTERPAPRTRPLRTALPPVDAPAAYALAAGVAVRRRQPVRRDLLRLRRAEPGHPGARPRAGGGGHRRVLQQADHRVPATRRAGRRRIRQARSGHRAPALRPGRRRRGAGGAQAVRPVAGRAQAVHRGQRRARRQQGRGERGHDHLAAGEERLAACLRPVPRTRPQLCRPRAPVARPGGGAGQLRRDAPEEVRPDRAGATAESGQGGRQGRRGRPRGRPEQHSATGQVQPRPDPAGPRRQARSGDRPLEGSRDHHRGSRPAQEEQPGADRRARRRQDRHRRRPGPAHGPGRGAGGAARQAPGRTEHQRHGRRRQVPR

SEQ ID NO: 22479 - protein, 822 aa, Pseudomonas aeruginosa
VRGTPQAGDGRTAGGAERDHPVHRRGAHHRRCRPGRRRRRAGRGQRAEAGDGARRDEPDRRHHPQRVPEVHREGRRAGAALPAGVRPRADGGADHLHPPWPARQARRPPQGDHPRRGLRRRRRAVRSLHRQPLPAGQGHRPDRPGRRPRAHRQHLAAGRDPGTGGRAGAAQARAGLRRQPQVVRRGEGLRETHPGTQGTPRADHRALAADPGVEDRGGAGRGHRRDHLQAHRHPGHRTDRRGAREAPADGRAPAPAGDRPAGSDHRGQRRRAPGPRRAAPGQPADRHLPVPRPDRGGQDRAGQGPGRGGVRRRRRDDPHRHERIHGAPRGVPADRCAAGLRRLRRGRPAHRAGAPAALQRDPARRDREGPRRRQQHPPAGVRRRPPDRRQGARGGLHQYHHHRHQQPRLRADHEERPGRRVRPAAGEAQARTDDYPARTFPPGIPQPPRRGDRLRVAEQGADRGHRAPATGAGEARRARSGHLPAHRRQPGRPPRRRGLPAGVRRPRAEAADPPATGDAPGHGDAQGRGERGRDGHLLLRRQGRRRLPQGRRAEAGGTQEIRRRRDAQGPRDGGEEAGGEERRRRQGQGRQAEGQVTRPRLGNKAPAGRSKSHPGLRMRPGRSISHEELPMRVTTHATLAAALLLSAASAFAFNLGDAAKAVAGASQGDSAQVATTPQTNGLLGALTGQLGVSQEQAVGGTGALLGLAKNQLAGNDYSQLVKTIPGLDKLAGNNALAGLGGLGNVLGKSGGDSKGLGSLLGNADSMGDVNKAFGTLGMDSGMTEKFAQVLVDYFGKQGANSELLGSLSNLWGVSKAGGSSLL

SEQ ID NO: 22480 - protein, 504 aa, Pseudomonas aeruginosa
PRCGYSPYEVGATPGYSLPAPVGRITPPALSAAAPWKRRITALRLFALRDGCASAGTSAQLPQAGDAFVLFFPHARDPFLHVLAEHRVVLVVALPQGGIDRAGLDVDDHLRHPSAEQVPESRHLVARVDHGDVEQGVQLLAQRGEDEGHPAGLGLEQVAIGRLLPGLLLLAETRAFQVVHHGHRDALELLAGGLGDLQVLALEFRVLLQEGLGIALHERILQRPPGQAEEGHPDQLLLEEELEVRGAPVEHLDQRGDVDPGLVVAHHQVRGVLAQVAGAAHVPDRRRAGGEDPLVDLRPGLGDPHHAPGAEVFQALAGEHQLEQCDQHHRADQDQRVEKQQKAAGQAGQQFPHGWFPCPGCGSTRPIIRIRAAPPKPPAWRTKPRRASPMWTSYHFRRCPREACPCLALAVRPAGPRRRTQPLRPLRMGLPAGAGPHPAGEDGHRRLHLLAVGQGHRVVPARRRGVGALPAGHQGGRRLGVRAQAGAHRQDQEPRRQPQRRGRG

SEQ ID NO: 22481 - protein, 694 aa, Pseudomonas aeruginosa
SRDCRHPALRPAGRRLRHHLGDPRRRGAGVTGAPAGGSADPRRRSAGHQRFRGLQAPAPVLRGAGDLPHRARCRDRPCGRPGDRRRRLRGQAVQPARGGGSGQGHPQAHGAAPGGAGRGRAERAVPGRRGARADPLPRHPAQPHPPRVPPAADAARAARAGIQPRAVARRPRRRQRGRLRAQHRQPHQEPARQAAPGERTRRSDPDPSRPGLQLQPGPRLMPLGVRIFLVYFLFVGLTGYFVLSTVMDEVRPGVRQSTEETLVDTANLLAEILRQDVKNGTLAQSDLPEMLEDYGKRVPQADIWGLRKEAVNHRIYVTDASGKVLLDSAGVAVGQDYSRWNDVYLTLRGQYGARSSREDPDDPDSSVMYVAAPIKDGGKIIGVVSVAKPNSSLQPYIDRSQRRLAWLGAGLIALGLLVGGLLSWWLSGALRRLTQYAQAVSEGRRAELPRYRGGEMAQLADAVERMRTQLEGKDYVERYVHTLTHELKSPLAAIRGAAELLDGEMPAEQRARFVGNIAGESERLQQLIERLLSLAQVEQRQGLEEVGKVDLREIAASLLEGQAARIQRQRLRVENRLEGPCEVRGEQFLLRQALANLLDNALDFTPPGGILRLLAEVDGEGIALRLFNQGPAIPDYALARLTERFYSLPRPASGRKSTGLGLNFVAEVAQLHGGRLQVGNRDDGVEALLWLPRG

SEQ ID NO: 22482 - protein, 486 aa, Pseudomonas aeruginosa
GASTETPSTLHTATRSPPSRRRRLSAITPTESPPMNRTLAYKLGAIALLILLLLIPLLMIDGLIRDRQEVRDGVLQDIARSSSYSQRLTGPLLVVPYRRTVREWVTEEKTEKRVLQEREQRGELYFLPDRFALDGQMRTELRYRGIYQARLYHVDNKVAGYFQVPAHYGIEEDLEDYQFETPFLAMGISDIRGIENALRLSLNGASVDFEPGSRVGLLGSGVHAPLQGVDGRQAQRLEYAFDLSLLGSERLDIVPVGRDSQVILKADWPHPSFGGEFLPSEREITAQGFTARWQTSFFATNMEEALRSCVEEQRCDGFQARAFGVGLVDPVDQYLKADRAIKYALLFITLTFAGFFLFEVLKRLAVHPVQYALVGLALAFFYLLLLSLAEHVGFELAYLVSAGACVGLIGFYLCFVLRSVARGLGFSAGLAGLYGLLYGLLSAEDYALLMGSLLLFAVLAAVMVLTRRLDWYGVGRKDFPAVPARA

SEQ ID NO: 22483 - protein, 289 aa, Pseudomonas aeruginosa
EELRMATVEILGAECRAGGAVNDDALGCTAQAAWVIDGATSIGRSVLGVESDARWLAQAVDRHLRLLLEVEPEQSSETLLRRLLNDIQGDFRAQSGRDWHDLEDMPAACLSLLRIRGGEIELLNIGDSRILVEGADGQVRSFGDSALHELDRQSLAHFCRMREEHPQWDHAELFKASRPRVRQNRLLMNKPEGYWALDISDRWLGQVQRETLPLAALRSFVLMTDGFDRLVEPFRRYTDEQLLRRLEDVGVSAMLDELREIEQGDDQALAFPRFKIHDDASALWGRIAG

SEQ ID NO: 22484 - protein, 139 aa, Pseudomonas aeruginosa
NGGRTVMNVPEGFQPLFRSSPLLDLLGPFFCRQDAQRQLVVALRIDEKHCNHGGTAHGGLLSTLADVGLGYAMAFSREPPQPMVTVGLRLDFCGVARVGDWLEVHTRVDKLGQRMAFASARLHSGERLVASASGVFHLP

SEQ ID NO: 22485 - protein, 273 aa, Pseudomonas aeruginosa
GSGMLARSSAVSWGVRFAEEVQCRRTDRPCHRLAAGQPRVFRHRAERHHRSRRGAERLALSLFPRGQAADRQRRDRLRRRRGGVLPRPRRDPGPPCAQRPPPVHRDPAWLAGAFAFRRGLPGAFHQPEHRRRAGPGACRMPPGAPRLARQHRACVARRRTGGKARRLARLADPRGAGGGGRGGPRRAVVPGAGCDRGRIAGATAGLGGCRAQAGQVSVSAARCPPRSLRRKLRGRPCGAWPGRSGSGRPGRRRRTRRTAIARRMPATMPAGWR

SEQ ID NO: 22486 - protein, 344 aa, Pseudomonas aeruginosa
AGSPVRRRIRSDAPSPCRRRRSAIARTRWRRRSPSPGSTGRGWRPGRRLRAPARSPSAARAGRWRRDRSGCRTRRWRSLRGSARGVARRGCRRRCGTSPGRAARSSGPCSRTGSSARRPSARPGPARRGSARRSCRGRRGRWRRSSWRYCARRWSTARTGCSVPSGALRPWSGRDRRCTGAGSAAAVRGRRDGWRGAGNRDWRECPGPGAPPRTPLRAARRVAGSRDWPECPGRAVRRRTRRSADRRAAGCRGFPGCRGRAAREKTRGARRAASGCWTWRSPPAVGRTRREVGFVCCFCIQEFRRFKPVMCQPILDRIFRALRKPAFRRQAPETAWEKAVASIR

SEQ ID NO: 22487 - protein, 440 aa, Pseudomonas aeruginosa
RFSLLGAGNGNGREDGFLARLPGGRRATVKKRAGVLLGGSEECLDAGLRAAEDQRVDIVGALVGVHHFQVDQVAGDAEFVGDAVAAQHVAGQAGDVEGLAAAVALHDRGDFHRRGAFVLHPPQAQAALQGQGDLGLHVGQLLLDQLVGGQRAAELLAVEHVLAGGVPAEFGGAQGAPGDPVARRVQAGERTAQAAHFGEGVLFRNEHVVHHDLAGDRGTQADLAMDRRGAQTFPALLEDEAADLPFVILGPDHEDVGDRAVGDPHLAAAQAIAAVDLLRPGDHRARVGTVVRLGQAEAADVFAAGQLGQVLLPGGFVAEFMDRHHHQRGLHAHHRAIAGVDALDFASDQAIADVVEAAAAVGFGNGRAEQAGLAHLAEDLRVGLFVAEGFEHARGQLVLGELLGAVANHALFFGELLVQQQGIFPVEASFGGHAYILVKR

SEQ ID NO: 22488 - protein, 284 aa, Pseudomonas aeruginosa
PAGGGTPRRGGARHPGGDGAPGRRRDRTGGGADLRHPMAVAAAQALPAAAPGGHDQPDQPHPPVPLRRHRVRRRAVLRRRRLVGYRLAFPDARESGAGVQPGAAGRASNAERRAGRRAAADAAEHPALRLAPVVSLPGTERRPRHERAALRAVLHACPGGHARHGRGPHTALPDPGRAGRRKAYRAHATCLFERECVLPDHSRAQGRIGDAQCLPRLAGGRGQAVPRGQRAGLNAQEHRVAQAGRAAPGPGRSAGSRGAAAAIPPGILHDGQDGGRGAPHQEFT

SEQ ID NO: 22489 - protein, 317 aa, Pseudomonas aeruginosa
IPVASAIISSLKSWHVEGFADPDTRGEGESHWTRLRSARRGRSLAGPVRGTSAFVPGWPGRAVGEVDMRMPCRLALALLLCFAGPACLAASGPVRVLSVDGAIGPASADYLVRGIERAAEDGAQLVVLELDTPGGLDASMRRIVKAILASQVPVAGFVAPSGARAASAGTYILYACHIAAMAPGTNLGAATPVRLGTPDKPAEKPPARDAEPMVRKQVNDAAAYIRGLAQLRGRNVEWAERAVREAVSLAAHEAAAQKVIDLQARDMPDLLRQVGRPQPARRRARADPGYRRRHGRAARHRTGARGCWRCSPIPAWR

SEQ ID NO: 22490 - protein, 643 aa, Pseudomonas aeruginosa
IAEQGVREDQEAEADLGVLPEMAGFQEHVRQGGRERRVGVVRVAPGGAVVEVVALAGGVLLHDLPQVTAVAGEGVGEHAVEPAALPVGQHQEHREAGDQAAQQGIEQAGQDQPVAIADLVEAEQHQQGDRRRRQGIATAAGGEEGDPGGDREQRLHQRAGEQVDQRPADHQADHRTEDPLHQAQAGRAIVGLADEHRGEQYPVALGRMDPVQHAVAGGQRQGHAQAVAEQQRGRGELLAQALEGVLQAARRAVEQGAVLFVGDGVRVARPGQLAVQRGEVGGQGAERAQQALPGRVALLAQVFERGLEVFQGQLAVGVIKRLAQADSPRQGLAGLALLVEQALAAEQHVAVEERLGQPVVRVVRGTGALVDVLGDEIELQVAAHLGARPTMAEAVENGLLGLVQRHHHLAVLPCQGEALALHVELAQRFEQARLDPQVFAQLEIQAGKTLLHRLVGEQRVPQHREQPVPGRPGHQQQRFVPDIGDLAAALVHADHGVDREDQGRRGDCRIALAEGAEEDHAERRQRHPGNEQPGIGEQQLDGEGGDAEAQQGHQQRLQAAEPVVVGLRQGAGDDPEEQRDQQLDAVLPPAQQQGAGQGDEHPQAVGELVEGPEAAERVCQRRGRHGGGVLSDGPWFSLCGLSG

SEQ ID NO: 22491 - protein, 539 aa, Pseudomonas aeruginosa
FNRPISRDWKSAARRSRRKRCRGQLGRAGHLADAGFVPANAKTSSPRRTLPGGDIARRSGPGERSGGALKQADLERATLDLAFAQALEGLVGEAALDGDEGLEVEDGDLAHRAAGQPGVAGEGTEQVAGAHLVLASAGDAQGAHRRQQWFRAGLQLAEGVPGQRLLLQVLDGLRAAGLGRRHQRQGQAFLAGATAASDAMDVDLRVTRQLDVDHRFQGGDVQPAGGHVGGHQYVATAVGEHRQDLVALALLQVAVQGQGGNPLRLQCVGQLLALLAGLAEGHAGLWPEMLEQAYHGVHALFRIDLEETLLDLAVGVQRLDPHLSRIAHEGLRQLLDAVRVGGGEQQGLPALGELADDLGDAVVEAHVEHPVGFVEDQGIEPVEDQGALAQVLLDAPRGADHHVRAVLQRSHLRAVGDAAAEGQDLDVVGGAGQPADLLGDLVGQFAGRAQHQRLAAEVARVQRAEQGEAEGRGLAAAGLGLGDQVVSLEDQRQALRLDRRHLPVTEGVEIGQEVRGKRQRGESGGGHGAGLGRRYERLV

SEQ ID NO: 22492 - protein, 72 aa, Pseudomonas aeruginosa
TRRITSRPTGIISAPPTPCTMRAPTSSSRLGDSAQSNEPRLNSSTAPRNTRRVPKRSAIHPEAGISRATVSR

SEQ ID NO: 22493 - protein, 1044 aa, Pseudomonas aeruginosa
RSSRRDGTAGDRIGANSGHCGGSRGQRGRLSLSWVKPKRWRSPAAVLVLKSHPVSGCGCDVGASSSHGHVPRCMLDGACFTALSRCSPRSARRPRSPLPSPKPTFRGNRSPPMAQELCAICHERPAVARVSLVQNGQRRELALCELHYRQLMRQQRMRSPLESLFGGGSPFDEIFSGFGEQSPVTPVRAREPEAVDIAEYFSKQTTEYLQRAAQVAAEFGKREVDTEHLLYALADADVVQAVLKQFGLSPAELKQYIEANAVRGASKGEASEDMTISPRVKSALQHAFALSRELGHSYVGPEHLLLGLAAVPDSFAGTLLKKYGLTEQALRQKAVKVVGKGAEDGRVDGPSNTPQLDKFSRDLTRLAREGKLDPVIGRSKEVETTIEVLARRKKNNPVLIGEPGVGKTAIVEGLAQRMVQGEVPEVLRDKRLVELNINAMVAGAKYRGEFEERLKQVMDELQAAQSEIILFIDEVHTIVGAGQGGGEGGLDVANVLKPAMARGEMNLIGATTLNEYQKYIEKDAALERRFQPVFVPEPTVEQTISILRGLRDKLEGHHKVTIRDEAFVAAAELSDRYIGNRFLPDKAIDLIDQAAARVRIASTSRPAEIQELEAELAQLKREQDYAASRKWYDEAKVFEKRIQERKEHLEQITERWQQTQGSKTEEVRVEDIAEIISRLTGIPVTELTAEEREKLLQMEERLHQRVIGQQEAITAVSDAVRLARAGLRQGSRPIATFLFLGPTGVGKTELAKALAEVVFGDEDAMIRIDMSEYMERHAVSRLIGAPPGYVGYDEGGQLTERVRRRPYSVILLDEIEKAHADVNNILLQVFDDGRLTDGKGRVVDFTNTIIIATSNLGSELIMKNAQAGEFAQPPEKLKRELMTTLRGHFRPEFLNRLDEVIVFESLSKAQIEDIVRLQLERVKRAAHAQDIYLHIDDSLVGHLAEEAYQPEFGARELKRQIRQQLETRLATAMLKGEVKEGETVTFFYDAKDGVGYRKGAAPKPAARKKSGAGETPKGRATAARKPAAKKGAAAKGKADKPKAK

SEQ ID NO: 22494 - protein, 355 aa, Pseudomonas aeruginosa
RFMNGYSSAHQARPRKGTQISSFLRKNLKYGVRRLNTWINAGMSTQDWWLLTTRYEVSWRRSPAPRTSQTVGVQVAKIHLSISAQVSAIHITPLEQRSFRRWPGSTSLSSAISIIGPIRISVLRSSRRLLVRPVNSSRMVGFPVLGVGRRGPSYASAPRRPSRRRGERNRAVLVLCGPRITSGDARVKRALALLSLFALPVLAAEPNLYGRYEWVSLPELDRTLQAKMDTGAYTSSLSAKDIELFQRDGEEWVRFRLATKEADGSVFEHKLARIGKIKNRADNRNGEDEDEDRLSERPVIDLQVCLGGAMKTIEVNLTDRSAFNYPFLMGTKGLRKFHVAVDPSERFVADKPTCK

SEQ ID NO: 22495 - protein, 257 aa, Pseudomonas aeruginosa
ASYATGGAIDARAGLRHRSGIPVSRRHAMPHILIVEDEAAIADTLLYALQAEGFATTWVTLAGEALALQERQPADLLILDVGLPDISGFEACKRLRRFSEVPVIFLTARDAEIDRVVGLEIGADDYVVKPFSPREVAARVKAILKRMAPRPAALEEAAPSGPFQVDEERVRIHYRDTPLNLTRHEFRLLQTLLGQPERVFSREQLLDALGVASEAGYERNIDSHIKSLRAKLRQVNERGEAIQTHRGLGYSYSPDHA

SEQ ID NO: 22496 - protein, 129 aa, Pseudomonas aeruginosa
AWPRWSSGKAWRRSARSTCGRSPRPCWKARRRVSSASDCGWRTAWKVPARFAASSSCCARRWPTCSTTPSTSPRPAASFACSPRSTARVSPCACSTRGRRFPTTPWRASPNASTRCRARPAGARAPGWD

SEQ ID NO: 22497 - protein, 200 aa, Pseudomonas aeruginosa
SAIARRFVTACCRISPAAPATASASPARCWWCRTAGRCASGSPRRRPRSACCRSASSAASCTSCPTALPSTGRCAPSCATVASTRRACTTSTTRLPATSRCLRTMASKKTWRTTSSKRRSWRWASATSAASRMPCACPSTVPASTSSRVAGSACSAAVCTHRCKASTGARRSAWSTPSTCRCSAASGWTSCRWAATARSS

SEQ ID NO: 22498 - protein, 138 aa, Pseudomonas aeruginosa
PAAWTGTGSAARTSRRYPPGPDDEGGGAGRRRFPRRKSMRLFFEFTLCAALGLLVSGVILIFLLFFGKFGLIEYWIASGKPLAHAMLVLMPDGFWEGLSGIEGAAGNPHVRSFLELCMGLGQSALLLGLLLFRLVCWK

SEQ ID NO: 22499 - protein, 266 aa, Pseudomonas aeruginosa
  UNSURE (194): Identity of amino acid at the above locations are unknown.
RGLVARRLLQAVACVLAFFHFGVGVAIGADHLQVVGDVAGGFQLYPGDLHFARLRSDRRAAYVLRHADVLLAQVIDRGGEQRVGAHRLVLHTDFPLLAFGRLQRTGAVHIGASGGLERLRIGDVGRHAIVEDVAERRVAAELLVAAGIGGVALVVEGGPGVHPVLATAEGQAPVVEGDLVLDLEAGLVGLLLVXVIRVGTRRLGNRLAVNRVVDVGRRYIEAEDRGVFVGGPVVVQAQQQGVAQRAGVEVGLEVVVHHELADVLVH

SEQ ID NO: 22500 - protein, 313 aa, Pseudomonas aeruginosa
CAGALQGTVVAGGSVIAGWGQRLERQVVAQVAQVLAELPDIVDPPLEGVAQPVVGAVVVFPVRIAEVLVMGNLAERRVVLGSAQRQELAGDAGIVAVELAEEGQPGVVVDVPGQARGDVVALVVDMVDLGVAVAHHAGDAVEKASLVVERAGAVEADLLVVVVADLGLHLVTGDVLRTQADHVEHAARRGLAVDRGGRAAQQGDTLQVPGFQLRVVVDADRHRQAVEELGRLEAAHLQPVGAGVAAEAAGDDAGHVAHRVVEVVHGAVGHLLAGRHRDRARGLEDRRIGLGAGHAALGPRSRWSAPVGLPRRR

SEQ ID NO: 22501 - protein, 137 aa, Pseudomonas aeruginosa
RSSALTGALRRGRCSTGADPGPGIGARAAPRLRDARRSPRGACRPGGYRETRYAPSATACQAGDRSRGGPRESGTALRPKAAPLPEPAPVRRDRPAQGRRGGSGRSSDRAPPSPGTRAVRAGRAAPGGRGGERRCPG

SEQ ID NO: 22502 - protein, 143 aa, Pseudomonas aeruginosa
TSPKGSSRCSAAVRCSTCSVLSSAGRTPSASWWWRCASTKSTATTVAPPTAACSRPWPTLASATPWRSPANRRSRWSPSACAWTSAGSRGSATGWRCIPGSTSSASAWPSPRPGCTAASAWWPAPAACFICPEARACLPGRLP

SEQ ID NO: 22503 - protein, 194 aa, Pseudomonas aeruginosa
VGESGLPKKSNAAERIVHATASLLASRGYFGTGLSDIIARAEAPKGSLYHYFPEGKPQIASAAIGFVADEVASFLDRAGTQAPHARNVLRQFTATLRGWLEHSRFEEACPVLSTSLSIDAELAPVHAECRRALRAWHASIERALRADGLAEKLAASRAWLILAALEGAVAVARVERSFQALDAIEEELQALLPA

SEQ ID NO: 22504 - protein, 490 aa, Pseudomonas aeruginosa
LGECRQQCQQGGDDRRRDERGDGPRVHPSRVVIGAGAAFGVQLRQVHPAFPHQVVVDHDDPVQRAEQRAEAAEEVEDHPGAVVQVPGQDQHRDGRADQPGAAEVQQVRRQVGEYVGRGDEVGHDVHRHGDDQQRQAGQHQEEGVGDRGDDVGGALDELAVDPELGAGEDHREQAEQQDVHRQPPEVADADGAAVRAAAGEVAEVQDHGAVQGHPERRAAEDLQPHLRTAHGFAAGPGDGGAGAQVHPGGEGGDGEQDHRSGEGFVATHHLHAVGEDQQLHAPDGDEGRPAQARQAEDGVLVVGCEPRPDRRQQHAQDDGGEIGLDAEPGDGDHCADQRGELRAVDAEGDAAHHRVGQPGLLAHVAGQVHQPVDHQRAQGQRGEDLRAAHAEGEEADGEGVVGDIVHVVGPQREQAVASPAAPFGLGRGEIGAVQARAQRRQFGAGVMAGAGQAIETGGSAQVQARRRELRCAQPGAWQAVETGRSAQVEQ

SEQ ID NO: 22505 - protein, 1011 aa, Pseudomonas aeruginosa
PRRGAARRLLGACAWLPEEMKKPPLGAAFRCAAANGLQPVLRLELTAAAMQDRLGIAVRLPGAFHHQLQGGLERDVVVEVRRHRPVGRVAGVLPVDHHGHALEALDHLLLADHAVTQPVGQQLAGDAQGGAVFHQTDVVDVRHLGAADALVDPADDIAEDALGVVVHLVLDLFRGPVGVRRQRNGQDVVHRGRGALGQLGLAGEHVDLVVMQGVQGRGGRRRDPGGVGAGQRMADLLLEHGGHQVGHGPHALADLRLALQAGGQADVDVVVLVGADPLLRLHGALAHHGAGFHGGVDLVAGAVEEAGVDEHHAILGRLDAGLQVHGGAALLVHDADLQGVARQAEDVLDAAEQLVGEGGFFRTVHLRLDDIHAAGAAVLAAGVAVQVMNGDQAGEQTVLDAFRHFVAVLVEDRIVGHQVADVAHEQQRAAVQGQFGTVGPGVDAVRVHGAGEGAAALADFLGQVAFHQAQPVAVDHYLVVGVDRGDRVLAVHDGGEGGFHQHVLHACGIGLADRAARVDLDFEVQAVVLEQYRLRLGGVALEGKELASILQAGFAAVLQRDDQRAVLHAVGSGVDMGAGLQRRGLVEEGASEGDDLVAANLVVALAFLGAAFFADHVGAVECVVQRAPAGVGGVEGEARIHHRHHQLRAGHAGDLVVDVLGAGLEVFRLGQQVADFLEEGLVGSGVVGLAGASLVPAVDLGLEFVALGEQGFILRRQVVDHGLRTGPERVGRDAGSGDGFVVHEVEQDFGDLQATDLNAFSHCLPHSALDQLWTRAARPCSPSRGILHDAAGKISGYASRYDWMTLHGHVGQAQCSQKNCTLFQINLKTVHDLSRAQLRRGVAGCFTALRAPCLYSRNRPRSLAMPVHAASLADLADLVPLFSAYLDFYEVPAPEEQVRAFLAERLRQGDSTLFLARDAEARALGFVQLYPLFASLALRPSWLLSDLYVRPEARRRGVGEALMNQARGFAESMGACGLQLETAKTNHAGQSLYERLGYVRDEQFYTYWLQL

SEQ ID NO: 22506 - protein, 324 aa, Pseudomonas aeruginosa
SPARQARRTPGQDRRLAPGSRRPGPRRRCLQGLPRGNRLPAARGGRLPGRHPERRRRDRPHGRPAAGGAGDECALRPQRLQRPLGLAVRRTLRHRRDQRRRRRRERQGLQQGSRRQGHRLRSRLPRRGRAAGVRLPCRRHFLQREERRAGRRAEERQRNRPEECWPVPCLPGRRRQAASGTAQAQRPALRNPDRPEQPGRPDRCRRREGRADGSRPHHHHGLRGLGRRGRRRRQGSDLPQLAGPDERRPGRGSQQGRQHLHPHHEPGPRLHQGRRFRTDPARPLAAVRAQRRPPDDQRCDPRQGRQRSAGRHPGRSVHQPDRHS

SEQ ID NO: 22507 - protein, 341 aa, Pseudomonas aeruginosa
PERQHQPQEQPHRQRVYRQAEDARSGRSRLHQRAVRPRRGRPRPAAQHPEGRHHGRGAPHHREPEGLHQGGQGSRGVHQHRLPRPHRRRDPHLHGSRRRGAQGRHEVGEVDRRLREQQRRRRPGHRPARQGADRQGHVGHARPDGRHARAEDRPSAGRRQHRLGPVADRRDPARPALPQGRRVRPPGRAGQAHPGLGGRHPDHSAGAEHQLDRGRDQERGGQQRPGHPRLCRPLDRPGRRLLQGAGHQRRRSDGRPRHPAHLQPTAGQLAASRRDQPGAGGREPQAHGRGGRPAERQRPVLPADGAELRRQRRVPGRPGAGGGRHPAAERLYRAGPASPPP

SEQ ID NO: 22508 - protein, 307 aa, Pseudomonas aeruginosa
HARLHPPRPPMLRRGGRRRRLPGRRTAPAPLPSGGVRRRCPAGAPARPGAAGTGRLPGRPDRRRSLLPPACPGPALRTGRVAWPRRAPGPGRGKRAARGTGRLLPAAPGPGAARRVFRQPAADPPAIAVRNRQRPAGAPAGRRGRPDPASRGQVRPTPGMARPVQGRAGPGHRAGPARRSSAATGAPGTTAPLRPVRDARQRPPFSADGLFHARRRATVQRAGPANEERGDPPGPRLGAPAGLPGRRGTGRRPPARSGRAASARTQRRGGGGAPARSRAGPGSGTPVGVPAGQRYSDTGERHGYRWR

SEQ ID NO: 22509 - protein, 531 aa, Pseudomonas aeruginosa
LGRRQASSVRNWRISPGAIRPTPHTPPASTSACRQLFRHLAQRLAIQAIAHPLVLRQRADGAVEVDGRLVPVQHAPLQASAVVGHGLAGQLAEQPATGADATVFRGDVEVFEVDAVAPQPGRVAVEIHRIADRPALAQAHQRAGRRAFGEQAAADAFDIGDHLVAGALVVGQFDDEGKDLFGVGRYGGTDFESHGQPSGGGSGHPSATAKMHEVHSSHRQLNNMHPLLRRLDLNLLLVFDALYRHRNVGTAASELAISASAFSHALGRLRQGLDDELFLRQGNRMQPTQRAEHLAAAVAAALRALGEGLEEWRPFVPGQSQRTFVFAATDYTAFALLPPLMNRLQHSAPGVRLRLVNAERKLSVEALASGRIDFALGYDEEHERLPEGIQAHDWFADRYVVVARRDHPRLAGAPTLEGYLAERHAVVTPWNEDSGVIDRLLARSGLRREVAVQLPTVLAALFLAGSTDFLLTAPRHAARALAEAAGLALYPAPFDIPPYVLRLYSHVQHVGRDAHAWMIGQLKGLDISRTG

SEQ ID NO: 22510 - protein, 764 aa, Pseudomonas aeruginosa
AYESVRNSYLIEATAFSQAVSGACRRKAGFRRARKIRSRIGWHITGLNLRNSCIQKQQTNPTSRRVLPTAGGDRHVQHPEAARLAPRVFSLAARPRHPGKPRQPAARRSAERRVLRLTARPGHSGQSRLPATRRAARSGVLGGAPGPGHSRQSRLPAPRQPSRRPRTAAAEPAPVQRRSRPDQGRRAPLGTLQPVRAVDQRRAQYRQLLLRHRPLRPRHERRADPRRAGPGRADGLRADEPVRLHGPEDRAALPGDVPHRLRHPRRATPRADPRSDRHRLVRHPDLSRLHRPARAADGDLAGARSLRPGRHPRPVEPGLGDLRRHLVRAIADLRLRHGDGASLRILRRTGDPAHRRRPRRLDVPARRRLHRLVQRRTHERFADVVEDLRRRGVLGDPVRHHDPELLRLRPRLPGPPHHQRRQLLGAAGEHPAVRPVRGGPRRRPVQDRRPAHPEPHRHRRRDPRHPLPGAGQPGAADRHRGGEHHGQLRRPGLRTHQPGAEPAELPPRRADQRDHRGADPALAPVQQPRGDPLLPRRPRRAARPAVRDHHGRLLPGAERPGEPAGAVHRKPRRRLSLRARGEPAGHRRVRPGGDHLHPAGIVAGIRRAIAVLLVLRRRPGRPDPLRPGQAPHGLPRSFRRSDRGGQRAALTDTWPAWARHPPRPAVAPAILPRSHPAPGTTARRGPPRPPPPAPRGSARRARRRAFPPVRRRATHARCWRARRGAPGGIRHAPGPARRRCSGWWKAPGRPLRNANAPASHAGSR

SEQ ID NO: 22511 - protein, 512 aa, Pseudomonas aeruginosa
NMPGRWIHQRREGLIEALNGASSGRRPGRRPHSLSAAHRTAHRPLAGVAGLAERRAGLAQRLALFGDRGLRGGLLETRQMLEGRQGESVSQQARQARPALAVDLVARQLGIAEQAGDGDIGDGQLAAQPAAWRDPPFQVVADRWQVFVVGALQDRLVGFALPDATVDHQLVEQLPDDHLAQPRIGVLLQPAGLGALADVDGIQARLRVALLQVLADHAGIVEDEVTVHQHRNLAQRTEALEGLVAEERHDGVDAVGNAFQFQQHQHLAHIGGQIGTDDQQRFGHGETPVLVMGTPILRQTSGTTQVASRRTPIAGIVALCDHLRIILVFPFNPVSGWGAVVSAGDVSNSEFVGSLYRDHRGWLLAWLNRNLGCRQRAEDLSQDTFVRLLGRPELPGLREPRAFLAKVARGLMIDHFRRAALEQAYLAELALVPEAEQPSAEEQYLILEDLREIDRLLGTLSLKARSAFLYSRLDGMPHAEIAERLGVSVPRVRQYLAQGLRQCYIALYGEPR

SEQ ID NO: 22512 - protein, 673 aa, Pseudomonas aeruginosa
  UNSURE (555): Identity of amino acid at the above locations are unknown.
GTTPGGSKWCHAEPNGPAKNFSRRPYHFFRFVRQGGIETRFHPGAPHMPRPTFRPGLLALAIALAVPAPFLHAAPAEQASVRDYRIAAGPLAGTLNRIAAQAGLVLTLDPALAEGRSAHAVQGRFDAPGALREALKGSGLELVENAGGTYSLRKVPEDTLSLQAMTVSGAEEDPLGPTSGYVGQAQHDRHQDRYADPRDPALDLGGDPPADDRPRRAQPRRRGALHARRRRQQLRQRHPLRLVEGARLQADPVPRRPADGGRRLQQPEAGNLEPGACRPVARPGLLGLRPDPAGRHARHGQPASAERRQSRGEGRGRQLQPQAGQLRQHRPARRRGTLSLPRLRRGARQQHPGRPYRRQALQHRPEPDLEHRRRHQADLPRPVQPRRYRHHQPVPAAARNQVRRAVRQGFPSQEPRRSGLGILRPHLLLAGLRLRAADQRCLAVPPEPALPAQRPVVPGADPSQLLRCRQRRRYPAAHQHISGRGRQPVRGGQQLPGRLRHRRAAPHPAAGPGPQPDHQRIHLDLRLQCTADQHQQPDLRPADSQAAAFRRVLRXQAADLPDRPLGRGPDRPRQLAPDPRRSRGLGAHRGHLLQQGRRHQYQPRQEVQRQRGAQLHLRQWRGALHLLCGVVPTHHWRRYEQHQFAEADRRQAMGNRCEVPAGGLRLAVHRRGL

SEQ ID NO: 22513 - protein, 509 aa, Pseudomonas aeruginosa
SHCGCSSRIRQKCARDCRSSSCRAESPKLRTWPSAPSTRIRLSPMLSSSISPPRIRSRLRQAAGMSSRSCQSRPLWARKSPWISLSRRRSRVSLDCSGSTSSSNRRCRSTAWASQRASLSTPSTLRPMLVAPSITQAACAVQPSASSFTAPPARHSAPSISTVAIRSSSYAQCAARIARQSLSTFRSSFRENRMRHLPYPLLGLFLALSSTGAALAGEQYYPLDKGSAPYAVAPSAQGAVWYGADGGHSLGRLDPTSGESVQVPLGEGARPRAIVSDESGNAWVLDSGLNAILRIGGERLGSERFPLPAKAAPAGLDSAVFDDDGRLWFTGSRGFHGRLDPARRLVEVWPSPQGKAANGICVTPDGEVWYAQDDALVHVDPLDGSAEQLPAPEGTKALRGIGADSIGRLWASDSGGARLYRYDPSDASWQSWPLPDSQARPDSLRVDAMDRVWLHDAASGALLRFDSAQATFRVLPSDRPAPGNALLGGRPGETWSAEPAADRLRVVRD

SEQ ID NO: 22514 - protein, 212 aa, Pseudomonas aeruginosa
SFQGARMSATHTLFYAAASPFVRKVLVLLHETGQRERVALEEVTPTPVAPIRQLNASNPAGKIPALRLPDGQVLHDSRVICDYFDQQHVGEPLIPREGSVRWRRLTIASLADAVLDAAVLSRYETFVRPEEKRWDTWLEAQREKIARSLAWLEGDCIAELQARFDIAAIGVACALGYLDLRQPEWDWRGRYPRLAAWFAEVSQRPSMQATRA

SEQ ID NO: 22515 - protein, 156 aa, Pseudomonas aeruginosa
SGIAGPWLNRRKAIPSPSTSASRRRMPPGGVKSRALSSRLASAWRSRNCSPRTSQGPSRRFSTRNRWRWIRAAWPSSRDAAISRRSTLPTSSRPCRCSTWARLSRRSISCCRRSLSPAMLPTKRARCSAGISPSSNSAAPRIAANGLFSSWVRVCT

SEQ ID NO: 22516 - protein, 157 aa, Pseudomonas aeruginosa
CRCWPRRSSSSSAARTVAPARAGSIRKRTRTSRMAWIATLKRWARELKTEVIALWLCSRHPHMPWLARLVALLVVAYALSPIDLIPDFIPLLGYLDDLLLVPLGIWLAIRLTPPTLLAECRARAREVETHPRNLWMAALIVLFWVALGAGLLRWFFY

SEQ ID NO: 22517 - protein, 371 aa, Pseudomonas aeruginosa
KYRNALFSFFGRTVLAKDTLPVAAAPAAIARGKPPQAARLAARIACRALPRDLHRFLLAAAFRGPPGQSRLPRLPGDDADPGAEPAADPPGTRPDRPGQDRQRQDRGLRPRPAQPAEPALLRLPGAGAVPDPRTGRPGRQGDPPAGPRRRQHQGPDPLRRRPLRPAGGFAGARRARGGRHPGAHPRAPAQGHPGPRRAQYPGPRRSRPDARHGLLRQHRRDHRPAPRAPADPAVLRHLPGRHREAGEDLHARSATGEGRVAARRQPDRATFLRDRSETAHGRRGTPAPAFPATVQRGLLPDPPAVPGAGRRTEGAADFRPGPARRPGAARARPGPDGVRQPQLQRTGGHRRGRPRAGHRRPGNGDQRRAGA

SEQ ID NO: 22518 - protein, 316 aa, Pseudomonas aeruginosa
TTDHRIALRPHAALFVDTHAPPPLGPRQVRLQPAGVHRPGRRPAAVLVAGPHRAADPAVPRDHRQRPGGDRRQLARPPASAAGDPAVLQRRRLRRRVAVPLSLAVRFRDGAVGVRHDPPRRPRRALCGNRLGDPDPLDLHHDRRGPARRRGRRCLARTAAAGGRGGLVRAALGAVERAVLQPAGAAESFPPVFRAGRIPEDQVEPVRTVAPARRGGPAPRPGTAERQGGGGAEPGQGDHSQPPRPWSAGPQGEPLPEALFHRPGRPRARQFLALPVQPAGRGVLPQRRAVPLPAPAQPAGQGLPGPGAGYPPAPAV

SEQ ID NO: 22519 - protein, 681 aa, Pseudomonas aeruginosa
LRRPRAGPGRPPGLARTPAPAEQPGLEGPAALARRPGRQPHHAGPQAGRGEQPGRHRRRTGQRPARPLAAQPEGRLRAPAPAAHPDLAAVPPRPAHGPGADRRLRRAALDPSDPGLLDTAHHGVRLPAQLWRDPPAPGAADPRYGGRPGGRLGADRPVPQPAGAVAVRGRRRGRLLRHPQQSLYPGDGGDHPAGAVLLQPGRRWLRADPAPPVRYLAGQPDRRPRGVPGAARLAGPPAQPHARQHPRLQQPLPAADHAAVRHRQARRPRLPHRPAQRAQRRRGALDHPVEHAPGTRPFQEGRRDRLPLPGPLAHPAQLSIRSRRAPRKPARGRQRRPPGARRRAALRQPRGNRREPGTETPGRHLQRRGGSAGQGTGADARGHGRQPSPGTDPTGTHLPPARPAAHPGRALAEEGTGRRAATARPALARAVAFQQALVAAVVAHAADGQVEAVDDLVMPGIPQAHQQVQAVLAKRDGQYLQLVAQIGQFALEGDPQRQLVLHRQVDPPRLEHPRGVGEAGHVDLLQTAVTVEFGRVGIVAHDRDAVGTQVAQAGKLDTPPLALQQADAVAQVGAGKLPVEAAGGLVPGAQGDVVVAAAHAVQGTRPGYLLETRVEAGALERGGHQFHRQAVARQARIDERRPGVADQAQVGGRQRAREEQCQQQECASQHEGASREWIATA

SEQ ID NO: 22520 - protein, 420 aa, Pseudomonas aeruginosa
TPGVVPHGRHPGRRGGCPAVSPPRLRGTRRIGPVPGRRVLPAPPDVPARSAQPVGLAVLPGLFHQPVAEGIEHRRFDPALGNDQVIRILAQIGMLHGHDKPSVGQLVLDQEGRYEGHAHAVHGRLGKHGEQLVARPAHVVGDVQSLGVKPLAPSVGPGALLHQRQPGDLLGAQRSTPAQQLRAAHRHRILAHQEMRDGTRPVGVAEVQRGVELGVGEEERAGAVGQVDRDLRVQPLEALEPRQQPLGAEGRHHRQFDRAAALVPHHRQGVALHRVEAYRHPPAIGQPGLGELDPAPRATEQLDTEELLERGDLPADRALGQGQLLRRLGEALVARGGFEADQRGGGRDLASHGGLRSAGFASMTPRSRFLAPLQGHEIRDSFSRSEKIAQVLANSSFAAPFARLLGCFHSGWPTPASATA

SEQ ID NO: 22521 - protein, 219 aa, Pseudomonas aeruginosa
RRADPRLRPREGLGRSERPGDPWQGRPACLDHRRDRDGQRVRSGRERLPRSARPARSVHLPELGALRDLLGRPGRRRILLAHRPPVRARPPAVRPPAGRQPTDPEEAGRHADRDHPGPARLPAPGADEGRRHRGGGNHLDHEAQQLRQGPRHRPPGPRHAGRQRHLRRIRHRPPPGQPGSGEHLRGHPRCPRADPRPRADRHPGILLSHRATPRRAFSR

SEQ ID NO: 22522 - protein, 434 aa, Pseudomonas aeruginosa
RAGRRGDGQGTRLPGHFRFQPPAARTVMPGALSHIRVLDLSRVLAGPWAGQILADLGAEVIKIERPGSGDDTRAWGPPFLKDAEGNDTSEAAYYLSANRNKKSVTVDFTQPEGQRIVRELAAKADILLENFKVGGLKAYGLDYESLKQVNPKLIYCSITGFGQSGPYAKRAGYDFMIQGLGGLMSLTGRADNEEGAGPVKVGVALTDILTGLYSSTAVLAALAHRDVSGIGQHIDMALLDVQVACLANQTLNYLTTGVPPRRLGNAHPNIVPYQDFPTADGDMILTVGNDSQFRKFAELADHPEWADDPRFATNKARVANREVLIPLIRQATVLHTTAEWILSLERAGVPCGPINDLAQVFADPQVQARGLRVELPHPLAGTVPQVASPIRLSETPVEYRNPPPTLGQHTDEVLETLLGLDAAALERLRDGKVI

SEQ ID NO: 22523 - protein, 254 aa, Pseudomonas aeruginosa
PQRGYPPASRASADNAPGVIRPTVPRAAPRRAMKWTPPSYGVKRQTNGAATSPGGGVSMNLSRIGLDLAKQVFQVHGVDRHEHVVCRRQLKRAQVRDFFRQLPPCLVAMEACGSAHYWARELRELGHTVRLIAPQFVKPYVKGDKHDAHDAEAICEAASRPNMRYVPVKSAEQQAVQSVHRVRSRLVRARTALCNEVRGLLGEFGVIATRRGRAGKKALVENVPGNETGAPWRARMGVAVALNGKMNWHTPEGA

SEQ ID NO: 22524 - protein, 731 aa, Pseudomonas aeruginosa
SRVRQTMTERVQVGGLQVAKVLFDFVNNEAIPGTGVSADTFWTGAEAVINDLAPKNKALLAKRDELQAKIDGWHQARAGQAHDAAAYKAFLEEIGYLLPEAEDFQAGTQNVDDEIARMAGPQLVVPVMNARFALNASNARWGSLYDALYGTDVISEEGGAEKGKGYNKVRGDKVIAFARAFLDEAAPLESGSHVDATSYSVKNGALVVALKNGSETGLKNAGQFLAFQGDAAKPQAVLLKHNGLHFEIQIDPSSPVGQTDAAGVKDVLMEAALTTIMDCEDSVAAVDADDKVVIYRNWLGLMKGDLAEEVSKGGSTFTRTMNPDRVYTRADGSELTLHGRSLLFVRNVGHLMTNDAILDKDGNEVPEGIQDGLFTSLIAIHDLNGNTSRKNSRTGSVYIVKPKMHGPEEAAFTNELFGRVEDVLGLPRNTLKVGIMDEERRTTVNLKACIKAAKDRVVFINTGFLDRTGDEIHTSMEAGAVVRKGAMKSEKWIGAYENNNVDVGLATGLQGKAQIGKGMWAMPDLMAAMLEQKIGHPLAGANTAWVPSPTAATLHALHYHKVDVFARQAELAKRTPASVDDILTIPLAPNTNWTAEEIKNEVDNNAQGILGYVVRWIDQGVGCSKVPDINDVGLMEDRATLRISSQLLANWLRHGVISQEQVVESLKRMAVVVDRQNASDPSYRPMAPNFDDNVAFQAALELVVEGTRQPNGYTEPVLHRRRREFKAKNGL

SEQ ID NO: 22525 - protein, 196 aa, Pseudomonas aeruginosa
RNQSAPRKLSTAPSNACGNSTFDRCTAGSVTSLAPAIDAAISSPWLAAVTVSYAPAITRVGRSIRASCARRSVSRTAAKEPARPCRLVAMSIARKRSTTGSARSSSAGGNQLPRKPAAVSLMSSACSTAAMRSSHCAAGPSQAEVLASTSRSIRCGACSASHWPTIPPRDRPRKCARRTSSASSSSSTSSPSRARV

SEQ ID NO: 22526 - protein, 366 aa, Pseudomonas aeruginosa
ARLAPSLVARKDRLPMGASGVRVIAMHARLVATVPGKNYKEWNDSVREADMHDFTLHDLQCFDAVVDAGGFQAAAQRLHRSHPAVFAAVARLERQLGLVLLERGGYRVGLTAAGRSFHQRAQALLYELEGLRGHAAHLAQGEESELRVVLGDFCPPRPALALLAGFFGSQPQTRLQLLFETVSGPLERLLDGEADLILHRVDKSDPRLEWLDLCRVGLVPVIAPGLLGDPPPRPVRPEQLRPFAQCVMRDSARHSPPTDYFMLAGARQCSVPDQRTKKEVILQGLGWGHLPDFLVDEELADGRLLALAGPHLPGRSEEVVAARRRDRAQGPVAERLWAFLRDNATAIRESGMDTGGDDSAGARRPR

SEQ ID NO: 22527 - protein, 602 aa, Pseudomonas aeruginosa
IFEILVYKNNRRTRPRAEFFRLPEETAMSSTPKPPASPREFSPSLLDLGTLESLDSLPRAGQRSAEFSASLLDLGTPASLDCLPRAGLRAAEFSAARLDLGTPASLDCLPRASHHAGPELPPLSPRLYSADLAPTKAEGRRWGRYSLFALWTNDVHNIANYSFAIGLFALGMSGAQILAALALGALMVYGLMNLSGYMGQKTGLPYPVMCRIAFGIHGAQLPALIRAVIAIAWFGIQTYLASIVLRVLLTAIWPGLAAYDQDAILGLSSLGWATFVAIWCVQLLIFAYGMEMVRRYESFAGPVILLTVAALAAWMYLRAGASIAWSSGEPMSGSQMWLKIFGGAAFWVTLYGTMILNFCDFARGCPDRRTISVGNFWGLPVNILLFGLFAVVLAGAQFRIDGQLIQSPTDIVAAIPDTLFLVLASLALLIVTVAVNIMANFVAPAYVLTNLAPNLLNFRRAGLISATIAVLILPWHLYNSPGVILYFLGGLGALLGPLYGIIMVDYYLVRKGRVNLPELYTESRAGAYHYARGVNPRAIAAFVPAAIISTLLALLPAFAELSPFSWFFGAGLAGLIHYALAKRRTAYREVSGEAIAVDSVQH

SEQ ID NO: 22528 - protein, 366 aa, Pseudomonas aeruginosa
SSFAGTRAGARRSHRLAIAARLRRSPSRRSPRLPPLVRGASRTRTRLGTARRPRPAPGESRQRAGAQRPAVRQRTLQAPPAPARRQRPGASAGARRRARRGQPLRPGPLPAGRCLQRHRRAARADPPGCHSCAPEQPQRHRRPLRRRTPPGRATGRRDPGGNRPWRPAPLRGQQRRWRHARPRHALPGAPRGTRHAPHRVAVGGGRARGNAQRRACDQGRPAGADPAARPAGQRSGPGPGRRLGTRHAGGRERPAGRPGGGTGALFAGAAAGRPEHRRPARHRQFPAEGHPPRPSGFGAEPAGAQRKAQRLVVRSGATLNRTGRRKIFPAGPITFSDSSGKEALRLVSIQEPRTCPARRSVPACSP

SEQ ID NO: 22529 - protein, 399 aa, Pseudomonas aeruginosa
  UNSURE (389): Identity of amino acid at the above locations are unknown.
RSAAPRKTHWGRPAATWAKRSMTGTKTDTPILETPRSISVATRQQMTDRAVHNLDDAVRYMPGVVASSFGSDTRSDWLKVRGFKPTQFLDGLPMAVGVYNNPKLETWNLERVALLRGPASSVYGQTPPGGMLDMVSLRPQNVASHEVKAEVGNYNHKQVSFDSTGPLDDEGRFLYRVSGVVRDSNTQVDHIDDKRYNIAPSLTWNIDDDTRLTFLGQFNRDDTGITSQFLPLRGTKYDAPFGKVSHHKNLGDPDWEYYDRTYYWLGYAFERRINDVWQFRQNLRYLRNDLSFQALTPASYYAAASDDGTLQRTSTSVDEDVSQFVVDNNFQADFDTGALRHTLLLGLDHNRTTNEYTSIFGFNVPPTNINNPIYGQPIPKPPRSDAYYXYKQQTYQTGL

SEQ ID NO: 22530 - protein, 284 aa, Pseudomonas aeruginosa
VEDQIALDNWRLTLGGREDWVHTGATFYNKGDATNTSRDKKFSGNAALSYIFDNGVAPYISYAESFQPTTGADMNSTSSLKPTEGKQWEIGVKYQPVGSDSLFTAAVYDLRQENVSVSQNIGGTPVTSQTGEVKVSGIELEATSNVTDNLKMIGAYSYTDTEVKKGQYAGNRLQQAPRNQASLWADYTWYEGTLNGFSVGAGARYVGSTYGDQANTYDGYAGSYTLYDAAVRYDLGQLNGSLKGVSVAVNANNLFNKDYLASCDGYYCYYGDQRSVVGSVSYKW

SEQ ID NO: 22531 - protein, 339 aa, Pseudomonas aeruginosa
QDRAFPRSARRSGRTVCVTCPTRCWACSWPCRRPAPPWPANSTTRWTRAPRPTRSRPVHRVRSGTARTAGIRWGVSTRPAARACRCRSAKARGREPSSATRAATPGCSTAASTPSFASAASAWAANVSRYRPRPRRPGSTPRYSTTTGASGSPAAAASTVASTQPGAWWRSGPRPRARRRTASASPRTARSGTRRTTRWCMSIRSTAAPSSCPRLKARRPCAGSAPTPSAGSGPATAVAPGCTATIPAMPRGRAGRCRTARPARTACGSTPWTVSGCTTPPAGRSCVSTVRRRHSASCPATGRRPATPCSAVAPEKPGAPSLPPIVCASSATDPSKEPA

SEQ ID NO: 22532 - protein, 334 aa, Pseudomonas aeruginosa
PSPRWRTPSSTPRCCPATKPSSAPRRSAGTPGSKHSGKRSRGPWRGWRATASPNCRRASTSPPSASPAPWAISTCASRSGTGAAATRDSPPGSPKSASARRCRPPAPDPEGPPTPAAAAGARRVAARPPRGRGTAGRSAPPGARRRDGRRAGRHTRSFPAHQAEQQQAQQQRALSEPHAKLQEGAHVRIAGGALDAAEAFPESVRHQHQHGVGQGLAAGDPVLDQAELAEEQQKDQDHAADQQAEGGTEGELEEQAHAFPPWKSAAAGAAAFVVRPWRVPPGSPCGRPRTSPGGGSAPSPRQAPRTAAASPSARRSPPRSASRRAGRTALPGRR

SEQ ID NO: 22533 - protein, 163 aa, Pseudomonas aeruginosa
SRGRCRAGWPAPGAAGTARREPRRDLPGGSPPAIAGAGYAPPGLPAGTRRSPAGRPCRPPPGLAAAPPGPGSAGARSVVAGARSRRRCCRRSAPAARPASRRRATRRRHGSPPMGSSVRGSGYARSARRSPCLPVACACVPPRPPVAPSRRRDSAAARRGAPR

SEQ ID NO: 22534 - protein, 206 aa, Pseudomonas aeruginosa
DRRTGSRPGRSERRAASGVVRAVAVAQAAMGLDRFAAFVHLAQLGAQALDVAVDVALVAGLAGDAEGVEQLLAAEYPLGLPEQRLQQAELVAGEVERGVAVVDPHALLVDLERPARRGLFQRRRARRHALEDGLDPSRHLARAERLDHVVVGADLQADHTVDLGIARGEEDHRHLGEPAQALAGLETADVRQTDVEDQQIRRLALL

SEQ ID NO: 22535 - protein, 399 aa, Pseudomonas aeruginosa
WAASTHTQDRETNHAGTVDRPDQQPSAASQHADPDRPDDADRTAQAGAPRPAPERPLLQGRDVDRRDLGGDRQVDLRHLHADGLGRARRRRPAPGHLVPGGEQPPVLGRHPRVDPGVQPAHPVLQVLPQEGADLGALPRPGLVGAGVSVHEALFQGLPGEAPGTQGQGPGDHQGRLREVQAHPGDRGELPGRHAFQRAEEGPATVALSPPAQAQGRRGGLRPRRAGRATGRPARRHRGLPERQGAGILGPALRTGAEGDRRHPDPPDRSRPVAGRLRERPGVPPVRAGMGLAHVGRKGRTHRPLAATALKYRPKHTHLVGRITATRLSAVSTAQRRITPGALFALPVRATNTRGSHPPRRANNRNAVIRRFHGAAADNAGGVIRPTGAGNEYPGAAPTS

SEQ ID NO: 22536 - protein, 525 aa, Pseudomonas aeruginosa
VAGGDDDGIGEVHHAPLAVGQAAVVEHLQEDVVDVGVGLLDLVEQDHAVRPPAHPLGELAALVVADVARRRTDQPGHRVALHVFAHVDADHRVFVAEHHLGQGLGQLGLAHPGRAEEQEGGDRPAALAQPGAGQAHGVADRGDRFLLADHPLVQALFHLQELLALLGGQFGDRDAGEPGDDLGDVLDPHLLGLRPLGLLPALGDLLEVFLAFLDAFLEDLRLVVPLAAGGVVLLALELRQLGLQFLDLGRPRGAGDAHAGGGLVDQVDGLVRQEAVADVAIGQLGGGDEGLVADGHLVVAFELVAQATEDGDGLLHRRLGDEHRLEAPLQRGVLLDVLLVLVEGGGADQVHLAARHRRLQHVGHVQPAFAAALAGTDDGVHLVDEQDDLALRRLQFVHHLLEAFLELTAVLGAGDHGVDVQFDQALVAQHLRHLALDHALGQAFDDGGLADAGLADQHRVVLLAPGENLDGGLDFLRAADHRIELAFAGQPGQVAAELVQLRSVARAVHAAVLGALADHLDRFLP

SEQ ID NO: 22537 - protein, 534 aa, Pseudomonas aeruginosa
KATSLAATSAAMPAVRPDPVAGRPIAARTSLCLGPVRPREPVHERAVPAHPPHRPPTALAGCRRLLHASPRRHHPQHRAAEHGQFAERKPAAHAGGGDRLPAHGGPADTGLGVDRRPFRHAPGVPRRGTAVQPRLVALRAVAEPRTAGRGAHRTGRRRRADDAGGTAGDPARLPAPGPGAGAQLRHHSRPARPAGGTDAGRLAGGVRLLALDLPDQPAGRPARLPGGDEADAGPAQPGAEPFRQHRLPALRRLHGADLHRPGRTRRAAPVAPARGPAADRRTGPAHRLLAARATHRQAAVPTEPVQGADLRRRHPRQPVRPPGQRRPALPHPAVAAGGTGLPALHRGHDHDPAGAVRDGRQADGQATAGLLRLSQAAGRQHPDPRLPDRRLRPGRPGHPLRLAAAAPEPARRGELPAIHGDEHPHPDRPAGQQRQQRQQPDVGGRAVVDQPRRGLRGGVAGRFPDRPGYGAGHRTRRLPRHLCQRRPDVDAGRGDLLPARQRGRSHQPAPGRSGKGPGPLGWPGSLRSSAGLAS

SEQ ID NO: 22538 - protein, 468 aa, Pseudomonas aeruginosa
PLVSPAEPCPVTSTAFSSLPLSADLLANLDSLGYREMTPIQAQSLPLILQGHDLIAQAKTGSGKTAAFGLALLSPLNPRYFGCQALVLCPTRELADQVAKEIRRLARAADNIKVLTLCGGVPYGPQVASLEHGAHVVVGTPGRIQEHLRKGTLVLDGLNTLVLDEADRMLDMGFYDSIAEIIGQLPERRQTLLFSATYPDGIEKLAKTFMRDPRQVRVESLHADSQIEQRFFEIDPKQRMDAVVRLLQHFRPQSSVAFCQTRQQCQELADALKAQRISALALHGDLEQRERDQVLTVFANRSCNVLVATDVAARGLDIAALETVINVELARDPEVHIHRIGRSGRAGEKGLALSLVAPAEASRAQAIEDLQKQPLAWYALGQLKASPEPLLPPMSTLCIAGGRKDKVRPGDLLGALTGDAGLPGSAVGKIAIFDFQAFVAIERGLAHQALKRLSEGKIKGRSFKVRLL

SEQ ID NO: 22539 - protein, 737 aa, Pseudomonas aeruginosa
HSAPMPPSSLTHTLRRLWALDKFAYSLRVFIALAGALLLCWWQDRIELLIPLFLGIIASALAETDDNWLGRLQALLVTLLCFSVAAFAVELLFPYPWLFVSGMALSAFGMILLGALGERYAAIASATLILSIYTMIGVDQRGGEVADVWHEPLLLVAGAAWYGLLSVLWNALFSNQPVQQSLSRLYFELGEYLRIKSSLFEPLRQLDVEGQRLALARQNGKVVVALNQAKETILNRLGHGRPGPKVSRYLKLYFIAQDVHERASSSHYPYNRLAEAFFHSDVLFRCQRLLNQQGKACQALARAIRLRQPFDYADRELALEDLQASLEHLRQQSNPAWKGLLRSLGALAANLTTLDRKLAGASNPDAIADEQDSALLDRSPRSLKDAFERLRQQLTPTSLLFRHGLRMALALTAGYGVLHWIHPTQGYWILLTTVFVCQPNYGATRLRLVQRILGTVVGLVVGWALIDLFPSPLVQSLFAVAAGVAFFATRSSRYTLATAAITLLVLFCFNQVGDGYGLILPRLFDTLLGSLIAGLAVFLVLPDWQGRRLNRMLANTLACNSRYLRQIMQQYATGKRDDLDYRTARRNAHNADAALSTTLSNMLLEPGHFRKDAEIGFRFLVLSHTLLSYLSGLGAHRESLPEDASDGLLERAAERLSASLEEIAASLEQKRPVAIYSEEEEALAKELEQMPEDMDDSHRLVQTQLAHICRQLAPLRTLAAHLLKKELAGAQPLPGQP

SEQ ID NO: 22540 - protein, 299 aa, Pseudomonas aeruginosa
APPATARASPVPGRSTVAPAVARVSARSPTRRLRPSNLAQQVGHVAGLQVDHLLRRRLVRRQADRLAHRALGPFDVAPAQLREATDIGGGVVDLLAHHGFGVPRRGLLCGLVRRPQAHRGGGAEVGARRHRRDMAGIQDVGAGARRPRPAGRDETGDRHLAGEDRLDDAPHRCVQAAGRVQFQHHQLRAVLGGTLDAAHQVIGAGRADRTIHREHPYRSGGRETGRAGEAQQQRQREPARHPHIDLPDRPAGPPRDEGARPAHRAGKRPAPPRTSQSSPVALAFPARVRIGKSLNMPTF

SEQ ID NO: 22541 - protein, 78 aa, Pseudomonas aeruginosa
DSPASVSLTPRRERRNSSTPRNSSSVAICRQIALWVRDNSSAALVKLSWRAADSKLTSAAVEGILRRMEDSGVPVSHL

SEQ ID NO: 22542 - protein, 413 aa, Pseudomonas aeruginosa
DASIPAGPRQPPLPLDEDVRMATKASFNWEDPLLLDQQLTEEERMVRDSAQQFAQDKLAPRVLEAFRHEQTDPKIFREMGETGLLGATIPEAYGGSGLNYVCYGLIAREVERVDSGYRSMMSVQSSLVMVPIHEFGNEATRQKYLPKLASGEYIGCFGLTEPNHGSDPGSMVTRAKKVDGGYRLSGSKMWITNSPIADVFVVWAKDDEGQIRGFVLEKGWEGLSAPAIHGKVGLRASITGEIVMDNVFVPEENAFPEVRGLRGPFTCLNSARYGISWGALGAAEFCWHTARQYVLDRQQFGRPLAANQLIQKKLADMQTEITLALQGCLRLGRMKDEGTAAVEITSIMKRNSCGKALDIARLARDMLGGNGISDEFGIARHLVNLEVVNTYEGTHDVHALILGRAQTGIQAFF

SEQ ID NO: 22543 - protein, 169 aa, Pseudomonas aeruginosa
ASPGSARRRARRAPAAPAETSCRGNPRRSRSCPRPAAPRRCARPTAPPGRARPRCWPAPAARSAAAHAAPATGRRSRPGTGRGNARAVPPARRAAPVRPRPAGPGCRAPAARWRRHGRGRRSAGRGSAGSVPGVAHPTCAGWCRWSWRAPAAVSLPHHPGDRRGWRRRW

SEQ ID NO: 22544 - protein, 169 aa, Pseudomonas aeruginosa
HASPAAPPRSQPPACLRRPVSPPQRRHRSQRTGDQRLGLQPCAGAPAPGAGRRAVPAPGQPHAADPACRAPGRCGGRRPARPRRGAGRVAAVRTGTEPAHLRLRRHRLHRLRPASAADEPPAAQRARSAPAPGQCGTQAVGGGPGQRADRFRPRLRRGTRAPARRHPGP

SEQ ID NO: 22545 - protein, 119 aa, Pseudomonas aeruginosa
LVRRPLRGGSAARPPTPRRGADAGGLPGRTACGGDAVERGQRGDRPAAGPLRPASRSGGATADGAGGAVPGRLHRFPAHRSATCRTGPGGSRRPRPVSRAVRHSALRAAALQPRPACRA

SEQ ID NO: 22546 - protein, 143 aa, Pseudomonas aeruginosa
AGSSACNSSSIASSAWNDRSTRATATAPSSAARISQAREAASFSASPSARNARSMLACQARSARRHSACTGASSASMLRLVESTGQASSKRECSSQPRRVAVNWRRTLRAWGAWVPARSRKDATSSATKPIAALAICGLPSGK

SEQ ID NO: 22547 - protein, 364 aa, Pseudomonas aeruginosa
PPGRHAPRGDRRASRSLGAARAPIPGPGSAPVLHRPLRRAPVSADDRHSPVRARVLDEAIAWQLLLDSGEAHPDDHRAFHRWYAAHPEHERAWEQLGGLDRHLARAANGPARNALLSGNARFKRRLRRLGGSALGLVLALGVGLGVANRYVPVRYLLADAYSATGEQRELTLPDATHVRLNSRSAIDVRFDGERRQVVLLAGEILVETAHGDPRPFVVSSADGDMRALGTRFLVRREEPGTRLTVLQSAVAARAETLSEERVIKEGQQVLILPQGLQASEAAPALAGAWAQGMLVVENARLADLVAELGRYSPALLRVDPSIADLRVTGSFPLKDTRLALQALEPSLPVRSVRHNAWWFEVVPR

SEQ ID NO: 22548 - protein, 149 aa, Pseudomonas aeruginosa
DSFPSRSPAHAPPDVPSRPARPSHRPRRSRTVPPRRPGRTGQRARLPHRRRAAGRHPEPHRGPGRPGPHPGPGARRRTQRPRRARSLRRARRIARSAQGQRPGTGGKCRRHLQPAQGAGRHPVAAGDDGQRRRGRPTGADQRLRGPSAA

SEQ ID NO: 22549 - protein, 369 aa, Pseudomonas aeruginosa
GRIAEAAYLAVGAFDEDPAVADVEQFDFSAANPQQAQAGRRHVFEVVPVAAALGAEVALDIVEQAPQQGLAGLLGLDFQQQPQVPVHRLGQPARVAFHAQHAATDAGGTVDHPGGLRRAAQRIVVHRAPRAAFRPEYFHCGHSQFLLCSMRCQNSKTEPFHVPLVVPGEPYASPALPAAGPVPGPVVDRRRPGRRTVLPAGQGLRALRGRAQCTGCGLVRRGRRAFAGASRPDQRRERAGAARRRRAAASHRQRRERQRLGARQRPQRHPSHRRRAPGQRTFPATGQGRAGRARLRGIRRRRAPLVHRQPRLPRSPRPSQAPGGGLALAPGQGGERHLRHPGRRGLVRAGRRAGACRSARRQRRAVARA

SEQ ID NO: 22550 - protein, 931 aa, Pseudomonas aeruginosa
RHEGLARDRRRLHRQALGQRQRWRPAVPLRSQRCLVAELAAAGQPGPPGQPAGRRHGPCLAARRRQRGALAFRQCAGDIPRPAQRPAGARQRPARRSPRRNLERRACRRSSARRPRLILPRSPHERYPYAVLRRRLALRAQGPGPAPRNRPTRARGARGSHADAGRAHPAAQRQQPGRQDSRPAPAGRPGAARQPGDLRLLRPAARRRTADPPRRQRPLATPDHRLAGGRRPRRRGAVPLRNLRPPRGEALGHLARSTAGKDRAVPGVAGGRLHRRTAGALRHRRHRRRLRPGLSRPAPAGVGLARPLPATRRLVRRSQPAPVDAGHPRLTPRARRRLLPPQALGALQPGRRGAGEQQADPRRQALAVATVVAQADIPVHFQHTRRNSSRPSNSALCPSPMQSSRKERTCGLPAAPSMPLRPSQNPSGISTSMAWARGLPLAIQYSIRPNLPKNSRKIRITPLTSRPRAAQRVNSKNRRMLFLLGNRRRPAPPPSSSGPGGYRREVLAADPVPVQAAGQHHHRGKHREQQQRAHQQGVVLRAQQAVEQAVQPCQAGAEAQPSGHAAQDEAQVEADQADAGSGGDQVGQLEADVLGQRQQQQVEERQRQADQRVLDRVYRQALEHLEEEETGEGQGDEQQRVLDRAVGLQVLVHRIDQADAEGARLEAVATLLLHATAQRLFHVGGEEAGLPARGEALGGDLPLAGQELAAEARVRPVGLQDDLAVAAHRHDVQPLAAEQRQVEGVLQALRLAPVDALQRCVHTAAEQADPATRLEVDAGTVEGQAQGILDAADVADAHRQERRFELVVLQVFFDAIVRRHLEVAGNLVVDVVQARLVDATVAQLGAHLPVEGKAVGQEVQLAALLALLQHALLGLLLGDPLAHRPAVRHHQQRAGEALAVAGAAGDILQHAVTNLLAIADQAVDHQQGNQQ

SEQ ID NO: 22551 - protein, 528 aa, Pseudomonas aeruginosa
GDGTELVGQRAVHGGTLRRGDGGKSAAPRWRASGRRVESRWSFRGGASAARQPEQRLDAVVAVADLQPAAMQLRHLGDEVQSQPGALAPAGRARQRVEAFGEARQGVVGNRRPLVEQAQGDTLAVDLGEQAKDAAGRGEVEGVVEQVGQRLAQQELLAANLAGTFQAVLHPQSLALDTRRLAFQQGRGDLPQVDLADLLQALPLLHLGQAQQALDQLLQALALAGDVADEARPLLGRHLAVEQLGGATDRRQWALQFVGQGMHVALDVVLAFQLRAHAFHRVRQLRHLAAAIARQLGAAPLADRLCVLGEAPQRAAEPPGEQAADQQPEGDQPGTEPGQAPLRAVDVGLQAAVRLGHRNHPDDLPTILDRRRHVHHRGIRVVRVFAAGARAVLAPESQVDVVPARIVLADSHPGGVQQHLAAGVGDVDAVVHSLLAQAPDIRLRHALAVVLEHLRQVALCQGAVLHVLAEDLGEQVGGVHQGFLGGLAHAGPHFVHHRAQHEVAGETDEQEVDQEDPNAERHQAWSGL

SEQ ID NO: 22552 - protein, 364 aa, Pseudomonas aeruginosa
RLGSAARTGRANSESKARARFTRASPEVIRGPHRTSTARFRSPRRRLGRRGADAYDGPRRPTPRTGKPTMRELLTGLTSSLLLLLNTLILIGPMMLIALLKLVLPGQRLKDLCSRGVMWIAETWAEIDKWIFATCTPTVWDVRGAGDLRQDTSYLVVSNHQSWVDIPALIQVFNRRTPYFKFFLKKELIWVPFLGLAWWALEYPFMKRYSKAFLEKHPELKGKDLEITKAACEKFKRIPVTVVNYLEGTRFSEQKKARQQSPYRHLLKPKAGGVAFVLAALGEQLDALLDVTVVYPSDKVPGFWDLLCGRVPKVIVDIQTRPIDPALWQGDYENDPVFRQYVQEWVSRMWEEKDERIARLRQLR

SEQ ID NO: 22553 - protein, 163 aa, Pseudomonas aeruginosa
PGGAPISRDTAWRSMYSLMSMRIIASSSPNTTSARALASSVLPTPVGPRNRKVAIGRLPWRSPARARRTASLTAVIASCWPITRWCRRSSICRSFSRSSAVSSVTGMPVSLEMISAMSSTRTSSVFDPWVCCQRSVICSRCSLRSWMRFSKTFASSYHLRLAA

SEQ ID NO: 22554 - protein, 278 aa, Pseudomonas aeruginosa
RSDSSAAATKASSRMVTLWWPSSLSRRPRRMEMVCSTVGSGTNTGWKRRSSAASFSMYFWYSLRVVAPIRFISPRAIAGFSTLATSSPPSPPPWPAPTMVCTSSMNRMISLCAACSSSITCLRRSSNSPRYLAPATMALMFSSTRRLSRSTSGTSPWTMRWARPSTMAVLPTPGSPISTGLFFLRRARTSMVVSTSFERPITGSSLPSRASRVRSRLNLSSCGVLLGPSTRPSSAPLPTTLTAFCRSACSVRPYFFRSVPAKLSGTAARPSNRCSGPT

SEQ ID NO: 22555 - protein, 540 aa, Pseudomonas aeruginosa
LLSTSTAAGERQRFGLTQDNERRPLWPRLPPQCPLFAPIRSPAVPSRRELLYAWALSARGSPSMSEPFQLTPRIARQLPWLVAVAFFMQALDGTILNTALPSMASSLNENPLRMQAVVIAYLLTVALLIPASGWIADRFGTRRVFLGAVLLFSLGSLLCALSPSLELLVGARIVQGVGGALMMPVGRLVILRVYPRQDLVRVLSFVTIPGLLGPLAGPTLGGWLVEYASWHWIFLINLPVGLLGCLVAMKLMPDLRSPVPSRFDSIGFLLFGGSMVLISIALEGLGELHLSHLRVVLLLIGGLVLLTAYWLRALRIDKPLFPPSLFKARTFAVGILGNLFARLGSGALPFLTPLLLQVGLGYPPSTAGMTMIPLALFAMVAKPMAKPLLDFFGYRKLLVGNTLILGCLIAGFGLVDQDTPYVWLLLHLSLLGAVNSLQFTAMNTLTLIDLQDSNASSGNSLMSVVVQLSISLGVACAAALLGGFQTDLDTGQDTVLGAFHATYVSVGLMSMLAAAIFFQLGSEDGRTSPRRVDPEKDPDL

SEQ ID NO: 22556 - protein, 132 aa, Pseudomonas aeruginosa
SSISSPRTSTSAPVPRTTRTTGWPRRSSTATCCSAASACSTSRARPARPWRGLSACASRLITPTASWPWKTSRPRSNTCASRATRPGRACCARSAPWPPTSPRWTASWPGRATRTPSPTNRTAPCSTARRAA

SEQ ID NO: 22557 - protein, 191 aa, Pseudomonas aeruginosa
SPASRCSWCCPTGRAAGSTACSPTPSPATAVTCGRSCSSTPPASATTSTTAPPGATRTTPTRRSRPPCRTCSWNPAISGRTPRSASASWSSRTPCSAIYPVSARTAKACPRTPATASWSAPPSGSPPASRKSPRAWNRNARSPSTAKRRKRWPRNWSRCPRTWTTAIAWYRPNWHTSAASSPRCAPWPRTC

SEQ ID NO: 22558 - protein, 215 aa, Pseudomonas aeruginosa
RSVPGVDRHSIAIPTPGTHVPVSRLDDISITNRTRSPLLFLSGGLFVPRRGTCVLAAEEFDRHREDDGRTLVAGDRAEGLHVAQLHGATLPAEHLRRLHEFLRGLQLALGMDHLGPALTLRLGLPGDGANHRFVEIDVLDFHIRHLDAPGVGLRIEHLLDIQVQALALGEHLVQLVLAQHRAQGGLGQLAGGGQVVLHLDDRLPADRARGSTPPR

SEQ ID NO: 22559 - protein, 240 aa, Pseudomonas aeruginosa
TAAARGTPATSPNHRKYPSSTSFIGQRDFQEQALARQHPDRLAHRQRPRGEHPPALALELHPACAGLFGIHRRHRRQAADQSGGATYHRLPASTQGHAQQTDDQRGAEQRQGHHQAGRNAVAGHLGIDQDQRADHERDDSTDAEHAEAGDERLAHHERQAQRDQRQPGVVDRQHLQGVQAEQQADAAEHAGQRHAGIGQFEDQPVDADHHQDQRHAGIGEHRQQPRAPVRCLAARPWRRR

SEQ ID NO: 22560 - protein, 597 aa, Pseudomonas aeruginosa
SSRPQRAGRLAPDPIRLPAASRGPCPFFARRSRYAKDITCHNRLPIMCRSSPARTRTMTSDVLPADAVASAAGNAHKPHLEQRPGRLTAFVFFAVLATGLLFSAYGLMQDVDDVGSAITTWTPFLLLGVALLIALGFEFVNGFHDTANAVATVIYTHSLPPHFAVVWSGCFNFLGVLLSSGAVAFGIIALLPVELILQVGSSAGFAMVFALLIAAIPWNLGTWWLGLPASSSHTLIGSIIGVGVANALMHGRDGTSGVDWGQATKVGYSLLLSPLIGFACAALLLLALRLLVKNRALYKAPKGKAPPPWWIRGLLILTCTGVSFAHGSNDGQKGMGLIMLILVGTLPMAYALNRTMPADQAVQFAAVAEVTQQALVKSAPQPAPADPRQVLSDYVRSKQASPELIPALAALTGSIGQEVKGYGAFSRVPAQAMGNVRNDMYLTSEAIRLMDKDDVGRFDADTRGKLQAFKRKIDDATKFIPLWVKIAVAIALGLGTMVGWKRIVVTVGEKIGKTHLTYAQGASAETVAMLTIGAADLYGLPVSTTHVLSSGVAGTMAANGSGLQWKTIRNLLMAWVLTLPAAILLSASLYWLLTRLF

SEQ ID NO: 22561 - protein, 107 aa, Pseudomonas aeruginosa
ALRMLPFRLAHASLRYRLTRMYAWPPKLASTGKIPCCWTSSSPKKSAWFATAPSSSPRTSWPRACSKPSATNRPTRRSSARWARPACSARPFPKPTAAAASTTSAMA

SEQ ID NO: 22562 - protein, 169 aa, Pseudomonas aeruginosa
SSAARRPASRHSSEPPSNTPARFFTVARRPPGRRARNPSSRPFPFPAPSSENRHARRPFPYPRTRPVPCPGRPLGRADPRRPRRRGDQDRAPRQRRRHPRLGPAVPQGCRRQRHQRGGLLPVGQPQQEVGDGGLHPAGRPAHRSRTGGQGRHPAGELQGRRAQGLWPRL

SEQ ID NO: 22563 - protein, 302 aa, Pseudomonas aeruginosa
LHDPGPGRPDEPHRARRQRGRRRSGEGRRGADRYPHRAVLLHRGARRPRPPRRQRHRPAHRHGPARRAGRLPGQPDPQLPDHRRAAAAPGQRTPEHRAVPGLPHRRRRHDPHGRQRQPVPQVRRAGRPPGMGRRPALRHQQGAGGQPRGADPADPPGHGAAHHRRVDSFPGARRRALRADQRPGAGVRRPAGAGPRPARGATAPAGRDGAAGSQPDPPVRDAGGIPQPAAHPRPAHRRGPRDAPRPGRGRAGKAARRQGDLSPAPRPSDASADNAPPYPAQHRDVGRITATRLSAGQPSIGG

SEQ ID NO: 22564 - protein, 429 aa, Pseudomonas aeruginosa
TWETKWSWALLNASTRAHSASNLSAGNGRLMLPQAIASLVLGSSTMKRSTGERPVRWPVRTTSEPLAASSPSPRRMASSTSWAALISVYTALLACVMWFPVGQRPSPPNFVALQKTHYRKKVAGLCQKSPLDEKSSVAGLGRPLAASASEQLGDVGGVEQVALVAELAVDADRAFFLLEQPLAVGLPETDQGVGRTFPRATAMEDQRLRLEQAHGFLVVEAVQDGLVVQRQQLFGGQRVGQGGQVLPTGLAGLGVLQAVGGKLLQQQAAGTAAVGVEPETGRQLFRAGEVVGQAFRQVHPLQGDDPLVALALDRVHGEGQHAFGHQFLHAGVGADGLRRIAGQATHLAVAGTLHHQQRNRAAGARLQYQQAVELERAAEQRGRREHLPEQLRDRFRIGMFGQHFAVAALEIDHLAAHVGIVEKETLALI

SEQ ID NO: 22565 - protein, 301 aa, Pseudomonas aeruginosa
MKIAVLSRNPRLYSTRRLVEAGRERGHEMVVIDTLRAYMNIASHKPQIHYRGQPLEGFDAVIPRIGASVTFYGCAVLRQFEMMGVFPLNESVAIARSRDKLRSLQLLSRKGIGLPVTGFAHSPDDVPDLIEMVGGAPLVIKLLEGTQGIGVVLCETEKAAESVLEAFMGLKHNIMVQEYIKEAGGADIRCFVVGDKVIASMKRQAAPGEFRSNLHRGGSASLIKITPEERMTAIRAARVMGLNVAGVDILRSNHGPLVMEVNSSPGLEGIESTTGKDIAGIIIQYLEKNGGPHLARTKGKG

SEQ ID NO: 22566 - protein, 315 aa, Pseudomonas aeruginosa
LATSTEPPPWFRALSIRLPSRRFIDTRRNGIAGTGCKAMRTCSRVWLNGATTSRTRSVRSPSSTGSSRPSRMKARNWSRIASMSSMSRIMSSTISRSLSGSNSSDRRRRVSGVRRSWETPANINSRSRPPCSMSSAIWLKARYTSAISLGVSGPSGRRTLRPWPNWRAATTRRLSGWLSWRTKIQAAAVESRPMPRNQPSTLQIRWPRKGCGYSGTASQPSPRLGARTQSCDGWWIRRRVSVSGPSSICICRWKISVYGQCCSPGWSALLGTQRRPEALAMAARDSSSAAQNARMVSAAPWLYWRSTITSSFISR

SEQ ID NO: 22567 - protein, 212 aa, Pseudomonas aeruginosa
DDAAGASLHRPRGDSGLARVAVRHEHVADAPDRLDIARLGRIRLDQPAQARDLHVDGTLQGIPLAATGEVHQLVPGQRFAGVLHQGLEHGELAGGQHVYLVALLQFAGGEEQLVVAEGHHLVGTGRRAGHQRRLAAQHGLDPRQQFARVERLGQVVVGAQFQALDAAALVALGGEHDDRHLIVLFAQAAAGSEAVLAGKHQVEHNQLEQFAG

SEQ ID NO: 22568 - protein, 100 aa, Pseudomonas aeruginosa
PPNWPATSSSPTPRPVSKTSTCLISRSAAPRARSPWKPASASWPTHCSTTRPWSRKARPRVSSTPRKASPTSRRCWKAPSTSSWSASPKTPRCSTSCACS

SEQ ID NO: 22569 - protein, 112 aa, Pseudomonas aeruginosa
SPSASACPTRAAPPTSGWPRWCAGPGRSSSIPTWKPTCSASSATAPRTRRSACSRATCTTCCWPPRPARAPPSASTRACAPGSRSRWSTPPASCWTPPPSTHMRRRTSGTRP

SEQ ID NO: 22570 - protein, 457 aa, Pseudomonas aeruginosa
TARSTLILGRPIWDAITRNPDLSDLLSRRLALLGAAANLPLLTECLHGIERECLRVDSDGKLALTPHPRALGSTLTHPQITTDYSEALLEFITPTETDVADTLGDLERIHRFASSKLDGEYLWSPSMPCELPDEESIPIARYGSSMIGRLKYVYRKGLALRYGKTMQCIAGIHYNFSLPERLWPLLRQAEGSELSERDYQSAAYIALIRNFRRYSWLLMYLFGASPALDAGFLRGRPSQLERLDEHTLYLPYATSLRMSDLGYQNNAQAGLTPCYNDLQSYIDSLRQAVSTPYPPYEKVGTKQDGEWVQLNTNILQIENEYYSSIRPKRVTYTGERPVQALAARGVQYVEVRCLDINPFLPLGIDLDEARFLDAFLLFCAFSDSPLLNGECSDATDNFLAVVKEGRRPGLQLQRRGQPVELKVWANELLERIADTAALLDRARGGEAHAAALAAPAG

SEQ ID NO: 22571 - protein, 148 aa, Pseudomonas aeruginosa
GRRCRTDAFGAGAEGHARARRELRSVLPAPEPRTRGVFPPASAGRRRAGTLREDGQRLPGRTDGAGTRPGWRLRYLRRRLPGEHPRPDQQLSEAGAPLRPGTRRRITGSSRIPANCAGSCTARPAPPVAALRCWAGSRARGTSARSAW

SEQ ID NO: 22572 - protein, 410 aa, Pseudomonas aeruginosa
TLGGPAAAGFDHGTGLGAGPNRFTTISEKNYPKTPVNSRSAFSLGCLVRRAVRRAPTRTRKIHERILPSRPGRPARRAPGSQPADQRLAAARPRRQPAAGGAQPADIQGQPLRGADHAGQLLRRQPGDAGVRHLHSRPAHRRRADRRLYRLHHAVPRHHAGRDRSPARPAVGRGKDHPALPRPVLRSAGPAGYRGAGDHRPGGQLGVDAAIHLRKHSAVHPPRGDHRHPAHRADLLDRPAKLRAHHEVPRRIRDRRHLASGRLPAGGDGRAVRHQRRLRAGRRPRRASVGGGRQAVMLDQPAQHADHRFDTRQFEVLVGLVGTGDVAGTEDQGLAAQALEVRRLGTERHGLGAMPGQAFGDAYQFAVLRLFERRHGREQRLVVDAHLVPFGQRPQALADRLAQLLRLHAG

SEQ ID NO: 22573 - protein, 217 aa, Pseudomonas aeruginosa
RAQVEFQRTLAADAVGIVAAVDATEVQGRLGHAELRVVPGPLPFPAQRHQLADGRVHGLQGATAEVRIGRMAALPENLDALHHHPLVQADRPQVGRLADHRGATQRSPAFGEGTGAGHRAFLVAGGEDHQRLAERLVEQRQQGLDGQREEALHVATAEAVPAAVALVQAQRIAAPQRFVVGHGIGVAGQHQPAGTAAVAGQQVELARRDFPDLAAEA

SEQ ID NO: 22574 - protein, 260 aa, Pseudomonas aeruginosa
AGHQFQVAAGLDHRDDRRHRADGVGHVVGAMGESHGAGGEDHQHREDPLDAGEAATRIGSASGSDAQQQDDAQAHHQATGEQRQTQRLEAGKLQADMLQALADGHQRDHEARQEHVQRHVAARAAERVLGMQYQPLHAPEQGEGEQPGQHRRHHPTGDDRADRAPVHRVHRDTDRGEADDRADDGVGGRHRPALDRRQQQPDPGGQQGREHAEDQQVGGHVLRIDDAAPDRFGDLAAGEVGTAELEDHRHQDRLADGQRP

SEQ ID NO: 22575 - protein, 497 aa, Pseudomonas aeruginosa
TDWSAWNASLVEMPKSIGHPPRAPLIWNTFTRGRLASRAGHRPMQKETEIKLRVSRATLEALQEHPLLKKRNKSGWERRELYNQYYDTPGRELARAKVALRMRRDGEQYIQTLKSRGQSVAGLSERNEWDWYLEKNKLDLKKLDDKCWPAALKDLDKKQLKPIFSTDFVRQRAEIAWGRGKARVVVEAALDLGKVVAGDNQEEICELELELRQGDAAALLELAAELAADLPLMPCDISKAERGYRLFDPNSYEVDPPAQKLLAETPLDGAFAAIAWYLLGSSQRLAEQYRFNGHWRLLEDWLQHLQDLRTLLGSLGQAVPRASSRELREALDALLADWAPRIERGRDDETLRQQAPQLFRGELDETRWGLFSLNASRWLLAKAWTESRNERGNRQGAAALGKWLLRSLAEEAQATPLARAHQHPELLPDQAPRLQRMLTWLRLARGVLDLPEADRLYGELAKLLELLRQPVDVERLAARATQAHTVLTLKPWKALMK

SEQ ID NO: 22576 - protein, 381 aa, Pseudomonas aeruginosa
ASPLPPSSEGSLHVRVRHRRPGPPAGPRRPAPRAGRPGPGRAGAGRTVPGDPPQRGAQPAASAGVPRRAAGRGSQAPRTQARPGDPHPVAGRVRRPALPAHRPAEDRRRRGDSADVLRLRPAPWHPRRRAESGGSHHRQRPALRTGLGKQPGACAQATDQAGGGEPGGHPALHRRVLPPGPLGQRRHLAGPEDQRRRQLRTVAQPRRRRPGAGRQRRAHRHHRRLAVPVRLPAARQRHPHRAAPRAGHRALPYRRRAAQRLPVPAAGDHGGGQPPEVTGTDERGGETQAAGRPGQDQDPGRRRGGAAPVDPAHRLRREDGDAHLRPRGAAQELRPARILRRRPAPLAEHDQPAQRHHPGHRPHRLGQDHHALHHAQATGHR

SEQ ID NO: 22577 - protein, 162 aa, Pseudomonas aeruginosa
GERLHHRGPDRDDRALVQPDAGPAQHRPDLRQRRTRPAAAGPGHHHGRRDPRPGDRRDGDPGGAHRAPGALHPAHQRLPHGDHPPARTGRTLLPDPRHGARGHGPAPGAHALPALQGADATGGQRLARTDPPLERPAAQRRAPGRGLPGVPRHRLSRARRRL

SEQ ID NO: 22578 - protein, 194 aa, Pseudomonas aeruginosa
RAFPPPSPRRRSPAAAHRTCGEPRAASLARCGSAGRRAGAEGRPMEILLLRLDFWDWLAFGTVLLLLEIFGAGGYLLRVGLTAACVGALGALLPGLAWPWQVGLFVLLSGLVAALHRRRRRKAGSVEETPGLQRRGDDLFGRTFPLHRAIVGGLGELRVEDASWLVSGPDLPRGALVRVTGQDGALLHVEPAAP

SEQ ID NO: 22579 - protein, 1097 aa, Pseudomonas aeruginosa
SSPRRTTPAATSPATARSAGRTWKPPCKSCATTTRTCRPATWNWPARSSPAASSPPSSSRPRRPRLRPEARSLAVVVQRHAGAEQVAVAVDVVHPVNRRPVLERPRMFARGHRLGDLVGSLPDPGDVGQGMRRPFQRVVLRRPGAALHLADLGPDAQHRLDEAIQLRLRLALGRLHHQRARHREGHGRGVEAVVHQALGHVFLGYPGLRLERSQVEDAFVGDALVAPAVEHRERPVQAVRQVVGGEDRHLAGVGQLRAHHGDVHPTDRQDAGAAPGRRADRVVQRVRPFDADHRMVGDERRQVPLDPDRPHARPATTMGDAEGLVQVHVRDVRADVRRSRQADLGVEVGAVHVDLAAVAVDHFADLAYPLLVDAVGRGIGDHQAGQPVARLGRLEAQVVEVDVAAGIALDDHHPHAGHDRRGRVGAMRRCGDQADVALAIAAALVVAADRQQPGIFALCSRVRLHADGVEAGDRPQPGFQFVDHPAIALGLLARHERMQFGEFRPGDGDHFAAGVELHGAGAERDHRLVQRQVLAFQLAQVAKHLGLAVVGVEHRMLQVGRSALQDRRDAVGHRPAIQVRDIQPVAGAEEDLEQGRQGRRVTGFVEAQGQPPVVDHAQVDPCRPRPFEDRRLTLADLVGQGVEEVPVEPPQSLAFQARRQQRGQALDALGDAFQLLWPMVDGIQRSNVGQQHLGGADVRVGLFPTDVLLAGLQGHAQRRVAAGVAGNADDPPRHCPLVPFAGGEERRVRPAVAHRYAKALGAAEHHVGTEFPRRGQQQQGEQVAGDASQRLLAVQRLDKRAQVADLAATVRVLQQGAEHRVGGKIVRLVDDQLETERLGAGTQHRNGLRMAMRIDEEPVAPGLRHPPGQGHGLGGGGGFVEQRGAGQVEPGEVDGQLLEIQQRFQAALGDFRLVGRIGGVPAGILQHVAEDHRRRHGAVVAHADQAGPALVEPGVAAQARQGGLFVERGGQFQRPVEADRRRHRLHDQFGASGNSEEIQHGLLFRRIGAEVAAQEGIGGLELGEGRRLRHGFGLVGGGIALPAIVAERISNEKATTAKTHFAAAKRTKPRMIEALSKDSGFCRDYAAAQPSASTAAW

SEQ ID NO: 22580 - protein, 425 aa, Pseudomonas aeruginosa
RSSAGILLILFSSKSGATAVAIARLDQGLAVTHETGLDHPYRVPLAADFHLGAVAGGGRHAGQRDGLVQGRRKAAAGDLPLTNASYPHHLVGAQHAALLQYQADQLRLVAGGLLRFQRAAADEVPRNRLPGYGPAHVGGKRGNAFVHVLAVEIEPGLQAQRIARTQARRGDPGANQLVEETRRFGGRQHDFQAVLAGVASASDEPVALGTALERLEFAYQRGACRGYQFGAVHAGVGALDGEHRQVAAFLQVDLEAGGLRLHPGDVLVAGGSIDHHPVAVLGQVDDQVVDHPALFVEHRAVERLAGFAETRHVVRQEMLQIGRGLLAGDVDHGHVGHVEDAAVTPDLMVLLDLRTVVQRHVPTAEIDHLGAERDVQLVKRGAQSHGYSPSGRSGCRRQGPPARNRAHCSRKPRSRTPWKRAAIRA

SEQ ID NO: 22581 - protein, 456 aa, Pseudomonas aeruginosa
QADQHQGQGRQRGARPFALAGHLEDPYGQGVPTEGTHQQGRRHLLEHVDEDQQRGAQRGRQQQRQVDPQEQQRAAHAEAARSFRQRRADPRQPAFQRPVGHRHETDQVGQQQGEQTAQQQRLAGAAEGAGKRDHPVIVQPAEGQHDRNRQDRARQRITEVAQAHRAADSASRRQAHGEGQQQGHGDRRQRGDAAQRQGMADQVPVALVEVETALAPEPDNQLRHGNHEGAEEHQPAPGARRQRPGAAQAIQRRAARTLAGGLGSASRVALAEQHQAYPEQQQAGQLGGAGEAVEAVPGFVDGGGEGVEVEHRYRAEVGQGFHHRQRQAGADRRPRHRQGDPQERLPGRQAENPRGFHQALALGDEGAAREQVDIGIEHQHQDQDHPAGGAYARQPQAAAEPLAQQALHRSGEIQQADEDERQDVGRDRERQHQRPVQPAPPGEFAEAGEPGQADPE

SEQ ID NO: 22582 - protein, 188 aa, Pseudomonas aeruginosa
GQAPGGRTAPSPRDGRRPGAGRRCAASAAATGRPGTGARSLPSPSSCPGCAASAAARSDSARVRRQAVRRAPGRATGPRTAPPHRGSPGSRPVRPAGGWCAQRRRPAPGPARRNAWGAAGAAGCTGAGRHAGWRPGAVRRLRRGRRGSHPRPTPSGVLPVPGWSTRRSSTSARRRGPAGAGRPADRRR

SEQ ID NO: 22583 - protein, 449 aa, Pseudomonas aeruginosa
RFMAKRSRRALRALDQTGMALQRPRAEAHGLAGEPALGRRQQVEPEQAEVAPGAEQRAVVGEQPGHPVGEADGHLLVQALPIEVALQHGELAQRRVVVEQGVDQRQGVAQRQVEALAGDGVQTVRSVAQHHQVRTHLLAGLDQVQGVAVPCADLAEGAEAVAEGSLQLAEEGRVIEATQAFGVLAWAGPDQRATVIRQRQEGHRTAGGEALEGLPEVRLGGRYVGDQRSLPVRRLLHGDAKLFAQPGTTAIGEDRQLAIELRLVVEGKPVTALPGFQGLHFGRAVPAHHLGVERLPQALAEPGVLHHVAQRRHAFLDGGQAGGAEAAAVGNMDMQDRLGALGDRRPQAESLVDLPAAVGQRRRAGVVAGLVGIAGGEGFDQHDRPAALPSAGLQGQRQRGADQAPADDRQVDLAHRHLRLPRSWPRPSAPRSRRRSSARRWSALRSHCG

SEQ ID NO: 22584 - protein, 117 aa, Pseudomonas aeruginosa
NEDGYPSTARPGKTMRPVAGAPAQPGHWPRPGTILYSCPITPIPKREPMEDADLQLLTAKFDQLLQKLEQLKAENRLLRANEKSWREERAHLIEKNEMARHKVEAMILRLKALEQDT

SEQ ID NO: 22585 - protein, 213 aa, Pseudomonas aeruginosa
LQQRRLPVGPVCMSARRKALRSTATATLNFRVQGLTRQRHDRGATFPHDRIARPQPPGPAPQAPPGAPRALPPAATPRRPCPLSTTGAASPFPPCPPYRPVPAQRRRDRPASAAACGAEPRARPPTCRCWRPGRRRAWYSSGSAAANAGPATASASANRWPTPAASARPGRWTWYCCRWWGSTNRAGAWAWAAASTTAAWPTWRGAKMVTNRR

SEQ ID NO: 22586 - protein, 245 aa, Pseudomonas aeruginosa
CRSAPRNGRRSCRWRNAEAIAQAICEMVRRKRQSAPKKNAEPITTIPANCGQTMSKPAPRNRIAWARLTKCVVGAASMMFCSSSGMLSRGVVPPERMFSGSSTRMVNSPSCGIERATVPRNMPMEVVANRCNPAPSRNSPTEPLIGTSSQPRTTHCNESPAATSTTNPIDQTLAIMISKADSGITSRCSTVPCSRSRISAAPVRMIDSIVIWLITSITPPNQAWVRFGLNSMRTSICAGMLGSAR

SEQ ID NO: 22587 - protein, 118 aa, Pseudomonas aeruginosa
ASFMKWVEMKMVTPSRRDSSTISSQKPSRATGSTPEVGSSRIRISGLWITATASDRRWRMPSGRSLGSSSATFSRSKRRSISPTRAGMPSAGRWNSRACNTRFCRTLSSAYREKAWDM

SEQ ID NO: 22588 - protein, 556 aa, Pseudomonas aeruginosa
HFRYFFIYEKCSVRNRVKRRDTTTSGARDVRNLSSRATPGATARCRGGQHLPAPALADLRRYLHRLRGLLPAAQELLPGHALPHRGRLQPRSTGRRDVGHRHRLRPVEIHHGPGLGSFQPTGLPAVRPVGVGGGDVHFRIRALGYLQRRHHVRPALHQRLGPGHGLAAERTDHGPLVVAEGARQRGLGVERRPQRRRRPDRPAVPARPGAVRRLALGLLRAGHRRRGRSRIRLFRHARHPAILRPAADREAQGRLPRRLRRTPRARAVDQGDLRHLRAAQQAALVHRPGQRVRLPAALRCARLGADLPQGGQALQRRQVVLGVLLLRMGGDSRHPALRLAVGQAVQGQSRRHRRGVHDPGDRRHPDLLAEPGRQPGDRHGRADHDRLPDLRPGDADRLAGPGAGAEESGRHRRRLHRSVRLPRRLGGGQRPGRLHGGSLRLGRWLQAADRRLPAGHPVPLPDPAQTRGPGRAAASRLMTRRLRRQAGAAFSPAARRRTRRRASGARPSLLRPGHPGSRRPSPASRWHTHAGSTGRRNPRAPPRAASRSAPPSHRGR

SEQ ID NO: 22589 - protein, 553 aa, Pseudomonas aeruginosa
RVRHDRVPLRSGVPAPPPAAPRRYGSCRCGSSADSRSRAAGRHRGCVPPAAARGRRRTVAGRYASVDPEARPERVDAPCHRFVLDDGAPPFAAGLARPLVGGIKPHLRAEAGDRRGEVEVVDGRVVDHHRVALGVHPRGDGPDHIVPVARIDVIVGDDDELGVHELPQERPDPEHHALGVPWVLLLHGHHRHPVGTTFRRQVEIDDFRELLLQDRHEHFVQRHPEDRRLVRRTPGVGAVVDRFLPAGDALDGEHREAIDLVVVAGVIAIGTFVGHLAGVDHPFEDDLGAGRHLQVAPATLDQLGTMPAQQAGESVFGKGVRHRRHRTEDGRRIGAQRHGYRIGLARMLLAPLAVVQCAAAMAEPAHDHLVAADHLLAVDAQVLPFLVRPAGNGQAPGDQRPDIARPAGLDRQPAEVDVLALLDHFLAGGVLEHLRRHGQDLPVHRQLGPGVLEALRRLGLLELRQQLADLAQRADVLGAHAQRHALRRTEQVAEHRHVEAGRLFEQQCRALGAQRAVAHLGHLEHGGNRHLDALQRTALLQLGDEIAEILERH

SEQ ID NO: 22590 - protein, 474 aa, Pseudomonas aeruginosa
HRLEQRPEFMGPLGRKVVVIHVQRPAITFGETIQAIAEHAGGVEHAHPRVAFGQRIEQRIHVGDARSVLSEGKTCAPDILPAQTQPHQPRRCLEWQQRYVLDQPDMYVGRVQPFDHPAQALPQQRLGDRAVRRVVRLAENVAGTVLRVAVDIHVPASGEDHPARPLLFDELEHLLVETQAIVLFQHPQQRRTARQRSLPDRHPATGSQFAQQRAQRRGMAVAPTDQQRSFGSQFRREAADAFLTERLLVEHAVGLPIAPLGRLGITQGFLGKTRRHAVVMPHQLADDSQQQQAAQRRAKHLPAPGEQLALAERCLDVVQRQCRQADARRQQPQACRQAQGLQCVVLDEDVQRPVPEVQRIGDQTEPDQRLPAQQAASPGVAGAVGPDQQGGAKHRRQRREAGERSVAVVEEHRQENRRYPEGGRQLQGPLRMTAATARQQCQRGTRQEFPGAHRQEEECTARSLVHRPDAGRQR

SEQ ID NO: 22591 - protein, 775 aa, Pseudomonas aeruginosa
PRPTSPRKPNGSSGSATASTCGKHRRGQLLQQGRLGIAGVLVTGGTEPLVATVGLQHPGLGVVGQVRFQFLLDPLHQLLAFHREAGLDAHVEVALHPVGAGEIELLVAAVEEVVDAAVLEEAPDNRAHVDIVRDPRDARPQAAHATHHQVDPDPGLAGLVQGADDLRIGQRVDLGHDVRRLAERRLGRLAVDHFQQVLLQGERRMQQLLHAQRLAHPDQLVEQLVQVLAERHVGGQQAVVGVQASVAGMVVAGAQVRVAAQFAVLATEDQHHLGVGLEADHAVDHHRAGLLQAAGQLQVGLFVEAGAQLDHRGDLLAVACRLDQGVDDLRVGTAAVQGLLDRQHVRILGGLAQQVDHRGEGFERVHQQHVELAEDVEEVFLLLQKTRDRRGEGRVLQLRMAFQAGDAEQAGQVDRAADLVQLAFGQAELLEQVVGQVLRAGIHHLQAYRIPVATREQLAAQRAGQVLDILGVHRQVGVAGQAELVAALHLHAGEQVVGVGVDHRRQEHVVVTLAANVFRQPDDPWQQARRRDDRQAGVAAEGIHPLQLDDEVEALVHQQRERVGRVEADRGDDRRDLVAEEAPHPGLDLQRPVTPADEADLVLGQLRQQGLVEDPVLPRHLLVDQLADPRQCLVRQQAVGAGLLAGEGDLLLQAGDADLEEFVEVAREDEEELQPLQERVGLVQRLLQHADVELQLGELAMNVQAAVIHAGNHRRWRFHRDRFGHLHFCFAFHVRHYGFVGGDTFDLIKSLLRIHSSSRGGQRPRLNCSAACLAK

SEQ ID NO: 22592 - protein, 496 aa, Pseudomonas aeruginosa
SCWACCSGYGGVSRHRAATARAATPTNPSEPAPARLNSRPLRTLQLLVPSAPAGRRGRRLAMLARYRPRPGPSGPDPAFPRSKPHAQESCRHPLRLWRLRWRGNPRKRDHPAPPQPAWRRGTMLRAEHRPAPCGQPPDRRGNAGKPQCPGRVRAYRPRRSQGPARSPRRGLRRADRARWLRRCEEPQRLCHQRRAMPGAAGRAGAGQGFRRSRQASRADLHRSGDGGEDLRRRRPMHHRQRRRHRRRAEADGCRAHRRAGGRDRRRQRAQAGDHPGLHARPVDSRSRFRDQQAGRPGARTGGPGQGLIGQARGRSRRRPFQIRAATPACVSKPSSRDAAMRETPSPALPDDVHQLVADFFQRIPFNRMLGIRVVSLGRERVVLDLPMKDELIGNFVQGILHGGVISSLLDVTGGAMALIGALERHRELPGHERMARLSKLGTIDLRVDYLRPGRGRTFTAHAVPLRSGNKVAVVRSELHSNDGTLVAVGTGTYLCG

SEQ ID NO: 22593 - protein, 254 aa, Pseudomonas aeruginosa
ISMVLLNSRNRPPKKRIRSRPEMPWPNRWNRSVVRRMTQVIESNSRIRVPMARARPKKRAFGCWAGGRRPTRIEMKMMLSMPRTISRAVRVRNATQISGLASHSIDGYFPFFVGVEKPGPRQRRTAFWKNRLLGICSSGPGEPSSRVSSSVVYKRLMATTRPVTPGLSALSISSTRSPMRNGPTVKISNAQNRLESTLQMAKKATAATAAKPVSAVHSTSADTPRRSSTMISALTMISQRRPPRSGRSSSGGTG

SEQ ID NO: 22594 - protein, 601 aa, Pseudomonas aeruginosa
GVGSWRRSLSVSPLRSVRLYDWKCLEIRGGRLCPAGRGNGLPRASGARCGRLPVAGRRLAWQARCELLERTRPDPGERRASLARNGHRTPAQIALRLARSGNPRRLPGRTPRGNEGPGTTSGTGTPATPGRPGHSLAGGPGSESQCGCLAASLQPGHLHGSRAPGFAGAWLGGFADSALGGAGRGGAVAARGRRCRSSAGGGCRGAGSRRRLRSRSGGGLGCGRFRGYGFRRRLGRRFRRRLRSRLGCRLRGRGFRHRLGRRFRRRLRSWLGCGLRGCGFRRGLGRRFRDRLRCRLGGGLRGCGFRRRLGRRFRHRLRRRLGCGLRGCGFRRGLGRRFRSRLRRRLGCGLRCRGFRRRLGRRFRSRLRSRLGRRLRRYGFHRRLGCRLRSRFGRGFRLAALQSLASSFLHLADTLRQLEAFLYVTLEADDVGTGVRLPGLQGIQRLFQVADGLARLGLCLGLAGLGSILQLGASLVQLFLGFATLLFKFGQELFRIDQRLFARTFQVLDKAVGKLLQQVQGGGDGLLVGRHDVPPGGRGCAHTRPAHPLSPTGSMCYKRRAPGLPADSFGETACRAAFSSVFFYCRCRFSPRLPRTNWPMP

SEQ ID NO: 22595 - protein, 215 aa, Pseudomonas aeruginosa
RLAGESDRYCRTLCAALAVGVVQDFDEAVLQLEAFVQLLPQDLQLRDEAGSFTAIAVVAAVVEVQRGFGDGFQPGEDLLGQLQAALIAEGLAFRRQLLVDLEVSGRYIVQQQLAEMLEFFGVGRRCLNTAQGIEGLHQLLALMQPAIDQLVHTPPPLLGITAAFEHVVLASLFGRPGESSSAPRRIADALSALCGRTPVQGADSGAMESQIMPPG

SEQ ID NO: 22596 - protein, 235 aa, Pseudomonas aeruginosa
SAGLRQAGPEQVGQVQHRMLGLQRVQLDQAGDAVQAVEQEVRANPRLQRFQARLQLGLLLPAPLALQVKVAQHQGGHDQRDQRVPQIQIDLAGTRQFSAQLIVLGDRRAAQGEGHHQQAAGTPRQRHRQACEQWPQAAEQRRREQYDPLHEQRRQGQAHPVEARRHRLRQHQHEHQQLRQQHQGEQGFGFAELGNEEVVLDGRPGRAAGLESDRHRQSFRKARGARKTAAGVRAK

SEQ ID NO: 22597 - protein, 216 aa, Pseudomonas aeruginosa
PRRYGSSRARRPARLAPCGGRGSAGDRGAPVVGAGGAGDFVGPGDLAVGEVHVFQVGEVGVARVLAVVHVVLDVDDDRVFQDGGVVVLLGAGGGGAVPLDLDLGQALAGGQGGQQQRRGLVEDLGDDHRLVHALAGRLAGLRVARDDHFVVEALDHHLVLVAFLVGVADRILGEGAGGDQALLGAGDGHIGGGCHGCSPCVSRKSRGLDHPSGNFT

SEQ ID NO: 22598 - protein, 61 aa, Pseudomonas aeruginosa
CPGQYFQGLWAVIGDVSWFSLCNFLHNRYYALNQLLVRLEGLCFEALQRNPLLPALFFINF

SEQ ID NO: 22599 - protein, 430 aa, Pseudomonas aeruginosa
LVENPGKQRSAASCPIQGPACCSLVDLGPLPTGILSRFAGRTGIAGTSVQPALGRDPSAQGAHSRRGHCLAGAPAGAGAERERTDQGATPPVPASRRAPGKTRYRADRATGRRRALVAADQSTPFGHAPARRRQPARTWRGRRRGGPGQAGGQPVAGAWCAHRQRARRPQGHARPAGGCTPPVRLVAEAESHRSARAAPQPNDALAAHRVHARAQCRTGHRAKGSAGGQAEKLPGAFRPGPVRRSPGGAGGEPGTGAVLVRRPAPGLGVPARAQRRAGDAGSRNAFRLAPAASAGAGGAAFPRWQRIRRCGHPRLDQRPCHAPSPERQCAAQGRDRGPAGRMGRRPGRGPAGVAQGRPEGGGTGVEAGHEARPRRTRPVLLATEPRATVLPGEEVRAGQDPAGEPRPSVARIGIARLGARSGAGCTAPAA

SEQ ID NO: 22600 - protein, 213 aa, Pseudomonas aeruginosa
LLRAVAAEPRRARTQGRHLSQAVPPRSRGGARIGLRALNSQGEKAMAKEGSVAPKERINVTFKPATGGAQEEIELPLKLLAIGDYTQRGDERKVEDRKPIGIDKMTFDEVLAKQELGLTLSVPNRLQEEGGSDELAVGLQINSMKDFNPASIVEQVPELKKLMELRDALVALKGPLGNAPAFRKAIESVLADDESRSRVLGELGLSAAPSQDA

SEQ ID NO: 22601 - protein, 459 aa, Pseudomonas aeruginosa
PRKQIHEHQCRTARPEPERRIQHSRQHHRRDPPEPGRRGLRHRQARRLRLHRGIAQAAERRRAGEEGDGRPDDRRDRRQAQHADGRDSPSSRFPGAGVGLARPATAGRPHQLPREHQDRDSQRFQAGPAGRFRGLARGDAVRPVQAHLHRRIRPVRWPAGRRHHRQLLHVAQFARRQADAIRLQRGLHGPCAIRGGRRSEVLRPGKLHRPAGPEGPEGSFRRPAVRQVAELPPVRGFPLRGADRTALPAAHALRSGRESGQVVRLQGDRGQQPRALPVGQHRLCLRHQADRQLRQVSLVPEHHRAAERRCGRGPAVAPLREHGRDRDQDPHRGAGVRSPRVRTGRGRLHFPDHAQGQRQRRVLLRQLGAEAEVLRHQRRRQGRGAELQARHPVAVHDDRQPPGPLPEGPATRTAGVVEGAYRPRAGAEQVDPPVRRRPGKPQRRSARPSPAARCTDHRQ

SEQ ID NO: 22602 - protein, 239 aa, Pseudomonas aeruginosa
PGPGPVSRAGRTRSGCRAPARGLCLPDRAVAAEAGRRVAGTQPLDDAPAVAELYAPAAGFQHSPVRPPDPPGRGAARGARYAGREPAGGRGRLSLPYLLRHRSPAAGAGGAQLFGDRRGCAARPAPGDELRRASRRAGPESAAPAPGRRALHQPDALPVPAAQPGEHPADSAGCPWAAAGWRGRQADVVPPDGRAGAAGGVRRRRGVDSLSAEYLPWLSLPAGILRVPGQVPVRRRGWP

SEQ ID NO: 22603 - protein, 654 aa, Pseudomonas aeruginosa
PARRSARGNPQAGPRPRVALRYPQERHPAPAPDAGERQAVLYAGGQPVPPRCAADPPRRQAGRVPADAGRIQPGGLRGVLGRGRHRLAAGRARLPGLCAVRVLRARSQLRRPGSTAPLQRPATDLVAARWPGHLPELRHPPSRADRDAVGGTDLHQPEPAPTAAPGRYLRRLRRYAGVPRFPQYHPGDAELRAAAEPRFPLETDQQHVAQLPVAGQRRRTQGDPRNLRPAALLRPACGEGQQAPAGRAQGGPPRACRPPASGPAAARLAYRADDRSGRLHRRGRPVRVRFGSERIFRALRQHQLLPRVAGEEHTGRRVPMETAHGFAAPAVSALARGIREYSLFQAVLLVMDRLRQEHPGLGDEALYDQLEFQANPSLGFPGSDVDRVEFFEERGMLRARLRFNLIGLFGASSPLPAFYSEQALGDSEEGNPTRNFLDLFHHRLHRLLLPIWRKYRYRVSFQSGASDAFSAQLFALVGLGGEEIRKARELNWKRLLPYLGLLSLRAHSAALIESVLRYYFKHAELVAEQCIERRVAILEEQRNRLGLFNSQLGEDAVLGERVRDRSGKFRIHIRQLDWQRFHEFLPIGPGYQPLCALVRFTLRDPLDYDIRLVLRHEEIREFRIGAQNACRLGWTSWLGRERADGVVTLGSKIH

SEQ ID NO: 22604 - protein, 879 aa, Pseudomonas aeruginosa
GWMSMINVDLQQLIQALDADTRRDLEGSAERCVARGGSKVLVEDLLLGLLERPQGLLARALQDAAVDAGELNAALQARGEHSASRNPVFAPELVQWLQDALLLANLELGRSQIDQAALILALLRNPLRYAGSRYQPLLARLDIERLKDFALSQPLEGAPSGKPGGGESLLQRFTHNLTQQARDGKLDPVLCRDGAIRQMVDILARRRKNNPIVVGEAGVGKTAIVEGLASRIAAGEVPPALRDVELLSLDMGLLQAGASVKGEFERRLKGVIDEVKAALRPTILFIDEAHTLIGAGGQAGGSDAANLLKPALARGELRTIAATTWAEYKKYFEKDPALARRFQPVQLHEPSVAEAVTILRGLARVYEESHGIYLRDDAVVAAAELSARYLAGRQLPDKAVDVLDTACARVRISLAAAPESLERLRGELAEGERQRQALRRDAEAGLPIDHDALQALEERLAQAESERHVQEDQWSRQRELAERLLALRQQLARAREANREEQGGEANAETFPADEHGGVEALEKALHETRQALADAQAQGRLVSFEVCPRLVAEVIGAWTGVPVEQLAREHNAKVMGFADDLRARIRGQEQAVSALDRAMRATAAGLNKPDAPVGVFLLVGPSGVGKTETALALADLLYGGERFITTINMSEFQEKHTVSRLIGAPPGYVGYGEGGMLTEAVRQKPYSVILLDEVEKADPDVLNLFYQIFDKGVANDGEGREIDFRNTLILMTSNLASEHIAALCQDGARPSAELLEETIRPALSRHFKPALLARMRVVPYYPVGGPVLRELIEIKLQRLGERLARRQLAFDYSQALVGHLAERCTQSDSGARLIDHLLDTHLLPLVADRLLEAMARDERLERVHATLGEHGRVLCEFA

SEQ ID NO: 22605 - protein, 214 aa, Pseudomonas aeruginosa
GRGACGLRADRHGKPGRTGAGARPGGSAGTRGKSASGTRRSLLAAFRPGSGNGPRRPRRRCARSAGDQRRRFAAAVHRRLAAEPADPQRTEERTAPVAEHVARYRQESLALQRRCRRGAGASATGWQAWPVEWRTGRRTQFPRPPGAPGGAARRQPGGGARDPRAFLAAAADPAFRARRPPAVAGHLGQPLACLWSLPPVAMPGRRLERAPAGT

SEQ ID NO: 22606 - protein, 192 aa, Pseudomonas aeruginosa
FRPGLRRAGSPDFHPLHRAPRMIAMSRRPIPPARALAMLAVLALLAGCSTLSPYSRLTKLDLALSAGERVNPDLNGRPSPVVVRLFELKHPVAFENADFFSLYERPKETLDPDLVTSEELELRPGERVELKLSVEEGSRYVGVLAAYRDLGEASWRYVVPVTAKELTRVELKLGRKGILNAGELLGKAGDAR

SEQ ID NO: 22607 - protein, 265 aa, Pseudomonas aeruginosa
RALAQRAALVPADRPAGKRQDQPAGLFRTGVPDQPDRPQADPRYRRHALLRLVLRRPRRPDRHRRALPDPSRRRGRRGRLGDSARPVAQAPPRTAAEWRDGVDSGGNVAQRRRDGAGYAGSPGARAPAGNPADPAPRSAGLPGAEQGRPVARLRRVLRPVEPRGERPGSGHQLRQGAERHRCDGPAPGVRGPSATPEQPGDHAHPPGARYPASRSHPRLPAPAWPDRRAVVPVRRTRLHRQPLPARQPPARLLPDQRAAPGPAAG

SEQ ID NO: 22608 - protein, 125 aa, Pseudomonas aeruginosa
ATCATPPRDCRDRSADGSACWPKTPGGWSSAMPTCTSTSATRASCTVSTARRSTSATRSTRTAPAMSRSAISASSSRRRASPNASSKPTCGPSSAATRAVTACAAWTVTACRCPRSISTRWARPR

SEQ ID NO: 22609 - protein, 383 aa, Pseudomonas aeruginosa
CLPALQRRALRRAERRCAGSRVEPGIAAGGGGAAVRRCPERRRTGQPDGRGDPPMNEPLSSLELLPEEEGGANLTYFAFAAPTASAPDLPAVLPGPLPDVLSGRYRLERMLGAGGMGTVYRARDLLHEQFGDPAPLVALKLLNESVAESPDASALLYSEFALTRRLRHPNVVRLFTFDVDTACQRAYIVMELMPGLPLDRLLCERPEGLPWSELSAIARPLLDVLAYVHEQGVLHGDLKPSNVMLGEEGVRLFDFGLGQAQAGILDGLPQLSRGRIDAWTPGYAAPELLEGAPLSPAADLYALACVLYELADGRHPFRRLPSNQAREQGLERQLRAPGHLPRRCWPALRTALSLDPERRCIGVRELQEALGARRSWLAGVLAR

SEQ ID NO: 22610 - protein, 249 aa, Pseudomonas aeruginosa
SASSADRRGRKRKTGPVGPVLSPADLASADQAEEFAAGGGVVAEFAEHHRSDHGRVLLFHAAHHHAHVLGLDHHRDAEGAGDLLDRLGDLPAHVLLDLQAAGVHVDDPRDLRQAEHLAVRDIGHVGLADEGQQVVLAERVQLDVLDQYHFAVVGAEQGTVDDFFQALLVAAAQVLHGLGGTLGRVQQTFAVNVLAELGEDRGVVLFQGHGRSSQTITSAEGRTSPGRWQDSALAGYSSRPSSMVLRSIT

SEQ ID NO: 22611 - protein, 261 aa, Pseudomonas aeruginosa
PELTRAERRAVVRQQSLHGDAQAGVIGHGIAQEQDRLRRLLIGMHGGERQPCVIIDGHEQRLPACTIDRVATVACDAVAGPHDAPELLGVDVQQVPGRLVLVAHNGFDGLQVAQPGHARSRQNAADRGLRDAHTACDASLQHSTFAQLDDEQSLARIDGPGRSQRPGRGIGQGGLATGQVTTEPLPGRWRSDAVRGCGSHGIQAFQRHLLDHLESAGKGKSGMLMGVHPVGRPEWIGCLATSSLSNPIRMNTGYNLLELHT

SEQ ID NO: 22612 - protein, 157 aa, Pseudomonas aeruginosa
ATRRRLRSEGTGGASMRPFHDQGRHRMTHPLRLLWLCSALFVVLGLGFVFFPGPLASLLTSGEPLTPAALTDLRASYGGTSFGIGLLLGYAALRPRYLVLGLLAALAVIASGGAARLYGVLIDASPALTTFLWLGAEALLCVLLLAALWKTRQLDLD

SEQ ID NO: 22613 - protein, 611 aa, Pseudomonas aeruginosa
CGTHENTTHPHPAPPTRLPVPGQPATAWLSDASLHLVTAFAWPRRPRNRLQRISPMSMLKDPSQKYRPFPAINLPDRTWPSKTITEVPIWCSSDLRDGNQSLIEPMDAAKKMRFFKTLVQVGLKQIEVAFPSASDTDFNFVRELIEGNHIPDDVTIQVLTQAREDLITRTFESLRGAKKAIVHVYNATAPSFRRIVFNQDKQGVVDIATNAAKLIKKLAAEQPDTQWSFQYSPEIFSSTELEFSVEVCNAVIDVWQPTPDNKIILNLPATVECATPNVYADQIEWFGRHVDKRDSVIISLHTHNDRGTGVAATELGLMAGADRVEGCLFGNGERTGNVDLVTLALNMYTQGLHPQLDFSDIDAVRKVVEECNQLPVHPRHPYVGDLVHTAFSGSHQDAIRKGFAQQKEDAIWEVPYLPIDPADIGRDYEAVIRVNSQSGKGGITFLLEQEYGISLPRRMQIEFSQVVQGETDRLGLEMTAQQIYSLLENEYLKATSPYVLASHRLQEENGTSAVDLEVSFDGEKQHWRGIGKGPLEALVAALPVKAEIMDYHEHAIGAGANAKAAAYIEIRLEGQRPLHGIGIDENITTASFRALFSALNRAVTQAEAKAA

SEQ ID NO: 22614 - protein, 458 aa, Pseudomonas aeruginosa
PSPKTREMSAADTDWFGPPPIQEFRASPRPAFWSIWNNPPSPPSEPASTPGAACPAPPAAPPSRSPRTPPSPPLAAPPPAPPRMLPSEPSRPPPSPPPCAAPPLARPQHGHQPDQQGPLSDREHLPVLQSHPAPNRESNRASPIGLPPDLMPTARRRGIRVTPFPALRHHAQRRVMASDIDRKRTFRHSRMDFEAIRVHVGRETLAIGRQCRRVQPDAEHAVGVRRVEQAVALEVQDLAIPSVAQGVAVFADTVHRHHVAKVLDRPRRQQAVPVLSTRRGPVGGVEQQVGVVRVAAPHRETQVVADQRAHPPALEFEQFLAFAGTVVLVFAGHAEQMALVVVQHLAVRTRPEQAVAMAAVGELDDQAAGDHRAKAPGLLQQPGMGRPQFGLGLLGRSHAETRGEHLREDHQIGAGGTLQQGGEMLAVGLGVVPDQGGLDQGDVQVRQNRQIAHSFSAA

SEQ ID NO: 22615 - protein, 564 aa, Pseudomonas aeruginosa
PPRDHSSPRQGIGGQRRRPGSSRGLQPRPMKKARQGSLPGLSTKETPPSAALVLLLLLGFLVVRHQPALLVDLARGERVLLALVGVLAALVLDADRRTDQLQYPPVGLLQVAGIGLRHRVHLVAVDHDQRRIGAAQVGVAQLDPATVDHRRLVHLHGVLEDAGQAAGRPAGHRRTEGLLDRLVEMADAGAMQGRNEMDVGEVDEQQAPLQFGLHVVTLGRLHAIPFVQGDDQGTAGLEDEAEQVEVVLDHPFAGVHDEDHHVGVLDRLEGLHHRELFHRLEDLAATPHASGVDQGVLLLVALERDVDAVAGGAGLVVDDHPLFAEHAVDQGRLAHVGPADDGNLDPVLLAGTGNPGRFLAFGDLFARRLALALFLRVVLGEDPQGFLQHMVDAATVGGGDRQRIAQAQRAELGASEIGIDGVDLVGDQEAALVPLAQVLGDHLVGGGHAGARIDQEQDGIRLLDGLQRLLGHFRINAFLIAGDASGIDDDIGAALPARLAVLAIASQACVLRHDGVARLGQAVEQSGLADVRATHQGNNGNHAALHENSENTKAADVGRQRPDT

SEQ ID NO: 22616 - protein, 430 aa, Pseudomonas aeruginosa
MVEPSTAGSSRLYRSPWPSPTERLHCLLNTTSSLKSVSSAGGSSFLLLLLQPTTARARASSAACFHCTISGLSLGQVVELDLQGIAGTVFGQRLLGFLVGRARLVGALELHQQVAPELLAGRDVGLVGIAIEQLQAFLDLALGRQDPGQALPRQFAEGGVGRLVHDRLQLGNGVIQLAAVDRDLGHEQAAVLGIMGAAELALQLASQLRHLRRIRLAGRIQRGFDQLLVDDRGALRLVGLVLLPGLPAEYHCQREDAAGDQGLAVALPPVLDLRQVFVFGTRCHPNHSYSLCSQACARQAARCSGRASQAMLCCSPSSRRGLKPTTRLATSSSPRIRAKRAPLLSAFLNWLLKLPAPALTSRRMPGMALRNCSARVRAASSGWFAEGADVEVGRTVQFGGDHPPRFPAAAPGVPRPWRNRRPGSACRRTG

SEQ ID NO: 22617 - protein, 233 aa, Pseudomonas aeruginosa
SEKRYECSLSYLQTGRFAADEGGHVHRLAVVADLGAASETEAQLQRGLAGQFQAVALALQRADQDLAVGVGDLGPAIGDELYLDHPLALAGHHGRGGRFARRWRGGRTGRRWNGWSSTGSGSRAGRRGGNGLLGCGGGALGRSGGNLRALARHRRRSLGLGSDFRRNLGGRLLAFLLRFDHRLVFRLVQGMDLGGAVGAFHFDMLKAQTGGFRRARGMLLPPEVAEADQQGEQ

SEQ ID NO: 22618 - protein, 251 aa, Pseudomonas aeruginosa
RIADRPPACFRRAGWRFPAHRSISGSLHAPLYRRAQWPSDTWLMVYLGISTTRSSSATTAWQDSRESGSRPQALSSMSSSSSSDGSMESRPSRTITWQVVQAQDFSQACSISMPLRNAASSMVSPGFASNTAPSGQWSAWGRITICGIFAYSSISLSRRPESAALTVASIRRAAKASVTWDRRLIWFSMAAVSLPPASSRKVSICAAMARRSSSSRSRSPSTSSADCTASSSRCASTCCSRRARAALSSPA

SEQ ID NO: 22619 - protein, 75 aa, Pseudomonas aeruginosa
DGLTWMLASTPELSSRADTPSKPSASTWKVTRIFAAPATIGGMPRSSKRASERQSFTSSRSPCSTWIIMAVWPSL

SEQ ID NO: 22620 - protein, 137 aa, Pseudomonas aeruginosa
VVNSWARATGMVVLRGITFSISPPMVSRPSDSGMTSSSSNSSPRLLPARASAWMAAPMATTWSGSISVSGSQPNNSPTAVRTRGTRVEPPTITTERISSRSTPESRTARRQDFRLRATNGSINSSSVARLSSPLQSP

SEQ ID NO: 22621 - protein, 254 aa, Pseudomonas aeruginosa
QGLPTPASDVEAFAAAAFATNVGIVELEAFVEPFASEVQLGAIEIDQAFRVDDDLHAMALEDQVLGRQFIDEFEDIGKPGTASGAHAKTDTLALAAPLEGALHVFGGGFGHADGHCNSLLVTSGLEQTLLLLVVANGGLDGVFGENGAVDLHRRQGQLFGDGGVLDGFRLVQGLALHPLGGEGAGGDRGTATVGLELGVFDHALLVDLDLQAHHVAAGRRADHAGADVGIGSVELADVARVFVVVDDLFAICHG

SEQ ID NO: 22622 - protein, 292 aa, Pseudomonas aeruginosa
GPRVRCEPPDHGGIRFGYLHAHVRTSVVTPLVGQASGHLLGFGQDPAQDIHFQLADRAAPIQAPQPRHQVARLLRIEEADIDQRPLQMRVIEFQLVGRHQLGVEHRGGLELFHLGRLALGRQPRHAHLVGEHLDRGRQVQRAELGIGGDMHMELAALQFFVGQTRIFAPEYQGHLAIRLQVLQAGRRALARIQQRPGNPPVAGAGAEHHAAAAQGLFQGVHHPCGVEDVGGAGSPRHRVAVGKAFRLHQHQLRQAHVLHGTGRPADVAGMTGVDQHHTNTVEQRRCSPTPSY

SEQ ID NO: 22623 - protein, 258 aa, Pseudomonas aeruginosa
TDFPLHRTPGCHLGQREGCQGLRDRSRSRRRADHRRRAAQGLSDSRDHGRGRRLHRRQRRGRRLPLGDRSAGRHHQLHPWRTALRREHRLQVQGPPGARRGPRPGTPGRIHRQPRSRRRPQRSPPARQRPQEPGRRPARHRVPVPRQPDRQSRQLPEHVPQPGRPDRRHPPRRRRQSGPGLRRRRTLRRLLGIRPVRMGHGGRRPAGTGSRRPGERLHRQPRIPREGSHRRRQHQMLQGTADHHPAAPAAVAEALIRR

SEQ ID NO: 22624 - protein, 263 aa, Pseudomonas aeruginosa
RRTRPGAGFFISMKMHKGARGRPCASLRQSGSAQRFALAEDQPAILVDRDLAARIALHADLPGLAVEHVLHVIADDLLAAVVHGAAAGFGGGVGVTLLHAFLHLVAGVAAADGAGHGGDLLAGTAADLVAQQAADHRTDGGTGDLVLVLDRTLAGHGHVLADLARRLDGFLDRLDSDDLGVVGTAIHQAIGGYRATCGHAYGTQNGPDEHRLVHMYLLAFIQCGLCSPFALPRTGQKPPSSRLPTNVSLAQIRKLPPKAGVLE

SEQ ID NO: 22625 - protein, 327 aa, Pseudomonas aeruginosa
PAGAGVPNQSASGAIVDGVLGLRRDQVLAGQVQPDQYHVGDVDRRVGTRHYTDEQGDGETEQVVAAEEQQRGDSQQRGNRGGDGTQQGLAGGDVQVLDQIGLAQHAEVLAHPVEDHDGVVQRVTDHRQHSGEDGQVEGHLEERQHAHHDDRIVHQREDRTEGELPLEAEADVQQDAAQRQEHAEAALVAQFFTHLRADVLDPLQVRRVAGIGLLQGGSDLLAQFRVLAGHPHQHVAGVAEALHHGVLVAGADHLTTHLAEIGRLFVRQLDQRTAGEVEAEVDALGEPAAQGDDGQDQGDGKRHVADAHEVDGTDLDIHLSPLRSTAS

SEQ ID NO: 22626 - protein, 204 aa, Pseudomonas aeruginosa
RGLSAGICGGRKSSTRIISSFGSPTDKPPMARPSKPISCKPSSERRRRSSCIPPWTMPNSADGLSPWAIFERLAQRSDSSMERLATSWSAGYGVHSSKIITMSEPRARCTAMDSSGPMKTLAPSTGEAKVTPSSLILRMAPRLNTWKPPESVRIGPFHCMKSCRSPWRWITSVPGRNQRWKVLPRMICAPMSSMSRGNMPFTVP

SEQ ID NO: 22627 - protein, 298 aa, Pseudomonas aeruginosa
MKMSVSPLKGFSSPSRAALCQRAHAGGADGDYPAAAGPADGNRVHHVLADLQPFAVHHMVLDTLDTHRLEGTGADMQGNEGGIHPLRADRLEQRLIEVQAGGRGRHRTGALGVDGLVALAVGRIVRSVDIGRQRHVPDPLQQRQHGFGEREFEQGVVALQHLRAATAFDEDPRAGLGRLAGAYVGKHPVLVEHALDQDFQLAAGFLLAEQARRDHPGIVEHHQVARTQVVQEIGELSVGEGSRRAIQRQQAACAAFRQGMTGDQGLGQVEMKIGDTHGETLERPRSLPEMCFPRHEPD

SEQ ID NO: 22628 - protein, 287 aa, Pseudomonas aeruginosa
LDHLGTLFPRMQQGGGDLFQLPVIGLEARALGETGRFQATLLVEAVAGHAVQHAIGLHRVDVDVLAPLAMPQTALGALRIAAALGQGAAALGDVLGPGRDVLANQDAGQHQHQHRFHHRPDDPRQGYPGRAHDGQFAVAGQGAEADQAADQRRHRQHVVGAPWRGEEDEAQGVADAVAGADVVEFVDEGEQQRQAKDHPEHREDRDEDGDTDVTIELNHAPRRDRHGRTPASGARVPNRTEEDRSPGIVRGPTTGRWPWGSCLCPVGHGQRSAGPGSPYKGGSPAAA

SEQ ID NO: 22629 - protein, 112 aa, Pseudomonas aeruginosa
PATAAPPAGSPRIPAAVSTGATAIRPGSVGCRCRTGRRWAPRHARSPRCWPRAWAASRHRCRTGSPGSWPARDCRRSGSRCAGSGNGCHPPGCSGCPSPPPGWRCRVPGCCC

SEQ ID NO: 22630 - protein, 145 aa, Pseudomonas aeruginosa
PRSTAIRATASPAARRGRAAARRTWWRQWTKVTPSSERNSRARVREDAPTQRAHSSSPRGSAGFSSSAWQILPRRRSAGSGKARGCSRDHSSSSSSTAINRPSRPRSSYNNGRPAARTINSRNNGLTITPRGTRGNSGGQDCGRT

SEQ ID NO: 22631 - protein, 267 aa, Pseudomonas aeruginosa
STSPPSPAPASSPWAATPRALWATTKRWSGNCSRPGEFADDRAWQLPAVRRIPGTAGQPVRRHRQHRRAEGRHHHRRLLPLALRQEIPLGAPGHRRHRLDQRRQGQRRHRPPGSVVDPVPAGTGQVTRVDFYVIPSADPSARLQVACRLAEKAWRQGMQVYLHCADEAQRSELDGRLWSFRGEAFIPHSLAEEDAEAPVALGLGEPPGNHRDLLINLTLEAPGFVPNFSRVAELVVEEPAIRQAARDKFRFYREQGYPLQDHRLPRI

SEQ ID NO: 22632 - protein, 64 aa, Pseudomonas aeruginosa
AATTSAGRSSWRKSGNGRNSPAATSPGRFVAWAPRWTGRASASPWTTASPKRSRKPSCACMNTA

SEQ ID NO: 22633 - protein, 140 aa, Pseudomonas aeruginosa
PTSGTSAPSRWPKTPSPPWKTAVSSSCPSSTRTCTSPGCATSRTGASAASSGGATASRPGTTRPATSTSAATRSRCAPSTSSATRSSCARTKTFSTPGSAPACGPSPPSAGRSRPSSSRPSTPPTYWSPASTSSSSGSRG

SEQ ID NO: 22634 - protein, 155 aa, Pseudomonas aeruginosa
CSRSWRRRSPSRPAPNSPKASPATAPTPCASPSARWPPPAATSSSTWAASKASATSATRSGTPPTSSSRTPMARTPGSTASQSSCPRSTAGSSPSCSAPSRKSPASSTPSASTWPPRPSMSSSGTSTAPGTWSWSSRCCGTRTPPSSASAALVAP

SEQ ID NO: 22635 - protein, 335 aa, Pseudomonas aeruginosa
MVAPQCPGPWHGPVLRRQRRRAEVGGGDRHRRAPGAGRRSRRGQGGPPGGRLRRRQEPQVAVPERPGQHRHRRADRPQVHRRQARRDRRHRHSVGPGAGGRDQEHPDRLQHRHRPGRRAPDAELGSLRHQRHRGFRHARAGQADRADQESGAGRQAHRHGLQPGRSQLRGGGQGAEGTAAEDGPEPGRSLGTAFGGRQLGGAQPGRQGRRDLHQHRQQRGVRLRGAGQGRQRREDPADRLRHRQRQARRHRRPRHQLQGDGQADRPHGGAHPQGREAGRDQAGDQRQPAAVRQSRGRAEARRDPVRRTAQVGRGSHQVKKAAAGRGRPARGRTAR

SEQ ID NO: 22636 - protein, 306 aa, Pseudomonas aeruginosa
SCLHALGYEVMSLFSLFGALEIGLIFSLVALGVFISFRLLRFPDLTVDGSFPLGGAVCATLIALGWDPYSATLAATAAGALAGLATGLLNVKLKIMDLLASILMMIALYSINLRIMGKPNVPLIAEPTLFTLLQPEWLSDYVFRPLLLVFIVIAAKLLLDWFFTTQKGLAIRATGSNPRMARAQGVNTGGMILLGMAISNALVALAGALFAQTQGGADISMGIGTIVIGLAAVIVGESILPSRRLILATLAVILGAIVYRFFIALALNSDFIGLQAQDLNLVTAVLVTVALVIPMMKKRLLGKKGA

SEQ ID NO: 22637 - protein, 694 aa, Pseudomonas aeruginosa
CCTRARWCWTSPASNARASTYRTCWRCSRRCAARSSPTTPSSSADRAAAPLRGEAGRRRRPAADQGAIRVRLPHSQASSRSDARMNLELLWVVGLLATTVALFIHNRLRLDVIALLVIMAFSVSGTLTLNEALAGFSDPSVILIAALFVIGEGLVRTGVAYQVGDWLIARAGSSEARLLVLLMLAVAGLGSVMSSTGVVAIFIPVVLSIAAKLKIPPGRLMMPLAFAGLISGMMTLVATPPNMVVNSELAREGHAGFGFFAFTPIGLMVLAIGVAYMLLTRNWLNAASPAEVGAPKARRTLRDLIRDYRLAGRERRLQVQLGSPLIGSTLEELQLRTRLGANVVGLERVRKFHSEVVKVGGSTELKAGDVLLLDVFAPPEDMDRRCAELNLVRLPFRASYFIDQSREVGMAEVTLPPDSTLLGKSVLELGFRSQYGLNVVGLRRDHEALTDGMLEEKLRLGDTLLVIGAWKAIRQLQGRNRDFLVLSLPAEIDEVAPALSKAPHALLSLAVMVALMVSGVVPNVVAALVGCLLMGLFRCIDMDGAYRAIHWQSLVLIVGMLPFALALQKTGGIDLVVSLLVDALGDAGPRVLLASLFLLTAAIGLFISNTATAVLMAPIAIATAKQIGASPYPFAMVVAVAASAAFMTPISSPVNTLVLGPGQYRFGDFVRIGVPFTLLVMFVCVLVIPWLFPL

SEQ ID NO: 22638 - protein, 491 aa, Pseudomonas aeruginosa
TFRFACQVESIEQSLAMATLLPQGRLFEDPAGHSLLIAGAQQHAHVGLFVIENLFFILVVRYPADIDSGPAEHGGYRALPEAPRDTGVQGGGEIAVVVANLALFHRIEGIPATGATESLHYLFSLSALLEGRGHTLVDQLLSRIQLLPLTQSAIQVRVVNAGVETKRHHFGVTVDATRLSAQVLFRIRPEPLHQAIRQRLVGRYSADLALYRLAQQCDLAHYLMQLVGDFAPQFRACVEHQLTRGTAGGAPLLQRDPADAPFEQAASLDTGLLDLAAGTNAGQGGAQRTQRPISAGQAGVLPGQSFRCQGRQLARLVESLQGHGQCLLQHHLLEHDGRGHDRRLRVLTGLRPGAGVGAQQFAQPVHDRHEGTHERRAQASEQPLTLRRVLALGQLLRFTGGGDLAGLNLSQTPTGGLVQFDGERRTLLERLNMHDGCLLLMFLRQSRNGKPHRLSGLAAVFSLESAAAKPKKREPRLTVSPGWHCSNGRLQ

SEQ ID NO: 22639 - protein, 387 aa, Pseudomonas aeruginosa
PCRASRSTCPRGSRLPLPGGSSNCVSPCSACEQRGAEGPGGRSEMRLRAIDGRPARSTVAVLASCSSYRQSPSVPADVEHEEVRQHPDHQQQVGQLQSLLADPVAEPEPAQQHAEEQAEGRAQDQAEPGPGRLHAGAEQQFATTGPGRDDGSDLQRTEAGRRRNRAVRGAPAWRLAGSDRRRLEEHRQPLRIIRIACQFRVFAGGDPLRDHQLAEAPGHRDGHPDQLDATVACQRLLAQRCLQPVVGRQQLPLHPLQPGAVAAFLGTQVQFVVDLHGFLAGHQRRADQTQRPCTGLRPLRQQTAFAAGQALQVIEDQAGVHQHGAIVQHQRGRLDHRVEQAERLEIAEHRQRPVLVGQVQQAQGDGDPAHKRRIQHTDQLHRGILCR

SEQ ID NO: 22640 - protein, 332 aa, Pseudomonas aeruginosa
LSAAKRATPGKITLVVAQREKYRDKFSESFRKTYMSDLPPLTALRSFEAVARLGSISQAASELHVTHSAISQQIKLLENLLGLALFVREGRGLRLSENGRFYALQVRASLGEIADATRVVRARPREGELVVTVMPSFGLNWLLPRLPRFRERHPHCRVRLVASLDVQNLRQGLADLGVRIGKGDWEGVGRERLFDDELLMVAAPDFNGGRLPRTPSEIVACPTLRSTESWALWCQRAGVAEPQHGLLINDSNLLLEAVRLGQGIALERRSLVAGALAEGRLVQLGDIRVPYPYPYWLVWPQREPPSDRHQAFADWLREEARRYQAEQPPLSE

SEQ ID NO: 22641 - protein, 208 aa, Pseudomonas aeruginosa
SRGSGRCRRVPSIRRRPSPATRSSPRPGASAPRPAPCRSAAASRSPPPRRTLRDHGQAGRARSAARRRAPRCRKPRTAGGRRRARAAGRRRRRPRSPASRGSAWAPAHRAGPPPSAPGPCCTARWPAPARPVRGPRATTTGCTRPAPDRRRWPAAGVPGYRPPAGSRLRRGSAWRPPSVRRLGSSGLGLHGTGAMDSASSHNPSRSLR

SEQ ID NO: 22642 - protein, 470 aa, Pseudomonas aeruginosa
GVRPPASVIPFWRAAQGPLMNRIKHLLKDLAILIRANLWLIPVIAALVAAVFYFVAPPPPMSATMATGAEGGGYAVFAGKLREKLKEQGFELKLVPSAGSRDNLERLLGTGEVDIALVQSGQERQLEAGQARQLQTLGAVYQEPLWLFHRSNVHIDQLSDLLHLRLAIGSDGSGTRAATEAILQANDIAPGHYPITWEARGGNAVVDDLLAGKLDAAFIVGPAENPAIQKLADNDQLRLVNFRRSAAYEARLPFLKRVEVGEGLLNLPRNVPERNISTLSPVATLVINERFHPALIPLVLEAAREVMKDGSLLDKPGAFPSAEPRTLRLHEDAERYYKSGLPLLQRYLPFRIASLADRYIILLIPFIAILIPLMKSIGPLYRWRIRARIYRWYRYIRDIDRKLDSGTDAEQLRSEIERLEKLESELNTVEVPLSYYHELYELHLHLNFVIKRLHGLQERQATQAEAGNLG

SEQ ID NO: 22643 - protein, 328 aa, Pseudomonas aeruginosa
AFMATPWSVFPVPGHAGRVSQCKTESPAGEGLSAQAHAERGAQPIGEGRGKGTDQHLAQRRERQRPPGETGGDRAAEQQRKQAGQQACDQRRGTVEEQERRHRHQGAKGKQQERRARRVHGLPPNSVGSMPRASRDKVSSAPRPSFISCRATRRADTSLSPLAVKISISSWVSVFGQSLSRRSSSAMRLLAISRALVTDSHSPRAIEQAPDTSPAIPVRTMDECAMLAPATPITRHRFDTRPSLAPSTAARSLVPASRSGLASGNAHCGGSASGRSGGVSAGMPQRASMRKPRRGKCTCTVPARGSSRRRMSSSLPAKSSSPCTASTP

SEQ ID NO: 22644 - protein, 281 aa, Pseudomonas aeruginosa
QSYADPAPIGGNDFMDNASPFQAAWQWRKFAICHLLALLLLILWLWGPTRELMNGFDFWLFDKLNGSLALNETWLKLWGLLSTRPFDAVVGVILLCLLIRGDWLLPANQVRRLTFGFIVTLLILVVIRVLYAKIAHHLHWQHASLSMLMDKAIHLSDHFPDWERVWEIKDRSKRSFPGDHASVLLVWALFMSLFARRAGQFLLIWTLAVLFMMPRLVAGAHWGQDDYIGGLQMALLALAWGCYTPLAAKASGWLVQVTEPLFRLLAKLPLIGRLGVVRDSA

SEQ ID NO: 22645 - protein, 234 aa, Pseudomonas aeruginosa
RSAPPRATCPGAPCRRLSRSLAFPVFVPPLSRDCHRQPLGSSSASSGSRLAAAHSPARMPAKRLECLPVKTFDQLSVIGLREWIAFPELGMVGLRAKIDTGASTSSLHASDIVPFERDGEKWVRFTAHLGTLVQRRHRCEAPMVARKTIRSSNGQAQTRYVIRTTLALGDRMWPVEFTLACRKSMRYRVLLGSKALIAGQLVVNPALAYVQDRPESPAALPAATSIDLLDGSPV

SEQ ID NO: 22646 - protein, 337 aa, Pseudomonas aeruginosa
STAATDAGNPVEPRALPALESFPDASRNRRMTSRPSSDQTWQPIDGRVALIAPASAIATDVLEATLRQLEVHGVDYHLGRHVEARYRYLAGTVEQRLEDLHNAFDMPDITAVWCLRGGYGCGQLLPGLDWGRLQAASPRPLIGFSDISVLLSAFHRHGLPAIHGPVATGLGLSPLSAPREQQERLASLASVSRLLAGIDHELPVQHLGGHKQRVEGALIGGNLTALACMAGTLGGLHAPAGSILVLEDVGEPYYRLERSLWQLLESIDARQLGAICLGSFTDCPRKEVAHSLERIFGEYAAAIEVPLYHHLPSGHGAQNRAWPYGKTAVLEGNRLRW

SEQ ID NO: 22647 - protein, 213 aa, Pseudomonas aeruginosa
AGGRRSRRRRWRAGRCRGTSRARSRSVGHARDADTAAPPASLRRGSVRAPRAATAGGYAGGSRCPAPAPSASAAGRFPCTASAARRAGRRCSAPSAGRKPWRWPRATPRRQPRTRGWSAPRRGCTGGRRSRPRSSAGRPGSAPWRTARRSAPARGCGRRSFAGTRAAFSSIGPVARRRTGPTPVAGKTTRPVHRCTGRAETQALRALPSGTNT

SEQ ID NO: 22648 - protein, 268 aa, Pseudomonas aeruginosa
AAEKRPVAPRPGDLPRTQRRHPQRLAEGRRGSAGHPAPMRGHDRRALRPVQPGPRRRQVAGRGGALDLEGQALYPPGNRPVRRAPRRRRGRGDQRVRAQPARPAAGRPGRPARHPRPRPGPAHRGQGRGGRRHRQAAGHRHRLPTCAEEPVGPDPSRARRAVRQAPGRADRHRQRHRQPRNRQAGRRTDQEISGHEADQDHGQRSRRIGVFRLRTGGEGVPRAGRVPARRRIHRPSPAGPAGGAGEDRAQVDRRRPVPARRVPAEAGA

SEQ ID NO: 22649 - protein, 427 aa, Pseudomonas aeruginosa
PGRGGRGLRERRRRRRQHRLRRPAGTHLRPQLDAGAEHRRAPRRQRSVPHPRRAEESQPPGRKDLRASRRLPPRDERRQPAGRLGGAPGDLSAGAAHRRRHRARHPLADRRLGVPQAPRPEEVHRRDLRPADRHRHPQGTRQARPRPASGVQDRRIPGRRREPQGPQAGHGPGGRGDQRHQLRRVRRHRRPPGRPGAYLGAVREVRQGSVRSGQGRRHRQGQGHGSGHPAQPCRPVHAHERHPRREGRRPARRASHRQRPAAPGAWRPARTERAAGEQRHGRAVRQRQATEEEVTEPSMSEMPAREQMISAYSELVGLDPVSLGDGVAEVRLPMAAHLRNRGGVMHGGALFSLMDVTMGLACSSSHGFDRQSVTLECKINYIRAVADGEVRCVARVLHAGRRSLVVEAEVRQGDKLVAKGQGTFAQL

SEQ ID NO: 22650 - protein, 127 aa, Pseudomonas aeruginosa
RSGRTSCSNESPTPRRCSTAHAAAKPTRRRWQRQRAKVADAELTPSAQVLKVMRERGESFEAFSLRQSREHAEYFRQHPLAAEEQARFEKMASDSLAEQTELERDQDGDFDTFVAAYQASILGLISN

SEQ ID NO: 22651 - protein, 402 aa, Pseudomonas aeruginosa
PLYAAGLEAALAEPVRGPRGEHEQGLQAESARALLDPLQQFVATPAVAVLRVDRQTGQLARLGIGDRVERGAGDDQPFALDDAELFNLAFQHLAGTAYQDALLFQRADQLDQPANVLNARLAQLFELLLGDQGAVAGAGEQLAEQRAVLGVADDMAALDPGPAGLRRGVQQLGLVAVAQPLQVRGHLLRAQFADQLAGCVQQALFGAVENQLFRFQVDGGAHGHVFAGQVEDFPGRRVAQRREQDDAALVEKAANALAVDATDLAGMVVVDTLDHADRPRGDQVAASDPQARALHRRGGHVHRQPRLDGDAQTTHGVDDAFQGRRIGHSQVAVIARSQAARGQARLDLRARTVHQHQARAEAVEKDQVVDDIAEIGMLHPFAGEHDHEGAVPVRVDVGRSVT

SEQ ID NO: 22652 - protein, 251 aa, Pseudomonas aeruginosa
AASFAVPSGAHPRERGKSMSEYFHHVLVGLLAVLPVANPLTSVSLLLGLGGSLPPAERNRQIFKASLYVALIMLVSFYGGSLVMQVFGISIPGLRIAGGLIVAYIGFTMLFPATTPDETEVQHDLLSDEEKITPHFRDLSFVPLALPGTAGPGTIALVVSSASTLQSTYGSIPLFIHLAAITVTLLTALIFWIALQSSGRIMKFLGESGIDAISRVVGFLLVAMGVQFVINGGFELVAGHAALQSAAGVRQ

SEQ ID NO: 22653 - protein, 208 aa, Pseudomonas aeruginosa
SMLTWCRSASGRRRWRIASRNCSGCMPGSGRRSNSSEHWPQMRLGLSPPWMQPKFRVGWGTLNCGLFQARCHSPRSAISSPMVACMASRALRPRFGSDEWPLCPRISMRSIITPLCRRIGRRLVGSPITVARPSGRPLSARARAPAIELSSSQVARIISGWRNGWSSSGSKASMASGKKPFMSQLPRPYQRPSRSSRRSGSLLHSASS

SEQ ID NO: 22654 - protein, 194 aa, Pseudomonas aeruginosa
LASRLNLPGETSRISQRKPRSPSQEASRSTTGRLVWSSSGWVQLTEDAAISAPNWSFRDGNGMGLSTRIEPHHGLSRRWIKPSVPVPPAPADEDRAQAPNSARRTRKHRIASTAPAGRVTTQDRKIEPITRRLSAPIPRAMPMPSTAPTRVWVVDTGRPMAEAPTTVEAVASSAAKPRLGVSSVISRPMVAITR

SEQ ID NO: 22655 - protein, 140 aa, Pseudomonas aeruginosa
CPATSARPSAATACSTRTATRSIPRPRNCWRKPRWTVPSPPSPGTCSAAASDWPNSIVSTATGACWRTGCNTCRTCVPCSAASARRCHAPAVASCAKRWTLSSPTGRRASSAAVTTRRYASRRRNCSAANSTRPAGVCSP

SEQ ID NO: 22656 - protein, 608 aa, Pseudomonas aeruginosa
NKLRRYRHHPKGVCMSVFATAAQDRLLDLGDLLRELVAQGRVGQEQAEQCLAIRRSAVRNQQHPLEFLAAQQVEDLKRPGRKLDLETLTQWLAEYAGQPYLRIDPLKIDVAAVTPLMSYAFAQRHGILAVALSPEEVTIASAQPFVQGWESNLVHVLKRPIKRVVANPADIQRYTVEFFRLARSVSGATSPDQKISGVGNFEQLLNLGAADQEPDANDAHIVTIVDWLFQYAFQQRASDIHIEPRREQGTVRFRIDGVLHNVYQFPPQVTMAVVSRLKSLGRMNVAEKRKPQDGRVKTKTPDGAEVELRLSTLPTAFGEKMVMRIFDPEVLLKSFDQLGFSADDLRRWQSMTSQPNGIILVTGPTGSGKTTTLYTTLKQLATDEVNVCTIEDPIEMIEPSFNQMQVQHNIDLTFASGVRALLRQDPDIIMVGEIRDLETAEMAIQAALTGHLVLSTLHTNDSPTAITRLLELGVPYYLIRATVLGVMAQRLVRTLCPHCKAPMQLADSDWHELTRPWSAPPPSGAHQAVGCLECRDTGYRGRAGVYEIMLLSDSLKELITADTDLVALRRQAYKEGTRSLRLSGAQKVAAGISTLEEVLRVTPQSEQK

SEQ ID NO: 22657 - protein, 74 aa, Pseudomonas aeruginosa
GLCQIPVTSARVCGARFSGLSSAGQAPLSTLPISALMLSIASTKRSSSAFDSLSVGSTISVPGTGKDMVGAWKP

SEQ ID NO: 22658 - protein, 482 aa, Pseudomonas aeruginosa
  UNSURE (136),(137): Identity of amino acid at the above locations are unknown.
TVPGSAAVLLRGGVLCPLFPGRHVHLYRHPSQPSAVQPGHRSARLDLRGVPPRPAGDSRQRPPGPHPPAPPVAAGRIAAGRVRLAADPGAGPADDSRRPGPQRHRRVPRTVHGQRLHRQQCRDRQGRCRRPIPDLXXRRRQPRRGTAGAILGALGLAGLPGPDPPGPVAAVAADPLRLVRTTGRTRGPARVARKTVTIARTTRTDRRLAMNHVITPHSKLLGVIEPVLNDMPAGTLRHALFRAFWDETASLLDIEDAFARVTARRQAVEPLRKFFASWSKTNNSAASVSGLANRLTLLARSEQGSAAADQLYRACGSLQRITDEDLGALGNTVHADLFYTMATTLCGDDRWLLRENCLPSAQAFKDWTDRQRLRERDLMQGLLTTLVHEVYTHGEVEYIHPLYKEWFSRDMGVPAERARATVAWVTVHTGGTESNHFAHATTAVNAFVEAMEIEVNEEAARNLFGLYLRNKAQVMRDCAALF

SEQ ID NO: 22659 - protein, 436 aa, Pseudomonas aeruginosa
GLAALPSGGPPRSDSCQRRQVAAEAKRLADEQRLRLVMAVDQAQAGVAQPAQRQPVGLEQALEAFHRRHHAQVVRHPPPLEATQHAFVGKPFAALQGVQQDLGQHRRIEEAQVHALSGQRVDGVRSVADQRQARLDVTLGVPLAQRDAQAPVGMQDGAQALFEGFAEGGAEAILVQRHQAFCLFRGGRPDDRAPVLVAAVRQGQEGQRTVVGEALPGGCAVRVLAAHAGDDGVVQVIPFAGGAAGQAAYRRVGAVGGDHQRRTQLATVGQGQQPVVAGVAHLFQARIGQQAGGGIVQAFQQGVLHHPVLDDMAEYLGVHAGGAEADPPGAGAIPHLHLAIGLGAARDDAVPGMQALENPPAGFGQRADPRLVGRLRLERRHVERAAVHQQHLQAAALQGQGQGATDHAGADDDQIRVHILVLHSWALFRPRSAGAA

SEQ ID NO: 22660 - protein, 497 aa, Pseudomonas aeruginosa
ALPGAKGSISTIDQPRSRAPACRASASEAPTRPPPMIARLTLLIVTSGCLALGRGHQRLDLGDGLRHAVGQHFAAIAGDHHVVLDAYADTAPLLRHRGIVRGDVDARLDGHRHARFEHPPFAADAVLADVVHVHPQPVAGAVHVESLVGLVGDQLVDVALQQAQAHQPGGDDPYGGLMGLVPVATGGDVVERRHVGFQHQFVDRLLLGTEAAIGGEGTGDVAGVAVDLAAGIDQDQVAVLDRRIVLAVVQDAGVASGGDDRAVGRHLRPALAELVFQFGFQVVLEQPRPAHLHRPDVRPGGDLGGVAHDLHFVGALVQPLVVQQVVEGNELVRRLRALAGLGADHVDPVHQPAVEVGIGAKGVVDPVAAFDQAGQDVVDIADGKGVVGAVLADRTVLAGAQAVPQFTLRIPLAAEQHVFAVSTAGNQRHHRLRLGEAGEVLEVAVLAVDMLDVAIADVHRRRRQDGDAVGFHLRHQRLAPTGVLRLGDTDHAETSVQ

SEQ ID NO: 22661 - protein, 131 aa, Pseudomonas aeruginosa
KPWSRTHEPVEYPHRADSRQGILHQLPGRRARQPGKRRPLPGRQDARDPLQRQSHRRRPGCRDGRPQHHPRPAAPQGAPGPGKQLDPRARARTARSRRPRPGESGRCRRSLTRARPIRVYWPPLPGVLASR

SEQ ID NO: 22662 - protein, 183 aa, Pseudomonas aeruginosa
PDSGTTGELPFHMIESQDLSRPALRRKLRQARRALSPLQQRLAARALYRQLAQHPLFRRARHIALYLPNDGEIDPRPLLRAAQNRGQGHLPAGAGALAADAHGIPAGRQRRTLDPQPLPHQRTAGRRRPPAQGLGAGPGTAAAGGVRRTGRAPGHGRRLLRPQPGLPGEAQKWSQTDADRPGP

SEQ ID NO: 22663 - protein, 231 aa, Pseudomonas aeruginosa
AEVIRNYTGDRWSRADVSYVYLRKRSKVHACLLADEIRAGRTLDPRPATPRNRPLGWRAQLSGAQLHPQHEPRRPVLLLPLQLPAARHRRYRPHRRRSLPRSHGPGSRQPLPRPQGQRREEPLERPRRQLRRSLRRGRSTGPAEGPGRPGQPRPGAEGQPPLGNAGQRRGMAGDPAAGETLKPSLRPSARWSGGNARARRRRTPNRSPRYRRTAARRCRNRRRGTGSPGPG

SEQ ID NO: 22664 - protein, 139 aa, Pseudomonas aeruginosa
RWSPRRGATARPSAPRSRREPPGRPPKWARRGSGFPACGSPPPPATDAGECPAAGRWAARRPPSPGRSAGAFRRPVPGCHPPAGGTAGRATPGSAARSARHTGKRPGTCSRPGDGSPCRWRPPAGRTARTCLRWPAAGR

SEQ ID NO: 22665 - protein, 216 aa, Pseudomonas aeruginosa
TPTRGSASRYARATPAAYRWPGPFRRPSPPASRSARLPPCRRWRPARSCLRGPRGYGRSAPRTGCATAGRRRWSARRGSAGRDRGSARSTARASASCRRTACPQDARRTAPARCSAAGRRCAARARPCRGRTADRRSRRSRTPRASGRGSCPAPGACRRCAGRPPGGGGGRACRHRARGSRHPASSVRRPAAPAGWTCRPRPDRSGRPCGWPGSPG

SEQ ID NO: 22666 - protein, 420 aa, Pseudomonas aeruginosa
RRPPRASRRSAAKRPGGSPRRSRQRSLRNLDLQVGRPLDLRVQSQVGHSGHAGLDVGDVFFQQRRIEPRLDPEHQLLPLVGGFHRFRGELGDAGDIGNLGRDHVVRHRVDHQAHFLAQSDPAGLHGWQEESHVDVGQVDHVEQLATGRQHFPRLCHAVLHAAVARRLEQAVVDIRLEPGDAGLGRLDGRLRLDYLGTPGLDRRLRRNHLRACRGQRRLGALQGRPIVVELLLRQGIALDQRLGTGEALLRRCQLGLALRHHGLGGALLALALGHQRGRGELGVLRLAHLGLGLGQLRLEHLGIHPRDDFAGLDEVALVDLDLGDPPGKLGRHVHLGGLDASVAAGESLAQAGRSRYLPDQHAYAEQRRHDQGTAQPPFAFLFHPFSSHVRPGRGDGAHAGKRGRRGLHWLDCPSRAARRC

SEQ ID NO: 22667 - protein, 412 aa, Pseudomonas aeruginosa
TGLFAPSPSGAASSAEANDGNRLRHRASDRAMGVLTGASPRRMPASIARLSAGPKPGVYGQPSVAAMLIDPRRLPPTLAGPQTGASPMKAVLCKAFGPASSLVLEEIASPSPAKNEILLDVHAAGVNFPDTLIIEGKYQFKPPFPFSPGGEAAGVVAAVGEKVAHVRPGDRVMALTGWGSFAEQVKVPGYNVMPIPEGMDFASAAAFGMTYGTSMHALKQRANLQPGETLLVLGASGGVGLAAVEIGKAMGARVIAAASTPDKLAVAKAAGADELINYSEGSLREQLKALTGGQGVDVIYDPVGGELFEEAFRSIAWNGRMLVVGFASGSIPSLPANLTLLKGASLVGVFWGSFAQRQPQDNADNFRQLFAWHAEGKLKPLVSQRFPLERAGDAIDALGQRRAVGKVVVEVR

SEQ ID NO: 22668 - protein, 459 aa, Pseudomonas aeruginosa
KGATQQQAELAMFGIFRPAPHQAPLPDAEVDSTYRRLRWQIFAGIFIGYAGYYLLRKNFSLAMPYLIEDGYSRGQLGVAMSAIAIAYGLSKFIMGLVSDRSNPRVFLPFGLLVSAAVMFIFGFAHWATSSVAIMFVLLFINGWAQGMGWPPSGRTMVHWWSQKERGSVVSVWNVAHNVGGGLIGPLFLLGLALFGDWRSAFYVPAIVAVGVAVFAYFAMRDTPQSCGLPPIEKHKDDYPEGYDEHHERELSTKEIFVTYVLRNKLLWYIALANVFVYLLRYGVLDWAPTYLKEAKHFNVDKSSWAYFFYEWAGIPGTLLCGWLSDKLFKGNRGATGVVFMILVTVGTLIYWLNPAGNPAIDMAALIMIGFLIYGPVMLIGLQALELAPKKAAGTAAGFTGLFGYLGGSVAANALVGYTVDHFGWDGGFKLLIGACLLAILFLCLTLRKPAVQAAPQQAG

SEQ ID NO: 22669 - protein, 501 aa, Pseudomonas aeruginosa
GRLDIYFSPGMKKGAPVKPERLLQFPGRLLPFHRIEELIVGLGLLELVDEEFDRGDLVHRVQDLAQDPHALELVLAGQQLFAAGTRTVDVDGREHALLGDLAIQWEFHVAGTLEFLVDHLVHLRAGFHQRRGENRKRTALFDVPRGAEEALRLLQGMGVDTAGEHLAGAGDHGVVGPRQTGDGVEQDDHVLLVLDQALGLLDHHLGDLYVTGRRFVKGRGDHFAAHGALHFGHFLRALVDQQYDQVAFGVVAGDVAGDVLQHDGLARLRRRHDQAALALADRRAEIDDAAGQVFGGAVAGFHLHPLVGEQRRQVLEENLVLRILRTIEVDRVDLEQGEVTLALFRRPDLADDGVARAQVEAPDLARRDIDVVGAGQVGRVGGAQEAEAVLKNLQHAIAGDLFTTFRVLLQQGEDDVLLARTGHVFQAHGIGHFQQFGNRLLLEFGQIHRKEIGTQKEELEKASSLGKPCRKGATGALESSSRKCVRDGMQKATEKTSRTRI

SEQ ID NO: 22670 - protein, 556 aa, Pseudomonas aeruginosa
FPIDRLPHWRPSPYRGRMAQFSNGLAKHAAKTCRGIPADCRPGPGLQQFPPLSGQGQYPRRSPHPRTAGREGPTGRRPRRGAQSQRRGHPARPRLPAPLRPVHQRHAPGFRTRGRDQRLARGAQPQRFHPSCGRGSRPSRGSHLRPRGSPPDLPRRRQQHARQRRSPAGQRHRRRQHRVHHRPGFRVRAAGKPADGLRQLHPTLLPRRQDHPGPLRPGVHCCTPGTDGHREQPAAPRLATGGRRLRHHPRSGAGDQGRRPRQRRDQPGRTGLAEAQGAQARRRGEARSGRDQAGPPDHLPGRTGHSRSDLRRAGTGTDGSLRGRPARRRSLRPGRPSPARGRARTHHQLADAALPRRSGAGFAGGGQGPQGACRSRRRLGAERRTAPRPAELGRTGPRDRPGHRPLPLPQARRLLDRALRPGWLLAPGPADAVATGTRPPPQHSGGQAGGVRRGRRQAGTPVHRAALRDPLPPHSRHPGNALGASEGRAQEPFGDLPRGLAGSQPADPGRLRPGSRMAQAGRLQPQRAVSTGAASFSSRVAWVLRGFWLPVGLSRW

SEQ ID NO: 22671 - protein, 255 aa, Pseudomonas aeruginosa
LKVAASCRTANHRKKPAAKAIHCTINDLSRDDRAFPTPSTELGCAFISLRCPDDAPTIPAGLRLFRPFSRYFLRGRNHSRAGRVPCLPRLHAAGYRDSHRLPRQLRRRPTLVLPRTPPRPPVAGAQAALAEARRQGAGPCAPPSRPVGAEFPLRLRPAYGDAGGHRPVRLSTGPLSSSQRHRRHRLGRRAGLRRLLFRQRTGRHARQHQEIRTHGPRRPDRAGPAALAMAAFQDTARQRRGRQRRQIRVNPRRRD

SEQ ID NO: 22672 - protein, 270 aa, Pseudomonas aeruginosa
TAGPFAHSNSLYPPLRLAAGAGGSLCLRDTDPGQARPVRILRSQGVSLMHKKVAVILSGCGVYDGAEIHESVITLLRLSQRGAEAQCFAPNIAQHHVVNHLTGEEMPESRNVLVESARIARGEVKDLREARAEDYDALIVPGGFGAAKNLSDFAINGAQCQVQPDVLALAKAFAEAGKPVGLICIAPAMAAKIYGAGVQCTIGNDADTADALKQMGAEHIDAPVDEIVEDSARKLVTTPAYMLAQSIAEAASGINKLVDRVLELVDQDKA

SEQ ID NO: 22673 - protein, 186 aa, Pseudomonas aeruginosa
WRNSASRRQAAWRPLPACPWPAPAVAPPGFPGGHRATPGGRPSAASRWSGANRRRRCPASFPPARSPPGRPPPTGRRPGRGRLRDRPRSSCPGWRRYSRSTAQDRAAPAADAHAGRGSSPQRPRRRARRLRPESAWPGSPAGRHGPCPAAHCRRSGRPHSWPGPSAGVRRAGRRTPACRCRPRPGR

SEQ ID NO: 22674 - protein, 309 aa, Pseudomonas aeruginosa
HARSQPGVAGHDDQVDDDHGAAHDQVLRQQRLVRVDELRQHREHEDHRLGIAGVDQETTQHQGQRSPQRPFAIGAQGLWRRLPLAHRQVHQVGHAEPLDQAESQCRGRQQRTDAGGDNGDLQGQADLQAQRVPVASRKAVLQPAGHRGDGSGARRQADGPAGEEEGEPGTDEHCTPRKANAAGGGNEKASVHQGGAAAQVFRPRASPNLCGRNLADRKNPADAGLSRGYVLSHVGQTTAMRLFALAPNALSPANPCAASPALRRACAPGLRASGCSAPPPPGRRPWRSRRSLSARALRRTRPPARCRPR

SEQ ID NO: 22675 - protein, 276 aa, Pseudomonas aeruginosa
TLQRLDPALRLARLGGLGLEAGDEAFHVRTLRLLFLVGLLLLSQPLGAGPLESGIAAAVEGQLAVFQMHHVVHHRIEEVAVVGDQHQSAGITLEPLFQPEDGVQVEVVGRFVEQQQVGRAHQRLRQVQAHPPTTGEITDPALHLLAAEAEPGQQLARPCIGGITVGVVQLGMQARQGRTVVRRFGDGQRRLDLAQATVAVEHVIHRQAIQGIDLLAHVRDAPVGGQQAVAGILPELAAQQREQAGLASAIGPDETGFLAGVQGQFSSFQEALRPAL

SEQ ID NO: 22676 - protein, 161 aa, Pseudomonas aeruginosa
GCMTGNVWKFAVDVYARPGVETACLALQEQGADVCLLLVAAWLGRRGVSCSKERAQILENAARPWRETVIEPLRRLRCAWREAATHDACLAELREEMKAQELRAEREHLQRLADLATAWLEGQEANRSADAWLQACSRDICTEAERRALLVLGSAALQTAP

SEQ ID NO: 22677 - protein, 251 aa, Pseudomonas aeruginosa
EALVGAAPLLPAAGVAEAALEAAAGALGVAAGFAAGAVAGLVAAGFAATGFAAGLAAGFAAGFAAGLAAGFAAADFATGLAAGFAAGFAAGLAAGFAAAVFAAGLAVGFATGFAAGLAAGFAAAVFAAGLAAGFATGFAAGLAAGFAAAVFAAGLAAGFAAGFAVGLAAGFAAAVFAAGLAAGFAAGFAAGLAAGFAATVFTAGLAAAFAAGLVAGFALRLSRALPAASFTLPTPCASLRLSCTSRLRPTM

SEQ ID NO: 22678 - protein, 203 aa, Pseudomonas aeruginosa
VRVSACRAFRVSNASSRSLMVSRALACALVLPALAASCSLVRALCSFSWALPRCFSSLARSFSESTSACLHAPSRCSTRLWESCCNRCKGVVTGFLLADMTCLQADVVAPILDPHTPSRQRVRCATSDVRQDCPPIRLEKPHAAPPFHRSFSTAAAAFRRASQGRTGLCRRRPPGYAPTAGNARPRAIRATSRTAPGLSRRGT

SEQ ID NO: 22679 - protein, 190 aa, Pseudomonas aeruginosa
RHRRGNPGTRPLPRPACRRSSVRPERKRRVVRPGQCDRGMADSVASDACRRALASGDSFGASLWSRRRWRPDPARRSAGLRDRPAGLPLKCKNGALPHGDAPFRNDSPVNQTGTAEPSAPLWLWALCRTSMRQSSSSKRSCNCCRRTFSSAMRQAPSRQSPLSQRSLKFSADSVMASSRGKICLASSRPR

SEQ ID NO: 22680 - protein, 145 aa, Pseudomonas aeruginosa
IPLRASKACTSCWRSCSQRSISWCTPPHRSWALRQLSSMLSSLPSSDVPENHRPLRDALLTHSLRSVGERLCKGRTPALWKARLCPRDDPIKTPVQKNSYGCLIGIPHPLWFSPNRYGRRSRADERPRDSPHQARRRNCTMEKPR

SEQ ID NO: 22681 - protein, 132 aa, Pseudomonas aeruginosa
RGLARGMADPQVHRGKAAYGSGKPPAVSSRKAALRQGIPNHAGRPRQAATVLPMEPNGERRVAFPMLKSPPPPRAAPEYADRAGPGPPGTTGCCARPRRAAPAGVPARRRSRHCAGSSGWPPGIPGPCPRAC

SEQ ID NO: 22682 - protein, 457 aa, Pseudomonas aeruginosa
PPAPSCRAGAGPGAPAPPAARPPPAGRGTTTGWIRNGSSCRRSAHSRPARRSPAQPAWRPAPPPEPGGRCVSWTALRGRSRLRLGHQVAGGLAARHVRLQGAQGRCDVRDLHGDRLLRQLIDTQLQRTAVGQLYVEIAVQHVLGLLQRLLVDFLLAIQRRPLGLLQGQADGQAHLRQLLAGQQRTNVLAGIEVDADVARDLLPPQLPGAVAVAPGDIAGTAFAFLEGRRERLQLVDLLAQRRQLHEQPGTVRLRQRTQGLEAGRQLGTGGIGAGIVLRAQDVIGALHQLGGATHVLQGGQAQAGQAQQVFGLGQSPLLAALAEELLQLLAEMLLVALQLHHKASPGLQFVRGRQSVQAGSQLLVALGQGFGLATGIFQLRQLVALGALQLLDLPEAPATRAESRHANQQGEQRQAGGGTGTPGCIGCNGRRGGSGSSCVVLGSDCFAHRSILWSRKF

SEQ ID NO: 22683 - protein, 683 aa, Pseudomonas aeruginosa
CSATAVQPRVRATTNRQQALPASATGRRASNGRRRQNSAAESSTIHCTNSDARARRTQLKLGVIGSASTSTSTSSSASSTRVNRASASQSSGMKKSSWTAGRVERPGLNRIGIDRVSARPVAPARQPRAYGRNKAPKCHLPQKTAKQRSFRLRRRAAGFSSRPAIIVALCPSRRPRGLSVSCCSERYHERREDQPVLGRPLQRARRRLRRPFHRLRRLRQASLPPRHHGFHRPRHDAGQGRRAERRRARCDRRRPATDPGGNRSRQLRLARRPGRRAHEHRGAPDRPHRRHRQEAPHRPLAQRPGGHRHPPLATRRDRHHPRRDHPPAGGPAGPGRSGSRHHHARFHPPADRPAGDLRPPPAGLVRDARPRLRAPGRLPQAGQPHAARLGGPGRHHLPDPARDHLPVAGLRRGWRQLPGRRLRPRLRHRILRRRQPGDDAPVALLGRAGAVDQRAVPVHRPARPLLHRLLDHAAEEEPRRAGAGTRQVRPGVRRPHRLADPDEGPTAGLQQGQPGRQGTAVRRRRHPARQPARLRRHGPGDPAPARDHARGGTPRFLHRHRPGRLPGAQGPAVPRLPRDRRPRSEVRRRQRQGPRRDEPRRTAPLQRADRRRRLRRADPGRLGQRPRPYRRHRAEPGPCRRRPRQKTAGTALKSRPVPGRSPCPTRDLIARRDRNALVDRQPL

SEQ ID NO: 22684 - protein, 65 aa, Pseudomonas aeruginosa
ANQGVELLYVPPPLSGGFSHYANSQSNPYKKIAQHPKREYYIRNSARVLELPTHRVAICLSTSNL

SEQ ID NO: 22685 - protein, 136 aa, Pseudomonas aeruginosa
PAAGRDRLRGRSPAPPCRPAGWRWHRSSFPPSRRQRVTSNCCCRRPGPRDPSGIAPSPDRSDRSGFPRPSGRSPPRSACRGCAASAASVGDGRTPPRAWPGSGCGNPAGSRPGSPRHRRRCFPPAPEAAAPRESPR

SEQ ID NO: 22686 - protein, 521 aa, Pseudomonas aeruginosa
RVRMTYSSKLSSHYLELAEQPISKDVFAGEDVRFSSEYEALENELGKALSLHENGQTDWLKILENSEALLRAQSKDLRVAAWLTWALYQRESFPGLLAGLGLLERLCSRHWVEIHPLKARTRAAAIAWLVPRLEQALNENVPIKEQLPLFRRLAEHLEKLDTALTAQLGDDAPLLLPISRRLSGMLQRAADNQPEPGVVGAVVAQVKQAASQLLAPGAPIDNERDAHKAMRAQQEAARPLCAWWLKQKATDLRALRLNRTMLWLPIESMPERNAEQVTALRGVPADKLKSYQERFAQGLYADLLVELEASLARAPFWFDGQRLVWECLQGLNAEQAMREVEMHFALLLQRLPGLVELRFHDGSAFADAATRGWISAHVMPHLQNDSAPRKVETVALQAEWDVALDEVQPVLRKDGLKAAVQVLKQGMKRAHGGRARFFWQLSLARLCFLAKKYELAKTQLESLDHQLHESGLHAWEPDLALDVLHLLHSCCELLPQNHAVRERKEDIYRRLCHLDLEVVLE

SEQ ID NO: 22687 - protein, 509 aa, Pseudomonas aeruginosa
APPPPRTPEPPPSQGSRYMSTSAAQQGRNQNGEYNILDSIIAETRLSPDDEAYDIAKRGVSAFIEELLKPQNDGEPVKKAMVDRMIAEIDAKLSTQMDEILHHPDFQALESAWRGLQLLVDRTNFRENIKIEILSVSKQDLLDDFEDSPEVMQSGLYKHIYTAEYGQFGGQPVGAIIANYYMSPSSPDVKLMQYVSSVACMAHAPFVAAAGPKFFGLESFTGLPDLKDLKDHFEGPQFAKWQSFRQSEDSRYVALTVPRFLLRTPYDPEENPVKSFAYKETVANSHEHYLWGNTAYAFGTKLTDSFAKYRWCPNIIGPQSGGAVEDLPLHHFESMGEIETKIPTEVLVSDRREYELAEEGFISLTMRKGSDNAAFFSASSVQKPKFFGISAEGKAAELNYKLGTQLPYMMIVNRLAHYLKVLQREQLGSWKERTDLELELNKWIRQYVADQENPSAEVRGRRPLRAAQIIVSDVEGEPGWYRVSLNVRPHFKYMGADFTLSLVGKLDKE

SEQ ID NO: 22688 - protein, 139 aa, Pseudomonas aeruginosa
AELSMTGYGSLFERLNGDADKRVGWSREVSAMASVAAHLGKMLSTRAGSVQTLSDYGLPDLNDMRLSLHDSLSQARSAIEGFIEAYEPRLSDVRVVSLPRDNDQLRLAFSIEGLLEVGGFKRQVSFSACLDGSGQVKVS

SEQ ID NO: 22689 - protein, 596 aa, Pseudomonas aeruginosa
AVSFNHYYQSELTALRQLGRRFAERSPALAPFLGQVGRDPDVERLLEGFAFLTGRLRQKLDDELPELSHSMMHLLWPNYMRPLPAFSILQFDPLTRPGGALRVERDTPVESRPVGEVACRFRTCYATEVLPLVLEALNYSVTGEGALLGLRLAMNCDGHLGELGLSRLRLHLAGERYISQMLYLCLLRNLESIQLIPLDAHGRPLDGVAGKPMSFRLTGERVQPVGFAEDEALIPYPLNTFRGYRYLQEYFAFQDKFLFVDVDGLDLLGALPEETLKQVRGLELRFDIRKSGIQRLHPTLENVKLYCTPVANLFRHDALPIRLDGKQDEYLLMPAEYSLEDCGVFSVEGVTGWRPGGLGYQAYVPFESFEHDPSFDVPEARPHYSVRQRTSLLHDGLDTYLSFGIRHPEQIETLSVELTCTNQNLPQRLRLGDICVACEGTPEFLGFRNITPATPSYAPPLNRDFLWKLISNMSLNYLSLANVDALKVILETYDLPRYYDQHAAKVSKRLLGGLKAVRHEHVDRLHRGLPLRGLRTELTIDPEGYIGEGDLFVFASVLNEFFALYASINSYHELRVRSTQGDVYQWKPRMGLQPLL

SEQ ID NO: 22690 - protein, 135 aa, Pseudomonas aeruginosa
SSRCCATTSSMPNWSPSSVSNGASRSSKSSATGSACSTASLAKTRCWANGSATAAASSAFISASSTGSASTSSCRSVPATSRFARWFASPCATRSTTTSGWSCATRKSVSSASARRTPAALAGPAGWAGSARMAW

SEQ ID NO: 22691 - protein, 198 aa, Pseudomonas aeruginosa
RSCVAWPGFTRKATVSTCATTRWWPPPNCPPATWRVASCRTRPSTSSTPPVRGCASAWRRRRRVSSACAASWPKASASARPCAAMPRQACRSTTMPCRRWRSAWPRRKASGTYRRTSGAASANSPSACSPCASNWPGPARRTGKSRAARRTRRLSRPTSMAVSKPWKRPFTKPARHSPMPRPRGGWSASRSARAWLPR

SEQ ID NO: 22692 - protein, 552 aa, Pseudomonas aeruginosa
STTCWTRTCCRWWPTVCWKRWRATSVSSGSMRRWASTAACSASSPEVGAMFSRVPQPLAFAEALLAQFGALSRETDITALLGGFARAVGELSGCELSQLYLLDQTHTALTLNAECRDGLLQALEPSSLPADYTGEQLLQFALCQNRVVSLVDLPSRLHETGFLPAGEQPWLSLLCVPLVSPEKTVEGMVVCATRRPLDLQGFAHPLGQLGSFVLAQLHLLQRLSQPSGEPQGPSSAPVVSGYGLIGRSAAMRETCRLISKVLHNPYTVLLQGETGTGKEVVARAIHEYGPRRAQAFVVQNCAAFPENLLESELFGYRKGAFTGAERDRPGLFDAADGGTLLLDEIGDMPLSLQAKLLRVLQEGEIRPLGGNDTHKVDVRIIAATHRDLALLVRDGKFREDLYYRLAQFPIELPPLRQREGDALELARHFAERACVFLRRAPLGWSAEALELLDGYGFPGNVRELKGLVECAVLLCEGEMLLAEHFSLRAPPEAEAPLKLREHLEQIERDLLLACLRRNAGNQTLAARELGLPRRTLIYRMGRLNIHFGDPRT

SEQ ID NO: 22693 - protein, 476 aa, Pseudomonas aeruginosa
SRFPSNQPSRARAWSAASAALPWRLPDACSSLARRASGPGRPLRPRRLQRQLQIQRRRLSPAWRSAGGQSRQVTARSDLMELVLEMLSAKQFVPTELCSKTFGRNGGLIGRGGECDWAIPDRKRHLSKQHARVSYRNGAFYLIDTSSNGIRAGNGSRLPHGEPQRIEQDSVFLLGDFEIRARLLREPDELAMDVGRPQPAGSIIPDDAFLALDPLQALDQDGADAYELDDLSAIAQPSHEAGARADYARIDMESLVVPELVPAPAAPQEPVESPPPERDEAFWQRFGQALGMDLEGLDGAAREALAINAAGLLRQCIGGLQQSLRTRSELKNELRLSLSTLRDTGKNPLRFSADAGEALGHLLRDGKPGQLSGEQAVARSFRDLQAHQVALLGASRAAVRATLEHFSPQQLTLRFERDGRRPLLATSGSRWRAYGRYHQSLCQDDDWSERLLARDFAQAYEEQVRLISTLYTEHQG

SEQ ID NO: 22694 - protein, 299 aa, Pseudomonas aeruginosa
TEILGHQELNMIKEREYHEDEKTVLLDHQGQVPAQGPLTDFAEPPRFEQLEERMIYAARLRPGEAFNVSLNPLVAAASELLSEVVRLKHSSVLENLAALKERLTSAMKLFEFRAVQDGVENSQVMAARYVLCTVVDEAVVTTPWGNESEWSKISLLSSFHNETFGGEKFFQLLDRLSKNPVKHLPMLELMYLCLALGFEGKYRVMARGVLDLDGISDALYRQIRQLRGDVPRELSPHWQGLSDQRRGLVRIVPWWMVALFTLVCLVVMYSGFAWVLGEQRDTVLQPYQSLDAAAGQPGS

SEQ ID NO: 22695 - protein, 501 aa, Pseudomonas aeruginosa
TQGREMKNFFKKVGAFLRKTWVWTLLLVLLAALLVWFVGPLLAVADYKFWESPTSRLLSISLMFLVWGLAMVFVSWRAGVRRKAVEDSDEGQERLRRDGLIEDEQKELRSRFKDALRTLKTSSLYRGRSERWRNELPWYLLIGPQGSGKTSLLDFSGLEFPINRIDRKLTRDTAGTRYCDWYFADHGVLIDTAGRYLTQADGEVDGGAWATLLGLLRKRRRARPLNGVMVSIPVETLLSDDEMALDTLARQVRARLQEIQQTLHLDLPVYLVLSKADQLLGFDEFFDQLSREESDQVLGTSFGKEQNGTDVTVLRQAFEDLLRRLNSQVIMRIHQERDTLRRGRILDFPHQLGQIGERLCLFVELAFTGNRYQRASRLRGFYLTSAPHLAQQLDEDTAGIGANLGIASGLLPTLRNGRSRFIHHLLSQVIFPEANLAGLDRRERTRIHWGQRALYVGSLALLLLFGLLWAGGFFGQPRAPGAGPRAGAAMDPAAPGAWRAR

SEQ ID NO: 22696 - protein, 283 aa, Pseudomonas aeruginosa
RDGAQGRPGRPARQLPAARPAHAESVRSRGPAQLPHAGAALMQRTEPWRSAARTDRGKVRARNEDAFLDCPDRGLWAVADGMGGHQAGDLASRMIVTSLAELPARAGFDERLNAMRQCLHWLNRRLGEELTLSAERGDRIIGSTVVALVVEGSRAACVWVGDSRCYLWRGQRLYQLSRDHSLLQRLVDERRMDIEQARAYPSARALTRAVGASEQLVLDVLELEVHPGDVFLLCSDGLYEELSADALGRALSLASPQVAVERLFDGALSGAARDNLTAVVIRQ

SEQ ID NO: 22697 - protein, 143 aa, Pseudomonas aeruginosa
TGKSRRLAWEPPRSGAVYRIGRTPAARSVALFHQVRRQAQVAVAAAAAAAETPEQHAEAERQQAKGQQDAASGGFDMQHADSRLAADQGRGAGQRQQHAQARHQGRERRRQAPAPDSRPARAQPARIETIGQLHPDFLVCHRG

SEQ ID NO: 22698 - protein, 150 aa, Pseudomonas aeruginosa
AGSPGRPRASATGCRGRRACLRAARRPSARSSPPRCSPANARRREPCRCTVRCAGWRRGADRRGTRKSCRPPPSRSAGRSRSPPPRRARGRYPPPFAEGCPPASACPSASRARPGRNARDARHGRRPPAAASAAAECSPAARAPAGATRC

SEQ ID NO: 22699 - protein, 160 aa, Pseudomonas aeruginosa
LRRSPPVAAIDRRRRPGKCPPPTPTGSAHRRSRNSGHHPGLRSGASGTTRRVRPVSRPPRPAPPARHRPRRHRADRRGRHPARRSRPRRRHHQGCCPANRADHRHRHRPVPHRPWRDLSMVTSPINRGHFRIASTSLSFRATQRRTENRIEPVPLVFLLI

SEQ ID NO: 22700 - protein, 173 aa, Pseudomonas aeruginosa
TITRSSPSMRLTRVDLPTLGRPMMAILIPSFSLGPGIRVGSSPSATSSLAGSPSPSSSALSLGKIPRASCSIWLMPRPWAAAIGSASPRPSGLNSARARSGSMVSTLLAIRKLRLFRLRRCSAIIWSAAVMPARESTRNRTASASSMACNDCSAIFASMPSSSPEMPPVSMTI

SEQ ID NO: 22701 - protein, 172 aa, Pseudomonas aeruginosa
VRPCQRASPYWRSRVRPAYSATMASRDLVRRLNRVDLPTFGRPTRAITGTMRLSTRIQKTQRPLTSDGSGRTLETQSSGWCRRRACHRCRTRTSSSRPPADEPARHRCRPARDRRSDRPPGSADARSLPGRRPPRCWRTPPEPTVGDAPGRRCSTAKRHRASPGLPPNRWPG

SEQ ID NO: 22702 - protein, 733 aa, Pseudomonas aeruginosa
RSAGRFSSAGITPQGFQQQHQAFHAHGETDARGRLAAELADQPVVAATAANGALGAKLVGDPFESRAAVIVQAAHQLLVDFVAQSDSIQAGLETLEVGDRFFVEIVVQGRRANQQRLGALHLAVEDSQRIGGHAPLAVFVELLEALLQIGHQGLAIACAGLAGAEGVELQGHRVGHAELLPQAPGEDDQLGVDVRTGQVEDFHADLVELPVATFLRFLVTEHRPGVPELLHLATAAQAVLQHGAHATGGTFRTHGQGFAVAVEEGVHLLVDHVGAFADAAGEEFGELEDGQADLAVAVAVQQAGEGAFQIAPGRSLLRQDVVHATNGLQGLAHVGSLNGSAAGDQARIGLGLLGRLLADQPFQLVHQVVVGQFLRRLAVDIHQVRSAAGEADMGLLGFARTVDDATDHGHVHRHQQVLQAPFQLVHGLHHVEVLPRTARAGDEVDATGAQVQGLEDVETDLDLLDRIGSQGNPDGVADSLGQEHAQPHRRLHRAGAQAAGLGDAQVQGLLDLPGQQAIGGDGHEDVGGLDADLEVLEVQLVEMIDVAHGRFEQGFRGRFAVFLLQVLFQRTGIDADTDRDVALARGIDHGLDPVLATDVARIDAQAVHSQLGDAQGDAIVEVDVGDQRHVDLLLDLAECLGGVHVGDGNPHDVRAGIFQAADLRDGGSDVAGLGVGHALHGDRRVAAHRDVADPDFPRLAANDRRSAMNAHCPTFRRAVSPRTKGVTSTGWPL

SEQ ID NO: 22703 - protein, 192 aa, Pseudomonas aeruginosa
LTWAPRAKPRRSSSGALPASSRLSPLRFSALTRTLPLASVTWVQQSATNCTLTTPWPSPATTGAAAGSLGAGGAAGLAVAGTAGAVPGAGAVPAGAAVTGCWGAAGVPWAGAAGTCAPSLATGGAPSAWAATSGETSAGACSPSFCASITAWSSGSSRVWISVVPSALSTSTCSRLRPAVSGVRAECSCHQK

SEQ ID NO: 22704 - protein, 587 aa, Pseudomonas aeruginosa
REAVATTSGCGAFIIFPPGIPDIRESLGTGVSTAGHSWRPCRGLRRPSRDECPATDCGRSARRPGQRDHSTGEPARTRAPCRAGRPSPARRWAGYGSDAGISRSTPWPGPVSSFAAKPGRGSRRPASARDRGCPGWPPGDAGRPPRSASARRGNRRSCSVPGHCGYRWRAPCGTPRRPAWAPSRSGTPPPARRARRRWKGRSRGPCAAAPWPARCSPAGDSRGQAGYRRRAPRHGPCRFSGDSDLRSSRSLSAQLPTGTPARRVQSSEPSSHSISIRRRLGLGQLAHGNITFAPAGTIHDLTNQLATGRVDVVAAGGTHGHVEAALVQHVLETPDGIVARALVAGVREWIKRNQVDLARRVFQQCDHLLSMLGLIVDILEQGVFDGQHALLAEPGNIPAAGIQQHAQRILLVDRHQLVAQLVVRCVQRQGQGHVDHLAKLVDHRHHAGGGQGHLALGNTVAEVVHHDVHGDDHVVEVQQRLAHAHHHDIGDGAVDLGRNGTERLVGDPHLADHLGGGEVAVETLLAGGAETAIQGAARLGGHAQGAASALGDVHGLDATAGRHPDHPLAGAVGGNILADDLGTAYLG

SEQ ID NO: 22705 - protein, 217 aa, Pseudomonas aeruginosa
GLELFAQGLADVGHGVEIVDAKVVNPLHDLAGPETLLADGLEELFQLRLGQAQQVHLAGGGRCHGFTLTHARSANALADFGSREEVGDLASGGSFGIGTVDGVLVDGDGEVGADGTGVGFLRIGGAHQLAVLGDGVLAFQDLDYNRTGSHEGNQVLEERTLFVLGIEAAGFTLGQLNHFSGDDAQAGFLEAGQDFADHVLGNGVRLDDGQGALQCHW

SEQ ID NO: 22706 - protein, 187 aa, Pseudomonas aeruginosa
ATAFVLAQRDLLDLLAADQIGQADAAEELMDLQTEVAPQVVGQTGIAGVAIALPLAAGRVDGFVDRVDHLRHMDARHMAGQLVAAARAAHAGHQVATAQLGEQLFEIGQGNALAFGDIGQRDRTLLSMQRQVEHGGYGVAAFGGQTHGLFPSGSFGVDADYALIRVIRSTIRPIKLLRIRQIQGATC

SEQ ID NO: 22707 - protein, 272 aa, Pseudomonas aeruginosa
QKAAGRALRGRIAVLVLDSGEIFLAQYRQVLRAVVATQGGERLAHALEPAVDGLQVIEQLTNGTRHRVRHVLADPIGIEAELLRHRLALGLLLGVLAHDDPPGNADHGGTRRDFLGHHGVGADLGALADGERAEHLGTGTDHYVVAEGGVALALVPGGAAQGNALIEGDVVADLGGFADDDAHAVVDEEAPADPGPRVDLDAGHPAAEIGHQARQPLPAGRPQAVGQPMQPDGVQARITGEDLECVASRRITVEYALDIFTHTFEHQSSLRL

SEQ ID NO: 22708 - protein, 334 aa, Pseudomonas aeruginosa
LVLTNTTRIRSSNADALQRQVTEGCEILQQRSALYHAADRSPFKRHRFLLEWPAFFNDPGDLSMQPMLNIALRAARSAGELIFRSIERLDVISVNEKDAKDYVTEVDRAAEQTIVAALRKAYPTHAIMGEEGGFIEGSGEGADYLWVIDPLDGTTNFIHGVPHFAVSIACKYKGRLEHAVVLDPVRQEEFTASRGRGAALNGRRLRVSGRKSLEGALLGTGFPFRDNQIDNLDNYLNMFRSLVGQTAGIRRAGAASLDLAYVAAGRYDAFWEFGLSEWDMAAGALLVQEAGGLVSDFTGSHEFLEKGHIVAGNTKCFKALLTTIQPHLPPSLKR

SEQ ID NO: 22709 - protein, 289 aa, Pseudomonas aeruginosa
DAADQQRGQVGVEDRGEGTVEAFVDRLLDGHAIGQFLAYPREDQHVGVHRHAHGQHDTGDARQGQGRAEDRHQRHQHDHVEGQRNGGDHAEETVDDDDEQRYEEHAPERRIDTLGDVVRPQARADGAFFGEVHRRSQAAGTQQQGQLGGLAGAIEAGDTELVAQRRLDGRQADDLLLFLERRNRDLLLDAIDHLLGVAGHRLLLDEHHRHAAADVVAGGAVHQLAAMAIQADVHLRAAVLVETGAGVGDLVAGDDHPALQRHRRPARLAELEGLGGGLQGVRLGGQAEF

SEQ ID NO: 22710 - protein, 201 aa, Pseudomonas aeruginosa
VGGLAEDPLGFRGVLHARQLDHDAIGALALNQRLGYAQLVDPVADGGEVLLDGVFADFRQFGLGQGDAQDLQAVALFGHDLEIAEVLGDQAARLVQGFAVGETELDRAIAGSAGCGSARAPCAAGSSLRFHRPSGGHRPPCPCPLPAGSAHRRTDPGRASSGCRPACAATREWSGPGSAPPRSRRPGSGAPLPWREAGRPA

SEQ ID NO: 22711 - protein, 160 aa, Pseudomonas aeruginosa
SPRCRRTGGRCAHCASASRSRTCPRRGARLPPGLPACPRPSGSAACRPASAAAGNRARGSSLPSARPPTNHRWPGRRSRSPASHPASAGAGPRAYRPGRCRTAPTGYRHGRSSSAWPSAATAPWSAWRRHGRPGTACIRRRSSRCPSPGRVAPPWTPPAP

SEQ ID NO: 22712 - protein, 274 aa, Pseudomonas aeruginosa
PLASVRRKCDDGSPLPFLHSQAGKQTLQRHRPADQVALQVIHPAGGQVVTLLGGLHAFGDDIQVELGGQLDDAVENMPGKSIDADAGDEALVDLQAVHLELAQVGQAGMSSAEIVDSDLHSQGMQFVEQTVGDFARLDQLALGQFQDQGDVPGRKRRQQLATVVHQGQFVAMGGTDVETDVEAWLQLPGMPAQVFRDLAHQRARHRYDQSRALGERYEQVGPDQSLTRMTPAHEHLDAYPASALAGTQRLVVGNELVGLQGPAQFAAGRGDPPG

SEQ ID NO: 22713 - protein, 202 aa, Pseudomonas aeruginosa
LGSAQRLEQPGKSVARVGGASCGWTYNPRLCPARNTPMPKHMLSPQGDYAPAGLIRRLAAMFYDFLLCVALMMVVTLVYQQGILRLIYGSDHLRELADRGALIGDPLLSTLLVFALFGFFAKFWTHNGQTLGMQVWGLRVQNRDGSAISLLQALLRFMIAIASWLCLGLGFLWMLWDKDKRTWHDRYSESQVVRLPKNTHKK

SEQ ID NO: 22714 - protein, 350 aa, Pseudomonas aeruginosa
SVDPPQADGHGDLAFVQLATDSDQQGQVAHIKEDRRQQLEEAPLAWVDPRQRHRQQGHHEYQQRCRQAPLQFGLVAWVVAAEQVGGGHRVTLAHLAAGLGLGQHHAIGVVLDRPVVGLPGIAVVAVAVVQDQVTAAIRLDVLGALLRHQDGDAAFLVAAVEVLLRNEDAGQFAAILRQFLGIGHPGTVAHCLETARDQGVELGQGILLVQQQGELVDALGRQEQAQPGHQDRHQQRRGHGIAEQALLAHAGRREHGHLAFQIESPVGQQDAEEQAKRQDQLQEAGNPERHDQEQRTGVEQPLRRLRQVLDETATHDDHQQHGADGAHGDQHFTGQITENDQSGHSWVARL

SEQ ID NO: 22715 - protein, 490 aa, Pseudomonas aeruginosa
KRTPGNPENRHPGARRRRRPQARRQRQGGRRRHRRRHQRSAQAWRPGRQGRPDHAPAEPAQSQGRARAAGRRRQGARTGRPPVPQAGLRRAVDPQGPGRRRCRAGPRRSRGERPRCPREGASAGGNPGRWPVRVRSLQEPESRAAETEEADPARRQGRQRRRRARQQGSSGHRQWHGPDPRSRQPAAERLPSDVPRRAGQGPGQGVQGPEGRGPRREETARAGHGLVPRRRPGQRPAAAADRPAIQRREEGPGPARAGRQGHHLRHRRHQPQAGPGHGRDEVRHVRRRQRLRHLPRGARTAVADQPGRPAGLRREHAQRRSHPSGRHRHHHERADRRDPQHRRRRAPGAVRRTDLRRALQAAVGDRHRHPHRRLHRRPGQQHLGPYGQQRSAGQAIAQGRGSSPTTAPGNCPLFDEYQEQLDSPFADIANIGGPKAGTITAGCFLSRFAKKYHWAHLDIAGTAWISGGKDKGATGRPVPLLTQYLLERAK

SEQ ID NO: 22716 - protein, 305 aa, Pseudomonas aeruginosa
PGVDPRPALRTERAALADRILRAGQHSPALRRRLPRYRPARARAADRGSHHGRAGARRTGAPGRRVASVRRTDPAGSHRRLRPADRSRTAPPPASPPGSPARPTQRLIRTRRAPAAARGLTPGLPSPLYSRTFFAFSPAIFSFGPLSHGQDLPAARHRDFLVRDLGVQRLLRSERRRPALHHHDPAAERDRQPAHGPWLQQRDHGRADPLPPHAGPQHPVAAGHRSRRHRHPDGGRAPARRPGREPPRPRPGEVPGESLGMEGTVRRQHHPADSSPGLLGGLVARALHHGRRPLRSGQGSLRAPA

SEQ ID NO: 22717 - protein, 286 aa, Pseudomonas aeruginosa
VHLGRVLRLVPGAGQAGAVGRERPHRAPARHSSHPDPRAGDGPAPGAPVHAVHHRGNLAAHQGPGRQGRSDPDAATLAGGRRRQDRRRRRRRHRVGQGADARRAADPRRDEHLHGQAHRHHPQERLAQRPPPPGRQRAAADETGQAGKHPRAGSRRGSADVRHRPGRRHGSIGADGRPDRQERRTGAPGQGDPAPGRRGQARRRQAVQRRLRRQGPGRRDREGTRQASRGRTGPGQAGRATAEDRRALSTLAKVRGCGLVPFSPQAPLSICAEVIWHTAFTVALAE

SEQ ID NO: 22718 - protein, 97 aa, Pseudomonas aeruginosa
SIVRNLSTRQISSHAFNITCKSRINFCSLRQTSPITQFNKSTGFIQNINSRPWKSYVRPIRHPKIPATENIFTVPCERFPITPRKYTSSIFMATTPS

SEQ ID NO: 22719 - protein, 397 aa, Pseudomonas aeruginosa
PSVRRPRGASSNFRKGQALPLARPPSGNPAARKNIKPADDLREKCDVSATLYPHRPIRTIRYSAPIQSGDRRMMQAYKNKWLPLSALALGMALSFGANADEQKSVAVTAIVEHPALDAARDGVKEALQEAGYEDGKNLKWQYQSAQGNTGTAAQIARKFIGDKPDVIVGIATPSAQALVAATKSIPIVFSTVTDPVGAHLTPSWEASGTNVTGVSDMLALDKQIELIKKVVPGAKRIGMVYNPGEANSVVVVKELKELLPKMGLSLVEASAPRSVDVSSAARSLVGKVDAIYTNTDNNVVSAYEALVKVGNDAKIPLIASDTDSVKRGAIAALGINYKEMGKQTGRMVVRILKGEKPGEIKPETSDNLQLFVNPGAAQKQGVTLSDELLKSAAEVIK

SEQ ID NO: 22720 - protein, 316 aa, Pseudomonas aeruginosa
RNACSARREPDHAQREEPEDHLQPRHPHRDPRPARPVAGHPGRPVRHRDRLQRRRQVDLPQRSLRRPADRQRTDPDRRRRRHPQAGLGPRQPRRAGVPGPHGGYLRGPHHRGEHGPGATSRCRARPRQGGAGIDARRFPGKPGDPRPRPGEPPRRPHRPALRRPAPGRQPADGGAAAVAYPVARRTHRGARPAHRRLRPASHRTDRRREETHHHDGHPQHAPGAGRGRAHGDAAPGPGGAGRLRRATQGPRRTGPAGDVREGARREARRRRPPPRLTGPRRLSAAKRGGAVDLQQIKARSASVCHTRRHPPAQMPA

SEQ ID NO: 22721 - protein, 374 aa, Pseudomonas aeruginosa
FRGCFHCDRARSAPLGRNTGQPPADVNNARLAVTETENMPRPTSPHPDAERKSASPLHPRNRHLGRYDFPRLIAGSPELERFVILNPYGRQSIDFADPAAVKAFNRALLQQFYDVREWDIPDGYLCPPIPGRADYLHYLADLLGASHDGLIPRGPGLRALDVGTGANCIYPLLGHHEYGWRFVGADIDPQSLASAAAILAANPRFAAAIELRRQPDRRQIFQGLIGVDERFDMTLCNPPFHASLDEATRGSRRKWKNLGKLDPTRTLPLLNFGGQGAELYCEGGEAAFLAGMAEESRAFATQVFWFTTLVSKASNLPNLQERLKTLGASDIRVVDMAQGQKQSRFVAWTYLDKKQRRAWRKERWTAALLEPLGE

SEQ ID NO: 22722 - protein, 135 aa, Pseudomonas aeruginosa
QSLRAGTALMAASSDSEHAMNPLYRAAIHQLFLALDLPTPNDEESVLSLQVGPHLCHLAEHPTDHLLMFTRLEGQGDATASEQNLFSQDPCKPILGRDPESGERLLWNRQPLQLLDRAQIHHQLEQLVAAAEELR

SEQ ID NO: 22723 - protein, 193 aa, Pseudomonas aeruginosa
SWCPAPARATTWSACSAPARSTSPWSRAARSASSKPGRRASCRPSARSTRNRSGCSTAATCTSTSSATCCTCAWPSAATAAAPAPPPRRSCRPTTSPRDTIRSPGKPAAATRWSTTCWPASWTRRSSSARRRTRRSRNWPTTTSFAWSTSAAAPPTRRACRSSSGSRSAKACSTCRATCRNETSAPCRRWPPW

SEQ ID NO: 22724 - protein, 249 aa, Pseudomonas aeruginosa
QGLRPVAGNPGGQAHPQPVPPLHRPRRRPVDQLRGAPAGLQGGIRRRARHADHPPVADPVEGPAQAAQGLTRAAPERRRRSLSLLSRRPSRSACRGNRAGRCRRRSCSRPGIPRTLRRRDSSPARPAPDAWCRRYGSAGALPPRDARGSCRARSCRPASSAAAGSRRRRIRWAPPRRWGLAPAPSSAAGSAAGGRPPGGHRGRAAGSSRPPPSPARSWPPNQPPATAAARSAPTAGCPPAAPAAGRARR

SEQ ID NO: 22725 - protein, 484 aa, Pseudomonas aeruginosa
TDQHFPIAAVAAVASLTPDPLPHPLAIRHQARIASRHMAEWGIQGRLDEVGEDTVSGGIGAARMFAAVVRDLAKQAVEGIEVVAGEGQQFVPAVDPEPLRPEGSADLAAHGPGHRVAHAEWQRAEEHRLEHAPAVLVEPAEIQHQVVQVFVAQARDRPCPALAPGIQAGVECDPVALAEGTDDDLAVTDRLALDTHVGQLALGRLARVADDLHLILQAGQAQPGFQFQAVGTGIGYVECGGELEERDHRGVLRVVRGELRRLSALRPPTASAGRRMGSLVGGQALARLPADRPLHRRRPAQQQALGAKRLAAPAPQVELVAMLDDQTVGEAETGLDAILHPAPGLGEQVVGHPLRTPLVLVGADVRVVQAEVPRPAGQQAPHVAHLAPAQFAEGRVVEGRLGSVAGRHGLAVEALEGLVEALDQFGVGVGHAGFLAMIGTCQASPGGNAVVPGRFSRTTRGRCARGRSARPGARRTPAGRRIRA

SEQ ID NO: 22726 - protein, 158 aa, Pseudomonas aeruginosa
EGIFLRNCPIFHSNASAWERAPPGTHERRKIRMNSRRSKLMNRMGQLALFGLLVGTSSNLFAAPGSISGVIRFTGAIVEPPCSMSAPRQDESKGSFHLSGCPMQARTADVSIRSMKTGEVRHLQPSDTVIGERDFSAHYELAGSDRRSGNYLITVTYP

SEQ ID NO: 22727 - protein, 568 aa, Pseudomonas aeruginosa
RSPMKKPPEGGFFMVPKRGLQLRAGGLDRIGNLEFLEVFDELLGQALRRLVVGSLVSPGVARVEQIGLDARNGLRHVQVDDVQVLGFRADQRAALDRRDHATGGRDVEALADAVATTGPASVDQVDLGAEGLDALDQQLGIDAGRTREERSTEAGGEGRLDTAAGTHLGGADQRGVAGQEVVGRLLIVQDRYRRQYAGQVAGQEDHRVGLAAEVLLRTLLDVLQRVGGAAVLGQAVIGVVGHALFVENHVLQHGAELDGFPDDRLVLLGQVDALGIATAFDVEHHALAPAVLVVTDQVTAFIGGQGGLAGAGQAEEQGHIARFADVGSAVHRQHVALGQQEVLHGEHGFLHLAGIAHACDQHFLLGEIEDHATVGVGAVALGHAFEVGDIEDLPLVLAGRVVLLRLDEQATAEQILPGGSGGHLHRQVVSLGGTYMNMGNEMVLGVVERFHAGPQRIELVGRERTVDVAPGDRVLGARLFDDETVDRRTAGAMAGAYDQRAVGGQFALTAANGFFYQLGGADIGVHGVVGLRHVVPRRPEAESSKLRSASKNSLQEKSGGIMPEKPAG

SEQ ID NO: 22728 - protein, 265 aa, Pseudomonas aeruginosa
AREGAGSAAGTAQTRQVSGRAARQQQPQRQADPRFQAAAIAVAQFDAAAVLGGDALDDRQAEAGALAATRLVATDEGIEDAVHFRGIDALAAIEHAQHHVGRRAFAGHVAGHLHRTAAVVQGIVDQVAQQTLHRHTPQRHRRYRLQGHAHLLASLVERRHDLAHQVGQVALLHRLVAAVADEGEELVEDRVHVLDVADHVLDHLPFALRQQLQRQAQARQRGAQVVGDTGQHQFAFAPALLDVLGHLVEGAIHLGHFTRRLRSQR

SEQ ID NO: 22729 - protein, 801 aa, Pseudomonas aeruginosa
CGAFAAGRCLHGPFSFVLPGGSMDSINTRIAEELSALPSGRVQPQQVAAAVALLDEGSTVPFIARYRKEVTGSLDDTQLRMLEERLRYLRELEERRGAILASIEEQGKLTPELARDIKLADTKTRLEDLYLPYKQKRRTKGQIALEAGLGELADALFDDPTLVPESEAARFVDAEKGFADVKAVLEGAKYILMERFAEDATLLDKLRVFMKNEATLTARVVPGKEQEGAKFSDYFEHDEPLKSAPSHRALAIFRGRNEGILSASLKVGEEAPGTLHPCEVMIAERFGLSNQGRAADKWLAEVVRWTWKVKLYTHLETDLFGELRDGAEDEAISVFARNLHDLLLAAPAGPRATLGLDPGLRTGVKVAVVDATGKLLDTATVYPHAPKNQWDQTLAVLAALCAKHQVELIAIGNGTASRETDKLAGELIKKYPGMKLTKIMVSEAGASVYSASELAAKEFPELDVSLRGAVSIARRLQDPLAELVKIEPKSIGVGQYQHDVSQLKLARSLDAVVEDCVNAVGVDVNTASAALLARISGLNSTLAQNIVAHRDANGAFRTRDELKKVSRLGEKTFEQAAGFLRVMNGDNPLDASAVHPETYPLVQRIAADTERDIRSLIGDSAFLKRLDPKKFTDETFGLPTVTDILKELDKPGRDPRPEFKTAEFQEGVESLKDLKPGMVLEGVVTNVTNFGAFVDIGVHQDGLVHISALSEKFVKDPYEVVKAGDIVKVKVMEVDIPRNRVGLSMRMSDTPGEKVEGQRGGRPTGSGQPRQERGAPRGQSAPPANNAMAALFANAKQLKKK

SEQ ID NO: 22730 - protein, 406 aa, Pseudomonas aeruginosa
RRQAGAHPPPPGPGFDPDPSADHYRLLRGLAGVHHAHGNRRRRHSGRSRAHPPLRQFETGRRIPVEPIDALRAAGRGEHPDRPLRQLDDRPPEVRLPQGPGAALRQDHAVHRRHPLQLLPAGEALAAAAPGRRQRAVGTRLPVRRLHRPDSQFPPLQLAADVPVRRLAGPRRRLPAWPPEPVGAPRRTHALPALRHQPADERPGLPEQRPGRPDALLQRPAELHRQPAPGGQHALPALREGRHQAGWRVGAAEHQHPADRKRVLLEHPAKARHLHRRASGAGPGRSRRAVRGSALPGHQPVPAAGHRPGRGALPRRLPAVLRVQRQPAAEWRVQRRHRQLPRRGQGRQAAGPAIATSRPAGGIEGLGERAARTNRRHRGAARPRTRRRSPRGGAGSASGLRSPMPN

SEQ ID NO: 22731 - protein, 169 aa, Pseudomonas aeruginosa
TAGCSRPAAIPRAAPSARRWSRAWPPGRYGRGSDRTNGRSARESRCAPSSPPCAGGSAAGWSARRSPWRDPAVARFRRGHGRRPSSFPRRRWRGSSAAGGTAGRAAAARPRWPAGRSPSCRNCRGRTSGRRARPGAADRCSTALRRRARYRCGRPAPARRNRCRSWPAG

SEQ ID NO: 22732 - protein, 390 aa, Pseudomonas aeruginosa
TCSTCAQSSAITARKNGNRPAAHSWALAMCCCIGPIGERPNRLMNGLVGMERLPGGNAEKYRPPTPRAFDLEHLHPRTPGVPSRTSPHAERNRNQTPRQPRHPGSLAGAPVAEEAQQIGLGAPRTVQPVLRHPRPRAGPGQGRAAHAPRRRAVHPDAEEPRAERGRVVRTQRVGLVPGKEQARPKETRRQVLAGGPQGPRQEAAQADLQHRLRPPARRDRLGPRQGQGSRGGGARPGQGGRRRQPGGNLRTGAGTAPGRCRRAARAGRGTGRRPAADALRHQQGRARLPPVRPEQLRGRSPGPETAGGNPAGRCLRRHRLVPARQQPATGRTVSFQRPLAPAGGLAATPAGPAYPARQPRPGGATRQQSRAARSAGRSPRRLGAAHRARP

SEQ ID NO: 22733 - protein, 255 aa, Pseudomonas aeruginosa
RRDATPAGAATVPRRTRRDPLGSVLPECLALAAGQGLDRVAQRARQPPGRRRAGQMAAAQPCRRSPGHAAGARPPASRAAPRPSAAPAAHAYLVAPGARRARPAGSRPPLRRTGQVAGAAAATCRCRAPGCPRHAGPYCADAQTLEGADEISFAATAIIRRESACPCSPPPPRTACWTSATCSASWSPRAGSGRSRPNSAWRSAAARCATSSIRWSSSPRSRSRISSAPDASSTWRPSPSGWPSTPASPTCASTR

SEQ ID NO: 22734 - protein, 136 aa, Pseudomonas aeruginosa
VRRKSPSPAPSPSYRAGKATWCMCSSDRSSGWWRTRRTSSATPSSSSAWPARSAAPPRRTRRSAASATSNSCSTSAPPTRSRTPTTRTSSPSSTGCSSTPSSSAPATSTSSRAASRAPCASVSTACCTTSTSSRRR

SEQ ID NO: 22735 - protein, 120 aa, Pseudomonas aeruginosa
CNTQPPIRSSPMRSVKLAAATLVIAALPLGSAMADTFWRNIISSGATTASTYLTFRHDHKLIVAAQDDAGSYIASDGAIRGPYLEAALQKLRNDNPDLQASDMELASAILAGGEQSAVQQ

SEQ ID NO: 22736 - protein, 200 aa, Pseudomonas aeruginosa
RVLSRLRGGSAFRVDGGLVASGIEQLVQLGRIARLELEEPGRVRVVVDVFRGVGQGFVDGDDFAADRRIDVGGGLHRLDHARFLPGGEGLAQLRQLDEDHIAKGFLGMVGNAHGNAAVGFQASPFVALGVTQFGGNIAHLVFLEVGGDGGRHCQVRSGACRDARNWAGPPVPGTTCRGFPPRRGRRWRPARGPARWTCSG

SEQ ID NO: 22737 - protein, 135 aa, Pseudomonas aeruginosa
RESAPGARRRPAAGPRRPSPARRCRPASGYGRSGPSSARRGRNGPGARTRQPVAPRESRRRRGTPARTRRSPPAPWRRAGDTAARRADARWRPWLGLACGARRAAPGIPRATTGWPAGRRWRGCRSRTRFCRWRW

SEQ ID NO: 22738 - protein, 314 aa, Pseudomonas aeruginosa
ARMIRNLACEPARLNVSGCFACVQATEDGEERLHRGAAAMAAGEDEEIGQRLGLGQRAIDDSGPGQRGAATRHQGNALAGRDQGDDRGDLASGRSPRQRQPGLPVEALDQFVEAGAVVQWKQDQRPITQIVQVDPLLPRQRIAVGHGHHQRLAAQGQHLDADLAFRRRQAPQPHIDAAFGDLRPLRRRSAFEQLQLHLRMALAEQSDRLGEQVRQGDGAGVAEGQVAGQPLRQLAGEAGGALQLVQQGACVRQEQAALGGEGHRPAGAVEQAKAQLFLQRGYLPGQGRLRHVQALGGAAEMQGFGNGCEAAQAA

SEQ ID NO: 22739 - protein, 432 aa, Pseudomonas aeruginosa
  UNSURE (372),(373): Identity of amino acid at the above locations are unknown.
VEHAVPRYRSVLNRYWPARRERPYNRGFLVQAERSMNSSQGFPRLALFLCGCAAFLNLYTTQGIFDELAASFHISAHQSNWSITATTLAVALAAPFVGRLSGGRERSRVIAFAASLLCVPMLLAAHAGSFAAFLLWRFAEGMLIPLLFASSVAYIGERWSGGAVIELTSLYVAGTILGGFAGRFLTGLLTEEWDWRVAFRILAGLTLLIAVAIRALLPANSGRHAPALGKRPLVSRELFRAPLLSSYAVGFCVLFSQVAMFTYIGIHLSRQPYSLDTAQLGSIYAVFLLALLVIPASGRLARTRPHRQLLLGASLLGVCGSLLTLAPGLPTILVGLALSATGVFLAQSTVNAFTASNAGTDKAGAVGLYLTXXYAGGSLGAVLPAPFWERWGWPGCLGLILLAQLLPLLLTRYGWSAPQAERAALRASQGRP

SEQ ID NO: 22740 - protein, 310 aa, Pseudomonas aeruginosa
GASGLNGATSSEPPSTSSTSRPLPSRARARALPTMPAPTMTRSACISSFSTRGPSSGRVPQARLEPHVQGFLNPRHQGAGVVAHFGVQPGQVLLAAGGPLADLVEQLLVDAEMRMHRALARADELDVGRLVPDHVVAAQVLHQHQHEERVGHRVEAAAELGAYIVAIEPVQAHAHPNLAEIASDVPHTDARPQEGRVEIHGEAQQAGLARPRPDRHGATAAARRGPWPGGRTSAWPAAAGRARAGRGCARRRAARGRWRTAGSPGRRSRRSSAGPGAAHRGSAAARRTRPAARRRGAGRRPAPGCRATTG

SEQ ID NO: 22741 - protein, 139 aa, Pseudomonas aeruginosa
AGNRPPGLPGSSLRPGSASAPPRGRAPSTGTGRARRSPPRSPAPARLPRWRSGGWRRSGRGRKHGYAGSARRARRSPATGRVARRSAGCRRTAPKSGRRSWAGRHCRGRRVRSARSTSRAPERRPAGPAPARRRPGPRR

SEQ ID NO: 22742 - protein, 140 aa, Pseudomonas aeruginosa
SVSPSSLSSSWPWTWAMAAMSCSTSSASPVRLPSRAVRPKPARKPWHHWPSASVRWASGVSSSGRSMTTATSPAEKSCRTMPSRPDNAALSRSPGAPPSSSAAACCQAASSKPAPAQTRPSRWPCSSAGETGMAASARRE

SEQ ID NO: 22743 - protein, 184 aa, Pseudomonas aeruginosa
LSNHPNSQARAHGRRRSAIVDGQVRPAAPEAGTAQGGEPAAAGERKVLARGARSSDRKERNGETQGRSDDFASESLGAGHMSQSNTLTVQILDKEYCINCPDDERANLESAARYLDGKMREIRSSGKVIGADRVAVMAALNITHDLLHRKERLDQESSSTRERVRELLDRVDRALANPADAGEA

SEQ ID NO: 22744 - protein, 202 aa, Pseudomonas aeruginosa
SNRKTSAARPCAASSARRAARSPPCSNASPPVPSIDNWRSIPFSAVPAISPCTCPTTARSTRVRCCVRRRTAGKATYLPVLAPWPQTRMVFQRVGSGERWTRNRFRISEPLADAGRQRKAWALDLVLLPLVGFDEQGGRLGMGGGFYDRSLAYLARRKNGHKPTLIGLAHECQKVDRLALASWDIPLAGTVTDAGWYVAGKR

SEQ ID NO: 22745 - protein, 187 aa, Pseudomonas aeruginosa
KTAFSDKLKSYAITPATGGHAQTFPTYIYERGAKFMPAYWLMKSEPDELSIRDLQRLGTARWDGVRNYQARNFIRSMNPGDLFFFYHSSCPQPGIAGIARIEGEAYPDPTALDPASPYHDPKASAGKNPWSARDVSFVEAFAEVVPLARLKAQDALANLALVQKGSRLSVMPVSAEEWQAILPLAKR

SEQ ID NO: 22746 - protein, 1315 aa, Pseudomonas aeruginosa
  UNSURE (619): Identity of amino acid at the above locations are unknown.
SHRSGHLRDGPAETPERAEEERRTDHHDTGELRPDDVETGAAEQDRLGQADEMRGRRRQHDVLQQFRHAFPWRGAARKDVQRQQHEDGQQSELRHRTRHRAEEYAHGGGGEQMQSGAEQEQSHRAADRHVQPATHHPLQREPRRHQHHQPHRPDLGHHDLEGRQRHHQQVLDGAVLALADQRGAGEDDRQHSDLVDHFHHPTEPGLGQVRVEFHAHLDLRRHARLRAVAADEFAHLGGDDVLDVARAREGLPGLGRVDVDLDRGLAPGEHVALEVRRDIEGEGIQADVHAAIHLGMTDHFRRPEVWGLEGIDDTRRELRAVLVDHRDRRVMQGFRNTGGGTVDAQGEGPDDQCQHRVVAAETAELLDAQVEDVGQAAHRSVLLLLQAGHAEQGQHHDGSGKRQVVGPEIGQAQRFGKGAAADHQEMRGRIELADPGRRTLQRGHRVDQPGELDRRDHGGDRHAEYSGDLAAHERREEQPEASAGDHIEESADGQRQEAALERHAKYHDGQDQHQQEVDHAHGDVGQLLADQELQARHRGDIEVGDRTQFLFAHHAEGGEHGRDHDQQQRDHRRHHRLQAFHVGVVAIAHLGAGRRAGLGPTRLAREVPPGTGVQGLHVXEHGVGTGRHRSVDPHADGRIGATLEIAPEVRRNLHRQAQLAAAQAPVEVVRVGDRRMFDEIARAGDVQRVGLAGGGLVTVDDRPGEVLDVHVDAIADDEHQQRGAEQGQGQADRVAAQLHGFAARIAEQPQGAEAFALRLALLAIAGLLRDGRRLGRLRWRGGTRGFLQVSDEGRFQGRQTTLAHQLIGSIAGQYLAGMHQRDAIAALSLVHEVGGNEDGHPVAARQLDHQLPEAVASHRVDPRSGLVEDQDFRLVDHRHRQRQTLANAQRQVVGQLVGHLLQVEAPEHFADPCRDAIRRQVEQPGVQHQVLPHAQLGIQGKGLGHVADPATGRHVAGVHRLAEQRARAFAGRQQAGEHLHGGGLAAAVGAEKAEDFPTLDTEADVIDRDEVAETTGQALGLDGDPRRAFALRSRRDHQSMVAGALAFRQQGDERRLEALRPGTLAQLLRRTGGQDLSVVHRHQPVEALGFLHVGGGDQHAHAFAARADTADQLPELVARQRVDAGGRLVEDQQVGIVDQRAAQPELLLHAAGQLARRTLGERRQPGALQQVGDAPLALGLVVAEQPTEEVDVLEHRERRVEVLAQPLGHVGDARADRPAVAAVAHVAIEHADLAILHLPCAGQQRQQAGLADPVRTDQADHAVGRDLQADVVHRARLAVAQRNAPEARHAAPASGHCGTLICRLAGHSTSGSSRR

SEQ ID NO: 22747 - protein, 323 aa, Pseudomonas aeruginosa
TSARSTMLSSLPPAGSTSPGCATRYCTRPLRGALSRLSSISAWSRVTLALAASMADCASITWERPASIAACAEITCERAADNAAWALCRVARSSSSCCCGRALRLTSASVRVKRFCAAVSSAWRCATTAWAVLFSLSRWATSEVAVSLAFSAWRTWAWAWANCASSTWVSIRATISPALTKSPSSTLISATRPGSLAATSTSVASMRPLPLANPSPRPVGRDTCQTSTPTPSSAATTRARLSHRLLSCFIPSPRTFGQAAAMALTLESAAAADFTGSIVPPGRRAGVDARQTRPTELHRKAESPVPRIRERGTERIVDLRAGR

SEQ ID NO: 22748 - protein, 82 aa, Pseudomonas aeruginosa
TAAGTTRPRASRAWRALGTASSWSPPPSGRNNLPAAGRNRRFPGTASAGSARTLRSAPPRGSPARPADARCRCCGRSVSAGG

SEQ ID NO: 22749 - protein, 273 aa, Pseudomonas aeruginosa
APSCRTCSRSAHRATWTPWHNARLPRKDATARRRNAAPTGRRLPAAASCTAPRQASAGARRTACARGTVPRRSTATVPPGRCSPPATPGVPAGPGSPVRGTGRRRTTASARGTANRRSDRTRPAVASPAGGEPRCRRRRWPRSAGRCQAPPAAPRGRGKECRCRRRTPAGESPLSRGWPPVAGTTANDRGYRPAAMPARHPPGVPRRASAGGRMHCQVAGSPPRRWPPAIAPGPRGGWRAASAADARRPRPAVEGRECRTALPPTTTRYAIAA

SEQ ID NO: 22750 - protein, 557 aa, Pseudomonas aeruginosa
NAKVPTIISRLDPRRKAQPIESLYRWSADSRLIGCRIGDPRPIVAGWRSFPMDLQSMPQKPAEAFPLIAALDLGSNSFHLCLAKANIHGEVRILERLGEKVQLAAGLDEERNLSEEATQRGLDCLRRFAQFISGMPQGSVRVVATNALREARNRSDFIRRAEEVLGHPVEVISGREEARLIYLGVANSMPDSGGRRLVSDIGGGSTEFIIGQGFESELRESLQMGCVSYTQRYFRDGKITPARYAQAYTAARLELMGIENSLRRLGWQQAVGASGTIRAVALAIKAGGHGNGEISPDGLAWLKRKVLKLGDVEKLDLEGIKPDRRTIFPAGLAILEAIFDALELEQMVHSEGALREGVLYDLVGRHQHEDVRERTISSLMQRYHVDPEQASRVEAKALKVLAEVGDAWELNGELHRDLLSWGARVHEIGLDIAHYHYHKHGAYLIEHSDLAGFSRQDQQMLSLLVRGHRRNIPADKLAEFAEEGDKLVRLCIVLRFAILFHHIRGTQEMPSVRLKAEPKSLSVTFPEGWLEANPLTQADFAQEAEWLKRVGYSLNVR

SEQ ID NO: 22751 - protein, 388 aa, Pseudomonas aeruginosa
LFCGLLGEVGQNAIGAGTFEGGKGLEDHRFGQPAVLDGAHVHRILATDLVDKGRGAEFILHPTHDVEVGHARLDHHHVGAFGQVGGHFVKCLVAVRRIHLVGGLVALAEVRSRADRIAERTVVGAGVLGRVGHDPHIGVAGRLQGLADRTDATVHHVRGRYHLGACLGVGQRLPYQHVDADVVEDVAIVIQDAVLAMGGERVERHVGDDAQLRKALAQGAGGALGDAFRVVCLGGVQGLLLHRGHREQRQRRNAQGHPLFRLDQQLVDGQALDAGHRRNAFTLVDPIEDEHRQDQVVDGEDILADQAAGEVIAAIAPQAGVGIGAIGGSEAHGLLQGPDNGHSVTVIVPDYDGLATSDDSDSRSRHPAAPPIIAKSQRQRPFIAQSMT

SEQ ID NO: 22752 - protein, 206 aa, Pseudomonas aeruginosa
AARSFRFAAPMMLQQFLQDFGYFALFLGTFFEGETILVLAGFLAFRGYMQLDTVILTAFLGSYAGDQLWYFLGRRHGRRLLARKPRWQKLGDKALDHVRRHPDLWVLSFRFVYGLRTVMPVAIGLSGYPPARYLLLNGIGAIVWAAALGSAAYYFGSVLEGMLGNIKKYELMVLGGLIVLGLLLWLWRRFKTPRGNGAGGNADKSE

SEQ ID NO: 22753 - protein, 832 aa, Pseudomonas aeruginosa
IGFPLQAGEQAIQGVGERLAVTLTVGRLAAAHLPLVTQVGHQVAHGQLIAHVPRVELAAARIEGGNLFLDQPIGQRYVAADRQVARLGLLHQVIVSRIHPAFHHHQTHAGERRLDLRLAGDHPDFQLALESELADQFLGRLGAGVGIDPDTHERTSVEMTTASIALAVVVARTRSVGRVGRRTPALDDPATSVEQRDGHQRHGLGRQRIGVSLDPQPVEVEERHRTGADHPGFLQGDDAMSGEHHRERTEQRRVDAEEQPQRQFRRTTQDHPGQADQQDHGGRRAADHGIVPGRSGLQPEGFVEQDDLEQLAVDREERQHCEAEASATAHQAAADVVLPGCRVAAVVHPDAEPEHHHAGEQRGEALHQLALGTADIDHIGGQRPGGETGDEGQPPADVHATHGTFLPGIAQEGEDGGKHQDCLYPFAQQDQQGGNETDGETQRVAAKLLGGLCQLALGQLQLLRHLGFREAIAQRLAVGHQLLLGGAAQIGVDVVQRAFHQLEALQVGRHRQVVGLVAVAFAIDREALVQGGGGIVDQLPRTALLQRRMRTQGAEALRSGLAVVLGDFGRSLRGQGRQRVGMGLVRLRTAGAQAGHIAGQVPALAFVELVGERRHVGAGHAQADDVTQVVEAQVVEALAIGEVRWRRFQADAGGAVALARIAMADRALLGIDRRRAARVGGDRGGLHHLVDIRHPCLEVARLEGHVPSRQALLDGLAQAGDAPLQLGALGAHRQGQDQCLQVADELHLFLVFAGVDDLAVSHGRRIVGRQVTQQMQGLGGVDGRVGKSSKAERADQRQQPQQDFRRVHGEDEVRMEEIKLSLRLPAHARNTL

SEQ ID NO: 22754 - protein, 378 aa, Pseudomonas aeruginosa
PRAKPYCNPQDIEAMAPAPGDRLMAQQARKKANQVLTSIAHLGKRTRLAAGTKKPVCTKAEQPHRFSDHAPRPTFAGATWRTEKTRQMPGFPEDTCSAMLGRPPRCGYSPWPRTLSVRRTLAQLHRLFAALARQGSAQADVQRLHRQGEGHGEVDVAFRHVHFEGLGHQHGADHDEERQGEHLQRGVFLDEVADGACRQHHHADRDDDRRDHHRHVLHQTDGGDHRVQGEDDVDDRDLDDDAHEAVDLAAALLLFFRAFQAVVDLHGALEQQEQAAEEEDQVTPGDALAEQVEQVGGQAHDPGDREQQQDPRAHGQGQAEEARLRLLGRRQAPDQDRDEDDVVDAEDDFQGGQGQERDPDFRTGEPFHRWLFPVFCWS

SEQ ID NO: 22755 - protein, 147 aa, Pseudomonas aeruginosa
QPGDQQDEQDLHRHHQRPAPGLRQHLQVFHHSLASSSFCRASRVSRASSQRSSSSPSRTFRLDCSDSNSRNSSFRDTSYRALSPSRASIAASFSCRPPSSRSSLSASRLCGASCWRSAAAAWRWARLSVRSVGAPGAVSACGALRAR

SEQ ID NO: 22756 - protein, 192 aa, Pseudomonas aeruginosa
SSRSPSNGTTRPSATRRNSSVVLLSRCRSWETTRTAPENSCRAMVKARRISRSRWLVGSSSSSRLGFCQAISARARRAFSPPEKFNTGSSTRTPRKSKPPRKSLRVCSRSPGAIRCRCSNGLACGSSESSWCWAKYPMARFSPRSRRPPSSGRSPARVLISVDLPAPLGPSRPIRAPGTSCSLTFSSTALSP

SEQ ID NO: 22757 - protein, 303 aa, Pseudomonas aeruginosa
RPRNYERNGNTCNAWPTWPQPGWRARKRIAVRMPGCKPAAGTSARKQSAGLCWCLARRLCRQRLRRRWSGRRRCCPRQALPKQRWRRLPGRWESPQASQQERWRAWLRQVSRLRVSPQAWPPVSPQASQPAWLQASRPRISPQAWPPVSPQASQLAWLRASRLRFSPRAWPSVSRQASLPAWRRASRLRFSPQAWPPVSPQASPPAWLRASRLRFSPRAWPPVSQQASPSAWLRASLPRFSPQAWPPVSQQASQPAWPQASPLRFSPQAWLPPSQQVWSRVSPCGSPEPCQQLPSPCRHPAPA

SEQ ID NO: 22758 - protein, 238 aa, Pseudomonas aeruginosa
TRTPPLANGFDVLQATCARIARRFVWRNRMPRRLFIGLFLLPLPLFAAPPKDELAYAVGARLGMRLQQEMPGLELSELLLGLRQAYRGEALEIPPERIEQLLLQHENATTETPRTTPAEARFLANEKARFGVRELTGGVLVSELRRGQGNGIGAATQVHVRYRGLLADGQVFDQSESAEWFALDSVIEGWRTALRAMPVGARWRVVIPSAQAYGHEGAGDLIPPDAPLVFEIDLLGFR

SEQ ID NO: 22759 - protein, 556 aa, Pseudomonas aeruginosa
WRRRPGTREGKADGGWPGAWRIHRYTGERPPTVVESLRPFQAARQLCGKASRIMPGARDKPPQSCRWSRTGNAGWRSPCSNPRHHHGQPRSTPIEQDQALLEQLVAALDLAELRQQASQLGAGLGTALEAQAGLQVFPGLAPELVDQAQAPQGQQQAGIVRMFLEPTFRGLQLLARIAPAHLPVELHQGRVEALLERMAEDFFSLFLGAQAKQLGGIARDDRRVCTQRRRHVLPALGQRLQRRFALVQSTLAGFLQGSHPGTAFEVAQFGILQHTLLAQLRQQDAKGLPVVLGDVQLLHQPQYRAVLRLEPVQLFEGIACLRVVAAIDQQLRTGQADQQLGIRLALASPVQQVVGLVVALEFVGGPRRAEVMHQRPLAHLRSPPQMTQRLRPVAFAEIAQAAVLGHLHATPAVVARPGVDHPPRAAEQAQDQAHQHHQQPDHRQQGEERPQAGFVTEALVGDQHIAGLLGDRQPNQRGDQHHRQNQEVDASHGRPSVAGAACASGTRLPAASRRDTYDCKALRAGAMSGTCTVTGCFANSSIRNFNARLSASSTLK

SEQ ID NO: 22760 - protein, 665 aa, Pseudomonas aeruginosa
PPPPRSSGPGRASAYAAPGFLPADRSPTAAGCCYGRPPRRGWRPGPRTPRRGASAGAASRSRMSGLAVDGFENRFGALLQQVLGHPHAQRLGVRQWRPPLGAQQLGAIRLADQAAQPQLVALADGVAGDRHLATAVEPLVQRALGSDPQSRVGMVQGFQQGMQVAVGRTAFDADGALSAGGQAVVDTDRGADARLEAEADQAGGGEDDRVVFAGIQLGQAGIDVAPQETDLQVRPARQQLRLAAQAGGADHAPGWQLLEAGVGVRDESVTRVFALADGVEAEPLGKVHRHVLHRMHRDVGGAFEQGGFQFLDEQALAADLRQRCVEQLVAATGHRQQGDGQAGMRLFQARLDVFGLPQGEGALASGDADFAGRHGIFRAQGCAHDNSSNPSARTLGPIAAPGSLANRRPPSELMHQTPDPGHVPPADGQRIAVEAFQVELEMPQRRTLQAFDPFAGDQRVAVDAHEALAELVFQRLQRLVQQHLALRMAQGHVLVVGNEEDHLFQRDQLDPLAGPCTDVAARTAAAGGRGLGQRGQLHAVRSRGFLQRLGQVFAAHRLDQVAHGADLEGFQGEFVMGRAEDHSRRRFPLAESGRDLEAVQTGHADIQQDDIGLEAVDQRQRFFAIAGRGLEDAIAVQLPYQSGQALSRQRFVIDNQDIHKLRLPA

SEQ ID NO: 22761 - protein, 540 aa, Pseudomonas aeruginosa
ASTEFPQGPWRPQDSRGRTGEIKHRNAICRKKPRNSARSGFVDEPPVFPPGLLSSSHFARHAGRAACPFLVAARDTMSVEKTNQSWGGRFSEPVDAFVARFTASVDFDKRLYRHDIMGSIAHATMLAKVGVLSDAERDAIVDGLQQIQAEIEAGSFDWRVDLEDVHMNIEARLTDRIGVTGKKLHTGRSRNDQVATDIRLWLRDEIDTILAEITRLQEGLLGLAEAEADTIMPGFTHLQTAQPVTFGHHLLAWFEMLGRDYERLVDCRKRVNRMPLGSAALAGTTYPIQREITCQLLGFDAVGGNSLDGVSDRDFAIEFCAAASLAMMHLSRFSEELVLWTSAQFQFIDLPDRFCTGSSIMPQKKNPDVPELVRGKSGRVFGALTGLLTLMKGQPLAYNKDNQEDKEPLFDAADTLRDSLRAFADMVPAIRPRREIMREAARRGFSTATDLADYLVRKGLPFRDCHEIVGHAVKYGVDSGKDLAEMSLDELRRFSEQIDADVFDVLTLEGSVNARDHIGGTAPNQVRAAVARGRKLLAQR

SEQ ID NO: 22762 - protein, 422 aa, Pseudomonas aeruginosa
PAPAPGSALVSCLRPDACPHAGCAPAGDRLRTGCPCHHIPVRATTCRPGTGRSVPPAVARRRAAGRHNRPCPALAGGPAASQPGRCSAGYARAPHGRAYRWPPESAGYRRPVARRSMPVVHADRSGRRCACARLRRYSGPGIRSCLALRWQQYDLASLRRVSPDIDDQLFRPLPLGTATRRVVQYLARCRRIRVERRPRQQRRRAAAVARAAAGVDPDVGPGEGHAAGVELEEAAAALEGQFGAGLQHHLQTAAQVDLLAGLDELAAGDLQVLVVGYGEVVAGSDLHLALGVGGAVFLGLELAVAVRLHGVVALVTDADLLVVLDVFVPVALGMDEDLLLALAVLDAQLVVATAARAAEALEDAAGLVPRQFVGHRMFPVKQAAGDQRLVGIAFEEGHQHLHADPRDGDGTVVPSRPAGGNA

SEQ ID NO: 22763 - protein, 500 aa, Pseudomonas aeruginosa
PATAAVVGLALAIPVELHLHPTVAIAVDFLALRAGHHRALRAEDARLRRRRWGTEERLPGRGLEAVAVTLPEVVRARRGIGDDAFLQHLRLPPLVNHLGEQPEVVPARLGMGGQRQEVAAEQQRLVAAALGQAVVAALPFEGAPGQVLSALAVDEATGIVVVLEVRPGFAAGGAFQRQARFLEVVVAAGDAAGAGFQAYAEALDRRPVGDQAGVLLVGHRREPREHRLVVAEHQQVRRGAVLEMKMDALLAAQALDELQVALVVLHAVFALGVAGAELEAVGVGEDAVFLQHPADDLRHREVLEDALVGALGEVGQLRDEGDAVAGQALARVALSGAAHQAVDTVAGGPEGKEGGFVQQAFEVRHGAFADQLQVEGERLADGFAAAEGEHLQVDGEAVDGEAEVGLVGCCEHPLSLTGAGDRFDCPAWRGRDKGAQARSEAAYNKQSGIDPARAFLTTALWVIEGTTASKAGPVRRSRLSRRPGSASRRSRRCRRLRGSR

SEQ ID NO: 22764 - protein, 65 aa, Pseudomonas aeruginosa
RSAKEVSMSGKPAARVSDPTACPLPGHGSNPIGVGSADVFFDGLAAARQGDASAWRCTARCLVRP

SEQ ID NO: 22765 - protein, 230 aa, Pseudomonas aeruginosa
AERCRGGDDPAWPGPGLRGKPRYLLARRRGGGRRRTVRPLPGGSPVAGQGRRRPRHRLCAGAHQPGGGAGESRAPARRAGRRRAPAPGPAPRCRGRPADRPRCPAGAGGAPGPGGKRAARTGGPVEPPARTRRAPARPAPAIGQGPRGEPGRAGRRGERGDFPGRRAWRCRSPGKGPSRNPPGTRRCPGPGAAGQLRGLPAPGCRGDRRLDRRTGGTTGAGTQRQGDGVR

SEQ ID NO: 22766 - protein, 350 aa, Pseudomonas aeruginosa
RPAGADPWPGTGGQRPGPRDARHRGRAEQARCAGRRVSAGGPERGGQDRDRAGAGRPAVWRRAFHHHHQHVRVPGEAHRLAPDRRAARLCRLWRGWHAHRGGTPEALFGDIAGRGGEGRSGRAQPVLPDLRQGRGQRWRRARDRFPQYLDPDDLQPRQRAHRRALPGRRAAFRRTPGGNHPAGAQPAFQAGAAGAHARGALLPGGRPGTARADRDQAATPRRAPGAPSTGFRLQPGAGGPPGRALHPERQRRTVDRPPAGHAPAAAGGRPFAGSDGARRASRAGPCDAGRARPRALRVRLRWVRCSAAYRNPWPSPKPCSLSSARCRGKPTSRPCWAVSHAQSANSAAAS

SEQ ID NO: 22767 - protein, 82 aa, Pseudomonas aeruginosa
ASCICSTRPIPRSPSTPNAGTACCRRWSRRACRRTTPASSCCSSPCARTAWSVSSTCRRGCTRPASCRQGSSPGCPCSAFRW

SEQ ID NO: 22768 - protein, 206 aa, Pseudomonas aeruginosa
SARSCTTPIPCCCRARPAPARRWSHGRSTSTARGVHRRSWCRTARRFRKTCWKASCSATARAPLPVPSAIVPGCSMPRMAEPCCSTKSATCPSRSRPSCCACCRKARFARSAATTRTRSMYASSPLPTVTSPCWYAMASSAKTSTTGWRSFPSSCRRCASARATPSNWPGISPSAPACSCAARRWAGPRKRWNCSTAMAFPATFGS

SEQ ID NO: 22769 - protein, 445 aa, Pseudomonas aeruginosa
RAMNVHKIVWQEGMLLRPQHLQHNDRYYDNQMKARTQLLGSYNWGFLALELDRQFLNMGKLVISQASGVLPDGSLFELGGNTEPLALDVPPNTSNVPIYLALPLVTGNHIEARRPEQAEVLARYTAYDLEVADSNAGEDSMVQVSCARPDFRLLLGEQQNDQAYVKLKVAVVLDTTPDGVISLDPDFVPSYLHAHASAYLLSCLKEVISMLGHRGDTIAERIRSNGKVGGAEVGDFMMLQLINRTELLLRHYLGLEQVHPEQLYRVLLTMLGDLATFGSESKRPRLDSRYQHSDQGASFRRLMEAIRQVLSMVLEQHAIELPLQARQYGILVSPLHDHKLLGSASFVLAASANCESEELRQRLPAHLKVGAVEHIRQLVNLHLPGIRVKPLPVAPRQIPFHSNKTYFILEPNAEDMTQLERSGGFAFHVSGEFSELELKFWAIRN

SEQ ID NO: 22770 - protein, 751 aa, Pseudomonas aeruginosa
SSPRPTWQVSIAANARASTGASAPCTSVRWRSFCYSACSGLAVFLANHERLERVRELAQQWTQQRQALGERDDAMAALKTLDSSYAATTVFPPKGEVSLHERAGLYQGNEVNPPLAAAYRRELETQLLPRVARMLEAQIRGNMQNRERLLNSLRAYLMLNLRERRENGWLKDWVATDWSQRYAGNGTVQNGLNTHFARLLEQPFSYPLNETLVAQARQVLRSESLANVVYRVLREQARSLPEYRFGQHLGPQAGLFVGTDYVIPGFYTQQGYQQYFVVQGASLVNDILRDNWVLGEGSGISDMDLRRLMVELEQLYFRDYANFWSEAVGRLGLLPFNDAGEGADQVSGLLAANSPILQLLLEVRENTRFPVLAESAEALAEASDKAAEKGGKLGNAAAAAAGNAMDALAKNLPDTAKKSLQRRFEPLHRLLDDNNGPAADLTPLLQALNELQLQLAGLARASQPEQAAFDMAKSRMGGQRDALSNLRNASARLPRPLGGWFSVLAEDAWRLVLGDAYLYLNQRYQSELYGFYSKAINKRYPFNAHSASDVAVSDFREFFKAQGVAERFFETYMRPFVSGDPGSYRLRSVDGYSLPMSKVYLDQMGTAQVIRQSFFAENPAEPQVRFRLEPYTLDPGVSRAEFRFDGQSMEYRHGPIVPMSFKWPSDADGGRTSLVLEKMAGRPVGIERNTGPWSLFRLFDLMQTEYLSGRDVMVLKADLGGLRANYLLLAQRTPNPFDLAVLRSFRMPVQL

SEQ ID NO: 22771 - protein, 254 aa, Pseudomonas aeruginosa
RVRPDPALAPSERRASVHLRRRHRMPARLHRHGTHAWPAARPPALRASRRPALVRAERDRPAVAGCSGLRPRTRSTAWRPEAEQRDARRRGRAALRLRPRPGAGRHPGWPAAAQPGPHRRLDSGLRRSRTARGRAIVAGGRPVCAGLRPLRTGRRSPSVPPPALEPGPGAGAGAPAARARTPASALLAGAAYRPEPRPRTALHRRPRIAGSAGRAAFLAGRRSCPLSRRRSVCRTSTAALRKRSAGRYDCLRCP

SEQ ID NO: 22772 - protein, 183 aa, Pseudomonas aeruginosa
PASIPVLRHKNTLAPGRSERPFAVRLGEVIMAHLVWQDDLNTGIQVIDNQHKRIVEMINHLHDAQQGKEHAAIAEVIEELVDYTLSHFAFEETLMEDAGYQFSRAHKKIHELFIRRVSEYRVRFQAGEDVGDELKGLLSRWLFNHIRNDDAGYVDAVRHSMSELVKDKSEGGWLSRSMKRFFG

SEQ ID NO: 22773 - protein, 305 aa, Pseudomonas aeruginosa
VDWVFGDFQSLKPNPDEHRIQPIGASHLAFVSTLLLAAFCALPAQADSFIMRLLNKPVPGGVAVVDLGEEGPPPRAFYQGKPVLVVREEGRRWIAVVGIPLSTKPGPQKLEVRAATGNHEERFSVGSKHYREQRITLKNKRQVNPLPEDLKRIERELAEQTAAYRRFSPGLPSNLMLDKPVDGPLSSPFGLRRFFNGEERNPHSGLDFAVPAGTPIKAPAAGKVILIGDYFFNGKTVFVDHGQGFISMFCHLSKIDVKLGQQVPRGGVLGKVGATGRATGPHMHWNVSLNDARVDPAIFIGAFQP

SEQ ID NO: 22774 - protein, 423 aa, Pseudomonas aeruginosa
PRETPHDSPASPALAVLGTVRGPRPGLRLLPRPARLPAHQRRTAHPRRPHRPARQLRRHQLRHRPAARLCRPAPPLPGARPARRPGGDRQRRRGASLRCADRRLAGANHLPLARRRGAALRAVAGGTLEDPPARPRLSAGQQVSSQDPANRRQPRQHQPVQRPDQQERGPHQREGHAQRQHDGDAALPARQLVAQRRHAKASGRLALPPDPQAARRAEQDRQADREHQQLVAEAEELAFVQHDAHLHAPRHRVVVLPTHVGENLAAVLFDVQGGVVARIVGEHGNRVDPLHPARQGDPVARRHAALAGDIHHPLQRDARRHRHVHRHRVPGLGGMPAMLGMGVGRRRLRARQRSVLQRPGHLLARRAVEATGLHVGGRHIVPHRRREAVPDIGELLAPVAGPGHPAEQHEQQQQAAPEPGDHM

SEQ ID NO: 22775 - protein, 258 aa, Pseudomonas aeruginosa
QRDHQPAHPQRPWHRRGRHRAGPDGRRRPRRRLPVRQRRAHRQRRPGDPGLEHVHPGPASATGLLRHRRGAQGGRRVQPVAGPPAPSICRRPGPYRFLRLAPGCHSQGLRPAEGRRDLGSAVPADRSGRHRPRLRSGDPGQQPVRQGRHHLPARTGVRHQPAAAHADRVQPGSARRDRPSRPGNDRTTDLLAAGKRIPQGDLALRPRQPSPAGRERHQRRRPGSLLRRREAALARDRQGTAGSLGGRPAGQGGNHGLP

SEQ ID NO: 22776 - protein, 317 aa, Pseudomonas aeruginosa
RMTTRKLGNSGLEIPALVFGGNVFGWTADESTSFRLLDALLDAGLNCIDTADVYSRWVPGHQGGESETLIGKWLKRTGKRDRMVIASKVGMDMGNGHKGLSAAYIEQALERSLRRLQTDYLDLYQSHTDDPHTDLEETLSTYGELIKKGKVRVIGASNYDARRLLEARQVSARLNLPSYQSLQPEYNLYDRADYETNLEPTVEELGIGVISYYSLASGFLSGKYRNQADTAGRARGEKVKGYLNERGVAILAALDEVAEQYNANPTQVALAWLIARPTVTAPIASATSLEQLDDLIAATHLKLDEQAIHRLDSASAY

SEQ ID NO: 22777 - protein, 103 aa, Pseudomonas aeruginosa
AGLHARRRLPGTARGATEQIAEDATQPAARGPAAGTTKDAAQRTEQTTAIATALCRTAPGATSAWSPARSTGATFGSRAPPCPSEPPSAEPRIESSQSHWSSS

SEQ ID NO: 22778 - protein, 398 aa, Pseudomonas aeruginosa
LFRCLTQRLLAFGVTEPDQPHGVRSLFIKHRNRDRRHSVFAGQPLGHGHVVQVRTDGRIVHALEVGARRTGKTEARVQQQVAEQVALGLVEAGQLPQVLRMAGHVVRQCPLQRRDATEVDVLVNLAQLRAERRRRDHVAGLPAGDVVGLAERTDHEGTRIQLVVGQHAGMGDTVEHQVLVDLVADQIDIPVADQRGQAVQFLAADQRAAGVVRGIDDDQPGTRPDGLGHALPVDGEVRQHQRHVHATPAGELHGGFVAVVGRVEYHHFVARMDQRLDRAEDRLGRPRRDGHLAVGAHPASIELLDLLRHLLAQGRQAGHRRVLVVPGGDMPAYRLAQLRRAVEIGKALGEVDRATLGGQLRHAGEDGGADIRQLALNHRDFLQRLAGRQPGQTGGRAG

SEQ ID NO: 22779 - protein, 404 aa, Pseudomonas aeruginosa
RRTAAAGHLKPSLADGVGDELATVAEHVHPAPDHQRTNPHAIAVDPLATDEATVHLAQQMHVAFQVADHHVAGEHRRSRQLATRQGVVVPQRRGTARVQAFHRTAGLADVDIAEAFGDADVARRFALPEQAAAVHVQRRGTALVADHVEGVAGQQEAAVDVHHAIQFGTPLGNRYPLLPDRQAALYVDRHHIAAGQAGQGHVAGDQRRAGAAQGQHRHGAFVDPAMVAAGRIEADQLVVLGLHHHHVAIGGRRRQHFAVDSLGPLLLAGGFVEGDHVTAQGTHQHQAVANADTAGNRTFQVLLPEHVAGLALDRHHPPFGGRGVDGGTIDGRFEQVVQVTLAITDRAAPLLAQHDFLFEVGQFGGREFLLAVAAATHDRQGQGEQRRVFPLHHLRPLPWTGRRA

SEQ ID NO: 22780 - protein, 180 aa, Pseudomonas aeruginosa
TGQPRAIRLASASAFSAAFWRISRSSSSTRLSLVSFCDGLPSIYTRFGVPPVRPTWASLASPGPLTTQPITATSIGTSRSSRRPSSSFMVFTTSKFCREQLGQAMKLMPRERRCRDLRMSKPTLISSTGSAAREIRMVSPIPSARSMPSPTADFTVPERRPPASVMPRCRGCSICLASRR

SEQ ID NO: 22781 - protein, 85 aa, Pseudomonas aeruginosa
SLTSLSRVYSTVSTRFSPSREIYRRQASSSMPSGYFLLIGTSLLRNSSFGACSDRARDTSITSPSLSIIGTTPEVDRVTLRLEIP

SEQ ID NO: 22782 - protein, 151 aa, Pseudomonas aeruginosa
PRSSIMMFMATTTLSKFSSGSPMPIITTLVMARSILAGTVPNDLLAIHTWPITSAAVRSLLKPCLPVEQKLQSRAQPAWEDTHRVPRPPWGMYTVSTQLPDATRTTHLRVPSAEISWLTISGPRISAEALSFSRKALPTLVMASKSSTPKW

SEQ ID NO: 22783 - protein, 703 aa, Pseudomonas aeruginosa
PRIGLQTPGLVQHVVFEFVGRLHGVEAFADDYVAGRAGAGFLTGMLDLDAIAQRGIQYGFAGLRLEYRPLGAVVGMGQNHDLRHLRLFLDFVEPAAGERGLDGRVHPPCGESVGHLGQALDLVLDGRGVATTGQFTQGVHLRRDGQALLFVQEPLAVDVQRRLHGLQQPLRLDLLFAQGAGSLVVAGVVEGVLEHPRDLAVGQPIGRLDLDAGLDAGTQFACGHAEQAVGVDLEGHPDFRRARHHRRNAAQLEARQRTTILHQLALALQHVDHHGRLAVLVGGELLGARHRDGGIARNHLLHQPAHGFQAERQRNDVQQQQFLAALVAGQGIGLDGRADGDHLVRIDIGQRLAAEQLANRRAHTGHAGRAADHHHRADFFQIDTGVAHRSAAGLQAASDERLDQLVERRPAQLAAPVAIGDPDRRLVGKTLLGRTGDLQQLPLAARVQIGREASLLDHPASDGMVEVVATQGRIAAGGQDFEDTAGQAQDGNVEGSATQVIDGHQAFRALVQAVGHGGGGRLVEQAQDVQSGQARGILGSLALGVVEIGRHSDHRTHQLATEGGFGALAQLTQDVRRDFHRTLQPLYGLDEGHVRLTLAEAVGQLLAQLLDVLQAAPHQALDRNDGIEGILRGGRAGALAHFRPLGVITHRGRQDQASLRIRQGLGDAATHRGDQRIGGTQVDPNRQATLMGLGTLTGLGDLQ

SEQ ID NO: 22784 - protein, 532 aa, Pseudomonas aeruginosa
PFRYMPWLILTFFRGTRRSVRLPFDLGQVDALFVHIPQRRQFAQLGNGLDHLLRGIVDLFLGGEATEGEADGAMRQFVVAAQGAQYVGRFQGRRGTGRTGGDREVLERHDQRLALDVVEADVEVVRDAGGHAAVDVELFQAVDLREEAVAERQHAGVLLGHFFLGDAERLAHADDLVGGQGAGTHAALMAATVHLTLDADARLAPDVERANAFRAVGLVRGEGHQVDLELVQVDLDLAGRLCGVDVEQHAAGAGQLADGGDVVDGADLVVHVHDRDQDGVVTQRRLDQSRSDQAIFARLQVGHFETFALQLAAGVEDRLVLDLRGDDVLALARVEVRDALDRQVVGLGGAGGPDDLAGIGVDQFGHLATGVLHGFFGFPAEHVGTRSRVAEVAVHQQAFAHFLGDAGIDGSGRGVIEVDRQFHQVTPTGWRPAQSMADASILSRRGVLPEQRRSSWRSATSWTSWRLTRSARLMPLRNSWICKLRSHHRWWVRQVSPEWQSPCPWQRVASTDSLTASITCATWMPDIWRDSW

SEQ ID NO: 22785 - protein, 88 aa, Pseudomonas aeruginosa
ASKPSFSAIAWRLACCSESSRMMIRPGMPTTVAPGGTSLVTTALEPTLAPSPTVNGPSTLAPAPTTTLLPRVGWRLPLFQVVPPRVTP

SEQ ID NO: 22786 - protein, 142 aa, Pseudomonas aeruginosa
APGPRPPGSASRTRDRRGYAHGTGSAAILRWSNPHIRARIPGPPRHSPPGAPGRSSRTRADPAAARESAGRGRWCRAPRCSRSGPLPGCPPPLRRRGCRWRRKPAPPRRRGESFPAAPAPVATGPCSSWHGPPRRCCRDDWC

SEQ ID NO: 22787 - protein, 109 aa, Pseudomonas aeruginosa
GSAGHSCRPGSGCPDRAPCGSARPCRRACTSRHSRRPSRCCRARCCSGFRWWCRCHAPACLPAPCCRRSRRRRRRPRWRSSCRYRRRSGCPASRRPPHRWRYRRSGAGP

SEQ ID NO: 22788 - protein, 142 aa, Pseudomonas aeruginosa
IHSFLKSRPPKIRLTIARVTMMAVNIEVMMPSDMVTANPFTGPVPMAYRMPPTSSEVRLASRIAVKARLKPSWIAFWTDMPLASSSRIREKISTLASTAMPMVSTIPAMPGRVRVAPRIDISATSMTMLKASATVAITPKKR

SEQ ID NO: 22789 - protein, 511 aa, Pseudomonas aeruginosa
GIDKGGQCTLLDCLAQTSHNPLIMPQVVDGIEHATEHFPALVQVVQIGAGKMFAGVTVAGRVERGVVVLVYRVADLDHPAVDEQVAVARIARRHHAVEHVHAAAHAFHQVFRLAHAHQVARLVGRHLRRQEIEHADHLFLRLAHRQTTDGQAVEADLLQAIQRAQAQVLVHTALDDAEQRRRAIAMGDLRALGPAQRQLHGALGDVMVGRVRRAFVEDHHDVRAQGALHRHGLLRPHEDLGAVHRRGEGHALLLDLAHGSQAEHLETAGIGEDRAFPLHEVVQVAVALDHLGARAQPEMEGVAEDDLRADVLDVARQHALHRAVGAHRHEGRGLDHAAGEGQAAATGLAVGRQQLEVHEAHGSVLGSAGRGIAGDEHGITVTEEAIALRHRRGVGGHGLRVAGEGRDQHQQGGFGQVEVGDQGIDHMERPARVDEDVGVAAEGLQLTVACRALPASARWWCRRRLPGRRGPGRRKPRPPRPGRPPAIRGASHGPRYARHAPAGRYRRRHAG

SEQ ID NO: 22790 - protein, 503 aa, Pseudomonas aeruginosa
RMPPLAPSRLSVLGTSSMEFLVKSVRPETLKTATLVLAVGEGRKLGASAKAVDDATGGAISAVLKRGDLAGKVGQTMLLQSLPNLKAERVLLVGAGKERELGDRQYRKLASAVLSTLKGLAGADAALALGDLAVKGRDAHAKARLLVETLADGLYVFDRYKSQKAEPLKLKKLTLLADKADSAAVEQGSKEAQAIANGMALTRDLGNLPPNVCHPTFLGEQAKGLAKEFKGLKVEVLDEKKLRELGMGSFLAVAQGSDQPPRLIVLQYNGAKKDQAPHVLVGKGITFDTGGISLKPGLGMDEMKFDMCGAASVFGTFRAVLELQLPINLVGLLACAENMPSGGATRPGDIVTTMSGQTVEILNTDAEGRLVLCDALTYAERFKPQSVIDIATLTGACIVALGSNTSGLMGNNEALVRQLLKAGGVRRRPRLAIARCSTNTRNSWTARSPTSPTSAGRRPAPSPPAASSRASPRNTTGRTWTSPAPPGSAAARTKAPPAARFRC

SEQ ID NO: 22791 - protein, 146 aa, Pseudomonas aeruginosa
IPLLPGAGLSSTGPSPAAYLKCTTMDSHKPTQPPEQLLDDLESIHDLLYERNEPPLLTESFEPDNIPLLSDVVSPGTAPRAPEPQTAAATTAGLAPAEQERLDDELRASAELILQEVIDDFAPQIEAELRRRLQARLGRLLGQRNG

SEQ ID NO: 22792 - protein, 990 aa, Pseudomonas aeruginosa
SGRGGRPPRPAALPPGCHPRYTPGLSSHFPQPYSALVPFRMDKTYQPHAIETSWYETWESNDYFAPSGEGQPYTIMIPPPNVTGSLHMGHGFNNAIMDALIRYRRMQGRNTLWQPGTDHAGIATQMVVERQLGAQGVSRHDLGREKFLEKVWEWKEQSGGNITRQIRRLGSSVDWSRERFTMDDGLSEAVKEAFVRLHEHGLIYRGKRLVNWDTKLHTAISDLEVENHDEKDHLWHLRYPLVNGAKTSEGLDYLVVATTRPETLLGDAAVAVHPEDERYAKLIGQFAELPIVGRHIPIIADEYVDREFGTGCVKITPAHDFNDYEVGKRHDLPLINIFDKNAAVLAQAQVFHLDGSVNPNLDPSLPQSYAGMDRFAARKAIVAEFEAMGLLEKVDDHALKVPKGDRSGTVIEPWLTDQWYVSTKPLAEDAIAAVEDGRIQFVPKQYENMYFSWMRDIQDWCISRQLWWGHRIPAWYDEAGNVYVGRDEVEVRTKHKLGNEVELRQDEDVLDTWFSSGLWTFSTLGWPQQTEFLKTFHPTDVLVTGFDIIFFWVARMIMLTMHLVKNPDGTPQIPFKTVYVHGLVRDGQGQKMSKSKGNVLDPLDIVDGIDLDTLLQKRTSGMMQPKLAEKIAKQTRAEFPEGIASYGTDALRFTFCSLASTGRDIKFDMGRVEGFRNFCNKIWNAANFVIENTDGQDTGVNGEPVELSSVDRWIISQLQRTEQEVTRQLDAFRFDLAAQALYEFIWDEYCAWYLELVKPVLWDENAPIERQRGTRRTLIRVLETALRLAHPFMPFITEEIWQRIKGQAGKEGPTLMLQPWPVADEGRIDAAAEGDIEWVKALMLGVRQIRGEMNISMAKRIDIILRNASPSDHRRLADNEPLLMKLAKLESIRVLEAGEEAPMSATALVGDMEVLVPMAGLIDKSAELGRLDKEIQRLEGEVKRVGGKLSNEGFVAKAPADVIEKERAKLAEAEQALAKLAEQRQKIAAL

SEQ ID NO: 22793 - protein, 605 aa, Pseudomonas aeruginosa
PCPTNCSSRPRKSSSKKSGRRPRASRPWPDGTIILPSRTRLRSHVSVFPVRCPGDRPDLQPRGTRRIHLLPPAALPRPHGGRQLPARRRGLRDPHRPRLGPVQRDPGGHRSRRTGRAGHRPAQRQAEDHGPARQHPDDDRTLLDQPAHHGQAQRTADRRADIVHPAAAGMAQRLRVPAAAAGVHRDRREAAAGLVLHHPERPGDPRHRLQPADGPCPGGQHRRHDPARHGHLQRAGGVGRRAVRADPGRRRYLHGYRHHRHRPGRGDRRREHPALAPADPGDPRGDPRCHRLPLLHRPGAEQRFHRLAGPGPEPGHRGAGHRRPGDSDDEETPARQEGSLTMLSAKNLKITFNPGTPIETRALRGLSLDIPAGQFVTVIGSNGAGKSTFLNAVSGDLPIDSGQILIDDEDVTRKPVWARANRVARVFQDPMAGTCEDLTIEENMALAQRRGAGRGLGRAVQASMRDGFRESLATLGLGLENRLGDRIGLLSGGQRQAVSLLMAALQPSRILLLDEHTAALDPRTADFVLHLTARIVAEKKLTTMMVTHSMRQALDVGERTVMLHQGQVVLDVSGEQRKGLDVPDLLAMFEKVRGEKLADDALLLG

SEQ ID NO: 22794 - protein, 668 aa, Pseudomonas aeruginosa
QGRGASPRRSGEAPSTCSRSRRDPRPSATLAGILPLRCPHEPRTALGGRPARHHRRPLHPQPPAPGRDRPAGDHGLQRQRNPYPQRSPGRLQRSQRDTDRRAVRDRRRPGAYRGGLPGRRLADRPRRQQRSAPAGTADAGGGRVGLGDEFHRGGGDLHPGGPEHRRQAEDPSGPADDAAGLRRTDQRHDDPGRHATEHGGQQRAGARGSCRLRLLRLHPDRPHGARHRRGLHAAHAQLAERRQPGGSRRAEGTADPARPDPRLSPGRPRTAPAGPARLAVDRQHPGRTATAHPPGRQRGRPGAGTQVPQRGGQGRRQHRAEGGRRVAAGRLRPSGGHGPALRRAEPGAPAVPRQLLHRPVAGGRHGRGDSAAGLHPARQERPGTGLPFAVRAQRGRPASRPRSAHRRHAGREAAPGRYPAGDRRLEGDPPVAGTQPRFPGAQPAGGDRRGGAGPEQGAARPAQPGRDGGADGQRGGAQRGRGTGRLPVDGPVPLHRHGRRLPRHPLAKPGPDRRHAALRPGPAEDRRYRPGGLAAGRRPRRRRPARAAGQPVPAHRGHRPVHLQHRYRGADGADRHRHRQADRRLALPLRHGGGGGGLGSLHDADFLAGEHPGAGPWPIPLRRLRPDRRAIYPAGDVRLRAGDSVAVSIVTGPGARRSAETLASLRRM

SEQ ID NO: 22795 - protein, 119 aa, Pseudomonas aeruginosa
SARPPRRSPRPARCHRRVPAAPGAALPPASRRPPATAPPPAPARGRGGVPRDAGSVRSRSARISRRPPAPRRSDSTPVHGPAAVAAADCVRGRPGTPGNRGSGWSPSARCHRPAPAWAP

SEQ ID NO: 22796 - protein, 96 aa, Pseudomonas aeruginosa
KNLHERPPSPHRPAQLRSGRPARQHQPGRQRAARHPLSDQPADQAAGKPPRPGPVRPRGARPAPERERPVLRPAGTRLAGRDRRRHAGGAGASTGG

SEQ ID NO: 22797 - protein, 290 aa, Pseudomonas aeruginosa
LEPAAGSRAPGPGHRPGASQPGRRRPRRGPPGATGRHPRALPLSLLAGLAAARAAERPPPGLRRLAARGGPALPGRATAAQRMKLRLISRKRSLPARSIHSKATISRDTIIAPAWRIRSTASALSLGRREPIASSTTNTSRPRPSRSSTVCSTQTCASLPQTTNCRRSPPGARSRAPSAAAEKSSFSRICVGSSSSRRAATVGPRPLLYCSLASTGTSSARATRNNHWLYSTSAGPSSMAGSRRSWISTTSRVEVAARISMASSFGSTSRFVWLRLARHGRHGQRVLPQP

SEQ ID NO: 22798 - protein, 160 aa, Pseudomonas aeruginosa
QEPAMNISLHFESRLQASPEQLWRWITSVDGILREIRPLLSMSVPPGIRSLEDLEVVPRRPLFRSHMRLFGLLPLGTSQLTLLELTPGRGFIEQSPMTGMRLWRHERRILPTPGEAGECLLVDQLTVRPLFAAGLVRWFLTRIFRHRHRVLCRQFRTDRR

SEQ ID NO: 22799 - protein, 501 aa, Pseudomonas aeruginosa
PSATLRSAPARIRHTLLESSTRTAHESHQAPAQGPRHPDPRQPLADPGDRRPGRRGVLFRRPAAADERDHGHRRRGRRLRRVRRQAPGKAQGAGLRTEAGAQRRLARQPGAPARHRRGRHRPGPERPGAPARSRAGAPVADPRRGLPGTALAVPPQQRAHRPAQRPAAPAPGHRQRRQRHPRRHRGDPAGQRHRPGTLSDHLGSPRRQRGGRRPAGRQAGRGVHRRPGGEPGDPEIGRQRPASPGQLPPQRRLRGAPAVPQAGRGRRRPAQPAAQRAGTKHQHPVAGGHPGDQRTLPPGADPAGAGSRARGDEGRQPARQARRLPQRRAAHPAPARGRRALLQERPAAAAALPAVPHRLPGGPLHHPADPVHRHPHPADEVHRPAVSLAHPRAHLPLVPLHPRHRPQARQRYRRRATEKRDRAAGETGERAEHRGGAALLLPRAVRAAPAPELRDQAPARSAGTPGDAGRSRQPRVNWPIRGRASGVSRSVAETCAAPPIT

SEQ ID NO: 22800 - protein, 339 aa, Pseudomonas aeruginosa
KVEPDMPIHHAIVHLIEKKPDGTPAVLHARDAELGDSQAIENLLADLNESYNAKNKAWGFFQGESGAYPFSGWLGEYLEGDRDFVGFSREAVEHLQKLMEESNLSTGGHILFAHYQQGMTDYLAIALLHHSEGVAVNESLEVTPSRHLDLGQLHLAARINISEWRNNKQSKQYISFIKGKGGKKVSDYFRDFIGCQEGVDSPSETRTLLKAFSDFVESEDMAEEQAREKTETLVDYATSQARIGEPMTLDALSELMDDQQPRAFYDYIRNKDYGLSPEIPADKRTLNQFRRFTGRAEGLSISFEAHLLGSKVEYDEERDMLIIRQLPTQLKDQLKRRKD

SEQ ID NO: 22801 - protein, 231 aa, Pseudomonas aeruginosa
CCISAGSTRTAGACSSRCSSARCHSACATRWPGPCAARSALPSGRRGSGSTAGTNCWPSPATTSMPSTACLARSRTTAANIRAAPMPPLTVSSPTSSRRPWIPHSAMWREAIRAWWRIASGCGSGSGVSEATAATAAIGKCWSVYLVRAENGALYCGISDDPLRRFDTHCSGKGARFFHSSPARALVYVEACASKGDALRRERAIKALSKRAKERLLVGVPVLREVGEPAI

SEQ ID NO: 22802 - protein, 573 aa, Pseudomonas aeruginosa
AGASHPPGGAHVRADPASLSHFALCREGAPAARFQATVLAFGDDSAGDAQAGPGGADRRLSEDPGVAGRRRCVLRYRVDRPSPGAGKGGSGAVSRRPGDGRRELRPVGRCGAVPARGKPGVRPGVHRRAFRQAAAGIPQGLHGRSQPAIQRRQRRPPAAGTGAPPVAGIHGATGAPVVARGRRFPVRRSVRRRLRRGALPVVPQGHAGHRAAGRRLPAGAGLVGTGARLRPWRASRDECGGSPGGGSRQPARGIAGRILQRPQRFPARPGGRHRRHRLRCRRGTGRTALRRQRGTHPAPRRPAGGYRACAFPAPGLSHRGALRHAGGDPAAAAGRRSAAVRVARGEAGPRRRHQAARRSARCQRWPGVEPVPGDGRGGCEHGAFVHRPHRDGRTGVRGLFDGPRRVAVGDQRPRDGEQAHRRGRTPAQALPEHRDPGTDRYLHCQGAERGVRPARGPATDERRSWRAGHLVPRGPRHRSDGVGRQPVNAAGTSFLLFSLGALVPVAPFLFLDGAAALVASLLSSLLALLFSGAVTARFTGRPLAFSALRQVLVGTLAAAFTYGLGTALGVGLG

SEQ ID NO: 22803 - protein, 496 aa, Pseudomonas aeruginosa
SAAPRRFPRRCGTRRWRARGSASLPEVAGFCLRRLAFLQTVQALDHEVQVQVQLVQLVVVGERHLHGVQLALQFLQPLDLASQLLGVGTAVELAVDVADVAVPAVDARADAPAIQRADGLHQRDEDGDERDQQDDVAVRQGGDAERQVALQQRQAALVVALGVLVQAQGARLGAGEGAGLVEQAAVLHHLARGFQHQRDQRRVEAFVDHQGGHRRQGADVSFRHVARQVEQAFADLDPLEERQARLVGGAAAEVDQAKLVVVGQFLDRRVLRRADDERRVQLAGQQVVDHRVAAAGFPGDRIVSRGDVVGLQDRLGGGAGAAAVAADGQAQVQQVAELVDVHVAAVEQPERFLVDRAEGLQLARLPGFELALLAALDQGDVDLAGAEQALQVVARAGAGHQLQFEALLLELFPELAGEHGVAAALGAGGHGRAHRRRRGDEIEHRGDQGGDHRDQPEVGADQDGEVLEQVLDAIHERSLCCSPEGYDGCGRAHSSA

SEQ ID NO: 22804 - protein, 291 aa, Pseudomonas aeruginosa
SCRGRWSPSNGWNAPAATASARSAATSFAERRLLGLVAPGLLAQPVGEGLVAVARRLALRPDQPVGIGVGHADVAQLHQAALGEGAGDQAATLQGDALAQAHGFQQQVRVIDQQSVLRFRHAGTLAPERPGFGGAQCRAGDDLARRARQAAAVEVGRGDHQQLVVEQAFPTDPFPVALADAYAEVGQALAQVLHVKTGHQPHATVRMALAKARQARQQPVQAEGRHHRDHQLTLPWTRPHHPRGVGDLAQRGAYLQGVEPAVLAQAQAAPLADEQGQAEEVFQQLDLLADR

SEQ ID NO: 22805 - protein, 210 aa, Pseudomonas aeruginosa
SSTKDAAMQLIGMLDSPFVRRVAIALRLLDLPYEHRPLSVFRNFQAFSLFNPMVKAPTLVLDDGTVLMDSSLILDYLECLAGRERSLLPQRPQARARALSLIGAALVACEKSVQIYYELNLRPEERRHGPWLERVEGQLLAAYDWLEAALRQEPLARDGGIELVGVTVAVAWRFSQLVVAERVAASEYPELASYSDYAEGLPVFLETPSV

SEQ ID NO: 22806 - protein, 80 aa, Pseudomonas aeruginosa
VAAVVTARTGCCELLFGAGMEAARPWLSLVLSAALGLLFGMLLGGLWFGYWIRQEGLQLTHLLLVVWVLANFFVLNVRWN

SEQ ID NO: 22807 - protein, 472 aa, Pseudomonas aeruginosa
AMGFPVPRLAEKHQEKATIMHIQSLQQSPSFAVELHQAASGRLGQIEARQVATPSEAQQLAQRQDAPKGEGLLARLGAALVRPFVAIMDWLGKLLGSHARTGPQPSQDAQPAVMSSAVVFKQMVLQQALPMTLKGLDKASELATLTPEGLAREHSRLASGDGALRSLSTALAGIRAGSQVEESRIQAGRLLERSIGGIALQQWGTTGGAASQLVLDASPELRREITDQLHQVMSEVALLRQAVESEVSRVSADKALADGLVKRFGADAEKYLGRQPGGIHSDAEVMALGLYTGIHYADLNRALRQGQELDAGQKLIDQGMSAAFEKSGQAEQVVKTFRGTRGGDAFNAVEEGKVGHDDGYLSTSLNPGVARSFGQGTISTVFGRSGIDVSGISNYKNEKEILYNKETDMRVLLSASDEQGVTRRVLEEAALGEQSGHSQGLLDALDLASKPERSGEVQEQDVRLRMRGLDLA

SEQ ID NO: 22808 - protein, 672 aa, Pseudomonas aeruginosa
RPRWRLRGCSGLALLRSASGCGLVGRGMFSVSVTARRALFTSAGGWPVFLPSGALLARSQWKQPRNHQHADEHHQQGKWHADPDEVAEAVLARAQHQGVHRRGNRRHEGCRGRHRHHHGEGVGRGADLLGGGDGDRRHQHRGSGVGDEQADGRGEQEQAGQQHARAGVAEGVDQQRDHQVDTAGLLQGQGEGQHADDQDQALPMDGAVGAVHVDATEQAHQQAADQCRDHVGHHPADHQRHHHGQAEQGVRRLAQGRRHLVDLRRQAEHQEIAVASLQLADRLPGADHQQGIAQAQLLFQHAVGERFVVATQADHVEPVLRTEAQFQDALAEQGGVRRQSHLGHADLPRLVDEVAGAERQAHQVQLGAAPVHVLRRGEDVQQQHVARLQLGAAADLDHLAVELAYPLQADHVGAQAGAQLQFFQGAADQRRAELDLQAPFAAGQAIVADQVAQGPPCLRRADFRRAGGVQPVAREQHVGHADGEHHEAYRGEGEEAEAGMTLARQLAVDHHVRWRGDQGHHAADQSGEGQRHHQPARRDLQLGGDAQDHRDEDRHHPGGTHHRAQPGHRQHQQYQQARFAAAGAGDQPVADLVGHPGTHQAFADHEQRGDQYHAGIAEAGQGFVEGKGSADAEGHDHQQGDHVQAQAVVDEEGDGGGEQADHPEQFEVHAGI

SEQ ID NO: 22809 - protein, 133 aa, Pseudomonas aeruginosa
APERDVMADFEYYIKGDMALRCNSEGLWYLSVGGSGFFLQEEESFWRVLVLLEKPYEEVREKLGRGFCYLNVVLAGLDSESDYWIGLALSWVEQGGAEASDVLLARLKGVVEGRSANQKNRHKAFSVLRKIGG

SEQ ID NO: 22810 - protein, 131 aa, Pseudomonas aeruginosa
RNALYIVEKWHLGGYMGKRVVVLLWLLFTSMSAHAIDKKVNNVTIMRVGFMVDANSPGGGWGCIVSKPGAADCGFGLMRLPPMNTDAGKAMLSLMLSAQATQNKLPEIAYSASATVNAVCQITSAQIDSGA

SEQ ID NO: 22811 - protein, 722 aa, Pseudomonas aeruginosa
QGIPWKRSPIQTVGMAQGAASVSGKRLFRARFVPRTDGRRRGGDAGSDSLVVAAGVVPCRGWQPRFYSAGAGLAVPPGRCRTWSHNCGVSGTTVYAWEPAAMPRPYNERFVPQESHRARQQTSRGSRPEYRPTRLPASRPAARGHGQDLPGGVRGRRAPARAGAVDPCPVGRDRTACRSHAMAGPAAARGMDAGGDGARDAGARRGPLAHCLCPAAVLPAGIPPGAARSDGQPIVARVDRARRRPAVVVRRARPGGAVDGGAAGRTGVVAGTAPGLARPRGPTPGKNLPGAAGEPGRPSRAGGVGALRGGVLADPGTAVSLRTGSDLRPLAPPGAPGRRPATPGGWRSGGADRRGSRLPDAQRIQCHVPTPDREHAEPLLRLVRFGVAFVRWRTAPTRQDSYAGPVSRRPPREASMQRLNVEFRSEGVALRGWLYLPEARAERPAIVMTHGFSGVKEQYLDRYAEVFAAAGFVVLLYDHPNFGDSDGEPRQEIDPVMQRRGYRDAITWLGAQARVDARRIGIWGTSYSGGHVLEVAALDRRVKCVVAQVPTVSGHASALRRTRAEQLPALLASFDADRLRRFEDLPPALLPAVAAGPDEPCAMAGADAHRFFTDSAALAPNWCNRVTLRSAELARENEPGIHMARISPTPLLMIVADRDLLTPTDLCLEAYQRALPPKRLLMLAGGHFTPYIEHFDATSQAAADWFVRHLGEGGEQPATVVE

SEQ ID NO: 22812 - protein, 367 aa, Pseudomonas aeruginosa
SWRPPVPVATWRMVKLDRYIGVTVFVAILAVLGVILGLALLFAFIDELNDISASYGIGDALRFIFLTAPRRAYDMLPMAALIGCLVGLGTLASNSELTIMRAAGVSLSRIVWAVMKPMLVLMLAGILVGEYVAPWTENIAQSGRALAQGGGDSQSSKRGLWHRQGREYIHINAVQPNGVLYGVTRYRFDEQRGLESASFAKRARFETDHWQLEEVTTTLLHPREKRSEVVKLPTERWDAQLSPQLLNTVVMEPEALSISGLWQYIHYLADQGLNNNRYWLAFWTKVLQPLVTAALVLMAISFIFGPLRSVTLGQRIFTGVLVGFVFRIAQDLLGPSSLVFDFPPLLAVVIPASICALAGVWLLRRAG

SEQ ID NO: 22813 - protein, 273 aa, Pseudomonas aeruginosa
ATRPFESLPMRVADFHFDLPEALIARHPLPERRASRLLALDGPTGTLAHRQFADLLDYLRPGDLMVFNNTRVIPARLFGQKESGGKLEVLVERVLDQHRVLAHIRASKAPKPGTRILVEGGGSAEMLQRHDALFELAFAEPVLPLLERVGHMPLPPYIDRPDDAADRERYQTVYAQRAGAVAAPTAGLHFDEALLEAIRAKGVDTAFVTLHVGAGTFQPVRVERIEDHVMHREWLEVGQDVVDAVSVCRARGGRVVAVGTTSVRSLAKRGTRR

SEQ ID NO: 22814 - protein, 172 aa, Pseudomonas aeruginosa
CHVHHPQSRAPRTRGLIHELHELRAAGDRRQGPSRPPDLPPRRGRDPGLHAGGHLRHGEGHVAARHRGHRRADHPRQHLPSLVAPGHRGDPAPRRPARLHAVERPDPHRFRRFPGVQPGSHAQDQGGGRDLRLAGGRRQGLHGAGGVHGGATRPGLGHRDDLRRMHAVPGRP

SEQ ID NO: 22815 - protein, 164 aa, Pseudomonas aeruginosa
RGAQGAPRHNGRCHAQQVSSVEISADPGGPRRRVHLFRTQPLPGRPGGADQRRQHGAAGHPGRCRPRCQGADRRRYRGEGRQPVEEGRPDPPGQAGRPASRQGSGAPDPGRRLRGGAEPGPDHSRVAAQAGRQPDEARPGSVRRCALPAGSGHGQGGRCPPEGL

SEQ ID NO: 22816 - protein, 322 aa, Pseudomonas aeruginosa
SSAGVTSRSCGSKGTEMNIKIGTINFMGIRNVAFAVTLILTVIALGSWFTKGINFGLDFTGGTLIELTYEQPADLGKVRGQMVGAGYEDAVVQSFGDARDVLVRMPSEDPELGKKVATALQQADAGNPANLKRVEYVGPQVGEELRDQGGLGMLLALGGILLYVGFRFQWKFALGAILSLVHDAIIVMGVLSFFQVTFDLTVLAAVLAVVGYSLNDTIVIFDRVRENFRVLRKADLVENLNISTSQTLLRTIATSVSTLLAIAALLFFGGDNLFGFSIALFVGVMAGTYSSIYIANVVLIWLNLTSEDLIPPQAKDTVDDRP

SEQ ID NO: 22817 - protein, 192 aa, Pseudomonas aeruginosa
PALDESQEVHVNKSMLVGAVLGAVGVTAGGAVATYSLVDRGPDYAEVVAVQPVKETIKTPRQVCKDVAVTRQRPVKDQHQIAGTAIGAVVGGLLGNQIGGGTGKKIATVAGAVGGGYAGNKVQEGMQERDTYTTTETRCSTVHDSSEKVVGYDVKYMLDGKAGQIRMERDPGSQIPVDKNGRLILSQGETLR

SEQ ID NO: 22818 - protein, 345 aa, Pseudomonas aeruginosa
SLASFSLTEMTSRRSMERKISSPALRAARRAIFSIGCMERSPGSLKKAGHSSRNRWRLKGDLSAAWYKADLCCRISHPSVTWRWRASALLDRIRVVLVNTSHPGNIGGAARAMKNMGLSQLVLVQPESFPHGDAVARASGATDILDAARVVDTLEEALSGCSVVLGTSARDRRIPWPLLDPRECATTCLEHLEANGEVALVFGREYAGLTNEELQRCQFHVHIPSDPEFGSLNLAAAVQVLTYEVRMAWLAAQGKPTKMEKFESTSMLNTELVTADELELYYAHLERTLIDIGFLDPEKPRHLMSRLRRLYGRSAISKLEMNILRGILTETQKVARGLSYKRSDD

SEQ ID NO: 22819 - protein, 131 aa, Pseudomonas aeruginosa
GLAMAYSEKVIDHYENPRNVGKLDAADPNVGTGMVGAPACGDVMRLQIKVNEQGVIEDAKFKTYGCGSAIASSSLATEWMKGKTLDEAETIKNTTIAEELALPPVKIHCSVLAEDAIKAAVRDYKQKKGLL

SEQ ID NO: 22820 - protein, 110 aa, Pseudomonas aeruginosa
GVAMAISMTEAAAKHVQRSLEGRGKGEGIRLGVRTTGCSGLAYVLEFVDELAAEDLVFESHGVKVIIDPKSLVYLDGTELDFTREGLNEGFKFNNPNVRGECGCGESFNV

SEQ ID NO: 22821 - protein, 400 aa, Pseudomonas aeruginosa
SLCPGRRAERPQSVAGHSSREGLRRPRHGRQLWPAVETPVPRLSRISGIPGGKMMKAPQPEVVATASRQNPGETLRQAREQKGLSLSQVAGQLNLTENSLRQLENGAFDKLPGHTFSRGYIRAYAKLMGLDQAELVNSFDHFTGTNASGSTVQSLGRVAEPVRLSRNVLRIVSLLLLALLIGFGYFWWQEHSARTPETAGLSLEHVEVESADGTTEIHTLDEPEDQAVIEAQKEGEQAPAEVSPEVAAQAEGAPPVASEGAQVPAAPAQGTPAAPQQPVTAAPAGTAPAPGTAPAVPATASPAAPPAPSEPAAAPVVAGEGQGVVKVQFVADCWTQVTDANGKVLVSALKRKGDSLELAGKAPLELRLGFARGAQVSYNGQPVDVTPFVRGETARLKVGQ

SEQ ID NO: 22822 - protein, 184 aa, Pseudomonas aeruginosa
PTPRPATSLPPSRRSAAWKMPARTSCGFPSPTWTPPRHSARSSSRSTCRWSPTSTSTIASPCASPSWEWTACASIRATSVARTGSRPWSMPRASATSRSVSASMPVRWKRTCRRNTANRPRKPCSNRPCATSIISTSWTSRTSRSASRPPTSSWPSPPIACWPGRSSSPCTWASPRPAACAPAR

SEQ ID NO: 22823 - protein, 220 aa, Pseudomonas aeruginosa
RIGVIGVTSRTEDEDLAQIKDWWQRNGKPLVTGGILALAVVFGWQAWQKYQTNQAQGASIVYQQLIETALNPAGQPDPAKVAELAGKLKSEFGGTHYAQYGSLFVAKVAVDSGKLDDAVAELKAVMDKPADATLGELARQRLARVLAAQGKVEEGLKLLDGDADKAYVSTREELRGDLLVQLKRTDEARAAYEKAKQSLPEDGAGDALQIKLDDLSKGEA

SEQ ID NO: 22824 - protein, 283 aa, Pseudomonas aeruginosa
RDRPRRSHRQEEVDQASQQRSAVGAGHQWRRGGGADPGRQADRPRCGQRRPSLDLRKHRAGADPARHRRAADRRQHGPGRPGQRQCGGGRRTARPADLGAAGTDSPGAFRTGSRGGHRRRPPAVRRHPLRGQLPGPCRGAGREQRPPALAARSVELRRRRRRLRQYLRQPGQRFGGRPGLARCLFAVEQRRPGASPTVGSGGVLQQRGGRRPGRLRASAEPGGRSLRRSRAGRQRWRAGSSAGGRELDVRVRQRWQARRLHHPLDWVSSVRPLPSDVSGLCVF

SEQ ID NO: 22825 - protein, 499 aa, Pseudomonas aeruginosa
ILVESRMVPVIALVGRPNVGKSTLFNRLTKSRDAIVAEYAGLTRDRQYGEARWQGRTYIVIDTGGISGDEEGIDAKMAEQSLQAIEEADAVLFLVDSRAGMTAADQMIAEHLRKRNKRSFLIANKVDTIDPDLARAEFSPLGLGDALPIAAAHGRGINHMLQEALGIFPKDNAEEEGEGEPASEEVAEGEEPTRIPGPSEKDGIKIAIIGRPNVGKSTLVNRMLGEERVIVYDQAGTTRDSIYIPFERNEEKYTLIDTAGVRRRGKIFEAVEKFSVVKTLQAIQDANVVIFVMDAREGVVEHDLNLLGFVLETGRALVIALNKWDGMEAAERDYVKTELERRLLFVDFADIHFISALHGTGVGHLYKSVQESFRSAVTRWPTSRLTSILEDAVQVHQPPMVNGRRIKLRYAHLGGANPPLIVIHGNQVDAVPKAYTRYLEKTYRRVLKLVGTPIRIEYKGGENPYEGKKNSLTARQVNKKRRLMSHHKKAEKKKKDKRR

SEQ ID NO: 22826 - protein, 291 aa, Pseudomonas aeruginosa
KGSGRHAAGPVLLRQTRGDAASGSGKAMRDLTVLPDLDIALVQSSLVWHDAQANREHFAALLESAAGADLVVLPEMFTTGFSMASAEQAEPELGPTHAWLLEQARRLGAVVTGSLIVQLADGSHRNRLLWARPDGEMLHYDKRHLFRMAGEHEHYSPGERQELFELKGWRVRPLICYDLRFPVWSRDPHDTDLLLYTANWPAPRRQHWNRLLPARAIENLCYVVAVNRIGEDGNALRYAGDSQVLDFQGDSLFNAADADGVFRVRLDAAALAAYRQRFPAYMDADRFEIHP

SEQ ID NO: 22827 - protein, 153 aa, Pseudomonas aeruginosa
CPEFLDRRWAEPVGVGGGHFPGLRRRSIAATGGLRRSQPGRGGRTPEQPAAGTGQQADAGRPGAAGRPGHRFAAGALQLRLSRRCGADSRDTVIRSTQRGEAALDGRSVNRRWRCPGGGSPVRRASGGWRRSGRRAVPGWWRWRSARSPSDER

SEQ ID NO: 22828 - protein, 112 aa, Pseudomonas aeruginosa
LAMTTQRYLLDELETADMLEIDGLHAWRFELNENLLDQADLAAEADQPFASEDWVLAVESLDGRTRREWRFSYNAVMEAEPQADGESWRLTTGEGAYQLRCLGAVSASGEDE

SEQ ID NO: 22829 - protein, 636 aa, Pseudomonas aeruginosa
KKGAAWLPFSLPCRSGRLGLGLGHRAVQRAEQGAEAGGGDVLVDADAVQRALALQADLDIGRGLGIGAGADGVLMVVHDFRLDRQGGHQGFQRSLADPAPVLLLAVEGDFQVDGAGAVLFLQAMAGEDVGRGRLEVFVFQQRVDLLCGHFQAETVGLALHYLAELDLHAPRQADAVLLFEQEGDAALAGLAVDPDHRFVVAADVGRIDRQVRHFPDRVFLLLGEALANGILVRAGESGMDQVADIWMARVDRQLVALFDHLAHRVDVGEVQLRMQALGVHVQGQGHQVDVAGALAVAEQATFDAVGAGHQAQLGGGHAGATVVVGVQADDHAVTLVDVAAEPFDLVGVDVRRGALHGGRQVEDDLVVRGRLPDVDHRVADLHRELQLGRAEDFRRVLERPLGIRLLGGQLLDQFRGVGGDVHDALLVLVEDDAAERRGGGVVDVDDGLLRPAQGFEGAGDQVFAGLGQHLDGDVVRDVVAFDQLADEVEVGIGSRREGHFDLLQADLHQGLEESHLLRRVHRFDQRLVAVAQVGTAPDRHLGDGLRRPGAVGQIDGREWAVFLRRVFQHAHGANPLESVPGPAGPGERSDEMKRSVAQPRSRGLTRHRQACWRSRMRVCGVFMRTTLVRLHLNGKH

SEQ ID NO: 22830 - protein, 102 aa, Pseudomonas aeruginosa
SRARRRCSGGRARRPGRSSSSVSRSASENSARGSTPACWPAPMAASTRCWTPPPATGSATCASPATTRSPTITRTAPGIPCRRAGRSGTATSRSAGPPTRTP

SEQ ID NO: 22831 - protein, 124 aa, Pseudomonas aeruginosa
  UNSURE (123),(124): Identity of amino acid at the above locations are unknown.
SNSPPARATARHATPGAAWTARSSSARAWACASSNRTSAMCWRRSRHRFTTITPTTSGTSSAWALPDPSGMMPMPMASQVDRGTLGGGLAATWRWDDFKLVTGVDAMRNEHRARGSKYDMMTXX

SEQ ID NO: 22832 - protein, 332 aa, Pseudomonas aeruginosa
YTDADQFPWSKDAVFHNYGAFGELTWFAAERDRLIGGLRLDRASVKDYRQTLKSGHMGHAMANPTANDTRADTLPSGFVRYEHDLADSPTTLYAGLGHAERFPDYWELFSPKRGPNGSVNAFDKIKPEKTTQLDFGLQYNGDKLQAWASGYVGVVQDFILFSYREGMMGSSTQATNVDARIMGGELGASYQLTGNWKTDASLAYAWGKNSSDDRALPQIPPLEARFGLTYEEGDWSAGSLWRVVAPQNRIARDQGNVVGKDFDKSAGFGVFSLNGAYRVTRNVKLSAGVDNLFDKDYTEHLNKAGDAGFGFSANETVPEPGRTFWTKVDFSF

SEQ ID NO: 22833 - protein, 262 aa, Pseudomonas aeruginosa
PQQRVAPAGALAAGEHSAAALAAAGGRRPCRASRAFRPGRARDADGHADAGGHPSAKGGGYRPRARRGGGLRDRPAERDGGGLHDFRVPRRSAPRRHPAHRTVQRQGSRRRALAGLQRGGEERADGRRAARRQALRPRQPVADARGLPGDPAQLGERPVDLVEAQAGRTPWRAAAAPRAAALEERHRHHAGAGRGLPVGGGLAPAGLGAGLAGAVAAAGGSPGPGLRPAARRSVEVELAGLPECRQQQHAEQRLGAEPEEGG

SEQ ID NO: 22834 - protein, 332 aa, Pseudomonas aeruginosa
ETGSRQTPNPLRTPNRMNTHKHARLTFARRLEMVKQMTLEGLDAVRAAAAHGVTAPTARKWLGRYLAGGQAALADASSRPLRSPRAIDAGKALLIVELRKRRMLQARIARSVGVSESTVSRVLARAGMSRLSDLEPVEAVVRYEHEAPGDLLHIDTKKLGRIVRPSHRVTGNRRDSVDGAGWETLFVAIDDHARLAFTAMHPDEKTAQAVLFLRNAVAYYARLGITVQRLLTDNGAAFRSREFRSTCVELGIKHNFTRPYRPQTNGKAERFIQSALREWAYGWTYQNSAHRTDALASWQHHYNWHRPHSGIGGIAPMSRLNSSRNNLLTLHN

SEQ ID NO: 22835 - protein, 299 aa, Pseudomonas aeruginosa
PRPARHERGEGPADAMGLPCRGHPPGNPLRARDPWQGRAQGRTQPAGEKPRQYLVAPAPAGARFHLLPATPRRHRLGLRDAAQDHARRPRRVAGKRRVLPAARRRPTLRAGNRLTGTPMSLEQHYSSILTQLGEDVNREGLLDTPKRAAKAMKYLCRGYQQSLEEVVNGALFSSDNSEMVLVKDIELYSLCEHHLLPFIGKAHVAYIPNGKVLGLSKVARIVDMYARRLQIQENMSRQIAEAVQQVTGALGVAVVIQAQHMCMMMRGVEKQNSSMVTSVMLGEFRDNAATRSEFLSLIR

SEQ ID NO: 22836 - protein, 146 aa, Pseudomonas aeruginosa
TSAIVAGKRRHQWSRQDRKEMNLIAHVEIPVSDLERAMRFYASVFGVAFGEVATLHGSRMAHFPFEEGRDGASGALAEGDVYVPTLHGAIIYLNVADLDAVIARALGEGSEILFPKTPLGDGVFIAEIRDSEGNRIALQSACGERP

SEQ ID NO: 22837 - protein, 79 aa, Pseudomonas aeruginosa
PGWRPGPRSTAGSPAGCRTPESRSRCRRTDRPAAPGAGRSDTRAGFAPVRAAPGRPRWPGTRCAAPGVPGPPGSRSADS

SEQ ID NO: 22838 - protein, 592 aa, Pseudomonas aeruginosa
ASRASAKARGCGTRLNIAPTSGELAEHAAVLAQRRMDPLETLVARHRFQQTVGHQRQQVRVQQVVDQPCAAVALGATLGQVAHQRLAVVESQLTARQALAEALQLDLDQLAQYRAAHRVVRHHAHARQQRRLEMPAERRPDGFLQEFGGRPRAVLAKRGDVLAGEVGGHQDQGIAEIDLAPFAIVGHALVEDLVEQVEHVRIGLLHLVQQYHRIGLLAYRLGEHATLAIADIAGRRADQARDGVLLLELGHVDGGDETLAAIQQVGQRQRGLGLAHPARAHQQKHADRRIGLVQPGRGGAHRAVQGADRLFLATDPRPQVVSEPHHLGVVFPRQLFHRYAGPGADHLGNQARADLEADQPPLGLGIGECLAGFVKGLFQGFDTAMLVGRESLRVRLAALLFPVRLAGPGQLLAQGEQALGEFALAAPLVLLYVPLAFRLGQALLQRLQGIVVDRQACLGIAAQGLALALAFGQLAAQALETLRRRRQADAHPRTGGVEDVDGLVRQLATRQVAGGQFGGGHHRVVAQVDTVAFLVNPGQATQDRHRLGNARLMQLHGLEAPGQRRVLLEILLVFGPGRRRDGAQLATCQGRL

SEQ ID NO: 22839 - protein, 184 aa, Pseudomonas aeruginosa
QVGGIRAAGLTARADKRMGLVDEQDGRPERCLHFVDDAFQAPLELALHAGTGLQQAHVEGQQLDVPQRRRHFPCGDPRGQAFDDGGLADAGLADHDGVVFPPTGQDVDHLANSPVATEHRIELAVARLLGKVVGETLQQGLAAARLAAGRALQRLREREILQPLDVEPRQQRLVAAAGIAQRVA

SEQ ID NO: 22840 - protein, 472 aa, Pseudomonas aeruginosa
QGQDQCRLVDLATAQFEVGQQQRILQPLHQLGREHRIARGTMLAPRLQRGVEFAGVHRGILQGARQQSLGTLQQAQQQVLHQYLAATTGYAALGRAFEVAPGVGIQRLNQLLQVYVDHAHPSLMNLAAQRHHAIRALPAQPAGPAKAAGVLRADAELTDFLVAQDQPDVVVERVAQGEANQRAKRLVAGTDRQELVEALPVELADMNAELAAAVADPFAQHRVFAKLAVEQAEPVALLFEDRDAPFDTLLGDQFGMLEVVAQHRLDQGRRVRPQAEQAQVGQQAFPVQFPGLADLFPAQSDEGEQLGGKRIARAALEAHPVAVLAPDRQQQPMQAVMEEIEEVPRRIALLAVAQSLLAVERRQRRTGTEQADQVETQPRPQHAALFEELHPIDIAAREAEARIGLEFQLIVERLVSQAGMFLAQAIHDQQDRLEQRVLANAPGQRAYSRGCKPMRGFHWYTSPCVLLTRNSW

SEQ ID NO: 22841 - protein, 196 aa, Pseudomonas aeruginosa
ELLGEVARGVVQPAGFPTHARRASMATPAYMSITGTKQGLITAGAFTEDSVGNTYQEGHEDQVMVQGFNHEVIIPRDPQSGQPTGQRVHKPVVITKVFDKASPLLLAALTSGERLTKVEIQWYRTSAAGTQEHYYTTVLEDAIIVDIKDYMHNCQDPGNAHFTHLEDVHFTYRKITWTHEVSGTSGSDDWRSPVAG

SEQ ID NO: 22842 - protein, 660 aa, Pseudomonas aeruginosa
GTTDVRSSQPDPLQPRHRRPRHRPAGALLQRPRSHQPAVRLRPGAGRRTPRAGPRKPAAQTRLPYPRARRQRYPRPGAQRRTGRLGQAPDPLPHHPRPATGLPRPAHQPAHLPAPHGAADRRPGAGGTRHPRRRLPLPARHPLPRARILRAVRRERPAVRPAPVLRGGHPFSFPAQRHGAPAGVRRRPDGVPAARAGGLPAGLRPGRRPAGGQALRRTPGNPHQPRHPPRLRLRETAPDAGKRRPRRSPAGPRGLRLSRSLRRPRARKAPGQARPRTAAQRLPPGRGPQRPTVAAQRPLPAAGRPSPGGLERPLAAHRGDSRGAAASGAGGKHRLRCLGEPGRLPAGLPQPLPGHALGGVLPSPTDAAEAAHPRHAERGGDRPEGRGNPLRSLRSGEGAIPLGSRGPGRRQQQLLVTRCLRLGGKELRCHRHPAGRHGGAGDLPRRRSRPAAGHRLPVSQGTSGALRTAGAQDPQRLQEPQQPWRRWLQRAAHRGPQGPGADLRPCPARLGRKHRARPEDPRRSPTPRHRAGEQLQRVQGRGTPHHPRRAQGGGPSQRPPHRSQRPAPEDRQRPVRRGRPGDPPEQRSEGGAGGRRRTDPQGRRQLPQARRQRRDPLRGQRPGQLRRQPGQRQRRGAAVAGAAARRGCGDSGPGTGQPGA

SEQ ID NO: 22843 - protein, 1122 aa, Pseudomonas aeruginosa
PSRAEGAGTIDRRCLGRPGARKPGRTVATGERGMSGFQDQSIDEGVRKRTAYQNDRRARLALNVERQDGGILQIPVASDMLGHEEHERIQQNTFLAVMPLVRLPTLGKAGYGDQLPAGALPRAGRIYLFQDGKLWRELECDGKGNLFEVDLLQGRSQRADKRPAVGKTQALILVPVLVKGQFVIPRYTMAYSETPWPWSYIDWLEEDPQRVNRRCQQMASAWNASVANQHWKASIHQPALVIDHHAQGLRPRDFNVESALEDPAEFTPAFAAFREESLVCQLQRRQQELAPLLKQAPPSALPTLEAGEDVLETLKLRGHPNLIGLMLDDSLFALRHAAAQARHCAAYLRSLNALLPHRPNGRYAQVLSNMLDGPLAKLRGEVDQAELDEAIFAEERQSCRIHLTQQVEHLVALLEGPLHPVLQDWTHQCDEALLEPYSLMSEALAALNQLPDRCDALYSGTAYRALAAHVERVVSTVLQASHPLGAMLLAKDEGQLPEPVRRLQALRDSPRTPDPDAMGLSTLMLGASLLGEVDQPSAGKSLAYFLGDLLDVFGASVVEQLGRLSQGATQIQLDRLFAPTFNTLSALSVKMKGIRLLPDSQVPLDMVVVGVRGAGLRNGLTEVERQELRRKSYRRAIVQDGAGNPLAGTSPRDTGMSRANLRNVMVVAVPKDHPDLLAYTKFRTQLGTLTQVMENTRIVPTMMLGFAIYNLNVQVQAYSGFVDSGEKHRGTIGAVGAVIDLTAAGGSHAKLLFGPSTAKYLETPRISVAQISPRWARNLEVQTGSPKLGLLRGLGGAATLFGAGISVWDGYRALRQGDSDAAAAYGVAAVGGGLWGAYVLGWIVNPYALLAGAVLAIGGTVVANLLTDSDAETIVKKGPFGRQFAEAGLLDSLMGQDQRFAHLKDPQTAYRQLLGVLGHPRVFVHRLEDWRKLAPAAHRSVLQEAERGRQAVSRTALSCIDPKLQALEANDWAVVLSSPLLAMFENGQKAFRLVAQEFLSSLPIDPGTLFGVKRYHRVPAGPAKLEALPLDAASVLYVLPASLPIPQLSPRARYSMRMTQGLKISAQFELNADQPEQRLVLPQPSPKSWSAFTSANRYLPPDDLGPHAAPPYWLIENSEFNV

SEQ ID NO: 22844 - protein, 446 aa, Pseudomonas aeruginosa
SGRPRTGWSSLRSWYLSLQQETDRPRGLRDGQSATMIAGREEKPAARRRSRNERCFAVFCGRWHFGALFRPYARGCLAGATGLAETLSMPIRFKPGRSTRPAVQDDFFIPELCEAEALFTLVLLAELLVLVLVLAEPMTPSFNWVRLALASLFVQWIVLLSAALFCRLRPLLARLPVALAGSACCLLVVALTLGCTAVAEHYQLGGELTRAGEVNLYLRHALIALIMSALVLRYFYLQSQWRRQQQAELQARLESLQARIRPHFLFNSLNSIASLIELDPLKAEHAVLDLSDLFRASLAKPGTLVSWEEELALARRYLSIEQYRLGDRLQLDWQVHGVPANLPIPQLTLQPLLENALIYGIQPRVEGGLVQVEAVYREGVFQLCVSNPYDEALESPPSKGTRQALHNIDARLGALFGPKASLSVERRDGRHYTCLRYPCARLMQEA

SEQ ID NO: 22845 - protein, 305 aa, Pseudomonas aeruginosa
RIRPGSLPGQRRGLPGQAGAQRRPGRGVEESLATEPRATGRADQAPGLRRQRSAQPHQCTDPQGDRADPAGRGDLLHCRPQVRDLAPCAGRGAAGRAVEGAGRRVRRALRAHPPQRAGRPRTDRTPAAYAAGAFPALPERPRRRCADRQPAARGRGQASDASALTAVGGSPATRVRLSGPASAHSGSNCYHGRIPVHGISHVVPRNPHRHSPERPRLVAGRIRQGAPGTGASRLDRHPAADDQSRRQAARRTAGEDRRQGPVRQGTGNRPARRRRRHRGAFDEGRADGLSRGARPLHHLRARRPA

SEQ ID NO: 22846 - protein, 160 aa, Pseudomonas aeruginosa
RFRLEHLRQPRATASRERGRHLQPAPPGAAAGAPAGPADPFPAGQRQYPPGQAGCRRIRRDHPRRRRPDPPRLRVAHPLLDQCRRQPARRRTRRRRHRMPYGRQRPACLAGTLAPYRHGSAGHCRARAEQAAQRRLPGADRLLRHPRGRPTVAARPGRPA

SEQ ID NO: 22847 - protein, 297 aa, Pseudomonas aeruginosa
WHPVAARRGAGATGGRRGAGRAGGRGPAGAGRRSDSRSRLRRGRTSVSGWRLLLTRPDEECAALAASLGEAGVHSSSLPLLAIDPLEETPEQRTLMLDLDRYCAVVVVSKPAARLGLERLDRYWPQPPQQTWCSVGAATAAILEAYGLDVTYPEQGDDSEALLALPAFQDSLRVHDPKVLIMRGEGGREFLAERLRGQGVQVDYLPLYRRRAPDYPAGELLARVRAERLNGLVVSSGQGLQNLYQLAAADWPEIGRLPLFVPSPRVAEMARELGAQRVIDCRGASAPALLAALTSAA

SEQ ID NO: 22848 - protein, 154 aa, Pseudomonas aeruginosa
RSSSARAASNGDWPRPNTCCAWPACACPPCRTWVAPPSWCRAPMTSCARRTIPAPMPPVPSWRPASRPCVRCRSRTVPGCSCNWRRCASRSTSCNRSRRPSRKAKAVPAMSPGATATAPGSCGGRRSRATSASTSMPARTFVRCWPASNWRRCA

SEQ ID NO: 22849 - protein, 318 aa, Pseudomonas aeruginosa
APCSRTCRAARPPATWCPRRRRLRPRRAVHETHLPPGSGGGAGRHAGWAGDLRAGRLCADRLQELPLRIQPVVVPRPAGGGLAAGGAGAPGPAPARQLGAGGQPLVALQPPASRADGRAQRPARSRRRQLAAGAASFAAGCGDGRAAADALPRRGAGRQRTRALRRGRRPAEPGSRARAGCPIAGRPDPCATADQSRRLPAGTQYPRRAARAPAAAPHGIAADAAAVRHPARLAGPLRPAAGAAQGACAEGFRTARPRTPCLGGFLAGSRRAWTERGRNGVAAADPALAERAFGAACRPGDRRGLCRPTASPGRRGRG

SEQ ID NO: 22850 - protein, 149 aa, Pseudomonas aeruginosa
RSPPPCAQARLRRDPGATLRAGARARSGQAIAGRGRLAQGTSERSRPAADPGAPVPDQQALGQGPGIPGGQPELPAQCRDLRRAGTPAGAARRGRAQQPVVPGGPGPARSAYSGAARGGGGDLSMGNATRRSPFGSIGRTVAACRGRPA

SEQ ID NO: 22851 - protein, 174 aa, Pseudomonas aeruginosa
AAFPLCTCGSAMPLASPRQLFLLAFLACVAIMGGALYLEHVVGLEACPLCVVQRIFFILIGLTCLAGAIQGPGLRGRRIYSVLVFLLALGGGATAARQVWLQTVPLDQLPACLPSLDYMMQALPFQEVIRLVLHGTADCAQVSWTLFTLSIPEWSLLAFVAYLGFSIVQFLRRA

SEQ ID NO: 22852 - protein, 172 aa, Pseudomonas aeruginosa
FSGTSEEGSEDNMLESCRNAQERWGGVHQLIDRWLHERQQLVQAFDALSGIQAPAPNAEELQHFCQLLLDYVSAGHFEVYEQLTAEGKAFGDQRGLELAKQIFPRLEAITESALNFNDRCDNGDCREGACLIAELKVLRQQLHERFELEDCLIEVLHNAHSQSGAEGSAVPV

SEQ ID NO: 22853 - protein, 399 aa, Pseudomonas aeruginosa
KGGAACGFSKRIGGQSWRTSLVAHRTRWREGVCGSSMGATTSAWRHVMSANKKPVTTPLHLLQQLSHSLVEHLEGACKQALVDSEKLLAKLEKQRGKAQEKLHKARTKLQDAAKAGKTKAQAKARETISDLEEALDTLKARQADTRTYIVGLKRDVQESLKLAQGVGKVKEAAGKALESRKAKPATKPAAKAAAKPAVKTVAAKPAAKPAAKPAAKPAAKPAAKTAAAKPAAKPTAKPAAKPAAKPAAKTAAAKPAAKPAAKPVAKPAAKPAAKTAAAKPAAKPAAKPVAKPTAKPAAKTAAAKPAAKPAAKPAAKPAAKPVAKSAAAKPAAKPAAKPAAKPAAKPAAKPVAAKPAATKPATAPAAKPAATPSAPAAASSAASATPAAGSNGAAPTSAS

SEQ ID NO: 22854 - protein, 133 aa, Pseudomonas aeruginosa
GAVCKAAEPSTSKARRSASVQMSRLQACSQASALRFASWPSSQAVARSARRCRCSRSARSSWAFISSRSSARQASWVAASRQAQRNLRRGSMTVSRQGRAAFSRIWARSFEQLTPRLPSQAATSNRQTSAPCS

SEQ ID NO: 22855 - protein, 135 aa, Pseudomonas aeruginosa
PCTPARKPVSSGPMALASPACSRCCAASSGRMPATACCPPTGASRTCARRSIPWIAWRWITCSTATVACARSRRRWPSPKRRTTVLPWRACIPSWTTPTVIPPMHGRASCWPGSASAASRWSAGSVISPVVGGCA

SEQ ID NO: 22856 - protein, 133 aa, Pseudomonas aeruginosa
RQDRRPQRIPGTGGVRRQPAGIGPDPADAPRARRAGEGRRQPAPGHRAALAGKGRGPPGAQPRGTGGGYLPGGADPRDHPRPEPRGADLCPAVRDLPWRCGQGRRPRRHRPGTAASEPHRSPAPRPPEPLRPA

SEQ ID NO: 22857 - protein, 414 aa, Pseudomonas aeruginosa
RHRPGRGRHRHAGVRRPARRTPALGPGQLCGRPERRQCAAGQGPCLPAGDPGHADSGRSRRARRRGRCGELPRPACASAAGAARSWAVDRLYRRHPGQELRGLSRRRPRPGLRPVGGGLPGGLRAGGKLAGQRRRRFAPLHREAADGLPPGVARWPPGNPGGATAGAGQGQAGRGRQAAWRRLAEFLHQFRFRLVDPVARRGRGNPGACRHPRLPAQYRAGKCRAWRARRLGAGLRRRFRHLGVGRLCDRYRRCPARADGGLHLSVRLRDGALARRLDARPPPRGSLAGLHPQQPGGRWRTLRLRSAGVLLGLPRVVRGHPVLRNPLVAGRTGRAQCRDRRRGDRRGPADRPGLGDPAWFGETAAGVVLQHQRGVALCALGGVRRTWRHRLAGSRGDRHPSGAVLRLRLAGDQG

SEQ ID NO: 22858 - protein, 244 aa, Pseudomonas aeruginosa
PPGVRQRPGSPAHPPAAGSRSTRESAAQIGTGTDGDQRAVVAMQFRAHHCDLVARAKRHRMGGERPAASRAQVVDAQVDGAEFRQPRHALVAWQFAMPFEGADQGHRSAGDVEQAGDHPAVENALNEVADQFVLHRQVEDYPLAAEAHHADAEHAVEGDALEEIRHQLVDVVRQGGGGRFAHRGVSTRWFRDARWRSGTDLKRAAARPPSCLADQALSWSTSSSTRSTSLLIPEAASAIDWASM

SEQ ID NO: 22859 - protein, 736 aa, Pseudomonas aeruginosa
MNTQQGLDEIERIAADETVVANVESEAEVKMAETIPVETPPAVVPSVDDSSLYIHRELSQLQFNIRVLEQALDESYPLLERLKFLLIFSSNLDEFFEIRIAGLKKQITFAREQAGADGLLPHQALARISELVHEQVSRQYRILNETLLPELAKHQIRFIRRRHWTLKIKTWVRRFFRDEIAPIITPIGLDPTHPFPLLVNKSLNFIVELEGMDAFGRDSGLAIIPAPRLLPRIIRLPEDVGGEGDNYVFLSSMIHAHADDLFPGMKVKGCYQFRLTRNADLSVDTEDVEDLARALRGELFSRRYGDAVRLEVVDTCPQNLTNYLLKQFGLSESELYKVSGPVNLTRLFSVTGLESHPELQYPPFTPAIPRLLQKKENLFNVLSKLDVLLMHPFESFTPVIDLLRQAAKDPNVLAIKQTLYRSGANSEIVDALVEAARNGKEVTAVIELRARFDEESNLQLASRLQQAGAVVIYGVVGFKTHAKMMLILRREDGELRRYAHLGTGNYHAGNARLYTDYSLLTADVALCEDLHKLFNQLIGMGKTLRMKKLLHAPFTLKKNLLEMINREAAQAALGQPAHIMAKVNSLTDPKVIRALYKASQAGVRIDLVVRGMCCLRPGIPGVSHNIHVRSIIGRFLEHSRIYYFLNGGDEKLYLSSADWMERNLDMRVETCFPVEGKKLVQRVKKELETYLTDNTQAWVLQADGSYQRLSPTGNQNPRNTQATLLEKLAAPVLTAR

SEQ ID NO: 22860 - protein, 148 aa, Pseudomonas aeruginosa
AIRLPGRSRPGSAGWLPASPRGRSPKGSWALPSDAPRAFPGCRECGGRGSRSAARCTGVPACRLPRRTPPACPPECCGGGRVPVATASAGPGARSQPGRSARSSRRRACGSGNGRCPGRSRGPVRPSSAGRGAVRRSAPRRRRLRQAP

SEQ ID NO: 22861 - protein, 662 aa, Pseudomonas aeruginosa
MSSLPYRRDIDGLRALAILPVVFYHLGLGGFTGGYVGVDVFLVISGYLITSIIRRDRQAGRFSFVDFWARRARRILPALFVMMAVSLAAGWFLMEPRDYEQLGRAVRYQTMFASNILFWKQDGYFDAASEFKPLLHTWSLSVEEQFYILFPLLLAAVSGRLLRWRLAILLAVLALSLAASVWAVNQRPGSAFFLLPMRAWELLAGAALALLPGGSRGHSQWSLQLAATLGIAAILLPVFFYDSDTPFPGLAALPAVLGTALLIWANGAGDTWARRLLGWQPLVWFGLISYSLYLWHWPLYVFVQYHALETLGLPARLGLLAASIGLAALSLYYVEAPFRERKLFAGRRQMLGAALCSLLLLGVVGQLVRHYDGVPSRLSEEALRYAKASKWRDGQTDCMFDKKALSQESICRFPAELAAERPLLVSWGDSHSAALSPLLRELAASRRVPIWQASLAGCPPLLGMLEKDNCLRFNQQMLEFVEQQRPGGVILAGRWDMYVYGDSQDGTRNILREPDDTPDSSIAEALLRQRLSGMIERLNAADVHVWLVKDVPLLPFKAPARLVRLSLSGEDVGRARFPFAEHAARVAYVNALFDALAEGNPRVSVLDPSSVLCDGLDCFAERDGWSLYMDNNHLSTQGAHELGPLFEPMLQSLDDSRIASQQ

SEQ ID NO: 22862 - protein, 492 aa, Pseudomonas aeruginosa
MVRLMTFKDLRDFIAQLEQRGALKRIQVPISPVLEMTEVCDRTLRAKGPALLFEKPTGFDMPVLGNLFGTPERVALGMGAEDVGALREIGKLLAQLKEPEPPKGLKDAWAKLPMYRKVLSMAPKVLKDAPCQEVVEEGEDVDLGRLPVQTCWPGDVGPLITWGLTVTRGPNKERQNLGIYRQQVIGRNKVIMRWLSHRGGALDYREWCQKHPGQPYPVAVALGADPATILGAVTPVPDTLSEYAFAGLLRGHRTELVKCRGSDLQVPASAEIVLEGVIHPGEMADEGPYGDHTGYYNEVDRFPVFTVERVTRRQKPIYHSTYTGRPPDEPAILGVALNEVFVPILQKQFPEIVDFYLPPEGCSYRMAVVTMKKQYPGHAKRVMLGVWSFLRQFMYTKFVIVTDDDIDARDWNDVIWAITTRMDPKRDTVMIDNTPIDYLDFASPVSGLGSKMGLDATHKWPGETSREWGRAIVKDEAVTRRIDALWSSLGID

SEQ ID NO: 22863 - protein, 161 aa, Pseudomonas aeruginosa
TPGLGPAESLAMLAGIRRGDAPVRTPIALSLALCLSLFPSFASAEEAAPEGEGANKPVYVDLTPALVGNYGSGPRLQYYKADIALQVADKDAATKVEHHEPLIRNQLIMLFAQQTDQSLGTVEAKESLRQEALKQVQQTLEQEEGKPLVTDLLFNNLIVQP

SEQ ID NO: 22864 - protein, 537 aa, Pseudomonas aeruginosa
CSGSRRGSIRRCWKNTSPTSRPACPEWPTCDWTLRSSGRPTCRSRFRNDRWRERRGEPPGRFAALRRDARGGRRQPGDPGQPHGRPDRSGRGRQVQPAGAAGRRTEDAGWRDPRARWRHARPPPPPGGLPAHRLHAPGAGQEPLPDALGVRERRLLRSAVRPRQGRARAAHRRPAAEHRAGAVRRASCGQAVRRHEAEARAVLRADPRSRPADPRRADHRRRPAVAQPVLGADRPYPRGPRRHERAGRHRLHGGSRALRLAGGDGRRKGPGHRYAAGVARAYRDAEPRVGVHRPAAGKQARRPPSIGDPAATAERRRAADRHRGRGPDLSFRRLRRGRSRQLPYRAWGNLRLSRLQRLRQVHHHEDAHRPAAGQRRHVRAVRPAGGRQRHGDPSPGRLHVPGLFPVCRAERAAEPGVARPAVPPAGGWHPGTGRRNAPALRPGEGGRRAAQRPAAGHSPASVAGGGGDPQAGNPDPRRAHFGGRPGGSRRLLGADGRAVAPRRGDHLHFHPLHERGSALRSHLADACRQGTGQRYSR

SEQ ID NO: 22865 - protein, 711 aa, Pseudomonas aeruginosa
  UNSURE (79): Identity of amino acid at the above locations are unknown.
PDHHQPGLRAEHRRLALFRRTCADHRPGRPRPAPAQRRAEPGGGDSAELRARSQAWLRSGHRRVDRRSDADPCQHRARXRAGPAHQYLAALLAPGGWGRGQRGGQHRGALSLQPRRGKPEGDGAGGDPAAADHDPGHAHRPRRGARKGTGFDHQPLCHPGDAPGVPGRQAAALRRHGHDQLPADAGPGHRGISRAAQGQLPGVDHRRFPLCGHQHWPRAVPLDVHAQPDRRCIRRGDRHHDPGDPVLRADPPGVLAGGCGGLDRQALSDLAFPGGQPRRLFQIAGPVRSLGLLPAACRFHRGADPAQRGLPEEAGGLSDAQPGQHLQPGHQGVPQSRPRLRDAGTDRLGLHPGRLQFRHRYSGNLASRADRGGRRGPLAALVAYRQCLPAPILPAAGNDRSCRDGSRHGRRPVYLHPRYPAGLPARRARRAQALDPGQRRRDPDRAGLLWRGLHPEHRRHRGARIRQPLPRGAEHAGADRGAHGIQPEPDPGLVRWGDGSDQPDHYAVDHPHRRRADPRARARHRRAPAGDAAVGLRDHDGQGLVDGVGGAGGGGALVAVGGAWLAGRADQRLGGTVPARRRIASVRHHLHGHIPRHGGAFDAAARTVDHPRAAAAEHPFGRHHATGKHAGTAAEHHAGGADHAFRQPGPGDPVPRRRFRHRLAAVRRYRGDRFGVLLRRALAFPPDHLADGLSDGFSVSPAAGSPAIPRR

SEQ ID NO: 22866 - protein, 170 aa, Pseudomonas aeruginosa
DRPRSGPMPRLGRRAGNRSHGLAGAGGARITIFISRVAPQWRPAVRVPRCPLRIPPTAPFTPFSPRRPCRSRRPNCTAICWVGSAPAPASTRPPGNTLPPNCSAARRANDSRPRCPACSAWSGRTFPPARSPSSCSCPTTKPRSPSAPRRSANGARVSSPVSASPPAKAA

SEQ ID NO: 22867 - protein, 406 aa, Pseudomonas aeruginosa
WPRPRARQPEVTMSKVNLAIIGGGLVGASLALALQAGARERGWSIVLIEPFAPGNAYQPSYDARSSALSYGSRQIYERLGLWPAIAERAEPILHIHVSDRGRFGATRLTAIEEGVPALGYVVENAWLGQCLWKALDPEVVRWHCPAEVKTLEAREGGYRLTLDDETQLDCELAILADGGRSGLREQLGIAVEQTPYRQTALIANVSPSEAHLGQAFERFTPSGPMALLPLPDNRCALIWTRPGKDAERLRGLDDAAFLGELQAAFGYRLGAFRQVGARHCYPLHLVEAREQVRPHLVVLGNAAHSLHPIAGQGFNLSLRDTLALVDALLHDDAPLGEFAVLQRYLDGQRLDQQMTVGFSDRVTRLFSNDRALLGAGRNLGLLGLDLLPPAKRWFARQAMGLGARPL

SEQ ID NO: 22868 - protein, 318 aa, Pseudomonas aeruginosa
RHAGLVEGAQGPPAALRHESLPALPGGGHPCAAHRWRFPRGSGAHGPEPAQSQLCMHPVRRQPLRDDRPVLHADADGEPGPRLRGLGQGGQHRVRQPGQGPGACAFQHRPEAARRGPRADRRRREVPAPAARRSARRRRHPGGAGSENPVRAAQAAPAERGLKRAHEWRTRICTRIWSSSAPAWSVAPWPWPWRAAAWRCCWWTAARSTWRRSSRRRPTSRGSARCPKPAGGFSSACMPGTASSRAAPSPIARCRCGMAPAPGGSASAPPACTPRYSAISSKTGWCRTPCWNACTIPPPACWPMRAWNRCATPATTGC

SEQ ID NO: 22869 - protein, 243 aa, Pseudomonas aeruginosa
GTQRNRRETARGGGNPGTNSWNALPGRETPCYRGAPDGLANTDSGPIDTEEPHARPTPPALLRSRCRNPAFRPRRPAPAHGAAALDPADIRAGGRAGLSPVRPLQPGGDPHRRGQPVPALRTRPAGPTGAHRRLRPQAGAGAGRPPDPRLRQLHRPVGPVHRGDPTVPRAPSGGATGAARRRFGGAMGADRRRRHRCGAGAPAAAGRPGRHRGAGPGRRAAGGGRAQRRSAGAARADRPVRSA

SEQ ID NO: 22870 - protein, 569 aa, Pseudomonas aeruginosa
WTAPAGTDRRLYSAPRLVRAGRRSFRTEDFVAHPAPRRWYPITFTVAALVLLPLSVLLLSWLEIDREIWSHLWDTQLPRLLGNTLTLVLGVGIGVTLLGVSLAWLTSLCEFPGRRWLDWALMLPFAIPAYVLAFVFVGLLDFAGPVQSLLREWFGSGLRLPRVRSTGGVILVLVLVFYPYVYLLARSAFIAQGKGLMEAARVLGLSPWQAFLRVALPMARPAIGAGLALAVMETLADFGAVSVFNFDTFTTAIYKTWYGFYSLSSAAQLASLLLLGVCLVLLGERHTRGRAKAASERPRGAPLYRLRGARALAASAWCGLVFLCAFVIPVAQLVVWFWRQGRFDLDERYWDLIGHTLTLGGIAALATVAVALLLAFAVRLAPTRAIRGAVGLGNLGYALPGSVLAVSIMLAFSWLDNHWVIPLSSALGGAGKPLLLGSLFALLLAYLIRFMAVAYGPLESGLARIRPSLPEASRSLGVGGPLLFLRVYLPLLLPASLSAALLVFVDVLKEMPATLLMRPFGWDTLAVRIFEMTSEGEWARASLPALTLVLVGLLPVVGLIRRSAHHSDR

SEQ ID NO: 22871 - protein, 402 aa, Pseudomonas aeruginosa
GLCTDRGTLPWCPAPGLAATMRAISCRRSLPTAPATPGRRIPMGLRTPLYELHVALGAKMVDFGGWDMPLHYGSQVEEHHQVRRDCGVFDVSHMTVVDVAGEQATAYLQHLLANDVARLGETGKALYSAMLNEEGGVVDDLIVYLTEHGYRVVVNASTRDKDIAWMQAQAAGFKVDLQERGDLAMLAIQGPNARVHSSELVSPARAALIRELKPFQGRAEGDWFIARTGYTGEDGLEIMLPAAEAPGFLNELVGAGISPAGLGARDTLRLEAGLNLYGQDMDESVSPLAANMGWTVAWEPVARDFVGRRALEAQKAAGDQPKLVGLVLEERGVLRAHQVVRVAGIGEGEITSGSFSPTLNKSIALARVPAATGDRAEVEIRGKWYPVRVVQPSFVRHGKPLI

SEQ ID NO: 22872 - protein, 1161 aa, Pseudomonas aeruginosa
PGNGDRRRPRLRGKQDEQYSRRTALRPEPRMGSPGSRRQRYRGHFRPCPGSPWRCGLHRAAGAGQDPRRRAGSGRGRVGEGRLRHLFADRRRSHRHQRSPGRHPGRRQQRPVRVLVLQAQAEQSGRAGQAARCRWLPGRRRRGRLSRRVVATKPAILGQGLDHSRLCSFCSGEMRFRRRCFLIRYPFGDDRWQGDAAPNETEAMSQTPSLAQLQPADAFLRRHLGPDPAEQQAMLDFLGVSTRAELIVQTVPPAIRLNRPLELPAALDEQAALARLRGYAGLNQRWTSLIGMGYYGTVTPPVILRNVLENPGWYTAYTPYQPEIAQGRLEALLNFQQLTIDLTGLDLASASLLDEATAAAEAMALARRVAKARSNRFFVDAHCHPQTVSVLRTRAEAFGFELVVDEPDNLAAHAVFGALLQYPDSRGEIRDLRPLIEALHGQQALACVASDLLALLLLTPPGELGADVVLGSAQRFGVPMGYGGPHAAFFATREGYKRAMPGRIIGVSRDARGNPALRMALQTREQHIRREKANSNICTAQVLLANIASLYAVYHGPQELKRIAQRVQRLTALLAAGLESKGLRRLNRHFFDTLTYEVGERQAAILERARAARVNLRVVDDRRLALSLDETCDAATLATLFEIFLGAGHGLDVAHLDGGAVADGIPAVLQRTSAYLQHPVFNAHHSETEMLRYLRQLEGKDLALNQAMIPLGSCTMKLNASSEMIPITWPEFAELHPFVPREQAEGYRRMIDELEAWLRAITGFDAICMQPNSGAQGEYAGLLAIRRYHQSRGDSQRDICLIPASAHGTNPASAIMASMRVVIVECDPCGNVDLDDLRLKAAEAGDRLSCLMITYPSTHGVYEEGIGEICEVVHRHGGQVYMDGANLNAQVGLARPADIGADVSHMNLHKTFCIPHGGGGPGMGPIGVKRHLAPFVANHPVIRVEGPNPLNDAVSAAPWGSASILPISWMYIAMMGPQLADASEVAILSANYLANRLDGAFPVLYRGRNERVAHECILDLRPLKAQTGITEEDVAKRLMDYGFHAPTMSFPVPGTLMVEPTESESKAELDRFVEAMLSIRAEIGKVESGAWPAEDNPLKRAPHTLADVTGIWQRPYEIAEAVTPSEHARAFKYWPAVNRVDNVYGDRNLFCACVPLDDYRE

SEQ ID NO: 22873 - protein, 101 aa, Pseudomonas aeruginosa
GTPSSSRRVIAVGESLVCRVESTRCPVSAAWIAISAVSRSRISPTMMMSGSCRSRARTPLAKVRSMLCWTCIWLNEGSIISIGSSMVQTFTSSVASCLSVV

SEQ ID NO: 22874 - protein, 468 aa, Pseudomonas aeruginosa
CSSTRSSNGSAMSPTAPSGSATAWSNCWRVERQVSFRLLPAYGSPPMSLIADHGFAFLVLACLFGFFMAWGVGANDVANAMGTSVGSRALTIRQAILVAMVFEFCGAYFAGGEVTETIRSGIVDPQYMTPDLLVFGMLSALLAAGVWLLLATIKGWPVSTTHSIVGAIIGFASVGVSVHAVHWGAIGPIVASWVVTPVLSGLLAFALFRSVQWLVLHAEDPFRSARRYVPLYMFLAGFMVALMTVGKGLKHVGLELSGLQTLGLALLAGGLVMGLGIVLLLRIRPTGGADPRGGFASVERVFAVLMIFTACSMAFAHGANDVANAIGPVAAVVAVVQAGGDLELVTRSPVPSWVLLLGAVGIVIGLATYGYRVIATIGREITELTPSRGFAAELATASTVVGASAIGLPVSTTHTLVGAVLGIGMARGIGALNLRVIGSIFLSWVVTLPAGAVLAILCFLVLRALFGA

SEQ ID NO: 22875 - protein, 393 aa, Pseudomonas aeruginosa
WGSIRVESPMPLPSLKDQFGALIAASSVSCTQPELDQTNRPVVDLLASWLGDLGFRCEIREVSPGKFNLLASYGSGSGGLVLAGHTDTVPYDEALWSSDPLRLDERDGRWYGLGSCDMKGFFPLAIEALLPLLDQPFRQPLMILATCDEESSMAGARALAESGRPLGRATVIGEPTNLRPIRLHKGVMMERIEILGQSGHSSDPNLGRSALEAMHATIGELMALRGEWQRAWNNPQFSVPQPTLNFGCIHGGDNPNRICGQCSLEFDLRPLPGMQPEQLREAIRQRLRPLAERHQVSIDYQPLFPAVPPFEQAQDSELVRVAERLTGHRAEAVAFGTEAPYFQRLGSETLVLGAGDIACAHQPDEHLELARIEPMVGVLRRLIQHYCLTPAAD

SEQ ID NO: 22876 - protein, 74 aa, Pseudomonas aeruginosa
SAAWPATSSKPPLMTNCTPIATSRKPTTREMASIPDSPRNFMMRPELCRAIQKISAVSRVTVIAARWMNSGMLP

SEQ ID NO: 22877 - protein, 632 aa, Pseudomonas aeruginosa
AATKVSKSPSWSRSSSVCSARESLAIFSKRACSSAASGCWRKYSACSRLWRRENASKLSPRSRMTFSTCAEGVSSASATLARWRCQRRRVGFAAACAVEQRRGVGDSFEQLVRPDLQFHRLAATLQLQARPPAFLDHGEEVVGGVAALAIQQRAVAERAEQQEGVEEARLVQVDAQRQERVDVQAAHFHVLHAASGQGLHRTLAGVGDALWPDARVVLVFDLQDVGVQLHPLAILLGADLLVGRVGRADRLAQAVDVALQVVVAGRQAGLGVVLVAQVAHPQAGGVGQVERVFVEALQLARAATQEAGVEGRRGAEQVHQQPAVAAEIANQGDVGGGLVVAFRQLAAFGLAQQRPEPLRQGEVVVDAGDALHGLAVAQRQALAVDVLQAADHRAAVAGDRDALLVRQLAGHRWAPQVFAVQFRTGEAVDALEIAQSVGDVGFRGRDELQQGLGVVGSDLRMGQGRTQGPGVGGERQLAVAIDSQAFALDAMQALGQQGQVGCGAEQSQAAGEKIAQVGIPCDRVPDRSPQYEGGPSGLQEGGRKCVFASSWGRSPRLRREPSRRAPGTDRDRRCAPFCRMAAAPVYNWAKVPCPFATSLSPCRTSASTTRLRRPAWRTRATQRTSPSATARM

SEQ ID NO: 22878 - protein, 253 aa, Pseudomonas aeruginosa
LILGVSMSNPAALAEGEKILVVDDDARLRRLLERFLDEQGYRVRAVENTEQMDRLLSRELFQLVVLDLMLPGEDGLTACRRLREQNNQVPIIMLTAKGDEGSRIQGLELGADDYLAKPFNPRELLARIKAVLRRQAPLVPGAPAGADEVVTFGDYQLFLATRELKKGDEVHMLTTGEFAVLKALVQHAREPLTRDKLMNLARGREWDALERSIDVQISRLRRLIEPDPSKPRYIQTVWGVGYVFVPDGNARKA

SEQ ID NO: 22879 - protein, 480 aa, Pseudomonas aeruginosa
STPCTSSCRRVASSTSVAMAEAGAISATRPSMGCQVWSEEGREVMRRFREASGKDSSAGRARGSTGFPASVAAVLHSSVAWTFCRGRDRRRNAVRPMRRDNACVVWSGSPLSLRPGQVGAAVLFQVLDDDPGDVLAGGGFDTFQARRGVHLHYQRTMVGAQDIHPGDVQAHHASGADGGHAFFRGDLDQAGAAAAVQVGAELAGRCLALHRGDHLVADHEAADVGAAGFLYVLLDHDVVLEPHESLEHRFGGLLGFAEDHADALGALQQLDHQRCATDHLDQVRDIVRGVGEAGHRQADALAREQLQRAQLIPRASDGDRLVEREHAHHLELAQYRAAVEGHRGADARDHRVEALQRLSPVVDLRLVAGDVHVGAQRIDDHHFMAALPPGLHQATGRVEPGIARQHGDFHSAPVDGLDRLAGSGGEAVGCRRGRHWTGRFGNGWRLDRCCRRMAQTGLPSSRSMLVAAGRAAGDSGRSWT

SEQ ID NO: 22880 - protein, 197 aa, Pseudomonas aeruginosa
QSRDSGGTNTGNASERERRRQGAPGQVALGGALLQDPGAGQGRDRGRQGALPGRAVQAEQGTQGRGGIDHSYGLRRANRDDSRAFRSPAWRAGGPGSLRGNRGQRGKPRARGGHAQGRGAGRTDRGAAEQEAAAADPPVARRPGLRSAGLPQGRPGWPQAESRTTPRRPISGNFASRRNSGSVTCTSQPLAFAASGV

SEQ ID NO: 22881 - protein, 353 aa, Pseudomonas aeruginosa
QMANLRHCQAAWNGEALSIKSFPPIGAGSAYDCHEARFYRPLSLTCHSLIRSVVSRMSHSDQSQRFLFDDTDVRGEMVDLERSYSEVLAKHPYPEPVAQLLGEMLAAASLLCGTLKFDGLLVLQARSSGAVPLLMVECSSDRQVRGLARYSAESIGADAGMQELMPEGVLTLTVDPVKGQRYQGIVALEGVNLAECLSNYFASSEQLPTRFWLNANGRRARGLLLQQLPADRLKDPEAREASWQHLTTLADTLTAEELLALDNETVLHRLYHEETVRLFEPQPLVFHCSCSRERSANALVSLGQADCERLLEEEEGSISIDCQFCNQRYLFDASDVAQLFAGAGSQGPSETRH

SEQ ID NO: 22882 - protein, 62 aa, Pseudomonas aeruginosa
PIPSLLSITTLCPVRFGYNCMVRFNLTPPYPDSQARNKGFNEYRFTPVPYWAEEPGCSRNPG

SEQ ID NO: 22883 - protein, 87 aa, Pseudomonas aeruginosa
FPPLVPPGRPFGDRGRLTEARVWNARSLAEALSGTELFSSGEAQIELIEGAEASLYVIMREYGDLPVFVAPQGEQICLWRSAREWFG

SEQ ID NO: 22884 - protein, 195 aa, Pseudomonas aeruginosa
NDPARRRSRLGTPGKSLSSQGTPHGPPQRRTDRALLPGLPAPRRRGHGGLLRSPGDLPRPGLRRTARARGGRHVAPADQPGAGLPPGLRERPRRRERGACAMGGPLPVHPDRAQGGESHRGPFPLRRRFDRRASRPVRPVALEPPGAWRQGPAAGLGAAGAAGDPRAGAQGPGRLPGCPSGGRLRLSVAEARIIS

SEQ ID NO: 22885 - protein, 262 aa, Pseudomonas aeruginosa
ASAPRSACWSAYRCCARSASRQSRTFICGHGVFVGYLKNHWWKRWIRRRGCKLAGGPASVGKRTTLVLEERVELGHLRIVPPRLEIGAYSYVRSGTDLSLVASIGRFCSIGSDCFIGQEKHTHPSDWVSSHPFQHTGTALRYEPALSYAEIGHDVWIGHSAMVMEGVKVGTGAIIATRAVVTRDVPPYAIVAGTPAQVIRYRHPPEIIEGLLASRWWELDSAFLTGLPLDRPREFLAALEAREAPRAAYRRMTITRQGCRLD

SEQ ID NO: 22886 - protein, 329 aa, Pseudomonas aeruginosa
ACFPSRAKLVPHIRPEAPMSELILHHYPTSPFAEKARLLLGFKQLSWRSVMIPPVMPKPDLVALTGGYRKTPVLQVGADVYCDTALIARRLEQEKAVPALFPEGQEMVAASFAQWADAVLFQHAVSLAFAPESIAVRFGKLPPEFLKAFMADRSQLFSGGSAGRLPLEQARHQWPAFMARLERQLSREDGDFLFGEASVADFAVAHCLWFLKGTPVTAPLVDDYPQVQAWLGRVLGFGHGAPAEMSAEEALEVARGSQPAALPDESFSDPNGFLPGQAVAIAATDYGVDAVQGELLFAGSEELILRREDPRAGTVHVHFPRLGFRIEAR

SEQ ID NO: 22887 - protein, 164 aa, Pseudomonas aeruginosa
GMPAETPPLRPDADPPQCALPEARPDRDAGTKLRAAVLGANDGLVSNLCLVMGVAGASMAHSSIVLTGMAGLVSGACSMALGEWLSVTNAREMASKRIAEEERLLRLCPNTETQELIDIFTAKGLSEVSARRVALQLMNDGRGALDTLSREALGIDPTELGGNP

SEQ ID NO: 22888 - protein, 419 aa, Pseudomonas aeruginosa
TRRARRSCCFPLAPWCRWRRSCSSTVPRRWSQACCPACLRCCSAARSPPVSPGGRWRSRRCARCWSVPLPRPSPMGWAPRSAWAWAESPSPAGDSVLHCDTRPAWPGTGKTDQGVAMNAYDIEIVNDAAHAGEANHGWCFGLPPGIRPEQWPLDPDTGYPLMHGFTLLLPEDYRVHGPEIVALSFFSLAPDQNDGGPTSVDGIREMLIDPPAQPPAEAELRPFWEAGRNSHPRLHRMEDILGGAYALILLDAAEFSGAPCQPPALPAGNPLLAQTEPPQWLEAGSAASFVPDWAEDDYYLLRALGGRPAAGHQQRYPLRWTARAQDPNAGVVPSEYGDGGYQLPHYWLDGKIERDNYREHPWVEGHLPNHIGGTMRPVQGVPEMSPFYVEFEEYLGGYNFGGGNAQLDFRDMRFDWACG

SEQ ID NO: 22889 - protein, 415 aa, Pseudomonas aeruginosa
GGKGSAGGAPGRRGSVLAPLELVLQLGRQLADDQHVALFVVFHLGAQQVRLEADRQAFGAAGEAAELVEGALVRRDFRRQAVVLVTDVVVERPRLLVVHQFRKRVEGHRLADARLGGGVVDQRLGLLAGLFLGHVLAFHEIAEGFQQGARLARRIHPFLAADEVAEIVGDLLPALALDERDVLLRLLVVAPFGDIDPRGQVQLAEVQVARRGDLQRLVHRHAFAVVQQGDRQVVGHALLVVGEQDVAAGGEIGLLHQLLQVLDRFAAEADEVAIALQVLTEPAAERVGPGLALEEAPGLVLGVVAFVEVGQQVLDGLGVAQLGVARVEHGRGAVGLLLDQVDDGVMDRHVRFDLSGNRRRRAGFRDAAGHAAGAPADRPVYPRLPASACVAWRSCRPCRRLITKFRCRCSSYSSW

SEQ ID NO: 22890 - protein, 67 aa, Pseudomonas aeruginosa
NRPFSLRRRPRPSRTNRARPRRFSSSLICWLIAEWVTCSSLAAWLMLPSRATASKLRRAVRGGRSLM

SEQ ID NO: 22891 - protein, 201 aa, Pseudomonas aeruginosa
TRTPAWRTPGFPRPCRPGRPLRRPRSTARRPGRQSSVAAGYGSGRACRGSSTCAGCRAWLRPARRGRAGCRGSCRSAHRRRSGPGISACDQAAGATRWQRRSVGWRRGSQRPRPAIAGRCRRRRSASRIRGGRAAGRCSWLRFRRPAHAGRDRVESGHRGWRRAGRPGSAGSRRDRGWAGTGNHRVYPTRVRRRTVAAARG

SEQ ID NO: 22892 - protein, 145 aa, Pseudomonas aeruginosa
APSMSMQRNRPINRQPTSAATTLGTTPLTISATITARLSRACGALLRAGATSSISAGRLSTRKSRLRPCNWRIAFQAPITSRVSPRRSFSSSMPSVSASWSRRRPTTLSPYCERKPSSRTLLPSRVESGGRVTSAMPTSRDWSMK

SEQ ID NO: 22893 - protein, 333 aa, Pseudomonas aeruginosa
SAAGRRRLPASPRRGAAALSAEEEGVVGELLAAHLLEHRQQVRYVEALALLAGDVQHHLALVQHHRALAHVQRLAHAVGDHHGGEFLLGDDPCGEMQDEVGGARVERRGVFVEQQDTRRLQRRHQQADGLALAAGEQADAVAEAVLQAEAEGRQAFPETVAHRCLHRPAEAAPGTATLRQGHVLLDGEVLAGTRHGVLEHPRDAVGAGPDRLAGDVFVVDQDLSAVDRQVAGDCVEEGRLAGAVGADHGDELAGRDVQRQAAQGAGLDGGAGVEGDLQVLRAEHGQAPFLPSRRFFIIGITRATVTSTAVTRFRSWACKPMKSLFSARAMKKR

SEQ ID NO: 22894 - protein, 194 aa, Pseudomonas aeruginosa
WPCGKRLPSCKDAYRTACLGAVLCARSACLPWGWALGDAWWGVGVRGSSPWRSVSWSGTRPPLAGVRQTSVSIAAQAYNRYSYGWNNPIASVDPTGYALEEISLSKSWYSPVIDNSWLFLSNLWMGNGPESGFEFSLGILKGGLSFSQSMSWVNPVAGGVQYLSNNWASQAIWGEGFSELISYKNIDQCWRWLV

SEQ ID NO: 22895 - protein, 809 aa, Pseudomonas aeruginosa
HQRLDPLDVAFGGGVDPAFVGHRPGLQHQGRTFLAGLALDALPDFLGDERHERVRQAQGRLQHADQGATSAALALDGGVLVPQHRLDQLQVPGAVLVPDELIEGLGGQVEAEGVELAGDFLLGALQLGDDPAVDRGQLDWLAVDPGVLAIGVLDDEVGGVPDLVAEVAEAFDAAHVELDVAAGGGQRAEGEAQGVGAVAGDAFGEFGAGLLGDLLRQLRLHHAAGALLQQGIEVDAVDDVQRVEYVALGLGHLLALTVAHQAVDIDGLERDLRGAVGVLHQVHGEHDHPRDPEEDDVEAGDQYVGGVEGLEELGLLRPAEGGEGPQAGAEPGVENVFVLAQLDLVAELVLGAHLDLVAADVDVAGLVVPGRDAVAPPELAADAPVLDVAHPGEVHVLVLLGHELDTAVFHGGDGVFGQRLGADVPLVGQPGLDDGAGAVALRYFQRVVVDLLEQAHGLELGDNGLARGEAVHAGVALRQAGVKVRVDTAVKVEHLGLGQHRGVLVENVDQRQVVALAHFVVVEVVGRGDLHAAGAEFAVDVLVGDDRDVPADDRQFGELADQLGVALVFRVHRDRGVAQQGFRTGGGDHQVIQAFAGLRAVHQRVAQVPEVVLLVVVFHFQVGNRGVQLGVPVHQAFAAVDQAVFMQAHEGFLDRFGEAVVHGEALARPVHRGAQATNLPGDVAAGLFLPFPDFLQELLPAEVVAAHALGAELALDHHLGGDAGVIGARLPQGVAALHAAVADQRVHDRVVEAMAHVQAAGHVRRRDHDGVGLAFAARSEVVVGLPGLVPGSLDGVRLVSLVHAKGDQS

SEQ ID NO: 22896 - protein, 489 aa, Pseudomonas aeruginosa
WCRPSARRCWRCRRTGCPAVPGIRRTAGNCQARSSANSPGLEQLPDQRFVVAHKARGVAAQGDDAGAGEGGDVDHRLRLEALGVGQCVAQHQAPFGVGVEDLDGLPAHGGDDVARTGGSAAGHVLGAGQQADQVDRQLQFEHRAEGAEDAGGAAHVELHLVHAQARLEADAAGVEGDALADQHVRGLVLLRAVVLQDDQPRRLVAALGDGEERAHAQLAQFLLVEDLDLQALELLGQALGLLAEERRMADVRRQVAEIAGQGHAIGDGLSFLAALLDGGAVGLVGEQGQLLQFQRLGFLALVAIEHVQAIGQGFHQQTRLRVGIAAFHREIAEGQRGIGAGQALEGRQHGGGQLAVLAVAQFALLAGADQQHALGLEIGQALQEHGLADLAGQVATLEHCADGAAGGVVDRLGAGAELAAFAYGEHQGGGFQGFRAYAFNKEFHGRGPQYRQSGWRKGRHPLAVSDCSEHDSSRGLTVAAGAVTQAATA

SEQ ID NO: 22897 - protein, 336 aa, Pseudomonas aeruginosa
SLRRGSFHAEDGNRGSTAPEPGWRCLPAVAAHGRTTAACLARLCTHGNPRPCRVPIMNVSFRRSRTVPASKPVADPARSTDPRDYQRVGRPLGVMAKTFPAGFVVAEHRHERAQLIHALSGVIELHVGRTLWLVPPQRAVWMPAGMAHAMLARGEVRLHTVYVRPQSCPPEFPRVPRGVMVSPLLRELIVRAAGLPLLYDERGREGRLMAVLLDELEWSREQPLALPDPADRRLGRICQALLENPADPRGLEEWARCVGASSRTLARLFLSELGVTFVHWRHQVRLAAALPRLAAGEAVARIAVDLGYQTPSAFSAMFRRLTGSTPSRYFALSDSA

SEQ ID NO: 22898 - protein, 156 aa, Pseudomonas aeruginosa
SRRACSARRNPAASWKSWSSACSTSTGCLPTYAPARRPSPARGSSSKAVAARRCCNATTPCSNSRSPNPCCLCWSGSGTCRCLPISTDRTMRPTASATRPSTPSAPVRWRPRPPACTSMRRCSRRSARRGWIPPSLPCMSAPVPSSRCVSSVSRTM

SEQ ID NO: 22899 - protein, 101 aa, Pseudomonas aeruginosa
SPSAPPACARWQSAARDGELKPFSGDTDIFIYPGRPFHVVDALVTNFHLPESTLLMLVSAFAGYPETMAAYAAAVAQGYRFFSYGDAMFITRNPAPRGPED

SEQ ID NO: 22900 - protein, 376 aa, Pseudomonas aeruginosa
SMSFMNFELLATDGKARRGRLTFPRGVVETPAFMPVGTYGTVKGMLPRDIEDIGAQIILGNTFHLWLRPGTEVIQRHGDLHDFMQWKGPILTDSGGFQVFSLGAMRKIKEEGVTFASPVDGAKVFMGPEESMAVQRALGSDIVMIFDECTPYPADHDVAKRSMELSLRWAKRSKIAHGDSPSALFGIVQGGMHEDLRLRSLDGLQEIGFDGLAIGGLSVGEPKEEMIRVLDFLPPQMPADKPRYLMGVGKPEDLVEGVRRGVDMFDCVMPTRNARNGHLFVDSGVIKIRNSVHKHDDSTLDPTCDCYTCKHFSRAYLHHLDKCGEMLGSMLNTIHNLRHYQRVMAGLREAIQQGTLAAFVDALYAKRGLPTPPLDA

SEQ ID NO: 22901 - protein, 629 aa, Pseudomonas aeruginosa
THDGARKAPRVITGGVMLNKYPLWKYLLILAVLAVGFIYSAPNLYPDDPAVQISGASTALQVTQADVDRAAKALTDAGIAVKADSLSKKGGLIRLVKQDDQLPAKEVVRRTLGDDYVVALNLAQTTPEWLRKLGGSPMKLGLDLSGGVHFLLEVDMDKAVDARLKVYESEVKSLLRKERVRYRSLPIQRSRDPARFHRQRIPGQGAQPDRQGLPRFRGRARRAQRPAGPARRPDPGQTGGNPRILHQAEPHHRPQPGQRAGRIRAAGSAPGRQSHRGRAAGRAGHRGSQADPRQDRQPRIPPGRRAGRPEVRHRDLRVPRAAPAAGAAGARGDHHRRPGHRRQRQFRRERPPAGEHPPGWPWRRADEPRHPQQRRPQHGGGVHRAEAGDPLHQADGRWRREGGRGSGVQGREADHQPGDHPVAAGQPVPYHRPRWPRRVLRAGPAAACRRPGCADVLRRRTHHRPEPGGGQHRQGYRCVALGHALRIAVHHRHLPFLRRDRHRCAGLQHGHAGGADVDPRRDPDPAGHRRYRADHGHGGGRQRADLLADTRGTGQWHVRPKGDPRRLQPCLHRDPRRQPDLAAGRRHPIRHGHRPGERICRDHVARHHHLDVHGHHGHPRNGQPDLRRA

SEQ ID NO: 22902 - protein, 214 aa, Pseudomonas aeruginosa
SGGSQRTRGPHLLSGPARRLAASAGPRLVDVRLEVAGAPGVQFRPLDDRHRDPPGGQDRPALLHRPRHGHRHRRNRRDRRRRHPLSGRYPGRHHLEQGQAPPHPRQQRSGRCRCQGARPVHRRRGRQGRLQRRGDQGSPAGCHRGRHSRADHHARGLRAAGQAPSDGGEARLRCLWGQPGHAGPGGACHWSVARSPAGRRRPARGHVPGAHRPG

SEQ ID NO: 22903 - protein, 133 aa, Pseudomonas aeruginosa
EHNPRQPRMIPMGKAHASDHQRPLRRNRHARPGAACSARSGLAGRYLRTPRHFPVLSRTAVRQVAPWQPGDQRARPGRRLPAVPPYVGHPCGAGDRRGQRIRRRDPLPGAGRLPLRRYLSDPPPVVRPQFADP

SEQ ID NO: 22904 - protein, 420 aa, Pseudomonas aeruginosa
SVRHRLSRAPACRSYLMKLPIYLDYSATTPVDPRVAQKMSECLLMDGNFGNPASRSHVFGWKAEEAVENARRQVAELVNADPREIVWTSGATESDNLAIKGVAHFYSGKGKHIITSKIEHKAVLDTCRQLEREGFEVTYLEPGEDGLITPALVEAALRDDTILVSVMHVNNEIGTVNDIAAIGELTRSRGVLFHVDAAQSTGKVEIDLDKLKVDLMSFSAHKTYGPKGIGALYVRRKPRVRIEGQMHGGGHERGMRSGTLATHQIVGMGEAFRIAKEEMAQENARVLALRDRFFAQIDGLEELYINGSMTSRVPHNLNVSFNYVEGESLIMALKDLAVSSGSACTSASLEPSYVLRALGRNDELAHSSIRFTFGRFTTEEEIDYAAKKVVEAVSKLRELSPLWDMYKEGVDLSQVEWQAH

SEQ ID NO: 22905 - protein, 223 aa, Pseudomonas aeruginosa
RSSSTRKAWSISMAPSWTSLAKGSTKASSSTIPTFVANAAAAKASTSEAGVGKPCHFAQFDLQPAFLVDLDELGQRYRELVRSVHPDRFADAPEREQRLALERAAQLNEAYQTLKSAPRRALYLLTLSGHELPLEATVQDPEFLLQQMQLREELEELQDSADLAGVATFKRRLKAAQAELEREFAACWDDAQRREEAERLVRRMQFLDKLAQEVRQLEERLDD

SEQ ID NO: 22906 - protein, 623 aa, Pseudomonas aeruginosa
LRQSMALLQIAEPGQSPKPHERRLAVGIDLGTTNSLVAAVRSGVAEPLPDAQGRLILPSAVRYHAERAEVGESARAAAAEDPFNTVISVKRLMGRGLEDVKQLGEQLPYRFRQGESHMPFIETVQGLKSPVEVSADILRELRQRAETTLGGELVGAVITVPAYFDDAQRQATKDAARLAGLNVLRLLNEPTAAAVAYGLDKGAEGLVAIYDLGGGTFDISILRLTRGVFEVLATGGDTALGGDDFDHAIAGWVIEQAGLSADLDPGSQRQLLQIACAAKERLTDEASVRVAYGDWSGELSRATLDELIEPFVARSLKSCRRAVRDSGVDLEEIRSVVMVGGSTRVPRVRTAVGELFGCEPLTDIDPDQVVAIGAAIQADALAGNKRGEELLLLDVIPLSLGLETMGGLMEKVIPRNTTIPVARAQEFTTYKDGQTAMMIHVLQGERELVKDCRSLARFELRGIPPMVAGAAKIRVTFQVDADGLLGVSARELSSGVEASIQVKPSYGLTDGEIARMLKDSFDYAGDDKAARALREQQVEAQRLLEAVQSALDVDGERLLDEEERLAIAAQMDTLRELAGGSDTAAIENQIKRLSQVTDAFAARRMDATVKAALSGRRLNEIEE

SEQ ID NO: 22907 - protein, 114 aa, Pseudomonas aeruginosa
AKMPQIVILPHADHCPEGAVFEAKPGETILDAALRNGIEIEHACEKSCACTTCHVIVREGLDSMEPSDELEDDMLDKAWGLEPDSRLSCQAVVADEDLVVEIPKYTINQVSEGH

SEQ ID NO: 22908 - protein, 284 aa, Pseudomonas aeruginosa
SHDNDHRRQGEPAGPDPAAAGTVLRVHRREAFPGRPGHEVDSPLWRRRFRRHDQRRQGLARKAQGLSRDTRSRDRQPGYFRRRHPQVGGPGGVRQLRRDRVHPPGRTRHPVRVLPGGLRPGLQFLLHRQAGFQQRPHRRRGDRPGVDRQQVVRYRSGQDRPRHHQCRDDGHGRAAAELRQRGRRHEHHDGRPRLRYFQAQGDPVHLRRGADDRQAWRGDRRVPGPVAARTERRVAQQAGADQQEVSAGHAAGCLPPVYFPARREARADRRIHPAQGCQRSARAC

SEQ ID NO: 22909 - protein, 335 aa, Pseudomonas aeruginosa
SIPALRLRAPEQQCHPAFPGHVAQGRLQRDRAYHPRRRHRRGLWPTGWSGHGSYPPERTLYCRAPTGRVRVGGESKLSERRVPMTVRAALVFLLAVGLTGCVTSGDQNPLKTDKGRDEARDAYIQLGLGYLQRGNTEQAKVPLRKALEIDPSSADAHAALAVVFQTEMEPKLADEEYRKALASDSRNARVLNNYGGFLYEQKRYEEAYQRLLEASQDTLYPERSRVFENLGLVSLQMKKPAQAKEYFEKSLRLNRNQPSVALEMADLLYKEREYVPARQYYDLFAQGGGQNARSLLLGIRLAKVFEDRDTAASYGLQLKRLYPGSPEYQEFQAEK

SEQ ID NO: 22910 - protein, 695 aa, Pseudomonas aeruginosa
RFSDHSPQVSENLGRQRPGGRRRADRRAEHDQHRDLRRRCHRRADPPPGRCRRGHRAGFRPRHGRRRGIRQDQAAGQRAAGRRHPLRLSHRPARRRAGSGLPAHQSGQHRSRGPGQGRGRCRARAQHPDPYRRQCRFAGKGPAEEIRRTDPGSPARIGHAPRRSSRQAGLPELQGQRQGLRRLHGRRRLSPAGQADRAAPAPGHHRGRRPALRHGEVGGGAGHAPGRGNRRHHPDFPGCRSGRGDQGRFRHPQVPAPALPWHQLHRLPELFAAELRRGEDHERAGRAPGGPAGADGRGRDRLRRQRSGRSQGGPCRPHRRHSEPGVYRRQAVAETDQRQPGGRAGTADPPEGGREGRGRCEPDRPRLTRLRTLREQVPASHSWHERHPAGADSGLALSGTHLRRPAGRLRLQRDPPAHPRVHRTLRPRHRRRHRRGRQGDVHLPRPQRRIPDHASGRYRRLRARRAGARPERRWPGAEALVHRADVPLRETAERSLPAVPPDRRGSLQPARSGHRRRVDHPHLAPVAEARHGRRGDPAAQHPRLQRGPRTLSRGPGGLSAGALRATRRRQPAAHDHQSAANPRQQGGEHPGVAGWRADPARLSRRRIDRPLRGSQGPPGCCRTALRNQPEAGARPGLLLPHGFRMGHRQAWRPGHRLRRWPLRRAGQPVRRQADPGRRFRHGRGTPGAAAGNLGG

SEQ ID NO: 22911 - protein, 102 aa, Pseudomonas aeruginosa
TVRPTSTSAPSANQPELAALTLAEQLRSAIPGIRLLVNAGAGSFKSQFKKADKSGARFALILGEDEVANRVVGFKPLRDEGEQQSIAWDALPEHLAACLAQA

SEQ ID NO: 22912 - protein, 445 aa, Pseudomonas aeruginosa
SCSMAMPTRPTSRPARSSGATCWCSSSAPTRRARPTRKPSSRCPKTVPAMPCRSSSTTCPRERPEMVQWKHAALLALALAVVGCSSNSKKELPPAELTDFKEEVVLSKQWSRSVGDGQGDLYNLLEPAVDGSTIYAASAEGRVMAIQRETGDVLWKKDLERPVSGGVGVGYGLVLVGTLRGDVIALDEATGKKKWTKRVNSEVLSAPATNGDVVVVQTQDDKLIGLDAASGDHRWIYESTVPVLTLRGTGAPLIAGNMALAGLASGNVVAVDVQRGLPIWEQRVPIPQGRSELDRVVDIDGGLLLSGDTLYVVSYQGRAAALDVNSGRLLWQREASSYVGVAEGFGNIYVSQASGSVEGLDSRGASSLWNNDALARRQLSAPAVFSSNVVVGDLEGYVHLLSQVDGRFVGRERVDSDGVRVRPLVVGSWMYVFGNGGKLVAYTIR

SEQ ID NO: 22913 - protein, 440 aa, Pseudomonas aeruginosa
SRGGYSSCAIAWRIFPSDLKRSRFFLRRAPAASLPDRLSCPATRLAGLSSGESLQEVPMIQSKLPNVGTTIFTRMSQLAAECGAINLSQGFPDFDGPPELREAVGRHIAAGHNQYAPMTGLPALREQVAKKIEQFYGRRVSADSEVTITPGATEAIFSAIQALVHPGDEVVVLDPSYDSYEPSVQLAGGRCVHVPLVLPDFSIDWQRMAEAIGPRTRLVIINTPHNPSGALISREELDRLAALIRDRDIYLISDEVYEHLVFDGVAHTSVLSHDELYPRSFVVSSFGKTYHVTGWKTGYVVAPPALSAELRKVHQYVNFCGVTPLQWALADYMAGHPEHLRQLPGFYQAKRDLFCDLLLDSRFRFTRAPGTYFQCVDYSAIRPDLDDVAMAEWLTREHGVAAIPVSVFYEKAPDAMRLVRFCYAKREETLRQAAEKLCAI

SEQ ID NO: 22914 - protein, 159 aa, Pseudomonas aeruginosa
GRARGGAAQGGGDGGGLLGSLGSILGGAGGGAASGGLGGVLGDLLGGAAGGAGQAAPGVEAGSLGGLGGLFQMLQNAGLGDALNSWIGGGPNQSVSAADISRVFGDGQLQQLADSAGVSQGEAAEHLSSLLPELVNKLTPDGQAPQGDLDIGSLLARFS

SEQ ID NO: 22915 - protein, 234 aa, Pseudomonas aeruginosa
GFPVDAERIAAIRLSAPLNGARPPSTAGRSIGAGAVQAVDRLFVELQVGGGDQVVELFQAGGAGDRRGHRRTSDEPGQGDLRRVGVVLLGHFVERREDGHAALVEITLHLLSPGSPGGVGLVAVLAAEEAAGQRVVADHPDTEFFHRRLQVGLVVGAIVQVVFGLQALVARQVKPGADLACFEEAPGVVVGGADDPYLAFLDQFAIGGKGFLQVGVGIVGVRLVEVQVVGLQAS

SEQ ID NO: 22916 - protein, 158 aa, Pseudomonas aeruginosa
ISAGSTRMNSDTENPFRPPEARLDEPDATHGEPLYRLSAIGLGTFIGTPLAGAFLAAVNLRRLGRAQEVGKTWLVGLCLFVLLPVLGAILPENIPSIGFTVAQIFGMVYYAKSAFGPALDSHKAAGGAFISNWRAAGIGLLFMLVVLSVAIPVVMLVV

SEQ ID NO: 22917 - protein, 148 aa, Pseudomonas aeruginosa
SRPMSAGSIGRYGTSQIASSFCWAKPLRMASWCEPEKAVWTRSPTYGWRGWTGNWLHSSTTLRTASMSEKSSCGCRPWVYMFKARVTRSTLPVRSPLPNRQPSTRSAPAIRPSSVAATPVPRSLWVCRLMITLSRLSTWRPNHSIWSA

SEQ ID NO: 22918 - protein, 149 aa, Pseudomonas aeruginosa
TWTMAFFAPRRDSKVRVIRSSRAWVSTWMVTSSGMWLPSINSRTKLKSVSEADGKATSICFRPTCTRVLKNRIFFAASIGSISDWLPSRRSELHQIGTSVMVFDGQVRSGRLMAGNGRYFCEGSFNMLMGLILWSRFLGRRGQANAVTR

SEQ ID NO: 22919 - protein, 411 aa, Pseudomonas aeruginosa
RQAHSSFRHDPARAAIRPATRWSSFKTAGVAGGDHSETTRHRCMAGSVRHADDLRRAADLPVDADGPPDADGRGDGPRRHVPREHGPWRHGPCRLFRCPALRRPCRHAGDGRRGRQSPGQRRALGEVRLLQPVVPQPAAHRRRLPGAVLRSLRDGARRRFPERGVRRLAGVSRRPYPCAAVPDRLTSFNPIAAASWGHRRVFAAPVTRAWPRACSPWGRGGSHIDHGKTYVYSTTSGRQRLPDRRFQLRPCPSRTTPPLGGSLRRSVRPGPVSVGAPGRGTLTAPGSRRGAGAERGHRSRPEFAADHRHQSQGAAPTGAGQRWGRLPEDHSRLRGDPQRRQQRRPGAARDVRFAPEHPHQRRHDARCLSEPDGRADLLHLAGNLRQAHRDQGPADGALGAGRVGRDDPLRA

SEQ ID NO: 22920 - protein, 151 aa, Pseudomonas aeruginosa
AGALRRTRLAGQRQPAGRLQWPLRQGAGRRRRQPARLPALHRQPRAVRRLRGRRREYRAVALEEVERRRRGRLDPRRGHPDRTHRRQGRRRGTLRRARHGRLAVQAREPGPALRQIERQRCAGEGRGTGLLQLPRPHQGQVPPGHSRTHPA

SEQ ID NO: 22921 - protein, 473 aa, Pseudomonas aeruginosa
SMQSNEKNGRDFYALAWRWHFYAGLFVAPFMILLALTGIVYLFKPQLDALLYPQLLRVEAGAQMRSADQLLAGVRQAHPQAAVSQYLPPSEAGRSAQFVIGERGQGQWNLFVDPYSGRELGRQDAQLNLQAVARALHGELMVGTIGDRLIELAAGWGIVLVVSGLYLWWPRGRAASALFWPRLHLRGRPLWRDLHVVAGFWGSLLLLFMLLSGMTWTGYWGKQFADVWNRFPAAMWNDVPTSDMQAGSLNSASRQQVPWPLENTPLPRSQPPAADAHAEHRGHSAQAGHAMPMDMPMPAGIPLQRVVDIARERGVAAGYGIALPSGMEGVYTISVFPDDPRHDATLHIEQYSGKVLADVRWQDYNAVARSVQMGVVLHEGKLFGLGNQLLMLAVCLAILLSSASGLWIWWKRKPAGRLGVPPLRHELPRWKSGIAIMLALGVAFPLVGASLLLVWALDWLVLSRLPAVRRVLA

SEQ ID NO: 22922 - protein, 305 aa, Pseudomonas aeruginosa
FRCAPAAPAPAESLALAPGGGVRGPGGEPGRAAVAGRHLGLDRPPAGCRHAAYRTRRWRRLAGPWPAVALPRRVVLAFQPPPQPPQQRPEPVAEPDEKARLSGLPASGRSGKLRRFAEAPMQDDDFSLFKSEMRGVKRISVDRADTGKPRNDRQQLKQRQLNASVRNDEIRVDGLSDQFVIDVGPEDELSWARDGVQESQLRKLKQGLVPFDGSLDLHGMSVEKARQTLWDFLAEATRLEIRCVRVTHGKAARKDGRSPLVKSHVNTWLRQHPQVLGFTSCLPRHGGTGSVYVMLRRTMLEGRDE

SEQ ID NO: 22923 - protein, 814 aa, Pseudomonas aeruginosa
RSSGWPGRRPGARPCHRRPPRARDPGSPGRHPRCARGPCRDPCVPRCARARCVASELHRHAEAAQDREIERIRRALGEQQVVGAQAAQVGLEHHHVTPAEVLGLHQVEQPEQRPGPGIAFDSYRSSGHLLQHQAGAAAVGVAGPLERHRHDRAVAVLHGLTVETELGAADARIEGIGLQAEAHLWLGRVLGEEALADHLGRAHLVEIDLGHRQAVTVHAAQAVTARVAADEGPHVGFEEAFGDALRLEELAEIADRDIAGAVRVERVALVDRLAVETVQLALVALVEVQVGIAEDQPPGVFGQHAEPSAERSRQSRGGVAQVAQGIALAAHAALRHVESRLLRLAGARQSGELQLQLVERLQQRGEVGRRAVVIVEQAMQGLEAALQGFLRGIRQVLRQRVHGIAGRRGGRIAQLAALFRGLVAGLCQRLGALRQDRETGVLTDLQQQLEDRRVGGEQPGNLVGALAGIVERQQAQASDRLAPEVRVVAEIQLLEFDHQAPQVHVANPAALAQDPVVAKDVVDQAGALDHEVLLVALLGVEPRNHVVGADEQTGLRPQVLAEAILGQASRLFAQHPVDHVGQGLAAQHLACLGHQGLVQRIAERLLEQTGEMRVQAILHGAVAGIALRPVGSHPVLEPSVLAALAQIQHQVGPQAVEQAFAILHVAADLRFEHPRHARQQLRLQLAAIGRGQRRVDLVALVQPGALVQRDFPFGRKHGGRRIAAIQRLQRRHGVIALAKRLALLGPLLRQLADPLQALVVGQKNRQPRAGRIAEGAPANRRTGRAGPSGCACVRGDRDLPGWPRGRSPGSAGDG

SEQ ID NO: 22924 - protein, 91 aa, Pseudomonas aeruginosa
SPGCSGVAEGPRTPGAGPSHLCRSAPCRSWCPEPGRSPRGSTGRRTRRSRATGRPCSAPGRPADRGAGSAGFPAGARAPGEPAYPAPSRRR

SEQ ID NO: 22925 - protein, 481 aa, Pseudomonas aeruginosa
SCSVPDGPEFQFKLGELAGYVERETAGALQLGHVLGVGFENEIGLVGVERDLPRRHRQRLDPDPRQVQVDQLANVLDRTHLEMRGQALAQFLRLAIGTGGEHERGAAEQLVVVQGRDQDAVLAGLERQFDGMLLEHHRQDLANRLHQPAEAGALVAVLVTAVQARTLALAAEGGEVAEHGQQHPVQLLRMHLLQSQVVAQQQLGAIDQLQHHEIADLRAADLAIGPDTLGDGVAAMAEHANHLLQAGQQVGGCVGMEVARHEVGVEADHPVRRGIQHHRHLQFDVGLVVLLLAEQQAKIRPRAADLHHGILAGVGVRHLQIVGGIARQDLGLLRPARLDVVTGDQRQGQVDRHVRGIGRHVEGERLGVAAEFEQAAVGQYAGGLADHQLAHVEELAVQLQGEEAPVVAAQQLGPGLHLVVVVAVVVLQMLRAQQHAFLPDDLVHVHRASPALPSSSPAFRMPFRPSFSSTRVSSFAVTGTT

SEQ ID NO: 22926 - protein, 141 aa, Pseudomonas aeruginosa
PGGAPIRRETVCFSWNSDMLMVVMKRSPPYSRSASASAVSVLPTPLGPTSRNTPTGASGLFSPAAVARIARSRALTACSWPRIRARRSSANPITLALCSRASCSTGTPVQAPITSATRRGQTSKLTSRPWAWASASAWRVS

SEQ ID NO: 22927 - protein, 137 aa, Pseudomonas aeruginosa
RAFSRASTPPCSSAGKVSAFASPPCSSRFASRALANCWRRASRRSASSRWRLHWSSCTCRSLSAWARRSSSACRASWSIGRPASASRRRAWRWRSPSASSPRRRSRLSGAAARLMRTRAQAVSRTSTALSGNWRPAR

SEQ ID NO: 22928 - protein, 163 aa, Pseudomonas aeruginosa
PPAPISVWASSMNRMVGLSAAFTSSMTPFRRRSNSPFTLAPACNRPMSRDNSSTSLSAGGTSPAAIREARPSTMAVLPTPASPTTMGLFFRRRARMSTIWRIAPSRQSTGSSLPSRACWVRLWVKRCNRDSPPPGLPLGAPSSGCESAKSFNRSMSSRASSGW

SEQ ID NO: 22929 - protein, 150 aa, Pseudomonas aeruginosa
ELRARSPIRAPPRDRGGTACDKCLPCVLARRGSAATARSSYAAGAVHPAPDRAPRRAIPIRATDGRGSPAGSWPARTSSPGSTVARGSVARRTGRVRRGRASCPASTPVPPPSGRPCATPAGPRPGRRPIRPAGPRSRPCAAHCRSGDGA

SEQ ID NO: 22930 - protein, 738 aa, Pseudomonas aeruginosa
RRGQESPRRVDAALFVVGSFRSSLRALVSPAPGRTIESVACASEGQRMFAAANQTHFSLAIDGLAIDLQVLSFSGREAISQPFAFDLELVGERPVPDLESLLHKPAFLTLGPAGNGIHGLVRSAGQGDSGKRLTRYRITLVPQLAYLAQRTNQRIFQHLTVPQIVGRVLEEHGILADAYRFQLGTRYPEREYCVQYDESDLQFVQRLCCEEGIHFHFQHSATAHLLVFGDDQTVFPRLAPVAYQQDSGLVADRPAVKRFGVRLETRTSRVTRRDYDFEKPRLTLESAARGEARPDLEDYDYPGRFVDRERGKHLARRALERQRSDYRLAEGRSDQPLLLSGHFLPLAAHPQAGWNDLWLLTEVIHEGRQPQVLEESIVSDASASPDDFRQGYRNRFQATPWEAFFRPPPTPPKPRILGTQSAVVTGPKGEEIHCDRYGRVKVQFHWDREGQADDSSSCWLRVASGWAGRNYGAIAIPRVGMEVLVTFLEGDPDQPLVTGCLFHREHPVPYELPGHKTRSVFKSLSSPGGGGYNELRIEDRKGQEQIFVHAQRDWDENIEHDQKIRVGHQRHDTVQANSYSEFKAEEHRTTHAERKVEVRASDHLTVANDQHLKIASGQFVEAGQEIHLSSGLKVVLEAGAELTLKGGGSFLKLDASGVTLSGANVRVNSGGSPGNGSGAAPLLPGPPLDADAATAGQVLDNPARSRPERKGPEQLIVDVWGDPAQGSQVVLLPPESEA

SEQ ID NO: 22931 - protein, 350 aa, Pseudomonas aeruginosa
DREICRALGATSALCQQFSAAGDGGTDLVRRGAADMVAGVDRAFQGQHVEDVGVDLLAEAAQFVEAHLGEVLAAVYAVLHCVADDLVAVAERQALAHQVVGQVGGGGETAACRLAHDLAPGPDRRDHVGEGAQAVAQGVGGVEQRFLVFLVVLVVGQRLALHQGQQAGEGAEHPAGLAAYQLRHVGVLLLRHDRGAGAEAVGQVDELELRAGPQHQLFREARQVHHRQAGGGAEFDGEVAVGDAVQGVAANRVEAQQLAGDLALDRVGGAGQGRRAERHAVDPLAAVDQALVVAAEHLEPGQQVVAEGHRLGGLQVGETGHDGVGFRFGQAQQALLQAGDLGEDGVDLVA

SEQ ID NO: 22932 - protein, 311 aa, Pseudomonas aeruginosa
ATPTTRRSSRPRRKARDRRYTISMHDLGHFSGLKRVSASSAVTDGTTPVYAIHVRDSCRKPELMNVLIVDDEPLARERLARLVGQLDGYRVLEPSASNGEEALTLIDSLKPDIVLLDIRMPGLDGLQVAARLCEREAPPAVIFCTAHDEFALEAFQVSAVGYLVKPVRSEDLAEALKKASRPNRVQLAALTKPPASGGSGPRSHISARTRKGIELIPLEEVIFFIADHKYVTLRHAQGEVLLDEPLKALEDEFGERFVRIHRNALVARERIERLQRTPLGHFQLYLKGLDGDALTVSRRHVAGVRRLMHQL

SEQ ID NO: 22933 - protein, 349 aa, Pseudomonas aeruginosa
RRSAVRQRPGCGYRAQRPRTRVRTVIMGASLCTEYPMSSREIRIATRQSALALWQAEYVKARLEQAHPGLTVTLLPMTSRGDKLLDAPLAKIGGKGLFVKELETALLEGAADIAVHSMKDVPMDFPEGLGLYTICEREDPRDAFVSNTYASLEQLPAGSVVGTSSLRRQAQLLARRPDLQIRFLRGNVNTRLAKLDAGEYDAIILAAAGLIRLGFESRIRSSISVDDSLPAGGQGAVGIECRTADSDLHALLEPLHHTDTALRVTAERALNKRLNGGCQVPIACYAIREGDQLWLRGLVGQPDGTQLLRAEGRAPLADAEALGVRVAEDLLEQGAEAILEAVYGEAGHP

SEQ ID NO: 22934 - protein, 447 aa, Pseudomonas aeruginosa
HRTGPERLAVVRVAPRGRRQPGARGAGGSGHGGPSMRRIYLLVLAVVLVATLVGLAISEQAGYVLIAYKSFRYESSLWSFLALLAVVWLLVVLVRLVLRLLGSSGRVVNPWSRYNRRRRVQMAEHSGLRDLGEGNWPQALRHLRRAAEMGERPLMHYLGAARAANELERYDEADDLLNRAREREPDAQLLVGLTRAQLLINRGDYPQARNTLEELHGLQPQHRTVLRLMQQLYVTQHDWQALCVLLPELRKERVLKDSELRDLERRAWVASLQEAGERGLNEGETALQPLTQRWQNVPSALRADPAIVAGYAAQLLRLGAEEEAEEVLRHALKQGFDATLVQLYGQVRGRDPGKQLQAAEGWLKEHPNDPGLLLTLGRLCLINKLWGKAREYLEASLSFQRSAETCAELGRLLAQLGEVERSNQLFQEGLVLLDRRTPGLPVVVAGI

SEQ ID NO: 22935 - protein, 153 aa, Pseudomonas aeruginosa
RSCGNSCTNASSWRTASSKSCTTPTARAAQRVRQYRSDSPASRYETARLHAGERRFCISAEAQQVDLEDQRSVGRDQVASAFVTIGLRRRNHHSPARADRHRSQRCPPSLYHTVQGEPLGAFALVEHLTVGKQAAVTDVYLGCRADAVTLATT

SEQ ID NO: 22936 - protein, 149 aa, Pseudomonas aeruginosa
RRSLRPSRLRSLLRNRRPSLRRKPRQRSPQPSRRRSLLRNRRPSPRRKPQPRSPQPSRRRSLWRNRRPSLRRKPQPRSPPPSRQRSLSRNRRPSPRRKPQPRSPQPSQLRSLRRNRRPSLWRNPRPRSLQPSRLRSLRRNRRPSLRRNP

SEQ ID NO: 22937 - protein, 140 aa, Pseudomonas aeruginosa
PRNLPQPSPPPLLLRSLRRLPAPRQPPPALLRQRLPRAATAPPRPAPPKALSAKPPSQAPAKPGALLPCRCPGCRLAARHPHCDSLPGPPARLWPGRPGVAGVPVPLVVPGPSFPRGVRPGRRRGLPLRARRNAICAGVR

SEQ ID NO: 22938 - protein, 193 aa, Pseudomonas aeruginosa
VMEDLQVLTQTWSGPLVVAMQILLILLVAWLLQRLVRRTVTRIGERYPVPPELLLPLRGGLRWLIMVSALIMVLERLGVSAEVLWTALTGFAAVAAVAFFAIWSVLSNLFCALLIFTVGPFRIGDRVELIDSADKPGVTGRVVAINLLYTTLEETLEDGSPGPLLQIPNSLFFQKAVRRWRGPGFSTPTKNGK

SEQ ID NO: 22939 - protein, 254 aa, Pseudomonas aeruginosa
PSMEWLASPEIWVAFLTLTALEIVLGIDNIIFISILVGRLPPAQQPKARFFGLALAMGTRILLLLSITWVMRLTTDLFHLFGQGISGRDLILFFGGLFLLFKSTMEIYHSLEGAEEEQKSGGKVHGFMGIIVQIAIIDIIFSLDSVITAVGLVQNVPVMVAAIVISVGVMMLAAGTISDFIEKHPSLKMLALSFLIVVGTVLVAESFEVHVPKGYVYFAMAFSLAVEALNIRLRGALARKRGEEPVKLRKGSPD

SEQ ID NO: 22940 - protein, 659 aa, Pseudomonas aeruginosa
LLQSISCMGGKAKGQFNLFHSHFVFAMHPPKILLWLLPLVCAFSLGALADTAVDPSQALHLLSYLAADYPPTVADGKIVDPSEYQEQVEFVGNLQALVLTLPMRPERAELERGVASLRQAIEQRLPGRDVALQARNLEARVADIYQVVQTPAITPDPSRAAPIYAQQCAICHGDAGKGDGPAGIGLEPPPANLTDRQRLDHLSLYDLRNVIGLGVAGTDMPAFADQLDERQRWDLASYVAGLSAGSAQPDKAHAYPLATLATQTPAEVAEHDGEAAAESFRALRAHPPLEQRGPGQLIDYTAATLDKSFAVYREGDRDQAYDLSVAAYLEGFELVESSLDNVDADLRRSTEKQLMAYRQALRDGLPETQVAQQLELAKGKLAEAAKQLGGDSLSFSISFVSALLILLREGVEAILVLAAILAFLRNTGQESAVRGVHVGWGLAFVAGFATWALAAYVIDIGGAQRELMEGFTSLFACVMVLWLGVWMHDRRHAAAWQDYIRSSLVGGGGRFGFAVLAFFSVYRELFEVILFYETLWLQAGPAGHNAVIGGAATAVVLLIGLAWVILRGSAKLPLGLFFSINAALLCALSVVFAGHGVIALQEAGVIGTRPVPFFDFDWLGIKADAYSLSAQAMALVAIALLYGRSRIVERRRAAANAAD

SEQ ID NO: 22941 - protein, 182 aa, Pseudomonas aeruginosa
AGSRNHDGQCDTGRRHFYGSPFMRIWIDADACPKAAKELVCKFALKRKLEVWMVAGQPQVKPPFACVRLVVVESGMDAADDYLVEQAEPGDLAICSDVPLADRLIKKQVAALDPRGREFDARNMGDKLAMRNLMADLRDQGQMGGGQAPYGERDRQAFANALDRLLTRLQREADLRASQPHR

SEQ ID NO: 22942 - protein, 338 aa, Pseudomonas aeruginosa
TVSFTPANRAYPYTRLRRNRRDDFSRRLVRENVLTVDDLILPVFVLDGVNQRESIPSMPGVERLSIDQLLIEAEEWVALGIPALALFPVTPVEKKSLDAAEAYNPEGIAQRATRALRERFPELGIITDVALDPFTTHGQDGILDDDGYVLNDVSIDVLVRQALSHAEAGAQVVAPSDMMDGRIGAIREALESAGHTNVRIMAYSAKYASAYYGPFRDAVGSASNLGKGNKATYQMDPANSDEALHEVAADLAEGADMVMVKPGMPYLDIVRRVKDEFRAPTFVYQVSGEYAMHMGAIQNGWLAESVILESLTAFKRAGADGILTYFAKQAAEQLRRGR

SEQ ID NO: 22943 - protein, 580 aa, Pseudomonas aeruginosa
RQHLLVLAREASQVGVLDQVGAVLVVVVMGDVQADLVDPCAPAQQVAVQFAVQLPGVADFGKHLEGLGLHPRSLLRIDVVALHQRADGAFAHVLVLVTADQVVENAFAQGALGVNHLFQFQRVEDRFENGQSGREDGPAVRLDPFQIELLHVAELEHLALQPGQSVRADLAVAVAAGLDRQRHCADGAGGADRLLPAEAPQAVLDAHQFQACSSVRLGVAGRGDLAVAEVALGVADATHLQAFPQLGLETLADDELGAAAADVADQPATAAVGHAVGDAEVDQAGFLAAGDDFHGMAENLFRTTDEIAAVARLAQGVGRDHAYGTLGHAADELGEAAQAVEAALGGLFAEIALLVEAGGQLDLLAQPFEDADFAVDIGLGQTEVETVGAQVQGGNQRECLGRFLRHALQVHWKTAPSCHDRARVANAAADQSGISRPTIETLNRLRLPARVKAGYDGRHFRVSIRVRLRRDFMSEHIVNVTDASFEQDVLKADGPVLVDYWAEWCGPCKMIAPVLDEVARDYQGKLKVCKLNIDENQDTPPKYGVRGIPTLMLFKDGNVEATKVGALSKSQLAAFLDANI

SEQ ID NO: 22944 - protein, 122 aa, Pseudomonas aeruginosa
PRCATARCAPRARHCCSKSRPASTCRCSATCSVRRSAWRWAWAPRTSARCARSASCWRNSRSPSRRRASRTPGPSCRCTGRSCPWRRRCSRTPPARKWSRRARTSTSAGCRSRPAGRAMSGR

SEQ ID NO: 22945 - protein, 424 aa, Pseudomonas aeruginosa
PTCCSTTSSSSPEVNYPFCPALPDARHRGFCFPVKFGRARLTCINTCAPPWRDNRASEVRGGRAFQRERHRRGLAERARRRDETGKQTVAEPCPGRGGAARRRRAGLAGIATDRPGRGIRQRQRTHRGHRGGRGGQASRAGRRDQGRRGRLRQGRRNRRADGYPGARGAVGPGPGPGAPGGERQAHRDLAGGPAREREEHRPGRGGAAPGRADSGAEALHPYRGAGQAQCPAATATRRRSGDPAERPGGVVRGTLASDFGAGGDRGRAFPGNRGAVGHRGGQGQRHPAPGGYRRQPAQGAAQRPRAVPRGTAGGSAAGRWQAAQHGRPGRRLHDFLPAIHAGRQGRTGPGSALGDRRGAGLRDPGQGFLCRQRRPVHPENGGNRQRAGEADVPGQGAARSGAAGKIHHLRQDRRARNGLPATGP

SEQ ID NO: 22946 - protein, 929 aa, Pseudomonas aeruginosa
  UNSURE (691): Identity of amino acid at the above locations are unknown.
GRVAGQPADQGSAMTAGGSGVASLRGVSLRYGETRAVDDVSLEIPANRMVGLIGPDGVGKSSLLALLAGARKMQDGEIRVLDGDMRDRRHRRAVCPRIAYMPQGLGKNLYPTLSVFENVDFFGRLFGHDKAERERRIADLLQSTGLAPFAERPAGKLSGGMKQKLGLCCALIHDPDLLILDEPTTGVDPLSRNQFWELIGRIRAGREGMSVLVATAYMEEAERFDWLVAMDDGKVLATGTPQELRERTGTQSLESAFIALLPESKRAGHHRLVIPPRPQSEGAPRIAIEAEGLTCRFGDFVAVDHVSFRIERGEIFGFLGSNGCGKSTTMKMLTGLLPASEGTCALFGQPVDASDMATRRRVGYMSQAFSLYAELSVRQNLVLHARLFHLPADGIPARVGEMLRRFDLEKVADELPNDLPLGIRQRLSLAVAVIHKPEILILDEPTSGVDPVARDGFWELMVELSRRDGVTIFISTHFMNEAQRCDRISLMHAGKVLASDTPDELVRQRGLPTLEATFIAYLEEAAGAAAPAQPAEAPAVAEQPGDGQERQAQRERFSPLRLFSYARREAMELRRDPIRLTLALLGTALLMFIIGYGINMDVEDLSWAVIDRDQTTTSQAYALNIAGSRYFVEHAPITDPDDLDRRLRSGELSLAVEIPPNFGRDLKRGSDPAIGVWIDGAMPTRANTVLXYVQALHTSTWRHFSRQAGGAEASAAASTEVRYRYNPDVESLKAMVPAVIPLLLIMIPAMLTALGVVREKELGSITNLYVTPVTRLEFLVGKQLPYVAMGMINFLLMLVLAIVVFRVPLKGSFLALTIGAFLYVVTSTGLGLFLSTFMRSQIAAVFGVAIATMIPAIQFSGLIHPVSSLEGAAAWIGKLYPTSHFLVVSRGAFSKSLGLSDLWAYYLPLAASIVVLTLLSVACLKKQED

SEQ ID NO: 22947 - protein, 375 aa, Pseudomonas aeruginosa
AMRSLANIFNLGIKEFRSLGRDYAMLALIVWAFTLGVYSSATGIPETLHHAPIAVVDEDRSQLSSRIVNAFQPPYFRPPEMIGHAEMDRGMDVGLYTFTLDIPPDFQRDVLAGRKPSIQVNVDATQTGQAFSGAGYIQNIVATEVREFVSRYRAEPSMPAQIEVRMEFNPNLTQAWFGGVMEVINQITMLSIILTGAALIREREHGTVEHLLVMPLSAFEIMMAKVWSMGLVVLVAAGLSLQWVVRGWLDVPISGSVGLFLLGAGLHLFATTSMGIFLGTVARSMPQLGLLTILVLLPLNILSGGTTPRESMPELLQNIMLAAPTTHFVSLAQAILFRGAGFDIVWPQFAGIVVIGSAFFFGALWRFRRTISQMA

SEQ ID NO: 22948 - protein, 273 aa, Pseudomonas aeruginosa
SQGPASKIAWKGEAIDEAQARLAVGFGHHLRTWGRHHRLYPEPLGTTGQHARPGDATAVRLAGYRMERGTQGSPSFLAFPCHVPARIGHRSRQGNVPAGQRQSIHLLTFMGQADQRRFVTIFAPRQVGQAAVVEAAAHAQAPALFVEPHQRQQYQVQRPGLALAAGVGQRFADAEAVAGPAFAAADPLEYHARLRPGRQHRQVGGLARGSAPHAAADAGRSRRRWAGTGRYGGHGGKGDAAPVVDRGHGRRGVAAGGRARGAPGGACGAGPGG

SEQ ID NO: 22949 - protein, 284 aa, Pseudomonas aeruginosa
RPNGAQPSGSRDVHSEFRLQRLLLPSRRGGHAGLAGRTARPSAGSGLRRRRLRRGRLATRCRRTARRRAGRTTQGRVVRPARHGPAGLFRRRGRRRHAPARRRNPARPAHRGARPMVPGFPRRFRPHRPRRQPDRRSRGSAAGHGRHRPGPGPAGRQRGRRDGLYGSHGIPAGRSAAAVRRVRQAAGARSQAFTALRFLHDPYPQVGVRPSAQGADGADGTQQHRHPAGGADVHPQSRRRACLPPGQRLPVPHRLPRAGGGDGADSRPCSRRIRAVLPRAGSGA

SEQ ID NO: 22950 - protein, 228 aa, Pseudomonas aeruginosa
TVGRPARRPGRCDRPVRRRRRLSHRRYRRHPARPDRRPRPGLLRPWRQSRLRPPADGLDQRDPLQGPPGRAAAERVRCPRPPAARPAAVQERQRSEGHALRRRGLRPGAHPGDGGVPAGAVRVPPGSRTGIRVPQGRGEDAGLRLDRRRRTQRLHPALPRERCGDQGRRPDPDRCRLRDRLLRQRHHPYLPRQWPLQSRAEGDLRTGAGSQHGGVRLHRPRSPLERGP

SEQ ID NO: 22951 - protein, 206 aa, Pseudomonas aeruginosa
PGCSPTTARCSAPGATSACSGSTCCRRPSAGSPARPWASARGRCSAMPVWSRARKARLLRFAMNLYPPFLGAGIRVRHIAGDFREVRVRMGLNRLNRNYVCTQFGGSLYAMTDPFFMLMLMENLGRDYVVWDKAANIEFVSPGKGPVHAHFSIDQKLLDEVRERTAGGEKYLPRLHAEVRDDAGTLVARVQKTLYVRLKPRLRNAA

SEQ ID NO: 22952 - protein, 412 aa, Pseudomonas aeruginosa
RPGPGPGGQRPGGAAGGRRLARRGAVQAGGALRAAGQRAVRSQPADSPAPACLGRHRRAPRRALSRDAGVGWLRHRADRLQRRQRARRGTRPYRPKPGGAGRPAGTPARFHHRPAGQCAPGTDAPLRRRLAADPGRRSPAACAAGGRRRRRQLGGTPPGRLRHPRMGLPAPRHRHQRALRERAPRNRLAALHRRRSAGLPAPAGPRRRALVLDRLVDHPGTGRTPDGVGRGWLPRRPRRSLRTAPGRHPACRPAPVHPAAPAAPQALRRAGPGAGRRRCAHHPPAGRTGREPGLPRCGGAVRGPVARPGARRTACRRTRAESLRAAADAAQPGHDDGDGRLRAPVPGRPVAAALAAQRRPAPGRRPSRGEGAVRPPGAWPQRRPAVAGTSLSGAAPLTGGPPVLRTAPRSHA

SEQ ID NO: 22953 - protein, 533 aa, Pseudomonas aeruginosa
GAFPECGRVPARIGREQRTDGDSDEQGQPGEDPEGDAPIPLLGQQAGEEASGEAAEDGPGDIEAGQLDDRAAAPALADVGHAAGEQQGNQHPFGEAPEQEGGEAAGMGGQQHGHAEQAGGEGDHPAALAAAAESADEGRGESHRQGGGGDAPVRLMGADVEARRQFVEDALGGIEIEERSATAEKQREAGETLGRIHGTLCLDEKPPVIGALPTGWPIPIQDRSIPRNRMLDLRRLRCFAAVAETLHFGRAAQRLHMAQPPLTRQISALEEELGFRLFDRSSRAVTLTAEGSLFLPYARALLDQLERTAGFARKLAQGLAGHLTLGYASSIALSDLFTEAIRLFRERHPEVQLELLEGASAAQWAQIAEGGIDVGLGRLPPPEGQVGIEVLALGGEPLVVAVPNGDPLARQERIDLYDLRDRPLILFPLDYGSGLNELIERLYRKAGLALTRGPAGRQITSIIALVAAGQGVALVPRCSTALARAGVVYRPLAEPEALADFLVFTRRHGRSAAVEAFLAILGGLDAGETPRHI

SEQ ID NO: 22954 - protein, 146 aa, Pseudomonas aeruginosa
SNLAMATAVAPDFEENKMSNIPAELRYAQSHEWARLEADGSVTVGISDHAQEALGDVVFIELPELGKTLAAGQEAGVVESVKAASDIYSPIGGEVIAINEALADTPEDVNNDPYASWFFKLKPSNPAELDKLLDAAGYQAAVDAEG

SEQ ID NO: 22955 - protein, 325 aa, Pseudomonas aeruginosa
PRANMRGRSSTGRRLTGWTTSTATATCSAPACRWTTTASDLASGRRRGRRGLLLDGGLLAAGEDRAGQFHVAGLQVRVVVAQLLQGGFQVRPADRAVAGDVAAGVVLRGDDQLVVVAEGQVGGGRGGTRGNDVAPEGIGHGRAQRQGGDDQGGGGEFDGTHGGTPDRGLRVTSDRVCRPGVPVGMTVRSLFPLPYSPRRPGATAIQGAAGSTCSRAPSWPVTRTRAPRGRSGPLTSHDASSTRSSPSPPTIARCKGKVRPNRSSPRRCNPGVSSTLPALRRRRRCKAATSPESRTNSPTCQGQASPGRSAPSAPTQAAVRPTRSR

SEQ ID NO: 22956 - protein, 115 aa, Pseudomonas aeruginosa
DPRPAARRGTPADAAGCAPRCGGSPGTVRPAPARPGPGRPARGAGRRGPAGGPGRRWRTRTCRLPSDDGGSGEAYFISAFQGLSVSTVWACVARAARRSTSTGCRSSSSNLASSP

SEQ ID NO: 22957 - protein, 157 aa, Pseudomonas aeruginosa
PRSALLMSQGISGRSAASSAASSSSAAASPWRSSSSSSQISSWLSPATTLPRSSAASTTTLALPRPQAISARWRTKSVLKIGLSCFLSRSLRAAGQHLSSSFFRSSLFFSRYQSHSLRSDNPATLCPRLFSVWMYCSPSRRMRSATLARASSRPGVS

SEQ ID NO: 22958 - protein, 125 aa, Pseudomonas aeruginosa
PAGAASAAAWASPPRARSSSAAVSAIRSSSSFAQTFNSTGWPRRCNCRPGRLPSLTTARKLSVASLHSPFSSGLSLNAQNSRKASRKRASSRSMPSGRNGLMSRQRTSTYCTPRAARACTGRSPV

SEQ ID NO: 22959 - protein, 422 aa, Pseudomonas aeruginosa
SSARGRASRSWTAPSLLLQLLGVGEQRGHGVVRRRRALSARGATLLARLAAAGGTPAALAFDLLAGGVAHAHGQADTVARDVHFHDLDLDDVAGLDHFVRILDELLGQRRDMHQAVLVDADVDERAEVGDVGHHALQDHARLEVLEALDAFLEFCGLELRTRVAAGLVEFLEDVGDGRQAEGLVGELLRVEALEERRVADQRADVALGVGGDALHQRIGLRVHRRGVQRVVAVHHAEEAGGLLEGLFAQAADFLQLVAGAERSVGVAVRDDVLRQRRVEAGDACQQGGGGGVDVDADGVHAILDHRVQATRQLQLGHVVLVLADADRLGLDLHQLRQRVLQATGDGYGAAQGHVQLGELLRRQFGGGIHRCAGFADHDLGQLHARIFLDQFAGQLVGFAAGGAVADGDQLDLVLGAQRGEHG

SEQ ID NO: 22960 - protein, 371 aa, Pseudomonas aeruginosa
GLVPLVLRRMWVDGGGVQQLAGGVDHRDLDPGAQARVEAEGGARAGRGGQQQVVQVAREHADRLVLGAVAELAEQVGFQVGIELDLPGPAHHLGQPLVGGAALVGQAEALGDHDLAWVQGARRFLADLQRGAEDAFVASAEDRQGAVRRGAFQRLIVFEVVAELGAFLFLAGDHAGGQGRFVLHEHAQLVEQRGVFGEALHEDVLGAFQHRLDVGEAFLGVDETRGLAFRDQGRVVEQCVGQLAEAGFQGDLALGAALLLIRQVEVFETGLGVGELDVAGQFGGQLALFLDAGEDRAAAFFQFAQVAQALFQHAQLGIVEAAGDLFAVTGDEGNGGAFVEQGDGSGDLLRLNAAGGQCGELFGDTGVDAVH

SEQ ID NO: 22961 - protein, 501 aa, Pseudomonas aeruginosa
SSRIRPSRAISRRSGASATCSCRTATRARPESPRGRCSDAPAASSYPQQASAPSAGAQPVRSMKTPLWFPQSFFARTLWLVLIVVLSSKALTLVYLLMNEDVIVDRQYSHGAALTIRAFWAADEESRAAIAKASGLRWVPSSADQPGEQHWPYTEIFQRQMQMELGPDTETRLRIHQPSQLWVRAPSLGEGWLAVPLYPHPLRGQRIWSVLGWFLGIGLLSTAAAWIFVRQLSQPLKRLVVAARQFGQGRSVRLPLGPETPSEMAEVYRAFNQMAEDIEQGGRERELMLAGVSHDLRTPLTRLRLSLELLPESEREMVEDMIRDIEDMDAILDQFLAFIRDGRDEPVEEGDLTDLVREVVAPFNQTREQVRMALQPVPAMPLRRVSMKRLLGNLIDNALNHGGGSVEVASYVAGESAAPYVVLSVLDRGQGIDPAEVDSIFNPFIRGDKARGGKGTGLGLAIVKRIAAQHGGSVELRNRDGGGLEARVCLPLGLLLPRGAA

SEQ ID NO: 22962 - protein, 372 aa, Pseudomonas aeruginosa
CPACRRRCAGLPGAARRSRRGSGSGLRRGGRDGSPRRALPVAAGSPPARRWRWPRLARSAPPGRRWAARSGRRRDERSCGDSVKRQERIRVPEEHGVRRGFRHRLRRCFIQAWHGPSVEAGIAGVTRCVRCAGTTHALSGPAHPFPFVLARWGPPFFSRYWMMIPAMSLPVVDSIPSRPGEEFTSITSGPWLERRISTPATFRPITRAARMAVMRSSGVILIRLALPPRCRLERNSPGAAWRFIEAITLSPTTKQRMSAPPASFMYSWTMMLCLSPMKASSTDSAAFSVSQRTTPMPWVPSSSLITSGAPPTISIRSGTSSGEWAKPVTGRPMPLRESSCSERSLSRERAMATDSLSGNTPIISNWRNTAQP

SEQ ID NO: 22963 - protein, 167 aa, Pseudomonas aeruginosa
QGYGRPPDGCPRMPKTNLAAVDDSRETAAERIREMPVSEKDDDKVRLDKWLWAARFFKTRALAKAAIEGGKVHCRGERCKPSKEPRVGEELTIRTGFDERTVTIRALSVVRRGAPEAQALYEETADSVASRERAAAMRKAGALGVQTEGRPSKKQRRQIHQLRGGQD

SEQ ID NO: 22964 - protein, 529 aa, Pseudomonas aeruginosa
SATKFGGLGLWPTGNHMTQANNAVYTDISAAQLVEEAIRRGEGELAANGSLVVRTGHRTGRSPVDRFIVEEPSTKDAIAWGNINRPFPADKFDALWARVEAFNNAQDHFVSHVHVGSAEAYYLPVKMTTATAWQNLFGRCLFIEPEQYNPAGKDEWQVLNVANFECVPERDGTNSDGCVILNFAQKKVLIAGMRYAGEMKKAMFSVQNFLLPERDVLPMHCAANIGEAGDVTLFFGLSGTGKTTLSADESRYLIGDDEHGWGEGVVFNVEGGCYAKCIDLSEKNEPVIWKAIKFGAVLENVVLDEERVPNYADDSLTQNSRAAYPLEHVEKRSEKNLGGEPNAVIFLTCDLTGVLPPVSILNNEQAAYHFLSGYTALVGSTEMGSGGGIKSTFSTCFGAPFFPRPAGVYAELLIKRIKAFGSKVYLVNTGWTGGGYGVGKRFNIPTTRGVIAAIQSGALIGAETEHLDIINLDVPKAVPGVETNLLNPRNTWADKAAYDEAAKGLAKQFIENFKKFEVSDAIKAAGPQL

SEQ ID NO: 22965 - protein, 221 aa, Pseudomonas aeruginosa
SLVYLLANALEWAPLCSLAVDFPMHIEDAVRSRRAIKGYDSSFSLTREEKDHLLDLALHAPSAFNLQHVRLVEVSDPQLRVQLREVAWDQAQVTDAAMLVVVCAQLDSWERNAQRVWDGAPEAVQAFMAGAIDTYYRGKPQVQRDEAMRSCGLLAQTLMLVARGQGLDSCPMDGFDFDAVARLINLPDNHVIGLMVAVGKKAVEPWPRSGKLPREELVQTV

SEQ ID NO: 22966 - protein, 214 aa, Pseudomonas aeruginosa
SCANTATCRCSSRPRASRSASGAAPASGSAETTRHDGVPAWGRLASPYHRKEPRMAHPNAELIERFYQAFQRLDGEAMAACYAPQATFHDPAFGELRGREVGDMWRLLTSRARDFRLDYANVRADENEGRAQWVAHYLFTQTGRRVENRIEARFRFADGLIVEHRDQFDLWRWSRQALGAKGLLLGWAPPVQRAIRGQARKGLAAYQAAHPAAG

SEQ ID NO: 22967 - protein, 246 aa, Pseudomonas aeruginosa
SPKLAADNPQDAAMITLFQFPAAFNVPNASPYCLKLETWLRLAGLEYQVKVVSDPRKAPKGKLPYVRIEGEAIGDSEIVIRTLGERYGVTLDAGLDARGKGWARAITRLCDEHLYYLMLYFRWFDEDSWRVLKPVFFGSLPFGVRDAVAWAMRRKVRATLRAQGLGVHGRDELLAFARDDLDALDGLLGQVPYYGGEHPCSADAAAYGILANLIEATLDTPLSHVARGYPRLVAYCERMRERVWSE

SEQ ID NO: 22968 - protein, 136 aa, Pseudomonas aeruginosa
SCSTPLNSAARPASRRRCRRATRCWRRPSRRSGWRLVRRPASCRTGRRTTTTCCAPSVAARRPATSSATRCAGRRGRKTPTPGWCPANTATAATSCRTTGWTARSSATTTASIPGWKGTCRTISAAPCVRCRACRR

SEQ ID NO: 22969 - protein, 209 aa, Pseudomonas aeruginosa
GCGRTRCPWRPCRASLSQTNRDVEPKEDAMLIRAATSTLLVVDIQERLLPAIDDGPALVEYSQWLLRVARALDVPVLASEQYSKGLGPTVAALRDELEPTQILEKLDFSAAADGALLRAPGGDRRQFVVCGSEAHVCVLQTVLDLLGRGREVFVVEEAIGSRRPSDKALAVERMRQAGAMIVSREMVAFEWMERAGSDRFREISRNFIR

SEQ ID NO: 22970 - protein, 342 aa, Pseudomonas aeruginosa
RRLIIDKGCRDATDRYAGFAFCAPGRHRPAPAGPALRAPAAVGVPQFPGVQPVQPDGQGAHAGAGRWHRADGLQPDPRLPGVPGRPRTQSAAATAAGPCTGVESDRRGAGGLREIRADLLRTEPASRGTPPRPLAGAGGGAVAGGLRLAGGSAAPGAAGTRRWHRAGRGDRRGGLALQPTGGRGAGRRQRIPGTGKLFGLCGGVAGVPRDAVGLSPRGARLAPLERLDSACARPRFAVGRCRRHGPDRLLRTAVRRRHGGGPALAQPGPERGPRLALRHAAGRALVRLLDPPGGIATDPPAAGGLGAGELLRAQRPLELMGTAGTRSRTRGRRQWSEPDARR

SEQ ID NO: 22971 - protein, 211 aa, Pseudomonas aeruginosa
GAARSPGRGARASLRGDHGLAGQTVGLPRPHRAAAQSGRAACGHVLGRRVQADGAAAGIAHDLEGTRQGERAGDPDTGRTGPGALPPGQRRWGAAFAEHRLGRHSCRQPGRGVPYPGWPPARTEHRRDRAAAVGHHRRCRESTGARRKPGTAARNHRPVASGNERGRTVAPSGRERGQQSIGRQGAGGWPGEAVRGGCGKVPGQTAWWHPQ

SEQ ID NO: 22972 - protein, 139 aa, Pseudomonas aeruginosa
SGLTGRKRKTSRTDTLGCPILGSAADLDGEACWLFAQWFQEGCCPTLLAPGPALLLVEVGPGDEAALLLSLGHVHHADIAGAQRLQALLEVRQVARLGYQGGEPEHLRGERPAFLGHAGQEGRFAALAVQLGALAAKVQ

SEQ ID NO: 22973 - protein, 279 aa, Pseudomonas aeruginosa
RQGTGRVELAEVLPLAPAAARGFVQRGVEGRVAEGHVEALIDADQALEYLPAIRLPAQLDGSGEAWVGGEDRSGRGQRLRVDVGADEAPAVFVVAEQRVDAVGSGSDVQRTQAGTAWNQAIVAGAEQVGQVVQVVGATGDGRAQVTIGYIPLAYVVELLQQRAVEGFHRRRIGEVDALPAVRIEDDEALQFRAAGDQARKVVASQVAIARVQRAGALALGVGMRAGRAGHVLGFRDGEAGIIHIRRRLASVSAERRAPGPVTMETATESPARRRTSPAG

SEQ ID NO: 22974 - protein, 343 aa, Pseudomonas aeruginosa
RGRRWWRAGRPPRAVRGSCGHLSGRMPASVADGRGSRLDLLQVDGASPLRRGEAPRPCQPRRRASSASFSPRTFSNIASRSGTSRPLRCSPETSSTTWPWCSITVRSPTSSAWRMLWVTIMVVSFFSATIRAVRCRTKSAVRGSSAAVCSSSNRIRDGCSAAISRLTAWRWPPESRPMRSPRRFSRPRPRVARLSRKPSRIDACTALPRPRPAPRRCARAMFSSMVRSSQVPAMGSWNTRATRLARAQTGLRVTSSSSIRICPLSIGRSPETALRKVDLPAPLEPITVTNWPAGMSSDRPRRARVSMGVPGLKVIFRFFALSMVRLPSCRAGVSSSSESPGRR

SEQ ID NO: 22975 - protein, 190 aa, Pseudomonas aeruginosa
YLIKISISAGGGLFDVGSVFLPVGRAIVSVGFDFMFGAVSGAERGLGGRGGHKYAAGILSGGNGKAFAGHGKYVFGSGDFWVPDGTYITLPRPGINILDETGRFIELGDWAGLAQAAKINPRLAGDIEGMATYLPRAEIPNYTLSAPAARGPALHIDGNSTTVEFSTPLEKLLQLGVGCVQWAACTTFAR

SEQ ID NO: 22976 - protein, 248 aa, Pseudomonas aeruginosa
SAAIFCRCSASLARACSASASLARSFSITSAGALATKPSLDSLPPTRLTSPSRRWISLSRRPSSALLSIRPAIGTNTSMSPTRAVADIGASSPASSTRMLSSLASFISSGSLSARRRWSLGEAFLRMMSMRLAMEMFISPRICRTPSISALTHSMSPSAAASILPSSATGQGCSIRVGPSLPAWPLMRCQISSVMNGMNGCARRRAVSSTRIRVRRVPRWRSMGAFSSHSTGLTSSRYQAQYSSQMNS

SEQ ID NO: 22977 - protein, 194 aa, Pseudomonas aeruginosa
RPRRGSSTGGRPTRCAAPRRRNAGRPACPAARPSRPGGRRPAGAPTDRRWGSRRNRPGSLGPFQQVLGQQRNRAAGGAFVLAAADPGGAGDVQVRPVVFLGEAREEAAGGDGAGLRPADVGDVGERAVQLFLVFVEQRAIARRGRRRTPPALSNCLTSASLLPIRPEVLLPRATMQAPVRVAMSITDCGLKRSA

SEQ ID NO: 22978 - protein, 184 aa, Pseudomonas aeruginosa
VSASHSTRRPSASVLRISTVCPLMVVTMSPGRVAPPLGMFSAQASRPTRLIGNCSSSTARKVPKTLAAPHMSNFISSMPRPGLRLMPPVSKVMPLPTSTCGAWSFFAPLYCRTISRGGWSLPWATARNEPMPSSRSFFSSRTSTFRPLNSLARPLACSPRNVGWQTFGGRLPRSRVRAMPLAMA

SEQ ID NO: 22979 - protein, 388 aa, Pseudomonas aeruginosa
RGRRAPSEPGNPGVSGLIVFRYLSREVLVTMSAVSAVLLVIIMSGRFIKYLAQAAQGLLDPGSLFLIMAFRIPGFLQLILPLGLFLGILLAYGRLYLESEMTVLSATGMSQKRLLGYTMAPALLVAILVAWLSLFLAPQGINQFALLLNKQDTLTEFDTLVPGRFQAMRDGTRVTYTEELSKDRGELAGIFISQKDLNSSNQERGISILVAEKGTQNIQADGSRYLILHNGYRYDGNPGQANYRAIQYDTYGVMLPKPEASSEVSERDAVPTADLFGSDNPRYQAELQWRLSTPLLVFVVTLLAVPLSRVNPRQGRFLKLLPAILLYMGYLALLIAVRGQLDKGKIPMAIGLWWVHGLFLAIGLLLFYWEPLRLKLASSRAGRDVAHG

SEQ ID NO: 22980 - protein, 360 aa, Pseudomonas aeruginosa
ARSLHRCHRLRRDPRGARGDPWPGAAVRLHRRTQRHQRQLRHRRRPALHLPHRATARLRHAADGGADRLPGRPRHPGQQQRTDHHARGRGIPVADRLGGDETDAGADAGRHPGWRVRRALDREHRPERPRPGPGRRRFAKLQARSVASPGARVHPHQRGAAQWRAVRRDPLPLRRAAWPGIGQFRQARALRDRSLATGRGHHHLAASEGKAFRGGQATDRTLGCPAQPATAEHCGDGARGAVYQRSLAVHPLSRRPGPEQQPLLAGVLDQGPATAGDRRAGADGDFLHLRSVALGDPGPADLHRRAGGLRLPHRPGPARTLQPGVRLPAAAGGGDPRLDLRTGGCLAATPGGLTGPAGRV

SEQ ID NO: 22981 - protein, 538 aa, Pseudomonas aeruginosa
SLRRPQSLRVFSMPIPVKRARRKALRLSLSVLVGVMPIVLGLLILYWQAERSLQETSEQAAGNAVRQFERMLDNAALAARKVMPVAGRPCPEAELALREQVAIMPFVRSVNLTRDNTIYCTSLFGGFDEPVRIENYVDGRLLLMPGNQVTPDAALLVLRDFDGKRGVLAAIDGRYLSYVLDLVDRRSRQVLVVGPNWLDAEGRTHRDAPPTYEVAAVSLASQRYPLRVLSGFPEGEEWRSIRSQNPAMFGLLLFFGLLAGTLCYWLSRRVASPSSELRRALEANEFIPYYQPLSPGQGGRWIGVEVLMRWRHPREGLIRPDLFIPFAERSGLIVPMTRALMRQVAEDLGGHAGKLEPGFHIGFNISATHCHELALVDDCRELLAAFPPGHITLVLELTERELIESSEVTDRLFDELHALGVKIAIDDFGTGHSSLAYLRKFQVDCLKIDQSFVARIGIDTLSGHILDSIVELSAKLDLDIVAEGVETPEQRDYLAARGVDYLQGYLIGRPMPLESLLSSLTVQEGQGASVVALPADRG

SEQ ID NO: 22982 - protein, 160 aa, Pseudomonas aeruginosa
TPRKPPVGAGWPDGNPRPQTIRRSPGLPASGRPDGVQQYPGDPGAPVRPEGIRRQAGSPGRARARPAPGACPHTRQQGAQARHADPRRRRWQRGDAATPRRPVRTRVRRTRAAFAGAGRAHAVASLYRPTGRCGRPRALPDRLRPARRCGGGPDRRPALR

SEQ ID NO: 22983 - protein, 116 aa, Pseudomonas aeruginosa
QECYMSFLIPAAHADAAAPAAAGPAGTGFEWVFLVGFLVIFYLMIWRPQAKRAKEHKNLLGNLQKGDEVVTSGGIAGKVTKVADDFVVVEVSDNVELKFQKAAIAATLPKGTLKAI

SEQ ID NO: 22984 - protein, 465 aa, Pseudomonas aeruginosa
RACCARSACATAACRSSDRAIQLGFTDSESLDKARSLIAKDFRDFEVVPEERNGLQVLRVALTQAKLAEIREYSIKQNLTTVRNRVNELGVSEPLVQRQGANRIVVELPGVQDTAEAKRILGKTANLEFRLAAEPDALKSATETFEFREPRRPPVPLERGVIITGDQVTDASASFDENGRPQVNIRLDGHGGELMNRATRNNVGRSMAVVFIEQKPVTRYTKQMVDGVEKEVAVPAFKEEKQIISLATIQSPLGNQFRITGLDGPGESSELALLLRAGGLAAPMYFAEERTIGPSLGADNIAKGIDASLWGMLFVSLFIIVIYRFFGVIATVALAFNMVMLVALMSILGATLTLPGIAGIVLTMGMAVDANVLIFSRIREELANGMSVQKAIHEGFNRAFTAILDANLTSLLVGGILYAMGTGPVKGFAVTMSLGIITSMFTAIMVTRAMVNLIFGGRDFKKLWI

SEQ ID NO: 22985 - protein, 298 aa, Pseudomonas aeruginosa
KTRRQAGFFVSGGSALQRRRQVRLDGGQQCLEAFGVAGDDVTLLEEFVAAGEVAHQAAGFLYQQGACRHVPFGQAEFPEGVVASGGDVGQVQTGGAGAADAGGLADQAAEHVQVVVEIVDLVVAEREPGAEQGAFQALAAADAQAATVEGGAATAAGGEFFLAYRVEDHGVLQAALVLAGDAHGEVRYAMDEVGGAVQRIDHPEVIGALAAAFDEAAFLAHDRVSRIGLAQRGDDGLLGGAIDFGHVVLGILLVDRDDIQAFDGAENQFTGAASGAQGDIQHRLHGEVTWVVKESRPF

SEQ ID NO: 22986 - protein, 260 aa, Pseudomonas aeruginosa
RLMFERVREDIQSVFHRDPAARNALEVLTCYPGLHAVWLHRLAHGLWTSGWKWLARLVSNFGRWMTGIEIHPGARIGRRFFIDHGMGIVIGETAEIGDDVTLYQGVTLGGTTWNKGKRHPTLGNNVVVGAGAKVLGPFTVGEGAKVGSNAVVTKEVPPGATVVGIPGRIIMREDSEQQAKRQAMAEKLGFDAYGVSQDMPDPVARAIGQLLDHLQAVDGRLEGMCQALTALGSDYCAKDLPVLREEDFAGVKDEDGNPAA

SEQ ID NO: 22987 - protein, 169 aa, Pseudomonas aeruginosa
SRWEKPMRLTTKGRYAVTAMLDLALHAQQGPVSLADISERQGISLSYLEQLFAKLRRGNLVTSVRGPGGGYQLSRHMSGIHVAQVIDAVNESVDATRCQGQGDCHSGDTCLTHHLWCDLSLQIHEFLSGISLADLVSRQEVQEVALRQDERRCSGKTPRLDKIEASAID

SEQ ID NO: 22988 - protein, 134 aa, Pseudomonas aeruginosa
SSAKASTPWSRPTNSKTTCWTRPGVWSPIRGYPARQWWPTKTWWSRFPSTPSTRCRKATEPGGREERAMSLKWTDVLEIAIQLDESKPEVDPRYVNFVDLRRWVVELPEFSDDPQRSGEKVLEAIQAAWIEERD

SEQ ID NO: 22989 - protein, 200 aa, Pseudomonas aeruginosa
NRPRAHSRLGAPGPMPGAATLIPALSGRFRQRPERITASRPAGGAAHARQPCFGVLPMALQRTLSIIKPDAVSKNVIGEILTRFEKAGLRVVAAKMVQLSEREAGGFYAEHKERPFFKDLVSFMTSGPVVVQVLEGEDAIAKNRELMGATDPKKADAGTIRADFAVSIDENAVHGSDSEASAAREIAYFFAATEVCERIR

SEQ ID NO: 22990 - protein, 387 aa, Pseudomonas aeruginosa
SSVGEGEAMTTTTAGKVNLLGLTQPQLEQFFESIGEKRFRAGQVMKWIHHFGVDDFDAMTNVGKALREKLKASAEIRGPEIVSQDISADGTRKWVVRVASGSCVETVYIPQGGRGTLCVSSQAGCALDCSFCSTGKQGFNSDLTAAEVIGQVWIANKSFGTVPAKIDRAITNVVMMGMGEPLLNFDNVVVAMNIMMDDLGYGISKRKVTLSTSGVVPMIDKLGEVIDVSLALSLHAPNDELRNKLVPINKKYPLGMLLDACRRYISRLGEKRVLTVEYTLLKDVNDQPEHAEQMIALLKDTPCKINLIPFNPFPHSGYERPSNNAIRRFQDMLHKGGFNVTVRTTRGDDIDAACGQLVGQVMDRTRRSERYIAVRQLAESESAANRN

SEQ ID NO: 22991 - protein, 547 aa, Pseudomonas aeruginosa
RPGGDRSAEGRRASARRGFSGSRCPGRGSAAGGERGRAGSRRSGPGHPRRTPAARYRRACRHGSRSRYCSSRSSDGQSGRPASAERTCRRARGGRRGPGGGQGTVRRRLLDPGHRRQRQGPGQRAEAQGRQPGTGRQGPAGAAPRFRSRRPGQLQRPAGGRDPLRPRRNGPSEGRTMSIHSASPIIRRKSRKIWVGNVPVGGDAPIAVQSMTNTETCDVAATVAQIRRLEDAGADIVRVSVPDMDAAEAFGKIKQQVNVPLVADIHFDYRIALRVAELGVDCLRINPGNIGREDRVKAVVDAARERNIPIRIGVNAGSLEKDLQKKYGEPTPEALLESAMRHVDHLDKLDFQNFKVSVKASDVFMAVAAYRLLARQIEQPLHLGITEAGGLRSGTVKSAVGLGMLLAEGIGDTIRISLAADPVEEIKVGFDILKSLHLRSRGINFIACPSCSRQNFDVVKTMNELEGRLEDLLVPMDVAVIGCVVNGPGEAKEAHVGLTGGTPNLVYIDGKPSQKLTNDNLVDELERLIRQKAAEKAEADASLIARG

SEQ ID NO: 22992 - protein, 350 aa, Pseudomonas aeruginosa
GPYVSKSLQAIRGMNDILPEQTPAWRYLERTFAGLLDGYGYSEIRLPILEFTELFARGIGEGTDVVDKEMYTFLDRNGESLTMRPEGTAGCVRAVLEHGLSGGGQVQKLWYTGPMFRYEKPQKGRYRQFHQIGVEVFNLPGPDIDAELIILTWRLWQKLGMADAVTLQLNTLGSSEARARYREALVAYLQERFEQLDEDSQRRMTTNPLRILDSKVESTQALLVGAPTLHDYLDEESIAHFEGLKARLDAVGLRYEINQKLVRGLDYYCRTAFEWVTDKLGAQGTVCGGGRYDGLVSQFGGKPTPGVGFAMGVERLVLLLETLGGDPRRTEPSGRPLRLRLRRTSPSWPP

SEQ ID NO: 22993 - protein, 258 aa, Pseudomonas aeruginosa
CENGRAIVAGHRGGGCRPVPGRFARRHDRRRPDDRRAPAQAEQAQLPDRQQGRHHRSRSRSRRVQPAGPGRCAADRRRPRSRHQPYAAGSPGDLPQGQRGGRGRGRAGERRGRRRRGTDPDSRSQREGRDQDCHHRPAQRGQVDPGQPHARRRAGDRLRPGRHHPRQHLHPVRAQRGEVHPDRHRWRAASRQDLRGGGKVLGGEDPPGDPGRQRGDLRHGRPRRGGRARPQPARLRPRDRPCPGHRPEQMGWHGGGRA

SEQ ID NO: 22994 - protein, 142 aa, Pseudomonas aeruginosa
SATRSTSTWCSTVSPIPACCPTTSCIRVPSWSVRSARPTTSPAGRPATWSRRRRSARSCARFTSTSTSVASRRCNGHWRTTWPAIRSTCGNCPASTRPSATCSATCCWTLASVLPVRRAPTSSAWTIRPSVRTWTTWPWPSG

SEQ ID NO: 22995 - protein, 135 aa, Pseudomonas aeruginosa
PGSPLRSRGRCRPDRSAGTALPRSRLPSAGRSPCEWHPGASRRKRYGPGRRHMDGAGGPATGCTLRPPCAPRRCRRSPVADAGPGCTCSRPGSPGRRCRCARRCRTGNLRRGRRRPSGPARWRPRRCHGRCGCAG

SEQ ID NO: 22996 - protein, 225 aa, Pseudomonas aeruginosa
KLVLDCAAGTLSATENSAAPCRRRASRPCAIISFPVPGAYNDRRILLFGMTRRERPSGPLRGGLHSRRRESQVATTLKRQGIGAWLALFAMLMIFVGPLISQSMPMDHPMPMGVGMGHEGMSHENMDHGDMAHAGCSDAQRSVVHAGMPGMGGEEGNRLASDVLWEKCGYCSLLFHSPPLTEDACLALFSVPFATAPAVAFLNEAFVASPVFPGARTRAPPFLIA

SEQ ID NO: 22997 - protein, 682 aa, Pseudomonas aeruginosa
  UNSURE (392),(393): Identity of amino acid at the above locations are unknown.
IMEKRMSTQQRAAGNACPTAAFSFDPARLAQRRRWAGAFAALCGLALSPSALLAEEHSQHQDHAVELAPSVVTGVAQSSPLTIVTNPKEPRQPVPASDGADYLKTIPGFAVIRNGGSNGDPVLRGMFGSRLNILTNGGMMLGACPNRMDAPTSYISPETYDKLTVIKGPQTVLWGPGASAGTILFEREPERFGELGSRVNASLLAGSNGRFDKVLDAAAGNRLGYLRFTGNHAQSDDYEDGAGNTVPSRWKKWNGDVAVGWTPDEDTLIELTAGKGDGEARYAGRGMDGSQFKRESLGLRFVKSNVSDVLEKVEAQVYYNYPDHIRDKFRLGTPGPIRHDAHADGVPGGQRHPRRWPGGHLALGRLQAGHRGGRHAQRAPRARLQVRHDDRXXHRRRPVPLEQGRGVPQLRGLRRTDLVRRRARPADRRVAPGPRLGQGLPADPEVRAHGPRHGQPDGQRHPRRYPAQRLRALRARPRRLADHPIRRPRPCRALPRLLGAVLAQARAERVGQRLRQDQAGKDHPARLRPPVQRRQAAGLGLRLRRGGPGLHPVQLSRGHDGFLDPGDQRRRADHGRRAGRFLPAHRQLEDRRQPGLCLGQEQLGRPRAAADPAAGSALRPDLRGRRLECRQPVAGGRAAESHRQGPGQRGRQGLRQERRLRRLLAQRRLPGDSQRQAERRCR

SEQ ID NO: 22998 - protein, 177 aa, Pseudomonas aeruginosa
CSRSAWRSCSARRAACGSGGSASRPDALACRRCATSCRAGRAASPSCWRWAWPSRWWGPRSCWSGRWTGWCCRGCRRFAGSWLETCCPALSRGRAGGSSRVPPATARRAAPRRRARGRWLAPARRRSAHRRDAPRRRWRSPPGRRAGRAPGSGGAGRHSRAAGRCRSWCRRSWRAGR

SEQ ID NO: 22999 - protein, 169 aa, Pseudomonas aeruginosa; identical to SEQ ID NO: 20992

SEQ ID NO: 23000 - protein, 156 aa, Pseudomonas aeruginosa
PLDASQLVCLQGHGLRREDEWRTVCPRLPGIREPGRKVPVLAPMTHEEVGMKLSDSFDARRLRPRRPRVWRWRLAAAFAALVASLGVLLSLAGTSALIGRQPAVGMLHIEPAAGGVLLALGLLSLCLGVLFWRFSRRRSRRNSDLSLSPNLMKKRD

SEQ ID NO: 23001 - protein, 269 aa, Pseudomonas aeruginosa
PRRSAGHAQACRQGHEVPVPRLPTEPGRSRQRCPVQLRQQRNGIGQGHRAVLALRAPPAALHRQGPRGLYPERQGARPVEGRADRRHVRPPPADPGEHEPADRRGGPAGHRRPRRRGGDPGPAHVHDDARRGKAELVHGHFGDARRIPRQRRHPQRIPQPDPLRPGPLAKEPAPLGRFCVSFPGDQPKKRFIERDNQPPSLLSLTSSDMLWRTASTYPASSLRMWLNSQRESKPLSSSPTSSPAWKRTRYSETRRMNSSWIFLCARENW

SEQ ID NO: 23002 - protein, 199 aa, Pseudomonas aeruginosa
RCQRRTRRGRRLRAYATWGDHLPECRGPGCRHCPGPRRRQRNPLPEDAAWRRRVHRRDQGQRRQSYRPAERLRRAAVEVLQTERRRLNGQERRPARNAARPALPAIRGRRCSAVRGRGSGRYAAPASSAEAGVRARAAGAPAPAPGPGSRAGGGTDGDRRPVRRGRRPAHTGRPPATMARPRAVRERRSPESRRRCGPG

SEQ ID NO: 23003 - protein, 355 aa, Pseudomonas aeruginosa
AASALPAAPGRRTAHGAGPGHGRPSPCRRRRASAPDGSARKERPAADRATPPAGPAPRRSGRRRRNRSGSRRPPPPAAAPATTAVRSLADHHGRQVVPCGAAQGTVEQPLHRHLRRCQAQRATQRIGAQLFVEPVAAEQEDITGMHLQFQHVQHQLFASADGTGQRARRGIGAGLLDIHPPFVDQSLQQRVVAGQLVQPLAAPQVAAAVADPHAGRPRTLHDQRHHRTADDPVAAFGAEGEFLAQAPVEPVQALAHRVQALVESRPGRQFRQAGDDHPAGQVAGLVPAHAIGDRPEPAIRAVQEGILVARADLAAIRACRAAPGLGALHQSCTGMRKLRRTARSNGFGVRWASSR

SEQ ID NO: 23004 - protein, 567 aa, Pseudomonas aeruginosa
QKERQRTDVQGALAPVDARAFAAIETCQVGLGEDHLAQQVMDEARAPVAQGRQQAAGDPQVGADAGGVFIQLLGQVRRAGQVEAAQAAGALVAVAGEGEFDEQAQPLADLAKLVREVEDATATQGIALLVDAHDHLAVQASQKVLERLAQDRHICAVLLLAEAGAQNLVALLAAQLVEELVEAEQLVGLAQHQVDRQIEVQGLLDFLQARAHLASQRIQRHLVVAEQRFHRNRHHHAIQRPCAAALAQQAEQSRPGAPVDLAVGLGQVAPGGVDQDAVVGEVPVAVARAGGIAGQLAVDPVDRELQSGKVQQAGLAASLRADQQVPGQLVAPALATTAVQAGGLQGAQGVLEAAAQFLLFVFDQTVTAQALLALVAVLDGLAPHSGAPADEDHRQPPDQEHQTDAQQPRGRAFPELVVGDRQQRPDEPHQQCRQEYQQQRPDPRLAQEGADFLEEVFHFASLCLRTGLSCRRIERLVRLQHRVALLAENPGESRIHHHQADQGEQRHHPPGHDPHQAATLVAEPLPVRRQFARHVAAQLADLPVERIGNTVQVEHAAGHHPVLALEA

SEQ ID NO: 23005 - protein, 625 aa, Pseudomonas aeruginosa
RTGIRESPWKGRGRRAPGARPAGLVGRKSRSWASGPGIAEMNVQASHAIDQGSSRQTQFARGEGLVASVPAQAGEQQVPFDLLQMLAQLERRLRFRGRAQGKVFGQQHLAFAEQYRAFHQSLQLPNVAGKAIAVEQFQRFRGPAQRRAAQEHAGALGEMPGQFEGVALALAQRRQLDGKLRQPVVEVFAELAIAYQQGEVTVGSGDDAYIDLVRVVAAERANLAFLQHAQQLGLEREGHVADFVEQQGSAIRGIEQPGTIALGTGKGALAVAEQLAFQQVFRKRRAVLHHERLCTPRAVLVDRPCDHLLAGAGLALQQHGIGVVQDLADQAAGLTHRRAPADQPVSADHRCAGRSLRLAGGLREALQQMQLGQHERAQLAQWMGESLQVQWAPGSADHHALDRFLRAHQRNAEQGQPGLLPCRQEAGLVQPRRQVDETDHAVLAQGELQQLLAGVVRRQARRLQRLQQAVPAFGVEGERGMGLVEQIQLAQLAAAEFADCACETAQQGRDVGFPRQRAELSEQGFGEGQGLRYAAEHRTHLRRTRRARGRARPASHGPARDARRAPSLPANGRPPAAAGACPAGGRSTVRRCRSGCNARPGGPPAPGCSRKPVDGAPGARRGVAA

SEQ ID NO: 23006 - protein, 130 aa, Pseudomonas aeruginosa
PAAPGPGHRRVPGGFREGPFPGLRHRHARRPGKSPRSPRRPALPGSPRGPWPIAGAGRAGARRVRAGGSTGPPVRAARFPPGPGAPPAPAGHRGRSAGLPRHRGAGPGAGARLRPARRAGARDSPAPPPG

SEQ ID NO: 23007 - protein, 640 aa, Pseudomonas aeruginosa
PAGPPGTASTRECPGPARLQQGLQTHARFPLVHVSLCAPHPQLVVGVDAGVKREKFVQNRSEHEQVALADVAFRIDRQLGTQAAQRQAPMQAVDMLVADRLEPAQQALADLRRMLVVVARQVVGFEDHLECVDVGQRQVVERHVADQFPEEIAVQRRRVARRRRGDIAETEELRRTFASDADIAQAQPLGQVLVGAGQFHRQRLDLLGMADAEAQVGVQAIVQQRGPLPDAVVGPCFRDVEAGIVLEGLERHIGLVAEPARPPAGDALYREHPAVLQAVFGRHQQVLVLLAVEADRQRIVAEQVGHRRTVQLDVLQRRVQALDAALADIEAQLEAADLLEGFLGQSAEQVKAIHVDEQELVLEREVFLQVAIATEGIQRIGNQRLVFGEPHRLHPLARQAERHRLAGHAIQRPPMGIQRNQLDALQVAQQAQVEHLADVALAGQVQAQPTQAQLAEMPVAVHRQAQAEQRTLAGHRIVERLQHQRQDFGGVAGTEATGDLAHRPALDRRIALHAQRPARAGQGVELENAESRQRAHIVRPQQVHHRVAEFRQLVVQLLPQPPGQEGKALEQALDIRIASDLPEKRGQGRATLGETAPQLAQCGEFALVVMIEGHGLPAGYRFTDGSRLTAAAKTAMTFLA

SEQ ID NO: 23008 - protein, 768 aa, Pseudomonas aeruginosa
RSETHGVRCLSVIDPIRAHLRRPHGRTRHRAVQRQAEASPWRAAARPSKNTSAEPTPMGLLPCPGSGQAVGSETRAAGLPDIETSLADLHLAAAIQACGKTHLALETSHLQQAFDAEGQAELVVVAWQGNDTHVAQARFVSLDETFDGRAGLAQGVVQAQAHVVEIGQPVVGQRLHAARPGAEHLAQMGSHRRHGGNLAAPADALIRVAVQALEQAAVSGHGKLRLLFVQLADQRQGEVRPHVLEVRAHVQADAVPARLALDVTDDDLCSAQRATAAHFGAGVFLVGDVLADPLVQLQLEVGTLLPRPQLFALQDLQVMGQAVDDHHVRQLGAELVVQLRGLAFGADAEELRLLHRAGGEERGVVAALAHGQGNEAFLGQFVLAAIGHQHLGGDLGLDLAHALEVVQRQVLYRTAALRPDDVRAPAILGEAVGQLGAEGIGGVAPQVMLVAVGHGLLVGERLDRILFRIVGRAQQEARYGQRHVAGILGLAEALPLGELRAFEMILQVLQVRQAGEAFQAEELRTGGRHEWRMGHAGHAGDVLHQLDVGRTGRHVVVGDDGADRLATELAVFGGVDVLVQAGLHHLGRVLEIVQQVLLGNAENLDLDVLAEVGAVDQQLQAAPGRLQRLEIGMMENLVHLRAELGVDLGDHPVDHRLLHRLAVVLRLEQFLDEGGDAALGDVVGLVVRAQAGLGDDAVENVVFAVLVPALLCGTGAHVSASLARGWLRRPGRGRRSAPARPAHGYGTRRRRVRFRWPCGTPGRCPAGP

SEQ ID NO: 23009 - protein, 148 aa, Pseudomonas aeruginosa
PATASPSSRNWPTSPSAPTSASSSTSRCRRSSAGCWRNTASSPTPTASSSAPATPSANTACSTTRATCSSSSACAARRASIFISSTAPRRTCWCSATTRRCSRGSRRWPTSRTPAWSPTGRRSSASAYAWKPAPAASPAATTTSRNRA

SEQ ID NO: 23010 - protein, 120 aa, Pseudomonas aeruginosa
PSSKAIPTSRWSPAACFTGNIRCPTNCRGTRPAASSRASAALAAVATTSCASRTARARSRSSSMPSATGTKTSSTTRRSASVTNATTPCRRTATASSRPRNTAPPTPSARWRSEPATTSP

SEQ ID NO: 23011 - protein, 404 aa, Pseudomonas aeruginosa
VQRMTVHMDATYSASAYRSEVNDSLPPPRWKEESNRNGIFDTHLAFGNYANLDPEMEIVGQLSIGAEDKSEVGGAEAYCNSMRWQFQNSSRIPYIIFTLRMLCYFFVWIALGIGIMGEATGEWRRDIQQLYTLVCSFFVVAVSVISMVAFLSNKKYLHVIQMSGFLFSIPLALYQYGTIFGTNGLQIAIWIGVATYFMGAVGFSAILWLYSKVFKQDGSEFNRLDGMLRFKRRFRRLFVAPFDEFDPVLQLLPSGYGSHDYALWLHHRYTDNKVCLATRVHSLGLDKVNALAFWDCLQRYMDVTQPLPDLPVLEPSRPLDPVTAEHDRHTGRDPHYWRQRTYQGWPAKERKELDRRLHEYPWQQQPCIVRARIDPGLSIEAYYRRQEAKGIFATPRADDFNDEH

SEQ ID NO: 23012 - protein, 290 aa, Pseudomonas aeruginosa
RAKCDDDSRPGGKTGGSSTKPERALFRGFLRQMAFRCFISPVRPRLSCGRHGPCGNSVDAYPIQARPLDPAGRPRRLLHSRALRSRSPVHPGAAGGAAGARAGAGGADDAELQLGAPGPGVAVRAVDRTALGGAVLPPAAIARTPAGGAGGECLLPVGGGPHPGLHGGRRALSAGRRTDACRRGQSVSAARADRADHVRPGAALLLPAEPVAPAAAGRVAGAPGIAAGADSPALPVQQPEQHRQPDRAGPAEGRACGAGPVRPVPGQPGEARHFSFLGGGTGAGKALSFH

SEQ ID NO: 23013 - protein, 106 aa, Pseudomonas aeruginosa
TSGSTAVARCRSPATPSARATNCGCAAWSASLMAPSCCAPRGGRHWRTPRRWACGWPRTCWSRAPKRFSKPSTARPDIRERLAAPADAPRRGVRGPGRQPRRGGRP

SEQ ID NO: 23014 - protein, 381 aa, Pseudomonas aeruginosa
PKDGPVSEAVTPQDDARTSTSTPSPVAPDASRRSGTATGLALLALLVGVAGLGAGGWSFWQVQQLQGTERDQLAQLEDARGKTESLAQRNQQLAARLDALPTADELEARRRLVVELQGDQQHLSEQLKKLLGQSRQQWRLAEAEHLLRLASLRLSALQDVGSATELVQGADDILRAQNDPGAYAARAKLAASLEALRALPEPDRTGLFVQLAALREQVNQLQPLTPTFKEGESGASNVAWGDGNSTWELWWEKISRYIRIDFNAGQDIRPLLAGEQLAQVRLTIGLALEQAQWAALNGKQEVYEQALKQAQDVLDGYFNVELADSRALKLRIDELAKQPVTVQVPDIAPALSALQSYVSRREAAGNLVPEAQAAPATEGRP

SEQ ID NO: 23015 - protein, 217 aa, Pseudomonas aeruginosa
NGRRLSTTVGGLSPVYLWIRHAPGQPPSAFPSRVPGLRRHHGRGAVPGTCGWPGGLPAVRRAADLLHPDRPDLPCWRDPGARPAWAAYLLRAGVPARSRRRGHGRPPGMVADRSAGPTAGLPAQPRLHDAGASLPGSDPPGPAWHRGLCPGELDAIHPEHSGMEPAGVRCLSRLLHRAVPPTCLMRAVAWSFVSSRASAVSIWRKPERMRDTDQTSV

SEQ ID NO: 23016 - protein, 304 aa, Pseudomonas aeruginosa
RTGKPQAGAGCRQGEGSCWQGSGEPQGETRDQTCCEGGSQACGENRSGEACGQAGCEACCETGGQACGENRGSEARSQADGEACCETGGQARGENRSREARSQAGGEACGETGGQACGENRSREARRQAGSEACRETDGQARGENRSREARSQASCEACGETGGQACGEIRGREACSQAGCEACGETGGQACGETRSRETCRNQARHRSCCEACGDSQRPGSRLQRCFGNACRGQQRRRPDQRLLRRCLQSRRAKHQQSPALCFRADVPAAGLQPGIRTAIRFLALQPGCGQVGQALQVFPFRS

SEQ ID NO: 23017 - protein, 752 aa, Pseudomonas aeruginosa
FLGLHFLAEFGQAGVVGCRFAPGATQSAQGFDDRFAPGTRGVLQDLGAFFRAAHTAPAKPGGDQQQADVRTLLLKREASRFHARPGIDVHREFPDISSHTASRSARAKLINSAAMIRLLNLTLQRGPQRLLEAAELTLHAGQKAGLIGANGAGKSSLFALLRGQLGQDAGDCLLPADWRIAHMRQEVDTLDRLAVDYVLDGDSRLREIQAALAVAEAAHDGSALARLHTELDNADGYTADARARKLLAGLGFSSEQMERRVGDFSGGWRMRLNLAQALMCPSDLLLLDEPTNHLDLDAILWLEEWLKGYPGTLVLISHDRDFLDAVVDHVVHLENRKLTLYRGGYSAFERTRAERLAQQQQAYEKQQAQRAHMESFIARFKAKATKARQAQSRIKALERLEELAPAHVDSPFNFSFRESDKISRPLLDLGEGRLGYGDKAVLEKVKLQLVPGARIGLLGPNGAGKSTLIKTLAGDLPELGGRLLRGENLAIGYFAQHQLDSLDPQASPLLHLQRIAPGEREQTLKDFLGGFDFRGVRVDEPVLNFSGGEKARLALALIAWQKPNLLLLDEPTNHLDLEMRLALTMALQEFSGAVLVVSHDRHLLKSTTDEFLLVADGRVVPFDGDLDDYARWLVDYRARKAPQAETAPGAPTERTDKRAQRQAAAALRQQLAPHKREADKLERELGGLHEKLAAIEARLGDSALYDVSRKDELRELLSEQSSLKVREGELEERWLEALETLEALQKELEASE

SEQ ID NO: 23018 - protein, 277 aa, Pseudomonas aeruginosa
PHRGGLPNMAEHVSSGKPGICRVFSVRQVAPAKVGRGAWSENLCGCSALVHTGFFVPAASRVRFPRCAMLVSTWFAFFLACWAISLSPGAGAIASMSCGLQYGFARGYWNALGLQIGLALQIAIVAAGVGALLATSALAFSLIKWFGVAYLVYLAVRQWQAPPQALSTDGERPLGRPLTLVLRGFLVNASNPKAVIFMLAVLPQFIDPHQPLLAQYLIMGGTMIVVDLIVMAGYTGLAARVLRVLRSPRQQKLVNRTFASLFVGAAGLLATVRRAPL

SEQ ID NO: 23019 - protein, 263 aa, Pseudomonas aeruginosa
RHGFEKGGGATALVLGRSGLVLVHQFEHPVDQLVDPGSGFGYRLGEHVGRGGHQLARAVFDDLVHRRVDVLGTHLLQRVGGVGVVADGALDAGAVDLRRHRRSDADQPDWLAGFGESLGQRQHVRLHLALRAVDGKVAEVLRSAEATGHDQRVVVLGAGFAQVLDFAAGDTRGLDQDIAAFRHFLAGQVVDHMVLGDVRREALCLGATLAEAEQGDHAFVDFRAIVDATTGEDDGNFLVHEAYSLGTQDPDRTGLAGVGIAQA

SEQ ID NO: 23020 - protein, 157 aa, Pseudomonas aeruginosa
IRRASSRPEMTSTGWPRTSSARRMKSLRLRASRKALVATTRTEPWGMPLMNWAKRRRQSRPRWVASSLRLRSSSRPAASWTFSPSRSRMRTSPWILALARQRWKLLEPRSRAAISGNASAGFCGMLCKSIGKLRHPATIGRGSPMRQPINRESADQR

SEQ ID NO: 23021 - protein, 447 aa, Pseudomonas aeruginosa
RSCRPLATRLSQARRFLQFLFLRTYLFPMNLTELKQKPIAELLEMSDAMGLENMARSRKQDIIFALLKKHAKSGEEISGDGVLEILQDGFGFLRSADSSYLAGPDDIYVSPSQIRRFNLRTGDTIIGKIRPPKEGERYFALLKVDSINFDRPENAKNKILFENLTPLFPNERMKMEAGNGSTEDLTGRVIDLCAPIGKGQRGLIVAPPKAGKTIMLQNIASNITRNNPECHLIVLLIDERPEEVTEMQRTVRGEVVASTFDEPPTRHVQVAEMVIEKAKRLVEHKKDVVILLDSITRLARAYNTVIPSSGKVLTGGVDAHALEKPKRFFGAARNIEEGGSLTILATALVETGSKMDEVIYEEFKGTGNMELPLDRKIAEKRVFPAININRSGTRREELLTSEDELQRMWILRKILHPMDEISAIEFLIDKLKQTKTNDEFFDSMKRK

SEQ ID NO: 23022 - protein, 401 aa, Pseudomonas aeruginosa
ANDVQGSPRFHRPVGAARCVEAHPGADFPRARDDRGVRPHVARQGPGIAVRKADRLRHAGARQPVRYAGARGAGHGRRGRRRAARDRQAAGATQGARAAEGPQGRLGQAADVQEGPVHGAEGAQGRPLPGSGRGGRGRRPRPAAGPDLLAGRCRAADHLGPDRYPRAEQGTAEPGHLPPAGDRPQQGDHALAQPSRRRTGLPRVVPEASGPALSGSRGAGRRSGDHPRCGDAGAGHPFRIRFRRPVARASYRAGQVSRERLAGAGQRRDRPRRGDPPRRDGRRRSLWRSHRLLQRGRSLPGVHRRARHPPAETDLPQHLHRASAGRAGDPRGGAERSVRADPAEAVPGNRRFLPAAGRLFLPDGGGDHEEAVPRARQARDARGLVVPAAVHVHQVRHRHRR

SEQ ID NO: 23023 - protein, 360 aa, Pseudomonas aeruginosa
CHPQVAGRDQPRMGARHRQGRSGDTAHRRALVEPRDRLMRIVLQPSGACLELLPGERILDGARRLGYDCPQSCRNGNCHICAALLVEGRVRQNGEVRDHGELFTCLAEPLEDCVLHWDGVLAPGELPLRKLTCQLSFCEEVGGDVYRVGLRAPAGKPPRYHAGQYLLLERDGGDSAAFSLASAPHAGRDLELHILAKEDSAVALIAQLQRERLARIQLPFGDAHLAELPDGPLVLIAAGTGMSQMHSLIEHCRAAGFAHPVHLYWGVRRPEDFYRLPHWTEWEGLPNLFLHRVVSDLCGWEGRCGLLHEAVREDFADLSSLHVYASGSPAMVYATLDALVEAGMDAHQMRADVFAYAPRD

SEQ ID NO: 23024 - protein, 483 aa, Pseudomonas aeruginosa
TRLRPGAGAAASSAGLLRRGLDRGFAQGQAEEQDGQQAGADQQLEATVPAEVIHRVADQGVGRHRAAEVAEQTGEAGGGAGRFLRRQLQGLQADQHHRAVDQEADHDQRGHVDRRVAGRVQPVDQGADGHQDHEHHAGGAAIALEQLVRQPAAEQGAGNPRPFVEEVRPGRLVDVEVLGLLEVGRRPVEHTVAQQVDEHVGQGDVPEQLVAQHVGDEDLLGRQLALVVFVVAFGVVVLVLLDRRQAAGLRGVAHGEIGEYGYAHGDDGRHVEGRAPVAEQRQAEQEQRADQAAADVVGDVPHRDHAAALLLRPPVDHGPSARRPAHALGPAVDEEQDEHDGDAGGSPVRESENEHHRRRHQQAERQEDPWVGTIRDQAHDEFRQAVGDGDGRHRDAQLTAAVAVLDEVGHGQGEVLAQQVVTRVADEDTGEDLPAQAPVGAVHLGIGQWRLVWRGTKDSEHRELRLLLCRAFLRGCEHYIFRK

SEQ ID NO: 23025 - protein, 401 aa, Pseudomonas aeruginosa
VHWSEIRKPRSETGAFIGEKHLTAWASAGVSLRPAMPFSARAGGNTRRLRGSANLHHHLADRPALAEGVDSVAGPFQREALRHQWLQFAFGVPGEQLAEVVSVVLRLALGERSPEHADQRGALEQGQVGRQRRDAAAGEADHQHPSVPGDAAEGLLEQFAAHRIVDHIDALAAGQGLELLAQATFAVVDQFVGAGGLGHGELVGGTGGSDHPRAHGLADLHGSQPDPAGSAEHQQGLAGLQIGALFQGVHRGAVGHAEGGGAGEVHAFGNRHHVIAGHLDLLGEAAPAGQGHDPVAGPDVGDLFADRGDHPGRLAARGEGEGRLELVLALDDQGVWEVDPGGVHIEEDFVLRRARAGDFFQDQAAGRAEGFAEDGFHRGRSSLRSGQCRRETPGVNQHRRN

SEQ ID NO: 23026 - protein, 187 aa, Pseudomonas aeruginosa
WLSINPGLGPGRESGYACRHSSRRCARENPHCPVAGPVPESVPVVRLGRGGRAGRRGREQAGLRRPDPGAGRQLRQRAAPAVLQGRHRPAGGRQGRGDQGRASRALDPQPVDHAVRPADRPEPGYGRGQGKPAPGGAEAGPADPRAGRGQAAGDRPAVQQPHRPALRSTIRSVPRSRMRGTGDSAFL

SEQ ID NO: 23027 - protein, 397 aa, Pseudomonas aeruginosa
RASTPARRPGGTIEPVKSAAAALSSVSAIAAAWPNVRGEGMKQESKRWLSRALVVAALLGVGVLVWQVSRPTGLGEGFASGNGRIEATEVDVAAKLPGRVAEIKVDEGDFVKAGEIVARMDTQVLEAQLAQAQAQVRQAENAKLTATSLVAQRESEKSTAQAVVAQRQAELTAAQKRFTRTEALVKRNALPQQQLDDDRATLQSAQAALSAARSQVISAQAAIEAGRSQVIEAQSAIEAAKASVTRLQADIDDSLLKAPRNGRVQYRVAQPGEVLPAGGKLLNMVDLADVYMTFFLPSMQAGRVGLGQEVRLVIDAVPDYVIPAKVSYVASVAQFTPKTVETANEREKLMFRVKARLDPALLEKYITYVKTGVPGMAYLRLDPEVEWPANLQIKVPQ

SEQ ID NO: 23028 - protein, 108 aa, Pseudomonas aeruginosa
SVRTGSASPACWRCWPAHGRCRMARSACSMATCATAATAGRSARASPTCPRGWARTSTRRSRCSRTSTSSVGCSATTRPSASGASPTCCRAPGWRRSPSVLRASCPAA

SEQ ID NO: 23029 - protein, 204 aa, Pseudomonas aeruginosa
DNHLHFTCSAPMAPSRQGPEMSTQNSAYSAFYSLLAEAAMPVSPAELHGHLLGRVCAGAGFDEAAWQHAAAELLGGAPGERLKAALSGLLGMVRQDFSAGEVAVVMLLPDDETPLAQRTEALGQWCQGFLAGFGLTAREGSLTGEAEEVLQDMAAIAQVQGQLEDSEDGETDYMEVMEYLRVAPLLLFAECGKPLEPAPKPSLH

SEQ ID NO: 23030 - protein, 447 aa, Pseudomonas aeruginosa
GFCMIRIPKSEYARRRKALMAQMEPNSIAILPAAPMYIRNRDVEHVYRQDSDFQYLTGFPEPEAVMALIPGRAHGEYVLFCRERDPERELWDGLRAGQDGAIGQYGADDAFPIGDIDDILPGLIEGRDRVYYALGANPDFDRRLMDWINVIRSKARQGAQPPNEFVALDHLLHDQRLYKSANEVKVMRYAAEVSARAHIRAMEVCRPGLFEYHLEAELEYEFRKGGAKMPAYGSIVAAGRNACILHYRENDAAIKDGDLILIDAGCEIDCYASDITRTFPANGRFSPEQKAIYELVLEANMAAFDYIAPGRHWNEAHEATVRVITAGLVRLGLLEGDVDELIAHEAYKAFYMHRAGHWLGMDVHDVGEYRVGGEWRVLEPGMAMTVEPGIYIAPDNTSVAKKWRGIGVRIEDDVVVTRNGCEVLTNGVPKTVAEIEALMAAAKSEAA

SEQ ID NO: 23031 - protein, 222 aa, Pseudomonas aeruginosa
GDDEQGQPGDHRRGPGRRLAGAGPAGRRSGARLVDRADRTLRPRQCLPAQLRRPLFGAVLRQPADLRATRPVAGDRRARRADPAYPCFRPRPLRRHPPDRHRGRRAGAGLRGGERLARPVPVEGARPRGGALALPGRSEDPGSPGGRLPAYPRRRDATRLRAGDPRRWRSFRAARTTWHRRGADAVPADCADRQRIALRGAPRAGLRALHPQRSDGPPAVAG

SEQ ID NO: 23032 - protein, 171 aa, Pseudomonas aeruginosa
RGLPRRAAGCLRLPPRRLPPGRRTALLPLAPGRGPRAGASAPGGAGQRCAQSAPHRRPGLQPVVARHPGAGRRPAPRRRAAGRVRRAAALPRWAAPGPADDRRLLRPGDPAVLQRPRAARRRAQPRPARARPAAAGQALVRPPGHGPRRAAAVAPCRSGRGRARPACCASP

SEQ ID NO: 23033 - protein, 501 aa, Pseudomonas aeruginosa
WRTWAATTWSGTRRPTSSSSARARARCMRISASTRSCSTRSASGPPAARSTCPGCTPKCATTPAPWWRGFRKPCTCGSSRACGTRPEEGPRVENEDMHADLVIVGAGMVGSALALALEGSGLEVLLVDGGSLDVAPFKPEAPYEPRVSALSEASRRILQRLHAWDGIVARRAEPYREMQVWDGSGTGRIGFSAASVHAEVLGHIVQNRVVQDALLERLHDSTTGLLANARLEQMRHSGDDWLLTLADGRQLRAPLVVAADGANSAVRRLAGCATREWDYLHHAIVTSVRCENAHRATAWQRFTDDGPLAFLPLPDRGDEHWCSIVWSTTPEQAERLMALDEDGFRAALGEAFEQRLGAILHADRRLCIPLRQRHPKRYVEPGLALVGDAAHTIHPLAGQGVNLGFLDAAVLSEVLLHALERGERLADERVLSRFERRRMPHNLGMMTAMEGFERLFQADRLPLRWLRNAGLRLVDGHHEAKALFVRQALGLSGDLPSLARV

SEQ ID NO: 23034 - protein, 438 aa, Pseudomonas aeruginosa
RGDRPDARSPRSSPWSRPARALPWCRVAAPRWPGPESSIARWPSPRRWPISSSSPAAMAAAPRWRRSSPSSVAWTQAKHPDTFSRAGSQARFLIIRAYVPLTRLFFMQASKALLAALALGITGLAQAADEVVVYSSRIDELIKPVFDAYTSKTGVKVKFITDKEAPLMARIKAEGANTPADLLLTVDAGNLWQAEQMGLLQPFKSATIERNIPSQYRSSTDSWTGLSLRARTIVYSTERVKPEELSTYEALADKQWEGRLCLRTAKKVYNQSLTGTLIETHGAQKTEEILQGWVNNLATDVFADDNAVIQAVDAGQCDVGIVNTYYYGRLHKQNPNLRVKLFWPNQADRGVHVNLSGIGLTRHAPHPEAAKALVEWMTGPDAQALFAGINQEFPANPQVAPSAEVASWGSFKADSIPVEVAGKRQAEAIRLMDRAGWN

SEQ ID NO: 23035 - protein, 654 aa, Pseudomonas aeruginosa
PPVILGAPARPSGASFVPHRGFRGPSRSPPLVPHHLHRCRAGAAAAQRAAAELAGDRPGNLEPPVGYPVAAPARQHPDPGARRRHRRDSTRGQPGLAHQPLRIPRAALAGLGADVAVRDPGLRPGVRLRRPAGFRRTGAEPAARVVRQRPAVAARTLHRRGDPGPGAGVLSLCLPARAQRLHRPGQGPDGSRAGSRPVALAGVPAGRPADGAAGDRRRPGAGGDGNPGRLRRGIGVQLRHLHHRHLQNLVRLLQPLQRRPAGQPVVARGMPGAARRAPHARPSQGRQRASARRAAVSPARRQGAGGERLVRAGVPLRLRDSRGATGCLVLAPGPFRPRRALLGPDRPYPDAGRHRRAGDGRRGPAAGLRRAPGADSRYPRRGGPGQPRLCAAGLGPGGFDHAGLQLAGQSLGDPAFQRPRRRRQAAAAGQSVRPAAGLPDPFHGGGLRAAGKRAGADPPVAAGSFAQPRRGRPAAVPAGLPAAVAAGLAERRAAGLRRRAQGDAGDPADASLRLGHPGRTDLRDDQRGRMGARLAAGPDPGAGRPATGGRVDSSFCPSFRSLSPVSMQVVGSMHGSRHASMVSCSGACGYNARDFVPAVPADGTRYARKENTHGIAHPALRAARRARRQDGRFRRLGHAAALRFAGRGAPSGPA

SEQ ID NO: 23036 - protein, 552 aa, Pseudomonas aeruginosa
RPPPTSIRRSAAKSSPSTKPWPTPRKTSTTTRTRPGSSSSSRAIRPSWTSCSMPLATRPPSTRKAEPPRSRDKTRYPWTRPRSFEALFFLQRRNAFSPSLLSHSISVRRRSLAGRCRPQRDRSHVADAVPRPAPARRCLPAPPPRPRSGGTAGHAGFPRSFHSRRTDRADGAAGDPPQPAAGTARRARRTGRPGAPARLRRAQPALDQPDRHGLLRHRDAAGDPPQRAGESRLVHRLYALPAGNRPGPPGSAAEFPATDHRPHRARPGQRLAARRSHRRRRGHGPGQAGGEGQEQPVLRRCALPSADRFGVAYPRRGVRFRAGRRRAGQSCRPRGVRRLAAIPGQSRRDPRPAPAYRGVARPTGAGLRRQRPARPVVADPAGGTRCRRGARQRPALWRTDGLRRAARGVLRHPRRVQAGNAGADHRRFPRRPRQPGVAHGPANPRAAHPSGKGQLEHLHRPGAAGQHCFAVCRLPWATGAETHRPTRPAPDRAAGGGPGKQGTAAAQPALLRHPDLRGRRASGGDPRTGAGGTGQPARGRRPAAGPEPRRNL

SEQ ID NO: 23037 - protein, 161 aa, Pseudomonas aeruginosa
RGDPGDPVRDLPRRRPRAGCRAPGWRGGGRRHPGGPATHFGLPAASGVQRPPQRDRDASLPAPAGRQGPGAEPGDDPARLLHHEAQRQQRNDPHHLAGIRRTASVRAARAGRGLSPDDRRTGSLAAGDHRLRRHLHAAELGSTGRICRVAGDPPLPPEPRR

SEQ ID NO: 23038 - protein, 342 aa, Pseudomonas aeruginosa
PARHLPDPRIGAWHQPGLGDHGQHAGGDRRVRSLRQRRPRRPAPQGGRGGRPAVLPDDHLSLDPRRLRGGDRRDLRSGPPPRRPGLHGRRQPQRPGRPGATGGHRRGRLAHEPAQDLLHPPWWWRAGHGADRGQAAPGAVRRQPSGDPRRRAEPAERRGQRGALGQRQHPADQLDVHRHDGPAAGRRQRGGDPLRQLPGEPPGRGVPGALPRAQRARRPRMHPRPATAQGADRDNRGRRGQAPDGLRLPRPDHVLPGAGHADGGADRERVEGGAGSLRRGDAEHQGRDRQGGERRLAGGGQPAETGAAYPGRRHRDLAETLRDRRGGDPERTCAGVQVLAGG

SEQ ID NO: 23039 - protein, 204 aa, Pseudomonas aeruginosa
HRGADQVVGYAQFEQAGDRRGGVVGVQGGEHQVPGERRLDRHLGGLQVADLADHDDVRVLPQQGAYAAGEGQVDVVLDLHLVERGLDHLDRVLDGADVHLIGGQLLERGVKRGGLARAGGAGDQDDAVGLAGHALPAAQVVGGESELVEALEQHLGVEDAHHHLLAEGGGQGRQAQLHLGAVRGLGLDPAVLRLAFLRHVHPSQ

SEQ ID NO: 23040 - protein, 146 aa, Pseudomonas aeruginosa
ACAAGAALGRGAARDAGGRAPAAWPGLLRQGCAAAICPARRRPGGCRARCATRSRPWPAASARHSGRTDPSGSRRVRRGTVAAPAGVASRRHGRARCAAPSRRGERPALRAARDCWRVAPPGRGCRAGYAGPAGVAASPPAGASGR

SEQ ID NO: 23041 - protein, 249 aa, Pseudomonas aeruginosa
RCSRSKARGVGGLYFSAFPPGRRSMPTNPFISLFGRSPIGPMQQHIAKAHECAAGLLPFFRAVIAEDWAQVEQVQQDMVRLEQEADRLKKNVRMHLPKSLFLPVPRSDLLELLSVQDKVANRAKDIAGLMLGRRMRIPLPLQGQMLAYVQRSVDASAQALRVVNELNELLETGFGGRETSLVESMVEELEAIENDTDRIQVEVRRELFRLESELPPVDVMFLYQIIEWIGDVADRAQRVGNRLEQLLAR

SEQ ID NO: 23042 - protein, 459 aa, Pseudomonas aeruginosa
APGFFPPSARIRIPAHVLDRRPRLRLPCTRLPVRFLHGLGRRRQRRRQRHGHLGGLTGADHPPGDPGGDGLRVLRCLLRRRRGHRNDQERHRRSAVHDPRPAGLRHALGLAGRRGLAVAGDDQGLAGVDHPLHRRRDHRLRLGRCLGARGALGRDRPDRRQLGGDAGAVRAARLRPVQERAVVGTACRGPVPQRAPLRAAVHVPGGLHGRADDRRQGPEACRPGAFRPPDAGSGVARRWPGDGPGHRPAVAHPTHWRSRSAWRLRQRRAGLRGADDLHRLLHGFRPWRQRRGQRHRPGGGGRRGGPGRRRPGTGDPLTGAVLGTAAGRGGHRHRPGYLWLPGDRDHRPGDHRADPQPRLRRRAGDRLHGGWRLGHRPAGVHYPYPGRRGARHRHGARYRRAQPAGDRLDLPVLGSDPAGRRGAGDPVLPGPARAVRRLSAVFVGWRRRNRNGRFYPPPR

SEQ ID NO: 23043 - protein, 210 aa, Pseudomonas aeruginosa
AMMGLDPCGESHAVAVSERPVRRADRRVFRQLHPARAGPDQPPGGRPAGLLAGRSRLPLRDPGSLAGQVQPAGQLRQRFRRAGAGRPHRYRALRRSAVEQRSAAPGRARRPLVRPRQLRHEGLLPAGHRGLAAAARPAVPPAADDPRHLRRGKLDGRRPCPRRKRATAGSRHGDRRADQPAADPPAQGGDDGAHRDSRAERPFVRSEPRP

SEQ ID NO: 23044 - protein, 368 aa, Pseudomonas aeruginosa
AVARGDPPAPAAAGRTAPGEHRLPAAVPCRAAVRTGAGQRTGTRRRTPDRASRRGRGVRYRGAVLPAPGQRDPGPRCRRHRLCPPARRAPRTGAYRTDGRRAAPADPALLPDARRRLKRGVAGDQLEAAVDDELHAHRHQQEADHSRDGVDPGFAEELHDAPGALQGDPEDQRGEQGDGDRREVDEQRNASVGGLQRRRRADHQGDGPRPRGTRQGQRNEGQVAEVRGDLFLVRQQVVLDFGLVRRGGGEQHGEADIGDDQPAGDAQAGNGDAEHLHHQAAAVEADQHDQRHVEAGLEYLPVALRRRQAAAEAEQQRDAGQRVGYREHGEQADQDVMEVFAHGFSSFAWVRAGRHGERGSLAKKRCAS

SEQ ID NO: 23045 - protein, 467 aa, Pseudomonas aeruginosa
GEACRCCCDDDNGALRAVPAAHALLSLTKRQAFPTMPDYVNWLRHASPYINSHRDRTFVVMLPGEGVEHPNFGNIVHDLVLLHSLGARLVLVHGSRPQIEARLAARGLAPRYHRDLRVTDAPTLECVIDAVGSLRIAIEARLSMDMAASPMQGARLRVAGGNLVTARPIGVVEGVDYHHTGEVRRIDRKGIGRLLDERSIVLLSPLGYSPTGEIFNLACEDVAMRAAIDLEAEKLILYGAEQGLLDASGKLVRELRPQQVPAHLQRLGNSYQAELLDAAAQACRAGVKRSHIVSYTEDGALLSELFTRTGNGTLVAQEQFEQLREAGIEDVGGLIELIRPLEEQGILVRRSREVLEREIEQFSIVEREGLIIACAALYPIADSEAGELACLAVNPEYRHGGRGDELLERIEERARGLGLKTLFVLTTRTAHWFRERGFQPSSVERLPAARASLYNFQRNSQVFEKSL

SEQ ID NO: 23046 - protein, 196 aa, Pseudomonas aeruginosa
PPGAGCRCSSAGRCSRASGRPGRCSGSPGRSSAGWWRRAGRACVRRGAPTGSGGHAGSRRRGPARRRTGTSAASCSGGNCESGRCRRRTGSRVPTARCLRPGAAAARASPAGRSCSGCRRCTAWSCRSAAPGPCGRRTSGGRSSSCRSGRSGCSPRPAARRASMGSTGIRRPVSNWRSGGCARDRPECRRRRFPWA

SEQ ID NO: 23047 - protein, 378 aa, Pseudomonas aeruginosa
MRFRFVLGPVAATSAGAVEAGARHGSGSPLRAILPHGGRAGLQLGEGTLSFRDQFVALPHLGFHNQAAAPGMEDAGDAAHLAVGDGADVVDLAFQGDALAVETMGTGAGQPHGHVHQREQRAAVHDPAAVAQVRGHRQAYLGDAVAEADRVQADQFAVGADHLLAGGHLAHGRLRHFFFSCLALANSAAMALFAGGALCPRGAPRSWRGWPLPVGRPPRWPSTFSPGVSLMRMDRPTRLRGMSTSMTLTLTMSPALTTSYGSLTNFSDSAEICTRPSWWTPMSTNAPKLVTLVTTPSRTMPGLRSLRLSTPSWNSAVLNSGRGSRPGLSSSLRMSVTVGRPKVSSVNFFGSRRLRNAESPISERMSRSVSAAMRCTSG

SEQ ID NO: 23048 - protein, 216 aa, Pseudomonas aeruginosa
VSGCTAEASSGLSPFITRRKPAACSKVFSPRRLTFFSSSRVRNAPLASRCATMFCASVELRPEMRASRAAEAVLTSTPTAFTQSSTTASRLRASFSWDTSCWYWPTPIDLGSIFTSSASGSCRRRAMDTAPRRDTSSSGNSFAASSEAEYTDAPASLTMILVSFMPGYFLISSPASLSVSRLAVPLPMAISSTWCLAHSAASTARVWSHWFFGACG

SEQ ID NO: 23049 - protein, 77 aa, Pseudomonas aeruginosa
SLTFQVQRTTSASHLSAARPWLDRPKRSAIMTSHGCRVPGASSPTFSEALRMPSLRPRKIARARCDGALFSGSSCSK

SEQ ID NO: 23050 - protein, 172 aa, Pseudomonas aeruginosa
PSARSGLPTRSRARPSPRLPACAGCRAAPTSPASSTGRTRKSSSGRCRWSWGRTPRPACVSTSRRSSGCAHRASAKAGWRCRCIRIPCVANGSGACSAGSSASACSPPPPPGSSSASSASRSSAWWSPPASSARGAACAYRWDRRRRVKWPRCIAPSTRWPRTSSRAGANAN

SEQ ID NO: 23051 - protein, 359 aa, Pseudomonas aeruginosa
SGVARRRPRLSTRKPRTAWQAASARRPCARPGRWAYRPRGGRARSSGGRSTSCAAARTEKRRSPAGETGMASGRVADHAEAADQRQFRQQAEQRFGHLHQPAAGLRRQRCVAAPGEGQQGHLQAADVVVLAPVRAGYQARHHEQHGQGPDQQELPGAASEQRHEQRPDQQHRGVVAGEAALGAVLDFPHAFPVREVVAEVDGLVHQHRQAGVLPVQVVGDLRVEHADHHQDQQGHDEAEGQPPYLVRRQQPVAANQQAEQDHPDHRVERSGTEQAPEFQPGFVEGEGAVELVEEPEVEAVHQLAGGAPEPQDQQQERQKMTDGELAPLPGRLERRGIIHKIVSPYRRRVGVRLSRSALL

SEQ ID NO: 23052 - protein, 341 aa, Pseudomonas aeruginosa
RCVPHVPFRSEPAFPFRRYRRARRDGRSRAQLQRSAGQTSLSGTGRAAARGDARGGLAALRHAQVRRPAGIAGALQRRGSAVDGGVFQRPPGAWPGPLFGGVHRRRRRHAGTDARRRADPHRGPGQGPALPGDRRPGGGEPGGMPVQLLRQLGTAADPFLAQRQRPPCPRPAAAAASRRPPEGPRGPRGQLAAPDHPGRHADRRRAAGAGQRDRPAPPLPRGNRAPVRAATAGLPLQLLAGTFGQRPGQSRAGRLRAAARGGRRLDQHRLPVLQPALPVRRLRRRPVVRWRWQPGAFRDPPLTIFHPAGFSGIIPPLFSCSEFFEALRSLEDSASGRRGTT

SEQ ID NO: 23053 - protein, 234 aa, Pseudomonas aeruginosa
SIQISGGTSMKRFIQGEHRGQSSLLPESLDDYVADTNPVRVVDVFVDELDLGQLGFDGVVPAETGRPAYHPADLLKIYIYGYLNRIQSSRRLEREAQRNVELMWLTGRLMPDFKTIANFRKDNGNAIRGVCRQFLVLCHQLGLFSETLGGPRRLQVPRGQAPLPPFHHCLASSGNGGNPLRHPSLPKRPGFPRIVRNRRWRTSNANASTNRSATPNRSCRNLMEFQVHLCEISR

SEQ ID NO: 23054 - protein, 76 aa, Pseudomonas aeruginosa
RNRISTSSSMTTRSRSASAPASSTSVPVSPSPPYRLHLATLQRAGLVTSRRVGQWNFFKRNEETIQAFLDQLGDEL

SEQ ID NO: 23055 - protein, 179 aa, Pseudomonas aeruginosa
  UNSURE (168): Identity of amino acid at the above locations are unknown.
AALASTPPPRSPGARPMPASLLVLALSAFAIGTTEFVIMGLLPQVAGDLRVSIPSAGWLISGYAFAVAFGAPLMAMATARLERKKALLALMGIFIVGNLLCAVAANYGLLMLARIVTALCHGAFFGIGSVVAASLVAPNRSASAVALMFTGLTLANVLGVPLGTALGXKTRLARDLLGG

SEQ ID NO: 23056 - protein, 129 aa, Pseudomonas aeruginosa
VLPPPVFEDSAGIAGVLLVVLLVIGLAVANAMLRPLHQIRQNLDDIAAGEGDLTRRLPVTSHDELGELAGSFNRFVEKIHGLVRQIAGMTGDLKQLVEQMSAQAERSEQAMERQRHETDQVDHRHQPCR

SEQ ID NO: 23057 - protein, 352 aa, Pseudomonas aeruginosa
  UNSURE (340): Identity of amino acid at the above locations are unknown.
PATSSNWWSRCRPRPSVPSRPWSASATRPTRSIIVISPVDSDYRRNRSPYRPTPIYSSSQPDMDGQRTTAMPLDIDEIIKALSHPVRRDMLRWLKEPDKYFVEHDHPFEIGVCAGKFDQRTGLSQSTVSVTPRHPATRRSGDQPPGRPVELLQAQRGDHPGLPRPTRRRAVSSTRFHPTTSQSRSSTDAGVSSRPRFIRLCHRYHRIRHHGPAAAGRRRPAGIHSQRRLADQRLRLRRGLRRPADGHGHRPPGAQESPARADGHLHRRQPALRGGRQLRPADAGADRHRALPWRLLRHRLGGRRQPGGAEPQRFRRGPDVHRPDPGQRARRAAGYRARPXNPAGARPSGWVT

SEQ ID NO: 23058 - protein, 168 aa, Pseudomonas aeruginosa
  UNSURE (27): Identity of amino acid at the above locations are unknown.
STLPRPTKATTPIRSPTQKVARQPGFXAERGTQRHAEHVGQGQAGEHQGHGGSAAVRRHQAGGDHRADAEEGAMAERGDDPRQHQQAVVGGHRAEQVADDEDAHQREQGFLALQAGGGHGHQRGAEGHGEGVAADQPAGAGNGYPQVAGDLRQQAHDDEFGGTDGKGG

SEQ ID NO: 23059 - protein, 345 aa, Pseudomonas aeruginosa
DTDPSRPTASRPGAGTGPAGGLRHPSAEQRAGAQVPDPGPRHRRRGPPALVRALGRRGPGGGGDPAEPTPSRRLLRRRRSGHRRVLPGTATGQRPAHGLCPGALPGVARTGGALPGALISLYIWAGPHHLHYTALPDWAQSLGMVMSLILLAPSWGGMINGMMTLSGAWHKLRSDPILRFLVVSLAFYGMSTFEGPMMAIKTVNALSHYTDWTIGHVHAGALGWVAMVSIGSLYHLIPKVFGREKMYSLGLINAHFWLATIGTVLYIASMWVNGITQGLMWRAVNEDGTLTYSFVEAMAAGHPGFIVRMLGGFIFLLGMFLMAYNTWRTVSAAKPAEYEAAAQIA

SEQ ID NO: 23060 - protein, 538 aa, Pseudomonas aeruginosa
LHRPNPLVRIAPESHTAALESALKQASNWRRPWPGALQCPPAFSILAADFLSLKKSINRGTPSMSTAISQTAYNYKVVRQFAVMTVVWGVIGMGLGVLIAAQLVWPELNFDLPWTSFGRLRPLHTNAVIFAFGGCALFATSYYVVQRTSQARLISDTLAAFTFWGWQAVIVGAVLTLPQGFTTSKEYAELEWPLAILLAIVWITYAIVFFGTIVKRKVKHIYVGNWFYGAFILVTAMLHIVNHMSLPVSWFKSYSAYSGATDAMVQWWYGHNAVGFFLTTGFLGMMYYFVPKQAERPVYSYRLSIVHFWALISLYIWAGPHHLHYTALPDWAQSLGMVMSLILLAPSWGGMINGMMTLSGAWHKLRTDPILRFLVVSLAFYGMSTFEGPMMAIKTVNALSHYTDWTIGHVHAGALGWVAMISIGSLYHLIPKVFGRPQMHSIGLINAHFWLATIGTVLYIASMWVNGITQGLMWRAVNEDGTLTYSFVEALVASHPGFIVRMIGGGFFLTGMLLMAYNTWRTVRAAKPAEYEAAAQIA

SEQ ID NO: 23061 - protein, 320 aa, Pseudomonas aeruginosa
QRMTTFWSLYITALTLGTLLALTWLIFATRKGQRSSTTDETVGHSYDGIEEYDNPLPKWWFMLFVGTLVFAVGYLALYPGLGTWKGLMPGYQSADEFADKEKGWTGVHQWEKEMAKADEKYGPIFAKFAAMPIEEVAKDPQAVKMGGRLFASNCSICHGSDAKGAYGFPNLTDADWRWGGEPETIKTTIMAGRHAAMPAWGEVIGEEGVKNVAAFVLTQMDGRKLPEGAKADIEAGKQVFATTCVACHGPEGKGTPAMGAPDLTHPGAFIYGSSFAQLQQTIRYGRQGVMPAQQEHLGNDKVHLLAAYVYSLSHGEKSAE

SEQ ID NO: 23062 - protein, 212 aa, Pseudomonas aeruginosa
SASWREARPAQEVPRLQGPGPGRLHRLHDVRAGLPDRHRHPRRPADRVHRLRGVHRRLRQHHGEDELPERADQLHHRAQPQRPEDPPGPAAPDRLRHRPGADDLRPDHRGGPASAGRLRRQQGPRALPRERTRPHRERVQPEDHEQGSAGPHLHPRRQGPRRPDPGRPARAEGGGGRHPQPADGTVHRAGEAAFDHQRDRLHHRVGRRPEHP

SEQ ID NO: 23063 - protein, 196 aa, Pseudomonas aeruginosa
RSEESLHWPTHPLSNLSMQSETHPQPWYKHFWAWFIVALLATSVVLGLSLVTIAVRNQDTLVTDNYYEAGKGINRSLERENLAVRLQVHAKVKVDDLTGEVEVRLTGNSRPDRLTLNLISPTQPEKDRRVELLRSNSDRERYVGQLTDAVEGRRFVELLGQEGSGQWRLFEEEVVSPTVVMELGDEPLQGAEAKRP

SEQ ID NO: 23064 - protein, 104 aa, Pseudomonas aeruginosa
PWTSRCRWRSAAPTSPASGRRSPARASCISTRSACSPCSSSPAATSNAARGSAPPPPPRNWSTCCRRPACAWTPPTRASASCSANCASATAYWYRQAPCCRPTE

SEQ ID NO: 23065 - protein, 151 aa, Pseudomonas aeruginosa
RSSRCYPCAISTRIAAWPSPPPSRTVPNTPSPAPSAVRRRPPTASQAIRDWASKAWWKAAACASARPPSSATWAAAPRPRCPATPDSGCCSATSRDRWPGSVSTTACAATPPPCSPPARRAAGAPSCYPVTPRRWSPASLPNWASTKPAAA

SEQ ID NO: 23066 - protein, 506 aa, Pseudomonas aeruginosa
WGIDGRPSQHRATHPVYIHPLDTNQQAFPAQSLDFPTKARQLGISGMLDTIRWDADLIRRYDLSGPRYTSYPTAVQFHEGIGPFDQLHALRDSRKAGHPLSLYVHIPFCANICYYCACNKVITKDRGRSAPYLARLVREIEIVSRHLSREQVVEQLHFGGGTPTFLSPGQLRELMSQLRTHLNLLDDDSGDYGIEIDPREADWSTMGLLRELGFNRVSLGVQDFDMEVQKAVNRMQTPEETRTIVEAARTLQYRSINLDLIYGLPKQTPDSFARTVDEVIALQPDRLSVFNYAHLPERFMPQRRINADDLPSPGQKLEMLQRTTEQLAAAGYRYIGMDHFALPDDELASAQEDGTLQRNFQGYTTHGHCDLVGLGVSAISQIGDLYSQNSSDINDYQTSLDNGQLAIRRGLHCNSDDRVRRAVIQQLICHFELAFEDIETEFGIDFRSYFAELWPDLERFAADGLIRLDAKGIDITSSGRLLVRSICMLFDRYLPSLNRQRFSRVI

SEQ ID NO: 23067 - protein, 237 aa, Pseudomonas aeruginosa
SARKARKCTSSTPSSCAPSPAASWKAEAPANRQRARLSAGPLYDGPRKTPSPGSSMIFDEFTLKSQIRAVPDFPKPGVVFRDITPLFQSPRALRMTVDSFVQRYIEADFSHIGAMDARGFLIGSAVAYALNKPLVLFRKQGKLPADVLAEGYQTEYGEAFLEVHADSLCEGDSVLIFDDLIATGGTLLAAASLVRRLGARVFEAAAIIDLPELGGSTRLQDAGISTFSLTAFALDER

SEQ ID NO: 23068 - protein, 538 aa, Pseudomonas aeruginosa
SIQMSTFAGRRVYTPANNHNRSLAMSTQPTPAAARHCKVAIIGTGFSGLGMAIRLRQEGEDDFLIFEKDAGVGGTWRVNNYPGCACDVQSHVYSFSFEANPEWTRMFARQPEIRAYLEKCWEKYRLQEKTLLNTEIGKLAWDERQSLWHLHDAQGNHYTANAVVSGMGGLSTPAYPRLDGLENFQGKVFHSQQWDHDYDLKGKRVAVIGTGASAIQFVPEIQPLVAALDLYQRTPPWILPKPDRAISETERRRFRRFPLVQKLWRGGLYSLLEGRVLGFTFAPQVMKLVQRLAIRHIHKQIKDPELRRKVTPDYTIGCKRILMSHNYYPALAAANSTVITEGIRAVTANGIVDGNGREREVDAIIFGTGFTANDPIPRGVVFGRDGRDLLDSWTKGPEAYKGTTTAGFPNLFFLMGPNTGLGHNSMVYMIESQIAYVLDALKLMKRRELLSLEVKAPVQERYNEYLQRKLDRSVWSVGGCKSWYLHPVSGRNCTLWPGFTWRFRALTRQFDASAYHLTTTPLAALSNEACQQAEGVPA

SEQ ID NO: 23069 - protein, 238 aa, Pseudomonas aeruginosa
CCAWHQCSTSAWSPPACAWQRASRRARRAPRAPSEQARRVAARLPGTSYSTASLQGTAVMNPPLPHFRYHPEPLASGSIEASATTCQCCGKARGYVYTGSPYSRHELPPGSLCPWCIADGSAAARYEASFSDDYPLLDAGVAADIVTEVCERTPGYTSWQQERWLVCCEDACAFRGDAGREEIGQLGAEGLAQRFADFAWPAITWQRLVDAYTPGGNPAIYRFDCLHCGQAHYDLDFT

SEQ ID NO: 23070 - protein, 472 aa, Pseudomonas aeruginosa
NAALQPHLLADDLVHDFPRTAADGENPVVAIQPLHQAFAHVAHAAEHLHGIIGQAIGDIGGEVLGHRYLLDHALAGGHLRCLAIGELPGNLQLRGHFRETMAQHLELADRLAERFSLARPAQRLLQSQLRGHVGHHRQGQALALEIGHDAGEAGILHADEVFRRHPAVVEEQFGGIRRPPAHLLQLAADTEPGSALLHQQQADAGETLAAGTHRHRVVVRAHAAGDEGLAAADAIVIAIAHRTGLQVGHVGAARGLGDRQGHDLLAAQHRRHYPLAHLGTGPLDHRRQADIQRSQPGDQAAGTAAHELFAGRHLGEQIAFATAAVGFRVADAEDPGRAGLEIEFAGKFLGLLPFIDVRQHLALDETANRIPDQLMGLVEVLLEVSHGRAPDGSLRTYLALAWFSIRETGHRRGRIGRPSYGYGRHRAQEIGRRPARAWAKVPPSTSSSSPPSGTPWAIRDKVRPRPASSWAI

SEQ ID NO: 23071 - protein, 196 aa, Pseudomonas aeruginosa
SSCSSCSSGDTGNAAGRASRTVSTTASTATAGGIEGASTASGSGSGSGSGSGSGSGSGSGSGSGSAARLGAGSSQGKSTTSAAAAGSSTTASVTRASTAAGGADGAAGGAAGASTGAATTGAGATVATGAGEAAPATGELAGSVVALLIPRSFSGVLGTPSASAGRNASIRSNTISKPLRGSGASGRSRRPIRPIW

SEQ ID NO: 23072 - protein, 627 aa, Pseudomonas aeruginosa
  UNSURE (1): Identity of amino acid at the above locations are unknown.
XNCTSSAGNAWARASTRSRSPWPLSIASGRAWAIATRCSTLSISASTPPQSGPCSARWRTASSRARASPSSKACEHAIDLAVIEGTEHRPHVCGQHLALAEGDGLVGQAHGVTHRAVGGAPEQPQGVILEGHVLGSEHVGQVLDHPLRRHVLQGELQTAREDGHRQLLRVGGGQQELDVRRRLLEGLEQRIETVRREHVHFVDQVDLVASAGRRVLHVVEQLAGILDLGPARGVHFDQVDEAAFVDFATDRAFAARRGADPGLAVQALGQDPRDGGLADPAGTGEQVGMVQPLVVQGVDQSLEHMGLADHFTEGTGTPFTRKNLITHRKPSQKGSTSRPMLAQFTPSALADLANCVLRIPLALQQPSSVAMTLPSLTSFMPHFGAPALLLLQLLAALPATAAETDATPLRFSVMESWSMPLVRLQRGQPIDGIVYDITRSLARQVGRKALYHPYPRGRIEQAMNAGEIDVRCYISPAWLSHDFPGYRWSVALLVQRDILVAREGFAPIPEALPAQRIGTVLGYSYPRLQALFDIGRLRRDDARTQDLVLEKLRAGRYRYAVSHQLSLHWSNRQAPGQPPLQEAAQLEETAVSCMVRDSAEVPVEAILKTFEEMKRSGEIEEILQRYR

SEQ ID NO: 23073 - protein, 158 aa, Pseudomonas aeruginosa
PRPPWQKRQWSGFPNSFPYHLTPYMTTEVRLRYPIQIRKDKRMSEPQNGRGALFAGGLAAILASTCCLGPLVLVALGFSGAWIGNLTVLEPYRPIFIGAALVALFFAWRRIYRPTQACKPGEVCAIPQMRATYKLIFWVVAVLVLVALGFPYVMPFFY

SEQ ID NO: 23074 - protein, 112 aa, Pseudomonas aeruginosa
  UNSURE (64): Identity of amino acid at the above locations are unknown.
SEFTMKTQVSAQAKKLFASLALAAIVAPVWAATQTVTLSVPGMTCSACPITVKKAISKVEGVSXGDVTFETREAVVTFDDAKTSVQKLTKATTRCGLSLHRQSSETLKPETG

SEQ ID NO: 23075 - protein, 122 aa, Pseudomonas aeruginosa
CPVGETLIPLDPLHRAQALELALLVACDIHPLNNVRVLKYLTQVLGIDAEDRQRWYAHWVAEGLAAAETLLNRHRRGAFFAGAAAGIVECCLVPQLANARRMGCVLAPYPALLELEGRCLAL

SEQ ID NO: 23076 - protein, 230 aa, Pseudomonas aeruginosa
WPTTLGAPSVPPSRPNTKPPHRSPEEPSMKHEILEKDVGLLALCMAVAVSIGGLTQIVPLFFQDVTNTPVEGMKPYTALQLEGRDIYIREGCVGCHSQMIRPFRAETERYGHYSVAGESVWDHPFLWGSKRTGPDLARVGSRYSDDWHRAHLFNPRNVVPESKMPAYPWLVENKLDGKDIEKKLEVMRTLGVPYTDEDIKGAKDSLKGKTEMDAVVAYLQVLGTSIKNKR

SEQ ID NO: 23077 - protein, 158 aa, Pseudomonas aeruginosa
PAEHRDHHPRRSPRDHGGLGRHPRRRRGEERRRLRPHRTRRAEAAGRHQGRRRGRQADLLGQLRRLPRPGRQGYRPGRRAEPDQPRRVHLRLQLRPAPTNHPPWPPGPDAGPGAIPGQGKGAHPGRLHLQPVAQPGQQLTPPPTRALPGAGPSPGLRP

SEQ ID NO: 23078 - protein, 90 aa, Pseudomonas aeruginosa
SREGQDRDGRPGGVPSRPGNLYQEQTVSVMDIGTLRGLGTVVIMVAFIGLVIWAYSGKRKKSFDEATMLPFADDPEAKKHVEQASRSNKE

SEQ ID NO: 23079 - protein, 488 aa, Pseudomonas aeruginosa
PCRHVPAGRPPLPWYALMSKQIPVQDVTPPAKGDTNNNDLYAKREKIYTRAFTGIFRRLRMVGGAALFLLYFGTVWLNWSGRQAVWWDLPERKFYIFGATFWPQDFMLLSWLLIVCAFGLFFITVFAGRVWCGYTCPQSVWTWIYMWCEKVTEGDRNQRIKLDKAPMSGNKLLRKTAKHSLWLLIGLVTGLTFVGYFSPIRELIPELLTGQADGWAYFWVGFFTLATYGNAGWLREQVCIYMCPYARFQSVMFDKDTLIVSYDPRRGEKRGPRKKSLDYKAQGLGDCIDCTMCVQVCPTGIDIRDGLQIECIGCAACIDACDSIMEKMNYPKGLISYTTEHNLNGQKTHLARPRLIGYAIALVLMISALITAVVLRPLVGFDVSKDRVLYRENELGRIENVYSLKIMNKDQQDHTYILGAKGLEGLTLEGRRELKVAAGDILNLPMELSIEPEKLPSTTNEIVFTIESADDPSIHKEAKSRFIGPRTR

SEQ ID NO: 23080 - protein, 561 aa, Pseudomonas aeruginosa
GRAGGNQPDDRRHQLRRLRLADREAPAPVAWRGRGAAQPVQPSPARALAGQPVAAQPVAWRTAPDRLCRPSLPTRPRHRAPGHGEPSRPAPARCRRAAVDPGDDGGNGDLAGIQPRPFRRHGPHPALGQPDPHHADRLLLLRPVLPWRPARPAHPPPDHGRLGVAGDRRRLRRRHLVDDHRPGRAVFRRGRHVRPVPPRRPLPRTPRAGAHRRLHRATGQPAAGVLPAPGRRQPGRAHPAQRTARRRPRTGTARRRAAGRRSDPRRPVQRRRVAAHRRVPAPSTPGRRRRHRRHPERRGAADRRGRRPWRRQPPVGHRPPAGTRPGGQAAPGGTGRQGGAVVPAHRPAGRRSGRRAVVAGRPPARLLGGAVAAGRHLPLRPVAGHAHRAHRGHRQPAQARPADHARARAGRAEPHRHGNLRQDRHPHRRPPDAQAGATPARSRRGSLPGPRRRPREPFRTPHRPRLRPCAGGRRQRRKPSGTGPRRPGGRPPPAHRPGRLRQQPGRQRHARDARRLRTVAAARRRAGTAGLVRSRRPPAQRRPRPARRLQGARLAHPPAIR

SEQ ID NO: 23081 - protein, 223 aa, Pseudomonas aeruginosa
RLADGRQRRCRTGHRRSPRRPDPGRQAGHARTPARRGPPGADARRRSQRRTGARRCRHQRRHGQRHRPGQDQRRRGAPVQPPGQPGAGFPAGAPHPPYHHREPGLGQPVQWPGPALRRARLDHPGLGGDRHVGQFAAGGGQRPAADPNPFAEVRMAALYILIPVAIVIVAIAIYVFFWAVDSGQYDDLDGPAHSILFDDEDPKHQAGVDEAEKPSKPEDRPRG

SEQ ID NO: 23082 - protein, 254 aa, Pseudomonas aeruginosa
TGAAAGFRADPRPARGRPLPGHVRRPDGRPDPGHSRRTARPSSAPAAGLQPRPHPQLRLRRPAARPGRLGGGAHPVGRRAAGGRRAAADRHGTLPGRLVERPDPRRGARSRPLAPPGTLRPAPAAGLQPATGPAARSDLGLAALRAGLQHPTLGHQPGIGTGQRAADAGVRPRHLAGSAGHRHGRRTGDRPAAPSRRTHRGRPDGHPLRPLDPPRTAPGLADGALTDARPNIGRHILYTFTRLIQINRPSRRNP

SEQ ID NO: 23083 - protein, 138 aa, Pseudomonas aeruginosa
SPRIAGAARRTLRAWSARSRSSAATSPASRWSSNCTSVAEPRPSSVPANCANSCRNCAPTSTCWTTIRATTASRSTRARPTGRPWACSANSVSTASASAYRTSTWRCRRRSTACRPRRRPVPSSRPRAPCNTARSTST

SEQ ID NO: 23084 - protein, 296 aa, Pseudomonas aeruginosa
TPRHYLSPLPVWSPASVTGPATSSSLPRHLLSVATAPALRGLSRPSPPLFVIFGRGLHSAVPMGGQHAFLDLSVTGYRRRSDRHHLDETGRHPRPCRRHAADVRDDRPVLFLPRPGGQACPRRSRLRPLGRHWHRPDHGGQRRLAGRKHRPVQGRRPRRDDRRHPADQVRHPQRQRHAGAAPWGGRHMLTLNWIPFAWLGLAIALEVVANLLLKYSDGFRRRGLGIASILCVMAAFTALAQAVKDIELSLAYAIWGGFGILATVAMGWALFGQRLAWRGWLGLLLLLAGMSLLKLA

SEQ ID NO: 23085 - protein, 181 aa, Pseudomonas aeruginosa
TARSGPDRDADASGRRRQLPAYSWHRCWRSGRRGRAAGTAPATPRPGRWPASPPAAAPPPRPRQARARHPSRPGYPCRLRSSRLRAVASRPARPARQVIPATQPAGLPERFPPPPRPPLPEGSRELPRLAARARARARARARARARARARARARQRGSAPALPRASRRPLPRRRALRQPLP

SEQ ID NO: 23086 - protein, 273 aa, Pseudomonas aeruginosa
RRRMQMSQATPCTTTPTNNTNTTALLTPAEFEAIRLYSEEGLSIENVRKTTGLPNHHVRALLKGKPRALNTPLSKSVARVYELAIRPLGIKDYELRDILHEEYGSNWDEQKGCYHAKTTPDTIKQVKEKVRDRARREGQSVIFVMDWVCDSLATESRVFLESAALSLMARVDECVNEFMERFAAHATEDSEEADLAHCKQAYAARRHLLKLVSGLHPEPNSSLLERTTAVTDALDGISDLPAPPVPRQEPAGLIPEPSNSNAFLDYIEAQGWL

SEQ ID NO: 23087 - protein, 133 aa, Pseudomonas aeruginosa
  UNSURE (71): Identity of amino acid at the above locations are unknown.
RRNQRARNIPLSGMAGAHKIRQDGLHARQVGHLFAHVLELVLSQAAGFLAVGAIVEPQQLGNLIQAEAQPXGRLYKAHPRYIRRAIAANAAVRLVRFRQQALALVEPDGLYIDPGRLGKNANGQVFQILFHTT

SEQ ID NO: 23088 - protein, 310 aa, Pseudomonas aeruginosa
QRMTTFWSLYITALTVGTLIALLWLVFATRKGEAKGTTEKTMGHSYDGIEEYDNPLPKWWFMLYIGTIVFSVGYLVLYPGLGNWKGVLPGYEGGWTQDKQWEREMNIAQEKYGPIFAKYAAMPIEEVAKDEHAMKMGSRMFATYCSICHGSDAKGALGFPNLADNEWRWGGDPQSIETTILGGRHAIMAAWGDILGEDGVKNVAAYVRTELAGLKLPEGTKADVEAGKQIFSVNCVACHGPEGKGTALVGAPNLTNPGAFIYGSSYAQLQQTIRHGRQGQMPAQEPYLGKEKVHILAAYIYNLSHNQGSN

SEQ ID NO: 23089 - protein, 203 aa, Pseudomonas aeruginosa
MKNHEILEKNVGLLAIFMVIAVSIGGLTQIVPLFFQDVTNTPVEGMKPRTALELEGRDIYIREGCVGCHSQMVRPFRAETERYGHYSVAGESVWDHPFLWGSKRTGPDLARVGGRYSDDWHRAHLYNPRNVVPESKMPAYPWLVENKLDGKDTATKMEVLRKLGVPYTDEDIAGAREAVKGKTEMDALVAFLQGLGTSIKSKR

SEQ ID NO: 23090 - protein, 822 aa, Pseudomonas aeruginosa
RTAPGSRSEAPMSAPLPCYHCGLPVPAGSRFEARVLGETRAMCCPGCQAVAEAIVAGGLESYYRHRSENAANPEALPKALSEELQLYDRPDVQRGFVRHEGELAETSLMIEGISCAACGWLIEKHLRQLPGVAEARLNLSNHRLHVRWQDSQLPLSQLLGELRQIGYAGHPYQPDRATERLAMENRHALRQLGVAGLLWIQVMMAVMATWPEFNLDLSAGMDRILRWVSLILTTPIVFYCCGQFFRGALRDLRTRHLTMDVSVSLAIGGAYVAGIWSTITGQGELYFDAVGMFALFLLAGRYLERRARERTAASTAQLVNLLPASCLRLDAANQGERILLSELRVGDRVLVPPGAVLPADGVILDGQSSVDESLLTGEYLPHPRQAGDAVTGGTLNVEGPLTVEVGALGDDSRLSAIVRLLERAQADKPRLAELADKVAQWFLLIVLLVAAAVGALWWQVDHQRAFWVVLSLLVATCPCALSLATPTALTAATGSLHKLGLLITRGHVLEGLNHIDTVIFDKTGTLTEGRLTLKQVLPLRDLDADRCLALAAALENRSEHPIARAFGRAPEAADSVASHPGLGLEGLVEGRRLRIGQAAFVSNLGGSATPAMPGDSGQWLLLGDEQGPLAWFGLDDRLRSDAPALLAACKARGWRTLLLSGDASPMVASVAAELGIDEARGGLTPDDKLAMLERLHGEGRRVLMLGDGVNDVPVLAGADISVAMGSATDLAKTSADAVLLSNRLDSLVQAFRLARRTRHIIIENLAWASLYNGLVLPFAALGWITPGWAAIGMSVSSLLVVVNALRLTRIPSPRSVWPRSTS

SEQ ID NO: 23091 - protein, 287 aa, Pseudomonas aeruginosa
SPSRSSSSPSPSTCSSGRWTAASTTISTAPPTAFSSTTKTRSTRPASTKRRSRRNPRTDRVAELAPLLVSALILGLLGGGHCLGMCGGLMGALTLAIPAEQRGRRLRLLLAYNLGRILSYACAGLLLGLAGWAVARTPLAGALRVVAGLLLIAMGLYLAGWWSGLTRVEALGRGLWRHLEPFARRLLPVSSLPRALLLGAIWGWLPCGLVYSTLLWATSQGSALDSALLMLAFGLGTWPVLLATGMAAERVTALLRRRGVRIVGGLMVILFGLWTLPGPHQAWLMGH

SEQ ID NO: 23092 - protein, 250 aa, Pseudomonas aeruginosa
PSKDPSMAETIKVRALPQAHCKDCSLAPLCLPLSLTVEDMDSLDEIVKRGRPLKKGEFLFRQGDPFGSVFAVRSGALKTFSITDAGEEQITGFHLPSELVGLSGMDTETYPVSAQALETTSVCEIPFERLDELSEQLPQLRRQLMRLMSREIRDDQQMMLLLSKKTADERIATFLVNLSARFRARGFSAQQFRLAMSRNEIGNYLGLAVETVSRVFTRFQQNGLISAEGKEVHILDSIELCALAGGQLEG

SEQ ID NO: 23093 - protein, 308 aa, Pseudomonas aeruginosa
HIQRCYSELAIGNPRKPVRFPSPEQQKELAMTATGTASPVRANFPVRRMDFSFSETPKYWWDGQPFMTQFMNNLSSLFPYGEKFFVDSVRAVRDRLEDPQLKKDVSAFIGQEAMHSKEHAAYNEYAEEHGVDLECLELRIKVLLENVSKVTTRKHQLAITCALEHFTATMAAQLLKREDLTIQMQSPKMYKLWMWHAIEENEHKNVAYDVYQKAYGGYFTRVLVMMLTTLMFFGVIGWFQLDLLRKDGQLFNWRSWKHGLGTLFGLRKGFFTRLLLPYLDYYRPGFHPSDHDTAKLEKYWKDKLAFAD

SEQ ID NO: 23094 - protein, 195 aa, Pseudomonas aeruginosa
YHVHYVEHQGITSPHFPSGLPRASLDRRPLAPSLDTCCRWRPPLRFAVFPAPRHRSSSSLAAASIPRCPWEGNMRSWIYLLLAIGAEVIGTTSMKLAATHAPVAGMLLMYGMIGLSYFFLALAVKRVPVGVAYALWEGIGIVLITAVSVAWLGESIGLYKAVGLGVMIAGILLIKSGTRNASGTPAQPRGEAVTC

SEQ ID NO: 23095 - protein, 88 aa, Pseudomonas aeruginosa
KVFGFRPASRASSRKPMAPRLRLLLPRRKAASSKARLPGASATLSFVSFISLMFHLVVSMRHKFGRCAATTLPKVGLTLKYTDVYIRR

SEQ ID NO: 23096 - protein, 632 aa, Pseudomonas aeruginosa
LRPQGQARGGDRHRRLGDPVRPGDPAAGGRARSLPAHSAMDPAQTRPGNQRNRAPALPALPAGAEALARRPLQPARRAGAGLHLRPAGNEAGAAPGDPPHPQADQGSGTAPQGHAGLHHRLQAHPHVAQLLPCPGCRQLHGDHRRHPRRHRQWNRRRQRPGTRGRRDHLRYRLHRQRSYPPRSGLRSRRPRPAGQLDQGPGSLQGHYHRRLPQPVLPDGTEHRPRPQLDGLHDRVADRLRPRCAEADEAPRTAQSRGQGPGAGTLQRIPPAQAGPQRLERGRLQELVPASGQRPQLHPVAGIHLALPCPDPAVRRLRLPPHHDTARRPEQRSLPTGRRGTRMKSFENKVAAITGAGSGIGRALAVELGRQGCHLALADVNAAALEETRQLLASSGVRVSTAVVDVADREQVQAWADKAASEHGRVNLIFNNAGVAHAGTVEGSDYSEYEWIMNINFWGVVNGTKAFLPHLKASGNGHVVNVSSVFGLFAQPGMSAYNATKYAVRGFTESLRQELDMEDSGVSASCVHPGGIKTNIAKTARMNESMAKVTGQAPDKAREQFNDQLLRTTPEKAAQVILRGVQRDSRRILIGTDAHAIDVMLRLAPVLYQRLVTASMRLAARFAPRPKSPQGAQ

SEQ ID NO: 23097 - protein, 162 aa, Pseudomonas aeruginosa
LGDIVGGGLAFDGGVGGEDHLAEGSVPDPRFQFGNADRLRPQAVERRQVSLEHEIAAAVAGLLHREYVQRAFHHAEQRVVASRVGALRAQLLLAEGTALPAMTDPFHRGGQRLGQLQAAAAIALQQHQRHALGRLLPDTGKNAQGLDQLADQRAETHAGLVG

SEQ ID NO: 23098 - protein, 325 aa, Pseudomonas aeruginosa
REGNGCRAPSEEGGPGTNAGSEGHLEAGRQLHARGEAGHLFLVVLLDLAHRIVDRGRDQVFEDFLVFLHQAVVQADALDVVAPGHHHADQTGAGLPGHFGVGQFFLHLLHLFLHLLRLLHQAGHATFHHVLHLECRLVACAKRRSGLGFQRFDGTVTDHRGELLAQLPDQRVGIDRCLGRPLALGTPACRCLSRGLLLRLLQGHLQFEGAPQVLVQRIVQPPLLGGVEQRALARIEMQMPVVAVGSYQRTVGTDAGGQAAEAEPREQLQPLRGQAGGRLRRRQRLLHHDHVRLGRGIQVGQGIHVDFVVVVCGRWLVVLLVLLVR

SEQ ID NO: 23099 - protein, 465 aa, Pseudomonas aeruginosa
QCSTLLYHFGVTLMTYVIRRGAIYYLNLRLPKHLFPHRHTLRLSLDVRDRKNAVFLASALTQRVHLHITDKPLTTLEQLRALCIQWREGAPAPIPLPIHRSQQTPSTTLTTAAGNSPLLSTLSKIYIKEGQRGGTWREVSSLDVQRALRDFFELMGDMPADHFTAEVARTLKARLSRCPQYFAQRPEFKGMSLRQVVESAKDYQTITAVTINNRLRKLTAFFNWCKSNGYIEQNPLAGMKVMAGAAKDARLSFDRSDLLVLLNLDTLRQEARKHPWRFWLPLLARFTGARLEELCQLHTTNVIEVQGVPCIQIDDSHDGQKLKNQSSRRTLPIHPALITIGLREYVESIGANGATRLFPDLEPTRGKYGHAPSKWFSRYKTKMGITDPRKTFHSFRHTFIDDLREAGVQDSLIKQMVGHEDGSVTFGVYGSRLQVTAMRQALNAIEIDQAIRKMQVDIDSRPKYR

SEQ ID NO: 23100 - protein, 98 aa, Pseudomonas aeruginosa
  UNSURE (83): Identity of amino acid at the above locations are unknown.
GVSDLAKLVSPCSDAISGHETFPFRAWQAHTRLDRTASMRARSAIFSRTSWSLCSAKLLASSQWVPSSSRNSSAISSRLKPSXWADFTKRTRVTSAAP

SEQ ID NO: 23101 - protein, 197 aa, Pseudomonas aeruginosa
  UNSURE (33): Identity of amino acid at the above locations are unknown.
PASGGCFGELLDAGLGIIESDNRFAGLEGHVTXADAFDLGNRLLDGDRAGGAGHARYGQRDGLSGGPHGGNNGGEGEGGKQFFGLRRNLRFHGELRSVEKWHDVGKSECDQDQHGHDPENELVSRSHLGNRADLTRFAGLRRAVDAPPGEEQRHQRCADENRAIRLQHGQVADPCPAEAQGNQNQRPEAAGRGEDGS

SEQ ID NO: 23102 - protein, 358 aa, Pseudomonas aeruginosa
  UNSURE (340): Identity of amino acid at the above locations are unknown.
HWPTCASLLRRFSMSYQVLARKWRPRSFREMVGQTHVLKALINALDNQRLHHAYLFTGTRGVGKTTIARILAKCLNCETGVSSTPCGECSVCREIDEGRFVDLIEVDAASRTKVEDTRELLDNVQYSPTRGRYKVYLIDEVHMLSSHSFNALLKTLEEPPPHVKFLLATTDPQKLPVTILSRCLQFSLKNMPPERVVEHLTHVLGAENVPFEDDALWLLGRAADGSMRDAMSLTDQAIAFGEGKVLAADVRAMLGTLDHGQVYGVLTGLAGGRCARPARSGAPPGRAGPGLGRRACRNTQRAAPRRDRPGPAGSDRQWPGRPRAGAGPGPGVAGGRRTVXLPDGPDRPPRPAAGARSA

SEQ ID NO: 23103 - protein, 134 aa, Pseudomonas aeruginosa
SRQLPRGRRGLACAGRYRCSRACRGCARRSPGCPAGSAIRAAGGGRGARHGSGCRRARRRGRGRRLALGRAGAEPRCRARARARARARARARARARARARAASRGSSLDPSGSGGRGGGGNRSGSPAGCVAGIT

SEQ ID NO: 23104 - protein, 383 aa, Pseudomonas aeruginosa
RYHRTFGSQGLTGAWRTQQDDIRGEEHDERWHGRPDEAGAADAGKDAEDAGRTGQRRSDRAIRRRSGQRGDDRAPRRQARQPGRQPDAGRQGNPRRPDRGRGQRCGAQDRAEQPGKDVRLHLGHATAARLQDALLIPRSCRVRLLRTAPGSHSPPSIRRVLHEFQPADPPTDRVPAHSSRCRAEVGPAHGADAAGARSQRRPEAGPGVDRRDGRGRSLPAVPYPQRGGVVPAVRRPATRRLAALRGGRPAGRIRGGADRLPRPLFRAQGTPVAARRPGAGGDRHSRTGSADQGRSLQRGDPRHQPHRRRRGHRPLYRPATGRPRPDLVAYRPWRAAGRRAGAGRWRHLGPRPGRTAADLLSSVPPVSVGRAAYTPSPMASFPY

SEQ ID NO: 23105 - protein, 393 aa, Pseudomonas aeruginosa
VSSEAPIRSPAMTDFQQYFDESHQLIRDSVRRFVEREVLPYIDEWEEAEEFPRELYLKAGAAGILGIGYPEAYGGSCEGDLFAKVAASEELMRCGSGGLVAGLGSLDIGLPPVVKWARPEVRERVVPAVLRGEKIMALAVTEPSGGSDVANLKTRAVRDGDHYRVSGSKTFITSGVRADYYTVAVRTGGEGFAGISLLLVEKGTAGFSVGRKLKKMGWWASDTAELFFDDCRVPAENLIGVENAGFACIMANFQSERLALAVMANMTAQLALEESLRWAREREAFGKPIGKFQVLRHRLAEMATQLEVSREFTYRQAAKMAAGKSVIKEISMAKNFATDVADRLTYDAVQVLGGMGYMRESLVERLYRDNRILSIGGGSREIMNEIIGKQMGL

SEQ ID NO: 23106 - protein, 554 aa, Pseudomonas aeruginosa
WRRLCFRTTSCGYPFGLLAGFVAQGGERCRGEVVGGGVELPGQGTEAPGESRPQGAVAAADRMQVPALATAHAPDAAVQLALEVFVVAFLHRGLDLETEQFAALHQLQRIEDVGDLRLDHVDHRVVAEAGVRSHQEEQVGEAGGGSALVGFRALGPAVQQVAAVATEDHSAGDRIVGGEAGTEDDRVDLAFPAVAVDDSIGGDGADAFGDHRGVGGSQGRVVVVRHEDALAADGVVRRDLAAQFRILDLLVDVADRQALHQLHYLRGEGEAQHPPFEQAVEAAAPELLHQREAPEAPALGFADCPVGFGQDPWRSALVEIERGHQRLDLRDELDRRGAGADHRHALALEVVVMVPLLGMEDLALEVLQAIEAWIGRGGQAAHAGNHGVRGVMVALGVMQVPEALPLVPGQFADLGVQQGLFLQAVFFPALLQIGADFRLAGEHPRPLRVRFEGEGIDVGLHVAGAARVVVDSPGAADAGVLFEDQEVVLAFLAETDRHPQPGETGADDGDLAVPGGGRGGLGTHGQAPIMIVCWRIHSSTCECRHLYTSGSSQP

SEQ ID NO: 23107 - protein, 141 aa, Pseudomonas aeruginosa
CNYCRIVQQREVIPGHFEVINGQVGSTRRKMGCKERARGARAPPGVSTLVESERGETEGGDAGVLQASGAAEFRQVDDRRGLEDPGPEASYQARGRQQGPAGGDEVVEDQYAVAFAEAVGMYFEEGLAVFGLVALGEYVGG

SEQ ID NO: 23108 - protein, 212 aa, Pseudomonas aeruginosa
VWQRPFLTGRWRFQSVTCVKQLRLPVAPCQGATKRGLKFATRGPIQWKNSIFPGVTGMLTLSGWITTQVPPSSRAAADAKAARTGTAEQAEDPAAGTDAADQHVRLSQAGRELAATMGVPVEEEDEDIPQELRPMVKMIRQLKKKIEEKLRELQEAMRSSDPGAKEARVPELQKELQQLNSVLQTATAAMASAIKEMGISDPALIMKVMGSR

SEQ ID NO: 23109 - protein, 241 aa, Pseudomonas aeruginosa
KGRGFTALSCGQGGALSDHPGEALPVEAGQVAVEQHADRTHQQTSGRRDVDALGVQADQAVGGEAFEIGPQLGEVTAEVDAELCLDILEGQFEVADQLLDHRAPHPVVAVAVQAATDRQLAVVEAGLVVVDVAAVLAVEVADLADRRDPETYQVTVPVRGVALEIALQGAVFLGAGQLVVGQGEVIHADIAVARRGELLGGALEHFQLLARARQVVGVDPPLRHETLGQVGVVEHREAIRL

SEQ ID NO: 23110 - protein, 248 aa, Pseudomonas aeruginosa
RDHFVDRAGEAVRRLFRQSVDQVEVDRAVLQGARGLDDGTGLLRGLHAVDRLLHLHVEVLYAEADAVETEFAEQAHGRPVGLARVDLDAVVARIVVQQVEVGAQLRHEFAQLAGTEEGRGSATEVQLLDHLLAGEVAADDLDLADQARKVRRAAPAILGDHLVAGAVVADVGAERDVHVERQGVSGLPAVAQGVQLVERADAFVELHGGRIGGVTRAGKVVAPNQVSVPANGVEHARDPQLASFSREV

SEQ ID NO: 23111 - protein, 149 aa, Pseudomonas aeruginosa
PSGRPRCVRRDGAAGRSPVRRPCRWPAEPARCRGRTPASAARCPVPIPGWWPRVGCCRPARRAASPRSLRAAGPVAGWRPAAGAGRRVPGGARGRDRAPRRGSGRSTSRPGRVPWRSAAARRPPAARRPTGCAPPPSRPGRAAGRRRRS

SEQ ID NO: 23112 - protein, 433 aa, Pseudomonas aeruginosa
TGICLLISAYHGSGGRPAGTCRQGQKIVARLLIIRLIYQAFCGNCATFGRVLSHSRFSFAQNKTAPGLPAPSGSWGRERLFGALLAVRQAVYVGGQQVHLVVAQVFLLRRHHTLATVADGLLQLREAGAVDERAGVGQIGSAHRRGALAFRTVAGDAGGSEDLLAGLDVCLGAFRQLTAIHLGEDESGDVLHAFLADHFTPGRHGGVAASHDGGLDGFRLAAPAPVGVGQVGEAVGALGVGAVADRAVGGEQATAHFHRLRILGDFLDGHRGELGEDRAVFLVGLGHFLFPLVDAGPAFFLVGEFVGGLVARHQAFPGAQARVQGQVAHGEHQGADEQHEPPLRQRVVVLLDAVVGVAHGLVGGAAALALAGGEDQPGQRQQGAEGESCNVQTPEGRHSLLLLEACSTCFLASGSSAKGSIVASSKLFLRLPL

SEQ ID NO: 23113 - protein, 175 aa, Pseudomonas aeruginosa
RFPGLEGTPPGRPSRSCPSRLHVHRRCPRRCKARPACAGLPSWWRCPCHQACSLPATGRQASSTRAPRCAGCTGARGASRRSNGRRRGPGPGRYAWNPTGTGGPRRFHRRPSNGRSVRSRHGTDGPSASGSRRSLRGCRCRDLPVPGRYAASCLRPGYWSRPGRTAERSGSGRRC

SEQ ID NO: 23114 - protein, 405 aa, Pseudomonas aeruginosa
RWPAGRRSSRVFRGSSFTSGSSGDLRGGFVFGRLGSTHGAPGVVGHQQHAGEEETTADHAHDEARVACDQCFNEGVGQGAVLVDRAPHQALGDAVDPHRGDVQHGADGGQPEVRVDQADAVHLRATEDFRDQVVERADGDHRHPAEGAGVHVADGPVGVVGEGVDGLDRHHRAFEGGHAVEGQGHHQEAQDRVGAQLMPGAGEGHHAVDHAAPARCQEDQRHHHAQRLRPVRQRGVVQVVRAGPDVQGDQRPEVDDGQAIGIDRTLGLLGHEVVHHAEEAGGQEEAHGVVPVPPLDHRIGGAGVGGVGLEPAHRQRHVVDDMQHRRHQDEGTVEPVAHIDVLDLALDDGAEEHDRVGDPDDRQEDGQRPFQFGVFLGGGETLRQGQHGAHDHGLPTPEGEGRQRV

SEQ ID NO: 23115 - protein, 89 aa, Pseudomonas aeruginosa
LDYLSQRHTFELRSLGKVLRAPAESSLECPCYLSCKVVGWHVAHQLEEIPKRPLYVEAADFSPCTAALSFLYIDLRQCAKQRRVSCRSG

SEQ ID NO: 23116 - protein, 304 aa, Pseudomonas aeruginosa
  UNSURE (106): Identity of amino acid at the above locations are unknown.
PTRPSPSARARCWPQTCGRCSVPSITARSMACSQALLEGDARALLEAVRHLAEQGPDWGGVLAEILNVLHRVAIAQALPEAIDNGQGDRERVLALAQALPAEDVQXYYQMGLIGRRDLPLAPDPRSGFEMVLLRMLAFRPADADGVPRTPLKDLGISKATTDPANSPVAGAASPAPVATVAPAPVVAAPVEAPAAPPAAPSAPPAAVEARVTEAVVEEPAAAAEVVDLPWEEPAPSLAAEPEPEPEPEPEPEPEPEPEPEPEPLAVEAPSIPPAVAVEAVVETVLEALPAALPVSPDEQDEQDD

SEQ ID NO: 23117 - protein, 170 aa, Pseudomonas aeruginosa
PPPADDYYEVDMDTLAYLDAAPEPDVVVVEEPLPAAKPATGLAAEWLELFPRLGLGGLTASIGANCTLVAADGDHWHLHLDPGQSALFNATQQRRLNDALNQHLGRTLKLEVTLQKPEQETPAQAAARRRAERQRAAEASIDADPLVRQLREQFAAVVRDGTIEPLEAKA

SEQ ID NO: 23118 - protein, 123 aa, Pseudomonas aeruginosa
PALGARNKTTFEVKNMMKGGMAGLMKQAQQMQEKMQKMQEELANAEVTGQSGAGLVSVVMTGRHDVKRVSLDDSLMQEDKEILEDLIAAAVNDAVRKIEQNNQEKMSGFTSGMQLPPGFKMPF

SEQ ID NO: 23119 - protein, 224 aa, Pseudomonas aeruginosa
SRVRAGSAFFGRRPAAIPLPLSDESCMSFSPLIRQLIESLRILPGVGQKSAQRMALMLLERDRSGGLKLAQALTAAMEGVGHCRQCRTLSEEELCPQCADPRRDDSLLCVVEGPLDVFAVEQTGYRGRYFVLKGHLSPLDGLGPEAIGIPELEARIRDGAFSEVILATNPTVEGEATAHYIAQLLAGRGLTLSRIAHGVPLGGELELVDGGTLAHALAGRRPIS

SEQ ID NO: 23120 - protein, 345 aa, Pseudomonas aeruginosa
GRGGFMTAVPWRLAVEYDVPGSLAATRRACSLGALGALRARREARCQAHAGGDQALVEHWCQAQHHVDRVGVGADQDAPAVALHAAQDDLGGLLRGGPQQLVVELLASLVRSLAGDLGHALVHSRGLGDVGLDPAGMHATGGDAGVLHVQFLAQRLGEAAHRVLGGVVGAHAGLGEQPEDAGDIDHVAVAGGLQVRKERLGAVHHAPEVDVHDPLVFRVVAAFHGTGVGDARVVENQVHPAMFAGRLVGPGLHLLAVGHVDDRGGDAYPAAGEQLAGFLESCGIDVGQGQVTTLPAQLHGQGATDARACAGDGGDFVFERLHAGTPSACWQASLLRAASGVVVRW

SEQ ID NO: 23121 - protein, 321 aa, Pseudomonas aeruginosa
RWTKLSTVMRSARGDWNSGVMSRNTTPGLGKSGTARICDLRVNSSKIMEDPGLGVFRGPSYNGPALRRARWRFAGASAFQLAAGEGAQLDGVEDVHFLAFRADQAVLLEAGEDPRHGFHGQAEIVADLVTRHGQAELLGGEATGTEARRQVDQEGGDALVGSLLRQQQHHLLVIADFPAHQAHQLTAQLRQLLGQFVQALEGNLADRGGFQGLGGYRIGLGIHPGQADQLAGQVEAGDLLFAGIGDAEGFQGAGAHGKDRAERIALAEQEFAFLQGTTALDDLVQRIHVFHGQRQGEAQRGQTAILAVCLGQCAHLDGFGH

SEQ ID NO: 23122 - protein, 207 aa, Pseudomonas aeruginosa
GAVDQPAGQPAPDRSEQQGPWQAGDRQQAPGEGFQVAPEAATERLDAGQAAPPAGQVESHGDQQQPGDHPQRAGQRGARHRPAGQAEQQAGAGVAEDAAEVVGQQQAQTTAALFGGNGQGQGAHQAAAHAQAVASPEQAEDQRGNQQRRQFSHAVGPRVSTASPLRRRRPGASGLRRRRECCGRGRRDRRTGRCPPPRRTRRWRWRR

SEQ ID NO: 23123 - protein, 169 aa, Pseudomonas aeruginosa
RSRRGSGCRARPYGPRRRDSGQPQGVDHHQQRTDRHADRRPARGDPAERGEGQDQAIVQAGPGQVLDDDMAGAARQPESLHQAVQAVGQEHRVGAGLGQVGGAAHGDADVGTGEHRYVVDSVAEHQHPAALAVQAFEHGQLVVRGQAAAGFVDAQFGSDAGDHRRGVTG

SEQ ID NO: 23124 - protein, 579 aa, Pseudomonas aeruginosa
HLLERQAAFGEGAGLVEDYRVDVVQPFQHVPARDQQAELVQAAGGRGERGGRGQRQGAGAGGDQQRQHHPEGALVVDLPPQRADRCGDQQDDEQEPLRHLVGQFRQARLVRLGAFQQADDGRQAAVVAKGADLDGQRPLDVQGAAGDGVAGLAWMGQVLAGEQRLVDAGLAVEDHSVGRQHGAWRYQYAVADAQFAEQDALALVGGVQAQAGRRQQVDQLRGGGGGALPRAAFEVAAGEEEQGEHADRVEIQLALAGDRRPDAGDVGAADRQRHRDVHGQVAGAQVAQGATEELAAAVEDDRRGEDQADPAQDAVHAGGKVEVEFRPGRHYRHHHLDPQQPGDTELAQGVTVLHGQALGGAVGLVGMAGIADLAQFAKQLAERQLAVLPAHVQAMVGQVEPRLGHARQLAQVLLDQPAAGGATDAFDHQAGFRQLALMADEAALYVRAVVELQLFAERLGQGFGIGGVFAAVPVVAFQAAGDDGLGHRLAARTAHGPRLAEHAGLEAAAGGDRQAAVVAGQGGAHGRFASAPWSGSSPSSMTTVGDTTSSSKRRHWPLPSWPSSSTKRRPSTASVSCPT

SEQ ID NO: 23125 - protein, 151 aa, Pseudomonas aeruginosa
  UNSURE (68): Identity of amino acid at the above locations are unknown.
SCTESSGMEKNLENLTIGVFAKAAGVNVKTIRFYQRKGLLPEPDKPYGSIRRYGAADVTRVRFVKSAXRLGFSLDEIAELLRLDDGTHCEEASSLAEHKLQDVREKMADLARMEAVLSNLVCACHARKGNVSCPLIASLQGETSLARSETP

SEQ ID NO: 23126 - protein, 152 aa, Pseudomonas aeruginosa
EGYANEAVTPNVHLCTSKTARKKIGHLVANWLLDYVNWLLLYLCKGAAWGLLRSSGSIFVLPDTRRARSRAWVLVIAFLVYPEDAGQVCVGGSSEGLLIHAAACVQSSSELSPCVQCPIYIYGGVTSDACILEPALSFDIVEEGITVRWLWY

SEQ ID NO: 23127 - protein, 313 aa, Pseudomonas aeruginosa
TSVYFRVKPTLGRVVAAQRPNLWRMETTRWNMSDMNETKDRVADAPGKRALLEAALRLGSSSRSLGAIGLRELAREAGLNPNTFYRHFRDIDDLGLTMIRDISTQLRQPLRQLRREAATRAAPGARAQTTPFGLDLERGRRVCRETVRLFFDFVESNPAAFIVGVRELHGASPVLRGALRQIMDEFAEDMSEDIIEFRLLPAVSEATIRRLSSLIGRQLFQLSLDYIGQPERRREICALGEEQILLLFTGAAVLQMMGVSLDAEASGQLEQAHAGQQQQQAEPAAPGQALAEQRPAHGDGGEDAEAAPDRIGE

SEQ ID NO: 23128 - protein, 187 aa, Pseudomonas aeruginosa
RHNRSKGNAAAMRVPAIGLATTISDRPMAFPISDLRQTTATTCRTLSRGDEKGAQVRDAWADPMEEFHFSRSDWNVDPQWLDHHPGATLVARRRGRQGRADRHRRAGGRPGRRHRRRRSACTAFPGRARAGRHHGGAGGGGGRGYPAGVAADGEDDPPVEEEDRREAQGAAGGHEVVRSGGEGGSRA

SEQ ID NO: 23129 - protein, 632 aa, Pseudomonas aeruginosa
ASSRRRRRPRCSAGMARVRAPIRPPHMPRQWPPPSRPRISAETSSGASSATRSVLGFRRLLRFVDAGLVLRVFVVEENAVGGAVEIVVLAAVHRPEEHVDGDGDDDDRDGDQDVERGHTDLGEGIRVSRRALTTTSSELTDMPIAAQPGVIQPSAAKGRTRPLYRLAQARFSMMIWRVRRASRKACTRLSRRLDRSTASALVLARSVALPMATLMSAPASTGTSLTPSPSISTRRPSPCRRSSMASLSSGVRPPRASSMPSSAATLATIGEASPDSRRVRQPRALQAASRAGASLRRRSSRPNQASGPCSSPSSSHCPESPGIAGVALPPRLLTKAAWPMRRRRPSTRPSRPSPGWLATLSAASGARPKARAMGCSERFSRAAARARQRSASRSRRGSTCLSVRRPSVRVPVLSKITVSMWFSPSSTCPRVISRPSLCRLPVAAVSAVGVASDRAQGQVATSSDSTTQKARWWSTCHHSAPTAAATSRTMSRNHCATLSASSARRGLSAWARSSRRTMADRRLSSPRAPTSTVSGPSTFRVPPVTASPAWRGWGRYSPVSSDSSTLDWPSRITPSAGSTAPGGTSTRSPTRSSLSRMRSPWLAASRRRQDAGSRLTSCAVEAAVRSRARRSR

SEQ ID NO: 23130 - protein, 421 aa, Pseudomonas aeruginosa
TRPRSVCTRVEGGSRTACSSYSTGAWANEATLRFFMDARVVGRLDGEDDLVGGRRQLLRLDGQFHRQVEDVARRHLQLAPAFQGQAFEALGAEDVGVVLLILVHDLQAVHVLDAAEFVLAVEHAVLADVEADQRTQDHRGDQGGDHQHQGDGVADQARPGQVGLLAVEVVLGGVADQPFRVVHLLHDAVAGVDARRAADALDLQAVADVDAGRADLHAHRAVDAVAQALGLVVEGLLARAALLATTRIIGDDQGVLVEHHALEARVGAHVDAHLLAQPAGVAVGGQGEEADPEVGPAVGLAGEQLGNQLADRREVADEGQAGDQADQQPQAVLGGLAQQLVAAHRGLVQLDALVAVAFGDLLAPHVDPGPHALRAGIATPDATGEHGDEEQAEGADDQQPGQQHEVLRPEGGAEDVELALG

SEQ ID NO: 23131 - protein, 434 aa, Pseudomonas aeruginosa
SGSVRRGSARLHVERLVEVPAGLVRQFAFRIVEQLATQVFDGLVAVRVRVVRRQVHQAELVEGFFLYTGRNRRIVDRQQVELGGFVDPILEHRAARQQGHVRVEAGLVEIEVLLWLPGGEQFASALLHRLPGPLAHCQQARLGMLGGVGAGELADHALEVVGGLGVVALVVVAAHVDQADLVQRDTAHLGAVAAIVVAGEVELFRLGAPVVADRHGAVGQQVAFLLDGGGHAVALHLLVFGDFASGHLGDEQRRGRRAGGQQRQQREQDETAGEAHGISLAPGRGASQSSQALQSRQYAPIQFPTEDMPMRSLIVACLALSATGCNSWSLNSDLNGAYRAYDKGDCAQVMLDLSRAERRIRARPYLQPEISLLRGQCLERQSLFVDAAQTYHFIIARYPTSEYAYRAKARLETLRQLGRLSETPASASAVPTRL

SEQ ID NO: 23132 - protein, 174 aa, Pseudomonas aeruginosa
AAGRDWTGVQADRRSHGTPVYPVSFALDFTEEVRMRALWFCVALMPVLAQADIYRWTDAQGKVHFSATPPAGAQRVEVRPQVVERDAATRQREQRTQEYFDARREERTAAAERAGQRQAALAEECGRLRQQLSQLERGGRFYRQDAGGGPVYLSDAELDAIRRELASRESERCR

SEQ ID NO: 23133 - protein, 123 aa, Pseudomonas aeruginosa
RNAIMGLQRHIQRHQLPSYLKVFNRITDKPMGYIGNVSEDGLLLISQLPMLVGARFELRLKVPGLGGRPQCIDFSADCRWTCEDVTPGHFDSGFHLLAPPAEFLELVEALRRYFSFPRQPQSV

SEQ ID NO: 23134 - protein, 547 aa, Pseudomonas aeruginosa
AGGSASAPPGGAPTGRPAGRAGAARRAPPTRMYAVAQATAGRAPTGCPGRWPAAGARRTAPAGRAMASYAGGRYLVEQLLQDLVHRQPLDVQLRRQPDPMAQDRQGTALDVVRHHELAAAQQRPRPAATDQGDRRARSGAEGQARPVAGGAGQAHGIVEDLVVDRQVAGDPLQGENVLVLQQRPQVGHVEHVAARGAGHLAHQGLFLGFGRVIDAQLEHEAVEFGFRQRIGAFLLDRVLRRQHHERLRHRQGASFQGDLALLHHFQEGGLGLGRRAVDLVRQQQVVEHRPLAQLEWFAGEVVYGVAGDVAGHQVGGELDAREAAVEAARQGAYQQVLAEPRHAFHQHVAAGEQRGEHVVDHCALADQGFLQFAAQGLGQLAGALALERRVGRGARLFGRLFAHRAFLRLCRWATWRVKSAAERRCAGYGRMAWLMALGGRRVMRPRICHCSATPSCSKPGWRRRALRRMSRCRPCSKATWPRWRRRKSAPARRCSSSCRRERLATGCKGPWRSPARHRPASNNSSAAARASGKWRASRVARLSRSAR

SEQ ID NO: 23135 - protein, 139 aa, Pseudomonas aeruginosa
SGTLSAGSSSSPAVSSGGASVAWSSTLPSSASASAVSSLARSWLSSKSSVRYWRISRLSSSRSPLFFSSSSHRRSAISTRCPPCSLHCSRRRAWPGVMPERLPSRSRVCPEGGSSLRTSRPSARLTVTPCLRRNSSAAR

SEQ ID NO: 23136 - protein, 330 aa, Pseudomonas aeruginosa
WVSRTSAPGREVGATRRAAAFGGIGGPCRGKSDASQRGVIRQPGRRDGPVCTSVAQRANAEDGAVENTHGDDEQRAGPDQADEQRDHAHQHQQAQHQQQAEHLEPVAADGLARGFQGLPGRQAALGHQRQGEHVGDAQVETGDDQQEEADVDHQHHQQAGEQQRHQHAEVVEHFVEGRRLVGGAADADHGQAGEERVAHRRGDQAGDHLADREGDGIGLAHQADTAEEQGEDEGDGLDHHAVDHEGADQDAFDALDLGPGFADHVADAEVVVADDRRHRLGRLQGAGGGGVGIAGVVHGAVLVSETGIRASGMLARAEGTTQGSDGRYAH

SEQ ID NO: 23137 - protein, 295 aa, Pseudomonas aeruginosa
NGGLSRCFWSIPMRTFRLVIACPDGVGIVAKVSNFLATYNGWITEASHHSDNDNGWFFMRHEIRADSLPFDLDGFRQAFAPIAREFSMEWRITDSEVKKRVVLMASKESHCLADLLHRWHSGELDCEIPCVIANHDDLRSMVEWHGIPYFHVPVDPQDKQPAFDEVSRLIDEHGADCIVLARYMQILPPDLCRKYAHQVINIHHSFLPSFIGAKPYHQASKRGVKLIGATSHYVTEELDAGPIIEQDVVRVTHRDNVEDMVRLGKDVEKLVLARGLRYHLEDRVLVHGNKTVVFD

SEQ ID NO: 23138 - protein, 268 aa, Pseudomonas aeruginosa
LSVMVLTASWAPICSSSIIFWICWADSWARWARLRTSSATTAKPRPASPARAASMAALRASRLVCSEMPLITSRIWPMFTVRLLRASMLAQEALIFSESSFIARMVCSTTCLPSSAWWLASEAWCEASAALRAISWAAAPSSLIAAATLLVRLDCSSELAIEEFEAFTTSCATSCSWRAVPATSRIDSWIRSTKRLKALANVPNSSLLVTFRRLVRSPSPWAMSCMARPMSVSGCISTRISMPRRRTMATTAISAATIAEVRSLVSMA

SEQ ID NO: 23139 - protein, 268 aa, Pseudomonas aeruginosa
LSVMVLTASWAPICSSSIIFWICWADSWARWARLRTSSATTAKPRPASPARAASMAALRASRLVCSEMPLITSRIWPMFTVRLLRASMLAQEALIFSESSFIARMVCSTTCLPSSAWWLASEAWCEASAALRAISWAAAPSSLIAAATLLVRLDCSSELAIEEFEAFTTSCATSCSWRAVPATSRIDSWIRSTKRLKALANVPNSSLLVTFRRLVRSPSPWAMSCMARPMSVSGCISTRISMPRRSMMPTTAISVATIAEVRNSLSIE

SEQ ID NO: 23140 - protein, 1246 aa, Pseudomonas aeruginosa
PMKCLEGSRHMHRSTGIGVSRWLGGLLGVALALPALALPQGCIELLAQAPRVDVVQGQQRDLRLAVPIERLAIGDPKIADVQLLDRRGFLVTGKEQGSTSLLIWTGCSPEPLRSLVEVEGRGSVDTRGAPAFTVGAVEELPNQVQTDIRFVEVSRSKLKQASTSFVRRGGNLWVLGAPGSLGDIKVNADGSGLGGTFGTGSSGFNLIFGGGKWLSFMNALEGSGFAYTLARPSLVAMSGQSASFLAGGEFPIPVPNGTNDNVTIEYKEFGIRLTLTPTVMNNRRIALKVAPEVSELDYSAGIQNGGVAVPALRVRRTDTSVMLADGESFVISGLTSSNSVSNVDKFPLAGATSRSSVRSFRSTKVDKDDRELLMIVTPHLVQPWPADAQLPDLPGGGPAAIRSGVLAPVLLRARRVRRPAERHRSVGLGGAHEPELRGADPASRRTRLVAEQPGVRRPGGSGRQRQPGGAAGAARRHRRRGAVHQPRQKQPGVPGRAGRGIGIGAADALGGGHRRRPGQPVGAGGDARRRARLHHLRRPRQRADRADPAPRRTPAQRAGERGAPGRAADPGQRPTGRRRRLRRLAPGQGVTGADAEPGPAAGRRPAHRRGAGDPRPGLGLHLQRCLAQPAAPRPDPDRQRLHPPRQRPADTQPDRRARRAGASHHRRTLSVAGQPARGVQPCGGQPHRAARGRAEQPAAGAGQPRAVDGRPERAVLQEGPGAPAPPARAQPAVALHRVADRALPAQCGAGPAGPKPDVRPRSVRCPAVVPGIAPAREEPRQEPVRGGAARPIGGQAAATGGQPVRDTRRAPFAAVLARPGQGGAAMSTGFGARPDGGAFHSRQEQDIQALKLRLHRYIIDEIDEDGMNLLEGARSAVVQYVSEKVCEYGSRHQLAISRYELDRLAEEVVDELTGFGPLEILLRDPGVSEILVNGPGRVFVEREGRLYQSDLRFIDDHHVLRVIQRILAPLGRRLDESSPMVDARLPDGSRVNAIIPPVALDGPCISIRKFSQELLRSADLLAYQSVDEALLEFLRQAVSRRCNILISGGTGTGKTTLLNVISGFIDERERIVTIEDTAELQLGHDHVVRLETRPPNAEGYGEVTARDLIRNALRMRPDRIILGEIRGVEVLDVLQAMNTGHDGSMSTVHANSAMDSLLRMEMLVGLTGNRLPEQTLRLMICAALDVVVQITRLASGRRCISEVLEVLEVRDGVYVTNTLFSLDRRGSGQFVRQAAPVGQKFRQALL

SEQ ID NO: 23141 - protein, 209 aa, Pseudomonas aeruginosa
SRCSSRRCCSFSWSCWSSCCAPKAKRPTRCRCCSPPASVSSCPSRCSSHFAKARRALIADEMILFVQLIRILFDAGLTVEQTLRVVCLEGRGITPQLARELDLALTRADNGIDLAEELEALARRLQVDPLNDCCGVLRQMLRQGGSARSTLLTLKQLFEDRRLTTLQERIGKLSAKMSLVMMVLLFPALLIVLAGPGVIAITKALGGLG

SEQ ID NO: 23142 - protein, 95 aa, Pseudomonas aeruginosa
TMHERILFGVLLLLSGTAWAADTPAVRPAAPATAEPQTATRAWLAIQASGRAASPVRQSATAAERQRAYQRYLKSYEHEIPEYLLEDRGFGESKN

SEQ ID NO: 23143 - protein, 564 aa, Pseudomonas aeruginosa
RFLAEGQGMNGWPARQRGAIGILAATTLLLALICLLLVVDTGRLYLEQRNLQRVADVAALESASQGALCGDQSSAQATSFAKASAMLNGFDADAAGSSLSAEVGGVLSAGGLRSFIASASNAAAANEAVHVEVTKSVPGSLVANLGGLFGGGNANVDLRAEAVARRLPNATISAGTGLASVNSGQSALLNPILSGLLGTHIDLSAAAYNGIADAKLSVLDILGADGMGLIGVDTSLGTIEQLLNTNVGLQQVLAASVNVLAKNGVASVEALRAQLVGVKSATLKLGDLLGLSAGEVNSMSQLDTAINALDLIMAVAQVANKNSAVAVNLGIPGLANARLTVVEPKRIVSGPPGQDESGAWRTEVRQSQVRLTADIDSGFLSILATTKLQLAIEGASGAVWLKSMACTRPDTALEFGWRSSGATIKIGSPANIDQVGSILVLGGLVRLDLKLDTSIAGSSGDTRFNVKADGSDLVQSRRLPESGFLASTLKTSINVNPVVLGLCLPLLCGSTALTDLIVNSVVAPLVDGLLTPILNLVLPLLGVQLGYIDAEILKVDVGRAELLI

SEQ ID NO: 23144 - protein, 479 aa, Pseudomonas aeruginosa
GCGSGMSAHARKSFPATPARRRRHRIHSDLPAVFRAGLRSDQLQHSFAHVAVVQRCRCRGGPCGDRCRSLRCGLREPRRSPCQGRVARAPGLDAGGLAGEPPALCRQWPVRRLRQRHVADRGLRAVPVRRSGQGDHPRAELPRHRRDSQPAADAEGECQPVAVRWSHVRIFPLVVRRGREAGTLFAGRPRPLERFAEELGPVFRDGRTGPRDPGRRAAGVSSAVRPWAWRTAAAFRRVSGAARPRCADAGRPAPGRASRPDAAQRCRRAIDLSFPADAAARRPGTLAAAGHGHLRPQLAVRQPAAPVAEPEPGQADPFASAPCLPRTPGGGGPGDSRIALRRVPDAGYRPAAGRRQGFLHGLRQSCAAWQRQFAATDPATRRRRPARRGGRALATPWRRRLDAAPADRRGRALPGAGGDARWPPGGVAGPADVAGAARPGARAAGLAIPRGTAGEPGGGPLRTPRAARQFAQAGAVAGR

SEQ ID NO: 23145 - protein, 177 aa, Pseudomonas aeruginosa
RRPTRGRVRCSWFACRWRRPPRRADDVGGSAAKKRLRTSRRFFNRRGGSDELRGQPEQAGGQRHRSRQGEYPGHQDVAHGAAVQAALVRHHGPGHAGGQHVGGGHRQAVDVGHADGGGGGDLRAHALGVGHALLADLLADGEHYALPADHGADAESQGHRDDDPERRVFGGRGQVLA

SEQ ID NO: 23146 - protein, 354 aa, Pseudomonas aeruginosa
LTEVQGGVAGALDLVGGAVQVEDELGRDDADQYQHDQADTLLAVVGAMDEAYRHGGKHQHQAVPERRVLLLVEFATGFRGLVHLRQRTPPFQSEQDQRGDHEAGQRREDQRQADVDRLLPVDPFGQRHVGDQRIGQADAEDRADQGVRAGGRDAEVPGAEVPGDGGGEQGEDHRQAMAGVHVDQQLHRQQVNDGVGYADTAEQHAEEVEHTGEHHRPVGGHRFGVDDGGHRVGSVVEAVDELEGEDEGQGQHQADTHPGIEPAEKIEHVRNRSETGRRLCQMRFYPSGTPEGCHCRGQRPVASGFAGKTKQIETLRYPSLSCRLEVNGMGFAASCPALRRSSSIFCSSLSNACS

SEQ ID NO: 23147 - protein, 548 aa, Pseudomonas aeruginosa
RNAPEAGDLLMQPARSRILFVCLLQSLALVLLLVGARHGWLPLYLALPLGVALLWLPWLLPGNRTAVATVGEPDIARLARDLSHNTSQNALSAAGVAFSVKRLAEKLQSQLDAAEQIVGSAEVMIHTERATSNLARQAMDAATRARAGSDEGQVLLASTIERMHRLSERMGASREAIEALNQRSEDIQRVTLVIQGIASQTNLLALNAAIEAARAGEHGRGFAVVAEEVRGLAGRTAEATEEVGQMVAEIQRQTSEVVEQIRQLSEELGEGVGQVELTGRQLEGIAELAAGVESQITEIAQGAEINRSQLASLFAAVEQVRGDLSASEEQTLRLGEAASQLENQAEVISERLAEVSLDAYHQSVYDLAREGAAAIAARFEEDVRSGRIDLDDLFDRSYQPLPNTQPTKYRTRFDSYTDQVLPGIQEQLLERNRNLVFAIACTPEGYVPTHNRAFAHPPSGDPQTDALRSRSKRLFNDRTGIRCGSHQQPLLLQTYTRDTGELMHDLSVPIFIHGKHWGGLRLGYRPEGAEPGKAAAPAAQGLSLALNG

SEQ ID NO: 23148 - protein, 348 aa, Pseudomonas aeruginosa
TSKDCPWRSGRRSKVVVDMSEPTGGLSGVHYTSVFGLAQNGRVFLFHSAEPPMQYLFPLLAVFIWAGNTVVNKLAVGIIQPAEIGFFRWLLVGLALTPFMLGPVLRNRRYILANLGKFVVLGLLGMAVYQSLAYYAAALTSATNMGIILSLMPLMSLGLASSILAHRLNAGALLGALVSLAGVVLVISQGHLGALLEHGVNLGDAMMIVATLAYAVYSVLLKKWSLKLPAMQLLYLQVLVAILALLPLYLLSPRTGLNAANLPLVLYAALFASIVAALAWMHGVARLGPSRMALFFNLLPIITACIATLVLGERLTVHHLVGGALTLAGVLLAEFWQRRPARLRSATC

SEQ ID NO: 23149 - protein, 1090 aa, Pseudomonas aeruginosa
SWHWPKIPARTAAAVAASPRRWRCSCRRSSSGRPIARCWARESIPEVSELDKAPLTWRLMRLLPGLLERPEFRTLQRFLADDADLRKRHQLAERLADLFDQYQVYRGDWLDDWSQGRDQLRTANGQARPLGADERWQAELWRALLADVGADSLARSRSGVHRRFIEALRSASAAPRALPRRVVVFGISSMPAQTLEALAALARFSQVLLCVHNPCRHHWADIVADKDLLRHEYRRQQRRAGVPADLDEDRQHQHAQPLLAAWGKQGRDYINLLDSYDDPDSYRNLFGEVNGGRIDLFSEEAPHGLLGQLQDDILELRPLAETREHWPPVAPRSDASIRFHVAHSAQREVEILHDQLLARFNADPSLKPRDVIVMVPDINAYAPHIEAVFGQVPRDDQRFIPYTLADQGQRGREPLLIALEHLLKLPDSRFAVSEILDLLDVPALRRRFGVDEADLATLHRWIEGAGVRWGLDAAQRERLGLPAGLEGNSWRFGLRRMLLGYAVGEGAALQGIQPYDEVGGLDAALAGPLAVLLERLEVAYAELAEPATPAQWGERLQALLTVFFEAHDERDELLLTQLLQLLERWQEHCACAAFAEPLPISVIREAWLGGLDQGGLNQRFLAGAVSFCTLMPMRAIPFRLVCLLGMNDGDYPRQQSPLDFDLMRNDYRPGDRSRREDDRYLLLEALLSAREQLYVSWVGRSIRDNGERPPSVLIGQLRDHLAAGWRLDPDGDGEALLRALTQEHPLQPFSRRYFHDAPEQGVDGLFTYAREWREVHSEDDIAVPDAEASLPPLELEGALGLRALAEFLANPVNAFFQQRLKVRFDDEQLTGNDEEPFELDALDNWKLQFELTERMKRWVERDWDAEGLPAQLQAQVERLRRQGRLPLAAFGEFSARHLLQPLPDLLWRYRQEIERWPEAVEQQQELRHRHPSGLELEDWLGGLRRDASGRLARLQLLSGKLHEGRGFKWHSLVRHWLQHLALQRLGQPVSSVLVSQTGTLEIPPLPSERAGEYLDQLIDAWRQGMRPAVAGGLPDRFRLARPSGGAAEPRESHARGAQALRGRVRHGGRGGRLAGAGSGLSGFRPAARQR

SEQ ID NO: 23150 - protein, 1269 aa, Pseudomonas aeruginosa
VRALGRAALRAAAGCPGTWRGGAGMSQQQMPVALDPLDFPLHGSRLIEASAGTGKTFTIALLYVRLVLDHGGENAFGRPLSPPEILVVTFTDAATQELRERIRSRLGEAARCFAEPQERHDGLLVALRQQYPAERWPGCARLLRLAAEWMDEAAVSTIHSWCYRMLREHAFDSGSLFTQNLETDQSELLAEVVRDYWRRNFYGLTAPAAQAVASCYSGPETLGKALQPLLARQDADFRYADQALSAPESLTALLEQGGDWYRQLDQLDAQARAAWRAARVELEALLRDLRPYLNGNSYRGKDSDETFDAWLQALADWSEGGEQPANLGKFGQTRIKLTAKRVAPKHAALRAIDAWAAHQEERPDLAPHLLLHALGEVGHELEIEKQRRAEIGFDDLLSRLDRALQGPGGERLAQLIREQFPVALIDEFQDTDPVQYRIFERIYRIAADPYEPQARETGLFMIGDPKQAIYAFRGADIHTYLRAREATRGRHYTLGKNFRSTAAMVAAANRCFAFAEEHPRGAFRFAREGLENPVPFHAVDAQGRAERLLIDGAEAPAMTFWNLDVEAGVLGSAAYRQEMAERSASAIRRWLSLADLGRAGFADEQGGWRALRPADIAILVRGRAEAEAIRSALAARRLASVYLSDRDSVFDSQEAADLLHWLRACADPGADALLRVALATRSLHLDWATLERLNQDELFWERMVLRFRDYRRSWQAQGVLPMLRRLLADFELPARLLRHADGERSLTNLLHLAEWLQRAAVELDGEHALIRHLAEQVQSPGSEEILRLESDADLIKVVTIHKSKGLEYPLVLLPFICSWRELDGNSGAPASFHEDGAAGRVIELARRKEQAARAYEQANDERLGEDMRLLYVALTRARHSVWLGIAPLVASNSKSPELHKGALGYLLAGGATIGSDGLGQCLAALRGECREIVVEPAPEADAERYVARRGQGLGQARETRRSSREKWWVASYSGLQLQASAGLDDDDVLESDESQEPISAEEATFPEEGRSAEQPPVAHASEMRDDLHRFPRGPAPGTFLHGLLEWAGREGFDVARADAQRRRELVARRCDLRGWKDWAEPLDLWLEQYLAEPLRWPGGETSLAGLVAYQVEMEFWFATHQVQAEAIDALVRRHTLGGAARPALAPTLLNGMFKGFVDLVFEHQGRFYVADYKSNWLGADDGAYSPEAMTAAVLENRYDLQYVLYLLALHRQLKARLPDYDYDRHMGGAVYLFLRGARAATQGLHFERPPRELIERLDALFSGQPGAER

SEQ ID NO: 23151 - protein, 153 aa, Pseudomonas aeruginosa
RPARCSAISAGMPRRAGTAPRPAPGCSGSAAKPGRACAKVRRRRIRWRNRPSCCGIPGASARAAGSGAWRGWSTGNRPATRARCWTVRPPTSSTCACAGSAMQPSPGCSSTVIRRRRARRTATGTTCNAWPRAARPPDWRWRMAPGSAGRSRY

SEQ ID NO: 23152 - protein, 597 aa, Pseudomonas aeruginosa
RFRDWAVARNASIFPPTAGGPARTSRPVISIPASICWRRPPNSSNWWRRCAATSASPASRSRSDPSKHAGALPAQVAADQLRPEFAGTRIEHWHAVGRELLVEAVARIQVVDGAGVGERLLVAGDRLVAQGVEHFLAQAGDQHPVLAAQAFHRAEQFFVVLVAQVGYQDHQGPPPLAGQHRLHGFREIGGTLAGLQVVDGVEQRAELGAALARREMPAVVAGEGHGAHRVALAQGHVGQQQAGVEGMVEVRQVAVLAAHAAAAVEQEEDLLVAFVLVFAGDRRAFASGGLPVDLAQGVAVAEFAQLVELQAEAAALAAAYADLVEPVVDRHQFGAVEAGEVRVDAGLAACFQVAALPPQAQRAGQFQLAAGKHEVTAVERPHPVADLGAFARAQFDLLRQVLEIHAGRQVIEQGQANRTPIGVLQMQTHFAPAPQRQVAAELAAQLRHRLAARPQGVQQAEQEQRGERRPPECMQLRRQPLAERRQAAQADGQQQERGEQRQQGARWLHTRGAGTWSSNCCRTWSTDSPSMSSSGDSRTRWRRTARAQPLMSSGTTNSPPRSSARARPQRTRAIDARGPAPRARPGQLRVVRARRTA

SEQ ID NO: 23153 - protein, 145 aa, Pseudomonas aeruginosa
WRWVAGGSCARGSAIARRRRAVRNRGGDAAPCAGCRVADRAARRRGRAGGGGSRRRRAGVPPVAGANGWPPAARDPGAALRATGRRATTAALPPGPRGSGGRAGWRGCRVRRGRAGSPGCPGSGTRAARRCRTARCCGSARSRRR

SEQ ID NO: 23154 - protein, 613 aa, Pseudomonas aeruginosa
PPACAGTVRRPGRDCAGPPAMGRGRSSPYRVAGGWPGRSPAARPAAGARPAAGSARAGSSWLGSRGEKAAPAVAEALASVVGRQPVAVGERLPLGGQQLAVVQQRPLLLQSFDQTQDLALGMGALQRQAVVMQQSAEQPAVEQAEGFPWFLVPEPFGVAGDVVGQAFRTEIEAEHHRRRFAAGPLRQAQVADEQAQPFTVAPDQQEHRAEQQRPEQHFDDLRRVTERHPVGQGLEECLEPLFVLLAAVLFLGLVAEAPARNGLAVLERRAVDDRPDLLAGLFAVEFLPQQAGLLGRQLGFAGAGGGRRLGIGGRGGQPGQRSGQAEQQDIGAADQTLAQAAEHQLDVPGLQFGAPVQVEGEAAGHVDRLPDYQHQDVEQVRQVLQPEPLAGFRVEQALPVPVDLVLRRDQQVEKHGEAGPERHFQVHADHGQPGRAAGVALGQYDQALAAGLPGEPFQLQDRQVEAARRTEAAPQQAGRQLLPQQGGIGAQGLPQGWRIAEQGVRENVQRQPFEGRLEPPEDQDRQGRMLPQQEAEHGEQRQGQQRPAAHQQARMAMRQEDAEVERFPGAARADRHAGVSQAHGGSVRRTGSSCRPAARGPRRPRTSPAARND

SEQ ID NO: 23155 - protein, 233 aa, Pseudomonas aeruginosa
PLGPDRHGPYRLCPAPGGHPVAAAGRPAVAEAGNAHRGERPGAWAGPRRAFRCPRHHCPGPPDPSAPAAPVRLPLPVAQQAQGARPGAPAAAAGACLRTLFRGAPFPLGGPAAGLAPAQPQCSDRLRPLRRSRAAAGVVGRRLAQAPVYPSRRTGRGRVAGAAEADPGQPLPGGGAAVGIARRGSPANRHRTRGVPAKSRAVAPASNRLGGQTDSAIWRRKFLRQRRPRATVV

SEQ ID NO: 23156 - protein, 657 aa, Pseudomonas aeruginosa
PHRGCPPVRRRDRPVSDLEAVHQLAQAPGLGFQLATGAQGGLEVLHAFLVEGVDLGDVHVQRVDHRGLLLGGGGHRLVHPVDLADPPGHAAQAFAGTVGDLHALQAVALALGHGGHRLAGADLQLFDHLLDLLGRLLGAMGQVAHLVGDHCEAASGLAGARGFDGGVEGEQVGLLGDALDHFEDLADVHRAAVEGLDVGAGGADLLGKLVHRADGLLDHLFAVLGLVVGVGRMVRGIGGVAGDFLGGGAEFVDRRGDAVGAVGLLVGVGHRRVRGVHHQLRDVVQFVRGPGDFPDRAMDTLDELVEGIAEHSEFIAAGHGEALGQVALALGDVLHGTAHQVQRLHQQADQQAEQDQDGDDGDQRGGDGRDAELAEHGVGLVLVDGQRQVPGHRRQALDRGKGEDAGMPVQFGLAETGGDLRRVLRVDLAQGLHHLLFVRVHQDLAVAADQEGVAHAAEVQRIDDLHQGLQAEVAAYHAEGVASGLHRCRRGDDQFLGGGVDVGFGQGQAAGRHGVLVPGPAARIVAGRHRAVRTHGEDAVLLAEVGEAEGRGQGRLFEQGADGFRAVVAGQGLGGLLDQQQTAAEPVLNVAGSHVTHFPQVAFEVLADRVALQVIVVEGEQCESGEHHEGGREEDLVAELQTFDHVVLRPGVCSASL

SEQ ID NO: 23157 - protein, 548 aa, Pseudomonas aeruginosa
SWTARSGRCAGPTPFAGTRAYWYAGSAGSPVAQGLSLTVGTACRSFSPEDEWMSQANELLIGAGPDGQPVGQAWRLANRHGLIAGATGTGKTVTLQHLAESFSDAGVAVFAADIKGDLCGIAAPGNPQGKVAERIASMPWLNYQPKAYPTTLWDIAGKTGHPLRTTISEMGPLLLANLLELTDSQQAALFAAFQVADREGLLLLDLKDLKALLNHLKDNPEILGEDRALFTGASGQALLRRLATLEQQGAEAFFGEPALQLEDILRPEPDGRGRIHLLDASRLVHEAPKVYATFLLWLLAELFEQLPERGDADKPVLALFFDEAHLLFNGTPKALRDRLEQVVRLIRSKGVGVYFVTQSPGDLPDDVLAQLGLRIQHGLRAFTAKEQKSLRAVADGFRPNPAFDTLGVLTELGIGEALVGTLEEKGTPAMVQRVAVAPPYSRIGPLSDSERAELVQRSPLKGRYDQPIDRESAYEVLANKAGAKPEVQGQATAQQESSSGVGGMAGQILGSLLSNSTVKSAMRQAANQLSRELVRGLLGSLMGGKKRR

SEQ ID NO: 23158 - protein, 140 aa, Pseudomonas aeruginosa
RAGRRIDPAGATGVAWRPGTDLRRADRRGQRWTGPLEPGKGPASAAYRGAGGTGGRRGAADAGEPGRFAAPGHPQQGRRTLPQGAGRRAAASVAGRAERGAESRPTAGAPQTDGAERAQRGSARAGGQRGHGLPWQRHDP

SEQ ID NO: 23159 - protein, 397 aa, Pseudomonas aeruginosa
EARMNQNFVALTQHPGELDWLQNSLASAGQVVPAGSASLEELLALLDVTAAGVLFISLGKSNLVSQGALVEGLVSARPMLSVVAIGDGLDNQLVLAAMRAGARDFITYGARASELTGLIRRLGGRLPSVPVSAARQGELLTLVSARPDADGAFVALHLAKALQEQTPNQVLLLDVGQPTGEALAILGLDSAFTFSDALRNLRRLDQTLIDSAFTRLDSGLRILSLTDEPGVLERVTTAELYLLLGNLRGAFSHVVVNLTGLPEGELSNQLLVQANRVLWMVDQSVPSCKKGLERLRRLRERNLPLPSIELLIERYLPNVAPDQQALSRMFDLDLFGVLPLSPESRLRAKNLGKSLFEVAPRDPLAAKLRQLADSLCVTRGERRSLLSWLGRAKAALL

SEQ ID NO: 23160 - protein, 140 aa, Pseudomonas aeruginosa
SSVSSRPSADAWTSPARWSTRACRTAAGSTRSFPRWRWTGRASRSASSARSCCAVPTCWPTRASTKPCSSSSARRSRAAATSSSVAAPAPARPPCSTSSAASSTNASGSSPSRTPPSCNSATTTWCVWRPVRRTPRATAR

SEQ ID NO: 23161 - protein, 262 aa, Pseudomonas aeruginosa
GAAHPRPGRLGQPPLWRQYQRPAGQHRQAHPRAREAQPAVARDDRRDTDQRLCPGRRAERPGRLHPGEQPGLSAEHVGRRHRAFPAAGLARAATARLLCAVAHAQERLGGGHAGTVADFRGAPDGGRRCLVAVAPGAQRQPRAAPDREAPGSAGQPWRLDQVAGRHDRADGRQLLGAAPATDGQRGPPVAATGRLARESLPDPVPDLGVPHAAAVRSPGLAGQAAARRKRSVLRGAAAVRRRHRFPPAQAGAQATSPKRAGR

SEQ ID NO: 23162 - protein, 343 aa, Pseudomonas aeruginosa
SSSPVRASLPSPRPWEDWDESTDRHRPVRRPARRLRRAAGAGRPTGVFAAARPGAGTADEHGPRHDPRGPPACGPGQPGKHAAGVARRARRKGADPAPDRRPAGQGRVPGPAGNLQGTRGAPRPRPARPAQWRQRPGGPRAARGGAPAADREPLPQRPGGRPAQARRPCRRALRIHHCAGVAAGWQAAGDQPARPAVPARRPGRCAAPDRAFAAGCPGHPRGRGAGAQLGCRTDTRRGAGKRRPAGGTAGGGEYAYRDGQRGALSRRRRGEPCTSESCSASCCSCPARPGPRTRRRSVLPRQRRPNRRPPPAPGWPSRRAAGPPARFGKARPPPSASVPTSAT

SEQ ID NO: 23163 - protein, 192 aa, Pseudomonas aeruginosa
LLHPVLQPFFDIWINTFSVTLAERMTTSIKDADRGCQLMLGKASRRRQHGAVAIEFTAIFLLFFALVYGLISYSIPLLMLQSFNDAAAVGARAAIAVDPSDAGYESLAEARARDELLARLDWMPAAWRANLQPCAGNGQYADYVSATSRIEVCVQYPYGDPGKAIIPVLSFPGIGAIPNLPQTLKASANLLL

SEQ ID NO: 23164 - protein, 391 aa, Pseudomonas aeruginosa
GGRMFEFSRSSSAEAERPEPFSQEGPALWSASLRSWDLCFEMDEQDRVIRVGGRQAYRLQCAHGLGEQPRPFAEYLERRAPGAPTLAGLRRGERLDLTLRSDAAAPLTCRFQPMQPLDGLGRSLLLGMDISDLNWQSDNQQHQLQSLSLGKLILSRLRHVSHGHLAEAVQEILESLSGAFQMQAIALLLGDGKGFCTVFASHVRPGSDSLLRPTLQLADDDLREGAGARLLRRGEGASTLLRQIGEDALYLVPAAMRGGRLGALLVRPMSLEQLAQGPAPQDWQYLAELLANQVADRCELHEQHDSSRKLGLLQEDDRRRLVALLGGAGTLRTGAGLARQPGVGRRVSSGAAGTPAGPAATGGRRRTRPAPACQPAQRPGAGPGPLPASAG

SEQ ID NO: 23165 - protein, 203 aa, Pseudomonas aeruginosa
PRRAPLAAHRGSTAGARQRAGAVRRAARHQRRPAPGGTGTGGPRAAAQPDRQRAGGDLRPAGRAGAPGAGVLQRKREQPARPRLAGTELAGARRTGASGRPGGLFRPWPRVALRGPGEDPLSPRRWPGQLALALRRSQAAARCPGPAQRGGGPVAGRDRAAPGGTAYRRERGTLPGPGGGFAGADLSLYRRPGADLREPDLRR

SEQ ID NO: 23166 - protein, 302 aa, Pseudomonas aeruginosa
PRDQPGAPGRSPARRVAGGGRRQRLARASAGFAAGGRQRGAGTALQPAGATFSLAGVGRATVVRRPGRIVRGTGGGTRQHAGASGPAATGARRQDGQPGGDGQRPRPRGEAAAARAAHDPLQHAPADEQRRPRRRLPGRETGAHGCPGPARRPPGQPPRRVQPQVGAGGAAVRPLCRLRRRPGPARRGAASARHRGGVPGADAADGGARAGGPVGTGDHQPARQRPRCPAWQSRPGQPACSPGAGGLPRTGLGRIARARQRRWDRTAPAGADIRTLLHHQGGGQGYRPGSLGQPRSGAQHGR

SEQ ID NO: 23167 - protein, 154 aa, Pseudomonas aeruginosa
SASASPRSAWTPTTSRSTTSPGRARRLSPLASRRTCAAGASTSTTCSTAATSRCPIPSRPSTGPASTATPTRSCRASRSSCWSATATWYSPSPVPPKATCPPTIAPSPIRPAATRRRTRCAAAASACSTTAPGFAAAATSSRCCYRPTPVTPAS

SEQ ID NO: 23168 - protein, 288 aa, Pseudomonas aeruginosa
PWPGSCWPSSGSAARPVCARQPADFPATSSRLRRTEAPPLAIIGSAPRVGAEPCQPGRGRIVVEVFSVQDGLDAERALLDEVCGGAREHGLLLWQPCDRALVMPRRMERLEGFAPASAAVAERGWPVLLRDTGGEPVPQSPGVLNIALSYALGPGDNEQTRIETAYLRLCQPICDWLRERGLDAGVGAVAGSFCDGRYNVTLDGRKLAGTAQRWRRNGAGRPVVLAHAALLVGAEREEMVEVVNTFTRRCASAPDCQADSHLGLSERWSDFRMADSLELERRFVAARS

SEQ ID NO: 23169 - protein, 306 aa, Pseudomonas aeruginosa
CVCFPDCWSVPSSAPCNVSSPTMPTCASVINWPSAWPTCSTSTRSIAATGSTTGARAATSCARRTGRRARSVPTSAGRPNCGARCSPTSVPIAWPAAAPACTGASSRRCAPPARRRARCRDEWWCSGFPRCRRRPSRRWPPWPGSARCCSACTTPVATTGPTSSPTRTCCATSTAASSAAPASPPTSTRTASTSMPSRCWRPGASRAATTSTCSTATTTRTAIGTCSARSTAGASTCSARRPRTGCSASCRTISSNCAHWRKPASTGRRWRRGATPRSASMWPTARSAKWRSSTTSCSPASTPIRA

SEQ ID NO: 23170 - protein, 169 aa, Pseudomonas aeruginosa
ARSSTCWTSRHCAGVSASTRPTWRPCTAGSKAPACAGGWMPRSASVSACQRDWRATVGASVCGACCSATRSAKARPCKASSPTMRSVAWTPPWQARWLCCWSASRWPTPSWPNRPPRRSGASACRPCSRCSSRPTTSATSCSSPSSCNCSSAGRSTAPVRPSPSRCRSA

SEQ ID NO: 23171 - protein, 98 aa, Pseudomonas aeruginosa
STPGARACAQPLPVACRTAFAWLAQVVAPQSPEKAMREARKRYEGGFGMGGEVDASPALARVYPDFDRLLASGEFAHWAEQLYAPLLAALGRGAEEQA

SEQ ID NO: 23172 - protein, 274 aa, Pseudomonas aeruginosa
PAPAIRCGWASRRWWRATASRRSCTRGPWATCLPAARPSAAMASDNASPRCAASAGRSSSSRPPRRTPNAMSHGAARALGRPAKLAAAAARSGGSPAIPACNCRPPPGWTMTMCWRATNRRSRSAPRKPPSPKKAVPPNSRRSRTPARCATTCIASRADRLPAPSSTGCSNGPAAKASMWRAPMPSGAANWSRDAAICVAGRTGPNRSTCGWSSISPNRCAGPVAKPAWPGWSPTRWKWSSGSPPTRSRPRRSTPWSGAIPSAARRVRRWRRPC

SEQ ID NO: 23173 - protein, 321 aa, Pseudomonas aeruginosa
SNAWTRCSAASREPSDESDPQATGRRSPRWPRRPGSATAGGTPRPAAPARPVGGARLATGAGPGVRRLPRRVAAAGRSPGAAGGGADQPPTGPRSRLPGPGGDPRRARRGTVAAAGRRRRPRCAVAVATAARRAPRRLARGPGGVTAGGGGRRAPRRSRAERDGDLAAGALRPASLPASLLAARVGDRPGPARAPGSAGAPGRRPGAAPGRAVRAGAYGRRPARHRLAEAGLCPGGPRLFQPDHRRSRYRQDHHRGAPARSAPGTGGSRRPAAAHPPRGAHRQGRGASLRIHRPAGPGPAAGGRRVAGDPRRGHYPAPSAW

SEQ ID NO: 23174 - protein, 180 aa, Pseudomonas aeruginosa
TATRCAACSMPSRPGRAPGPGKSGRSRRRRANTPSAVRRPSRCPPPAGPVRCRRAAGGSAAPTGATARCCAAPAGRGCSPGRCGGTCRRWTNRSVRSGGPICGTRRGLAPVRQAAPGSARGAGCRPATGCRSPGRPVRWRPGVRAVAAGCLPAPRGRFPAAAGDAGAVAPGALLPASAGG

SEQ ID NO: 23175 - protein, 158 aa, Pseudomonas aeruginosa
APADAVRFAEAAPVAAGVARWTRRVPGKSAADLPASAASARRRAMDAIAGCPPRPAAANVRSAAVVPSAPAGAVAGSSRRPAVPAAIAGSGVGGRSAGRSLVGTAGAALPGRPGVVPATPTARTAAGVAVLPAASIGPVADRARPVGQSVPAAPGDSG

SEQ ID NO: 23176 - protein, 308 aa, Pseudomonas aeruginosa
PAGPAPPPSPPRRIGCLVVSGRAMPAPARPYAGRVRPGVEPGRCVGRGPVAIPCGALVVVPGYRSAGAIRPGVPPGRPARCHGGRSIAPASVRAVPRRGPGIFPARGAAPGFRARAGDVARRRRAGPGGSPRRRRARREPGCRAMPPAVAPVPRHGAAAAYPVAERRRFAGRGAGSIADGVPVARPAFAPGAWPRSPAGKPRATAPGPDADGCRPGPGARAPPASGPAILASARRPRLAARCAAAAAARSAGVPARVASGVRSVREPEPGAPAIAGFPAPSPGRPRPAWPRPVDLVRARRIAAAAAPR

SEQ ID NO: 23177 - protein, 462 aa, Pseudomonas aeruginosa
SRFPARQRGRRGSSGGWRESSWNGLFPRGLFGGQFDALQQAGEVIQRLRIRAGAIGAFPGAAEQFLGVELVEPEQRRLLFVAALVLAGDAHQTASLAQQGALDLLAQVRLRLIQHDADFQPGPLFVQQVGLGQFADSIEHLAKRRGADAQQFHRAWHRETLYILQALTFQGDEEDLVAIVHFGEGQRQRRAAIANALLSGDFLWLVQMTEGYVGDLLRKQAGGQRFDVADDQVSLGVFGNRAAGHVCVADGDQCLSRRATDVRGGNQAFVHLADTGQVIVAEPASGDFGGTQEGQGQAPGGDLAIRVVQGQKQAIAIEAFVYPADPADGMGVQSFHQRSGQFDARAGVVVACDHHDLQPRQPPMGADDEVVEALLGFERWIDRVEDIARDQQDIGALLFQLAQQPVEEARMLMIAVLAVQGLAQVPVGGMYEAHGTLVESGGAVARIPYMRQQKERAGQASL

SEQ ID NO: 23178 - protein, 858 aa, Pseudomonas aeruginosa
AQPGRKLAARGELPCITGGCRHRAGADRADAFHRQQALDAGIPTYVSLNLSFQSSDARLQRLQFIFQFTQQFAHRGRQGRRFGSRDRFEQGHRRRSPTSRRDQPELAQQATHLIAQRRAGPHQTTAHPMHRLHGLLLCALHRDIAHARTTGGFADRLGVVCIVLVPLDVGFDELRCDQAYRVAQLPQLARPVVRTAAGLHRHQARRQLAKEIPHLCPLELATTYHMLVTINAVHLEYLFCQIQTNATKVHADSPSGTCGCTISLALDAVGGRSPFHCPTPGWASGAPVRRVDNAPGVIRRDAAETADNRVAVIRPTPRWASGAPVRRADNATGVIRRDVRLYQQVADVQHLHGVGAALGGVAVALGQDHPVALGHHAALEQLVDRGLADLLRRQRRRVEGDGFHAAEHRHASLSLAVRGVGVNRYRRADARHDQRGEAAFGQADDRLDPREVVGRVHRRQGDALVAAVESLAEAVAGFLAGRVLLGALADAGHGFHRFHRVLAGGAFRREHHRVGVVEHGVGHVGDFRAGRHRAVDHRLHHLGRGDHHFIVAAGVQDDLLLDADQLGIADFHAEVATGHHYRVAGTNQAVECVVVGDRLGALDLGYQPGLASGLGEQAAGVFHVLGVAREGNGHVVQVHVRGQLDVGLVLVGQRRRGETAAAAVDALVVGQRAADQHPAAQFVGGDFLDHHHHPAVVQQQFIADPAVLHQVRVVDADHFLGTGVAGVAGGEAELVADLQFDALVGELGDADLRSLQVAEQGDEAAVLGRQFAHQPGAGAVFIGGAVGEVEAGDVDPGQDQLLQHFRGIAGWAEGGDDFGAANGHAKDSLDNAGVQATTGEARRRLRSHTICIRCHLSV

SEQ ID NO: 23179 - protein, 185 aa, Pseudomonas aeruginosa
APAGRIPPPPGRVRRSARSARCPGAPGRPRPSAAGRCRWPGRSRGSPARHSRPAGGGAPRRSPGRLPAGRRRPGGDVPHVAARNARNRRAFPRRTAGCAASPRGYAGSRRAAPGWLRAGGRRRSAGDRGRPACRWHAAGRAPRTGAGRARRRDGPARAAAGSGGSIASRCCPVAGGAAGCACGCS

SEQ ID NO: 23180 - protein, 449 aa, Pseudomonas aeruginosa
GIPEALQVGDLAGEVGSGKALRRIWAHGLADGAGWQAGHAPEDLPLLGDAELFETGVATPRPAQDVALQTVQQGDVAALAEEEVGAGAQVFLQLPARTAGHRLQGTLAQPCAPQAGEQQQQRCRQGLGEVAGEQGGEAVAFGAVEQGHLVVLGQVPEQPGVVVLLDVAVPPDPGVGEHRDQALAVLHLQQVGGVAAVGPGVGVVLRIVQVVVGIEADVGRRALVFQVQAGQCGIVRHAVGGLFFLAGGVLRRRFGRVVVDATFVGVGVGGFLAGPVLAVVEVLGEVLADIQAVEQQVAALLLVLVPQAFGDQHQMPALLAPLQQAASLAGSHAGAAAEQEQGMPGGRQLLEDLKAVGAAHRDPLLAQEQFGGQVGIAPGLRRWAEVDRLRIGLQAAGQEDRQQPGQQQEHGQQQEARAPAHHGLAPAAKRLRQPSQRRWRASSAGSRWP

SEQ ID NO: 23181 - protein, 676 aa, Pseudomonas aeruginosa
ARRACLRVGVSPNRACERMYSGSRSKAGLSHQKIRIARVGCCHSRRLSTANSGRVSNAQLPISRRAWRCARRMPRSSASQALRGRIATLASVRRMAAPSGEQEVAADQQPEDRADRVLHPRLEMTDGRPIGLGEGRQQQQHDHPGDQLHAAPGGQPQGFAAGQATWREQRPAELEAGGAGEGDGGQFERAVADDERPEGLHVADLRQVAGHRTDHQAIEQQEEQAAESQQHAAGEGLKGDADVVHDVEAEHFPVVAGVACPQRTQAGGFRGVHRLHLADLVRADHAVDQVGKVIDQQPHEPGRCRRTAGWPRRCCAIPRGPGAAGRRAGSRGCGCRGGCGAGRTAGGRASPVAATGRSGDCCSRAPGPAPVAGRGAGNRRRSRRWSLPASCLSRGRRGVCRSVARRPGGAVRRGSVSCALLTQAEKAAGDAVDLGLGAYRLDAQRFGENARQFLAACRGKRRAAFGETEEGALFFQAHGEGRQLRLDVRQAGPAQFGFAVDHQGAGGDVAQALEGRMVQATEQTEGVAEGQDVGEAQQVAQQRRGPAHRSAVVVDDAQSHHLLAGRAALVEHLEEDHVPPRHDEGQQQAEAGAELAEERQAEHQHQHDQAADAEVDGIGQGPGDDAGGAQEQVDAFRRFHVVVGVEDLGAWPGGGRDEAGGCVRWHRGAVSGKVRC

SEQ ID NO: 23182 - protein, 509 aa, Pseudomonas aeruginosa
VRWKTWKSPKWVASFAAVTGRLPGAARKGMTVNASIFWYDYETTGIDPRRDRPLQIAGIRTDEALNEIGEPMNLYCRPSDDILPHPMACLITGITPQRLAERGLSEADFMTRVHAQLAQPATCVAGYNSLRFDDEVTRYSLYRNFFDPYAREWQGGNSRWDLIDMVRTAYALRPEGIQWPQLDGRLSLKLEMLTAANGLEHGQAHDALSDVRATIALARLIRQRQPRLYDYLYQLRSKHKVLDQVRLLQPLVHVSGRFSAERHFLSVVLPLAWHPRNRNALIVCDLCADPAPLLELSAEDLRRRLYTRRDELAEGELPVPLKQIQVNRCPVVAPLSVLRAEDRQRTGIELEECQRKAELLRQHQTVWADKLTALYGEESFSASDDPEQQLYDGFIGDRDRRLCEQLRLAEPEQLAKEQWPFDDARLQELFFRYRARNFPETLNVAERQQWESFCRNRLSHEEYGAPNTLPAFEAALEACRQEQGGTLPAVLAAWRDYAAELRQRYSLET

SEQ ID NO: 23183 - protein, 180 aa, Pseudomonas aeruginosa
HAEPRQNPPVEADYLVQVADQHYRADEQADQEYRAEDQARFHVRAQRMAEGIDQDRAEGAEEERQVGQLVDREHRAGLCRAQAAPGQQRHQGQRPAAAARSGAESEFAGHDDADALQLPELAGTPGEQQAQAQAVDEPADHDHAEHQQQTVQREGAQAREHVAAAEHQRNQRGTDQTEQQ

SEQ ID NO: 23184 - protein, 459 aa, Pseudomonas aeruginosa
SGQVSGATSCNTSSRLRSAIAREPRLAVAEYRVVVQEQTGDHRVPGMLALDVTAGALAAQLDVVAEQFAHRAGHGVAVVRCAEHAATLRDYFRQCPGAHRHHRNAAGHRFECDQAEGLLVTGVQQRVAARQQAGDFAAVAEMVDHAGVARNPGRHVGTHQQQVIAVAEALDGVEQYRQVLFPRTAPGEHQQAGFLVQAEFLAQPRIAVARMEGDEVDAQRLYMHVGDAQAHQLFRHYPTGGQDPVEVAVQLADVVVRVGAEPGAHAIAHQQRQVGVVEADHRHVQPTSRVERRPGGEVGVADLDQVRLQIAQHLAPGAATEREAVAIAEWQRRRRHLVDAVRLAVAGAGNQHAVANAGIVPEMAMLGFEIGAYPPAGRRVEHGHIGDVHDGPSSVELVPSATQWTTGTGSRSNGVREPWVASSLGKKARAGALAAASAGIGRRGSGRRGRHASGGILAG

SEQ ID NO: 23185 - protein, 675 aa, Pseudomonas aeruginosa
TTPLALFTLTMAGGLADTRGAIIRRLRLRVGQCSDLEAVHQLAQAPGLGFQLAAGAQGGLEVLHAFLVEGVDLGDVHVQRIDHRGLLLGGGGHRLVHPVDLGDPSGDAAQAFAGTVGDLHAFKAVALTLGHGTDRFLGADLQFLDHLLDLLGRLLGAVGQVAHLVGDHCEAASGFAGARGFDGGVEGEQVGLLGDALDHFEDLADVHRAAVEGLDVGAGGADLLGKLVHRADGLLDHLLAVFGLVVGVGGVVRGIGGVAGDFLGGGAEFVDRRGDAVGAVGLLVGVGHRGVRGVHHQLRHIVQLASGAGDLADRFVDTLDEAVEGIGQRTEFIVAGDLQALGQVAFALGDVLHGAAHVGERLHQYADQHAEEEDDGDHRDQRGDDRRGTQLGEHGIGLVLVHRDADVPVQAGQALDRRETEDPGVAVQLGLAEAAADLRRVAWVDVAEALHDLVLVRMDEDLAVAADQEGVAHAAEVQRVDDLHHRLQAEVAADHAEWLAALARRAGDGQYQLVDGRLHVGFGEGGLAGAGGGVVPGAAARVVVGRQVAGGARGVGAVGLPQVGEEEGRAQQRLFQQGLGGLRAVVAGQGLGQVLDQQDAPAQPVLHVAGGDLAHFVQVVLQVLADRGTLQGVVVEGEQGEGRDHHQRGGEQDLVAELETFDHGFLHPGGAGALS

SEQ ID NO: 23186 - protein, 270 aa, Pseudomonas aeruginosa
RWLSVMVATASRAPTCSSSIIFWICWADSWARWARLRTSSATTAKPRPASPARAASMAALRASRLVCSEMPLITSRIWPMFTVRLLRASMLAQEALIFSESSFIARMVCSTTCLPSSAWWLASDAWCEASAALRAISWAAAPSSLIAAATLLVRLDCSSELAIEEFEAFTTSCETSCSLCAVPATSRIERWIRSTNWLKASPSTPNSSRLVTARRLVRSPSPWAMSCMARPIRCSGCISRRISRPSRTRMATMEISAAAMAETRNLLSMA

SEQ ID NO: 23187 - protein, 690 aa, Pseudomonas aeruginosa
SPANRFAVSRPVGRTGSDLEAVHQVPQAPGLGFQLAAGAQGGLEVLHAFLVEGVDLGDVHVQRVDHRGLFLGGSGHRLVHAVDLADPAGHATQAFAGTVGDLHAFKAVALTLGHGTDRFLGADLQFLDHLLDLLGRLLGTVGQVAHLVGDHREAASGLAGARGFDGGVEGEQVGLLGDALDHFEDLADVHRAAVEGLDVGTGGADLLGKLVHRADGLLDHLLAVLGLVVGVGGVVRGIGGVAGDFLGGGAEFVDRCCDAVGAVGLLVGVGHRGVRGVHHQLRHIVQLASGAGDLADRFVDTLDEAVEGIGQRTEFIVAGDLQALGQVAFALGDVLHGAAHVGERLHQYADQHAEEKHDADHRDQRGDDRRSAEFAEHRIGGVAVEDQGDVPGHAGQSLHRGEGNELAATVEFHLVDPGDDVRCAFGIGFGEGLQDQPGVGVEEDLAGVADQEGVAGTVELQGIEDRGQGLQLHVAGGDAQQLTGVPHRQRHGEDLLAGAGIDERFGDDQPVGRQRVLVPGAGTWVVTFRHGVVGAHGEGAAGRLAKIDRREIAAEDGLFQLPCDIRLVGLVEQRQLRGQAFHQVHAAFQPALDVAGGQGADFPEVVFRVRAHGLALSVIVIEDEAGEGENHHQRGGEKDFLGKRQRAKHERCVLAKASRRAGSPGHQVGSLRGKAMIQRLNGRLCSIVPA

SEQ ID NO: 23188 - protein, 318 aa, Pseudomonas aeruginosa
FSVHRPVRTHSRGLPMNSKVLMALAGLLLLGAVLLGYLGVSIGRAPSNAHAPSVAPASATVDASLEKLERKPVLVASRDLPALAVIGKDDLSVELLRTAPVGSYDRPEALLGKRVWVAVPAGSILSAATLEPGGPLARTIRPDERAMAIAVDDVVGGGGFVLPGDYVDVMLFVRDERDGESTPLAQLVLPGVRVLTYGERIAVGSDGQDRSNQEKDPRPPRTAVLAVPEDGVARLMLASQAGSLRLAIRSKDEELYRREQEGALLQASLGAPSAALSLDQLLERRKPTAPSVRSAAPRVPVANGVTVYRGSAMTHEVP

SEQ ID NO: 23189 - protein, 309 aa, Pseudomonas aeruginosa
RRYPRCSSVHRRRRGGAAEPGADRYPLRRGQPQQAEAGQHLVRPPRRQPLGARCAGQPRRYQGQCRRQRPGRHLRHRQLGIQPDLRRRQVVELHECPGGQRLRLYPGAPEPGGDERAERVVPRRRRVSDPGAERHQRQRHHRIQGVRHPPDPHPDGDEQPPHCSQGGAGGQRTGLQRRHPKRRGGGAGAARPAHRHQRDAGRRRKFRDQRADQQQLGEQRGQVSLGWGDIPIFGAFLPLDQGGQGRPRAADDRHPAPGPAVARRRTVAGLARGRACGNTIRGSRACTSSSAASTTASRTTPVCRIRRRA

SEQ ID NO: 23190 - protein, 313 aa, Pseudomonas aeruginosa
RAVRPPGRAGRAEIPPGAAVNGAQLLVLFSGVLAFAALALAFMGWRAGRNELVVERLLGRQEAVAVRPRSSHWLARQMRRAGIQRPRPWLFGAAVLALLLVWSGLGLFGTIGALGGLLLAALSCRVALGMLYQRRLKRMIRQMPRFLDQVVRSLHAGRTLGDALMQAVENAEEPLRDIFTLARNHVLLGIHLPEALQEVAELYEVEELRILALGVSVNHRYGGNTSDLLDSIVKLIHEREKLSRQLHAMTGETRISAYVLAGVPSALGGYILASNPGYLLNMWADGTGRFLLLASLGLQLLGCYALWRMLKSV

SEQ ID NO: 23191 - protein, 551 aa, Pseudomonas aeruginosa
EVAMQAQWLIFAALLMAVGGALLLLLQARNGSREQRLIERRLGALANPGGSTRWLAGMTERMDDSFWVRRLQLMDSEARQLLQQAGWHESRYRTLYLISVFLTPLLFVLLVLLVKLLRAESEASYAVPLLFAAGIGFLLPKQVLKPLRQSAPGADRRRNDPVRATDPHPLRRRPDRGADAARGLPGRPRDHPATGPRAGPGADPCRQRHRPGGRAGGACPAPAGGPAERLLRRATADVAPGRQCAQHPADAQATVRRPAPDHLAGTHRQAVGEDEPGDDGAAVPGAADRPRRSGRHCHHQGLGRTGMKALIGIGLCAALLGGCAALPGRDGPRECSQQLGQEQELQMNMVRDMIREGRLHAALANLESMPPGLLDVREERALILRRIGDPRARAEYQALLETCKAPEAHHGLGLLALRNGDSARAVLELREAARLRPTESRFRNDLGVALLKRGDRVGARFEFITALELQQGGKLPATNLLGLLYLQGDREDAQRLIERLQLDARDIRAAEARARSWGAVPTPGAAPASDDPLAELPAEANMHTAMANEAP

SEQ ID NO: 23192 - protein, 773 aa, Pseudomonas aeruginosa
SFRVCAMSPTDTWRRRSRRFSNRSPARSRCRLSPCCWATARVSARSSPVMCGLAATVCCDRPCNSPTTTCAKGRARACYAVAKAPRRCSGRSARTRSTWCRRRCAVAAWGRCWSGRCRWSSSPRGPRRRTGNTSRNCWRTRWRTAANSTSSTTVRASWGCCRKMIGGGWWRYWAEQELFELAPALHDSLGLAGEYRRVPLEHLQGLLQPADADELGLRLRASLRSGQALAQDLCLRQPDSRGERRWLRIEGRPLGRGSALGLSGVLLDISEGRRQEERAQAAHARLRSLIDSAPVVIYVQRVEQGHLVPEFYSESASNLLGLDLQGQSWQALAERVHPDDLEAFFARGRELLCEGRVKTRYRLADGQGNWHWLYDEAKLLRDAQGLPSEAVGLWLDVTEQHLAAQRIAESEERYRVLVEDSPALICRYTADLVLTYVNRTFADSLATSPERLVGRRLDEWLAAEDASALRARLLGSPREGASEVPELRFNLPGQRFLWLVWAERPLFDARGELCEVQAVGRDNTPVRRAQQQLAQGAKMASLGEMVSGLAHEVKQPLHVLRMTLFNMRQRMNSVGLDGDYLGEKLERMDAQVLRVDRLVSHLGVFSRKSALEALPFDPYAAFEGALGLLGEGLRQHAIEVECPAPTQRMVVRGQADQLEQVIINLLANARDALLGNPGLASRRVRLEQVACREPGWVELHVHDNGGGIEPLLLERIFEPFFTTKAEGKGTGLGLSVSHDLVRNMGGSLTAANQGEGALFVVRLPLAAPAEAGG

SEQ ID NO: 23193 - protein, 412 aa, Pseudomonas aeruginosa
HQPERLVGRRRGVLGEAPGGEAAIPARRRRTDRRQRRSDDPHRARHLQSGAPGHGRRHPGARRQRRRPGAAGLDHRAHASAQRADGRQPRGDRGAEPAQRGHPAGHPGDPGHRQPDQPAGPQRGHRGGPRRRAWARLRGGCRRGARPGRTYRRGHRGSRPDGRRDPAPDQRGGRADPPAFRRVGGRGRPGRADRSATGRHCRTGGRGGKPDYRDRPGRRDQPQPTRQPVRRGRAGARRPQRQRGTDPAPRRSCQPVGEPGRGDQRAPRRGQPGRLPPVGLRPRPGGRGGYRRSLRGGRAQRAHRPRRPVRPQLPAVAQYPADQVPDPLRQLHRPGPAGHPGAVAGAQPQPGIRHRLYPRRLRAHPQSRLRPSAQRRPADGRVAQPQQAPVQRPHRDSLRQPPAAAVATDLHP

SEQ ID NO: 23194 - protein, 235 aa, Pseudomonas aeruginosa
HRRADARSFGADLHPRQALGRPAPRLPAGGRGAGQGGRAGGAGAEPGLEWLAGCGDQAAGHGAGEHHLPGRRLPGEQGQQGEEQQGEVGRAQDAFGPERLVQRRQQQADHRRVDPGQRCPYPAFVAQAFPEWQGTGDQQERRQEDRQQAQQRAAPSVRRRARGCAEERGEGEERARYRLGGRVAGEEGIAVDPALGYHFRLQQRQHHMATAEYQRASPVERIEQAQPVFRPEARG

SEQ ID NO: 23195 - protein, 320 aa, Pseudomonas aeruginosa
CGTSHAIPVSPAGRVHLGRQHRRQQARRGDHPARRDRFLPLAAGRPGADALHARPGAAQPPLHPRQPRQVRGPRPARHGRLPEPGLLRGGADQRHQHGHHPVADAPDVAGPGQQHPGPPAERRGAARRAGVAGRRGAGDLPGPSRRFAGAWSESRRRDDDRRHPGLCGVQRAAEEMEPEAAGHATALPAGAGGDPRPAAAVPAVAAHRPERRQPAAGAVRRAVRLDRRRAGLDARCRPSRAEPDGPVLQPAADHHRLHRHPGARRAPDRPSPGRRRADPGRGPAGRVLAAPPGPSALGNLLISRQLPRDYGARRRRHWLS

SEQ ID NO: 23196 - protein, 246 aa, Pseudomonas aeruginosa
ASAGAISAWPTASNWNDASSPPDPDLFRQSLAPGIAVPMPEPLGTTALTPGFMIVHGNRLDDLRDLAVSWMRRYPLAPLESERVLVHSNGIAQWLKLALAEDPREDGGGGGGIAAALEVQLPAQFLWQAYRAVLGPRKHSRGFRTGQGAADLAPDASASRIAGASRVPHPATFPRRRCRPAQASSTGRAPGRPVRPVPGLSRRLARRLEPGPRPVAHGERAGAPARCRRALAGRIVARAARRRRCR

SEQ ID NO: 23197 - protein, 364 aa, Pseudomonas aeruginosa
PGPQPLRRAPALHRGAALRQRGAARVAATSGGVRDFLDAGADPRGAGRPGQVQPGAALRAQPLSPPLGRHRRRQGPVAPRVPPPAAPRRRPRRPRRGPPAPACPAVAGGLGQAGPRLHQPARQLRRPGQLSEPVRRGQRRAHRPVQRGGPARAARPVAGRYPRTAPIGGNPRALAAGGAAERRLDPLPCGPQRAARSGDPPRPVARPLQRRSEPEAARRDRHGPRHQRLRAAHRGGVRPGAARRPALHSLYPGRPGTARSRAAADRPGAPAETARQPFRRERDPRPAGRPGIAPAFRRRRGRPGDPAPLDRRRRRALGAGCRAARASRPASGTGGQQLALRSAAHAARLRGRRRRGPARHPALR

SEQ ID NO: 23198 - protein, 168 aa, Pseudomonas aeruginosa
TGGRTGAASAGGVPRQPGECVLPAAAQGAFRRRAIDRQRRRTFRTGRAGQLEAAIRADRTHEALGRAGLGCRGPAGAVAGPGRATAATGSPAAGGVRRVLRAPFAATAARPALALPPGNRALAGGGRAAAGVAPSPSVRAGAGGLARRLASRRFRAPGAPAVAQRQAP

SEQ ID NO: 23199 - protein, 363 aa, Pseudomonas aeruginosa
LLRPDGSGGASRGQLLQRAGDAGQGLAAAAGAAGRRLPLRRPGAECARVTDSLAGAGRRLVSPARPTGRAGPRRLARSARRTGSAAARPASLPERQQLSRQGQRRDLRRLAASVGGLERGRRAAGQPRQVRPDPDQAHRQARGAQACRAKGHRRLGRASGRASRSRSPPVVARVGRSRARTGDREAAACRDRLRRPAQPPRPRLAGAWWRAPGAIDPRAVPGGADRRVPGYRPGAVPDLRAHLPDRRRSLRAPGAGNRPVHDRRPQAGDLRLPRCRHPYLPARPRGHSRAALHPWQELPLDRRHGGGRQPLLRLRRRASARRLPFRPRGAGKPGAVPCGGRPGARRTFVDRRCRGASDDVLEP

SEQ ID NO: 23200 - protein, 212 aa, Pseudomonas aeruginosa
RCVGERRIAGADQRRGSHLPRRRPFRRTAAGRARQRDARRPASLPARTGSRHLPPRAARMGRPRRLRCGARRCPAAPRTGRATLRSAWLEGLGRTARPVAGAVSRRTAALARWRNQPGRAGRLPGGNGVLVRHPPGPGRGDRRPGPAPYPRRRGASGAGADPAERHVQGLRRPGLRAPGAFLRGRLQVQLAGRRRWRLQPGSDDRRGAGEPL

SEQ ID NO: 23201 - protein, 791 aa, Pseudomonas aeruginosa
PAVRVVPAGPAPAVEGAPARLRLRPPHGRRRVPVPPRRPRGDPGPALRAPAAGTDRTPGRAVQRPAGSRAMNPTLKQLAGEVRDGRDDQVAQPLAARHDLLRQLDLWVARGWLRALDRAFVAFLVELQPQADPRVLLAAALTSHQLGHGHVCLDLEATLGAPDAALSLPPEGDEGRDVLLPSQLLHGVRLDAWREALAASPLVEVVDERPGDPEPSETATSPLVLCAQRLYLRRYWRHELEIALALRERLGRQAPLAADLAPRLAALFAQAPTEDGQRVTDWQKLACALAARGYFSLITGGPGTGKTTTVVRLLGLLQAPAVAAGQPLRIRLAAPTGKAAARLSESIGQQVRALPLAEDVLQAIPAEVTTLHRLLGSGPDTRHFRHHRDNPLALDVLVVDEASMIDLEMMASLLDALPPQARLILLGDKDQLASVEAGAVLGDLCRDAEEGWYSAETRAWLQRVSGETWQGLREGSAQAHPLAQQTVMLRHSRRFGASSGIGRLARLVNRQQAGDARALLDSPPADLFDLRLRGERDAAFARLFVDGHPQAPGTPYGYRHYLQRLAEGRPAAGLALEDGAWERWAQSVLTAFDAFRLLCALRRGPWGVEGLNQRVAAELLRLGLIEADHGWYEGRPVLVTRNDYSLGLMNGDIGIALRLPERNDDGSLRFALRVAFPRNDGSGGVRFVLPSRLVEVDTVFAMTVHKSQGSEFAHTALVLPDALNPVLTKELVYTGITRARDWFSLVESLPGVFEEAVRRKVRRLSGLMLHLRPEREEQPPHAPGEQTELPF

SEQ ID NO: 23202 - protein, 904 aa, Pseudomonas aeruginosa
LPILGAGVLAQVSAEASVQFGEFRLGPFLCLTGFVALLVALLQLPARFIAALLELLQTLFDLLKPRLLLPALLDGLAECLESPQRICLPALPVLVGEQWTQLLAVLLDLLLQMFVALPLFRQRLLALLQDRLDGPQFLLQLLGLALAGDQPVEVSLALLALPCQVVQALCQPLQLRGRLQESQFFRQRPLVQLPIERGQLASQFLLLLATLVESFPLAGIALAQTDQGLSQPLEGLLGADLLLVVVFTEGGEQLLGMVIGMLLAAADRTGLAVHQAGAQLLDAGAAGQTLALEQLAGDLQGLLRRLHLLGALAALSFQVEQCLLLLDHTLVEFAQASSQAGALVEGLLPFLVERLLSFQAIGLPAQFVQACRQVVRLAAMEGGPLRLQAFERFPGVGQGFFQLGELRLAFERALATLHEGGELALVGRPGVAERGESLAVAQCRLQLRLFRDMALLLHIQLPSGVALLGVALVRLPMEFLSLGQRSLQAPGLALQLESLAQRRLGLTQMVVGLGLALARLLQAGLQSLQALGARGLLLGALPLLLLGVPEFLLELLQAFDQSANRSQALQPLQGFPLRRQGVPGLPGLGQLTLCVLAGLQQPLLLGEPLLLAFQTLQCLLLLETRLGVGFQRRLEPGPGLLGQGQAAFQALLELLALLVGLAGALIGGFAQLAVQAGVGEFLQQCAAVVVAGLEEGAEFALGQQHGASELGEIEAELLLQLFAELAFLVRCQHLLGLQVLEALLALLQGAVRLVPGAPGFPAGAIAVAVDADEIHFGVAAGATAAQQVAFVVAGQLVPAIGNLAAGRSAFQPRRAAEQGQAQGVQHGALAGAGRTGDGEQAGAGQRFAGEVDFLLASEGGEVLQADGENLHGTAYFPGGSSVASSTLCSRLAKSSSACASGPEP

SEQ ID NO: 23203 - protein, 615 aa, Pseudomonas aeruginosa
TNSGPGWKSASCWISRNRTCASRSRAPCWARLAVWCASPASTSAATKSRRRCSGSTNSTPRNCSAAPGKAPMAPARMRRRWMTSPACCKASNWPPKSPRGNKPFHEDSRHPPEEPRLPRWRAGNRLHPRTAVQRRPVRHHRSDRRRQEHRAGRPVPGPVRQHAAAGKHFGQQQGSRWPERAVQQRRTQPAAPRLRQRLRRSGFRRHRRPPLSRPLGNPALPGQGGRRLAKEPAEPPGPGDPANAGSEQEKRVPRTAGAEARPQFRPVHSRRAAGPERIQRLPQGQRQRPRRIAGETHRHRPVQPIEQSRLSARQPGRRAAQATRATPGRQPAPGRAGPGRARGGAGIPRPGASPGATGTATSGRPATMVHRGAAAAAILRARTRSTGRGQAGLGRPGDGAGNPAMAGAPGSGSRTDRTPEATRAGTPALRAAAAAAHRAASRGRRALARIAGPLAGGARAPGPGRQPSASGPGAVARGFPAGERGQAPGANAGRATGTPSAIEPAPRPAKRRRSATGYAAAAPCRGTGATAGGIARQPGSRRARRRLGDPPGPARRLRATSPARARKPGAAPRAGKIPGPRRGTARTLAGAMDRPPWQRAGRPGGTPGRIAPADR

SEQ ID NO: 23204 - protein, 198 aa, Pseudomonas aeruginosa
TRRPGAGPRRAVPRAAATDPGRSARGLFQPAGKTQPESPGAAGTDWPTGRARSATGPMDAAGRTATPAAVRAVGVAGTTPGRPGRAAPAVPTRLRPADRPPTPDPAIAAGTAGRRDDPATAPAGADGTTAALRTFAAAGRGGQPAIASIALRRALAALAGRSAADFPGTRRVHRATPAATGAASANRTASAGAQAALR

SEQ ID NO: 23205 - protein, 328 aa, Pseudomonas aeruginosa
VPAPSGRLAGLARTPGQPRRQPPRRPARPFRGTGDAMAGAIAATARGDHPPADAGSRAPGATAPASPAAAGNRPRGAGRQPAATARTPGRQRTGLPGDLQPVAGRQPAPRAEPGAACRTGASPRRVPQMGPPERTDRFVQRRQVPPHRPGLQPRPAGAAQQRAVAPVGAALPPAARRQRTGPAGGGHRDGRRTALGVFALRRRDLPDFPGPGARPGLDGIEQAAHRVAVHRRRLRQPRPGIPATGDGCPGQPAGPGTQGGGDFPRPGNARTDPGPGAGPARGQRHEQPEGGRLSRPPRRHVRTAARSVHPEHAAAALPFPAADAASAR

SEQ ID NO: 23206 - protein, 227 aa, Pseudomonas aeruginosa
YRCTPAPWSAPGSARPAGPARYGRTPNPATCARSWRTRCPPLPGGSAGRSARRRYRRCAGRPRAAQSAGCRRRCARAGAGRCRYRRSSAPGCSRCASPVPAAPRTSRDRPRSGQGAAVPPLPAGSVLPRPMGRGAARRAGGRRRKPSVPTAPSAPRRHPPAPVRRPGGPRPGVAGSAGSRTACPAPADDRRRTAGRRLHRAPRAGAGRRGRRADCPAARARRRPVAG

SEQ ID NO: 23207 - protein, 196 aa, Pseudomonas aeruginosa
APARTARPGAAPGRRPGAPADPGARAGPGRSPTRAANNDAGRDAGRKAPAARSPSRSARDRLGARRPPPPAVTPPGPRARRRGARRAAVATATAHRGLRRLPAAATVPRRARRGSPPGPGRRDRGPVGGWSAPPPAAPGDRPAAATRRGRRRTPGPAPVASRAPPTGRAGAAGRGVPPAVALPGRRGHRGLRRPVA

SEQ ID NO: 23208 - protein, 924 aa, Pseudomonas aeruginosa
GSDSSLGSRLAAEQRVQAFDQFPRRALEVQALGRRAGAAEEQVHGAAHVAVVVVVGQARLQLPVQGQQVQHVLQVITVLQHRGGHRFRAVGAIVGAQPVGLVVGHVETPLVLEDQVDEALEHAVQQGRRQRRTRRAAEGMAPDQGVDRLGLDLVGGEPELHFHLVGDQPGQAGFATGPAQRFGEILLQPQVERFGPVLPATQIAASRDQFAAPLGIGARHIEAFAAGPFEQPVEEGAGSRSAREAMQVVAHLAGVRDRRLFGGTAFFGEGGFLGADRLLRFVALQHIVIVQPGGGLQLQAGIAGDPPLLAAAAASFAGLPKALAAPCDIAFGVRLGGRLDDDLPALAAQRGEALSEAIAADGRAAGKQVAQGPLVQLRRLAVARHQRRDAQPHRMAGAGQGHVEQAHVFAEALVVGLLVGPRSLLLAPRQLDDPPCSAILVETRRRAAVAVQLPPAADEGQQHQGVFQPLGLVDGHHLDQVGVAFQAEDLFAPRTLHLLGQMADQRVLTVQFHRRALQPLGQVQQVGQAALAIGMPQQARRQFEVGEQAPQHRQYALGLPGPAIVAEAQDHPFPEQFVLVQSFQGRPVQVQAAGSQGDPQQRIGAGVGAGTQPMQQVGGFLAVEHRVAVGQVDAGQSSRRQRAADRLGLGATADEDGNIRRAQRPPAALLVGEAGAAQVGQAQPAADGAGAALGHFLAIRRGAEHAGFDIKVPERHRWRLGTVDQQTFGAPLGVHRMERHRVFQPLAGETEGAARMLFGEGEAAVGGRHHGGGRAEVLAKGVMPPASGLAGAQVGMDVGTAEGVDRLLGVADHEQAGFPRLGLVGIGGDPVDALEDPVLHRVGILELVDQRHRELLADQLRQALATRPLQGAVEAAEQVVEADLGTPLLLDLQFVPDFAQRVQQQVGSEIGTLFLMRGPGVDGP

SEQ ID NO: 23209 - protein, 186 aa, Pseudomonas aeruginosa
LGRTQRLVGVAEVGVLPRQQRLQGLAQRLRPAVATGHGLRRRSRQAVEVTPPVVPYHFGEQFALVGFQVLGEQAAAVEGVLAQHPVAPTVDGRYRGLVHPLRGQAQQARAARPALGGILLAQRDQQAVVALLRLGETTRRFAQAAADTLAEFLGRRIGEGHHEDFRRAQRPAESVLAAMVEDQAYV

SEQ ID NO: 23210 - protein, 1027 aa, Pseudomonas aeruginosa
TLEGEVLQPVAHQAVPLEAAPFMELAAEQLQARQAPGSVATQAAEPVLQLQPGRMAMAQLLLLLDRLRPALDFLAVAPEQVGQRLQQMARGELAERRQRQATLSPQSLDLGLQLRRQALGIPVPLDPALHAFGQLELQLPVVQRVQFERFFVVAGQLLVVETHLEPLLEERIHRVGEELRQRSQPQCALQFKRRQGRFGVGNGDVVLAMDLAPLAGVGEQAIDALLRRIVKIPTAERLQRMLLGQGTQQRLAVAVRVQTPAGRQVIAQLADQHRGRPLAIVADTPPHPAHVELLARREQRLEQQVAVVLAPRAVAGAVVVAHQVEIQRRLLAGVVAIVHAKQADQPERDRAHRHQRAETHRASQEALVQAALVQAAEPGLAYHADRQRLGEGRTGAVLLPALEQLQELGEEQLVALVVGLEEHREQGLQALAPLRRGGRFGQLGVGHLEALQQHSQRACQGGVQATDLIVGLDALQGRAFADRVAEQHAPQTEAPTVALQSRWQAETLALRGIQPPAHAGAFDPAVQGRQVGLVDAETPAQCRDVQQVEDLAHGETAVGQFQQVLQGDQQRLATALSLVGQGIGNEALVVARHLAEHRLDVRRVGVDVGDHDDHVARLQARIGVEAGEQLVVEDLHFALRAVGHMEADRGVAPRRHRRPVLAGFRQWAQFEDIVLQLAEQPVRGLLAEQVDAPAVDLAEQVPIAVRVVVAVEQVDVVAALLAPGRQQRLGMLVLAVLVEVGGDAGAALLAAVLVAQQVLVGDDVGPVVATGVVHAEQHLAEPGQGGQRLEGLRRHRGNPEHHHSSRQRARRRAGGAQRLDEAPVHAGAAAGQAIGTDVGEQRAPQFGLPALVGTERARLPVRRAQLVAALAPVVEPVAAIDLVLVEQVGQALGQLMTLAQVGIVGEETLQGAELGTLQQSGKQTHQAPGQRRLVQFGNLGNAFAGPAPRDRPARGTAPATAPPAPRRCRHRRRRPRGDLRPMPASTIGRCRCCAPGPARFPAAPADSGASRKRRGRAGRPGDCRGRS

SEQ ID NO: 23211 - protein, 478 aa, Pseudomonas aeruginosa
DRAMFSTPGDCGTGSPPVSRSSTGQPRSATAALAGANPSRRSIRRGMTSARSQGCQSNRPCSRAPPHTSSSRARSASSPSCTENTSTTILPLPGWHGSAPTRGALPMIASGGASVRRNREEVAGKSAGCRAQTGRAALPELGQQDPGQGQRAADQVMDGQALAEHQGGDAGGDDRQQVEEQGHPARPETGDTVHPGQRGDDRGEQRGVQHQRQVGGVQAGARRQQVQRQQGEDRHQHLQVEQLHGRQLQAPFLQQHAVHRIGQGGDDHHRVAEIHSMLQQSAEMALGDHQHHAGQRHQRAEQRPGVQPVGQDAAGQAQRHQGHQRQDDAHVGGAGQRRRVVGQALVDGHAEQAEDHELAEVGEDVAAVAQHRAEHEGRQRQADQQPAEETDLGGLDDPHGELVDDGVAGPDEHGQQGKQVLHGRFRTMKKEYAAILSQSEYRRIMNSRQTTRRFGHVDHHLAAPSRSPGAVFRRLFPL

SEQ ID NO: 23212 - protein, 720 aa, Pseudomonas aeruginosa
RVRRRHPFAAAHPRLGPAQLCSPWRDAAGDRRPALPLASAIRGMDTTGAGAQLLQQPGHRLPLAVPFRRAVTTPAGDTLHPGDQRDPQGDPLGLRRARGQPADLGAGPAPGPGRHGPAGMRPAPRRLPALRPYPGAARGARRTAGRAGRQPLAGAMGAAGAQHRANPGPALPARTGHDLRRMAPTPALPRGHRGAGSRQGDPADRLRPRLQQPLGVHLDVPPAGRHHTGTIPPGQPRPGHADAVTRRACVAAMLAAATIRSSHANRQPPSRHRPRGVPRLPQAGLQRLRRAHRPPRLFPRRVRPPPRLAERKQLRRPGRPLPVPSRPRQQPGRHGPRPGPRRLSRRPRRLARFHPALGVATGALRSRPGTLGRAVARGRAAWPEDRRGGGGGPGGLGHGTQPVPGSPAPDADGAVLRERAGLAHCLDPSRGDRRCRPGRPRPVENGSSGRPRAAADRHWLPRRAAVPHPVRRAAGLPAASRAPLAGTLAAPARCVLPGWLAGIRRWPCGAAAAAGGSGTQGLGRRRYLPRRLRGRPGGTGPALHLRRVPRRSLGPGAERMERRAAVPAGDLPAVVPAGRRCLAILGTPAPRTPGTGNAGRGQRGGGRPAAGGAVPAALDRRHPAPGRLRPAALRPAGPARLEDAALASGARLRRDRRPDRHSRLAIQGQAQPLRRRRGRLARLRALRPVAEAQAAPVLAVDEDRHRKIVHQLAGVTGVGL

SEQ ID NO: 23213 - protein, 482 aa, Pseudomonas aeruginosa
QQRLLVAAAANPGAVVEQALAAAAQRVRLRVAAGRMGEGAIVGGHVAFGGTGDGEYQVAVALQQLLLDARQDLVGVAVEAGPVLGRLGIGQRLVAAVEQVVEVDAPAAHVLLEASGDSRRALPGEVVDRLVVGVQADLGEALADHLGLVLQLAGSFAEAQGLFLAGAEVAAHLLDRGEQAGELAAVDLGALGDLGNLAFHPGRQFGNAFQLPTGQLDLADPFPQLFGKLADLLDHLAGLALDLGDHLADFLGGLGGTSGQAAHLFGNHREAAPMLAGAGRLDGRVEGQQVGLAGDALDHQGDPLDVLAALVQRLDRLAAGAHPLAEPMHALDGRGQQHLAFVAAGARPGGGVHGLARQIGGGALGVDHHFGAADDLFGGVELGLQLLRQALHRERHAGGRQGVLAGVMGQVASQPGDVGLADGRHRRAVAGKQPGQPEQRHAERQGQVQRQPAMPGADQQENQGQALQQADEEDAGTSGLHE

SEQ ID NO: 23214 - protein, 493 aa, Pseudomonas aeruginosa
PVSHMFDLFSGLDAWVGISLVLALAFVLTFEFINGFHDTANAVATVIYTKAMSPYRAVMLSGVFNFLGVLLGGVGVAYAIVHLLPVELLINVNTGHGLAMVFSLLAAAIAWNLGTWYFGIPASSSHTLIGSILGVGLANALITDVPLAEGINWQKAIDIGLSLIFSPLAGFMVAALVLLGLKWWRPLSKMHKTPETRRELDEKKHPPFWNRLVLVLSAMAVSFVHGSNDGQKGIGLIMLVLIGIVPAKFVLDLNSTTYQIERTRDAALHLSQLYQRHTDTLGDMLALGKSNGSEMPQFYRCDPKQTEPTINALLRDLRGVPSYNDLDADERVQVRRYLLCLDDTAKKVGKLSDLPAREKADLEKLRKDLTATTEYAPFWVIIAVALALGIGTMVGWKRVVLTVGEKIGKQGMTYAQGMSAQITAAAAIGMANIYSLPVSTTHVLSSGVAGTMVANKSGLHGGTVRNILMAWVLTLPTSMALSAGLFWLASQFI

SEQ ID NO: 23215 - protein, 219 aa, Pseudomonas aeruginosa
SAVPAPRWRPPAANPADARARRWRLPPPATRRAGDRPGAPGWSRGYRRRSGSRRSAPGRRYSDRSAPANPPPGPGSVPRSRRYAVPPGAARSRPATGPPPRWAGPGHRAAAWLRRRASASCPGHRRGDSGSSPGPRKATRGHGRKRPPGRPDAPVRRAPANSVPASRGRAGCSRFRCRTPAPGAPARPAGRRSPPARCRSGCAAARGPPVPVPPGAGLR

SEQ ID NO: 23216 - protein, 171 aa, Pseudomonas aeruginosa
CRAARRTAPARCRAPAVDPRCAASGARRGYPADAGKGPGPAPGRCAGWHAGAGRVRRRPPVAAGPAGVPAAPDDTRRPTPGCRARPAPVRRVPAPPSNATSRRRSSSCNSPSLRELSCCSWSSQRSATWFASSSARYCQSCGAGPWASCSSDIGRTSNAPRRPPRIAAGTR

SEQ ID NO: 23217 - protein, 791 aa, Pseudomonas aeruginosa
CICTTAHSWRWPCRLRRCSRAAERWCTDRRDGPADLLDQQFRPADIDLQNLRVDVSKLYPQQGQDQIQDRRQQPIDQRCHHGIHDEVGERRRAAQQRQAQSEHHGIDVDAGFQGTGEKAAFRQPAALDEIGTVGFHVESRIARAAGDRGIELEIQSHQAAKHQNRADLIDVGRTADLYRRSAASPTEFQRGIRAGTGHAFQPDGSRRAFDGQLQFRGGENGQEPGIDVRRKSYLGLAHLRAPGTALILPWRPGDDPLRLYDREPCIGQSRDTQVHGDRGILVGDLGNRHDEIQRIDRRIQLRHAVHLAGAQPQQVSQFQRGRLYPHQLRSQGLDRGYAVLRQDVHAGGEYLLQADVGIQQLFDGPQAGIDPDQAHSIRAENVQHTELRVGDTVVGRRREIDVGAQQSAQDGVEQRRLATVHARQPRACGNRGVRQASRHSLCAEIDVGIAAAEQSPEVGDQAAGNALGHLDMHRLVGGSRVRRAGYETAQAAGTQHAADLRRQAGAGGVRIEPVEHRAGLGERRRLGRTLVAAQGSLGGTLQRRHVRHSLQVALLQVEPPGIHHQQQADQGQQQGGRRQDADRPALSCRPSVHALPLRQEPSVLALAEAAIFQQVLGNLVLIAFQVALVGTLALGGGRALPNRAGGPAARLDGQPGAGGGLRFGRRWRGRTDRRRVRGPGRAGQEQQDAEQDSLVHGSPLRRRLRAPRWPSRYAYSPPPAVPPAGRRLPAPRRVSVRHPSCAPAPRPRGCPGHPAANARSGAAHLPGRLAGTAGRAGWSPAACHPAATPAQ

SEQ ID NO: 23218 - protein, 136 aa, Pseudomonas aeruginosa
RCRAAAPRHSPLPASARRPACARRAGCAPPGRGNAASAGSFASGGAGRACPGRRGRTAPPVAGRLARRWCRTGPIRSRPAAARALPPRTTTGAGAGYRRDASGEPASDCCAAAPRPPPGVPAAVQPPVRCARRASP

SEQ ID NO: 23219 - protein, 512 aa, Pseudomonas aeruginosa
TAPAVARRSQQRLAEFLPDRRGLADELPATAPVETEQGIGDVHAVAHLQHLQHFADATPTAGQAGDLHHHVQRGADHQAQGLLRQPVAGQADQHLHAQQRIHRRVGVHRAHRAVVAGVHRLQHVEYLDAADLAEDDPVRTHPQGVADQVAGGHLAVALGVRRTGLQTHHVVVAELQLGGVLDGDDPLAFVDEAADDVEQGGLAGAGAATDEDVAAARDRLAEELEQGFVDALVGQQVGTAQQLLAELADRDARPVQRHRGNDRVDPAAVRQARVDHRAGLVQASAEGREDTLDHPQHMVVVDEAQVALVEPPFPLDEHPARPVDEDFRDAGIAQEDLQRAEAGEFIDHLFGQAVQFVAGDRQLMARAVFADFFRDVLDHGGARALQQVHAVFVDLVDDVAVQAQLQRLDVLLLAGVEGTAVRTRAESRAHSSAALARPSQDSSERRSPRVTHRLSASCRSLAANGSRGATSNRLLPRFFARRRDSGDNGRTPNRSRSNIRLRACWSGATLGR

SEQ ID NO: 23220 - protein, 435 aa, Pseudomonas aeruginosa
SDRPVSFCWPSYSPRSKKYRRENPGSYCRRPSPGQVRQLCVCGPRLDQVRGDDHQQLAVVLVHLGRAEGTHRRSGCRPSQGKLVHVAHRVAAGQPADHETFAVGQHHAGVGAPDAQRRHRHPAVLDAGAVVQFADLRRHLESNAAVVHHRRGEGQADAELLVFDGDVVVGAVRHRDRKLAAGEERRALPAHRHQARARQGIGEAAALQGIHEAQPLAAAEDQVESRAAGAEGAAQAAAVGIDLDIAEAARRTEHPEVAAAADERGAGLLQLAAADLDEADIGLHLVRQLLHGADGERWSTAGIDATASLDLHQAAQRLGTAAGPDQQAGGALFLAGDQEAATIQQLYVGDLRIADGQPFDRHRQAQVTLLSLDDVDPRRLRQQLDAALRQSQCRQRQRHPQQPSQPARHAYPGAPMHMPAPLKALHGSWRCHGRP

SEQ ID NO: 23221 - protein, 310 aa, Pseudomonas aeruginosa
PRWPPARAEPRCARSAPSVCGAPAVGRDSAPRSARPATLAAARLPAPCGRVLRPCCGWPGAANRPGSPASAAPRRPPVPPAPRYAADAGPFPGSSGPVHRCPRRSARRRSVPGRQATPVAPAGSIRRPARHARRASRRHSRRAGRSRRRRPRRPQRSPSPARPDGWSGPADRRVRGSRRKECCRPAPRPRPACRATPRACRSYRPVRSATARRSGRPCRSPPAPGDRDWPPAPACVRAFPAKRPPSPKPAPRMERARSMARGRWIRRGIRATPHRAAAGRPGPSAPCYSWADPCYASGQVDERKITGDRR

SEQ ID NO: 23222 - protein, 304 aa, Pseudomonas aeruginosa
RLPTARGRAHGHGKLPRGNRHPDRQQHPELAGRPHAPGGRPGLATGAARPARRGEYRKATGTARLQPQFRVGLSWRGGQRHLHHAPLRRHAGRLRPTYPRLVQGRAGGRPADRHRTFRRCRHRRADPRHVAAGAARRSTAGRRRRRHEAGDPDRDPQFPEVRRCRLRLPGQRRRQDPPPPRLRAGPEDPRRSLSQRRTEHRPRGPRGGTRRSQPVRFLHPGEGTARRDLVRRPGPRPRHRLFDAQRIPHFGDRRHADRGGRHHASPRHADPRTDATAHRHGPRHAGHRPGRRRPDQAPEGHQQR

SEQ ID NO: 23223 - protein, 209 aa, Pseudomonas aeruginosa
IRYVGQCLQPLRRAYPRIDPRGRRHRSPTARCGATGGERLELLDGQLRRAVQPHQQRRSSDQRTRRRRPGNRPQRRRCLAPRLRRQPPGRGRQAGGRADHPRDERAFREDQRLLCQHRGPQQPHGEHRPDPRSDQGHLRADQPARPQRRHRSRARRRGRTRLRGGRRRGAQPGPPCPGVGPADPEDDRGTADRRPGSGQYHDRESALQP

SEQ ID NO: 23224 - protein, 142 aa, Pseudomonas aeruginosa
TFGASCTRRLASSRWMRPRPSGSGRRMSSSCRAGSPKKASAPCCSRVARRRSSACPEAPVNSARSSPRISGLSFRWLSSAFRSFRSSSSRPSRSATWKAANSAACWLSVNSRRLASSSGPISLMVVRNGWPVFPAMSQSVVG

SEQ ID NO: 23225 - protein, 62 aa, Pseudomonas aeruginosa
FSHGMLAIRSATLPCGLPGAAMPHRSPLMSAANTATPASLKDSARCCKVTVLPVPVAPAINP

SEQ ID NO: 23226 - protein, 372 aa, Pseudomonas aeruginosa
NHSSVALKLPDLPPTDTASLAVAIQLGLFTTARPRLPDARNHDQKSQVQPQDPARRRAGGDRDLLPVHPLQRLPAACLDPRGPGGLPARNGRDHRQQRAELAERAHPADREPGPDPGPRPQPGDHPGPAGTAAAGLDLPLHLPGADRRHLHRAPHQRPAGRLRPAPPPLVQRRHQRRPDHPHRTLHGAGHPRAGTDHRQPGAPGRPAIRRGRRRPQPADGGEDHQLAGLRRHGLRLPGQRRRQDPRPSGQGPGHEEPQRRLPTQHAEDRQRLQRGRAARQHPDPQFLSGQGPVRPGLVHRHLGGQGQGLCHAHQAAYLGDRRRADRGGRHRPPPRHADPRTDATAHRHGPRHAGHRPGRRRPDQAPEGHQQR

SEQ ID NO: 23227 - protein, 209 aa, Pseudomonas aeruginosa
IRYVGQCLQPLRRAYPRIDPRGRRHRSPTARCGATGGERLELLDGQLRRAVQPHQQRRRGDQRTRRRRPGNRPQRRRCLAPRLRRQPPGRRRQAGGRADHPRDERAFREDQRLLRQHRGPQQPHGEHRPDPRSDQGHLRADQPARPQRRHRSRARRRSRTRLRSGRRRGAQPGPPRPGVGPADPEDDRGTADRRPGSGQYHDRESALQP

SEQ ID NO: 23228 - protein, 388 aa, Pseudomonas aeruginosa
PRSTGWSATSPWTTRHESRLVTAVRFDRCLADSAGARRQRHVPALARLPAGQSAADVRHDRGLLVHQRPAPAPAARRACRQARAIAERRHHHGQRIRFLRHSGRQRRAVDPDGAAGPARPAPGTDQRGVRGRPVGRPDVLPLRPRRDPDLCPQPFAEPEHGIEPDLQRGIPGRPVRRRGNADPLPAPGNPLQRAGSGAARRVIAQAPALGPQDPAFPHCPARQPAPAETTPAGGLPSQQYALAAALQRARSDPARPGSGYPVGLDLPDPDGLAQRRTALADPRRRRRHRADLGGPAGPHDRQVDGGGGHRHLASGDLLFLPRRRRPGVRRARRTPAAEEADQQSRGFFLSVSSASASPVSLALSWIRRQSSAAPGNSVPSSSPRASMS

SEQ ID NO: 23229 - protein, 357 aa, Pseudomonas aeruginosa
RLVQPSPRVGGGLAVPADLGSLMFVPPGAGPGRHSRGAGSVEHHRLVAVYQYAVFQVIAQSAREHQLFHVLAQPHHVFDVVAVSDPHHVLLDDRTGIQFLGHVMAGRADQLDPALRRLVIRLGADEGRQEAVVDVDHLVGVLAAQVRRQDLHVASQDDAVGAMFVDQPGNFIEGRLLVLRIDGNVEIRDAVPLDHAAQVVVVGDHAGNLAVQFAAVPAVQQIGQAMGLLAGHQHHALLHLGIGDPPFHGEFAGDRGESLAEAIQVERQRVGTDLVAHEEPAVIVVGMMAGFGDPAIVGGQEVTHLGNDPDPVGTGDHQPKSAHGYTPETSRKAAILAAWREKFSLGEGLSTGCCARE

SEQ ID NO: 23230 - protein, 260 aa, Pseudomonas aeruginosa
HSARTDARFTDKDSTMNDTSNPYATPASALQPTQAVPPVIGDYDFRIGDVISEAWAKIKGVKGILIGAFVVYSVVIQTITFILTLLFGGIGLMSEADPIAFAVGQMIASLVATAVGYPFFTGLTMIGIRRAADQPATFNEMFNYFGMLVPLLLTGLLMMLMVYVGFFLLIIPGLYLSVAYMLALPLVAERGLTPWQALETSRKAISRHWFKVFGLLLVLSLLMLVSMIPLFIGLIWTGPLFVVSMGILYRTIFGVRPLGN

SEQ ID NO: 23231 - protein, 185 aa, Pseudomonas aeruginosa
LSPTRPPDATERSRPPRRAHLPARRRGPRHPLPRGNAGRHRPAPAPRRRRPPGPGLYHRPLHPRPDHAGADARPGVPRQARRRPRPAADLRHDVVVHGPLRGAQPGPLARQADDGTARRPRRRHSGGLGRVAAAQPAALRRHPALRLRPRSALLPEPSGLQAPGRHRRRHPGGLPRTRTEPAQPA

SEQ ID NO: 23232 - protein, 147 aa, Pseudomonas aeruginosa
PLRWPGCPPLPPMPSRRPPPAPAKPSCRPSRPACCGRNSTANRPASRSGRSSTARRSRTARPLRAGASATRPRKRTAARRTKSGSRHSSRPWPTGCRSVTRRRSSKCCSGRCCSARCSCWSGATVNGCACSSATWACRNGPAAKRRR

SEQ ID NO: 23233 - protein, 596 aa, Pseudomonas aeruginosa
RRRPRDRSAAGGHRRRGRRARRQRAGLFRTDPPVPGKRALAGLHRLRSRLPPVRSAEPRLRLGQQRRRHPPVADAARQGPGHGAHRRLDLAEPQHRAVRQRLAALVPDPGQPGDPALPRRTRQPRHPARPPLPRGPGGSAAVVARRPVARRAAPGSLAAGGQPFAPATGGTPARRRRLPPPPARPRRLAARSATRHPAQGAASPPRFRTARRRRAMADPRAHDPPATQRHQPGHAPISGAAPFRCRLHPPGRPPAKPQECPMSEQTPEQPSTAPNPALQRQRASQLAQALRSELQKALIGQGAVIDDVLTALLAGGHVLVEGVPGLGKNLLVRALARCFDGGFARIQFTPDLMPSDVTGHAVYDLASEPFKLRKGPVFNHLLLADEINRAPAKTQAALLEVMQERQVTLEGRALPVPQPFMVLATQNPIEQEGTYPLPEAELDRFMLKLRIDYPAEAEEQTLVRQVTRSARSDMLDVANLRPLLKDKDVLALQRIASDLPIDDQVLDYAVRLARTTRNWPGLALGAGPRASIALVRCGRARALLRGGEFVVPDDIKGCALAVLRHRVRLSPELDIEGLSVDQVLQQLLDQVPAPRV

SEQ ID NO: 23234 - protein, 286 aa, Pseudomonas aeruginosa
LKGLTRLGCPSPWRQGDAMRFARRLVLLPLLSLLAACSPTTPLFVAQVTTGEVAEYKQMKSNRMTAAIEEEGDLLTYSAMAIRDNRSAEAEKLYLTGYDNRRYSAEVRGISLYQIGLIYMSRYNDQRDDAKATDYFQRVVREFPGTHAAEHAQARLLAMRQRAREPVQKSARELLATWKPQQNLDLYKTSLDPDMTLLSRRAVLKDRVDEAAELYLLAVNDPAIPAGIKEKALYQLGLMYLAPDNPHPNRDKAIEYLRRQLLDYPEGELSNKAGRHLDQALNVQPR

SEQ ID NO: 23235 - protein, 327 aa, Pseudomonas aeruginosa
PRSSARRGAWSAMAFPPNARSVAMNLHNLLVVVDPSSDEQPALSRAQWIAERSGASVELLLCDFNPALDGGLFFDSHSLQRARDLYLDERVTWLEQLSMPLQQAGIRTQVEAQWGKPLDRMVLQRVGETRPDLVLKSTRKHNLLRRLLLGNSDWQLIRHCPQPLWLVHHDAWRGQRLCAALDPLHASDKPAALDHRLIAAARQLEASLGLRADYLHTHAAMPRSLLFDAEMLAGYERFVLQHEERHRQAFDDLLAAYPEIAAERRHLLAGYAEQAIPDFVRANDIDLLLMGAVARGHLDNALIGQTAERVLEEVECDLLVLKPTNDI

SEQ ID NO: 23236 - protein, 151 aa, Pseudomonas aeruginosa
TAAGRRPGGDGGRGSRRRRTALPGADRRPAVRPQGHQPPRRRSHRAGADRQGQGRHQAGRGHGPGLRGRFLPARRQGHGIRPPPAHRGRRQGLAGSQDRARRGGRRRRRTRRPDSCQRRGNGGPWRPRRGNRRCRAGRHPEEDHPARPPQQ

SEQ ID NO: 23237 - protein, 1233 aa, Pseudomonas aeruginosa
LRQPAAKRRTGHRRAPGEISRSMKILAIRLKNLASLAGEQEIDFTREPLSSAGLFAITGPTGAGKSTVLDALCLALFGSTPRLESTSASSKVPDGRNELSSNDERNLLRRGCASGYAEVDFVGIDGHRYRARWETRRSRDKADGALQKSQQSLQDLETQQMLAANKKSEFREQLEQKLGLNFAQFTRAVLLAQSEFSAFLKASDNDRGALLEKLTDTGLYSQLSKAAYQRASQADEQRKQLEQRLEGSLPLAEQARAGLEAALESHAQARLQEQQALQRLEGQQQWFTEEQRLLQSCEHAQGQLAEARQAWDALATERETLQWLERLAPVRGLIERLKQLEQELRHSEQQQRQRTEQQAAGAERLQGLQARLQEARERQAQADNHLRQAQAPLREAFQLESEARRLERTLAERQELHRQSNQRHAQQSDAARQLDMQQQRHVAEQAQLQAALRDSQALAALGDAWATHQGQLAAFVQRRQRALESQAQLPELEKSLAHAGEPLERLQAQWTALHGSEPDDLAARLDELRRQTDSLERQQALHKEWQQALDQRTGLARRLGELDQRMVEQEQALLDLKRQGSQCAEEVKAAEQALQVTRELLQRQRLARSASVEQLRAGLVDGEACPVCGSQEHPYHHSEQLLAALGEHDDQEQVRAEQSLERLRQTLVGLREGYSSQRERLNQSRQEQQELTGQLAALDRQLDQWTLPEELRLLQPSAQLEWLAQRLDDLAGQRQQCQRDFDRLIARQRQTQQLQQELRAVETILQQRQQALTEQRQRYEHLQQQVEEDSQQLRPLLSDEHWQRWQADPLRTFQALGESIEQRRQQQARLQQIEQRLQELKQRCDESSWQLKQSDEQRNEARQAEERAQAELAELNGRLGAHLGQHACAQDWQLSLEHAAQAAQSAVETLQAPLDSLREEQLRLAEALEHLQQQRQRQQDEFQRLQADWQAWRERQDNLDDSRLDALLGLSEEQATQWREQLQRLQEEITRQQTLEAERQAQLLQHRRQRPETDREALEDNLRQQRERLAASEQAYLETYSQLQADNQRREQSQALLAELERARAEFRRWGRLNELIGSSSGDKFRRIAQGYNLDLLVQHSNVQLRQLARRYRLQRGGSELGLLVVDTEMGDELRSVYSLSGGETFLISLALALGLASMASSKLRIESLFIDEGFGSLDPESLQLAMDALDNLQAQGRKVAVISHVQEMHERIPVQVRVQREGNGMSSLKVVG

SEQ ID NO: 23238 - protein, 382 aa, Pseudomonas aeruginosa
ADRPGGTSERQLGLFTRSMRRLLFPFRPQMQHQPAEPAHLAPHCFLEHPGQAFHQAEPVAGAGDTGVHQLLGQHRVQRVRQDQRGMGELRTLRLVHGHGEHGVHLYQAARQDEAHAAATVVAREGHAQRKAQAAVVVALGQAQGDADIAVHQPQAVVVARHQYRPPLVPAVIGLDQAKAQQFRRYPLVQSFHAPWAAAQRAEQAEGVESRQYRLRPALPGAILQRQSGGRAALGQALQVVPVAVRRARRLRMTVDEQPGEGCIALPAQAQVEEVGGRTVQQRARVAGLLPVDQPRQAPDPAARAEAPGMPQHDGLLRQRMRLRRTFAQALPGFAADPLQPGAGLGAVPALLGIPAEIAEHRAGLYRGQLVLVAEQDQARLRR

SEQ ID NO: 23239 - protein, 216 aa, Pseudomonas aeruginosa
RIEQAGHHFQVDHRGLIHHQHVQRQRVVPVVAEVPGIRTATKQTVQGSDLGGDRLQHVFRQRQGPDLLADGFGETRRGLAGGRREADAQRLAGGYRRCLEQTEQAHHGGGLAGTGTAGDQAEIAAGRQGTGQLLPVGDALAVFRRRLREQRGQARRQVGGQGRLPTQALAQGQGDLQLVPPITTQVETLGAKHQRRGRRLARLGIAWALVDHLHQR

SEQ ID NO: 23240 - protein, 136 aa, Pseudomonas aeruginosa
ATSPARLVSPPGQRSGSARYCSSHRSSGSAQSFQPRRSQRRATSSRRRWASARATSKPSRPAHSSSPWRKVPGAGPRGKRCRSSRISLACATGGCSAERPSSGKVASSALIGSCDSSLSNTSSSSSPAEACNCRPE

SEQ ID NO: 23241 - protein, 144 aa, Pseudomonas aeruginosa
ARAACSLRRASSMTRPAAPSSWKLAGAPLLPSSSLQLQMKGSSTKGYSSPLDLWMVTTLIRSASLSRRRISSLPGLCTCSARWRISACSPSSSTAARCSHSARCSRLVRLRSPSACRSRRAGSSKSASRRRSIGNTPWACQDRR

SEQ ID NO: 23242 - protein, 140 aa, Pseudomonas aeruginosa
RQSRSGSGCSKWRAENSPNAASGRRPCRRSRSTWACNCAGRPSASQSRSTQRFMRSVSSNCSFQLSSASSSKGSSSLPVNCSSSKRTLSRCWKNAFTGLARNSASARSPSAPSSSSGGRDASASGTAMSSSLWTSRHSRA

SEQ ID NO: 23243 - protein, 97 aa, Pseudomonas aeruginosa
HCSGRRRRNRPRRPRRRPGRARGASRRSAGTAAGRRFRYGSARCRRAPAHRTGRCSARPAIAAPARRRYRAAAPASRVRRPLRWPARILPGAPSGAA

SEQ ID NO: 23244 - protein, 277 aa, Pseudomonas aeruginosa
TPDKPPVGSDMSTTTLLRLPDLQGQSFDVYFRYDEFGADTHSPPHTHAWGQLNYAAHGVMQLEIDGQRFLSPPQYAVWIPPERVHSCYNSQAIVYRSLYLSAELSRRLPATPCTLAISAILKAILSDFAERGVNLPTSAQDLRLARVVMDQLECAQPHDDYLPYGRTPALREVLDALQAEPGDNRSLAQWAQQVHSTERTLARHCQRELGMTFGEWRQRLRFLAAIEALEAGRGIQQIAFDLGYSSPSAFISMFRRLAGTTPEQYRLASRAQDMPML

SEQ ID NO: 23245 - protein, 419 aa, Pseudomonas aeruginosa
PAVHALRLCSQQPPSGVRMPTASRHPDTALAVFLAFLKLGCSAFGGPIAHLGYFRDEFVRRRGWLSESSYADLVALCQFLPGPASSQVGMALGLARAGYPGALAAWLGFTLPSALLLVLFALGLGRWGALLPEGVLHGLKIAAVAVVAQAVWGMGRSLCPDRPRLTLMALSCASVLAWPTAWTQVAVIAGAGLAGLALLKTEAVEGHERLPIDIGYRGALLFLTLFAVLLVCLPLAARLWPEHWLRLLDAFYRAGSLVFGGGHVVLPLLQAEVVPKGWVDGDTFLAGYAAAQAVPGPLFTFAAFLGAASGPAPNGWSGALLCLLAIFLPSFLLVAGALPFWERLRHERRVRATLAGVNAAVVGLLLAALYQPLWTEGILRPADFALLLFALLALLAWKTPPWQVVLACAVTGGLIATAG

SEQ ID NO: 23246 - protein, 576 aa, Pseudomonas aeruginosa
ASRLTSARRSLITSAWFSNWLAASPRRRVCSSLALRSPRTCSTAANRLASWLRLISAPWAISVIWLSTPAASSAMPSSCRPVSSTWPTPSPNSSESWRICSTTSLVWRWISATIWPTSSVASAVRPARPRTSSATTAKPRPCSPARAASMAALRASRLVWLAMPWITRVTRWMSSLRWFSASIASRLAPIRSLSRCMRSMVEASSTWPSSLPARARVAASMAWRARLEVARSVWIITSALPTICSAASSWDCSFSARRFTENATPAADKAFWLVLWDRSRASRAMSGSPTVATAVRLPGSSQGNQSSATPSGRARYSGSQPCRAPTSRRTRARLCNRQTKRMRERAGCMSKSPASGALRHDPGVGRATAGLLYLTCSPVCSPPPEAPPSFLSGMANGWHSTSAGRDERRRTPRTRRPGLDPWGLRRISRGRSKNFRPAVRRPTPYDKPGAHVIIPRPFTAGSGRLDSQPALAGPRFRPAWSLSGPLFLDSGPPVTKDELRAALAREEQRYKDVYGGEVTLYAAQPEPDRKPWRKRPTVQEQAFDRELQKIEEERLKAGQEAANPIPFTSNRQESDG

SEQ ID NO: 23247 - protein, 790 aa, Pseudomonas aeruginosa
WPGYSPCRLRWRCPPACSGWPRNSSEPPRRLKKRLLVRRRFFAALPPTSSARLGGRRQRQANHEQRTLPLVGRRQATAHVAHQIVADRETQAGTLALRLGGEEGFEYPLQQERFDPTAVVVHVQFDPARFAASHLLQANTPAGQAGIAKQGIAGVGEQVDDHLFQLVRLPSHHHPLRRRRALHLDGVLTQPLAEQAQGAFEGGIGVERQRLQRRLAAEHAEVADQAVDAQDLGIHALQFLAQVVAVEADAVHPLAHVEEGHAQHVQRLLHLVGEAADHLPQAGHLGALRQLLLGPTHRRVVASHRLYLAQFAPGVEQRSLGPHQPEKTLPRQVEAQFRHLAGALPRRTQQTRAQGAGVFRRQPLVEPATDQALRAGREAIGEGPVHVGQHQVGGIATDQRRRILHQDPVAFLALGDTLCRQVLLGHVQPQAHRLAGQALGIAQQLGFVVEPVPVALAIGEAIAGLHPALAKQLAATGEKGLQVVRMHPFGERLPTLSLQVEAEQVARAFAVELRHQVPLLDPLDVDHHRRAVDQAAQPRVGRLCPFLLAPAFADVEQHAGQPQRAAAPQRSTLDAQPAALAAAIRLTQAKVLGQRLAAAQAGTQAQAEFVGVRRLQQALQVFQRHPTILAGQPQAVVQGRRQFEEFLLRPVTPPAAADHLPATAPACANCRAARGVRSGPPPGSPAVPRGIASPAARAPGRAAPATSAGPATPPGGHRASPPAPGRARPRRSAGAASRRLRHGVASARPPLRAGRRRRVAGSVAANCRCQAAHDWRRPCRNPCRRPAAGR

SEQ ID NO: 23248 - protein, 160 aa, Pseudomonas aeruginosa
GRRCPCPAAASVPGRRAAASAGNDRSMARRHRCAASGRDARPGAGRPASAHRGRAAPDTRRKAAAVRQAHGRTADDTPAARRPGSRGPVRPSRNTGPNSSAKRSRGRGLPAKRVPASRPRRTTSGKIRTCDHLTATGWHSPSASAAGWESRRCRGSSARG

SEQ ID NO: 23249 - protein, 268 aa, Pseudomonas aeruginosa
TPGDLGTPRTAGKQWLPLRNQHPPGVGDRQLPGRPEHRPGHLRPLPGARQRYPPDREPQGSRRQRQVLRIDHPHRSRWPPGSDRGHAGRRRRLLPETGGAAGTAAWPRTPGEPPARARPQPVEPEPRQPAPGIPRRIAELDLPRHPQDQVRGTRQQPAECPQERRQPAVRAAGVGRGKPGVPEQSAVRQAVAPPAGGGAAGEQGPDQLPDRLRTGHHREHGEAVRLPGAAPDAYAQPHTAGAGPVACGDAAGQRSGGALTGAMARRTC

SEQ ID NO: 23250 - protein, 822 aa, Pseudomonas aeruginosa
ARWRSAAVALCRTGLAARPLAWMASQARVAVCGSAVAGAAGRTAGVSAAQAVPDRSSKTPNRIRSCMVHLSGAGSGRLVGHRGMHIRLRRQFRQRVVACRRRAGCRYGTPAARPRLGRADVPGIQLQTLDQALRIFPVALQVQQAEQVGRRQLATLLQLQRSDEFEARADTVAALEQGDPQVVAEAALGRPQARRLAQLEDRPGAVAIAQGEQAEAVVRLGCLAGFQQGLVLGPGPRVADPAQDQRPFFAHVEQPRRHAFQVGQGRMQAALADHVADHVHLQFLLLAELLRTLPWAVPPRQRGATAEQGGAQADADQCFHPSPPKALVMAMTPGPARTISSAGNSSTIITRLIFADSLPMRSCKVVRRRSSNSCLSVSRVLRALPPWRNICRSTPQQSFSGSTCRRRASASSSSARSMPLSARVSARSSSRASCGVIPRPSRQTTRSVCSTVRPASKRMRISCTNRIISSAISARRALAKWLEHLLGQEETDAGGEQQRHRVGRFAFGAQQLDQQDQENEQQRREEHRDQVQGPVATLVPAGLLQQLAGLAVHQLQAPHPEAVVHPLGHAGQPPGRAARVGQRSQAPLDQALLAAAVARLEQQQQGTADRHQERRENQPLCLHGHLLDALEHAPQRIAAEQLQPERGQQQETPGAVGPHVQQIARVARQDVAAQGARHAGQDIGADPCLAGHRVQLPAELLALVDELDDAVQQVAGIAAITVVDRDAQGEDAQLLNLVEFGDFLQRLRQVDAEKHVVARQGEDVAQRLLGILHCLHQRVAQRAPGVQAAHHLVEETRHLPDHSLQAALVEHAQGDAAGQRRQ

SEQ ID NO: 23251 - protein, 593 aa, Pseudomonas aeruginosa
AKPLPSRAFMKLNHLPPPKIRLNPELPVPKVPPRPLPSALTLISPRLPGAPSTQRLPPRRTNEVLACFSLLRLTSTKRISVCTWFGSSSTAPTVNAGAPRVSTLPRPSTSTRLRNGSGLQPVQISRLVEPCSLPVTRKPRRSSNCTSAIFGSPMASRSIGTARRRSRCCPWTTSTRGACASNSMQPCGKASAGSANATPSSPPSQRDTPIPVLRCICRLPSRHFMGHGAATVDRDPVGHRHARSRAAHARRRRFAALQQLVETQRRARRAQRRLQQRAFLLPAVEFFVLAADGQAQRTGLARQHQPRHAVLRYRQHRGTRRTRVLFLVRAVLSIAAHGDPLAVGQYPDARQHQLRQRGRFAVPLVTHEEHHVDIVAGQDEAAAADHVVHSDRHRPLVRTDGPGQRTAGFEGRGGKNAAGRHRDPDPLAEQRLGPVVATDRCGPQQLDAQVVLADHRQRREIATGHQHRLAFELFQRSVHRRRSRRHGWSVRVRWRAADGYAEVSEQHRTEQQQAGQGHQHLAIHGQTPAMRPDRSMNGKSPAIADDRKRKTGVSLSVSWPYSGTGFPWQVHWGYRLATVVIQEPKFITSNLRR

SEQ ID NO: 23252 - protein, 640 aa, Pseudomonas aeruginosa
GFCQDASLMLRSLSFAKKILLAAALVVVFAFTCFILYNDYRQREAVRTDTENYLGEIGTLTASNIQSWLEGRMHLVEGLASQLALLDQPDEANIARQLEQPVFSRNFASVYLGEAASGTFTMRPYDAMPEGYDPRTRAWYKDALAADRLIVTEPFVDAGTGEQILAMSLPVRHAGQLLGVAAGDMKLETLTAILNSLKFDGAGYAFLVSDAGKILLHPDSGLVLKTLAEAYPKGAPNIVPGVHEVELDGRSQFVSFTPVKGLPGVTWYVALVLDRDTAYSMLSEFRTSAIVATLIAVVGIMLLLGMLIRVLMQPLTDMGRAMQDIAQGEGDLTKRLKVTSNDEFGTLANAFNRFVERIHESIREVAGTARQLHDVAQLVVNASNSSMANSDEQSNRTNSVAAAINELGAAAQEIARNAADASHHASDANHQAEDGKQVVEQTIRAMNELSEKISASCANIEALNSRTVNIGQILEVIKGISEQTNLLALNAAIEAARAGEAGRGFAVVADEVRNLAHRAQESAQQIQKMIEELQIGAQEAVSTMTESQRYSLESVEIANRAGERLGSVTSRIGEIDSMNQSVATATEEQTAVVDSLNMDITEINTLNQEGVENLQATLRACGELETQAGRLRHLVDSFKI

SEQ ID NO: 23253 - protein, 201 aa, Pseudomonas aeruginosa
ARPSHRPANREAVSRRSSSPHEKGARGRLFHGLALSAASSRPSTSRAGHAPAPGSTGWPPGAWRSSPSNWTAGCRESARPCRRRRTSFPAEQSPGPGPRAWRPPCSPAPRRPTRDRSAGRSDPSTATAGPVQRARCRSAGRSANRAAPPRRAGPWPACPFPPGCRPTPRRYPVRSAPPGCRTPGSGGNRRPPRAAISAPWR

SEQ ID NO: 23254 - protein, 342 aa, Pseudomonas aeruginosa
IRSARRCLQPVRRAYPSLDPGSRRDRAQTARRLATGGERLELFDGQLRRAVQPHQQRRRGDQRTRRRRPGNRPQRRRCLAPCVRRQPPGRGRQTGGRADHPRDERAFREDQRLLRQHRGPQQPHGEHRPDPRSDQGHLRADQPARPQRRHRSRARRRGRTRLRSGRRRGAQPGPSRPGVGPADPEDDRRAASRRPRGGGHHDREPALQPGERGDRQPCRRKPEQRDPADRRDRRDEPVGGHRHRGADRGGRLAEHGHHRDQHPQPGRRGEPPGHPARLWRAGNPGRAPAPTGGQLQDLRPAGLVAEPADNRDAVIRPADEKRPRALFFVLQVAFGETIHPLR

SEQ ID NO: 23255 - protein, 663 aa, Pseudomonas aeruginosa
SFRTCRRQTRQALQLRSNWGCSRQRARASRMQETMIKSLKFSHKILLAAALVVIATFSLFTLYNDSLQRASIREDLEDYLHEMGEITASNVQNWLSGRILLIENLAQTLARDHSPETTQALLEQPLLGSTFLFTYLGQTDGTYTARPTSDLPADYDPRRRPWYNAATSAGQTTLTEPYMEPAIHELVLTIASPARQGGQPFGVVGGDLSLQTVVKIINSLDFGGMGYAFLVSGDGKILVHPDKDQVMKSLSDVYPRNTPKIGSGFSEAELHGNTRILSFSPVKGLSGLDWYIGISVDKDKAYAMLTKLRTSAIVAALIAVVAIVLLLGMLIRVLMQPLTDMGRAMQDIAQGEGDLTKRLKVTSNDEFGTLANAFNRFVERIHESIREVAGTARQLHDVAQLVVNASNSSMANSDEQSNRTNSVAAAINELGAAAQEIARNAADASHHASDANHQAEDGKQVVEQTIRAMNELSEKISASCANIEALNSRTVNIGQILEVIKGISEQTNLLALNAAIEAARAGEAGRGFAVVADEVRNLAHRAQESAQQIQKMIEELQIGAQEAVSTMTESQRYSLESVEIANRAGERLSSVTGRIAEIDGMNQSVATATEEQTAVVDSLNMDITEINTLNQEGVENLQATLRACGELETQAGRLRQLVDSFKI

SEQ ID NO: 23256 - protein, 403 aa, Pseudomonas aeruginosa
SYPRLPHTVRTTAGAGGPLSGRRNKLNGGRPIVHIADMTMFYAPASGGVRTYLEAKHRHLWHYPGIRHSVLVPGASYRQANGIHEVPAPPLPFGNGYRFPLRRGPWRKVLRNLQPDLIEVGDPYLTAWAALDARRRLDVPVIGFYHSDLPLLVSNRMGAWLGTNADNYVSKLYGHFDRVLAPSRVMAEKLMRLGVADVHVQPLGVDLVTFHPSNRDPGLRQELGLDEETRLLVFAGRGSREKNLPVLLDAIQRLGDGYHLLLVGSNMPTRVPRNTSVVDHFCDSREVARLLASSDALLHAGDQETFGLVALEAMASGIPVVAVRAGALAEIVPERCGVLCAPNNGDAMACAVRELFSHDVELRGQRARRHVERQHAWDAVVAGLLLHYHAVLGDSEARFPRYG

SEQ ID NO: 23257 - protein, 506 aa, Pseudomonas aeruginosa
RPTTAYSRAILHASHLHLGGRVLCPRPRRGQGPPGRRHRAVPPPRMAAARFRRAGLADERRHPPGARRERAALHQRPVQPVSASPPATDRGPRPGLERAQCLASRPLLGAQRAAPPGLALSAGDPSRTPSGRHAPSLFPRILAAYPAHPAVRGAPAVDQDRLAGAPPRLGPRGMSRGWLLLFGLIGASLIPLVLGGSDMFPRLRAFPLDSLLLMFGMIVVCWFINGLRLRLLLAGRAGKLGQLQSVGIIMASEFAFCATPGGSGGPLTLMALLARRGLRPAQTSAVFAVDQLADLTFFLCALGAILIYALSHSLSPNMESSLIFSAVFLVGLFVGAVMLIRYLHQVIRFNGRVLARLGVSSRKRLHWGRKILHFRIALHDSLRLPKRRLLAVFLLSSTHWLLRFSVLDLTLRGLGVDIQWAWTFLIQMVSLSAGQLSLIPGGAGGTELTSAALLAPMIGKSTAAAAIVIWRAVTFYFYLVAGGPVFAVLAGRPLLKKLISSREASS

SEQ ID NO: 23258 - protein, 144 aa, Pseudomonas aeruginosa
LLLNLLTCPPPPLSTDKVPDMSLINEYRATEEAIKELQERLKSLEQDDKLKKELEFEEKLRTLMGTYQKSLRDVISLLDPDAKIGKSTRTAKAPAGKRARKVKQYKNPHTGEVIETKGGNHKTLKEWKAKWGPEAVESWATLLG

SEQ ID NO: 23259 - protein, 378 aa, Pseudomonas aeruginosa
RCQFVRPDGLMLAQQLGFSLALLEFDAGSLAILGAQYRQRRHHRATVDLDLLQRHRQLALGQFVATGIQAPAQVFGRQLQQRRGIGAEVADDQSIAVARVPGQRQDHREEMALRGKASGDMHQRLQQAHLVEHLVLAAQLVEVIVQARLALTDQAGQGNGGADIGKRVVGLPMLQAVRRGEHFQLQRQPAVQLRPLDALRAQGIGGTDHVDQVPAAIAALPLAGVGIEEVAVQAVARHFVVEAQGVVAGHAGRRLRQLGVYPGHEVGLGQPPLGQPLGSDAGDQASHRVGQDIVAGTAIQVHRLADLVQRLVRADPGDLQRPVAARVDAGGFVVVPKNTRVHGHSLSGGTGQSTSDCREARDPLRGFPGFPTNSRKAP

SEQ ID NO: 23260 - protein, 304 aa, Pseudomonas aeruginosa
SGPARCSSSPWVFSTAPSSAFARWATEVQTGPSRRPGCLMTPRWLASDFPRHGPPMPPNAAARLVAPTSRPGAEVLDTHYHVETPEGIDLLLRPAGVVPRALAYTIDLCIRGLIMLVLMLGLAFLGKLGAGLGLLLTFVMTWWYMVLFEVLNQGRSPGKQMMGLRVVHDDGTPVGWAASLLRNLLRFADILPFGYALGLLCCLNHPAFKRLGDIAAGTLVVYREPELSRPSLPDVEPQLPPFPMSLEEQRAFLGFAERGAALSSARREELAGILAEPLGVEPVRAQAEINGIARGFLGLRQESA

SEQ ID NO: 23261 - protein, 266 aa, Pseudomonas aeruginosa
STSCSNWRCAATSSSTGTAATSAAASSASCSPACRAWSARNGAASPWPACCSTAAPWLMGLLVYHFPDLIYSVVSPDKVSEMESMYAPETTRLGPLGARDTSDDWEMFGFYIMNNIGIAFQTFASGVLLGLGSLFFLLFNGLMIGSVAGHLTQIGYVQTFWPFVIGHGAFELTAITFAGAAGLKLGWALLAPGRLTRGEALRLAARRSVQLIAGVIVLLLLAAFTEAYWSSISHFEPRVKYAVGAVLWLLVGSYFLFAGRSRHAPD

SEQ ID NO: 23262 - protein, 380 aa, Pseudomonas aeruginosa
RQRGDPPAQRLGSARPRHPPGASPCAPADGQLGVADPAAVRRAQPPAVAASDPGDPDLLVAQAGLRTAAAVHSLARPVRRYANPEAGPARLSRPAEEAVAGQPAVAPLQSDAQLRPAGPATGRARRGAPQPAPDRIVPAQRRRRDLADRGRRAPGNGALGRLRHASLPADPGAERDRLELAEPARPGSRRVALAGAPVEPALRPGAGSLGADLRGLRLHPLLEPAHRTGGLGHRAGVPPPAPASGRQRLCPAARPDRFAGLAARPFRLCRAGGRHQRRRSRAAARAGPPAAAETQQRTGRQADPGDRRRRAVQEQRDRYGLALRRQDREKGQPQGGRRAAQGILRGPGQLGAVPSRGAGHRSAALGAAVQRGVPAGLALP

SEQ ID NO: 23263 - protein, 493 aa, Pseudomonas aeruginosa
LPPAVEGLPYRGRGPASGRRTGATTAAAALQPTADRPMAGARLRPPAAGRRRSPAPLRRLAQPFRRGSQAMMSRRARFLLLAVLLLLAGLLAIFLASRLQPYTETIDLGPSPEARRNPYLAAELFLRKQGVTVSRADGLEVLKELPPSGHTLLLLGSRSGMTPGQARRLLQWSEQGGHLVLIAERLWDEDEKKSGDLLLDSLDIRQYLTEDFDDSQDRASEETADADADEGSVDDHATEAPPEDTAGEEEEPADSVPDYSALTRLYLENERSPAYIGFDPDYHLYDPQNHAYAWANSGDATHLLQMQHGKGLVTVLTDAWIWRNRNIEQYDNAWLLWYLTQDNQVTLLYRAERDSLATLLARHFPEALAAALLLLLAGLWRAGLRQGPLQPVASRSRRQLEEHLRAGADFLLRQRGHVALLHGLQRDILRRARRRHPGFEQLGVAEQWQILGRMTRLPPSAISQAMRPYPAQRLSAADFTRQVAHLQSLRNAL

SEQ ID NO: 23264 - protein, 568 aa, Pseudomonas aeruginosa
RTRTFSPCSGSPATCRSTTRSSTMPCAWPAPPATGRAWPSAPDLARRSPWSVAAGRGRCCAAASSWCRTTSRAVPWRSCAIGSGCLRSWTSRGCRWTRSCNSCSTRYRPPAYEAIARPAGAVRRAPAAGHRPGQPVGARPAVACATAYILVGGARRAAPARPAGRPVGAPPGGAEAEPPAQRQPAAGALERSASASAAHLSASGSPDPVRSPAGRHGFRVPAAGGRTAPGRKHRGRLPGAAAQPRSLRVSPLRAGTAQPAAPVAAAPLPGSTRRDPRLPGLRPPLRRRTDGGRPLAQPDRRTRRPAPRPRPGVPPVARIPRRRHPAPDRLEGHRSQTHADRPRIPGRTRPADPLPARLRPPHAQPGRRPVALRPCPQRQPAAGLRGPAPGRRGGRHDLRRRRPPASPAGQGQRPARRAAQHRLRPADQPASRRFPGSRAGGAVPPAAAGPGDPGNQPARRGRRRTARRGETPGPPAPGAGRQPARGSARHPAPRAGRPLRAGARLHRHHRLPECAQRPPREARGPRRASARCASQRTRAGADQPLPGLEARRRALTDQTDCGWRGKLK

SEQ ID NO: 23265 - protein, 536 aa, Pseudomonas aeruginosa
SGRPPNASWRRWNATCWCSNRQMTSDADSMTPQSPPSLAGGSLHASVIQGVLCMSVRRTKIVATLGPASNSPEVLEQLILAGIDVARLNFSHGTPDEHRARARLVRELAAKHGRFVALLGDLQGPKIRIAKFANKRIELQVGDKFRFSTSHARDAGTQEVVGIDYPDLVKDCGVGDELLLDDGRVVMVVEEVAADELRCRVLIGGPLSDHKGINRRGGGLTAPALTDKDKADIKLAADMDLDYVAVSFPRDAKDMEYARRLLTEAGGKAWLVAKIERAEAVADDDALDGLIRASDAVMVARGDLGVEIGDAELVGIQKKIILHARRNNKVVITATQMMESMIHSPMPTRAEVSDVANAVLDYTDAVMLSAESAAGEYPVEAVKAMARVCQGAEKHPTSQKSSHRLGQTFDRCDESIALASMYTANHFPGIKAIICLTESGFTPLIMSRIRSSVPIYAYSPHRETQARVAMFRGVETIPFDPAALPAEKVSQAAVDELLKRGVVTKGDWVILTKGDSYTAQGGTNTMKVLHVGDLLV

SEQ ID NO: 23266 - protein, 453 aa, Pseudomonas aeruginosa
  UNSURE (389),(443): Identity of amino acid at the above locations are unknown.
AHVAADNARGVIRPTDRSPAGPTWCRANNRYAVIRRFSRIAANNAWGVIHPTDRRSAGPTWCRAMKWTPPSYGVKRQTNGAATSPGGGVSMNLSRIGLDLAKQVFQVHGVDRHEHVVCRRQLKRAQVRDFFRQLPPCLVAMEACGSAHYWARELRELGHTVRLIAPQFVKPYVKGDKHDAHDAEAICEAASRPSMRYVPVKSAEQQAVQSVHRVRSRLVRARTALCNEVRGLLGEFGLIATRRGRAATMALLETVTATEPAPLPAPMGELLRELKDELQTLEARIARLERQIQAHVRGDARIQRLLAVEGIGPISPSAVAASAGDARQFPPGRQFAAWLGLMPRQHSTGGQHRLGNINKRGGYLLGGPGSSMAPVQSLRCCAHKNQAPXPPGWQVWRNGVPANVLPRWPWPTKMPGILWGFTPPGENMLPGPGCSVPCPHPLXGKLPTPKWLP

SEQ ID NO: 23267 - protein, 436 aa, Pseudomonas aeruginosa
AGLPRPLLLLPHIRNASHGSAAFDECSMRLIHTSDWHLGQTLHGQDRDHEHARFLDWLLRQLEEQRADVLLIAGDIFDTINPPLKAQERLYDFIVSAHRRLPRLEIVMIAGNHDSGARIELPAPLMKRLNAHAIGRIGWIDESLDSDRLLLPLHDADGQVAAWCLALPFLRPAEVTGGGLGDDYLAGIRQVHERLVAAAHVRRTPGQALVAVSHAHMAGGSVSEDSERNLIIGNVEALPASLFPEQIAYVALGHLHKPQKVAGQERIRYSGSPLPLSFAEVNYRHQVLLVTLEGERLKDVQSLPVPRAVELLRIGPAPLGEVLDRIGELAEADLLNEQRPWLEVRVMLDQPQPDLRQQVESALLGKACRLVRIASEYQRRDEEQAPLLGLDQLNPQELFSRAWESAYGSGPDAQALDDFASLLQSVELATEEPPGK

SEQ ID NO: 23268 - protein, 192 aa, Pseudomonas aeruginosa
RTSPPSLASRKSTSPANRCPAPACSPSPVRPAPARAPCWTPCAWPCSAARRGWKALRPAARFPMAGTSCPATTNATCCAAVAPAATPKWISSASTATAIAPAGKPGAPGTRRTAPCKRASRASRTWRPSKCWQRTRKASSANSWSRSSASISPSSLAPCCWPRANSAPSSRPATTTAAHCWRNSPTPACTAN

SEQ ID NO: 23269 - protein, 238 aa, Pseudomonas aeruginosa
SNSSRNSGTPSSSSGSAPSSKPRAPSACKDCRPACRRRASARPRPTTICVRPRRRCARLSSWRARPGAWSERWPSDRNSIGNRTSATPSKATPLGNWICSSSAMSRNRRNCRRHCATARLSPRSATPGRPTRASSPPSCNVASARSKARRSSPSWKNPWPTPGNRSNACRRNGPPSMAASRTTWRHAWTNCAGRPIAWNDNKRSTRNGNRPSTNAPAWLDAWANSTSVWSSRSRHCST

SEQ ID NO: 23270 - protein, 160 aa, Pseudomonas aeruginosa
RWSAEPTAQAARQNGSSVCSPGACGGCSSLSGRRCSISPLSRRTLRRTASSNTPGRLSTRLNQSRARVIPVYTSSLVSTGFSASGRTSAVWANSEPCDLCTVMANTVSTSTRRLGRTKRTPPLPSLRGKATRSAKRRLPSSLRSGRRRAMPISPFISPRL

SEQ ID NO: 23271 - protein, 253 aa, Pseudomonas aeruginosa
PSTNSRAKAASRSPRRRRSKRSAGGLSSSARASPACCRLTNRARRPIPLLAPKRRECRSMTVCCASGCACAEPSRKPCQVSPLTRCNQARVSALYQPSSASRQRSPSTAPASTEANWSLSPSRIRRACGGSASSRLAIISRSIIEASSTTSTSSAKGLSRWWRKCRVSGPLPSRRCRVVTSAGIACNTSSASGRARTCWPMDSERRAAALPVGAARRMRSGWPAATAGAWSRPSRRTTVVVLPVPGPPVIRLK

SEQ ID NO: 23272 - protein, 218 aa, Pseudomonas aeruginosa
PGRPAAAHRRRGRRRHAANAAGRRLPGCRTPSRGRTGRRWPVVAPPTRCGSPRPRRDRGRGWQYPPGATPASRPARRRSRRGPGRPGSASGGWRWRCARPFPGDTPRSRARRLRHQGSRTSSLAPRHRRSTNVRRAPGRPPHGTAPGFPAPRGRNGRRRADALRRRRSSGWRPPPWRRSSGSSCQGCNAAREWPRGRAGRYGCRHRGRRRSPAWGRRS

SEQ ID NO: 23273 - protein, 136 aa, Pseudomonas aeruginosa
ATAGAPGARKRRDASRRASPPAPARTDGDGATPAAARPPPASARFPGGSARAGRAAVAANGARRTRRTPPAAGDPVAAVARPGPATAPAGPRHPSPARPSASCVRSARIAASSCPARPVRKVLRRCRSIARRRNAP

SEQ ID NO: 23274 - protein, 148 aa, Pseudomonas aeruginosa
TAAADAPGSGHAAAPRRRRPGPDASRPPGDRATGRSAPRAAARHCRGYSAPPSSRRAARAPRAAPRAAGSGRPRAASGRRGGSRCASGRNPAATAGGGSRHRSCQAGRPAGTGSRASASTCRNSPRQPGSAGSGRPGPGRRARPRVSR

SEQ ID NO: 23275 - protein, 160 aa, Pseudomonas aeruginosa
ARPAGARPTAPGWPVRPARRRPPRGAPAAQPAGLPGRRPGHRPHRRAGCLAGPRLRRPRSRAACAADRSANCCPPVPLAGRDARAARHPAPSARRRLRSSGAGSPGRPRRRRNAGAMPGRPAGRGSRSRRNGCRAVSAGAPGRSAAARDRAVPGRPGYRE

SEQ ID NO: 23276 - protein, 148 aa, Pseudomonas aeruginosa
RTGPSGSARDGRHRASRPARRRSRRTARRTAPAAGWRRSGRCAATAGTAAAGRGSPPAPAGRAVAWPAASGSISSAARCTPHRPGWRRSSSRRRDSLHAPAKRRDGPGRSPAPRRPATPARRAAPRRSAGGPGCCWPGPATSGASATG

SEQ ID NO: 23277 - protein, 151 aa, Pseudomonas aeruginosa
CSWRSTASASSRLRNTRYGYHRSGCTAATTARPSSTARCTFPPSCHDACRRHPAPWRSARSSRRSSRTSPSAGSTCRPRRRTCAWPGSSWTSWNAPSPTTTTCPTAVPRRCARCSTHCRPSRATTARWRNGRSRCTAPSEPWPGTASANWA

SEQ ID NO: 23278 - protein, 131 aa, Pseudomonas aeruginosa
PSANGANACASSRPSRRWKPAGGSSRSPSTSATAAPRRSSRCSAGWPAPHRNNTAWPAAPRTCRCCNPPCMRCGYARSSHHPEFACQPPAAIPTPPSRCSSPSSSWAAAPSAGPSPTSAISATSSSAAAAG

SEQ ID NO: 23279 - protein, 89 aa, Pseudomonas aeruginosa
SGFPPRPPVRQCLPVADRSARPGRPLPPTLRKAGGSARPPRWSGAGSRRPSGRLPRWPRRYVRPGRAPLRQPPRSRAHARRRGPPRWPR

SEQ ID NO: 23280 - protein, 601 aa, Pseudomonas aeruginosa
RFMPPSRNPTASPGANAQPFRSRRSTENCRRSKKSVSRPGRKQRTPFHLPPTDRRATDNEAFQSVSFFPQSPMRRGVARDNGNLPEFQTDKNASGIIAAPSLTGFSHVRSFQRARCLGGYQPGAGPGLRPHLRVHQRLPRHCQRGGHRHLHQSDVPLPGGDALRCVQLPRRAARRCRRSLRHRSPAAGGAADQREHRPWPGDGLLPARRRHRLEPRHLVLRHPGLQLAHPDRLDPRRRPGQCADHRRAAGRRDQLAEGDRHRPVADLLAAGRLHGRRVGPARTEMVASAVEDAQDPGNPSRTRREEAPAVLEPPGAGAFRHGGKLRPWLQRRPEGYRPDHAGTDRHRPGQVRPRPEQHHLPDRAHPRRRPAPQSVIPAPYRYPRRHAGPGQEQWQRDAAVLPLRSETDRADHQRAAPRLARRAQLQRPGRRRARAGASLPAVPGRHREEGRQAVRPAGAGEGRPGEATQGPDRDHRIRAVLGHHRGGPGSRHRHHGRLEARSAHRRREDRQAGHDLRPGHERADHRRRRHRHGQHLQPAGVHHPRAVLRRGRDHGGEQERPARRHRAQHPDGLGTHPADFDGAVRRPVLAGLAIHLSRLAG

SEQ ID NO: 23281 - protein, 156 aa, Pseudomonas aeruginosa
KNACLSAGVFLPRSHRRHPPASAGAASGKRTTNNAPSPWLAAVRLPPMLRTRSWLTERPRPVPLPSALVVKKGSNIRSSRSGSIPPPLSCTCNSTQPGSRQATCSRRTRRLARPGLPSRASRALASRLMITCSNWSACPRTTIRCVGAGHSTSMAC

SEQ ID NO: 23282 - protein, 405 aa, Pseudomonas aeruginosa
QARARPFAQVVVGELQGRSQQTVAARPHMTGEDRAETLAVAQQQGDSLHLERAGERFENLLDRLRQVSVGDMAQTRKDQLAQAQALQLVLLVVGLPVEVGDVHAQQQRASQAVERLHRLETTGQWRGGIAAQRQVETLAPAQAGQRRRTGGAPLQILGERPRLFAKPMGALQTIRLPPADPDHAVLFVHLETQVPTPQRSAPEGGAFLRKGFRPLGLGGRRAGKFEHATTSQQQVGTRLQRLRQVGNRADAGEAQHGDDRLARIAVRVLHADLDPRRGADVVGVLAIAGTGLEVRPPGRRHPVQAREQLVPGTGFGEALVARIGGIDSDRRTGPHGSGIVERLQHEQRNAVADQTVDQREKQQEDRCEFDGDGAVLASPGSFSEHELTSPIRILNTSRHSLRQRY

SEQ ID NO: 23283 - protein, 174 aa, Pseudomonas aeruginosa
KGINPDVEKRLKNRMEQLALALWASVCGYQDIKRLRVSNWLILGGFLISFVYLYVKESSLTGATVNMAMTALFIGVCLSLPGYLLGRLGAADVKYLAALGLASDPLTVLYSLAFGCLLCIALFILVKLFKRSVEKSAMNEEVRLRRAPSKNKSFPFIFAMSAGLLAHLIISKII

SEQ ID NO: 23284 - protein, 285 aa, Pseudomonas aeruginosa
KQNKQMERMTMDKPASRHFSVLIIDDEPQVTSELRELLENSGYRCVTSTHRESAIASFQADPNIGLVICDLYLGQDNGIRLIESLKEVAGNGRFFESIILTGHDGRQEVIEAMRVGAADYYQKPVAPQELLHGLERLENRLHERVRSQLSLSHVNQRLEYLAESLNSIYRDIHKIKYEVHGNSQPSALKSEDSQPSAPPASVAESQVSPSNPLFGKLSPRQQAVARLVSKGLTNYQIAYELGITENTVKLYVSQVLRLMHMHNRTQLALALSPAAMQQGSGAVVH

SEQ ID NO: 23285 - protein, 442 aa, Pseudomonas aeruginosa
ASRWPWRKTSPGQNSGRRTRLPGRHSPAPPRPPLAAGCAAPGRAARYPPPATGRSRPAAGWSPPGCRSPRAVLQAIRSCPAPPPGTVSSCSRRSRDLPAGTRESRAHSFSGSAGRHAGARRRSRFAEPGWRPGRSPGWPARRGWRSAVRPSLARQDGPPACPRPRPCRTGAARRRTGFARAWFTSPAPAQGASLAIAVCIFASAGSSASGSSLAGAAPGVGTAPQLRARASAARMSRASSCKRSIRRCASSRSPCRYSRPSRLVAGSLPPCCNSSAVMNSKRAPTRSPRLSRATPRSLRKRLSVGRRRAASRSSRTARALSPLRRASRPRPWCASGALQVSSRAWYSALARGSPIRRRISALSSRTSSNPGGMLSRLARAACRRPSRIMSRTMFICSSCSWPSCCEHSRGPSRPGSAAQPPSRAAHRPMPISAFIPVLPRPW

SEQ ID NO: 23286 - protein, 99 aa, Pseudomonas aeruginosa
LLQNAIIGLASAWRQGSVSVIAAFEEQTRMKNLTLFVYCKVRAFLADEEGANAIEYAVIAGLIAVALIAVLSPTDSGIVGGLKAFFDGVGTKVGGLAPD

SEQ ID NO: 23287 - protein, 636 aa, Pseudomonas aeruginosa
TWTSPRSTPSTRKAWRTSRPPCAPAASWKPRPGACGTWWTASRSEPVRPTGRLTAKRLAGDHPAPMKKAPAGAFFMAWRSAPLLPAHQRAEQATHQLPAQLVGRLAHGALHRRIGQQAAENLPGHAADAGRAFLLSSRLALDLGLGARLVRQHLVGRLAIDRLVVATLQRRPLDQFSALAVAQRADPRIGRRHRDALDHGRRALFLQGADQRLADTQFGQHPQGVERRVRAETVGHRAQRFLLLGGEGAQAMLDTQAELGQDIVRQVARRLGDEVHPDAFRADQPDHLFQAVAQGFRRAVEQQVGLVEEQCQHRLVGIAALRQLLEQLGQQPEQESRVDLRRLVHQAAGVEQVDAPAPVRLGAEDVFQLQGRLAEEGLGALLLQSGQAAQQRLPGSASEQRPVLAKDFRIVLQMVEQRLQVLQVEQQQAFPVGHLEGGEQRGLLAIGQLQEVGQQQRAHLADGGAQRVAGLPGDVPERGRVGLRLVVQPRHAGDTFGDLALRVARRGDAAQVALDVGGEHRDTGIAEGFGEVLQGHRLAGTGGAGDQSMTVGQAPGLSYRLAIGASADQQLIRLRHPFILGTKAPARCADSKGKPLCNGASSGTRVPICAGSREGRRASASTRSGRPASAKTFGPC

SEQ ID NO: 23288 - protein, 701 aa, Pseudomonas aeruginosa
DRKNRHRIRITHSSEPPREPWLRGTRPCLGRRTTHPRDPPDAARRTESPCARGTVAGVWSKTGATYSWTQYNMIKSLKFSHKILLAASLVVFAAFALFTLYNDYLQRNAIREDLESYLREMGDVTSSNIQNWLGGRLLLVEQTAQTLARDHSPETVSALLEQPALTSTFSFTYLGQQDGVFTMRPDSPMPAGYDPRSRPWYKDAVAAGGLTLTEPYVDAATQELIITAATPVKAAGNTLGVVGGDLSLKTLVQIINSLDFSGMGYAFLVSGDGKILVHPDKEQVMKTLSEVYPQNTPKIATGFSEAELHGHTRILAFTPIKGLPSVTWYLALSIDKDKAYAMLSKFRVSAIAAALISIVAILVLLGLLIRLLMQPLHLMGRAMQDIAQGEGDLTKRLAVTSRDEFGVLGDAFNQFVERIHRSIREVAGTAHKLHDVSQLVVNASNSSMANSDEQSNRTNSVAAAINELGAAAQEIARNAADASHHASDANHQAEDGKQVVEQTIRAMNELSEKISASCANIEALNSRTVNIGQILEVIKGISEQTNLLALNAAIEAARAGEAGRGFAVVADEVRNLAHRAQESAQQIQKMIEELQVGAREAVATMTESQRYSLESVEIANRAGESLSSVTRRIGEIDGMNQSVATATEEQTAVVDSLNMDITEINTLNQEGVENLQATLRACGELETQAGRLRQLVDSFKI

SEQ ID NO: 23289 - protein, 323 aa, Pseudomonas aeruginosa
SRSVAACSAHRTTATPWPARCANCSATTSSCAASAPAVTSSASMPGTRWSPVCSCTTTRYSATARRGSRAMAERSLLLVLHDVAPETWPDYRPFVEAVDALGEVPMTWLVVPDFHHRNPLEADEKFCKLLSRRVTRGDELALHGFYHYDDAPPPRTPGQYFMRRIYTWEGEFYALDHAEAKARLAAGIELFRRRGWPLHGFVAPAWLMSAGTRQALGESGLRYTSDPSNLYLLPHLQPIEAPGLVWSARSAWRRGLSWALSEQRRRAWRSAPVIRLGLHPVDMRHRFSREYWLRTLRTLLSEGRQPLTKIDWLERHLALDHAA

SEQ ID NO: 23290 - protein, 188 aa, Pseudomonas aeruginosa
AWKNSAPSSVSPNAARRFPRHAARNWRAFSPNRWASSRYAPRPRSTASPAAFSACVRRAHETEPLRTAPPGRLATLRQTPRLPRERQEAGRLQRRLRRRLPAPLPATGAGPGARLQQSPDRPVAATGDARPPAVLPAPQPPRQPHPRLPARRPAAPGPRGMAQHRRGQPAVLRQRPGSWGCWSITFPT

SEQ ID NO: 23291 - protein, 546 aa, Pseudomonas aeruginosa
STRSARSSGCWSAATSCSPDGAAMRLTDASVAIRPRSAWEALDLGILLAHRHARLLMGSWALLTLPLFAVLSLLLWQHPTLAILIFWWLKPAFERLPLYILSHALFGDTPTLRQALRAYPALLRKQLPASLLWRRFSPTRSFDLPVLQLEGLAGEPRSQRLIVLSQRNAGGATWLTVVGVHLEMALWAGFAMLLYLLIPAQNEIDWNWQSLLDPEAGEWLWLEHLSNLLYVLVLVVWEPIYVACGFTLYLNRRTELEAWDIELVFRRLRQRLVGSAYVLLLGLTASLAWLPAPSAYAEPAAATSAGEAELPPEQARLLRQKLNSEQAGKQIRAIVDGAPFKNSETVTGWRFGDKTEKKDSRKEDEERLKAFFEALANWVPFRHAAQVIEVLLWALLFSAVFLLVWRYREWLRLFVGNLGLPQRARREAPTVMFGLDLSPESLPDDIAGNAERLWNEKPREALGLLYRGLLSRLLHDYRLPLKGSHTEGEVLRLVEGLEQQRPLLHYSQLLTAQWQALAYGHRLPADDARQRLCDGWRSLFAAGAKP

SEQ ID NO: 23292 - protein, 816 aa, Pseudomonas aeruginosa
PACHPAPSARPCAHIRRSAFPLPTSPARSPTCKASGMPYERTDARTTEHRAQPGAPAPARQPAGPGPAQRTAESPDRPGRSDRRRAHRVARRRPRAGGRRAGARQEPAGTRPGALLRRRLRAHPVHPRPDAQRRHRPRRIRPRQRTIQAAQGAGVQPPAAGGRDQPRAGQDPGRPPGSDAGAPGHPGRTRPAGAAAVHGAGDAEPDRAGRHLSAAGSRTRPLHAQAAHRLPGRSRGTDPGAPGDPLRAQRHARRGQPAAAAEGQGRSRPAADRQRPADRRPGPRLCRAPGPHHPQLAGPGPRRRTSRVDRPGPLRPGAGAAARRRVRGAGRHQGLCPGGPAPSGPAVSGAGHRGAVGGPGPATVARPGTGPPRMKPSRALLALFAALLLLAIGLGSLSALGQRLPAQLHTFWWAALAALLLLGLLDALWARRQAVPKLSRQLSGNLPLGRWSEVRLHLQHTYRRPVRLTLFDHLPAGMDFEYLPQEVELRPGESTEVGYRVRPLNRGHFVFPRCELELPSPLRLWRQRRYLEARGETRVYPDFARLYGAELMAVDHWLNQIGVRGGQRRGLGLEFHQLREFRDGDTLRQIDWKATARKRTPIAREYQDERDQQILFLLDCGRRMRSQDGDLSHFDHALNASLLLAYVALRQGDAVGAMTFAGDDRRHLPPGKGSAQLGALLNTVYDLQTSQRPADFPEAVQAVLSRQRRRALVILVTNLRDEDDEELLGAVKRLGRQHRVLVASLREEVLDTLRHEPVARYEQALAYTGTIDYLNARNGLHEKLAAHGVPVLDARPSELGPELISRYLGWKRAGVL

SEQ ID NO: 23293 - protein, 259 aa, Pseudomonas aeruginosa
TGMPLALAPRRCHALRPPSRPAPVAVAAGRLLADHAAVRRPGDHWRSRRIQADEEQPHDRRHRGGRRPADLQRHGDPRQQERRGGKALPHRLRQSPLQRRGARYLAVPDRPDLHEPLQRPARRRQGHRLLPARGPRVPRHPRRRACPGAPAGNAPAGQGAGAEERSRIARHLEATAEPRSLQDQPRPGHDPAVAPRGAQGSGRRSRRALPAGGQRSGDSCRYKGKSPLPARPDVPGAGQPAPEPRQGHRIPASPVARLS

SEQ ID NO: 23294 - protein, 214 aa, Pseudomonas aeruginosa
PAGGRRPEQRRTAGPFPCPVDRRTQRRQRRVAAVRLQPGAGRRAVLRQSLAAACPRPLPGRTGHLAGAAFHAAAAGRHPHSGRGPVGQAAGPDGPATGRRNPARPGPQEHPQAQPAAPPATGQQRLAIDPPLPAAALAGPSRRLARPAPVRGARPAACQRQAGRPRSPADRRRPPARSQPGAARRLPAYPRGDAAQPAVRRGNARRLRAFRAAT

SEQ ID NO: 23295 - protein, 288 aa, Pseudomonas aeruginosa
GARIGRRALRSATIRTANNRASGYSTMQRYDDASHAPERTDRTRARGARRYERRQRARLRQDERRGQQRRREVSSEHRARAMPLEHQYARCHVSAERTTRRMERRNERRGSTQTRRRRPRHGTRRWRRQRRRPHGRDTRRRGTPAVEDHEATQNTQMTYGRGDEEKQARGEARPHRSAEDGGQTQPEADESERAQGQRRTGAAEGTPRRPGAQTGRRTDTDGGGTRHGARCARRLAAQGLRASPCSRTSTKRPRTRRLQEGRGEGRARANQPRRLPEKPTSARGPRSD

SEQ ID NO: 23296 - protein, 102 aa, Pseudomonas aeruginosa
VSGLNGPSTLTPMYSACFGVSWVTTPPKPLTISRATSSSSFFGSTSTLRRLAFSAAGRSAYFCSNRWICASTWLAKEPSMIRLGWPVALPRLTRRPSARRIR

SEQ ID NO: 23297 - protein, 215 aa, Pseudomonas aeruginosa
PITRACLPDSRWSVPRLMASLRLWRQPYLLSFLLLVTESLTLIAGTFRAPFLSMSSRRWTPVVVSSVMPWMRSSICGYFLCRISVRSPPSSSTMLASHGWPSLRMVCSMHHSYSSSVSPFQANTGMPAAAMAAAAWSWVEKMLQLDQRTSAPSATRVSISTPVWMVMWMQPRIFAPFSGCWPAYLRRRPISAGISDSAMISSRRPQAARVMSATL

SEQ ID NO: 23298 - protein, 705 aa, Pseudomonas aeruginosa
GTHRTARPHRQRRRRRGNPAGPRSRRQRRRRLAPGPEPARDSRLGKRGQPCQLRAARPAQHPGHRQQPARRERLGAARLRRLRHLPRLQLEPGQPVVQRHSGAIQQRHASAGRLDRRPRRAGRRSVLLPQRRRCRRRLAGLHQQARRPLRRFHGRPGALRQLRRFGSRLRLQPGPGHRPRAEALRAPGRQPQRRQRLRRPQFARIVERRFLPAQRPDPGPFPHPGPGVPGRAGRQPLLGHAGAQSLRRRAEDRQEPSPRELQCRRWPLRTARALAALDPRIPGQRQHALAQHLLPLRRRARLPQPRDLPLQRRQQRGGALQRIPPAPRPAAQRQPLRATAQPAAVRTGQRLGAGLRLQHQQADALPEYRLRAVRYGRSGQFRAGPLLRPAGHASRPPEGPQQRGAHQRVVRREPPGPDRRAVAGHRAALRPPRPRRAQPSGTRQGQSRTLRTALGRGHRARRAGLPVHSARRRLPAIQYRRRPAGRGADQRQLRPGPRLRPVHRRPVGAGQQVRFPRRSRQRHPGRLPHRPPGLLGGRPEQPQPQRAGGPADLQGHRGRRLPADHPEAAGRGQFRLGRRAVRRVHRERRRRRRLAQGQDAAERAGAGRQPVADLRLRPGLAGRGGRALRILGVRQQRQHLARAVLYGLRDFPQLPAGRAHADHRARAQPHRRGLRALRAEHAAVLRRRPAHLRAERADALLRSRR

SEQ ID NO: 23299 - protein, 646 aa, Pseudomonas aeruginosa
ERMPSWGKATICRSTQGATSPRTSSMALSAVRVGSETSTWLRTCCTPLAICHFRVCQARCLTSSWLSRALRWAQRSMPSNSVPERFHSGWPAVWVVSRWMCGSMNGGTARPPAPSRRSPASSAACSIGTRAAIRPSATRSCQRPSRPRRRRLSISMEDLFWFVRAAAQQGIEQQVGDGGAEHRVDRHYPRQPVAGGGAAGDGEDRRPVDRLDVRAGVLAVAPAATQVVGDDHPADGRDGGGEEGQPADEVVVQPERGEGAEGAVEHRQEAAGEAGDVGEAEAGGIQRVVVGGPDVQAEDQDRRDQQALGDHHVGDVRLAHRRRAGRAEDEHQRVAEEERHQAHHHGGTRAAAEADEVGGEGAGADERADHQGDRGREAQRRARRHLLQRRQAAGVAHREPYRVAAENDDRRDRDGRQQGQTGDAEEHREGHQRSGNQDQQVDVEAGGLGHRVFGANIATPTPNQPTWVPPSNAEGSQEPLLPNGVMRQQVGGKAGARADEAEDRGVQAEHQVAQQHGEEEVVVAQAGAEGAAGPHAGGKEGQAEHHHAQGQRALARCQRDRLLAVVAVCGHARVSVGRRPSGSVGRAAANGSRRRVDPTDAVARRRTAAARRKRAGARQGGVRRGCGRRPAFRRLRGRGCADPGSS

SEQ ID NO: 23300 - protein, 540 aa, Pseudomonas aeruginosa
TGRPSRSLHVEHELGVDRFRRQFAVLHRLHGEVLAERHAVAAGVDAGDAGAHLSVDLDALAVAPQLRCQRIAQAGAFEGLADGLEDGVGGQFEVLAGVAQATVLQARAGEAHAAHPAMLVEQYPFRSGPGQQAHLAGLGDLLLMAGGAHFLEATAVDQVDVAGAEPAHLHRHVDGGVAGADDDATVGDGQVEQVVALPQLADVVGGGEQAGGVLVFQAEALAGGQADAEEHRVVLVVQGAERQVVAETLAVAQFDTADLQEEFHFAPGEVVHQLVAGDAVLVEAAGLGAGLEEHHVVAVHGQAVGAGQPGRPGADHGDALAGGRRALERMFAEAGVVEGVALQLADQHRCAFLGVVAYAGPLAEDFRGADAGAAAAEDVRREDLLRRALDILLGDAADEPGDVDLGRAGVDAGRVVAVQAAGAFQGGLAGVERRREVGEALGERVRAGVRTGEVVQGIDHGCSLSSGFFSGQSTAIRHRPASTGRSGIAGRISARRRPGAGVRRGGRALRTPTGRPGAPRSVRRRVRRAGRLRPRAACPG

SEQ ID NO: 23301 - protein, 331 aa, Pseudomonas aeruginosa
RSDPRLRPPVWGPRYRQAENSPFYSRPSRSCSSTTRRQPSPSSDHCQRPCKGRVETRLNSSAFPSSRTRQRNGWPSHRPSPCCAAPRATMRNVRAPSTRAAVTAAWRSKRRTRPCSLSPTASSCGADVGSEAGPNNLPSISPNNNPASTSAPQTFQRWRRRSSMAEVECRPLSAPEPCMFHVILFQPEIPPNTGNIIRLCANAGCSLHLIEPLGFELDDKRLRRAGLDYHEYASVRRYPDLQSCLEALGQPRLFAFTTKGSRAFHEVAYQRDDAFLFGPESRGLPEDVRNALPTDRRLRLPMREGCRSLNLSNTVAVTVYEAWRQLGFAMD

SEQ ID NO: 23302 - protein, 274 aa, Pseudomonas aeruginosa
AAAPPRHPGPRGLPEWTRGIPEAATEPGTPGKIQPHPHLLRLHQQSPSRTARQLQRNPPPVGQRRAGHLCAESRTTEQARRAGQPPRGAGSDPQGAPASPGQAEQRLPRTRPEAQVPPTGPGRAGQGTADHRGNPGPPGPRSRRRGGARAPARAGRRTRACAPAAGRPRTSHQPAARTCAGPAGLKHWRGLRRRVRLGPRQAAVAGEWPRRGALRQPARRRSAGEMGRRTDFGERRQHRPRGARRTRGIRRLVARSRPVGHPRPRWRLPQPLWP

SEQ ID NO: 23303 - protein, 63 aa, Pseudomonas aeruginosa
PRSGAASRASRKPTCRGHLANGNGGADRPTGKRAAPSERPQDSDYQLSQALSLLKGLSVTRGN

SEQ ID NO: 23304 - protein, 237 aa, Pseudomonas aeruginosa
TWSSMTSGRTGQGTAGFSTCPPGVTLAIIPGNPACRRTGPRGAPARAHGDPAHADGPGRRSIRLAAGADPGRACAAAGRGAGQGAVCARPEQPRGQPHDRGAPGDGLARRGTPASRPVPGRQPHQRRHRGRQRGAADRPGERLARCVPRQRSHTGSGLRTTAGRRRPGPQAGFGVAHRPPAQGHPRRAGAGAAEAARPGHRAGTAADAHRRARQPQRQPTPGAALKPGLPASRQRLR

SEQ ID NO: 23305 - protein, 504 aa, Pseudomonas aeruginosa
RPRHSCTDAPMARPSPPMPLLAAALLVAGAIPLGFIWILTSAKFEIGGASPGESTVGKVENIDQRAMEQFCTGVRATPAGTWLVGRREVGRDEQALPEGVIDLDLVAAAQPREKESDPHLFNFLNGMLLSGGDPETTYVSRLGADGVFHEVARLGETACLEVTPDGSSVFLLTGLRRPGKDNGQREQTVVLRSDDQGKSWRRLEEGFMAEANRLGWALAPRFHGKDEVWVWGDFEYGGADGGRGTRPSRGGLFYSPDRGASVESIATSAPLLVDLAYARELAPNGVNWGDYNGKHGQIKAHVAQLNAERAAIWVSQTFRYGPPEGRYLTSSILVTTQAELRREGGRWQMGAIRRTDGVAVERLEQNMDGRVIAVLDHPDESRSLIAELDRDALEWKITGKLPSPFWPLPSSSGLREFYMGRNVLLANTMSHYEVPLWLYPDEEPASVSANAVYYSDDWGSSWRRLDIAGYLGVLGFDEAHDRVFWARGNWYDSRDLGVQAYDLN

SEQ ID NO: 23306 - protein, 140 aa, Pseudomonas aeruginosa
KRAWSGISCHNGCSTAWLTWFQPMCGTFRCSPASCRSLPKKRTWPGNRPMQSTPSFSSVRSSNACMPTQMPRNGRSWLTSRTRASKPRRRISAMQSRIAPTPGNTTRSASRITAASLLTSTRPAPTCSRALATECRLPMP

SEQ ID NO: 23307 - protein, 393 aa, Pseudomonas aeruginosa
PHLQSQFRSDPRRPLLPARLAQGRSLPGRPRTPVRLVRPPRRRPPAHRQAAGGGGGKRAREAPGPGGQRTRLRGRRPDAAGRHHAARAGAPGPRGRRPALAEHGNHRQPRLPAIAAGRRRTPRRTTGAGHPGRPPGAPRRRLARRRTERRRSVPVARGLGGQCRRPVRPGAGATHRRPRSAPGAGAAPVPGALFLLQRPLAVPPPGLPDARGAHRRARHPRHPRPRRPVALRSRRELRGQPRLPRRRIPPPRLRPGHLALLPRHRSSAPGRRLRRHPAQARRAGGTRRRLHHPNPCRTRPARPGQPVRHRVARPPRQPGARRTGRPRTLRRGFAARRVGLAKRRCYTRPHIHRCQHKGFVHESIRQGPGAVLPGTLTARRGPGLRPDPPVRSQ

SEQ ID NO: 23308 - protein, 398 aa, Pseudomonas aeruginosa
LQGRNPPDRPRQGQPGAGPEGRHRLEPVPLAGPGAARHQHRQRRHADQAVRRPADARPVGAGPAAAAQGRADERDPRRRPEPGPGPRQAGQGQLGKHRQAGPAPGPGRSFRHPAGSGRQGRPGAGTGAGAAERQPAHPDQARHRQPQCQQRPRHLHRRSQRQAVQRRGHRAEHRRHSRRQQHSAEAQRLPRHQPAGGTGQDRADRQPALRHRAQALPTGRRQALRRSLGRAAARQDRHLLRPGPVAARPVGADRRVERPEAERQPVARPRRTEGPRAGQGHQVQRRPVDRADEPARVPRRHRCDPAGHGRCQHPRQVRAEHPPGRQPQQPESRRPQAGSGRHRLQRPLRHRRFRQAIAARPAQGRQARPRPLPAGQGQASPGCRQRHAQGGSRRHRGQ

SEQ ID NO: 23309 - protein, 185 aa, Pseudomonas aeruginosa
RPGQHAATGKTDQAGLERRAATAHRDPAQARPGRGAELRPADRREAADRRRQPEAARPGRRNQPRRHARRAVQRPLQRQGQPRCTPGQRRADRHQTHRQRAGGAPARSPGQETAGEGAARPRRRHPHQRQQREILDRPSQRQRTLQPDQRRAARRQPGATALPGHRYPQPQGPCRYSRRQGHAFP

SEQ ID NO: 23310 - protein, 470 aa, Pseudomonas aeruginosa
PESGHSRPGGQRPRRYRPARAGHGLSHRRGDPGRQERHAGPGLPGQPALRRHRMAAALPRPAGTRRQGLPPGQGRHGQGRRETGRQSPQRKTRREARRQGQSGAERRTQRAVQPQMTPEGFNGAVLDWYDRHGRKDLPWQQGITPYRVWVSEIMLQQTQVSTVLGYFDRFMAALPDVEALAAAAEDEVLHLWTGLGYYSRARNLHKTAQIVVERHAGEFPRDVEQLAELPGIGRSTAGAIASLSMGLRAPILDGNVKRVLARYLAQDGYPGEPKVARALWEAAERFTPHARVNHYTQAMMDLGATLCTRSKPSCLLCPLVSGCRAHLLGREADYPQPKPRKALPQKRTLMPILANRDGAILLYRRPSSGLWGGLWSLPELDDLDGLEPLAARHSLALGERRELSGLTHTFSHFQLAIEPWLVAVEGAPRAVAEGDWLWYNLATPPRLGLAAPVKKLLKRAEQELGRGTAA

SEQ ID NO: 23311 - protein, 254 aa, Pseudomonas aeruginosa
TAWAGPLGVPEPALRQRLPRRGGRPAGRQHRPGALLRVGHRALPSAGPRPLARTRPARLRAVVRPRPAPARPGTVPVRRTAACARTPAPAARGRADRRLVRGPARLSALPGSAARQHARRQSGATLQCARRPRQPAQGRRRHPGSATAPGTAPRFRRLGPRSRPAAAHRWPGPAPVAGHPGRRPEPLLPGAGRRHPRPVAQPGVGATGLRADGPAGVGTTLRRGRPEPAGGAARRGTPGLELRPGSPAETARGS

SEQ ID NO: 23312 - protein, 432 aa, Pseudomonas aeruginosa
LRPVAQVAQLVEQGIENPRVGGSIPSLGTNNFKDLAQRLVQSHAPVVQFRCSTGTLLLEMMMASVKKTPYGTWKALIRKQGWPTASKTFRVKRDAEDWARATEDEMVRGVYLRRSPSEKTTLEKALGRYLEEVTPTKKASTQKAEQTKAAALIRHLGKYSLAALSADVIAEYRDKRLKETVRTKYKEGSDVAVRTVSANTVRLELALLSNLFTVAIQEWRIGLPQNPVLNIRKPSPGEGRDRRLTPDEERKLFQAVNAYHNPMLGWIVRIAVETGMRSSEITSLRRHQVDLKKRVVKLLDTKNGESRTVPLTQAATQAFKEALENPIRPIDTNLIFFGEPGKDEKRKPYVFSKVWNGMKKRLGMADFRFHDLRHEAVSRLVESGQLTDQQVAAISGHKSMQTLKRYTHLRAKDLVKALDNIDQSRQGARPSA

SEQ ID NO: 23313 - protein, 73 aa, Pseudomonas aeruginosa
VIVTAFIWSNLCNISTGAQMLSIAKQYVNKRKIKWLLSHSGFPMRKDLLNPEENFVTPKSLGVSPIKYIANPE

SEQ ID NO: 23314 - protein, 65 aa, Pseudomonas aeruginosa
TCDQLSFRNRRQNIKVPGSVHKEAHSASSGPARIYPKFHTRQAEAFLKPTETGRKLNLLLRGLSD

SEQ ID NO: 23315 - protein, 181 aa, Pseudomonas aeruginosa
PAQALRRPRSAQGHLPHRPRRRRDLHPRIVRLGQIHLPALHQPAGEPAPGPDPGLRRRAAPEEEQERRPGRRRQPADQPAAQRTRFRLPEFQPVAAHEHPRQRDRGATSRTGQEQGRSDRDRRGPAGQGRHRRQAPQLSRATFRRPAAARGHRPDPGHATQGDPVRRAHLGARPGNGTGSA

SEQ ID NO: 23316 - protein, 319 aa, Pseudomonas aeruginosa
RDPCARRRGPDHAAGHPRNELRPPGFQRGGIPPPGPGRRAGNAATGFRKPPVGALQTVHVQPPLTEQHRMKNYKKILLAAAATLAFALDASAADKLRIGTEGAYPPFNGIDASGQAVGFDLDIGKALCAKMKTECEVVTSDWDGIIPALNAKKFDFIVASMSITDERKQAVDFTDPYYTNKLQFVAPKSVDFKTDKDSLKGKVIGAQRATIAGTWLEDNMADVVTIKLYDTQENAYLDLSSGRLDGVLADKFVQYDWLKSDAGKEFEFKGEPVFDNDKIGIAVRKGDPLREKLNAALKEIVADGTYKKINDKYFPFSIY

SEQ ID NO: 23317 - protein, 481 aa, Pseudomonas aeruginosa
CQARPPPGASRRWPPSGLTSHDSRPAWVRRPTARRYLDDPQAVAGGGLRGAVARPPRRHREDFEVRGPALPRRHLHHHRPWRAGNALGTDDLFRHGERPERPRRPFRQAGPGTLAVRRRHPGPRPVLRRLRHRGVPRRAVVHSARPSRGRPGARPVARTDLLAHRPAADLAGRPARPRQPVPDPAEGHRAGVADHPRRDHAQGAGRLQRDQGTLHLLHDRGRHLPEPHGRHHGRPALPRTSRRPWFREERAMSEWELILKWMPKMLQGAALTLELLAIAVVAGLALALPLGIARASRHWYVRAVPYAYIFFFRGTPLLLQLFIVYYGLAQFEEVRKSAFWPYLRDPYWCALLTMTLHTAAYIAEILRGAIHSVPVGEVEAARALGMSRRQALWHIILPRAVRIGLPAYSNEVILMLKASAVVYTVTLFDIMGMARTIIARTYESMLFFCLAGALYLVITIVLTRIFRLIERWLRVDATQGR

SEQ ID NO: 23318 - protein, 558 aa, Pseudomonas aeruginosa
TAIPHGSLQRFRLSLQGLHWPAHRRQCRDQGPHPREAPRRAGHNRRPVQGADLRRSQPCQQSGRTVSRAVGGQRLDDSHAGAPGEKRAAAAWSLSRRPPLPAPGSQRSGTEGPGAASAYRLGGDERAGRLPEHGRIADADPSADQGSATRRLPAGQPAGVLIHAVPSSPSLAAAIGAGLGDSAGRRLRHFRRPGTERPTATGRRPPGGQEPGRRSPFASGLAAPGLVDRARRPAARPTDRRSPARHPRPADRRGACAPGGGNGPGARCRAPADAGRQGQLLRHPRADQRGPGTARRPLFGDQVPVARLQLRLRPLGRRARRLGSRPRPGQCRPDRQPGRAHRPLGEHRPRLQRPRPRLYRARSRRGRTEALAAHDRAEPEAHERRARQQGPAATDADPAGHRPPAAQRRRAGHRQRPHRPRRAAGQGARSRSRTAAPATAEPGQPEPALGTPGGTARPPRRHRCRALAGRGGAPQHRLGEDRVLSQPQSRRDGRPRRPAHQRRVAGAEPLLPGGAGDLPADLRRWPPPRQPGRTRRRLRPGRRPVQQDAGPGPRRGQR

SEQ ID NO: 23319 - protein, 495 aa, Pseudomonas aeruginosa
PRQVALPGAAGDRPAPGPRYRQVQLRPGHASLRRRRRQLPRRPQRATATAGRRTPAGQPGEPADRSFRPAGPGPGRRFPTRFPLRCARYRESAGRMNEAPTMTTANSETPAGNPKRKRWLLILLAVIVLATLASVAWEFFYGRWHEDTDDAYINGNVVQITPQIVGTVVSIGADDGDLVRKGQELVRFDPSDADIALQRAEANLAHTVRQVRGLFSNVDGYRAEVATRKVALAKAEADYKRRKNLADDGAISQEELAHARDALDSAKASLTSSEQQLNTNRALVDDTQITSHPDVKAAAAQLRQAYLDDARSTIVAPVTGYVAKRSVQVGQRVQPGNALMAVVPLDQIWIDANFKETQLKHMRIGQPVEIRSDLYGSDVRYSGTVDSLGVGTGSAFSLLPAQNATGNWIKIVQRVPVRIHIDPQELQKHPLRIGLSMDVKVDLHDQSGPALAQQPPREALFSTDVYQQQLASADKLIERLIEANLAEDHGKTAQR

SEQ ID NO: 23320 - protein, 494 aa, Pseudomonas aeruginosa
PRGEFGTGHLGDHLVRREQRHRPAADRLAGPAGRRGAPVHRRRAAVRTRLVPLRHRPVDAFSGRLPRLAGLRRRAAVSDHPDPADLHLPTGEARHGPGPAGDGHGGGADRRADPRRLDHRRLQLAVDLLHQRAGRPVRRLRRLPATEGTPGGDQEGADGLRRPDRPGDRRRRPADRPRQGQRPGLVRVELHRRRRADRGDRPGLLHHLGIHRPPSDRQPAPVRPPQLRRRHPGAGAGLCRVLRHQPAAPAMATDPDGLHRHLGRAGRRANRHPPGVPLAAGRPLRQPFRPAHARRPVVPGDGHHLLHARQLHHRGRLPAHRHRAVDHGARRGVLLHADPEHPALRPAPRPDRRWLRPGHLPAHPRRQLRRLADHLDLEPPRHPTPRLPQRKHQPLRPGHPRNPRPARRQHPGERGAARPDGAEPGLHDVHHRLLHHARLAVPRPAGDHLAGPPAVRRQARRGRLRALRTNGIRAGKSVVYSWRRLAIMSPSSPV

SEQ ID NO: 23321 - protein, 459 aa, Pseudomonas aeruginosa
PALIRVLLRIPTNSTLESTLMARTTAPLTDSACRTAKAREREYKLFDGDGLYLLVKPNGRKGWRLRYVKPDGREGLTSLGNYPVVGLADARHKRFELKQQLANGIDPIQSKQQAKVQAVINGRTFESVALDWYAGMVPKWAPGHAKTVLSRLKTHVFPLLGARAIVELDTHDLMQPLEAVTKRGTIDVALRIKNYLQSIMREAKRLRLITANPAHDLDGSIKTPRVTHRPALPLSRLPELQARIDGYKGRPLTRLTVMLSLHVFVRSSELRFARWNEFDLKRGIWEIPDTRPALDGVPFSTRGTKMAGDIHVVPLSPQAVALLEQIHAITGKFDLVFAGDAKPWKPMSENTVNAALRTMGYDTKVDICGHGFRAMACSALVESGLWSETAIERQMSHKERNNVRAAYTHKAEFLEERRMIMTWWSRFLEANREDHVTPHEFAKQTGENVTRLRSAKKTE

SEQ ID NO: 23322 - protein, 353 aa, Pseudomonas aeruginosa
LMTILVTGSAGFIGANFVLDWLALHDEPVVSLDKLTYAGNRQNLASLDGDARHTFVAGDIGDSQLVARLLAEHQPRAILNFAAESHVDRSIHGPEDFIQTNIVGTFRLLEEVRAYWGALEPEAKAAFRFLHVSTDEVYGSLAPSDPAFTENNRYEPNSPYSASKAASDHLVRAYHHTYGLPVLTTNCSNNYGPYHFPEKLIPLVIHNALAGKPLPIYGDGQQIRDWLYVKDHCSAIRRVLEAGQLGETYNVGGWNEKANLDVVETLCAILDQEQPRADGRSYREQITFVKDRPGHDRRYAIDATRLERELGWKPAETFETGIRKTVRWYLDNQDWVANVTSGAYREWVGKQYA

SEQ ID NO: 23323 - protein, 480 aa, Pseudomonas aeruginosa
ASRDHYETQGHHPRRRLGHPPAPGNAGHLQAVAAGVRQADDLLPAQYPDAGGHPRDTDHLDPTGHPTLPAVAGRRFELGPGPAICRATVAGRPGPGLPDRRVVHRQRPQRAGPGRQPLLRPRLPRVARQRFAAPDRRQRLRLPRAGPGALRRGRVRPGRQGHQPGREATGAEVELRGHRPVFLRPAGGGHRQGPEAFAARRAGDHRRQPRLSGARPAQRGDHGPRLRLAGYRHPRFAARGRPVHRHPGEPPGSQGGLPGRDRLPAEVDRRRATGKTRRAAGQERLRPIPQAPADRDRVLMKATRLAIPDVILFEPRVFGDDRGFFFESYNQRAFEEACGHPVSFVQDNHSRSARGVLRGLHYQIRQAQGKLVRATLGEVFDVAVDLRRGSPTFGQWVGERLSAENKRQMWIPAGFAHGFVVLSEYAEFLYKTTDFWAPEHERCILWNDPELKIDWPLQDAPLLSEKDRQGKAFADADCFP

SEQ ID NO: 23324 - protein, 187 aa, Pseudomonas aeruginosa
PCATTARGFPRTPWPTPTNPFSPPRPPPKGSASAWPSAITYCAPSAAAWKWATISKAAPWCACTCCREFPASPPCPRRKPAHESLRAIRCPDPGPADRRRSAPAPGPAPDARPRRAQGRDPGRRAPVGYRAVQGLARGGGQRHPHARHRWHGTAPPIARTGRRPAGDPDHRPRRRAAGGPGHARRRL

SEQ ID NO: 23325 - protein, 258 aa, Pseudomonas aeruginosa
RTVRRDQRRRPRRIGGGKRTVRSRGRRLHRRAEAPHRQVRVRQWRHPVPRRDREHEPGRAGQAVAPATGTGSRAARLQPVDPAGYPHHRGNQGRPAPGRRPGPLPRRPLLPPQRRQPAHSTAARARRRHPAAVPPFRRSRRHASWPDATRTGRRPVGAAAGLRLAGQRARIAERRRALRPGSRPEPGRRSPARRRRRAAQPQRQGRGLRALADRCRTGTPAQFAAQRRRGPRYPAQDPARQAAQARPAVQHAWRKSAR

SEQ ID NO: 23326 - protein, 396 aa, Pseudomonas aeruginosa
TSLVRPRREDTRPLHKRQTRTKRKSHAQAHREGARLRTFPDRRRNRPGGRPDRHQVLPRRRRAHAQGPGRAAVQETGGGTPAGQGQGGGLPELVAVRRRQGDGSPAAGRRADHRAVAGQVRAVHQEIADLRPAVPVRQHPGGRPLPAEPAGQGAADLDAGQGHHWPRLLAQRDEAVVRQQAPARAEGRPRPEVPRAGLQGARGTVQGGARQPAQDELRRGLSGPADRRGQRYREPLVEHLLAEDARSAEVHHRVRPRRAGLHGDHQHQVLERPAGRRARRAGQDHGRGHRGGEQAGRGAQPGRQAAHRRGQDQRDHRTHSRTAGRMAQGHAAGVEEVRRRDRRRPDQGRRSRQPGPIRRGKAHARARARLGAPGGRPDRLPPRRHDAGYLRLCSPQ

SEQ ID NO: 23327 - protein, 502 aa, Pseudomonas aeruginosa
LGEDPVHRRHRRRGPRPLRHPPMAHRPDRAGRLRPGVHPFRRDPRAHPAQPPDRTGTGRRGCRRAEADRARGAQGMTILFLFLLLFLLMFIGVPIAVSLGLSGALTILLFSPDSVRSLAIKLFETSEHYTLLAIPFFLLSGAFMTTGGVARRLIDFANACVGHIRGGLAIAAVLACMLFAALSGSSPATVAAVGSIAIAGMVRSGYPQAFGAGIVCNAGTLGILIPPSIVMVVYAAATETSVGKLFIAGVVPGLLLGLILMVVIYIVARVKKLPAMPRVSLREWLASARKALWGLLLMVIILGGIYSGAFTPTEAAAVAAVYSAFVALFVYRDMRLSECPKVLLESGKLTIMLMFIIANAMLFAHVLTTEQIPQSIASWVTELGLSPWMFLLVVNIVLLIAGNFMEPSAIILILAPIFFPIAMELGIDPIHLGIIMVVNMEIGLITPPVGLNLFVTSAVTGMPLGATIRAALPWLMILLVFLIIVTYIPAVSLALPNWLGMS

SEQ ID NO: 23328 - protein, 499 aa, Pseudomonas aeruginosa
PLPPNVFTLNSYREIPKMSQESSQKLRLGALTALVVGSMIGGGIFSLPQNMAASADVGAVLIGWAITAVGMLTLAFVFQTLANRKPELDGGVYAYAKAGFGDYMGFSSAWGYWISAWLGNVGYFVLLFSTLGYFFPIFGKGDTVAAIVCASVLLWALHFLVLRGIKEAAFINTVTTVAKVVPLFLFILICLFAFKLDIFTADIWGKSNPDLGSVMNQVRNMMLVTVWVFIGIEGASIFSSRAEKRSDVGKATVIGFITVLLLLVLVNVLSMGVMTQPELAKLQNPSMALVLEHVVGHWGAVLISVGLLISLLGALLSWVLLCAEIMFAAAKDHTMPEFLRRENANQVPANALWLTNICVQVFLVVVFFTSGDPDGMDPYTKMLLLATSMILIPYFWSAAYGLLLTLKGETYENDARERSKDLVIAGIAVAYAVWLLYAGGLKYLLLSALLYAPGAILFAKAKHEVGQPIFTGIEKLIFAAVVIGALVAAYGLYDGFLTL

SEQ ID NO: 23329 - protein, 425 aa, Pseudomonas aeruginosa
LLHWRREMSTEKTKLGVHSEAGKLRKVMVCSPGLAHQRLTPSNCDELLFDDVIWVNQAKRDHFDFVTKMRERGIDVLEMHNLLTETIQNPEALKWILDRQITADSVGLGLTSELRSWLESLEPRKLAEYLIGGVAADDLPASEGADILKMYREYLGHSSFLLPPLPNTQFTRDTTCWIYGGVTLNPMYWPARRQETLLTTAIYKFHPEFANAEFEIWYGDPDKDHGSSTLEGGDVMPIGNGVVLIGMGERSSRQAIGQVAQSLFAKGAAERVIVAGLPKSRAAMHLDTVFSFCDRDLVTVFPEVVKEIVPFSLRPDPSSPYGMNIRREEKTFLEVVAESLGLKKLRVVETGGNSFAAEREQWDDGNNVVCLEPGVVVGYDRNTYTNTLLRKAGVEVITISASELGRGRGGGHCMTCPIIRDPIDY

SEQ ID NO: 23330 - protein, 367 aa, Pseudomonas aeruginosa
RCPASASRWYTRRTRVSVTCSTERHHNGKGPARPGLFVSVQRARQLDQLAAPLGSARQGQEGAVEVVLARLVGEWRAMQVEHLAAGALQHTLGGGRVPLRGWRQARIAVGSALGEQAELQRTADAGSPQVAEALAQAIQQALLGRAAMALAGHHGEGLLGLQAHTDRLHAAIGLLAPGTETGATVVAAAAHRHADQAEQHPAILDQGHVDGELLATGDELLGAVQRVHQPPAPPVAALAQRYLAILFGKHRNVRRQRPQSRLQYMVRGQVGGSHRRFVGLRAHRHVGAPVRQDRLAGAPHQRHQFAPRHRPHAWYSPRWVSRSRTRYSAARARPSLNWACWARLDSSRRLMRSTPIGSGSSPGRRSS

SEQ ID NO: 23331 - protein, 330 aa, Pseudomonas aeruginosa
PSLDCKNRRNIPRLLRHPITLRPFALRFGDTPATEAPMDIKQLKFLCALDETRHFGQAAARCHVTQPTLSMRLRSLEEELGLELVRRSQRFEGFTEAGERVLAWARSLLAAQEGLYAEAAACRGQLVGTLRLGVVPLASFDPMRLVQHMAGRHPELRFQLYSLSSEQVLEGLARNQFDLGVSYLDRLDRSHFEGIELAETRMGLLHHPSHFPLDAALLNWEALAGLPLGLLSAGMHFRQSIDHNFRSRGLSPIARLETDSVQQLLQAVQRGLCCAIMPLGSEVDGELRLIPIEDAHTLAALGLIIRSGQPRSALAEACFEEARNWLAPQS

SEQ ID NO: 23332 - protein, 285 aa, Pseudomonas aeruginosa
NDRAQPMPCQPACPVSADTWAPSAVPDDYRYADLHLPQQVGQASLAAECAVAISYNGLNQAVMMASPEDMEDFVRGFSLSSGFVESIDDIYEIRVSGQGESLHAEVEISSRAFWNLKRQRRQLAGTSGCGLCGVEALEQALPQLPERSPQALPPAAHLGALRQRIEQAQRLARHSGALHAALYFDGHGELRLCREDIGRHNALDKLIGALHRQGLDAARGFAVVTSRCSLELIHKAVRAGIGTLVSLSAPTALTVQWARRHQLNLIHQPHHNAPRVYSPAPAATE

SEQ ID NO: 23333 - protein, 104 aa, Pseudomonas aeruginosa
RAGIRPRLHRRAHRRPRGLPGRTGCHPLGTPGAPVRAGPGGNRAGCADVPAGEQGHRLLGDGHHPAPPFGGDHPGNRQPATPARQPGPPGRRSLPGPRPQQRAG

SEQ ID NO: 23334 - protein, 387 aa, Pseudomonas aeruginosa
PVQHHHLRPGRSLSRSEGPARSGIRQRGGYPPPGLPAGRQGRPGLAVERWHRTPGTPLHPARLRHPGRPGSRLLPGNQSPGAAGERRRRQPYADFEVHRGTPGKGHGRRAHYLKPTKNAASCNRRRRLKEKSMKGLEGRPFVGVRMASIPPAKIPISTLKSRFTFGLRPPLLKKVPHTKQALGIFRICSTNRRLALVSGLGQPQHRSRHPHREKLSMKYSSILLLSLSLVGSTAFAGDDTRAAIGGALGGVLGSVVGDAVGGSTGAAIGSGIGGAAGGAVGAGRGNKTEAAIGGGLGAAGGNVIGRQIGGSTGGLIGAALGGAGGGALGNHYGDGNRRYDDDDDYRDRRYYRRAGYRDGYYRHDNGHHYGQYKKWKRHKHHRRYYDD

SEQ ID NO: 23335 - protein, 243 aa, Pseudomonas aeruginosa
MKWCGGMVTEHCSSVETANVQSEMSHPALPVRLTPCHGLSHRARFASVPDINSIRDFQMRPSFASWGLLALLLLQGPLLQAQPLSPALQQLLSLSSQRLQLADQVAQSKAQSGKAVQDSPREEQQLQMLAGQAGSHGVGAEQVRLLFAAQIEANKLVQYRLLSRPLPDAGQAVDLERIRSRLNQLNLELLRGYAPALAELRVDDCRPRLNQALQRQVRVDRLDELHAIALSRAAGDLCHWAEL

SEQ ID NO: 23336 - protein, 452 aa, Pseudomonas aeruginosa
SISAHLLQVGEGSALGGQALDQGRRLPARAVALFEETQALQQLGRAEAIGPGHGTALRGGEAVAVQVDSVDVGTTGGDTLVEDLRALVDQRQQATLEDFLVGEIAPRVAQRLGNPEHQGIHLGIVLRLAAARRVAVVAGTALLAEAAHLAKAVVHLHGRLVLADPGQLAGAPLQVDTDHVVHAERPHGETERLESPVHLVRQSAFQQHQAGLGGVGFEHAVADEAVAVAGHHADLAHPLAQRQGRLQHRRRGLRAAHDLQQPHDVRRAEEVQAEHLTRTRGDRGDGVDVQVGGIAGQHRGGLQRRVQLAEDRLLEFQVLVDRLDHQVRLAHRGEVLDRRDAGAARGRFLFADAPLAHVVRVGVGHGAERLVEHLRVAVQPLHVETGVGQAHDDTATHGAGADHRGLAEGKVLAHGLVLVVTSAGGTVDETWGSPTAQKATTTLGEGRTIFEI

SEQ ID NO: 23337 - protein, 101 aa, Pseudomonas aeruginosa
PHRDCARAHAPARVPSDRAPAGSKRAEAKDEHARINRGGYPRNRRPHAAPGATEPARPGVDGRRGPRQGPQRAGEDGAPGAAYSHWSRHGSEHDRAHARSD

SEQ ID NO: 23338 - protein, 951 aa, Pseudomonas aeruginosa
NSQVTPDTPLVAVRRVLGLRRCTAAQKRGEFAGQDARVRGHENRSQLPLAAAAVAELRPLCLRAGQRAGLRRPAPAGAGSGQRQGAEGQRRAVLRRRCQPMAIPGSRRRVRRRSGTGQSPVADELPDVQRSGAVRRARGDLVLALATATPGAFPPARHARAGAAPIRLAAGQPARFPRLILNARRAGHLHPSPVLPRPRSARRCPSGRGGRAHHALLQDRSMKKHSTARRVLALGLNLTLAGVPALLWADEEPTELPALTVSAGAAGETPPALDLDDSAGGGSRLGLSLRETPGSVSVANRASFERRGLRSTQDIANSLPGVNASAPPGFGGFVTYRGFSSNQVNQLFNGIPVQYSSAMRPLDDWIVDRVELVGGPSSFLNGAGAVGGSLDYISKLADRYGDFMEGRVRYGSYDDSEVAFGFNQALGIGPEPKHFVRLDVSRSGGNGYVDRNSRESWNVAFSLLSDLTPDLSHTLALEYQDEQEDSPYWGTPVLNPYAGELKIDKSRRRENYNVADGRYEQRVRWLRSILEYRVSDSTRWRNTFYHYDAERDYRNLETYRYNADNSGVVRSNAFLQRHDQQLNGNRFELQHSQPLFGLASDWALGFDYSINKQTRFPSTASGPFGTVDPASFEPGHFYDLPGMRPGHRKDRSNEVRTSALFAENRLGLTDELSLVTGLRYDHLDLDVRNHRVPDKDNPAHFERRWDVVTGRAGLVYQFTPHADVYLQYSTAADPPGGVLTSASFGQVRDYDLSTGDQWELGSKFDFLDGRGSATLAAYRIVRRDFSVADPNNPNLSVPVGQQTSRGIEAAASLRITPKLLAEGNFAWVDAQYDEFTENVGGVAVSRKGKTPPNVPERVGNLWLTYDFDPAWQGGVDARYVSSVYANNANTWHVPSYTVYGTFLSYRLDERTRITGRVRNLTDEVYARFVQSTPLYYVGDPRTFELSVQTRF

SEQ ID NO: 23339 - protein, 530 aa, Pseudomonas aeruginosa
LLSADMRESPWGAGRPGASAGPRRMVVEGGSIRQTPLRVVGPQRHAGSVPARGRAASAGDAGAALRSGGFAVGVARILGPVEIGLAGVLRHHFDAVLHRTGDLAQVAAHALGVDHFVAVRTVGPGQAGDGLVRGVLAGDMAAAATDAGVLVDAGDHLVVDVQVLPVGGIAHRAAAEIGQPLVAMAVHPARETVLHVLDDTEAVQHRRRAYLHRAAAERDEFRCVAPTADTADATDRQAAGLRVAGDLGDHVQGDWLHRRAAVAAVGALGADHGQGDHALQVDAGDRVDGVDQRHRVGAAAMGGARRLADVGDVGGELDDHRQRAVGLAPAGDHLHVLRYLAYRRAHAALGHAVGTTEVQLDAVGAGGFHQRQDVFPRLLDAGHHQRHDQRAVRPVLLHLGDLAQIDLQRAVGDQLDVVDPLHLAVRSEVRGITRRHVDRRGVFAEGLPDHPAPARLVGADHVVGLVGGRRGGQPEGVGRLDAGEFDRQVGHHAASTLSMSWAWIASAASLPCCTACTVRSSPSATQSPPA

SEQ ID NO: 23340 - protein, 593 aa, Pseudomonas aeruginosa
QYRQRALSRAAWRALSGGARSAKRSASVSAPASGRGRWFRESITVVASLQVSSRGSQRQYGTVRPLRAGPVLREGSALDGDRALAFGAAAEHFVHRRVGRALHVASGAGFGAQVACGPEQLALADGVAGNAAHGATFEDVEIDPLVMGGGREGAAALRVPEHQVGIRADADRALAREQVEDLRGVGGGQRDELVHRQAPAVDPGVPQQRHAVLDAGRAIGNLAEVVAAHGLLLGAEAAVVGGGGMQVAGLQAAPQRFLVFDGTERRAHHVSGRGGPVRVAVDAVVEQQVPGQHLAVDRLALGAGIGDLVQRLAAGNMHQVQRRTQRLGDADGAAGGLALDLRRTRQRMRLGAGEALGEEFLLQVEDQFAVLRVHRRHRAQLQAALEAGHQGIVGGHDGVLVGHEVLEAVHPVLCHQLAHFPGDLVAPPGDGDVEAVVRSGFLRPAAPGVEGLQQRLSRVGDDEVDDRGGPSGQPGRGAAEEVLAGHRAHEGQLHVGMGVDAARHQVLATAVEDVAAGGGFEVLADGLDEAVGTEHVGSITLFVSNHGGATDQQGHAVFPRRLTGRCRFLKLFFRHAPRTFIILSALTGFESRC

SEQ ID NO: 23341 - protein, 509 aa, Pseudomonas aeruginosa
PDERITKRILERPMQQSRSEVTERDGLVELSAGSDVLDSPRYNHDIAPTRVEQRTWNRWHITALWIGMSICVPTYTLGGVLTAYFGLSVGEALLAILLANLVVLIPLTLNAFAGTRYGIPFPVLLRASFGIIGSNVPCLIRAVVACGWFGIQTLFGGLAIHLFLGSIFPAWKALGGTGEVIGFLLFWGLNLWVVLRGAESIKWLETLSAPLLVLVGLGLLVWALPHISVSELLAQPPKRPEGASVTGYFMAGLTAMVGFWATLSLNIPDFSRYARSQKDQILGQIFGLPLTMFLFAALGVVMTAASASLVGETVSDPVSLIGHIPSPGWVAVAMALIIVATLSTNTAANIVSPTNDFQNIAPKLIGRTRAVWLTGFIGLALMAHELLKKLGWIVSDLSLESVYSNWLLGYSSLLGPIAGIMVVDYFLVRRQRLDLAGLYRDDVYPAWNWPGFAAFAVPVALTVMALGNRQFHWFYDYGWFTGSLLGGALYYGLCGRRARSPAALAKPLP

SEQ ID NO: 23342 - protein, 300 aa, Pseudomonas aeruginosa
AQPGRKLAARAELPCITGGCRHRAGADRADAFHRQQALDAGIATYVSLNLSLQSSDARLQRLQFIFQFTQQLAHRGRQGRRFGSRDRFEQGHRRRSPTSRRDQPELAQQATHLIAQRRAGPHQTTAHPMHRLHGLLLCALHRDIAHARTTGGFADRLGVVCIVLVPLDVGFDELRCDQAYRVAQLPQLARPVVRTAAGLHRHQARRQLAKEIPHLCPLELATTYHMLVTINAVHLEYLFCQIQTNATKVHADSPSGTCGCTISLALDAVGGRSPFHCPTVRSTAPASAGRPPGTTGQTMA

SEQ ID NO: 23343 - protein, 111 aa, Pseudomonas aeruginosa
ELPSFMPGGSAAIRASALPFGDLGTGRLRTPPFIPGRRAPAVRRPGASPRHPPTTASAPARGGSRPGSTAAPFPPRGRASATAGPAIARLPAAPRPGRRCATSGHPPPVPP

SEQ ID NO: 23344 - protein, 164 aa, Pseudomonas aeruginosa
PSTKPGASSASPWTEPADRHEKARARRASSQALGLLDRRRRDLAGGLHAGDFLGVEGVEVHRRQHQRRERTAYHQVVQGFASVREEDVRAERAKGMAHARRIEVLDQEDAGLLHFGDEGSGVLAVLHGHRYGQDHFVKVAVQLLLASVQVQADGRVPFLAEDFR

SEQ ID NO: 23345 - protein, 246 aa, Pseudomonas aeruginosa
VPPRTSPAAGRFRHADPVRGEHPGALRLPAGAADQRPRRVPGQAWQDPAAHRRDREVRPCDLLLLRRPRGTLRGRGAHPDPLAEGRHLRPATRDERAGSHRPYRRGHRATALRRDRGQLRQRRHGRPHRGVRGRGQGRGVPGHLHGPYRRGAGQGRRRSPDHRRPRQCRADGRRVHRPGAHRAHLRTGALRLRRQAQAEHPRRRRAGRRGADHADPHGAGAAGGNDRSQHRHPRLIRERRTPAQGG

SEQ ID NO: 23346 - protein, 820 aa, Pseudomonas aeruginosa
RAGRRALFPRRHLPRFNAADRPTGLATRRRDVCRGFHFPRLPPASRYVAEARASLARAVFSICPTRISADVVPPRHLAPRPVLPAPAGPRLAARDLLPRLLRRGSRSACGRRPGCTGRPRPVAPAPGGTPRLGPGPGAAAGRRRGGPVPAPATRLRQPQDPGQGGGRPAEPAVHHVLQLRQGTGAVPATGLPAEPVPRRSPRSRPPLVLAAARGGGAGAASAGCRRRPAAAGTPRAGLALAVHPGQPVLRFPCRGSAVPRLPAATPGPMAGPLARPGAGLGAVRPGALRRRPAADAVRRPRRADLRVGLAVERPPVGGDAVPLRAEPDASAAVHLPALQTRLMPVAFVVDDIRRCHPAEIRGSAPQRAVRGVFFNGGHGHTRPVQFPGARHPMLRLLPLLLSLACLAPAFADERADTQRQLEQTQKDIGELKKLLDGIQQEKSGVQKQLKSTETEMGDLEKQIKALQDELDKSEAELKRLDGEKKKLQDARIEQQRLLAIQARAAYQSGREEYLKLLLNQEHPEKFSRTLTYYDYINKARLEQLASFNETLRQLANVEQDISAQKAEQLSKQGELDSRREALAATRKERQQALAKLNSDYRERDQKLKSRQQDQAELAKVLRTIEETLARQAREAAAAAERERQRALAAERERARQQQAAPGRVTSPPREPAPGPLVSSTGAVYGGAFGSARGKLPWPVNGRVVARFGSQRGDDPRAKWDGVLISASAGSTVRAVHGGRVVFADWLRGAGLLVILDHGGGYLSLYGHNQSLLKDAGDTVKAGDPIATVGTSGGQSSPAVYFAIRHQGRPADPITWCRAQG

SEQ ID NO: 23347 - protein, 200 aa, Pseudomonas aeruginosa
PWRSSRETPHAAELAREAHQRGRTVILHMPMDPAGGPYAWRPELTQEERARRLDAALAKVPFVQGLNNHEGSRMTAVRPAMAWLAEELQRRGLYLVDSRTSAATVAASEAQRIGLASVSRDVFLDNEATPEAVSAQLQAGVALARKQGSALLIGHPHKATLDVLARELPKLRAQGIELVPPQMLIGERGNRNVNPRQAPH

SEQ ID NO: 23348 - protein, 220 aa, Pseudomonas aeruginosa
AGARSAATSRLCPRASSTWTWWRPPSPGKKSPTPTSSTSSTACCYPAAIRKPPMSRAWARTACSTKWRGSARPPAWKSRRTVPASSCSPACGARARTTVSASRQWCCAATTRARAGGGSRKASWPRRIDWAGLSHRASTARMKSGSGVISNTAVPMAAGEPGPAGAGCSIRPTAAPVSSRSPPPRRCWWTSPTPASWRRTASTGATTTASTGRSRHTSPN

SEQ ID NO: 23349 - protein, 427 aa, Pseudomonas aeruginosa
RQVGLETVLAEELGDGIALVGADPVFLRLVQAAQGDRAVALGQQHPVVRADRTDPLELVLALGQAGGDEHPVAGLLQRQLVDAVPGETQGQAVLDAGALEHLADDIHGDAVDVVFLGEVLAVDRHVVRREVLREQDHAVVGIGFGARAADQQQGCEQREEQASLHCCHPVRGLERGRITSAAPPGQPFASIAGEASVALADLLQQAFAAQRVDRRLQLLHQLVRGVLVQRQEQLGGMETLDHLHLLEALALGDVAPARIGGDPEIDLPAGQLVDVLVVAQRQLHLQAAVDQVLADGVVLVAADPVARGVFQAVQVDAAVAAGHQYPVVDRQRADPLELVLALRRTGGGKHAIAGLAQRLLVDPVPGEAQDQLALDLRALAGGAHGIGADAADAIVLGVVAAVHRHVERHQVLGQQDQGFGARQGASA

SEQ ID NO: 23350 - protein, 293 aa, Pseudomonas aeruginosa
LYLKESRASVDSRSGMASRSPALCAAAQRASAHHDTAAGQVGLGFRHGVLAEVEDARREHRVGLALEDAGGQVLQVADAAGSDHRHVHRLADGAGHAQVVTALHAVLVHAGQENLASAQVFHLLRPEHGIQPGGLAPAMGEDFPARRLARGGNLLRVDGDHDALRAEAVGGLTDELGVEHRGGVDRDLVRAGIQQVADVLHAAYAAAHGQRNEHLASHALDGMQGGVAPVDAGGDIEEGDLVGTLLVVAASDLDRVAGVADVLELDALDHSAVVHVEAGDDAFCQCHAVRLRP

SEQ ID NO: 23351 - protein, 233 aa, Pseudomonas aeruginosa
PAPGRHRRAQGPWPPSAGCPCRSRSRLPSASQAPFGRRHLPGHPLVQLDGHAQRAAEGLEHGLDLVVGVVPAQVVDVQGHLGVVDEALEEFHEQVDVEAADAGTGKGNVHLQAGPPGEVDDHPRQRLVEGHVGVAVAADALLVADGLGEGLAEGDADVLDGVVIVDMQVALALDVQVDQAVAGDLVHHVVKEGNPGIEPGLAGPIQVDGDLDLGLQGVARDGCLAFGHHQLHS

SEQ ID NO: 23352 - protein, 632 aa, Pseudomonas aeruginosa
EGQHYRQARAGAASRDRRRESPHGRRARPYTALLSSRRGEPHARDRRNPRPTQRPGSPGPGEDLRRRAGLAVRPACRRRGAGRGRAGRRRADRRALQRPPAGCRPAAARRRRLAAVAPLRARHHPRPRGRPTPPRRGPAPGCRSRQAAAPGRPGRAPGGPCPRGTPRAAAGQPLICSVAVPATELRHVLFLRRTRRPACPQGGRPDRAATPGADGPGQLRPAARLRRREYPRPGRGPDRLQLLEEQPAGAGSDHRRAAARSQRRMNDVDVLVVGAGALGLACAARLAEAGHGVLVAERERLVGSHTSSRNSEVIHAGLYYPPGSLKADLCLEGRERLYAWCARHGVGHRRIGKLLVAVEENERERLQALAANARACGVDDLMPLDGTTLRALEPQVRGVAALLSPSTGIIDSHAYLQSLQAVAERHGAQLALDTRVDRLERHAGGWRAEGQSVGEAFRLRAGWVVNAGGLFAQALAQRTEGLDPRLVPALHLCQGRYFSYSGRSPFRHLVYPMPEARTAGLGIHATLDLGGQLRFGPDVNYVDNLDYRVDESLRPAFAQAISRYFPGIDPRRLAAGYAGIRPKLGGPGEPAADFIIQTPAEHGLPGLVNLFGIESPGLPASLALAERVARAL

SEQ ID NO: 23353 - protein, 781 aa, Pseudomonas aeruginosa
DEVSPRAGSAWQNGVVILARTFTAASTKDSSMKAFGKVLGLFFLGLLLLVVALGFALTHLFDPNDYKDEIRQIARDKANLELDLKGDIGWSLFPWLGLELHDTSIASAATPTKPFADLQMLGLSVRVLPLLRKDVQMSAIRVEGLSLDLVRDKQGKGNWENIGKPAQPQAPAAPSATPPAADGKGAQAQAPEQAPQNDSPRTPIKLDIDSLNVNNARVTYTDEASGKQYNVEGIELSTGAIREGSSIPLKLNAYLGTNQPVVRVKTELTGNLRFDTALRRYQLEDARLSGEASGEPLQGKTATFSAQGQLLLDQSAQIAEWNGLKLSVNQLRALGELKARELDKDTKFSGGLSIAPMNLREFLAGIGVTLPAMADANTLGKFELNTRLAGSRNSLNLEDLKLGLDDTAFSGRFGIADFARQSLRAQLKGDKLDLDRYLPAKAKQAQDAASATRKAEVDATVASDAQGNTPLPEKPTRQAWSDAPLLPIATLRKLDLDVALNFGRLTVEKLPIDDASLKLRGQGGVISLDDMRGGLYNGRFNAKANLDVRQDSAVLTATKHIANVPVERLLEAQGKKPPVKGLLDLDADIRTSGNSEKSWIDHLNGNARFSLINGVLPDANLEQQLCQGIATLNRKALAGTHGGKDTPFRELKGSLNFTNGVASNPDLKVAIPGLAVSGHGDIDLRVLGMDYRIGVEIQGDKSDMPDPACQVNQRYAGIEWPLLCRGPLELGAKACRLDKEGMGKVAAKLAGNRLNEKLEEKLGDKVSPELKDALKGLFNRK

SEQ ID NO: 23354 - protein, 182 aa, Pseudomonas aeruginosa
HLKASTARSSTGTTVTVARICPGSRASPPTGCGSRKSCCSRPRSAPCSVTSTVSWQRCPTSRHWPRRPRTKSCTCGPGSATTAVRATCTRPRRSWSSGMRGSSPATSSNSPNCPASAAPPLEPSPACRWACAHRSSTATSSAYWRATWRRTAIPANRRWPGRCGKPPNASPRTHGSTTTPRR

SEQ ID NO: 23355 - protein, 122 aa, Pseudomonas aeruginosa
RSCSSAQNRNSDAARPRECRARGPGGNCRRTTMSRTVMCRKYHEELPGLDRPPYPGAKGEDIYNNVSRKAWDEWQKHQTMLINERRLNMMNAEDRKFLQQEMDKFLSGEDYAKADGYVPPSA

SEQ ID NO: 23356 - protein, 369 aa, Pseudomonas aeruginosa
PPPRPTEAAMTPSLSGLPPIRTALIGYGFAGKTFHAPLIRAVPALCLEHVVSRDPGRVHADLPEARVSADPDEAIEAADIDLVVIASPNATHASLAERALRAGKHVVVDKPFTVTLAEARRLADLARERPGQVLSVFQNRRFDSDFLAVEAALQAGSIGPVRYFESAIERFRPQVRDRWREHDLPGSGLWFDLGPHLLDQALCLFGVPQRVHGHLRRLREGALTDDWFEVLLDYPHCQVALRASMLAANPAPRFNVHGDHGSLLKAGADIQEAQLLQGLHPGSAGWGRDPDLLQHIDGQGLRQSLVTPAGDQSRYYQALAAAIRGQSRNPVSAQQACALMALLELARRSAEEGRSLPVELRDEERQAWN

SEQ ID NO: 23357 - protein, 122 aa, Pseudomonas aeruginosa
MSASSIEALASAWAQVAREAALPAEYEGTATPEAHRASELIQERIREHIVASNDMRLFGLLHLLGQASLRMEQVLWPEDYERMIREVEETLQEADAPNAKYFTHEEAIQAMQKRIDKPQHSE

SEQ ID NO: 23358 - protein, 85 aa, Pseudomonas aeruginosa
LRQPRTLLGITSATKLDPKSACILSNSYDYSIANNGPGTQHQRQPAPAGINAHVGRQDEIPEVFPGDVVALPHLASPFSRLLSIS

SEQ ID NO: 23359 - protein, 122 aa, Pseudomonas aeruginosa
ILSPPHSWRLSMSSSEYQVGLSAGYAHSRAAQASYEAAINEWRLHSENLKHQVNALNERIEIMQGHFEANNYVLLLLLEELRKTSPNSPLLVKGNRDSLRQKAFDRYLEDRGYEGPSSRPRR

SEQ ID NO: 23360 - protein, 305 aa, Pseudomonas aeruginosa
TRRTLSGPPIDAEEKLQLPAHHLARRPAGDAAAGTHPSLAGLGGQLAEPLRRSIQPDRSRLRRHRPAARRRFATGLPARYRATAGSHLPAWPRRTARPEAAAGQPVRPDPAAHPADRQPVQPGRPFRRPAGQEAGRRHRRDESGVVFLRRRRRRRAGADAQPRSGGTGRPRALRDPGADRADPGGRRPALRSGGMGETGTDRHGHLHQHLCVDGHHPTAAAGRRQGAGGAARGAAAGGSIGGPACPGTGRAPTSRLCFRSGFARSFLRKPTVLFLRDSALQRCDKMPPTPLQRHAACLAPVEALC

SEQ ID NO: 23361 - protein, 274 aa, Pseudomonas aeruginosa
LAFARKALPIRITRGKSMAEATPALEIRNLHKRYGDLEVLKGISLTARDGDVISILGSSGSGKSTFLRCINLLENPHQGQILVSGEELRLKKSKNGDLVAADSQQINRLRSELGFVFQNFNLWPHMSILDNVIEAPRRVLGKSKAEAIEIAEGLLAKVGIADKRHSYPAQLSGGQQQRAAIARTLAMQPKVILFDEPTSALDPEMVQEVLNVIRALAEEGRTMLLVTHEMSFARQVSSEVVFLHQGLVEEQGTPQQVFENPQSARCKQFMSSHR

SEQ ID NO: 23362 - protein, 233 aa, Pseudomonas aeruginosa
LLMILDLHGFGDQLLAGTWMTLKLSLAAVCVGLLLGLLGAIAKTSKYAALRFLGGTYTTIVRGVPETLWVLMIYFGTVSGLNALGDLFGKPDLALSPFAAGTLALGLCFGAYATEVFRGALLSIPRGHREAGQALGLSPGRIFWRIVLPQIWRVALPGLGNLYLILLKDTALVSLITLDEIMRKAQVASNATKEPFTFYMTAAAIYLSLTVVIMVALHFLERRAGRGFVRNEL

SEQ ID NO: 23363 - protein, 293 aa, Pseudomonas aeruginosa
SNAGCGSTPPRAAERVLSDACGAAIIAAPFSRCRSHRVRNLPVPHWRRPVAALPRAGRVPPRTPAALATPPVQRTDPGVGSRTRRAGVLAARAQPRTGRRGAQPAHPPGRARALSAARRPSRGAGRGRRTAIGGTPAGTEPLQRRRTGTQVAADRPVRRAPAVRPAGRPLARLVLRQGPSGPPAGPCGATADLPRTRSRAGRRRTAPERPPGALRPPPPPGCAGRGLRRAPASRAYASGPARLRRTTPAPAAPGQPGRLSPTGGGAMLLQPHSGAFLPATLASSRPIAARAIA

SEQ ID NO: 23364 - protein, 175 aa, Pseudomonas aeruginosa
SLPRQYYFETLSLPRQRSPMGHYSASDFPFKGSIGQLIGVSAATKDRILEKHLAALDITAAQFKVLIFVGLNRANSPVELCRELSVDSGSMTRMLARLEKKGLLLRGRCPEDRRCLRLDLSEAGRKVQEQLPLIASAAMNELVACLSTEELQTLTHLLTKVLLHAGCPRASLQES

SEQ ID NO: 23365 - protein, 493 aa, Pseudomonas aeruginosa
SMPFPLLHPWPQRLALASAIVLAAGCVTSEGLEPNARLQPAGALQAGRSLDGVALSPAAWPRQDWWTGLGDRQLDQLIGEALQGTPDLQIAEARARQAAATAQAQDAARQPTLDAKASYSGIRAPTSVAPAPLGGRYSAIKYLSLGFNYDFDLWGGERAAWEAALGQANAARIDSQAARIGLSASIARAYSDLAHAFTVRDLAEEELKRSQRMTELSQKRMSAGLDSKVQLQQTQTQLATARQQLSAAEQDIASARIALAVLLGKGPDRGLELQRPQPLNPASLSLPSVLPAELLGRRADIVAARWRVEAARRNIDSAKTEFYPNLNLGAMAGLAALHTSDVLQAPSRFFQVAPAISLPIFDGGRRRANLAERDADYDLAVGQYNKTLVQALGEVSDNLGKLRSLEQQVIDQRQARDIARSNFDLAMRRYGEGVGSYLDALSVQQQLLVAERQLASLESQQIDLSVQLVQALGGGFQPDSRSAALATAKAPAE

SEQ ID NO: 23366 - protein, 143 aa, Pseudomonas aeruginosa
SFSPPWPAWPGSSSTAAGTRTPTTPTSTATWYRSPRRSSAPWSASAPTTATWCARARNWSGSIPATPTSPSNAPRPTWPTPCARCAGCSATSTAIAPRSPPARSRWPRPRPTTSGARTSQTTAPFPRRNWPTPATPWTARKPR

SEQ ID NO: 23367 - protein, 136 aa, Pseudomonas aeruginosa
WPWSRWTRSGSTPTSRKPSSSTCVSASRWKSAPTSTAATCATAAPSTASAWAPAARSPCCRRRTPPATGSRSSSGCRCASILIRKNCRSIRCASACRWTSRSTCMTRAARPWPSNHRAKRCSPPMSTSSNWPRPTS

SEQ ID NO: 23368 - protein, 528 aa, Pseudomonas aeruginosa
SKPTSPKTTARPPSVEPASMSESSSFSPPSLVMATIGLSLATFMQVLDTTIANVALPTISGNLGVSSEQGTWVITSFAVSNAIALPLTGWLARRVGEVRLFIAAALLFVLASFLCGIAQSMPSLVGFRALQGFVAGPLYPITQTLLISIYPPAKRGMALALLAMVTVVAPIAGPILGGWITDDYSWPWIFFINVPVGLFAAFVVYQQLKARPVVIKKAPMDYVGLIALVIGVGALQIVLDKGNDLDWFESNFIVGGALIAAIALAFFIIWEFTDRHPIVNLRLFAHRNFAAGTLALVLGYAAFFGINLLLPQWLQTQMGYTATWAGLAAAPIGILPVFLSPLVGRYANHFDLRMLAGLSFLAMAITCFMRANFTTEVDYQHIAIVQLIMGLGVAFFFMPILSILLSDLPPDQIADGSGLATFLRTLGGSFAASLTTWIWNRRATQHHAYLSENISLYDPATHETLAQLGGNTQANAALLDRMVQSQAYMMSTIDYFTMLGWLFLALLVIIWLARPPFGAKPGAAASGH

SEQ ID NO: 23369 - protein, 94 aa, Pseudomonas aeruginosa
CCLCMYSYAPVSCVSPAGMSSTSREVSGRYPTLAQPSTACLFPQGVQRWPGIFTLYPYRHRQWPCLSRFTRSPASSTWCSRGMPNRGNRCPKTR

SEQ ID NO: 23370 - protein, 351 aa, Pseudomonas aeruginosa
SLITLNILGGMTWGEDRRADDEVTDMALVGRHDGRNFGYGRQLSYAGPQALKDMFGGGHYGTVKAHTDRWQAFVKWCRSEQGPGINDARQIDRKVLSDYAAHLREVVRRGDLAISTAQNRLSSVNRTMAALRGDQYVKLPSPSKALGMQRTGVRHSVPQGQDREQVKQIVDALCDQQQLRAAAIVLLARATGMRLREAVLADLPRLNREARDIGKINIQDGTKGGRAGASAPRWIAVDHHIQDALGFARQVSPASSRNLIAPDESYLNVLQEIIRPARDVLHAYNLKGFHELRAAYACERYEQITQHRAPINGSQCCQVDRNLDREARRQISYELGHGRIDVVAAYIGGRS

SEQ ID NO: 23371 - protein, 134 aa, Pseudomonas aeruginosa
STTPWPASRCRSTATASRSETGSTSRTIAAPSAGSSKPGNWARPTMSAAGTKRPTSTWSRPSAPSSTRSSRAPTAAAIASRSPSSRIVRAMIAATPSMPRAWSASWAGSRRKPSRPASARPCAGTWTTRTGWPT

SEQ ID NO: 23372 - protein, 564 aa, Pseudomonas aeruginosa
PSARRSRRPRRPGATGSRRAAAVHRQRRCLHRGGQGRERCRQRPPDQCPRRRGTGRGGRGLRRLAGALLHRLRVRRRGQRAFRRGRADRPAERLRADQAGRRAGHPRQRLPPPDLPHQLGLRRARRKLRQDHAAPGRATRRTQGRGRPVRRAHQRRADRRRHRPGPAAPALGCRAGSTGQRHLPPGRQRRDVLAPLCALRHRTGAGAGLGVAGDAAAGPADRHRGLPGAGEASGQFAPRQPQAATGLRPGTARLALPCRTHDPGTERAGTTMKRKGIILAGGSGTRLHPATLAISKQLLPVYDKPMIYYPLSTLMLAGIREILIISTPQDTPRFQQLLGDGSNWGLDLQYAVQPSPDGLAQAFLIGESFIGNDLSALVLGDNLYYGHDFHELLGSASQRQTGASVFAYHVLDPERYGVVEFDQGGKAISLEEKPLEPKSNYAVTGLYFYDQQVVDIARDLKPSPRGELEITDVNRAYLERGQLSVEIMGRGYAWLDTGTHDSLLEAGQFIATLENRQGLKVACPEEIAYRQKWIDAAQLEKLAAPLAKNGYGQYLKRLLTETVY

SEQ ID NO: 23373 - protein, 618 aa, Pseudomonas aeruginosa
RSTGRCRMPPCFRRRTARARHSPTPTASPERQGATGLGARRDNLGHPVRDAPDTRSHGRFVRLESLFPSLALAGHPRPASRAAALAPAIFRRALLQRAVGRAEPPDARPLRRQPARHAAPLRRTAADPRRPAGAAPGPATTWRPAAAEDRQRGAGRHPPTHRRRRDLPAATGRHYPGRLQLGPGGQFRPPQLRLPPLLSRGHAGPPGALLRPGHHLDQARLLLRQCGEGRLADHRRAGGEGRSRTHRTALGQFPGATAGDRQLRRGDPLLPRGLALPCQSAAERGGARRDPRQHPLPGAGPEAPAPAAERLAQPEPDATGNRLDGEHLRPPHPHRTAGAQRPADRRRDPARPAPAAYPADPQPPSLPGPHRSRGRGQAPVGRARTGTHPRAGERQRAVAAGSPRTRAGPARADARPGRSGPGRQAHGPRHHVGEHQPRTQPAAGGDPQLRRQRPGAARPPAHRGRPRQSRADQRPHHPHGLDHRPPQGLCPRCAPGAGERAVAAGDRGRPVDGGQPAAGDERRTAARRAGRPAVGPGRRDPLAADPRQPAHQCPRRARRESSAAAPVGNRQPGPARRDPDPARQRPGVFRGRPGPRPRTLFHHQDHRQRARPRPGHLR

SEQ ID NO: 23374 - protein, 504 aa, Pseudomonas aeruginosa
PIARPRRPPGNGQPSRRRRRGAPALAAGSSRRRRHAPGGNPRMSPFAPFDAQTQVLLIDDDPHLRQALRQTLDLAGLKVATLDDARQLDTAQCKDWPGVVVSDIRMPGIDGMELLRQLHEQDADLPVILITGHGDVPLAVQAMRGGAYDFLEKPFPSDALLDSVRRALEVRRLVLENRTLRLALAERHELHGRLIGRSAGMQRLREQVGSLAAIQADVLVLGETGAGKEVVARALHDLSSRRDGPFVAINAGALAESVVESELFGHEAGAFTGAQKRRIGKFEYANGGTLFLDEIESMSLDVQVKLLRLLQERVVERLGSNQLIPLDIRIIAATKEDLRQAADQGRFRADLYYRLNVASLRIPPLRERGEDIPLLFRHFAEAGAMRHGLTPRELDAGQSARLLAYDWPGNVRELQNAAERFALGLGLSLDDGVLPDAADEPHNLSAKVEAFERSLIAAELERPHNSLRSVAEALGIPRKTLHDKLRKHGLPFNTPGENPPDDGE

SEQ ID NO: 23375 - protein, 411 aa, Pseudomonas aeruginosa
MADYRQPFAIRARSISPAYPCPTGTGLAHGFPSVPTSRRPGAFPIHAASAAALPRLPLFGHAERTPVLFIKDRQEQRGSLMLKHTAKALVCALSLTVAGIVQAADPIVIKFSHVVAEHTPKGQGALLFKKLVEERLPGKVKVEVYPNSSLFGDGKEMEALLLGDVQIIAPSLAKFEQYTKKLQIFDLPFLFDNIQAVDRFQQSPQGKELLTSMQDKGITGLGYWHNGMKQLSANKPLREPKDARGLKFRVQASKVLEEQFKAVRANPRKMSFAEVYQGLQTGVVNGTENPWSNIYSQKMHEVQKYITESDHGVLDYMVITNTKFWNGLPEDVRGVLAKTMDEVTVEVNKQAEALNQGDKQRIVEAKTSEIIELTPEQRAEWRKAMQPVWKKFEGEIGADLIKAAEAANQAQ

SEQ ID NO: 23376 - protein, 215 aa, Pseudomonas aeruginosa
EEGKPMHALARVWARLEEGLIAFLLAAMTLVTFVYVVLNNLYTLLYDLADLWEGGNETLLAIGDGVLTLAQEMTWSNALTKALFAWLIFLGIAYGVRTAGHLGVDVLVKLASRPVQRVLGVIACLACLGYAGLLCVASYDWVKTLFIAGIGAEDLDHFGIRQWHIGLIVPVGFALVFIRFAEILVRILRNRQTGLGLADEAADALKLTEHEEPKA

SEQ ID NO: 23377 - protein, 374 aa, Pseudomonas aeruginosa
PARSSATRSTTDRQPALELNGGVPREGAAHRLPTRRSIMAFNMHNRNLLSLMHHSTRELRYLLDLSRDLKRAKYTGTEQQHLKRKNIALIFEKTSTRTRCAFEVAAYDQGANVTYIDPNSSQIGHKESMKDTARVLGRMYDAIEYRGFKQEIVEELAKFAGVPVFNGLTDEYHPTQMLADVLTMREHSDKPLHDISYAYLGDARNNMGNSLLLIGAKLGMDVRIAAPKALWPHDEFVAQCKKFAEESGAKLTLTEDPKEAVKGVDFVHTDVWVSMGEPVEAWGERIKELLPYQVNMEIMKATGNPRAKFMHCLPAFHNSETKVGKQIAEQYPNLANGIEVTEDVFESPYNIAFEQAENRMHTIKAILVSTLADI

SEQ ID NO: 23378 - protein, 330 aa, Pseudomonas aeruginosa
PRSCAPAHAAGRSRLPEVTDMRIVVALGGNALLRRGEPMTADNQRENVRIAAEQIAKVAPGNELVIAHGNGPQVGLLALQGAAYDKVSPYPLDVLGAETEGMIGYMIEQEMGNLLPFEVPFATILTQVEVDGKDPAFQNPTKPIGPVYSREEAERLAAEKGWSIAPDGDKFRRVVPSPRPKRIFEIRPVKWLLEKGTIVICAGGGGIPTMYDEAGKKLSGVEAVIDKDLCSSLLAQELVADILIIATDVDAAYVDWGKPTQKAIAQAHPDELERLGFAAGSMGPKVQAAIEFARATGKDAVIGSLADIVAITEGKAGTRVSTRKAGIEYR

SEQ ID NO: 23379 - protein, 611 aa, Pseudomonas aeruginosa
FLPPRLPSHGHRIDGPAGAPGNPSRPGGHDETGQGRRRPLPGRRRHAAVPGGHRAALRRTHLRLYPGAAHRTAVPRPGCRPLAQGPRAVPCRRPDADLQGLAQATARAAAGQLVDRSRGGRRGTGEHPRALRVQGRQLPCADGEVRWPAAHRFRTRRAVQLALPPARPADVGGRRDRRDPLHRHRLEDHRRQRPARRDRGVLRQHHEPARRQRFRRPDAIPPEGPPGLGQATAAGLQQHAHRFHQCLRARQRRHDRQHHRRLRHLPLQPAEGYRRHHQRPGPGGHRRQQRGADPAGVHRGLQCHGRTGHRRRPAPDRRPRRRGLPPRQPAVRRELRLHPGRVQPIRSADGRRTGPAPGRGYPRRGNRRVHQRRRFQEVHLRPRPGQLPDGSQGGGQRGADRRPGHRAPRQLRPRPRLQHAGQPGHRIGNPRPRGQRLRHRRLAGHRGEGLRRPLPGHRQRRSTDFRPGHLQVRHPPWDQDHRQGRRRRPPAAPEHLQSRHAPGQAAGGVLHQLQGLRRQQRQRRGAVAANRREDAAQAPWPSGLRRLRREARADPRHRPRLRPARAAGRPGDHLQLRPGPDRRTCHRGQRRTGDGARLQPAAGIQEGRAFQ

SEQ ID NO: 23380 - protein, 133 aa, Pseudomonas aeruginosa
QRPLTGTPTRPNSTRPSSTRATLTVNSSLPEMNSLVPSSGSTSHQRRQWPRSLSGISQSSSESTGMSGASARNPASNIWCAARSAAVTGDSSAFERTATSARQCGRIASPARRTSATNSPQGTGLMPGTRRAG

SEQ ID NO: 23381 - protein, 260 aa, Pseudomonas aeruginosa
LLGEAGGLSYPGFSDYPCRRLMGSDRFPHRSRRTATRAAMPTLPWSAIDTVLLDMDGTLLDLHFDNHFWLEHLPQRYAERNGLSRTEADAVLEPLFREHAGQLNWYCLDFWSRELDLSIRELKHEVAHLISLRPHADTFLAALRRAGKRVALITNAHRDSLSLKLERIELAPYFDRLISSHDYGYPKEDARFWSALQADFGFDPQRSLFIDDSLPILRSARAYGVAHLLAVRHPDSRGQVRDTEEFAAQEDYRRLLEGLP

SEQ ID NO: 23382 - protein, 142 aa, Pseudomonas aeruginosa
WPRPRTWRISSAVSASAAASWSPSTTSMKSASAARANPSTPRSKSAAARSGTSSANAGNWPALPAAACAASKPWSRPCRNCRNGRRRRCLPPPISAPCASVSSRPSDWRAIAAPCMPRCISTGMASCACVARTSAATTPSTS

SEQ ID NO: 23383 - protein, 796 aa, Pseudomonas aeruginosa
STSPITTPRGSTARRRPQPSESAMSLQPLQPRYKPYAGAAAGWGALRSVAHFWLDSKQPFKNLRALLKTNQNGGFDCPGCAWGDSPEDGRVKFCENGAKAVNWEATKRRVDAAFFARYSVSALREQSDYWLEYQGRLTGPMRYDPLSDHYQPITWDAAFALVAEHLRRLDSPDQAEFYTSGRASNEAAYLYQLFVRAFGTNNFPDCSNMCHEASGVALGRSVGVGKGSVTFGDFEHADAIFILGQNPGTNHPRMLEPLREAVKRGAQVVCFNPLKERGLERFQHPQNALEMLTNGSSPLNTAFFRPALGGDMAAIRGIAKFLLAWEREAQAEGSEPVFDHAFIAEHTDGLEAYLAELDATPWEHLERQSGLGLAEIEQAARMYRRANRVIVCWAMGITQHHHSVAIIQEIVNLQLLRGNLGRPGAGLCPVRGHSNVQGDRTMGINERPPAALLDALERRFGFEVPRHNGHNAVEAIAAMLAGKSKVFIGLGGNFAQATPDSPRTHAALASCDLTVHISTKLNRSHLTTGRDALILPCLGRTDIDRQAGGPQAVTVEDSFSMIHASYGQLEPLSQQMRSEPAIIAGIAKATLGNHPVDWDALIANYERIRELIADTIPGFADFNRRVRHPGGFYLGNSAGERRWNTASGKANFVANPLPRDLLPAQVRDSGLEPDLILQTLRSHDQYNTTIYGLDDRYRGVKGQREVVFANEADIRRLGYQPGDKVDLVSLWSDGIERRVRRFTLLAFDIPAGQAAAYYPETNPLVPLESVGVGSHTPTSKFIAVRLEKATGDGRII

SEQ ID NO: 23384 - protein, 310 aa, Pseudomonas aeruginosa
LSIACTIASIPVAAVTAGGKPRVRSASSSARSGSKWGETTPTLVVSPVVTMAIGVTSEPVPAVVGTWISGRRGPRALPTPKTSPSPCPASGWASSATSLATSMELPPPKPTTSSAAMPRARPSAASTTDSGGSASTWSYTSTARPRRGKPGRIASSKPSRVIPGSVTINTRRALRSRQSSARRMAEPASQRICAVVAKLKACISVSLGETPVRTRNAPRAGPSGSRRHRARLRGACSPAAGCAAGRNRRCAAWPDRNRPRRSRRPALPGLAPRLATRGPRAIRRRCTGGSPPKWRRSPGDRGRRPRVPGR

SEQ ID NO: 23385 - protein, 320 aa, Pseudomonas aeruginosa
GKVVLFLKFSLVIAGIQAVNIQTFDLNLLRVLDALLRERNVSRAAERLALSQPAVSNALNRLRELLDDPLLVRAGRAMQPTPRALALEAPIRAALRQIEQSLGDGEGFDPGRSRQRFTVAVTDYVELICMPALMRRLSERAPGISIAIQHLTPTLPAEALDKGELDLVLGRFENVPARFQRRHWASETLQLVARRQHPLLAQAPDLATFLELQHLWVHGGQTKGMVDQWLGSQGLKRQVAYTTPNYLQAAHIAAYSDLVGVLPRQLAHYFERLLPLQSFDLPFDLGPFHLELVFLAQRERDIALQWLVEQIRQVGAAGPD

SEQ ID NO: 23386 - protein, 494 aa, Pseudomonas aeruginosa
RAQVKRGTSSGTGGRRDACPVVRLVAIGVRLERAFHAHADVLGLFRGQLGDHAAEALDHLQGHFLVELLRQHFDAQALGLLGGRQVGVLLLEQVDLRQHLVGEGTVHDPARMAGGVAQVDQAAFGEKDQVVVVVRVETVLAGAVDLVHLRLDLFPGPVLAHEGGVDLVVEVADVADHRALLQRLEHVGVADVDVAGGGDDQVDLAQQRGVDAGLGAVVDAVLVRRDDFEAVHAGLHGADRVDFRDLDDHAFLAQRLRGALAHVAVADHQGLLARQQVVGAALDGVVEAMAAAVLVVVLALGHRVVDVDRRDFQGAVLEHVEQAVDPGGGLFGDAVDALEHLRVFLVQDLGQVTAVVQHHVGVPRLAVLEDGLLDAPFVLFLGLALPGEHRDAGGGDGGGGLVLGGEDVAARPADFGAQRDQGLDQHAGLDGHVDATEDLRAFQRLLAGILAAQAHQCGHFRFGDDQLAAAPGGQGDVGDLVVGETGGRHDSAHA

SEQ ID NO: 23387 - protein, 238 aa, Pseudomonas aeruginosa
LSIRCLRMGAVGALTDRRGRPESALRSSLTGLGLLQRPSNGRRERPEGPPERAIIAAPYETPKSPLIRRSSPCVVSSGCGDAPQRRSAGNLRVRMLECAVMRIAPNSRSPLLQWLSFALCACVLVNALACGVLHLQALGVGSDKGQKASVGLFCVAGASQWLSLDPDDGSAGDPAPVNPQLPMSCPMCSALVLFVALGVIWSWRLQRRRQARFRPPATREPVPPRYVWPPANPRASPA

SEQ ID NO: 23388 - protein, 144 aa, Pseudomonas aeruginosa
TPRRRPASAASSPTAASARTRSTSCSTAFRCNTAAPCVRWTTGSSTASSWSAVRPPSSTAPVPSAARWTTSASSPTATAISWKAGCATAATTIRKSPSASTRPWASAPSRSTSCAWTSAAAAATATSTAIRANRGTSLSPCSAT

SEQ ID NO: 23389 - protein, 166 aa, Pseudomonas aeruginosa
RSTRAVAARTTMSPMAATNSACAGCARSSNTGSATARAGATPSTTTTPSAITATSRPTATTPTTAGWCAPTHSSSATTSSSTATASSYSTASRCSDWPATGRWASTTASTSRRASRVPPPGRSVRSIRPVSSRATSTTCRACVPATGRTAATRCAPARCSPRTAWA

SEQ ID NO: 23390 - protein, 502 aa, Pseudomonas aeruginosa
ACRRASEESSMKRYLYLWHRWLGIGCCLLMVLWFVSGMVMLYVGYPKLTPLERLAHLPELDGCEACVPLRTALAGGDGKTPRSIRLASVGGLPTYLLDDADGRTRALAARDGRPLAVDADRVLASARAFSGEVPMQLQGRIEEDAWTHTRNLDPHRPLWRVQTADEQGRLLYLSSQTGEVVRDASRRERAWNWLGAWLHWLYPLRGGWFDGQWANLVIGLSLLATLATVLGILVGLLRWRFRKPYRSGSRSPYAGGFQRWHHLAGLLFGALVLSWIFSGLMSMNPWNLFGRGTPLDLAAYQGGSWDRALPAGLEADAVLRRLRAAGLRVRELEWRALDGEPYALGRSASGNSLLLTADGEILRELPADRLLAAARALLPGVPMQAERLERYDFYYYPREEHSMMGYLERRLPVWRLRFDDPRHTWVHLDPYSGAVVGVLDDGRRGSRWLFSLLHSWDWLPLLTRRPLWDLWMLGFSLGGLVVCASGCWIGWRRLRGRRPKRR

SEQ ID NO: 23391 - protein, 213 aa, Pseudomonas aeruginosa
IRSNGSHMGTHKIEIRRRNVEKILLAAEKVFAEKGYAGTSMGNIAEEAELPRSNLHYYFSTKDELYRDVLLGLLEVWKQDALCFEMFDDPRVVLTSYIRAKMNHSRTRPHGSKVWANEIMHGAPLLGATLDDSLYEWAKMKEAKIRQWVEEKRILSIEPSSLLYMIWASTQHYADFGYQVEVLNGHQPLSDMQFERAVQTVTSVVLRGIGLEP

SEQ ID NO: 23392 - protein, 451 aa, Pseudomonas aeruginosa
AAEPSLEGSGEGSAGAGEVHRFRLFEEHRGLRRDRLGEQPSAADRVAHRDLPAHRVEAVAGRQHQQVGRMADLDAVFPQAEGAGAVAGDQVEAAVDLVVAHHLRHVQAHVQHLQHVRGAQRVPGVEHVVVAEAGVDPGTEQFLDPGDAAALRVVVEATLQVDVHQRVGDEVDSRQFQQAEQPRGVGAVVGVHRRGVAGGDPCAEAVAMGEHGQGLEEARLLVVDLVAMHVHRQVVALGQVDGLVQRLDAQLAGEFEMRDRPHHVGSQAQRLLQQFQAVGVGENALLGEGDDLQVDPGRHFAAHLEHGLERGEGRVGDVDVAAHVLHAVGDLPFQGLPGALLDVLVAEQGLALGPALDAFEQRAGAVPLRLAGGLGGVEMDVRLDERRHGKTAGAVQALAGVVGGLFHRHQGGDTAIGDAQLPETFAAAQAQVVNQHGGPLLVCSGCGSAGD

SEQ ID NO: 23393 - protein, 495 aa, Pseudomonas aeruginosa
PSWPSATASSTGSTTTAGSPARCSAARSTTASAAAVRGARRHWPNRCPDGHTGGRRAADTYSKPEETTMSTARNVLQSTQRHIDGQRLWQSLMDLARLGATAKGGVCRLALSDLDRQARDLFVQWCEAAGCTVSVDRVGNIFARRPGRNPDLPPVMTGSHIDTQPTGGKFDGCFGVMAGLEVIRTLNDLGVETEAPLEVVVWTNEEGSRFAPCMMGSGVFAGKFTLEETLAKRDADGVSVGEALDAIGYAGARDCLGHPVGAYFEAHIEQGPILEDEEKTIGVVLGALGQKWFDLSLRGVEAHAGPTPMHLRKDALVGAAAVVEAVNRAALGHQPHACGTVGCLHAYPGSRNVIPGEVKMTLDFRHLQPERLDSMIAEVRQVIAATCEKHGLQYELVPTADFPPLYFDQGCVGAVREAAQALGMPQMDIVSGAGHDAIFLAELGPAGMIFVPCENGISHNEIENASPDDLAAGCAVLLRAMLKASEAIAGGRLAA

SEQ ID NO: 23394 - protein, 62 aa, Pseudomonas aeruginosa
RSSQPPTWVSPIQICGTVVDPALRASSARSSGLPSQAISWKSTPLRCSNCLARMQYGHQAVV

SEQ ID NO: 23395 - protein, 529 aa, Pseudomonas aeruginosa
IWSVSEPRGNRAGHMTATPKPLVLIILDGFGHSESPDYNAIYAAKKPVWDRLLATQPHGLISGSGMDVGLPDGQMGNSEVGHMNLGAGRVVYQDFTRVTKAIRDGEFFENPVIAAAVDKAVAADKAVHILGLLSPGGVHSHEDHLVAMAQMAAKRGAGKIYLHAFLDGRDTPPKSAQPSLERLDATFAGLGKGRIASIIGRYFAMDRDNRWDRVQAAYELIVDGKAEFTADSSVAALEAAYARGESDEFVKATAVVPAGAEAVRVEDGDAVIFMNFRADRARELSRAFVEPAFNEFPRERAPQLAGFVMLTQYAASIPAPCAFPPEPLTNVLGEYLAKHGKTQLRIAETEKYAHVTFFFSGGREEPYEGEERILIPSPKVATYDLQPEMSAPEVTDRIVEAIEQQRYDVIVVNYANGDMVGHTGVFEAAVKAVECLDTCMGRIVEALDKVGGEALITADHGNVEQMEDESTGQAHTAHTCEPVPFVYVGKRKLSIREGGVLADVAPTMLTLMGLEQPAEMTGRSIVTLG

SEQ ID NO: 23396 - protein, 376 aa, Pseudomonas aeruginosa
SANDELPRRADNRVAVIRRFCRPSAENACDVIRRSGPGAAPCFHDATFPALTLPIGRQAWPRGVETCAAVFIFRVSPLPPATSPRPVLALPALSFPSALQGFPPMWFLLATSLLALSFQRLLALVLLLATCCLAFYDGVLAPPAVAALAALGVLALLRRRLAARRAWALGLELLLVAGAVGLFLHLLPGFANPRILDKAVVGPQSLPFTMYFNFDKALVPFLLLACLPSLFRDEARAPGRPWYWLLLVAAVPALLLLAVGVGLLRPELHAPAWLWQFILANLFFVSLAEEALFRGYLQQRLGQWLGPWPALALASALFGLAHFAGGPLLMLFAGLAGLIYGLAWLWSGRLWVATLFHFGLNLTHLLLFTYPLYRPA

SEQ ID NO: 23397 - protein, 427 aa, Pseudomonas aeruginosa
ELNMLHCFRPTTLALALLLGAGAAQGADAPADAAPLANGSSAPLPLDELRTFAEVLDRVKAAYVEPVDDKTLLENAIKGMLSNLDPHSAYLGPEDFAELQESTSGEFGGLGIEVGSEDGFIKVVSPIDDTPAARAGIQPGDLIVQIDGKPTKGQSMTEAVDSMRGKAGSPITLTIVRDGGRPFDVELKRAIIKVKSVKSQVLEPGYAYLRITQFQVNTGEEVVKALNQLRKDNKGRLKGLVLDLRNNPGGVLQSAVEVADAFLTKGLIVYTKGRIANSELRFSADPADPSDKVPLVVLINGGSASAAEIVAGALQDQKRAILMGTDSFGKGSVQTVLPLNNDRALKLTTALYYTPNGRSIQAQGIVPDIEVGRAKVTQERSSFEGFKEADLQGPPGQRQRRRRPPHRQACRAERAPAGFRLPAQPGP

SEQ ID NO: 23398 - protein, 343 aa, Pseudomonas aeruginosa
TAAPAPPPWPPARRSGSAWRASRAMCSSTTKPHRKRSPHNCRPASPWPASRVRRCSSATRTRPPSTCWRGSCRSCAPRASSWYRRRCSSASAATATSTHARRRTEAGFTGVAAAVKVTSSSFLHGRTDGPPFPSHAPARRRPAGRRRDSPRFHLDPHQRQVRDRRRQPRREHRRQGREHRPARHGAILHRRAGDARRHLAGRPARGRPRRAGSARGRHRPGPGGGRPAQGKRVRPPPLQLPQRHAAIRRRSGNHLCLAPGRGRRVPRSGAARRDRLPGSHAGRFQRLPAHRPAAPGQGQRSARADSGAAQRRPGQELAAARGRLHGRGESTGLGSRTALPRQG

SEQ ID NO: 23399 - protein, 147 aa, Pseudomonas aeruginosa
PLFTPSWSMLVRRISPAPRSSIFFAQSTASSPVGLRPPWVKISQRGASPGAETFFASMATTMHCEPKRSAASPTNSGLNTAAVLIETLSAPAFNRLRMSCTLRTPPPTVSGMNTWLAMRSTVCRVVSRPSTLAVISRKVISSAPCSS

SEQ ID NO: 23400 - protein, 416 aa, Pseudomonas aeruginosa
TLFKSVFGGQARGNSTLFQRPDIALDAFEPFLQVRLHVEDGLVVEVRGELAGEEIEQFLGFEGTQLQFEAVLHEALDRQYRVLSLRGVQLEDRRIALRPGHDLPAPVPGHEVLQQLQAVGMALFRVELHGETRAFGQRGGEIDAVVPVPHHLARVTGLDVIAVHEVEARLVGNLVPQRVLHRLAHLVPAHVRHLQVLAGFVQVLAEEAHLAGEQTDAVDPVVLLGALQQCLHADADAEERAVLADLADQGVEAQAADLGHAVADRANPGEHHPVGLADHRRVAANQHPAGTDVLKGLGHRVQVAHAVVDHGYRLHHRHPLVDGICPAIRSSSSMAMRSARPKALNTVSIWWWVLCPRRLSMCRVTWAWLTKPWKNSMNRSTSKPPTLARVKGTCICRPGRPEKSMTTRDSASSRGT

SEQ ID NO: 23401 - protein, 250 aa, Pseudomonas aeruginosa
SSICRSPLHSMSRSIRPWRAIWSIMWSRKGTPVSNRALPVPSRSMETLIWVSRVSRATDALRSAITSSTANTARNYKRASIIGRPGLALPAATVGANRPTGGGPGLTLRSFLPAAESRMPVIVETLAQPSAQDRLDLAKIYADAPDWLFAPHADGAALVAAGLAAGELIAGRFNDRLLGAALLRRGDDAWQLSHLCVRGITRGRGVGRRLLDEARRLAAEAGKPLRLVAPDGHLEARALAARHGLPLDSL

SEQ ID NO: 23402 - protein, 90 aa, Pseudomonas aeruginosa
YARWRSPPRSFAMSFSSAERAALLALKGVGPTVLQRLEQMGLDSFVRLRDCDAASILAQGAALTGSSCWKNSPQARAAIIAVLQRAASDA

SEQ ID NO: 23403 - protein, 320 aa, Pseudomonas aeruginosa
RLQRRGPRLVRPSRSQGSALAAGHHPLPGVGLGNHAAADPGQHRARLLRPFHGSVARRRGTGRGGRGRSPAPVDRARLLQPCAQPAQDRADRGRAACGGVPPRRRATRRTARHRPLHRWSHRQPVDGPARTDPRRQRQARTGALPGAGRLSRRTEGGQGAVGSRRTLHPARTGQPLHPGDDGPRRHPLHAQQAQLPALPAGLRLPRAPARPRSRLSAAQAAQGVAAEAHADADPGQPRRRHTALPAAFQRTLGRALEPPRTGRPRRPRTARRAPFPGPRRAPRTERPDPYLQSFPARHRALAGGGGRRSARRGRGRLALV

SEQ ID NO: 23404 - protein, 184 aa, Pseudomonas aeruginosa
SARYRRCAWSTWSPATLGGCTPTCPKPGSAPIRMRPSRPPTSTWWSSPRPMPPTPASPNGPCAPASTWWWTSRSPSPWPKPGASPTSPVNGLGRSSRCSRTGASTATSSPWRPPCRPAASARCATSSRPSSASVRRSATAGANTTCPAPGCGSTSARTCSTRHCACSAYRSVCTDTCAGCARAR

SEQ ID NO: 23405 - protein, 155 aa, Pseudomonas aeruginosa
RLTQARLRHPCRRWWPGPGQKAARRLARHPCLTSSIEVPNVRGGNQTMSRSRRKTPIVGHTTCRSESEDKKLWHQRWRTRERTALAGASTEVLSAHLTLRENQVSNVWSMGKDGRSYWPIKHQIATAERIANRKGRNPQERASLKKRLLRKWMSK

SEQ ID NO: 23406 - protein, 149 aa, Pseudomonas aeruginosa
FQTRCSMNDKSKSHKPTAKGQPLLQEAGSGRFVTLAFAGDPSQLKQAAKPAHGTVWVKSFRLARGVAKVKQVSNRADKLSMAAMQKQIQELQQQMQVLIEHESERIQEAVVVDLVDLEGLTVLNSAVARDLVDNPPAPNAKLQALLALR

SEQ ID NO: 23407 - protein, 175 aa, Pseudomonas aeruginosa
GLEDMDFITEPYNRSVDRKSFDCGLHPALNTYIAQQASQDEKRNVSRTFMLIEDGQLIGYYTLANASVVESDLSEEQMKKMPRYPMPAVLLSRLAVDKSQQGKGVGKRLMSDFFRRVYVISKHSGVAFVVVDAKDDDAARYYKSLDFVETNTSPLRLALSTGTLIQGYKALETSD

SEQ ID NO: 23408 - protein, 78 aa, Pseudomonas aeruginosa
LPSDSIFERTLSFMPLNNTQYSDYLFNYFSLISKAIYIASTLGHALTPQRFLKLSATTVNCGGHSSPICRLTFGRADC

SEQ ID NO: 23409 - protein, 161 aa, Pseudomonas aeruginosa
AMKIIPRNITAPPNTDIMLPSTSSVSPPSTFPPEWMVPTMEPNTSSRKSTEVSPGGGVNWLIPPEDSAWAAPPKNAARNRQSSSVFFIWLLSAVQAVKPRGWKERHERTAGHTECRRAHKDGSHRTNTAAQLKGPVRQLWGTPTSLVTHPKRGVGLVGLPS

SEQ ID NO: 23410 - protein, 272 aa, Pseudomonas aeruginosa
TRLAQPTRNDESPRRIFRPSRRTAEREPGSADRLGGPCPDPRSMLKKSFNSLLTTWLAGLLVMLPLVLTLALLAWVVSLLNRFVGPSSLIGRGFAAIGQPLAGDSPLAYLLGTALLLVAIYLLGLGVQLGLKRPLANLFDLTLRRTPLIGNLYNLADRFVGLLDKKQDADIAAMSPVWCFFGGDGAAVLALMPNPEAVELDGRAHYAILVPTAPIPVGGGLLYVPVEWVKPAQIGMDTFTSIYVSMGITPPPPLAAAKVLAEPRAEQPPAAP

SEQ ID NO: 23411 - protein, 267 aa, Pseudomonas aeruginosa
EDPAGRRCNPGLRPRRQRRRQAAHRHRRRLPALQRHRCQRPGGRLRPRHRQGAVRQDEDRVRGGDLRLGRHHPGVERQEVRLHRRVHVDHRRAQAGSRLHRSLLHQQAAVRRAEERRLQDRQGLPEGQGDRRPARHHRRHLAGRQHGRRGHHQALRHPGERLPRPLLGAPGRRAGRQVRAVRLAEERRRQGVRVQGRTGVRQRQDRYRRAQGRPAAREAQRRAEGNRRRRYLQEDQRQVLPLQHLLMPSQATAGRVPAVAAFRPDFS

SEQ ID NO: 23412 - protein, 245 aa, Pseudomonas aeruginosa
GTSYERVGADPQVDAEDAPGRGADPGAAGDRGGRRARPGPAAGHRPRLAALVRARGAVRLHLLLPRHAAAAATVHRLLRPGAVRGSAQERLLALPARSVLVRAADHDPAHRRLYRRDPPRRDPLGAGRRGGGRPRPRHVAAPGALAHHPAARGAHRPAGLQQRSDPDAQGQRGGLHRDPVRHHGHGPDHHRPHLRIDAVLLPGRRAVPGDHHRADADLPPDRTLVAGRRHPGPLSGCFPMPAGRL

SEQ ID NO: 23413 - protein, 417 aa, Pseudomonas aeruginosa
SPPRFPAAARIVSETFPFLTGDALSQRFLALDAFLLEHQRLWRPRPFSEPTLAWEAEHAELASWLRGRSLEQADAEHNQPTRLAAPAPYPQLAAQAAALGAVGELPLAERPQAPNRFNVDVPGRKWQQIGLFAGRLQFARPVVHWLDWCSGKGHLGRLLAHAGQPLTCLEHDPALVADGQRLSDRLGLSAHHLRQDVLAADCAERLLPGHTPVALHACGELHLRLLRLASQAGCRQLAVAPCCYNRIPGPFYQPLSQAAGRSLLALSLDDLRLPLSETVTASQRVRRQRDQSMARRLGFDLLQRELRGIDQYLSVPSLPVAWLERPYADYCRELAALKGLPEPAARDWQALEAAGWKRLAMVRNLELVRALFRRPLELWLLLDRCLYLVEQGYSVRLGEFCPTSLSPRNLLILAERS

SEQ ID NO: 23414 - protein, 409 aa, Pseudomonas aeruginosa
STSARPAISPGPTSTWPCVATAKASAATSTPSACNSNCWSPNASWPAWRASRSIFPSSWSRPWAAVSNPIPAPLRSLPRKRRQNERGTHHDYRQQRNPRRQPEAQALVADPARRDRSRHPGQRGLGVLLRPLARGHRRRLHQRQRGTDHPADRRHRGQHRRRRRRPGAQGPGTGQVRSQRRRHRPPTRRGQPGPHRAPGARAVQQRRRLSRRGRHPQGRAGQGRGRLQAAQEPRRRRRHFPGGTGPRPRRPGQRESLADQLGTAVEHQSRAGRRHPDHLPSGRQGRRRATAPGLPGRRPLDHRRAGHRLRRQAQRTGRPARATGQCADGRGPAGPDLDRRQLQGNPAQAHAYRPAGGNPLRPLRQRRALQRHRRQPRRGHRQRVLPAAGAERHRQLDQDRPAGAGAHPY

SEQ ID NO: 23415 - protein, 85 aa, Pseudomonas aeruginosa
VPGSTPGAGTIQGSIESFQNLWNPRKTRLLAGFFVLAFRRIPRVASANKGTFKDTYQFDIGKYPYGSHNGSPYRQRLPHCKGSRT

SEQ ID NO: 23416 - protein, 1117 aa, Pseudomonas aeruginosa
LTNQLPTSKLWWLLMFDNDTVELINRAPELDGLDLAELPKQLTEAYASIVSARICLREGTEQSGLPDDLIEIIKQMTRLAFSLEAIVSASEDAENRMAAAFVAGSAHHVILLAQELMPKNIKSSTLSAYGVSPEVSATLLFLIAEASSDAAETAKKIIVSGEDSIEASVLKAIYHLANGSLLKILATRVPSPDKFQSTDSLGQAVESLYYMLLHGIRALAASLLGSTDEHDLLDHDSKIIFNRVKGLCVDEIDELVGLGDHPVHNVFPGPLHLASLLAMVADHLIPSSIINTDPPKGIDAAKWFDMKQSIASARPYLWRNHRQAISSGYLETGMSSVISFPTGAGKSTLSELKIATALLRNMKVVFLAPTLSLVDQTTRALANTFPNAEVHREILDELLFDLENDSLPAISVMTPERCLAMLSFNPDIFSSVGLLVFDECHLLHPRDADHSRRSIDSMLCLLNFTSVAPKADLLLLSAMMKNSEEIADWVSELTSRPCLPLALTWKPTRQVRGCVVYAGDEITKLKQRLKLVRSQVKNVNAPAPLKRELLVQPFGFFCLNQTWHSASRKDYALIPVLSETVNLSTGTASEGNNWYLTPNGNQVSATIATSTARQKIKTLIFTQTIPLANSAAKKISDDLESSNCILTDEELHLFQTVVDEFGGEEHVYIKVSQEGRLLSSSTCHHGLLLSMERHLHESLFKRTDGLNVLVATSTLAQGMNLPSEVVIISGDSRFDQEADAMQRLEAHELLNAAGRAGRAGDSSYGFVLVVPSKVVHFDNNTSQIHNHWMDLRSIFSQSDQCLVIDDPLTSILDQIHSGALPLPNLPSYFLSRLPVDYGEDQEGRNSLARATIERSFSAFRARKKGDQEWVKSRIESAILSRNSNIDTSQPATWVDRLAAASGISTAIIRELGEPLSNNINHSATTDAWYQWFRDWLKRRPALIPTLIRKETLEVFLGSDYKKLKDDASRGTHACDIIFPLLELWMTGHTLASMEESTGTPINRVGRCEFAREFVLRIVPELSYIFGLPNQIFNAITVDRGEDTESPVGLNCLALCVKEGLNSVEKVALREVSKKRLARRELHRKYQKIESYAGILKEGENFGDVVNRITQALAFVNF

SEQ ID NO: 23417 - protein, 305 aa, Pseudomonas aeruginosa
AVRMNRILLLGANGQVGWELQRALAPLGELLVCDRRRADLADPEGLARLVRAERPQFIVNAGAYTAVDKAESDADNARLINARAVAVLAEEAAGCGAWLVHYSTDYVFDGAGSVPFAEDAPTGPLSVYGQTKLEGEQAIRASGCRHLIFRTSWVYAARGGNFAKTMLRLAGQRDELKVVADQFGAPTSAELIADVTAQALQRLRWDVELAARASGTYHLVASGETSWHLYARFVIEQALERGWELQATPQRVLPIATEDYPVPAKRPANSRLDNRKLQQVFGLVLPDWRYHAGRMIQELSEQGPL

SEQ ID NO: 23418 - protein, 617 aa, Pseudomonas aeruginosa
GIPSGMPRILAATAGSFVLKAYFHRWRSLVILALLLAPLLWPLQYFAERYYSEQLAEQNRQTLDLYVANLLGTLRRYEELPQILGGLPVLRQALQQPGDPLLQKIANEALADIRRRTGADVIYLLQPDGTTQVASNWAQADSFVHRNFAFRPYYREAMQGRLARFFGLGTTSIKRGYYFASAVKEGSRIIGVLVVKVDLEHIERLWGNSPEQLLVIDNYGVVILSSREDWRFHASRPLSAAERDEIHANIPYPVQDPKPLRLQQSAWLSQSRTLPETGWTVSIYAPRTLIERPVRSVLLIGGATLLALLLLLTLLTLSRRHYLDRIALEAEAKRQLEERVLERTRELENANAQLQQEVHEREQAQRELMRAQDEVVQAGKLTALGTMSASISHELNQPLAAIRSYADNARVLLDHQRTEDARGNLEQISDLTTRMASIIAHLKAYARGARRAPENVQLQPAIEDALSMVASRRRAMNVELLRDVPDAPLWVQAGETRLRQILGNLLTNALDALAEKAPPRRLWVIASQDQHGVTLTLRDNGPGFSEDALAHAHEPFFTTKTTAKGLGLGLAICDNLLRALGGRLEMGNHLEGGAVVRLHLLPGVPGVAAMPQEETRA

SEQ ID NO: 23419 - protein, 103 aa, Pseudomonas aeruginosa
SDARPACSACASRSARWRRSRPTCWSLAKPAPARRWSRGPCMTCRADVTDRSSRSTPAPSPNRWWKANCSVTRPAPSPARRSAASASSSTPMAAPCSSTRSRA

SEQ ID NO: 23420 - protein, 438 aa, Pseudomonas aeruginosa
PSTRSPRHDHSVPLPAALPADVHRRADRRLPGSLRRTDDPPVQPGLGTLAGDQAVRDLRALHPAGDPVLPALRRVHDHRWRGAAPDRLRQRLRRTHPWRPGDRRGARLHALRRAIRLVSGNGGGSGFDRHRRHGPLGLSTGVRRRDRLQRRHPRHPHPAIDRDGGLRRRHRDLGGQAVHRRRGSGAAAGTDPDGGDLHRRPGQEAARHAKGQSARMAGQRAQGAVGAAADGDHPRRHLFRRLHPHRGRRRRRGVLGLCRTVRLPRHAPERMPEGAAGVRQADHHADVHHRQRHALRPRADHRADTAEHRQLGHGTGTFAMDVPAGGEHRAADRRQLHGAFGDHPDPGADLLPHRHGAGHRSDPPRHHHGGEHGDRPDHAAGRAQPVRHLGGHRHAAGRDHPRSAAVADDPAGVPDHRDLHPGGIPGIAELAGDELTER

SEQ ID NO: 23421 - protein, 493 aa, Pseudomonas aeruginosa
GDSENVPRIQPKTPTRSANGSGCRLDDRRGHLLPPAKHGSQRRCRRRADRMGDHRRRHAHPRFRLPDPRQPQARTRRRRVRLRQGRLRRLHGFLLGLGLLDQRLAGQRRLLRPVVQHPRLLLPDLRQGRHRRGDRLRLGPALGPALPGAARDQGGGVHQHRHHRGQGRAAVPVHPDLPVRLQAGHLHRRHLGQEQPGPGQRDEPGAQHDAGHRLGVHRHRGREHLLLPRGKTFRRRQGHRDRLHHRPAPAGAGQRAVHGRDDPAGTGQAAEPVDGAGTRACGRPLGRRADQRRPADLAAGRAALLGAAVRRDHVRRRQGPHHAGVPAPRERQPGAGQRPVADQHLRTGVPGGGVLHLGRPGRHGPVHQDAAPGHLDDPDPVLLVRRLWPAADPEGRDLRERCPRTQQGPGHRRHRRGLRGLAALRRGPEVPAAVRPAVCARRDPFRQGQARGRPADLHRNRKTDLRRSRHWRPGGCLRPLRRFPHPLITPLET

SEQ ID NO: 23422 - protein, 635 aa, Pseudomonas aeruginosa
VMSRLPVIVGFGGYNAAGRSSFHHGFRRMVIESMDPQARQETLAGLAVMMKLVKAEGGRYLAEDGTPLSPEDIERRYAERIFASTLVRRIEPQYLDPDAVHWHKVLELSPAEGQTLTFKASPKQLPEPLPANWSIAPAEDGEVLVSIHERCEFKVDSYRALTVKSAGQLPTGFEPGELYNSRFHPRGLQMSVVAATDAIRSTGIDWKTIVDNVQPDEIAVFSGSIMSQLDDNGFGGLMQSRLKGHRVSAKQLPLGFNSMPTDFINAYVLGSVGMTGSITGACATFLYNLQKGIDVITSGQARVVIVGNSEAPILPECIEGYSAMGALATEEGLRLIEGRDDVDFRRASRPFGENCGFTLAESSQYVVLMDDELALRLGADIHGAVTDVFINADGFKKSISAPGPGNYLTVAKAVASAVQIVGLDTVRHASFVHAHGSSTPANRVTESEILDRVASAFGIDGWPVTAVKAYVGHSLATASADQLISALGTFKYGILPGIKTIDKVADDVHQQRLSISNRDMRQDKPLEVCFINSKGFGGNNASGVVLSPRIAEKMLRKRHGQAAFAAYVEKREQTRATARAYDQRALQGDLEIIYNFGQDLIDEHAIEVSAEQVTVPGFSQPLVYKKDARFSDMLD

SEQ ID NO: 23423 - protein, 304 aa, Pseudomonas aeruginosa
TPWCRPAGPPATSAASGRARSAVSRNPLRKAPECPAPAPAIPPPIYGARPGRRQSPAIRRPSSAPPRRRASAAGSPRRRAAPAPPIRPKAPASCLVLAALGEQVAHQVQRGQGAAFAELGVLGQARQFAQADAIDAHRFRLVARQALLVEIARQHHLDALAHVARRQRQFGDVLQLPGPVARLLLEFAVGRREDVLARLDQALGQRQLVFVDPGAIFLHQHRVLGIEHGHHHHRTVALALADQTLVGALDAIAEAQLQLLDSEQSALRDDLAGEYGGFLTHVDNSLAKPAGYHTPAFPIIPVGD

SEQ ID NO: 23424 - protein, 480 aa, Pseudomonas aeruginosa
ALALPYSALAMALRVSPFFTVTKRASGAAWATVILSSTEETPATLPSASRIFSFSSWLTTSPEAMTLSPSTETWMFGLPRPTLATCSFSDSAACASCPVSVSHSFSPASFTNAKIPIFGSPFTVTVASGRRNPDPRLAKSRLQKPAKYPQAPSSPHNTAPIRVKIRRHPRHGSADGHQATEIPLRPRRNPPLRPGRRALPRHPADPVHAPAQPGGRTRPGTGATQPALRRLHRGRRARTGLGTQPAGGPGRAVRGSRRLPRATGRDPAPGRGAAGQLRPDAPGPAHGRAPPGVAFPALFPEFGTGTRRPGAQPVRSRRLLSGPSGPQPFRGHRTGGDPHGPAPSPQPFPARRRAAELGSAGWPAARPALGGHALPPIHRPQLPQPRVEPHRAPGNRLGTATAAGGAARLVLRDHAARQRSRRRVAPDPHRGRPYPGSARSDHPQRTAALGAGRSLFRGSPELVGAAVLIDHVDQRIGTTD

SEQ ID NO: 23425 - protein, 137 aa, Pseudomonas aeruginosa
SSARTVPRQSTGKPPSAASTRRSSPATASAPCANRATTGWNTRAASPDRCATTRSATTTSRSPGTPPSPWSPSTCDAWIAPTRRSSIPPGGPATRRPTSTSCSSARSAQTTSPTARTCATKPAAWHWAAASGSARAA

SEQ ID NO: 23426 - protein, 213 aa, Pseudomonas aeruginosa
TPRSSVRHWAATWRRSAGSPSSSSPGSAKPRPRVASRYSTTPSSPSTPTASRPTWPNWMPPPGNTWSASPGWAWRKSSRLRGCTGGRTGSSSAGRWASPSTTIRWRSSRKSSTCNSCAATWAARAPVSARSAATATCRVTAPWASTSGRRRRCSTHWNGASASKCHATMGTTPSRRSPRCSPASRRSSSAWAAISPRPPRTVRAPTPPWRHAT

SEQ ID NO: 23427 - protein, 141 aa, Pseudomonas aeruginosa
NDEARTMRKSLLVIAFGLLSAQAALAGDSTKTAVGGGVGGALGNVVGGAIGGSTGAAIGAGLGGAAGGAMTAKDGRKTEAALGGGLGAAGGSVIGNKLGGSTGATIGAGLGGAAGGAVGNNLGKDNDSGHRGKKHRKHKHR

SEQ ID NO: 23428 - protein, 204 aa, Pseudomonas aeruginosa
RAGHQFHPRFPDAPVVRQLGPACPPAPARPVAPGPAAVTGSPATVEPEQPAFATSRSGSPEQGPVGQGGTGQPAGRTTVADARRTSREPRGRRRAGAPAVRRADRGEQAGPVPPAQPAATGRWPGGRPGAHPQPPQSAQPGAAARLRPGARRTARRRLPAEAQPGAATAGTRRSPGRAARHRPVTGGGRSLSLGRALKRGQRIA

SEQ ID NO: 23429 - protein, 461 aa, Pseudomonas aeruginosa
KLAYRSPWARRPSEREMLLGQGHQAVGATEQGFAVHARPRQDAPQVEIGAAQLGPIEIALAGAAVQRFLGSRRGLQPEGREQYVGAVLEEVHRSGADLLGIAGAGLEYLAGELPPLLQALQHRLSQWRQRSTPLQRLAGHRQFALQRQQFAALVAEQLAADQIERLDAIGAFVYLGDATVAHQLLHAPFADETVTAIDLYAEAGDFLADIGKEGLDDGDQQRCTARRRAPAVSIRMAVFQVELACAAGRQHAAAFDQGLLGQQHAPHVGVHDDRVGDLVRCLRADQGARLQAFAGVAEGALEGPFGDTQALQADLEARVVHHREHAGQALVRLAQQPASGAVEVHHAGGGALDPHLVLDGAAPQAVALAQGAIGIGDELRHQEQTDALHPGRRVRQARQHQVDDVLGEVLLATADEDLAAADRVAAVGLRLGAGAQEGEVGAGLGFGQAHGAGPFAAHQLA

SEQ ID NO: 23430 - protein, 134 aa, Pseudomonas aeruginosa
PAPAGNARGFPRRRNRAAGSPASRQPGAPGHPPRYRAPPGGCPARSGSSRHRSSGRSGPSRKGGCPPARPAGPGRPRPTRGRATPGRYRPRRTCGTAPWRNRTPGEPGPPGTAERLPAASGGPRWRRVRACGCR

SEQ ID NO: 23431 - protein, 439 aa, Pseudomonas aeruginosa
GSGRFLCGRTAPGFVHRSSCARYNEDKTMSQNFSFRQAAVIGAGTMGRGIVMCLANAGLDVQWLDSNPQMLNQALGAVADTYAHNVRQGRIGEEEAAARRARITPVQHLAAMREADLVIEAVYENLELKQSIFRELDAALKPSAVLASNTSYLDIDAIAAVTARPGQVLGLHFFSPAHIMRLLEIVRGAQTAPAVLEAALALGERMGKVSVVAGNCHGFIGNRMLEPYATEARLMLLEGALPYQVDRALQAFGFAMGPFRMYDVVGIDLEWRARELAGVGQDQPAVQVDNRLCEMGRFGQKSGAGYYRYAPGSRQAEHDTEVDALVLRVAETLGYPRRDFADEEILERCLLALVNEGAKILDEGIAARSADIDTVYLNGYGFPAAEGGPMAWADRLGAAELLQRLRFLEQRHGARWKPASLVERLAAEGGAFADLQEVR

SEQ ID NO: 23432 - protein, 507 aa, Pseudomonas aeruginosa
AGAATPGGVAAAHRPGTRGLRPRSPGDRRHFGGLPPVQRLRIARGPLVASRGASPGSAGRRLRRGRFLSGQAAQRRFLPAAHPAAGEHAPRSLARWRRLPDGPARGAFLVLTGVSPKETDMQAFSFATTAQILCEAGSAIRLAELCRERRARRVLIVTDPGITRLGLLDAILPGFPRLGLAVEVYDQVLADPPESVVEAALGRARGMAAELVVGFGGGSSMDVAKLVALLAHPEAGQGLGEVFGVGNARGPRLPLIQVPTTAGTGSEVTPIAIVTTGETTKVGVVSPHLLPDLALLDADLTLGLPPAVTAATGIDAMVHAIESYTSKLKKNPLSDLLAREALRLLAANLERAVGDGGDREARQAMLLGACLAGQAFANAPVAAVHALAYPLGGHFHIPHGLSNALVLPEVIRFNAPAAAGLYAELAPLLLGDRLRPGDRDALTVQLIDELAQLSPRNGLPSRLRDAGVDEAMLPRLAADAMLQQRLLVNNPREVGEADALAIYRAAY

SEQ ID NO: 23433 - protein, 183 aa, Pseudomonas aeruginosa
KVKAPRSRGFYTSASASMPINDACACGVSCRGDRCRCPCPGCYRPRHPLRRRGLHLWSRRCCRPACCRSPNRRPRRARHPGRLRSCARPWRSSRRRPRHPGRRLWPHRCYRRWRRPRRCPGHRLRRRPPRSWWNRRRARLVRSAGRTRLPGEIYASCVPHRFNREGNTVVRTKAGPSGPAFAS

SEQ ID NO: 23434 - protein, 221 aa, Pseudomonas aeruginosa
GAAGSVVVVATMMLVALPLLVLAIVMAVVMPVIAIAIAGAAVVATVAVVVIVVVAAVAVAIMVAQRAAAGAAEGRADQATGAATDLPADDVAACGTEAAADRRFGLVAASGADCTARSATDATTDRGASAAADRIADDRTQHPAQGAADGRAGVVACEGGTTDQTQGQQEYRGILHREFLSVGMTAAMLGLAQTADKRQPTIGRANSKYSKCLFCMGNFLK

SEQ ID NO: 23435 - protein, 161 aa, Pseudomonas aeruginosa
ASRPSVCSAMKAWSNTGSLPSAWASRSQARRNLAIPRIAAMSPPSAGRKNAVFSGEDPLVSISSAFCGCWKRSRPRSLRGLKQTTWAPRFTASRSGSSMRGWLVPGFCPRMKIASACSKSPKVTLPLPTPTLRPSATPLASWHMFEQSGKLFVPNARTNNW

SEQ ID NO: 23436 - protein, 303 aa, Pseudomonas aeruginosa
RGWRGCRLMADSLGCGRRRAVDPRGVVMGLVDQVQLVAARPLHGQGGGGGEADQGADPGTYGLVDKLQAAAAGDHGETARGVEALAVQGADQLVEGVVAADVLATQAQLAMPVEIQRGMQGAAMARQSLGLLDTLAQGAEMGGGRQRLRRPFRQLRQGLLQGFDAAQAAAGSAGQLPALALEVPERAAADFDLGVEGFALAADADFIDVVDGLHEAAAEAETADEILHVLGRGHHHRLVQSVVADRHGTLGGKGGLADLLRQVQVGVAVIVGNGGRRPGIRGYRACRLARHGLGPIVLGVAPA

SEQ ID NO: 23437 - protein, 201 aa, Pseudomonas aeruginosa
RQASQRFPVQQRGVEREMAGVMEQAHAGLRQFDALEMAAVQTVQIRDAEIELVARQAFEYLFRTQGIELETQLRVAPGHVLDQAHRVEAGQRHHAQAQGPDQLPAAGGGFRVQPFLGRQQAACPGQYALAGLGEAFEALAASHQFQAEFFLQAAQAHGQGRLGDVAARGGLAEVAGFVEGAEEFQLLDVHRRFRGGGVAES

SEQ ID NO: 23438 - protein, 478 aa, Pseudomonas aeruginosa
SEKPGYDNPPASPRSYPHASETHRTRQRDRREEPTVRCRGVATALQQWRRAHLRASGRQGPGLRCGDGGGHARCRARGAGGGILRRGRRIPVVAAQGPGRAGRGHPRGGQPRTQGGGGLRGPATGAHHRTVAVAGLHEPAHPGGAGARSLRGAPAGRRAGTDGRRSHQPARTVEPGPARPVQRRPRPGRAVPGARPAHPARRVPGMRPVPWGELVALVRRAGEAILPHWRADVAVRSKADESPVTAADLAAHHILEAGLRALAPDIPVLSEEDCEIPLSERGHWRRWWLVDPLDGTKEFISGSEEFTVNVALVEDGRVLFGLVGVPVSGRCYYGGAGLGAWREEADGRVQPISVRLEPEEAFTVVASKRHGSPAQERLLDGLSERFGDLRRASIGSSLKFCLLAEGAADCYPRLTPTSQWDTAAAQGVLEGAGGEVLDLHGAPFTYEPREDYLNGSFLALPRAAEWRSELIQLARALH

SEQ ID NO: 23439 - protein, 185 aa, Pseudomonas aeruginosa
NDQGDYADVNHDYRVTYFPTEYRVAWAFHKCWRSAVGGLTPMAGLLAEVGRGRVLRDLLESPRAEARRRGAGASAEAADDAWRYPPFARCRRRRMKKGREAALGVVYQRYSMPALRVLTRVPALPSVIATMSASEPITASLPVARANSMAAWTFGPMEPAAKPRRSSSSGWAWAMAFWVGLPQST

SEQ ID NO: 23440 - protein, 92 aa, Pseudomonas aeruginosa
GSSSLIRSPQASTGSPIDTQTSVWTKSTPFTASFGSSVRVSLAPLSSANFLHWATNSSCGQSAFGAAMRTSMPSLAPISSRELPMLLRASPR

SEQ ID NO: 23441 - protein, 473 aa, Pseudomonas aeruginosa
RSSRVLWCIRLSRLRLCMLKAMIDLLVGSRWAAPSLGTPPFSSRAGCLSVVDRVADDRAGHAVAAAATATQFAGADGDDLDAGLAQQGVGVGVAVVADHHARLQADHVVTVVPLLALGGEAVAAGLDHAQFLQAEGFGDHFEEGFLLAADVHAVGAARIGAQAEGHDFLDHFREDRDQVAVAEAEHGVQVHRGAGLRQAGDDHPLGGALGEQRLGDLTDGLARGALAHADQDHAVADRHHVAAFQGRGAVVLVRVAVPDLEFGVGELGMELVDGGGQQGFLSSRRPVHRVQGHAAVDPARGVTGELGVRQRRQQEAGMAQVLAVHLEDVGAFAGGQVVSGDAADQVLGQLARLQALQPGAQLAGQAQADAVGGDLAIEDPLQRFRVLDGLGQQIVHLEDVDAALAHLGDEVEVVALGLVHPDHVVEQQLVAVARGQALVGESGRADHHFAQFAGFGVDAKFGFFRAHFTSPVE

SEQ ID NO: 23442 - protein, 469 aa, Pseudomonas aeruginosa
SEGEETVVEAVGSHQGANDDCGEDQFFDSGEDRLADLVLGLGEKDRAGRIQQGGQQQVLQAPGVEQPDRVGHGDAGDDQVLAAFAGIVLVGLALQGQQQAIGGGPEVRDQDHRGGQEQHLGVRVHAVRVARGEEHHHQEHLYADVGQPQGVGRHLVGVLAAQELRHGVVLGGGEHDLGAQQHPGEQRAQQRDQQADADQHGAPVADHMLEYQRHRRVLQLGQFRLGHHAHGQHVDQHQQEQDGDEADHGGLADVGTFFRAGGEDARALDADEHPDGDQHHVAHLVHHAAQVRVALAPDVGGEDVQLEGEQADQDEQEQRHDLGHGGDGVDERRLLDPAQHQEVQGPEQDRGADDRRDGVALAEDREEVAEGAEQQDEVADVAQPGADPVAPGRGETHVVAEAGLGVGVHAAVEFGLAVGEGLEDESEGEHADGGDRPSDQHGADIGAGCHVLREGEDAPSDHRADNQSR

SEQ ID NO: 23443 - protein, 65 aa, Pseudomonas aeruginosa
RSPAFAGLFIWASGCEDRWGDGIAAHPPRVLAHVGTGEGAAIRFVAEGRGSLGEPKAGARGTASD

SEQ ID NO: 23444 - protein, 341 aa, Pseudomonas aeruginosa
ADFCRRPERRAGFSAVVTVPSAHPQPVRQCQGYRRDVGHDDQEHQQDHQPRQRCADGRAQRHAGDRRGDEQVEPDRRRDQADLHVHHHDDAEVDRIDAQLHGDGEEDRRQDQDDRRRLHEVAGDQQHDVHHQQEHPWRKSQFRDPTGDALRYLLGGQHVGEEHGVGDDEHQHDGQLAGLQQHLRAFAQAHVAVDEQCDKGRVHRGDGGGLGGGEGAGIDAAEDDHHQQQPPQRLARAGQPFAQTDPWHGGQLLDPGDDVDHHHQDQSQQQPRNHAGDEQLAHRGLGGGGVDHHHDRWRDEDAEGAGVADDPGAERLWITRADHAGDGDRTHCRHRCRRRAG

SEQ ID NO: 23445 - protein, 509 aa, Pseudomonas aeruginosa
TAAARREPVAPGLRGRRDRRADGHRPAVRPAAPGRAAAPSRPGRWRRGEGSGSCVLLTHPLAVGTAGYVGHPVLVVQVPAHGLADAGLEGFRRLPAQLALQARGIDGVAAIMARTILDEGDLLAIAAAVGARLLLVEDGAEGLDHVEVGLFVPAADIVGLAQLPGFEDPADGAAMVLDVEPVSDLLAVAVDRQRLAGQGVVDHQWDELFREVVRAVVVRAVGGQHRQPVGVVIGPHQVVGGRLGRRVGTVRLVAVVLGEGRIARCQRAIDFVGGDVEEAECRLRFRLQRAPVGAHFFQQAEGADDVGLDEVLGAVDRAVHMGFRGEVEDRPRLVLGEQAGYQLAIADIAGNEGVPGVAVEAGEVLPVAGVGELVEADHRLVMQGQPVEHEIGADEAGAAGHENRHESYLVQAVVVRRAASTRPAKVYQSIVKTTISTGKMAILPTPDLVGASDPAFYAKCHHRAAGRRIKQKSPARGGAFRGFGAPGVKKYHNYMFLYDFYFFSLAVYL

SEQ ID NO: 23446 - protein, 162 aa, Pseudomonas aeruginosa
CGAVGNFTASLERWCGGLLGFLGTAKAGDVLARLLGKLVRGHMVLAVCLQKPAPPGHDHPALFEELGLVGVGGAHVVAFLVAHLPLDSRLRPKPGLDQRTARHGSEAVSADIHLGVVAHRPESGIHRVFGHRFPRFGIPREHQVELAGDRVNLLKQGHCLWR

SEQ ID NO: 23447 - protein, 590 aa, Pseudomonas aeruginosa
MEISRVWVIGYSGPATKPCKARKPTREGIDWAMPQRNEASTNSSAAAMNRRTSPTRRASQPVSGRAMALLTANEVITQVPCSELTPRLPEMVGRATLAMVVSSTCMKVARDRPMVAITRLGGEKLLLSLMLAGSTLGGLAVVFGEVGFDQAFDQLVGRGQLLLVDIGGEQRFARWLLGQGRAALVMQVDLDVHRQADAQRMLLQFLRINMDAHRHPLDDLDPVAGGVLRRQQGERAAGAHAEAVDGAAVAHVAAVEVGADFHRLADTHVLELGFLEVGVDPDLVQRDHGHQRIARLHALADLYAALGDVAGDRRDDGRAGVVQVGLAQLRGGGLDVRMGGDLGVVDQRAIGVQLLFRAGQRGFRAVQGVAGVGQFLLGNGAVVCEVLAPLVVGLGLGQRDLAGGDLGAIAVDVAEQPAHLAHGVGQVGLGALEGDVGVAGIEPDQFLALAHQVAVVGADADHGADDLRGDLYHVAVDVGVVGVLVPAAVEELPGHAGQGGENDHGEQDQQPALALRVAGGGFAVGGSHGGCLVHSAGAFAVASAAERESGWKPPPRAWTSWTERSICWLSRLASWRSATSSCCCTLRASR

SEQ ID NO: 23448 - protein, 271 aa, Pseudomonas aeruginosa
LALASSVGWRAASCAWAVAAAWRARASAICRSGVPCRASPISWSSCRSPSPVHQSWRGQAAGERATPSRLLPAWRAPAGCSRAFGSRPSEVTQPAASTIAEASANRCGQGWRRGNGMDQDSCRLARGQPACSRTLVSRWVSVCNSSVLRQATSSFIAAEAISGSCSWTFRPASLRSRRRQRRSSGQRPRSSSPFFSRRASMRVIEPLSTDSSRHSSTGLLARLRPTKISTLNWAAVMSSAARCFSRMRSLVAALTPMSWPMEPLKGKSEAL

SEQ ID NO: 23449 - protein, 288 aa, Pseudomonas aeruginosa
GTGRFRTRCERQRENGAAIIAAPQASESTRSAALGGVDPQPAFDQAEDPRQHDGDHQVQRAGQAEEQHRFVGAGDDGPGHAHDVEQGHGVDHRAGLEHQDHFVAVGRQADAHRARQDDVPERLAPRHAEGAGGLHLADRHRVDRAAEDLGDIGGGVQGHGQQRAPVRIAQVGPEGALAHFLELRQAVVDDEQLQQQRRAAEEEDVGVRHRAHVPVPRGAGDAQRQGQGEPGDHRDRQQLQGQRRALEHLRHPLEDQLPLAHSSFLTKPRPARRSRKCRATMMTTVRLR

SEQ ID NO: 23450 - protein, 271 aa, Pseudomonas aeruginosa
RRPPPGRARRWPGLASIDAEGEVLVVDLLVGTVGDDFLQRGVELLAQRVALAHGDTDLVVVEHRFALELELLAGVALQPVVLHELVGQHAVQAPRGEVEVGVLLGVVELDGDHVGHVVFQPGAGDGGALGADHLALQGVLVGLEVDALRRDELQLVGVVGIGEVDCLLALVGDRHGRDDEVELLGVQRRDDAVPVGGHHLALGLHLGAQRLADVEVEADRLAAGIDAVEGRVGAFGADAQLVGGAGVEGEGQGCSGGQQDLLIVLHAVLLR

SEQ ID NO: 23451 - protein, 107 aa, Pseudomonas aeruginosa
RWLDMNCLQRADWGFSKTCCGVPCSSTRPWWRNTTSLETWRAKLISWVTSSMVRPSSASARITLSTSCTISGSSAEVGSSNRITLGCMARVRAMAARCCWPPESCAG

SEQ ID NO: 23452 - protein, 161 aa, Pseudomonas aeruginosa
RCPCRSVPVSPIPPERRAGRRPPGSARSAPGSRSARGRPVPPLRGWASAPARRRRRRRRNTTPDSSRRCRRPASCPAGRRNGRPGCTGCRSAGCAAGSGRTGWPAAASGLAVRRGQAGRWLPAVARYRAGRPVANRRRAAGLWRRSRDRSGWMDRRSGSAS

SEQ ID NO: 23453 - protein, 260 aa, Pseudomonas aeruginosa
AVRVAFIPAGLHGGRMAERKTLLLTGASRGIGHATVKYFNAAGWRVFTASRQSWASECPWADGEENHIHLDLEDIPGVEASLELIREKLGDGRLHALVDNAGISPKGEGGERLGVLETDYATWLRVFNVNLFSTALLARGLFAELKAAQGTVINVTSIAGSKVHPFAGVAYATSKAALSALTREMAHDFGPHGVRVNAIAPGEIDTSILSPGTEEIVERSIPLHRLGRPEEIASLIYFLCTSGASYVNGAEIHVNGGQHV

SEQ ID NO: 23454 - protein, 121 aa, Pseudomonas aeruginosa
SWSESALSHCRNCGATRMPTVNFDAILGSPAFTRFTHRAFYLLLLLTNLGVPLGQHRVWGGLPGWWVFPITAVLALLAVQQYLSGESHLYALAGIPYALLYVHDALSTPLVLPPAQRRAAR

SEQ ID NO: 23455 - protein, 80 aa, Pseudomonas aeruginosa
RLWSPAGVTSDWRRPWPSMCCSRSGSRPQPAEPGCSPWSSCASWMSAPALSRLPWSPCTLKRGAGLAASMLARSATWQCG

SEQ ID NO: 23456 - protein, 135 aa, Pseudomonas aeruginosa
RTGPMLPACRAASTARKSLSKRRFWNTERTCPGRSRARSARRRASARVTVNGLSTTTCLPARKARSARLAWVALGEAMTTRSMSAASMASSGSALTRASGRSACTRPGSRETTCSRHNAGTARISGAWKVLPAKP

SEQ ID NO: 23457 - protein, 466 aa, Pseudomonas aeruginosa
MSSPFAPGYGGRSRPGSSSWYLRHITVRLMVVLLQLPPGPRARHSRGRAASEFLFCALEQLLHRSGEAQARRGGEVIPEPVALGHGARSAFHRHQPGLDGELEMTEGMGQAAQFAALAEGQGMARGERFEAVEVVQFGEAPEPAPESAGRPPVEQYGAVAVGQDRHQRALLRQRLARLGLRIIGFAAEQVRAAAGDQRAKQATGLAARAEGGAEVHHRLGVVVDPCVRGEAFGGFPQRPGHLRFAGIAVLRQVARQYALDVAVEDRCAQAHRQAGDGSSGGAADAGQFGELLDVAGELPRMPLDHDLRGLVQVARTAVVAEPGPQVQDFVLGRRGQCLDVGQRCHETVEVTEHGADLGLLQHDFRDPHPVGGDALLPGQILATVTVVPVEDRAVEAFRCHLRLNSPLSASFSSGLTLSPSFSSSFSLRRLPASFAATLPMPSLSRRQALAPSSSGPRQSSGHSMPA

SEQ ID NO: 23458 - protein, 123 aa, Pseudomonas aeruginosa
PCVSPGTASTSWRWRSPATGCSSPPAWPSARTSSSGSVRSARTTGCCWPRATARSPWAAWTRRRNTGSAPTRAMPSPSSSARTVSRPTWRYATRKTRRSWSRARSTSGPAAIPPGATWPSRKA

SEQ ID NO: 23459 - protein, 258 aa, Pseudomonas aeruginosa
PSERCDHAESPDPDPDPGGVAGGLRGPCRIARRLQGGAADRELPALQHGGGRQELRPRRWHRRHQCRHRPGDVQARRHRLFPEPCASPWDRLYRLTLDKPGYGLFSMTYTPERVPQFKWVGPLADTSWVLLAPAGSKIAVKNLKDAARYKLGAYKNDAVSQHLEAQGIPVINALRDQENVKKLTGGQIDLWATTDPVGRYLAKQEGVSGLQTVLRFNEAKLYLALNKDTPDEVVERLQKALEQMRQEGFVDEAVANYL

SEQ ID NO: 23460 - protein, 205 aa, Pseudomonas aeruginosa
TSTPSTPRKSPACRPPARSRRRRSSKPSACEEARLARAFSCLSAGSVHGEAELAPGFVDGHRHRVGQVQATAAFAHRQAQAPIGWQGVAHVLRQSAAFRAEEEGIVALVGHFVEGPRPLGGEGEQAWLAEGLEAALQIRVAAYAGVFVVVEAGTAQALVVQFETERLDQVQTASGVGAEPDNVAGIRRYLRLKQDDVEHAGLRSR

SEQ ID NO: 23461 - protein, 460 aa, Pseudomonas aeruginosa
REATTVIDSLNHLPRPDAGADTLAERFADLAPPLNARQAALESARCLYCYDAPCVNACPTEIDIPGFIRSIAQENVQGAAQKILSANILGGSCARVCPTEILCQRACVRNNAQECAPVLIGQLQRYALDHAGFGEHPFKRSPATGKRIAVVGAGPAGLSCAHRLAMHGHDVVLFEARAKAGGLNEYGIARYKLVDDFARREVEFLLQIGGIELRHGQRLGDNLALGALHDEYDAVFLGIGLAASKRLGLEDEDAPGLLAATDYIRELRQSDDLLDLPVADRCIVIGAGNTAIDMAVQMSRLGARDVNLVYRRGFEEMGATGHEQEIAKASQVRLLTWARPERVLLDEHGRVRGMRFARTRLENGRLGDTGEHFELAADAIFKAIGQAFEGASLGDPLAAQLRRDGERIQVDGQMRTSIPGIYAGGDCVALGEDLTVQAVQHGKLAAEAIHAQLMLNVEAA

SEQ ID NO: 23462 - protein, 526 aa, Pseudomonas aeruginosa
STPSAWAATCARSPVRWRTASKWCRRTPASPISTGPRIRATPTAKPPERRAAPASPADAALPRAGTLPACRCGPTTRNGVCRIDPPSTTIRRGPADAPGRPAPHGDSRMSADSNYSQQPVPLAARKSALALSVVMLGLTFFSASMWTGGTLGTGLSYDDFFLAVLLGNLMLGLYTAILGFIGARTGLSTHLLAHYSVRQQGLLAALGVARRHPGRLVRRRRSDVRPKYPVAKATGLDVNLLILVSGALMTLTVFFGIAGLTLLSAIAVPAIVVLGSYSVWLAVRDAGGLAALQQVTPSAPLSLSTAIALVVGSFVSAGTLTADFVRFGRSARTAVVVCLVAFFLGNSLMFIFGAAGAAAVGKSDISDVMIAQGLLIPAILVLGLNIWTTNDNALYASGLGFANITGLSSRFLAMLNGALGTLAALWLYNHFVGWLTFLSAAIPPIGGVIIADYLSRRRRYRQHPCADIQAINWAAILAVACGTAAGHWLPGIVPVNAVLGAAIAYLLLNPLLSRSPNKPEEVLHAD

SEQ ID NO: 23463 - protein, 457 aa, Pseudomonas aeruginosa
QPAPARPRRSLATARRRWPYRRPGADGTGRRRRRRAPGRRRRSCRAAVHRAAHPSRHHPDRRPAGVEPLRHAVRRHRALGPAQGPAQPRGRQAARLADPEMADRQRRAARAQPRRRLRPDPHRAQGHARGARRSGALGRPADRRLPPGGHSLLPQRPGTAGGVAAPGSRRGGGDPAFRIHPRAGRRVAAQGHRPGQALRPAGGRALRRDRRRAVALPRDPGHARPSRRPRRTGHRQPHHGDALLQRRLHLAAVPPAETVGNQLRRQPAGEHPPAGSLRRLPEAPRHHPGQGTARCRDQHLLRPRRRVRPLVPAGHREHAAGAAHGPARDADDGLRRDRRRPRPDHPQQRPHPRPAGIRHRGRPSGQPAGAAGPRRLRRGAPAGPGALLDPRRTAARRDGPGADHGVPRTGGSGGLHPRQLSLRRSLLAKAPLLRAPIRFRAGPRWSPSVPPFRTACR

SEQ ID NO: 23464 - protein, 197 aa, Pseudomonas aeruginosa
NRASTGPTADAGSAAAASPSYATGKTASGCRADRRRARQPPRRCRDPGAPRYAGDRRNAGARPAGAVPGSPSCCVLRAGSNRSRSVPIVRPASARPAAAREPPPVGDPRVARGGFRHPPSAAGCCRWRCARAHRARRRAPATPARAPATRRHASAAGQRPPPVRRAAPGPSYRPGRPRGRAAYRGRTGSTDSSTSAR

SEQ ID NO: 23465 - protein, 147 aa, Pseudomonas aeruginosa
RSSSAPARRRAGRRGGASAGNRPHRASASRCDKACGSASGAGRRGCRGRSPGSPAATGRSPGSPTARRTSRRAADRASAARRRASSRRAPGGWRRVPPRRSARTGRAAGPARPRSAPAIAAGADRGCGYGSRRLPRSALATASVLRR

SEQ ID NO: 23466 - protein, 321 aa, Pseudomonas aeruginosa
PQRRHQARHRPPAVGQAGPGDRLRRRGQGLLAVAAPGRHDRQGRGSRPDLRHAGLHGRLRSRLAVQERHQRRHRGQHRRRAAGQDRPDRHHHRQRQRLRRQHAQGAEEARGGLQHRPLRQRDRHRLHAQELGLGRGQAAGAQDPPHRQGRFRRAQRRLPDPSRRRPPGQPGQRHRPSEPDHGRFLRQPGAGADPPVRAEVRRPAGRREGQAPERRSAAEEARRGSGPGDGQGLRRRGHPTDPETGRVHRRERGRPVQAGHLSLLSGPRGRRLGVPLFRWTSPSSPARVTAQSLRAWARSCSDPWRLQWLYAAPGAPSSPAR

SEQ ID NO: 23467 - protein, 659 aa, Pseudomonas aeruginosa
TATASPPRRAVPWPGPIASARPSCCNACVSSNSATARAGSRRPWSSAWPPRAEPSPTCRRCAEMDYQAPLRDMRFVLHELFDVGAHCELLGNGIDRELIDGVLEEGARYTGQVVAPLNRNSDEEGAKLKDGVVTTPTGFREAYRQYSENGWASMTGPTEYGGQGFPQMVSACFHEMLMAASLSFRVYSGLTEGAVLALYKHGDEALRRDYLGKLVSGEWAGTMCLTEPQAGTDLALLRTRAEAQADGSYAISGSKIFISGGEQDLTENIVHLVLARLADAPAGVKGISLFLVPKFVANPDGSLGERNSLGCGAIEHKMGIKGASTCVMNFDGARGWLLGQANQGLACMFTMMNDARFQVGLQGLGIAERAFQGALGYARERLQSRALVGPQAPDKVADPIIVHPDVRRMLLTQKTLVEGCRMLASCCARQLDLEHGHPDADGRRAATRRAALLIPIVKAFLTDVGQEVASLGVQVYGGHGFIREWGMEQLMRDSRITQIYEGTNGIQALDLVRRKLLGDQGGELLALQGELAVASEALQGRAALAPLAEPVLQRLEEWRQLTGQVLEACARDPQEIGATSVDFLQYSAYVLLAALWLQAAARAQEALDGGSGEGDFYRAKLRSADFYLRRILPRASMHREALLGGADCLMALPEEHFSF

SEQ ID NO: 23468 - protein, 216 aa, Pseudomonas aeruginosa
STNWPSSVRATACRAACATPGWTRRCCRAWPPTRCSSSVCWSTTRARSARRMPWRSIARHTESLLRGPGMATALRPLREQYLHFQPITTRWHDNDIYGHVNNVTYYAFFDTAVNTYLIERGGLDIQGGEVIGLVVSSSCDYFAPVAFPQRIEMGLRVARLGNSSVQYELALFLEGQREACAAGRFVHVFVERRSSRPVAIPQELRDALAALQSSAQ

SEQ ID NO: 23469 - protein, 189 aa, Pseudomonas aeruginosa
KPRVRGAFTHQLRQACRSTMLVLAVFLAAVTAVVVLAQVVTDRATRCAAEACTYGRAGAAAQLVADHRTAGRAEPATQGGFGLAPVLGGHRAAGRATQAGAYGRTGATADGAAHDVAQGTAYAAAHRGLGGIAGERGLCAQQAERDYQERFTHRACLIVSIGREIRSFAQRPDHPARPLPRRERRVQSS

SEQ ID NO: 23470 - protein, 193 aa, Pseudomonas aeruginosa
GTGGRVAEGARRQGRPGQPEHPGFGGRRQGHRLGRGGQPGGEREDPAGAGQRRRRLLGGRQDHRGPGRSGGALRHREERRHPERHRQGRIRQCQRLHEDLRGQQADAQPSGQDLPRPGPAHSRVIPAFRQPRPRGGVFVSAATAVLRAAAGSPPGRRTPRCPGPGHGCPGGVPPTGGRHHRRGRCAGSAGCRR

SEQ ID NO: 23471 - protein, 293 aa, Pseudomonas aeruginosa
AGRRVRGTAARARRRLRCDSGRCVRHSAGAGVPARSGCRSAGRAGCRPCRAARCRWRTRAGWAWRLLSRFVAIDAEICRFPSISDRDNRKSRGMITRRLRQGVIHMRQKPTVLASEIVAKSRLFAVEELQLRFSNGVERTYERLVGKGQGYGAVMVVAMLDAEHAVLVEEYCAGVDEYQLSLPKGLVEPGEDILAAANRELKEEAGYGARQLEHITELSLSPGYMSQRIQVVLARDLYEERLPGDEPEPMGVDRISLRELSSLAQHAQFSEGRALAALYLVRDLLTQRGEYQA

SEQ ID NO: 23472 - protein, 617 aa, Pseudomonas aeruginosa
SNWRARCTETKRPGLAGPFPLWWRSVEHVTETRVLLVYQRLAEAGHRHLFGADLDGMFVDQVLAEVVDDLQVALQRALVVGAGGGAGLLALLDVGGEGRLAMALAQHLLGDSRRQHHAAGVVAAEALGVDEAHLQRLVLAHVAIGDAQALLVDVVGDLVDGLDPREDAVLEGAQGGNQLIGAGGGQGVADVGLHRGDRPAVDAEGAGHAVEDFRFGDPVGRRAGAVGVDEAGVAHGVQADDLHRAGHRLGYRQVVARAGGGDGLLETVGVDEHVGYRAVDIRAQAQGQFVVHQHYVLAGLGQGEAAVLAERPAGAAEVHVVAAFDQAQAFFGGQCAHGTVALDALRQDRRLAVADDDHPGLAAGDDVDTLLQVVEEGGAGACDAAGHADAAEHVGIDEIGGHAVEAQRQLLGRDPVALQAGLHQAAETVVVELAHDAAGEHRDLVGLDVVDDGLPVDAGGADRVGRGDHRHLQAARVEARVVQLAWFETGGQLASGLHRQRTVAVDLELAALVDAHQYLAVLRGSDRPVGRQRLGQLLGRGLEGQRLAFGRGQLEDLVPVDGIRVEVLRFDAPHQGRGEDAFGVAPLDVLRGQRRAVFGQVAAAFGLDQFHHDRQAG

SEQ ID NO: 23473 - protein, 266 aa, Pseudomonas aeruginosa
AADQKYGIRIIEVARSSILVYGSMPSGSPEVKNTTTRNTCTQMLVSHRALAGTWLAFSRRRNSGMVWSLAAANMISAHSSTQESSAPSSEISRPTLISTAPQWPTTCSSTSAIDGFCSLASSGWVITPMDSTLTSTSRSRTVMKPITVALPTSERFSAREEKMLAPSMPMNTQTVTSIMLRTWFITLPRSGLLLPQMSAVKMSSLKANRQIRMNRNSGTTLATVVTVLMNAASLIPRSTRKCRAQSRTEAQTIAATVSPLPKIGKK

SEQ ID NO: 23474 - protein, 155 aa, Pseudomonas aeruginosa
VTMIRNTSRIISHGSAARMVAPSGMPVTAEVTNRLSPTGGVIRPISMFTTMMMPRWIGSMPSSMAMGKKIGARIRMIAEGSMKLPAISSTMFTTSRNIHGESPSSVTQLAMLCGICSVVSTWAKSMALAMMNISMMVSLPDSSSTFGHSLRRMSR

SEQ ID NO: 23475 - protein, 76 aa, Pseudomonas aeruginosa
PERTMPAMAIEPTAATVAGDEPDSAAKSMQASTAAIARPPRMCPTQALAKSIRRRATPPVVMNAPESRKNGIASRV

SEQ ID NO: 23476 - protein, 66 aa, Pseudomonas aeruginosa
AAQRQMLRESEKRLVFCLLERSGSREQALCQSGKGTQGRCCGRGWRTVGGNPPFIRHHLADFRQAC

SEQ ID NO: 23477 - protein, 80 aa, Pseudomonas aeruginosa
GWDRTRSSPSRCCGAPPRPASARQRCRRGGRAVPPGVPRAGSGWPGSAVAGAAVRDRDRAPCPAARRGRCGRWRCPARRR

SEQ ID NO: 23478 - protein, 153 aa, Pseudomonas aeruginosa
SATPARCPSAGSGTGCRGRAGRPARSAAGRCARRSVRATGRAPGRPRDGRAEWTTARRGTPRWRRRRSTGRGPGCRRRTARVPGPACRKGRRGRSGRSPCRNRSSVPRAFPARHGRWWCRCRRGSAGPRTSKSSRWRRGGRATAPRRPPPATA

SEQ ID NO: 23479 - protein, 64 aa, Pseudomonas aeruginosa
LCEVNKNKFYSGFAMYFIGLTPSDFGVTKFSSGFNRSFLMGNPEWDKSHLILRLLTYCLAIESI

SEQ ID NO: 23480 - protein, 94 aa, Pseudomonas aeruginosa
APVEILQRLLQMNAVTMTQQSQKAKFEQDFLNRFGPLVSQSQLADLLGMTARGLSTFLWRKTELAKGIRECRVKVGRRVLYRTVEIAGLLACQQ

SEQ ID NO: 23481 - protein, 96 aa, Pseudomonas aeruginosa
TGLARQCQHRRRNFFCFLTPYDPLAVSAGLPGLSSRPGVPRRAAPPAGSGLPRRSVVPTPAGPSARRPVAPTPGCATGRGWRRPAPGSSGSGRLPG

SEQ ID NO: 23482 - protein, 139 aa, Pseudomonas aeruginosa
SVAPDWRRACWRAALPGSADNRAGPRTSRRSARPRAAGAGVRAHAAVRRTGTVPGRAGAGRGRTTARSRAGRVRASGRGPADGSARWPTRSSAPGRCCRPAGRPPRRGSRCRSAGSGTPRGPAQAVHGRGRRGAGLRPG

SEQ ID NO: 23483 - protein, 181 aa, Pseudomonas aeruginosa
SGCAGCRSAAPAPVPAPGRPCRPLPAGWRKERPGPGAGPACRCFPSCPCPACRGPGPGSGLRRGSRSSARPCAAAAGPAPTGRASAGRRTAWSAWRRWRCWCRAAPGPARGTGSSRCRPSGPAPGWPCRGRSGGFRPCSHWDRTGGSGRSPGPRRAVRVPGRTAPGPCRMLSWTNPLCWQR

SEQ ID NO: 23484 - protein, 371 aa, Pseudomonas aeruginosa
PHDGPDRPPRPDRPGHRVQGRPAYRRSPHRRGHRHHPRPGLRQGHRRQEGHPPLRPRLRAPRRGAVAGGHRLLRAARPADARSLYPCQRRRLRRRPVHGILPGLRQPRPGDPAHRQPARAQHPPPDRDRVQGLRPRAAHGHRAGRADGRADAVDQRVPVMQTVAVIDYGMGNLHSVAKALEHVGAGRVLVSSDAAVIREADRVVFPGVGAIRDCMAEIRRLGFDALVREVSQDRPFLGICVGMQALLERTEENDGVDCIGLFPGQVRFFGKDLHEAGEHLKVPHMGWNQVSQAVEHPLWHEIPDQARFYFVHSYYIEAGNPRQVVGHGHYGVDFAAALAEGSRFAVQFHPEKSHTHGLQLLQNFVAWDGRW

SEQ ID NO: 23485 - protein, 87 aa, Pseudomonas aeruginosa
VMARAKSNTPILQLDAAQTQDAVLAIKRFMEDRFELELGSFEAEELLDFFAREFAPYFYNKAILDVQSYLKERFESIESDVWALEKS

SEQ ID NO: 23486 - protein, 261 aa, Pseudomonas aeruginosa
VSARLSTEYRLEQGSPMLIIPAIDLKDGACVRLRQGLMEDATVFSDDPVAMAAKWVDGGCRRLHLVDLNGAFEGKPVNGEVVTAIARRYPDLPIQIGGGIRSLETIEHYVRAGVSYVIIGTKAVKQPEFVGEACRAFPGKVIVGLDAKDGFVATDGWAEVSEVQVIDLARRFEADGVSAIVYTDISKDGMMQGCNVQATAALANATRIPVIASGGIHNLGDIQKLLDARTPGIIGAITGRAIYEGTLDVAEAQALCDNFKA

SEQ ID NO: 23487 - protein, 254 aa, Pseudomonas aeruginosa
RPGARRNPGPADREPGAVQHGGERRQLRQGRWHQRHQHRYRARRLRARADRVPADPALPLGPGLPAGAERARLWRVFHRPYAGARGQVQVGRPAGGQRLGTDGPRRQQHPPEQPGRRRALPDRRLQERRHQPAPGRPRPAGATGAARQRERRQAGQRADRSLGHRRSERALRRPARGPQGGEGGPAFPYRRAVPGAEQGHPGRAGAEVANGGRRAAQRRLVEADPRALLTPRRRCWQKAGLAARRWLFCLAPGP

SEQ ID NO: 23488 - protein, 393 aa, Pseudomonas aeruginosa
QDDNNAKKPALRAARNPAAGRRRARRNRSRLQHGPAHGELPAVQHGDQRQELRPGRQHRRHRRGYRPRDVQARRHQVQPDPAFPLGPHLQAGAGEARLRGVRHRPPGRARGQVQVGRSDRPGRLGAAGQGRQPDHPGQPGRGEEIPDRRLQGRCHRRVPRQERFRGRPGATRPGKRAEAGQGPDRPLGQRRSRRALPGQAGRRDRPEDGAALQQRPAVPGAQLRDSRRSGAEAPGSPGRHAQGRLRRGHPQQLSLIRSVRPTGGRAGKRLCRPRRQCHGRPTSQVFRPDAGMPLANNDNQASGVTMLKVLIQTLILGVLLGASAARAELPADYKVVLLTENFPPFNMAVDDKNFARDDGIDGISADIVREMFRRAGIGYSLSPALPPGTACTG

SEQ ID NO: 23489 - protein, 434 aa, Pseudomonas aeruginosa
SESCGRSLGAARLPVGRSAPPLPLARWPLQVGFLEALEAAPLLGHLGASDFDVRNDALGLDGAPVGGVVERGGELQGAVVVQRQHGLHRALAEAVGAHQDRALLVLQGTGDDFRRRGAATVDQHHQRNLVAGIGRVGAEAQLGVGDAALGVDDQALGEEGVGYLDGGLQHAAGVVAQVQDQALETALVVLAQLVQRLDHFLAGVDLELGDAQVGVAGFEDLALDTLDLDDGALEFDVERSAAIADDGQGDRGAGLAAHAVDRFGHRLALGRLAVDLHDQVAGLDAGAGRGGVVDRRDHLDEAVFAADLDAQAAELAAGAFLQLGEVLRAEVGGVRVEVAEHALDGVLQQGLVVHWLDIGGLHPVENLGERTQLVQGQRGTATVGQWRGVGRGVGTLGRARAEQQGQRQGGGTEAMQHVQLLITSSAPIPVRGTR

SEQ ID NO: 23490 - protein, 185 aa, Pseudomonas aeruginosa
KKRPAPRAVGRFHVFQPDGSGGCRRRRRPRASGGSVERVGEQQQMRQVQPEVEQRRHPQAAAPQPGQPVDQPGEAGEQHQQRAAGEVRQAEQRRGQRQGGPGAQPLAQALLQVAAEQRFLGKGNEEQVGQDELPEPGRRVEFRPQQADADSQQKQRRHRRHEQQPVPGAAGSAGFVAEQARQAGQ

SEQ ID NO: 23491 - protein, 518 aa, Pseudomonas aeruginosa
SGEGGVVETGRGARPATADNVAGVLRRWPAEAADNRDAVIRPAREFVVRGSAEGDDAATGHFRRLLQPHEGQHGRRHVGQHAAFADAQLALADVDEGHRFAGVRGVRLAGGLVFHLLDIAVVGGDQGFAADLVQRLDDTAHAGVQALHGLDRGLEHPGVADHVAVGVVDHDHVVALLLDGLDDTVGDFRRAHLGLQVVGGDLRRGDQDALLALVGFLAAAGEEEGHMGVLLGLGDAQLGLAMLGQVLAEDVGQRLRREGAGRRDARRVLGQHDETCQLRGSFAGELIECRLDEGAAQLAGAVGAEVHEDHRVAILDPHRFGAGRDHRGGLDEFVALAAGVGGLEGCHRGVGGELGLAVDNQFIGGLDAVPAVVAVHREIAADDRGDAALAEPGEGGVETLQRRLRAFRRGIAAIQEGMQVDLAGAALGGHLRHCHQVVFMAVYAARGEQAEDVHRLVGGDGLVDRRGDHRVFEEFAVADGLGDAGEVLVHHAACAEVHVADLGIAHLAVGQADVHAGA

SEQ ID NO: 23492 - protein, 214 aa, Pseudomonas aeruginosa
RRSATECRYPRSLCPARTVPGPELASFTEKDRHSNREVSRDAISWSRAGRRPAGSPLAGAVCILAGIFTPWISVTMQFVSRLIEFATNHYLLVAALLVLLVLLLLHELRKGGKSLSTRELTALVNADQAVVLDIRPAKEFASGHIVDALNIPADKLNSRMTELEKYKGKTIILVDAMGQHSGTWGGVLKKAGFNAAKLSGGIGSWRGDNLPLVK

SEQ ID NO: 23493 - protein, 161 aa, Pseudomonas aeruginosa
NRMTWNMQGSGADNGRHSTSAIDDLRRQRWKVWGALVLAGLLFGLMLGRLFGPASLPTSAPQLLAVGESEQGLVLRFDRQAAVTAARVEGALTLRIVARGAAQQGDGRWLGQPLRWRVREEGKALLLSLVSTRPLQGRWQWSEDGEGWRLVVELQERDGRE

SEQ ID NO: 23494 - protein, 565 aa, Pseudomonas aeruginosa
GDQACRRAFHQGSGVATPLHEAGYTDAVVHRFEIKTNTGKPGGVHIRITATRLSAGPAAHRRIAPRALFALPYPCRRRSMPAPRWKRHSGRQAAAGDRLGGLEHGPQQHRAAGGQVVGAGVLDLVVADAVLAGHEDHPRRTEFGEEDRVVAGAADDVHLRHAQRLRRLAHRADASLVEVQRREIGGRHQLVLQAMLLAGSGDHLADFGDHRVQALRLQMAEVQGHLHFAGYHVARTGIGVQAADRAASMRLMAEGRAIDRLDHRRGTDQGILAQVHRRWPGVCLDAAQGQVEPFLPERAEHHADGLLLVLEDRPLFDVRLEIGAHRMSETIARSRVADGVQRLAYADTVGIALGQGLLQGELPGEYARAHHAGREARAFLVGPHHHLQRRLGFHPEVVEGADHLEAGHHPEAAVELATGGLGVDVATGHHRGQVRVTPGTTGEDVADPIDADRAAGRFAPLHEEIAGLAVEIAQGQAADPTLGGGAEAGEIHQRLPEALAIDVSLGGLQDVPGSAHCRLLRLGVGVGGSPAACMPIRAAVWPMPPGSAHGGRRGRSRARRRAASR

SEQ ID NO: 23495 - protein, 536 aa, Pseudomonas aeruginosa
KSSAHGEKTISRTGNDRSACEERRHVPVDPWRHRGYSRRELSSRRALCQRPHPGHRREPRNPLRLRRPRRRWPVPDAGRHRPPYPHAVALHGHGGQRGLLQRHRGRAGRRDHLDHRLRHPQPATVAAGGLPHLARLGAEIRCGLRLPRRHHLVERRGRPGNGRAGGTARGEQLQALHGLQERHHGRRRYPGGQLRALPGAGRGADGARGERRTGLPPAAETPRPGPHRPRGASSVASAASRGRGRQPRHPHRRDAGYAAVPGAYFQPRGAGRDRLCPRQGPAGLRRGAGRAPAARRQRLPPPGLGHRGRIRDEPAVPSRRTPGSAVARPAVRQPAYHRHRPLLLLRRAEGHGPRRLQQDSQWHGRHRGPHGAAVGRRGQQRAPVDARVRRADLHQHREDLQPVPAQGRDPRRRGCRPGALGPAGQPHPLGRHPSPAGRFQHLRRSHRARHSQPHHQPGQAALGRRRPARRTRRRTLRGAPGLPVGVRSARPPRRTPAPGRRRALILPAIPDRPVEAGRCRIAVDCPEKKPEERLQP

SEQ ID NO: 23496 - protein, 178 aa, Pseudomonas aeruginosa
SASCNATPSTTPASANIRSSARRPPASASPWSAPGRPGCPAPTAWPCTATTWCSSRPAPRPAASTSTASPATSWWTTSPGAKWNSSCRSAVSNCATASVSATTWRSAPCTTSTTRCSSASAWPPASASAWKTRTPPACSPPPTTSASCGRATTCSTCPSPTVASSSAPATPPSTWRCR

SEQ ID NO: 23497 - protein, 633 aa, Pseudomonas aeruginosa
PGPDRNGYCSTSMAGCAACASPARAWRTVAWATPASTSNWPPTPSSRPSARPSKAPAWAIRWQRNCGATASASRSTDRCAPASPASTPAATAWRSARTSPCRRCSTANWRRKRSTPNSCSTWRLRDGRPVYRIRRHQVAQPLLAGLRAAHRQGLQRGPRLPGGLGRGGLEDPRRRPRGGQRVVALFRALRTEPPGAGDQQHRADHRPLAGDQSARDRPGEEGLAGPRADRVADGALRRGVVEIHPAAGGSHRRRRHRAELRLSPRHARARHGRGGRPGTGVRGDGHPLVQDPLLAAGDRQAHPQHHRHPPVGARRPSRRRRRGVADQHHQLDHQRRPGAHGRPARGRHPEHPRRLLRLGGEANRPEHGRRDRPRPADPRPADLWHRRYRQLARRSGIRRARLRRGAGMHGGDAARLPYRRGHAGRSRALDGQPWLPAAVRFQRRRGGQYHRLEVPGHQLPGDRPHRPGRLHRLRPLPYRLRGHLAPGHRQPAPGRRYAPLRSDRRRVRGLQPVPDHLSGGELHRNGAAGHRQALSQLDPGSAQPLPRSLLNAGRRPHPRRTPPCRAPARFLRAAAVRRRATASVGSTRLRLPFAAARPTLPDGRRPTETRACPQTATTASNRSRWQRARARWP

SEQ ID NO: 23498 - protein, 71 aa, Pseudomonas aeruginosa
CSACTPRSSASSARAPAFPPTCWRITPFGSKGSWLPSALLGGTQVGWFGVGVAMFAPNTRWPRPPASTSTC

SEQ ID NO: 23499 - protein, 434 aa, Pseudomonas aeruginosa
AAARTNQKRSSMLIDNLRLRGREGLWQLRVADGRIAALVPMEQAADDAGERLDGAGGLAVPPFIEPHIHLDTTQTAGQPEWNRSGTLFEGIERWAQRKALLSHEDVKQRAWQTLKWQIANGVQHVRSHVDVSDPTLTALKAMLEVRGEVAPWVDLQIVAFPQEGILSYPNGLELLEESLRLGADVVGAIPHFEFTRELGVESLHKAIDLAKRYDLPVDVHCDEIDDEQSRFLETLAMLAHRDGLGARVTASHTTAMHSYNGAYTSRLFRLLKLSGINFVANPLVNIHLQGRFDDYPKRRGITRVKELLGAGINTCFGHDDVFDPWYPLGTANMLQVLHMGLHVTQMMGYDEIDGGLDLITRNSARTLGLREYGIEVGHPANLLVLPARDGFDAVRRQVPVRYSIRGGRLLAETVPAQTTVFLEQAEAVDFTRAS

SEQ ID NO: 23500 - protein, 237 aa, Pseudomonas aeruginosa
RRLRCSGLQSDSAQDHAGHRLYRPFELHVAERLVAVEHLDLVAEVGVVLGGGPDHVEQAARFDRQDALFLDPLADLRLLHLGPFVEAVVEGGAEQRRAMHDFVGPDLGAMRAGTRVVHLRADIAGQYHPWVIEHLEAEGVLLPDLEQAEEDVAVQLVLGAEVVVQVGARQFGFFGDVAHGGAGVAFFGEDFFGGQENLLDVAAADLDLVCAHVRSITANSTKATSKSGRAATPSLAR

SEQ ID NO: 23501 - protein, 502 aa, Pseudomonas aeruginosa
ACQARTERALRPASPVCQRTNGAHSQTTNGELRMSAVMTPAGFTDYKVADITLAAWGRRELIIAESEMPALMGLRRKYAGQQPLKGAKILGCIHMTIQTGVLIETLVALGAEVRWSSCNIFSTQDQAAAAIAAAGIPVFAWKGETEEEYEWCIEQTILKDGQPWDANMVLDDGGDLTEILHKKYPQMLERIHGITEETTTGVHRLLDMLKNGALKVPAINVNDSVTKSKNDNKYGCRHSLNDAIKRGTDHLLSGKQALVIGYGDVGKGSSQSLRQEGMIVKVAEVDPICAMQACMDGFEVVSPYKNGINDGTEASIDAALLGKIDLIVTTTGNVNVCDANMLKALKKRAVVCNIGHFDNEIDTAFMRKNWAWEEVKPQVHKIHRTGKDGFDAHNDDYLILLAEGRLVNLGNATGHPSRIMDGSFANQVLAQIHLFEQKYADLPAAEKAKRLSVEVLPKKLDEEVALEMVKGFGGVVTQLTPKQAEYIGVSVEGPFKPDTYRY

SEQ ID NO: 23502 - protein, 255 aa, Pseudomonas aeruginosa
IPDKQISLTDPDARSMKTRGTGMVGYNVQAAVDAKHHLIVTHEVTNDGVDRDQLSAMAKQAREAMGVEELSAVADRGYFKGEEILACHEAGITVFVPKTLTSGATAAGRFGKGDFMYDAAKNEYRCPAGQSLIWRFSSVEKGLKLHRYWSSHCQGCALKEHCTPSSERRVSRWEHEAVLEAMQSRLDQAPEMMRIRRQTVEHPFGTLKSWMGATHFLTRTLDRVSTEMSLHVLAYNLKRVLTMLGSGALMAAMKA

SEQ ID NO: 23503 - protein, 139 aa, Pseudomonas aeruginosa
HQVQFAFVQRLGRQGRGQVLDGDGDSRRPLTQAAHQGGHADQFDVVGHRYGEALPAAPRIEALAVAQALFDLPQRRADRRFQRQRPGRRLHRTTGADQQRVVEQLAQAVQRIAYCRLAQRQALRRARDVAFAQQRVKDA

SEQ ID NO: 23504 - protein, 366 aa, Pseudomonas aeruginosa
WSLFVRSDCPRFRPPFLLRSLQRGQDHEPELFLPPGRGDRRRHHGSRYRHVPGQRRSRRAVAGQQPADAQPGARRRGRHLRAQRAPGAHRRRGSGRAPRPHHAGPAPRRDARGGPGDRGGLREPGTQAIDLPRAGRGAEALRGAGQQYLLPGHRRHRRGHRASGSGARPALLQPGAHHAAAGDRARRADRAGGAGGGPGAGRADGQGQRGGRQLPRLHRQPHARTLRHRGPPDAAGRRSAVPGGPGSPGVRFRHGAVPHVRRGRYRPGVARPRVGRGRPGPAGRAGGQPPLRDGPLRPEERCRLLPLRAGQPPGGARYRGGCPGAPGCRDAGLPAARFRRRGNPRALPAGAGQRGREDPRRGYRRP

SEQ ID NO: 23505 - protein, 445 aa, Pseudomonas aeruginosa
WPCPRSISRSDGRLAQGDRYASFQFRHYRADPLRGRLRHPPGGTLPRAKGAPRVDRDRPGDHPARLAGCDPARLPAPGPGRRGVRPGARRSARVGGRGRARAGAGHGCRAGGRFRRRQLHGRSQAGRAARPPRSRAGARRGLRGRQRTRAAPAADPGADHRRDRLRGDADRHRHHRRDHQGGRGLAPLAARPGAARRRPDPRLAAGGHRGDRYRRDGACDRELYQQTEEEPAVRPAGAGGVAPAGGQPGTRGRRRRRPRGAPGHAAGRLPGRAGLRQCAGGGGACPGLSAGRAFPHSPRPEQCAGATGGDPFQRSRCRWTLCRAGAAAAGRPLASGRSRRAYRAADRRTGPAQSAQRPAEPLARRRGGRGDAAAPGRRRDAPAASAGQQPARGRRGGCPGDLSRGILNPFYEDRAWRPPCDRCASSTFISSRSPRAGTTTTSTDT

SEQ ID NO: 23506 - protein, 77 aa, Pseudomonas aeruginosa
LARTRNMGFLILSRREGEGITLSLKADYPAEELIRQLREGGIRILVTDIIGNQARVGIEAPRGVLIVRDELKTAPKG

SEQ ID NO: 23507 - protein, 240 aa, Pseudomonas aeruginosa
PLSLSLPRLLPTAPPAAPPRPAPMVAPVLPPSLLPITEPPAAPSPPPRAASVLRPSLAVIAPPAAPPRPAPMAAPVLPPMAPPTTLPRAPPTPPPTAVLVESPASAACALSRPNAITRRDLRIVRASSFQSGGKYGRSHKGRTIRPGLCLVGSGGFSRRSSDDDACGASTSCTGHSDGRCHAGNSHRDSRRGGSSDGRGSRHRRRSGGCRRHNGCPARRRRRRRGPRRSGHRCCHRSAGR

SEQ ID NO: 23508 - protein, 301 aa, Pseudomonas aeruginosa
DAASCCRRRRFSWASDNAPVARGLFQAYRDELRSRRMAADADALQRHQGIGFRVVGGCLAGRDVEGEQGEAAYPAFDAIAPQRDQVDLVARLVAQAADIRLVGEYHFALALHSAIAIVQAVDGGVVLVMGAQGLQDQVGFEAAVAHLCRQQVAGQRVGDEVGLAAGGVPASFAGGVAEVEATGMADAAVEVGETGDGVGDQLADALVVGDQRVPVHRMVAQGCLGDAGDDRRLRTHLLRERLQLPVGCVDHAERVFHRDRLRASGLAVDVGAPQAGQDQCVAAGGQVAAVELGADVHGQVA

SEQ ID NO: 23509 - protein, 529 aa, Pseudomonas aeruginosa
RQGGVGARTVRGGLGEIAAQADEDLRLAGEHRGDRLDGVVPIVAWHFEAEAPFQCVEQRRRRPLVDAHGAVTLHVAVAADRAETGARAAQVAAQELQVDDFLDDRHRMVVLGDAHRPADDDPVRPPVHPRSLLDFRQAQPGLALQVFPGGGIQFGQVGLEAVGVLGDEGVVEYRLATLGLGFALPGEEELGDPADRRHVAAQCRTEERGVQRRGPVSQHFQRVLRMLEALQAALLERVEADHLGTALHCLAQRLEHARVVGAGVLPKDEDRVGVFEVAEGHAALADPDAAAQCHAAGFVAHVRAVGEVVCAERADEQLVEVGRLVAGPPGGIELRLVGAIQASQVLGDQGEGGVPGDRLVVVAERVVAHRSGEAALVFQPVVALFAQGADAVAGEERRVDAALGGFPVDCLGTVLAELHPAVFRRVAPGAAGAVETAVLVGLEQGAEVLERLFAVQPEVRHAAQRAPAGGGAGIGLVAGLERLQAHGGLTRLRPAPGCRPAGRCDGAGGSGSVGGGAPIARSGRWGRRG

SEQ ID NO: 23510 - protein, 205 aa, Pseudomonas aeruginosa
CPSALPWRGCRRILTRMGAVLWGDEGAWGYFAGFCSLDLASRGSGLRRPLATVTVKGEPKMGIFAFVKEAGEKLWDTLTGHEAQAAESLKEHVAKVGLGNPNIQVSVEGDKVIASGEVVSQEEKEKILLALGNVAGVSSVEDKITVAQAAPEARFVTVKKGDTLSAIAKAEYGNANAYMKIFEANKPMLSHPDKIYPGQVLRIPE

SEQ ID NO: 23511 - protein, 325 aa, Pseudomonas aeruginosa
RVALSALRPMPAEENEEGPRSGPGGGVSAVLDARLARADSRSRLALGDRDDVRERTDHRVLAGGAGELDGGLDLRSHGAGGEAEALQFVRVGLGDGLLGRLAPVDVGRVDVGGDDQDVGHQLLGQQRGAEVLVDHRLDAAELLPGLVVHGRDTAAASADDDGAFLQQPLHRADLEDPLRPRAGHHAAELVAVRGDAPALLGGQALGFFPGVDRADRLGRVLERRILTVHLDLGEDGSERHFERQQVAHFLFDHVADHALGFRAEDVQRVGRDLVVGGTLEGQQADLGAVAVGDHQLVAGRHLGDLFGGDPHVFPLVVRGHGFATA

SEQ ID NO: 23512 - protein, 370 aa, Pseudomonas aeruginosa
QGITAQCDDDTHIGYLRKAAAPGRVGRGAGARSDVGEGRDEDRLDGMHAVLGLLEGDVVGRLEDVLGHLDAVGQVRILLGDLLADLGLAVVERRQAVHELGPRVAGGLHDLHVDLVGQQFLDPLAPGFHRLAHRYPDVGVDEVHALHGFLRILGEGQLGAAFLGELLALGDELVVRPERLRRGDAYVHAELGADQQQGVTHVVARVAQVGVADVVQRLVAVLAHGQHVGEHLGRVVFVGQAVEHRNAGELREFLDDFLLEAAVLDGVVHPAENPRGVLHALLVADLRGVRVDVGDVGALVVGGHLEGAAGASGGFLEDQGNVLALQVLLLGAGVLGALEVAGQVEQVTQLAGAVVHQAEQVTVVHVESHD

SEQ ID NO: 23513 - protein, 836 aa, Pseudomonas aeruginosa
TSAGRAAGRGTEWSCLGLLVLGQLQRVGSLVGQSQSGLAVAQDAHEDLGETDEHQGEADRHDQADVPLADAEVVEVLGADAGDEQGLHPVIAGHAEQAGVAEAGQAGDHAEHALYRSRGQLHQHVHAEVPGGAYAVGDAEEDQPGEQGLGQGVAPGHLLGQGEDPIADGEQRLVAALPEIGEIVEQRIEVIEDYINEGNQRHGGEEEGDQAFLQARPDARERVHGLSLFLLGLVGGFGGLDQVGADLAFELLPHRLHGLAPFGPLFGSEFDDLAGLGLDDALLVALVERLGLLVHLHGDLVHGLGQHAAHVFRQAVPELGVGDHHVVQHAVVGLGDVLLHFVHLLRVDVRPGVLGTVDHAGLQALIDLGEAHLARVGAHRLELFLEHLGGLHAELQAAGVLRLAQGLVGGQLLHPVVPVAEASDALVLHRGQQLLALRALLEAVDRLDVVEQERQVEDLQFLGVLLELGQRRRDDLHVAQQQGFHLLAVAEQRRVRVDLHLDLARQAFLHQFLEQQRALALGRVLGDDVGELDDDRVGRLDDSGDGQGKCADERLRGVLEHETSSLFLSVFYEEDGCPLGVAEQGKSRQRSGRCCVNRKSAWSSACWNAREAVSKPCASRARVRRGDAAGADGERLAVIRHSFAIIWRIFARRVERQAVLAQLVVQGLARDTEGLGDAAQRIVRAFQFGSDQRALEGLDLGAEVVRLVGGVGQDSVVQAQAETQGEALGGVLQFAHVARPVVGQQPRRLAGVQFAWRQAMTHGAGFGEMAEQQRDVFAALAQRWNAQAGDVEAVIEVGAEAALVGGLAQVFLGCRDDADIQRDQLVGAEPLDYPFL

SEQ ID NO: 23514 - protein, 439 aa, Pseudomonas aeruginosa
QAQQLDLHVQAHALDLVEEQGAAIGVLELADAALLRAGEGAGLVTEQFAFHHRFGEGAGVDRDERSVTSARQVMQGPRDHLLAGAGFAKDQHVGLDRRQRADLLAQALHAGRASDQAPMQLVAFGQGQAQGAVLQDQPAHLQGAAHAVEQGVAGEGLFQEVIGAAAHGLDRQRHVAVAGDQDHRQVGVLFVQLAEQFHAIDAGHADVADHHPGPVLALRGIQLARVVQGRDLEPGEVERLAQGLAQVRIVVDQQDLGLGIEWREGTHARVSSWGMAATPGTPGSKCRRTTAPPSRWLPISRRPPRARNRLSQMARPRPSPLAVVLVVKKGSWAWARASSENPGPLSRRVRVTPCWSWLAITHRRRGGAFSASASRALVSRLPRICRKRVSPAWTHSGASGTSRSSSTFIARRRLATIDRASSIAGCNCTFSGARRAPRA

SEQ ID NO: 23515 - protein, 319 aa, Pseudomonas aeruginosa
RRELPGGSLSSVHGLGQQALEVLAVAVLGQRRGEFFQLRGVDPLLPVGDLFRAGHLETLAVLQGGDELAGLEQRIVGAGIQPGVAAAHDLHAELAALQIGAVDVGDLQLAARRRLQVPGDVHHLLVVEIQAGDRVVRLRLQWLLFQADGLAALVELDHAVALRVQHVVGEDAGAGLALRSAAEQLVEVVAVIEVVAQDQRAEVVADERLADQEGLGQAVRRRLHGILQVQAPVRTVAQQLLEAWGVLWGRDDQYLADARQHQGTERVVDHRLVVHRQQLLGDGQRCRVQAGARASGEDDALAFHSGPCSLSSWIMRPAW

SEQ ID NO: 23516 - protein, 233 aa, Pseudomonas aeruginosa
PAAARSKPLIFLPECRSSSVPGGGRAGLGAERRAGQPDDHQQGEEQPAEHGEVVDGGHHVGLALHHPVEQRRVRLGVAAELGEGFVGGRVVEADVFAEVGVVLGGAAVPDPGGQRGGEAAAEGAQEGGQAGAIGDLVGGQVGEQDAQDRHEEERHAEPHDQLHDGDVLVVDLGGEVGAHEAGDGHRQERQAGEHAQVEMVGVAADQRREEHREDADWRGGQPGPGGGVAHLGL

SEQ ID NO: 23517 - protein, 354 aa, Pseudomonas aeruginosa
PLREQQVDAEERGIAQHQRQGAGGEVAVGEQAQVDDRMAVGEFPDDEEGQGDRRDQRAADDEVRLEPVQVVALVEDDLQGADADHQGDQADVVHRRLLDHHRACLQLLVDDEGGEQADRHVDEEDPRPAVVVGDPAAEDRPGDRRHHRDHRQQGQGHAALRRWVDGDQQGLGDRIQRPGDEALQGAEADQRRHRLGDAAEERGEYEQQRGGDEQAHLADPPGQPAGQRQGDGVAHGERGDHPGALFRTHPEVTGDGRQGDVGDGGVEHLHESRQGQADGRHHQAGRGEAAAFAHAGGLNAGRSCRGLRRGWLRSGVRSACRPRPVAAGRHRWRTALRAVVAGPGPGRSGHAGRP

SEQ ID NO: 23518 - protein, 513 aa, Pseudomonas aeruginosa
SWWVPRSFCRRFRGSERSGAGIGLETAAQGLDQLDGKIDLLALQAGQLAFGDQQLLLHAEGVEVAADAFAVATHGQVEVGPGDIAGLALVDHLLLQGAQLAEVIADLAEGLDQRLVVLADGQVVVGVAFGQVGAAAATVEDRQGDRRRHLEEAARRLQHVAGVQGGEAGHRAEIEVGIELGLRRVDVAARRLDPPARGNDVGAAAEQFRREYRGQAQAGRVQRLRALQFETAIGPLAQQHGEGDAGAGDVLLGGAELLAGGGQLGLRLLQLDLAVEPGAHALLAQLGHALRALQFFLGEIAHGKGVGEVAVGAGDARREADARGLAVDPGGIGLAEGGFPGGALAAPEVEVVVEAERQVLDRRIAAAERCRGHAGRRADAGVAGLGVQRRLARGILRLGRCRRLARTRLGDLQVGGALQGFADQLVELPVAEPGPPVLARPGRWRKGYAVQAPARLEGACRLQSGVRFQAFGSDAAGGQHYRRGQRQSLRPGMEKRERHGSGLLQAGPRAAGV

SEQ ID NO: 23519 - protein, 254 aa, Pseudomonas aeruginosa
LVPHETTAGATFEEVQGDHDDDREAQVDGGRGHVEGEGFLGRVGGDLRLAHDLVEGDQRHQRGVLQQDQVQVAEAGQGDPPDLRQDDAPEDPSGRQAERLAGLAMAARNGQQRAAEHLGGVGAEAQAEGQGAGGERRECQVRLAEKVAEGVQAAHRAEIDHQYPERFRHATDDGGVGAAEEAQGRVLRSLRDGAEEAEQQPHADRRQRQLEGHPGTGEQLVAEPMQVENHEKSGLKAATAGTRPAVAWLGINRC

SEQ ID NO: 23520 - protein, 348 aa, Pseudomonas aeruginosa
RAGRRLRCRCAACRRRWRRGRRPGLQRRPAGSSYSSSCGVAPLAVAGHELFAARRLGVFENLLRRSLLFYQALVEEYHLAGNLAGEAHFVGDQQHGPALFGERTDHVKHFLYHFRVERRGGLVEQDHLGLHGQGPGDGRALLLAAGKLRGIAVALVGDADLGQQALGDLDRFGLALAQYATWRLDHVVEDAHVRPQVEILEDETEFAAQPVDLLAVGGDQVAVLALLQAQLFAGDQDLALVRVLQQVDAAQEGGFARAGRSEDGDHVAVAGGEGDALEHFEVAVALVQVTDFQCGGGLGHGFSSCYSDWKGLPGEGKLAQRFNRSQAGGVPLERGWRHLVASLQCAVA

SEQ ID NO: 23521 - protein, 771 aa, Pseudomonas aeruginosa
RSFHPLGFTACTAESSQMKKTLLLCLFLAAFFGGAAHAESSGGMSQFTPPPGDTSVDFLEEVFGSIVGTIHSGGNVEGGETEDVLGSMMSVFGGAVMFLGMIFIAYTTIKGTVDSAQDGEVLGRKMSDIWIPLRTAAGGALLLPLGHGYSLIQIMVLWLAIQGVGVGDAIWNQAVDQIGKDGMLSRPLIPDSRPLAANILKFEVCTAAMNKQFEASGRSTRIQAVASTRKVVNTGEIDVDITDAIPVYGGINMVQKYNKASYTVTDYKWKANDNSYMNPDVCGALTWKQSWEASEGNSNTKVIKDPILAAHAKAIQQMIQDIRPTAQQIVAGQKPAPGVIDAAANKYENSLRAAAKAAVSQTSDRAAADFLKAAKDGGWLFAGTWYNHIVKMNDVMQSTLNGLPAAEPIAIVDKETKETLQTYADVMLTADEYAKHRVDSVRNTYYAETNIREPRDGEGAWEYVKKMMSAPFMGAINQMTQSIAGSNLNHMSQMKSFGDVIVTIGEVMLASMAGVSGAANSLAAKVTVGSVFDVGAVIQFASSLVTTFVLLLFFFGVTLSTYVPMIPFITWTTSIVNWFVLVLESVIAAPLFAVAHIHPDGDDTVGRAGQGYMMILSLVMRPALMLFGLVGGMLLTQPIVGYINAAFMSVVSGIQADSMTGIVSFIAYVAIYVVIMTTVVHIVFSLIHWVPDNILRWIGQGATGGIADAERTGDGGQDVFVAGVRESKHGAAGGLGGGAKHGKGPDNSTTGTPGRGMPDNSTLLGGPPPGG

SEQ ID NO: 23522 - protein, 503 aa, Pseudomonas aeruginosa
RLTIPSRFPPDCRASVPGLAFLVAQLHRQAPAFLGGASCQLQQGHQRAGLLRRHRVARLAADGGGQRLVVAALVACRGDQRLAQALAIDVLQQVGIAAPAGGTGVQSLEQLRFLDVGAGLEQAAVVAVHIEAWRRIGGEHAGAQRYLAVRIIEQDLEPVVGQRALAQPAQVSVHTLRYAEQAQCLVEQVRAEVEPQPGAGQVVFAPAVADLRTEALDGRLEVAHRADAAGLQGGLHGEEVAVEAPVLEHREDLPRPFTGEVGEAPGFGQGDGERLVHHHVLAGAQGPFGEAGVGGIGRGDDHQVDVGGLDGLIRIGADPGFGQVGVHPPRVAGDHVLQAQRRYRADQRGVEGLAGEAVADQRGADRRQAREGWGHGGLRRAGWGSGGWRHVAVGLGVVLAGEELVHLLLEELAVLGVHHVQATLVDQHGLVLLPLVPGLARHVVVDVLALRARIRRAVEAGQLFVVLAAHHGAAHGRSPAVAAGPAGPAFTRPCRVRVPVLRA

SEQ ID NO: 23523 - protein, 423 aa, Pseudomonas aeruginosa
RRVALGVTGHGGVDFRLARGAGGILGLLGLGRQVAVEVELVALELGAQRLPGEIGDAEAAAEGGVVQTQLEVFEIQAVAAAGQAGVQLELAEGVGIGHGRQGHTDAGEELAQVHRRDRQAAAELGVLVQLAGLQFAEGAQLVDAQLQAVPLGDLRRLVEQQLALGGEGGGLALQRLARGFAGEPGVFQLVAPERGVEAQVAGQLGLDPYHRLVGAEVGVELQRNAAAFANGAGAQLDALDVVLLAAGFVGVGDAGVVDIEAVDVELDRGARAVVLRRLLRCLRLGALAVRCRRGGGRSGRGLGLGRLADVFPVALALLVADQVQAQAFDADRAHLHVLAQQRQDPHRQAEHLQVGERLGRRGGAGDAGVVQLQAQPGEQAPADVALQVQLQVGLVAGDLADFVLVVIGIEQVGQGEAQGHDEQ

SEQ ID NO: 23524 - protein, 615 aa, Pseudomonas aeruginosa
ESQEEQPQDLAECFHGRILCAGSGECAGEYNNAVLPGRPCARRNLVSECAGDPFGERQAGGEAGRLDAEQVDQAGQAVFGRGLDDEVGGGFPRPAELGPDAGVAGGQAPRIDAGEVARDGLGEGGAEGFVDAVVEVVHVIHVGTEAQLAAEVEGGVDAEPGGARLGHRVDQVAERRAAAVGEIAPLAQVQRRHQARIEAFGALRQRLGEQAAGIDHPARAQPERFADALSFGAPAAGVALQAVDPGVQRQLCAVAFGDGLQRLQVGVAVDDSRARREQGGDPADLGLQRAQRGAVQRHQVVDPAGACVGRQGLEPLALVFLHRHQQLADAPVADAVAGAPGVQAFAAFQAEIGLERAGRVVEAGVDHFGIATGGVATDQPFALRHQYAVAGFGQARGAGQAEGAGADYQYVDVVHASLAARCSTAMIAARACGLFFQQLEPVRAAPWARILAASQSRSRTKLSRPICSRRCSTVGPTPLRASRAARSAEEKDMAKLRGGDRHRAYQRLSSGSPWRAARARASRCPSGATRRSGLPASAARRRASSRRRRPTPRPRVMPRTQRCDSCQASSPRRSRAAPSRRSLKRPAISSPAASPAATSAAPSACGANSQSGASA

SEQ ID NO: 23525 - protein, 207 aa, Pseudomonas aeruginosa
LRAVLAVELVMAERKASVARDTLETQIKVSIDLDGTGKARFDTGVPFLDHMMDQIARHGLIDLDIECKGDLHIDDHHTVEDIGITLGQAFAKAIGDKKGIRRYGHAYVPLDEALSRVVIDFSGRPGLQMHVPFTRASVGGFDVDLFMEFFQGFVNHAQVTLHIDNLRGHNTHHQIETVFKAFGRALRMAIELDERMAGQMPSTKGCL

SEQ ID NO: 23526 - protein, 151 aa, Pseudomonas aeruginosa
ARRWSTRCGTRFPTRRASTSCTAITSRPVTRARWWGTGTTASISPPRWPKARVSPCSSTRKRAIPTACNCCRTSWPGTGAGRSWPGRRAIRRSSSWTPRRLRTRYWRSSASWRTASNWSWVPSKPRNCSISSPASSPRTSTTRPSSTCSRT

SEQ ID NO: 23527 - protein, 311 aa, Pseudomonas aeruginosa
SPPAASTISATSRSCWTPAPRGSSAPSPAGRSTKAPWTWPKPRRCATTSRPEANRMALAKRIIPCLDVDNGRVVKGVKFENIRDAGDPVEIARRYDEQGADEITFLDITASVDGRDTTLHTVERMASQVFIPLTVGGGVRSVQDIRNLLNAGADKVSINTAAVFNPEFVGEAADRFGSQCIVVAIDAKKVSAPGEAPRWEIFTHGGRKPTGLDAVLWAKKMEDLGAGEILLTSMDQDGVKSGYDLGVTRAISEAVNVPVIASGGVGNLEHLAAGILEGKADAVLAASIFHFGEYTVPEAKAYLASRGIVVR

SEQ ID NO: 23528 - protein, 288 aa, Pseudomonas aeruginosa
ARVDTRAAFFQVQSRPPHQVPLERRCPAITTNIATDRESSMSIFRLALGCVGSLALLCASALARAETLVLLTENLVPFNMAVNGGNYAKDDGISGISTDTVRAACERAQIECQLILRFPWDRVYQQALSEPGYGVFSTARTPEREDKFKWVGPLAVNDWVLMARGDSSIHLNSLEDAARYRIGGYKNDAISQHLVDRGLQVQLALRDNENVDKLASGQIDLWVTADPSGRYVAQREGLKEVKVVQRFHTAELFLALNKDTPDELVQKLQTAVDALRSEGLLKQIRERY

SEQ ID NO: 23529 - protein, 280 aa, Pseudomonas aeruginosa
RLAGDAGKRLAWRRGAGYSASLQAPDRMTTMQRSLLFALLATLLLVGGARAETDPDYSMVLLTENFPPYNMAINGKNFAQEDNIDGIAVDIVREMFKRAGIKYSLTLRFPWDRIYKLALEKPGYGVFVTARLAEREDKFKWVGPIGPDDWVLLAKGDSPITLGSLDEAKKYRIGAYKGDAIAEFLGKNGFEADLALRDQENAQKLVKGQIDLWASGDPAGRYLAKQEGVTGLKTVLRFNSDQLYLALNCETPDEVVQKLQAALDGMRKEGFVEDILNSYL

SEQ ID NO: 23530 - protein, 296 aa, Pseudomonas aeruginosa
ALRFPLGPPVPVDPGQARLRAVLHDLHPRAGAAVQMGRPAGRHQLGVAGAGRQQDRREESQGRRPLQARRLQERRGQPAPGGPGHPGDQRPARPGKREEAYRRADRPVGHHRSGRPLPGQAGRRVRPADGAAFQRGQALPGVEQGHSGRGGGAPAKGPGADAPGRLRRRSRRQLPLTGGRPSAGAARGLSSGRRPGRRGRGCRTSCRGPRTPGRAPRRSRARRGSRRCPGGARMNPSRPSSTPRWRRRSPAPRRDTATAALRSGSWCWPAAHSCPCRTRAARNWTAGARTGWAACR

SEQ ID NO: 23531 - protein, 244 aa, Pseudomonas aeruginosa
NRGESRLRPAGRRRAGAWEGKGGPSVRPCRNDEDVTLTAAATPVNPASVRRLAWVDVAVAALADEHLRRYQLDALGAQLRQLPRQHVEGGLVRVADEQRRTLLAGQGDAGLQLCGDRFRCGFVVEEHIARDARQADPLRLAGGHGGGAGAAVYQVQAATLEFLGEPGHRRAHRGHAAALVVVQALHKRHLGQRRVQPPRTLFLGQLRPPGVWTAGRVHRHVQDHRAPALVRLAGQFGGMRGFPG

SEQ ID NO: 23532 - protein, 148 aa, Pseudomonas aeruginosa
SRVRRLSLCAAPGNRVRRAALMANGEVHGRATLAAAGSNGGDRVSGLHGVAGVFQQALIMAIKAEVAATVVEDDQQAGSAQPVGEYHASAVHRADGAAGARRNQYAVPFRPRIVAALAAEARHDAAIHRPRQLAAGRAERAAVDRASA

SEQ ID NO: 23533 - protein, 62 aa, Pseudomonas aeruginosa
QERKEAEHGVAGTWELDRPSMPVAAVKKNAPHRALWGASTYFSRMAAADVVDDEGHGHQAGL

SEQ ID NO: 23534 - protein, 159 aa, Pseudomonas aeruginosa
PRNSASSARETKNRLARMNCQSQAGAWSSGRSRPTPTASRSSAGTAATSSSQYQGRPGARASSRNRLGRQASSRNGTSALSKLKYMVNGRLCGPTTALSRILGLAKPGSRCRNRPTAPATSSSSRPRAQARRAARRRRNRARTPSAARAATAGGARTPS

SEQ ID NO: 23535 - protein, 86 aa, Pseudomonas aeruginosa
SDMPPVVIYTTAWCPYCIRAKQLLQRKGVDFQEIACDGKPELRAELARKAGSTTVPQIWIGETHVGGCDDLHALERAGKLDALLSA

SEQ ID NO: 23536 - protein, 171 aa, Pseudomonas aeruginosa
IDPREGPKMTEQATNGAADEQQPQFSLQRIYLRDLSFESPKSPEIFRQEWNPSISLDLNTRQKQLDGDFYEVVLTVSVTVKNGEDTTAFIAEVQQAGIFLIKNLDPSSMSHTLGAFCPNILFPYAREALDNLVVRGSFPALMLSPVNFDALYAQEIARMQASGEIPTPSVQ

SEQ ID NO: 23537 - protein, 421 aa, Pseudomonas aeruginosa
CRFVACWCTLPKIRARAAALHNRRITAMRLFALRHGLTGGAGRAPCRGWGCAADGRAMKWTPPSYGVKRQTNGAATSPGGGVSMNLSRIGLDLAKQVFQVHGVDRHEHVVCRRQLKRAQVRDFFRQLPPCLVAMEACGSAHYWARELRELGHTVRLIAPQFVKPYVKGDKHDAHDAEAICEAASRPSMRYVPVKSAEQQAVQSVHRVRSRLVRARTALCNEVRGLLGEFGLIATRRGRAATMALLETVTATEPAPLPAPMGELLRELKDELQTLEARIARLERQIQAHVRGDARIQRLLAVEGIGPISASAVAASAGDARQFRTGRQFAAWLGLVPRQHSTGGQQRLGNISKRGDTYLRTLLIHGARAVVRCCANKTDARSRWLQGLLQRRPANVVAVALANKNARILWALLSRETCYRPG

SEQ ID NO: 23538 - protein, 174 aa, Pseudomonas aeruginosa
RPGRYSPSRTRVEGGRCRRLDGSATQAARRPPAIASEALSMARNSTAQPAARSSGLAFSISLWLMPFSQGTKIIPAGPSSARKIASWPAPLTMSICGMPSACAASRTAPTHPWSKYSGGKSAVGTSSYCKPCFSQVAAITWRTSAIIESRRSGCRWRKSRVIFTSPGITLREPG

SEQ ID NO: 23539 - protein, 187 aa, Pseudomonas aeruginosa
PMASSASPTLTPSASRLARVSSRVNFPANTPEPIMQGAKREPSSLVHTTTSSGASVSTPRSLRVRITSRPAITPKQPSNLPPVGWVSMWLPVITGGKSGLRPGRRAKMLPTRSTLTVQPAASHHCTKRSRAWRSRSLRARRQTPPLAVAPRRARSISDCQRRWPSMCRWVDCRTFRAVLIVVSSGLE

SEQ ID NO: 23540 - protein, 564 aa, Pseudomonas aeruginosa
VSAARRPPVCPSGQRFGQCRRAPRTAAAEAVVERAAEQRAGEPAVVVEPVELAVAEGHDGQRHRHREGGEAGPVPGRVDVVAVESGEVEALPAHQEVVHHHDPRDRPEQAGVAEQPVGVDAFQAEVGNDPAELLQQLVGHQRQADETGEPDGAGAADEFRCDVLEVVGRRDDVRRGVGREGGDDDQRHRHRHPAGAGDVPDQADRVGNRLAHQRSRGGGHHHAEGGEQEHGQRQAEDLPEYLVLLATRIAAEVGDVQRQRGPEADHRRQPGHEVAGDAGAFRALRRLRQQFADRYVRQRPHQQAEADQHQQRCRECLQPFDRLRAAQHHPQVQPPEQEETDHLAGTAEGFPGGKDRTEEEMDRQPAEQRLDAEPAARDHGADQAWHVGADDAERSAQQHREGNAVAGAGEGIEGQRDQHHQVGQQDRQQRFADAEAEVGGEDAAEGVGGHANGHADPQRGDVPPVPGTLFHPGRGDVVVVAGAVEYVAAGGQLDQAVALGHFRSALLHGPLQNSFSYSLIGLMRWPEYRTTSTAPPVRTMPWRAALNKRAENPATSLGRPVYWR

SEQ ID NO: 23541 - protein, 507 aa, Pseudomonas aeruginosa
QDYKSPRRMAKKQFQEPATTGQPARKDGMSLLIRGATVVTHEESYRADVLCANGLIQAIGENLETPSGCDVLDGGGQYLMPGGIDPHTHMQLPFMGTVASEDFFSGTAAGLAGGTTSIIDFVIPNPRQSLLEAFHTWRGWAQKSAADYGFHVAITWWSDEVAREMGELVAQHGVNSFKHFMAYKNAIMAADDTLVASFERCLELGAVPTVHAENGELVFHLQQKLLAQGLTGPEAHPLSRPPQVEGEAASRAIRIAETLGTPLYLVHISSREALDEIAYARAKGQPVYGEVLAGHLLLDDSVYRHPDWATAAGYVMSPPFRPVEHQEALWRGLQSGNLHTTATDHCCFCAEQKAMGRDDFSKIPNGTAGIEDRMALLWDAGVNSGRLSMHEFVALTSTNTAKIFNLFPRKGAIRVGADADLVLWDPQGSRTLSAATHHQRVDFNIFEGRTVRGIPSHTISQGKLLWAAGDLRAEPGAGRYVERPAYPSVYEVLGRRAERQRPVAVER

SEQ ID NO: 23542 - protein, 338 aa, Pseudomonas aeruginosa
RPDGAVLPLTAPRRNLKRGYNRDRFPEPPPPSGRRRGHARRALRRPRAAAQRPPGRPGKRPLPVLLRRALRQRLPDRDRHPRVHPQHRPGECPGRGAEDPLGEHPRRQLRPRLPHGNPLPAGLRTQQRPGMRTGADRPVATLRPRPRRLRRTSVQALAGHRQAHRRGRRRAGRAVLRPPPGHARPRRGALRGPRQGRRPQRVRHRPLQAGGRLRPARSGIPPADRRYRTAPRPASRRQPGARRPARRVRRGVPRHRPGRQQAPRPGRRGRPRPARRHRLHPRAAAERRPARPARRRPLHRHRRRQHRHRHGGADEPARRPRRQPGLPPWLRGNGRHRP

SEQ ID NO: 23543 - protein, 562 aa, Pseudomonas aeruginosa
ARDRQGQPGAPADLGPTGTGTARRAWPGARHALRPHAPGERSPGRHRRALRTGRRRHLQGHRPGLRRRQPGRSAGSATAARRRAHPGRRTDAHQHPRHLRRRRLRGARRGPHRAGGAARQTGGGSDPRPTHAQRGGCVMADLSIEFAGIKSPNPFWLASAPPTDKAYNVVRAYQAGWGGVVWKTLGEDPAAVNVSSRYSAHFGPNRQVQGINNIELITDRSLEINLREIAQVKKDWPDRALIVSLMVPCVEESWKYILPLVEATGADGIELNFGCPHGMPERGMGAAVGQVPEYVEMVTRWCKTHCSLPVIVKLTPNITDIRQSARAAHRGGADAVSLINTINSITSVDLERMVALPVVGTQSTHGGYCGSAVKPIALNMVAEIARDPQTRGLPICGIGGIGSWRDAAEFVALGCGAVQVCTAAMLHGFRIVEDMQDGLARWMDSHGYQRLSDFSGGAVGNTTDWKYLDINYQVIARIDQDACIGCGRCHIACEDTSHQAIASLPRADGTHRYEVIDAECVGCNLCQITCPVENCIEMVPQDTGKPYLNWTQDPRNPYREAS

SEQ ID NO: 23544 - protein, 303 aa, Pseudomonas aeruginosa
RCSPQIPGGQGHRPRRQPADPGFRSADDPHGVLRHRRSDPAVGHRGPGDRRSRQLLGMARGARRRRPGGAAAGDAERAAEPLDRDRPGGRLVRQRRHPHRRLRPLRPQRAYRRGGVPGGVLPRQLADVHLRRGRRGGGGQVGHLRRDDRPGPADPGDPGPRPEHLDHQRQRAVCLRPRLRQHHRPLQPLPGDAQRRPRHPRRALAVQPLRRLADLPLRRHPAHRRGDHRRLPESPPALPPAPLRGHPGDQLGGDPRRRLRHRRRPLAAGDSAGQRGARRRHRLPAAQSPAEPQPEQTRRGPPC

SEQ ID NO: 23545 - protein, 156 aa, Pseudomonas aeruginosa
NGRSPTACSTCAATSTSPTRPSPRSRPCSRCAAKWRPGSTCRSSPSPRRAFSPTPTAWNCWRSRCAWEPTWWGRSRISNSPASWASSRCTRPSTWPSATTCRWTCIATRSTTSSRASSRPWPCSPIATASAHGSPPATPRRCTPTTAPTPRGCSAC

SEQ ID NO: 23546 - protein, 650 aa, Pseudomonas aeruginosa
LEAVAVELLVVALEECVGAHHPAVVGVVAVGLEVAVIALGVVVVEGVAPARAVADPVFEDRAQPAHALFVAAIGDIVVLAATALVDLQLAGVGIEHRRAPVGAVFLLVLVLQGQGVGKVRGQVAEQGESDVPRFARIAVDVAVAAAAADVQAHEVLRLGADAQGLVEAEGDFRIVVAAVAHPAFHEIAVAVGELADVVQRAADGTGAVEEGGRTADQLDAVDDPVVQRTHGAAVLHRNAVEQLVDLVRAEAAVGDEAAEAGRRRGVHAGQAVGDVLGAAQAAPLEAGTVGHAYRAGSLAQAQAQARAAAGAVVEIEGRRGFPGGAGADGEGGQFGGFLIGPEQGRNAGQGEVETQREDAAGRGVLFHRAILKQGMVGTPASPGWTAASAARTRQDGRRMQMPGAAGVQDQAGEARGLAGGQTYRGGTGSRVAGGRKRAWRRRCKRQDQITPSATNSTRALHIGQLIGNWGLTGAGSPADPSSGSRDSHWLAPATQNSPTLAFCPLSLPTPSACRCRTPQASALTSTQAQRAKLSHCSSGERELGAILMTAHSSILTRKFPALLRCGASPQPEDTTHGDERRIRGDLGVSYGAAIIARSGGPSGRSRLPFEGRCSRPRPVRLERSALSGRPRRSVNAPTAPIRRQRMESYA

SEQ ID NO: 23547 - protein, 2284 aa, Pseudomonas aeruginosa
GSYNSASGTLASQAGMSLRLGGGALRNQQDGLIFSQAGALEVQAGSLDNRQGTLQAQGDNRLRIGGALDNQGGRLDSRAGNLDLQSGSLDNGAGGVLNSAKGWLKLVTGLFDNSAGVTQAQSLEIRAGQGVRNQQGHLSALGGDNRIVTADFDNQGGGLYASGLLSLDGQRFLNQGAAAGQGGKVGAGRIDFSLAGALANRFGQLESESELHLRAAAIDNSGGSLRALGRSGSSRLVAGGLNNAYGVLESANQDLDLQLGSLANAGGRILHTGNGTFGLDSGQVIRAGGELTTNGLLDIRASEWTNSSVLQAGRLNLDIGTFRQTAEGKLLAVQSFTGRGGDWSNDGLLASDGSLRLELSGGYRGNGRATSLGDFALNAASLDLGNAASLAGGANVTLGAGNLLVNRGRITAAGDLVASAASLNNYGTLGGGGNLRLNAPALLNERGLLFSGADMTLRAGDITNLYGDVYSLGRLDIARDDAGGWANRLENISGNLESTGDMRFSVSSLLNRRETLEIEGDLQNSAIGVRCTGCQLSERWGKTRSSSELVWIREYKSTLGESSAAASITAGRDLLVVGASLQNIASNISAVRDATLSLSNFENKGYALGEYAVRGVYSPPSKFGEELLMRILAYNAVNDPSYGEGYASTGGRLPNIHYFDKNFNEKVSPLEVIHGNGKNGGPGWHLYFGTLDVEYPGTDRWNKAIGRIPAPNYSSKKTDAIPDLLKGLAPLDELTINKGANSTVGAVVQAGGRVTVNAAESFNNSVLQGFQAVQETQLPHQDIAVSSTTSAVVTLKSQLPADLARQQINPLTLPGFSLPQGQNGLFRLASQGAQVNQASGALKSASDLTQSGHGVSVSAQAGSDASGWSTQARRVGDDRVTSLTGSAYQGRVAEAIDALRASAPISGDGGNTGRFQAGEHQATTGLGGLVEGNASGHSGNGVILADLRGGLPSFSSLPAADRIQGTAPGHDGNGTILANWQGAQATVQASPSTVRVEGVVSSPGGNGSILADLPAEQSSVQALPSAVRAQGSLPRLEERSAVLAEPPVGQPALQTLPSVARVEGVPSNATPSNSHKYLIETNPALTELKQFLNSDYLLGGLGINPDDSKKRLGDGLYEQRLVREAIVQRTGQRFIAGLNSDEAMFRYLMDNAIASKDVLGLTPGVTLSAAQVAALTHDIVWLEEVEVNGEKVLAPVVYLAQAEGRLGPNGALIQGRDVNLITGGDLRNAGTLRAQNDLSATAGNIDNSGLIEAGNRLDLLASGSIRNDQGGIIAGREVSLSALTGDVINERTVTQHQSSYRGTGTTEAFADSAARIEAAQKLTVSAGRDVANIGGVIDSKGDLALQGGRDVLVSAAVAERGWTAGSQAYQTQTTQMGAEVVAGRDISVSAGRDISVVGSRIDARHDVTFEAGRDVGLVAAANEEHAYGKTKKVTFQDDKITQQATRVDAGGDLAINAGQDLRLVASQASAGDEAYLVAGDKLELLAANDSSYYLYDKKSKGSFGSKKTRRDEITDVTAVGSQISSGGDLTLLSGGDQTYQGAKLESGNDLAIVSGGAVTFDAVKDLHQESHEKSKGDLAWQSSKGKGQTDETVRQSQIVAQGNLAIKAVEGLKIDLKHIDQKTVSQTIDAMVQADPQLAWLKQMEQRGDVDWRRVQELHDSWKYSNSGLGVGAQLAIAIVVTYFTAGAASGAIATAGAGTSMAGATAAATATTSAGWLNAAGTAALSGVASNGAISTINNRGNLGDVVKDVTSSDALRGYVVAGTTAGLTAGVYDKWTSTQTGTSTALPNTGAVAPAAGLGTWQGVGQFTSNQLLQNGTSVLLDRALGGKGSLGDALQNSLANAFAAYGFKLIGDTTHGMLDDGSLGKIGLHALMGGLAAEAVGGDFRTGALAAGVNEALVDSLAKQYASLPIDDKKGLLIMSSQLIGVLAASTQGDADAKSLQTGAWVAGNATQHNYLSHWQEEKKRQEVDGCKDKQLCKTGIEAKWAIISAQQDVGIIVGVGGGIGLSTAETAVGVYELVKNWRETYAALEQLATSPEFRQQFGDNYLKGLEERAAFLTQAYEDAGWQGSVTAGVEGGRFAAELVGVLTAVKGGAQITAKLPTAAKNLVNAIAESPVSGSMSSQLGAVGDLGRLGGGAKGATPKTETYFRVEGGGSGAATSQNRITVNTDGSIKINPGCSGQLCVSVGSADHASYFLTNKRPDGSVVVFEVDAGLHKQIMDSAIPQRPVPGVPRDPSAPKIVDPSQPGVALELPKMWESLLEKHSSNARLYSHDEFLKEFGR

SEQ ID NO: 23548 - protein, 560 aa, Pseudomonas aeruginosa
GGVVAALGAVADRVVGIAAPALDAAFLGQAVQRVVLVVQGAPEAVAVLLDIAIGIVLVVALPGADLLPQQLVVLVVLAAESDAVAPGQAQQRAEGQVGDLPDQGARRLVAHCQGHAGDLAAGVARVADGEAGGVADLQQLVGRVVAVGHAVEQGLLVEADAAHLLDQVAALVVAVHQAVASAIDGAQAADALVAVGGEVVAVLYVEARVARRAALDQPIEGVVAILGDRTASVGAADDVAGGVVLEGGGAAVRADQSGQVAEAVVFVAGGDTARVLDLGEVVLGVVGESGLAAEGIALADQPVEGIEGLAVGELARVGFADRIVVEVVGEAACLAAGADRTEQPAKLVVGPLLLAHQAAAGVLDALGGAIALGVDVVFEAFAEVVADRYQAPCVVVFVAQPTAVAAGDAGDLADRVIVEAGGAAGGADGGQPAVDAGVGEAAGDAVGIGDAAGLAALVIVAEAGDLAEGVGHLGQVAATVVGIEGDVLHIGARTVGALDQAEGVVAVAPGALGRLRGQGEGAGQDEGAEAGEVWGDAHGGRPCQRVVTVSPVLRPSASYW

SEQ ID NO: 23549 - protein, 427 aa, Pseudomonas aeruginosa
GGGTSVAASRARGRGGVGRGLPRRSGGPGRTGRGTSRRGRSSRAGSACNARPRPPASRACRRTRGAAPVGRPRRNTGVRSLRCGRSPRPGGFRRGAAGVLRSSWFPCAEAVHQRQARTIGGRQHASAAAVAHAVEAGPAVGVGVFLQPFELQAGAEQGADHIGQAPLELVAGMRVAEVLDAGAVAGGRQAGAGLGDIVADAALGDRLAAEVVVGRLPVWVEVQGERMELHQDEAPAGNQYLGDAVGPALEVGEPDQRAVGGEDPFEAFAAGGGDGQPAEDVVALEVGGDAAVAGQLAGEVDGAVGDVDPGDAGAKARQAQAVLSGVALQMQQAQAVEMAEQLQFLGIERGTAVAEEGGLVGLVAVVRPGGGVPRQPVGLVQVGSHGSTPSLECATARMAGPGDYMSLMLRTWSLLTRVRLPSSCSSS

SEQ ID NO: 23550 - protein, 320 aa, Pseudomonas aeruginosa
GTIGVRLNRTTRMFSMRRLLRPVFCAALFCLYPALVQAAAESEILGLFQRWQAAHGQRSGKALEGVYAPRLDYYGRAQTRERTLSAKQAFFARHPDFEQRIVAAPQIVPGDQEGRYEVRFVKQVRLDGRLRNYPGLLLAERAGPGDTWRFVGESDEITRYAVDPRYTPLARGRFAGAEADFAWVVAHAPNSAALCDEYEDCRCDLWSADARVPPKPLGSCTGAVLSVLGGLDDSGRERLQLLRTWWTSTWTKSSLLEIRDGQWVRVLPDISTTWDDAEAELVLYKADPQQPGRVLVTETVMDDEGDWSHRTRSEALRPVP

SEQ ID NO: 23551 - protein, 538 aa, Pseudomonas aeruginosa
RRPLGLGGARPYNRRLYGERRRSPGSRMRIHVSFIDRVGITQEVLALLGGRNLNLDAVEMVPPNVYIDAPTLSPEVLEELRAALLGIRGVQAMTVVDILPGQRRRLQLDALLAAMADPVLAVDGKGLVLLANPAFSERCGRDPAGERLASLFDDETLEDALVEQGFRLPLREVTFMGQALLLDATPITEGPGEGERHLAGGLLTLYEPNRIGERLAALHHDHAEGFEMLLGDSQPIRTLKTRAQRVAALDAPLLIHGETGTGKELVARGCHALSARHNSPFLALNCAALPENLAESELFGYAPGAFTGAQRGGKPGLLELAHQGTVFLDEIGEMSPYLQAKLLRFLSDGSFRRVGGDREVRVDVRILSATHRNLEKMVAEGSFREDLFYRLNVLSLEVPPLRERGHDILLLARHFMQQACAQIQRPVCRLAPGTYPALLSNRWPGNVRQLQNVIFRAAAICESSLVDIGDLEIAGTAVARQNDGEVGSLEEAVEGFEKALLEKLYVSYPSTRQLAARLQTSHTAIAHRLRKYGIGPRA

SEQ ID NO: 23552 - protein, 337 aa, Pseudomonas aeruginosa
RGPGKARLAKAPARQNRARRTTLVPERKESMDKLNALAMFVATAETGSFSRGAERLGKTPSALTKAVAHLEAELGARLFERTTRSLALTEAGQIYLEAARQSLETLRTAGQEIELLESELRGELRLAAPPSFAAAFLQQACASFLEAHPRISLRVDLDETFLDLSEGGYDLGLRDGPIDLPGLVARPLAPNQIVLCASPAYLARQPAPQGPEDFERHAWLVFQHPSLNQNFWWMERDGARQRIDQPRPRLASDNYDFLLAHLLAGLGLQFCPQWSVAPLLGEGRLVRLLGDYHFDPGPFGPSIHVLYPGHRRNTRKVRAFLEHLRASLQRQGLCHRL

SEQ ID NO: 23553 - protein, 130 aa, Pseudomonas aeruginosa
GSSMSKLRFTTDHEWLRQDDDGLLTVGITAYAQDALGDVVFVQLPELGEHAAGSEVAVLESVKAASNILMPLDGEVVAINDALPDAPELVNQDPLGEAWFFRFRPADAGAWEKLLDQAAYDRLLNANADA

SEQ ID NO: 23554 - protein, 442 aa, Pseudomonas aeruginosa
PEPRRHRPGHRRRIHRPPYRPACRRHPGHAPAPGLRLAGRADRQRDPRQHQGQQRARPAGRHGRGRGAGQPEGDRRAQSRVAFLHWPGLLQLPHPGTDPAQPPGEPGLVHRLHAVPAGNLPGPPGGAAELPDPGQRPVRPADRQRLDARRGDRRRRGHDLLQASVEEPHQPGILRLPPLPPADPRRAAHPCRAAGHRGGGRRREHHRRLLRLLRRVAAIPHLRRRDRRLPRTGQPLPCGRCAGRGGRRPAGADPADPAGRVRRRRGHRQRPALRRAARLRRPARGLFRHPRRLQAGHAGTPGRRLHRPPRQAGLPPGHADPRAAHPPREGHQQHLHRPGAAGQHRQHVRRLPRPAGPAAHRPAHPPADRDPRRRPGAPGRGRRAEAFLRHPEPGHRRAYRGDPCQGPRRRDQPARDRCRPSRPVARRDRPPGRRGNALGPAG

SEQ ID NO: 23555 - protein, 551 aa, Pseudomonas aeruginosa
RGPGAPGLRHPCRQQRGPPAGRAAAPVGDPQPPDLQPPSLGNRADALPAQAGGQGPGAGPHDDPAGLLHHEAERRQRDDPGDLGRIRQPAPVRPGRAERRLPPAHRRTGGDALFRHRLRRRVVAAQRRLPGRVRRPAGDPCLPPEPRRQPARHLSDPVLRPRYQPGYRQHGRHARGGGGLRRARQRRRRGPAQQGQRAQGTPGRADDHLSVHPRRVRGSDPRDLRHRPRLRWPGVHRRRQHERHGRPVRPGQVRWRRFPPEPAQDLLHPPRRRRPGRRPDRRARAPGAVPPRPRSRRAQGRRGERGAVRQREHPADHLDVHPHDGRRRPQARLGNGHPQCQLHRPSPGGALPGALRRRQRPGRPRMHPRPASAQGQQRDQRRRRGQAPDGLRLPCADHVLPGGRHADDRAHRERVEGRAGSFLRRDDPHPRGNPRGGTRRAGQGRQPAEERAAHRRRTARRMEPRLQPRAGRLSAGQPGGGQVLAAGGPRRQRLRRPQPDLLLPAHRGVQRGVTDEEGAASGGVLAFPAIPLSRRRACVAAPRPRSRQRAS

SEQ ID NO: 23556 - protein, 429 aa, Pseudomonas aeruginosa
PLAVSAKASAANWPAGSATSSTISTIPRSANGSGARSANSAGTSRSTLIEQERRHGGGQSASGDEHVPECLRSVQDRHRAVQLPHRGADACRRALCRGAEARGVAGGHCQRQGRAVRLARRHRQGPRQRQGGTARPGGRAAGHGGYRRDSRSARCHPFQRRAAPARRAADPLRREGTPCADPQAAGLPSQWHDLPCLRRRRPAGPQPRVLLGGRRFRGRRRGRRPRPHRRGPHAAGVPLQDRAATARPLRPRRPVDQPVDGREREGLAPRRGNPRRPAAYLAGDAGLRRGRLPQRGHHARRTEGQAPRGGAPPPVVPAAGGRPARCSQRARLGQPLRPGGERGERQRRPRGDRADQRRGGDHSGGSALLRALHPRGRRRRRGALPAHRRGDRHPLQGKRLDLRRRGRLPGRGRGGLFDGRRGALRSARR

SEQ ID NO: 23557 - protein, 318 aa, Pseudomonas aeruginosa
RAAGRERRRNRHGAQPRADLRPGWRAGPGALHRTQRDGFGEGHQRGAHGPARRRPALHLSRQGHPHHAPDRRRHEKQIQGNRARRPRREHHRMLNRAAAPALLFSFPTIDRGSPADRRPGCHGVKHDRRNPRQDAPARPAPGTGGEDGALRRLRHAGAVPGRGAQGAPAHPRAGRSVRCLAHGPDPPGGRRCGAGPGKPGAGGHPRPAGGPAALRVVHRRAGRDPRRPDGGQPRRLPAAGGQRRLQAPGPGAPASSPGRPLQRRAAVRGACLARPPGTGGGAGAGAPGAAGGADDLHAVRPRRAARPGLLRQPLRLYR

SEQ ID NO: 23558 - protein, 233 aa, Pseudomonas aeruginosa
RRLRDLRARRPCRGPGAAPAGRAGSGADRPRRARLAAPGSRPVPLRPRHGQRHHAGRSQPRLGHFQGAPRRRRARRRLPRRRADLCPAGAGRCQQARRFPAAGADAGARGRRDRRCPGVGDRQGQQRRFRSESQRAAGHGLRAERAGRPGQRGDGDGARQAGDPGGQQDALRGAALLPRLSTGPLSPRREKAATGLTGVSAAAVAGPASWPGGIPLRRVLPVCCAHHSEPRCW

SEQ ID NO: 23559 - protein, 482 aa, Pseudomonas aeruginosa
ESTWTPRASPPNRCRVSSRRPGSCASCGDGQRPASPWPPSAPCWGSSSACSPPTRSGRRCCTTSARPGWSCSPVCTRSTGSRPWPLRGPRRGGPARGLPGCAGSGTNPTPPPTAPMNGCWSAWGQAIAHGLAQIGHAALWLAASAALALCLVAAGWRLDMPRASSGQAADLAIGICLLLAFAVLVLERRLASQGPVQWPEAPVLGQLARALIGTLVLAALCLFLARQGHPWAPRLAVLLGLLPAALALELLGRAILAMFAPQRAGLEPRLVATSLLADLLRWPPRPLQRLQHELHQRFGIDLRQVWAFGFMRRAFLPVLAVVLLNGWLLSGVREIGMDARGVYERFGKPVAVLGPGLHLGLPWPLGRVLAVENGVVHELATSVAAGDGGAEPLAPAEGPAPDSANRLWDASHVSEKSQVIASLADRRQSFQIVQHGRAHRLPHRSRRRGSAGGDLPQRRRADAGAQHRQPRTGACLRLADPR

SEQ ID NO: 23560 - protein, 533 aa, Pseudomonas aeruginosa
GPRRAARGPGRADRPGRAGRSRPPRQRRRGTGRGGRGDPSAGRCGERLPRGAGRADHSPGADRPRARAGRRAAQRGATTGQRGARPGQREGPRDPGRRAGRRPAFRRRAGRLCRRRPGFPAGGLLPPTRTRPGQGQPAAHRPPHRRRRRADHRPAQLRPRPPGFPVFVPSVRRSGVRGRAIRTMRRALLSLGHSHSHSHHEHHHDHDHDHDHDHDHDHGAQAAPPWRRLLVAALLVLFAVAAACLVQVRSGEAMVITRFGNPARVLLEPGLAWRLPLPFESAIPVDLRLRTTSSGLQDVGTRDGLRIIVQAYVAWQVQGDADNVQRFMRAVRNQPDEAARQLRTFVGSALETTASAYDLADLVNTEASRVRIGDFEARLREQIDHQLLATYGVKVVQVGIERLTLPKVTLGATVDRMRAERETIATERTAEGRRQAAEIRSAAERDARVIQAEASVKAAEIEAQARVEAARIYGKAYAGSPQLYNLLRSLDTLGTIVNGDTRLVLRTDAAPFRVLVDGPPAFPAEAPANGRRP

SEQ ID NO: 23561 - protein, 319 aa, Pseudomonas aeruginosa
PSWRRWPGRFPTSARSARRTVAVVLRLGALERLAGPGLLLAWPQPLEQVVLLPSAEQVIERRVEGLLRSEQARRADLDVSLSSDALAGSGYLLTGDAGVVQLDVRVFYKVDDPYAYVLQGAHVLPALDRLVARNAVQVCAARDLDTILVARPELLGNDSAVAERRERLRGDLVQGINHSLAALAAAGSGLGIQVVRVDVQSSLPRNAVSAFNAVLTASQLAEQNVAKARTEAEKLTQAATEGADRTLQLARAEAGERLAQARRDTASIVGLAPALGATDAGLLWRLYRERVPAILGKAGSVGSVDPRDDGRLILQGGQP

SEQ ID NO: 23562 - protein, 175 aa, Pseudomonas aeruginosa
NGYPASASTFGTRFRQRNAAPSRTTRRTGRAMTAGGIPFTGNGARLSPGRALLCGLALLLCGGEALARQLPSDMLVGFVASAQYPVITLKKPKQSLLRSVLTLGLGKKTVSYSVAPSVRIRTAQNLFIVYGRMPQLKGSFVGLKSDNNGQVKQIWELTEKEALDYVRRPDARFPQ

SEQ ID NO: 23563 - protein, 261 aa, Pseudomonas aeruginosa
AISANARGSAWSHEQRRAKPPSAGPNCSSNWASTPARCRSMRDRSPESPWTGASSAGCCWADSVRAEAAEAMADLRELGLGRQLLLTGDRRAVADAVAKQVGIRQLVAQALPEDKLRQVGAEIGSGFRPMVVGDGINDSLALKAGVVGVAMGAGGADIALASADIVLIGSDLRRLGTCVRLSRQCRRTLQVNVAIGLGWTLAIVAAAAFGLLGAAGAMVAALLHNLSTLLVLGNAGRLLRFEEPLGQPRPAVEGREEEGTP

SEQ ID NO: 23564 - protein, 289 aa, Pseudomonas aeruginosa
AATDFLAPSRLEANPPHEPRTRNQHVESLHRRLVRGQPLPGGAGPGMEGLKFYARLLWRPPRETLLFALRTVAAGLLTLYLAFLFDLEQPKWALMTVVIVSQPLAGMALKRSFAQVLGTFAGAVVAVLIMALFAQQPLPFFVALGLWLAALHRRRHLAALHRLARLRAQRLHRGDRRRAVDSRSGKHLHARRGAGHRDPAGRRLRGPGQPAQRATAGGGEGLLRPGRRPDPQYRAARRGGDPRRRGRRVVQPAADATGRQHHRAGRPAPAPLFRRAEPAPRRWPGAVAG

SEQ ID NO: 23565 - protein, 374 aa, Pseudomonas aeruginosa
PAGADGLAAVAAAPASPAGAGALGRAVAGGYPGTAGSCVAGAGRAGRAGAGGTLRGAGGVPGGAPGLRCRGDARGVLRRGAEPGAAPAGGDPALGIRAAVPAPGRSARTQRCDPVRPPRQQFLPPWPGAGAAPGLGAGLDERRARFRRLVLRRLAVDHQRLERRPQQPAAGRRDVLADGDLPASAAGGAELPARAAAGDPDLGGAAVRAVAGIRRLRVAGAVDGVAAVRGRGRPEQPAERRDRHGHRPGDLADGGATEYRGLLQQRFAVVRVRRRLPRRGGPRRAGVRPGLSVPRRPAPAPAALPVAPGRRGNVALRGQRGAALRLRDADDRSPGGDGRPAAGEPGAGCGGTFPVRPGLRGDGRGVEPPARAAA

SEQ ID NO: 23566 - protein, 319 aa, Pseudomonas aeruginosa
TGGAARRARGERGAGGAGRVARGDRGQPGPVAPAPQRGATALGIAEALDAIGGRERKGPDRRQPGPGRVAEEPGQPRPGPGQRGACRSRLAAGPSRSRTYPGARPGQRLRDQPADPRGRLRPRRGAIAGAGGPRFVLCQRILRGDQVAGHPRRQPGAGGTDERRALRRARAEHRPCHHRPGECRGLAPAGEHQPELYLGQAGPANSGAHRHRSRLSPAQHLARRRDRDHPGAARGGHRESRFRGARDCLAALSQAEPVSLCRSWLRVVRGRFPPGAGSIARQPGCRSAGGIAWPPRGRAGRPHRRWPGHGCRESTGRGP

SEQ ID NO: 23567 - protein, 157 aa, Pseudomonas aeruginosa
PAMLPSPASSLSFPSPLERREADPYARCDRQRPACNESHEPAQERPEPVATCAFIEEERRRGDPTGLLYALGPRERGEPERVAEWLAALVHHFYLDGPVEPPRTTLGKERCETAPGLCRCCGQPFDFRHKRAALLLLGTHFAARAEAQAASVRRYRR

SEQ ID NO: 23568 - protein, 3340 aa, Pseudomonas aeruginosa
TRNCPPPTPRNCSASTSWTRPLPMPGTSRECVPEHITFLQYTSGSTALPKGVQVTHGNLVANKVLIRRGFGIGADDVIVSWLPLYHHMGLIGGLLQPIFSGVPCVLMSPRYFLERPVRWLEAISQYGGTVSGGPDFAYRLCSERVAESALQRLDLSGWRVAFSGSEPIRQDSLERFAEKFAASRFDASSFFACYGLAEATLFVTGGQRGQGIPALAVDGEALARNRIAEGEGSVLMCCGRSQPEHAVLIVDAASGEVLGDDNVGEIWAAGPSIAHGYWRNPEASAKTFVERDGRTWLRTGDLGFLRDGELFVTGRLKDMLIVRGHNLYPQDIERTVESEVPSARKGRVAAFAVTVDGEEGIGIAAEIGRGVQKSVPAQELIDSIRQAVAEAYQEAPKVVALLNPGALPKTSSGKLQRSACRLRLEDGSLDSYALFPGLQAVQEAQPPAGDDELLARIGEIWKARLGVAQVAPRDHFFLLGGNSIGAAQVVAQVRDSLGVALDLRQLFEAPTLQAFSATVARQLAAGLPAEAPMAHLPRGVDLPQSAAQQRLWLTWQIDPQSAAYNIPGGLRLRGELDEAALRASFQRLVERHEALRTRFLERDGAALQRIDERGEFAWQFVDLAALAEHERAAAAAQRREAEAQQPFDLEKGPLLRVSLVRLDEQEHQLWVTLHHIVADGWSLNLLLDEFSRLYAEACGGQPADLAPLELHYAEFAAWQRQWLDAGEGARQLAYWRERLGDTAPVLELATDHPRTARQASPAARYSLRVDEALARAIREAALDHEASVFMWLLAAFQALLHRHSGQGEIRIGVPSANRQRLETQGLVGFFINTLVLRGTPRARQPFAALLGEAREATLGAQANQDLPFDQVLAACGQGGQLFQVLFNHQQRDLSALRRLPGLLADELPWHSREAKFDLQLQSEEDARGRLTLNFDYAADLFDEASIRRFAAQYLELLRQVAEDPQRCLGDIALVDAEQAAHLAEWGSAPCEPARAWLPELLERQLVQSAERVALEWDGGSLGYAELHARANRLAHYLRDKGVGPDVRVAICAERSPQLLVGLLAIVKAGGAYVPLDPDYPSERLAYMLADSGVELLLTQAHLFERLPGAEGVTPICLDSLKLDNWPSQAPGLHLHGDNLAYVIYTSGSTGQPKGVGNTHAALAERLQWMQATYALDGDDVLMQKAPVSFDVSVWECFWPLVTGCRLVLAAPGEHRDPARLVELVRQFGVTTLHFVPPLLQLFIDEPGVAACGSLRRLFSGGEALPAELRNRVLQRLPAVALHNRYGPTETAINVTHWQCRAEDGERSPIGRPLGNVLCRVLDAEFNLLPAGVAGELCIGGLGLARGYLGRPALSAERFVADPLSAAGERLYRTGDRARWNADGVLEYLGRLDQQVKLRGFRIEPEEIQARLLAQPGVAQAVVVIREGVAGSQLVGYYTGAVGAEAEAEQNQRLRAALQAELPEYMVPAQLMRLAQMPLGPSGKLDTRALPEPVWQQREHVEPRTELQRRIAVIWSEVLGLPRVGLRDDFFELGGHSLLATRIVSRTRQACDVELPLRALFEASELEAFCEQVRAAQAAGRTDSHGAIRRIDREQPVPLSYSQQRMWFLWQLEPDSPAYNVGGLARLSGPLDVARFEAALQALVQRHETLRTTFPSVDGVPVQRVHGDGGLHMDWQDFSALDRDSRQQHLQTLADSEAHRPFDLESGPLLRVCMVKMAEREHYLVVTLHHIVTEGWAMDIFARELGALYEAFLDDRESPLEPLPVQYLDYSVWQREWLESGERQRQLDYWKAQLGNEHPLLELPGDRPRPPVQSHQGDLYRFDLSPELAERVRRFNAARGLTMFMTMTATLAALLYRYSGQQDLRIGAPVANRIRPESEGLIGAFLNTQVLRCRLDGQMSVGELLEQVRQTVIDGQSHQDLPFDHLVEALQPPRSAAYNPLFQVMCNVQRWEFQQTRQLAGMTVEYIANDARATKFDLNLEVTDLDQRLGCCLTYSRDLFDEPRIARMAGHWQNLLEALLGDPQRRIAELPLFAAEERKQLLLAGTAGEAGLQDTLHGLFAARVAASPQAPALTFAGQTLSYAELDARSNRLARVLRSHGVGPEVRVGLALERSLEMVVGLLAILKAGGAYVPLDPEYPLERLQYMIEDSGVRLLLSHAALFEALGELPAGVARWCLEEDGPALDAEDPAPLAALSGPQHQAYLIYTSGSTGKPKGVAVSHGEIAMHCAAVIECFGMRAEDCELHFYSINFDAASERLLAPLLCGARVVLRAQGQWGAEEICELIRAEGVSILGFTPSYGSQLAQWLESQGRQLPVRMCITGGEALTGEHLQRIRQAFAPASFFNAYGPTETVVMPLACLAPERLEEGAASVPIGSVVGARVAYILDADLALVPQGATGELYVGGAGLARGYHERPALSAERFVPDPFAAEGGRLYRTGDLVRLCDNGQVEYVGRIDHQVKIRGFRIELGEIEARLLEHPQVREALVLALDSPSGKQLAGYVASAVAEQDEDAQAALREALKTHLKQQLPDYMVPAHLLLLASLPLTANGKLDRRALPAPDPALNRQAYEAPRSVLEQQLAGVWREVLNVERVGLGDNFFELGGDSILSIQVVSRARQLGIHFSPRDLFQHQTVQSLAAVARHSQASQAEQGPVQGDSALTPIQHWFFDLPLARREHWNQALLLQPRQAIDLGLLRKSLQRLVEQHDALRLAFRQVDGEWLAQHRPLREQELLWHVPVQSFDECAELFAKAQRSLDLEQGPLLRAVLVDGPAGEQRLLLAIHHLVVDGVSWRVLLEDLQQVYRQFAEGAEPALPAKTSAFRDWAGRLQAYAGSESLREELGWWQARLGGQPVEWPCDRPQGDNREALAESVSLRLDPQRTRQLLQQAPAAYRTQVNDLLLTALARVLCRWSGQPSTLVQLEGHGREALFDDIDLTRSVGWFTSAYPLRLTPAQSPGESIKAIKEQLRAVPHKGLGYGVLRYLADPAVRQAMAALPTAPITFNYLGQFDQSFADALFQPLDQPTGPIHDKQAPLPNELSVDGQVYGGESGAALDLQPRALGRADGERAGAGLSRRTAGADRALPGRRRRRPDPVRLPAGATEPGATGRPGGAGRRDRGRLSADPDAGRVAVTHPAGTGHRHLLHAGPLPDRQPARSRALRRRLAGGGGPPRGAACVVRLECRRNDVAGDPQARSHPHRVPRLERTAGGRPRGTPASAAQARARGRLRPTRTAAVPPAPDPPGRGALLVHDEQPPHPHRCLVPWPADERLLRDLRRPRRRPPGEPADAAALPRLHRLAATPGPGAIATLVEREPARLRAADPGAQRPPVPPRARRRKRRDDRR

SEQ ID NO: 23569 - protein, 757 aa, Pseudomonas aeruginosa
PRPAPVLRPALLRGADRRAPARRVQAPAAGPGRRFPRRTGGLAAARRGRARLPPRRLQPQRPRLPAGARLRAAVRGAGGSPSAAHRRQLPGTALELRRAEPTGQPPRPRPARRRRRHRPAGGTAGRARPRPARHDRRQLQGRCRLPAARPRPSDPAPDPDRRAEPHAGAGLHPGLPRASAGAVRRTRLRRPAAPAGVGRDPAGRGRRARSAGLQRAAEPRLRDLHLRLHRTAEGRDGGAGGHAQQPVEQGPVPGTGRERRDRPDRLAELRHLGLAVPRRAVVRRPRGDRAERHRPRSAGPAGARRRTGHHGAGKRAVADPGHARRRAPGPRRPALDAAHRRGDAAGTGAPVAQALPADRPGECLRAGGMLRRRGVLPRRPGLHREHLPADRQSHRQQPPVPARRRRRRRLRTGAAGRGGRAVRGRHRRRSWLRRRSAAHRPGLRPASVRRAGRASVPYRRPGAAARRRSAGVCRADRPPGEDPRLPHRAGRDRGAPARTRRRPRGGGGGAGRGERQVPGGLPGSRRDTAFQRRLAGRTDGGAGRLVRADQAATARRPAGLHGAAALAGAGPDAAQRQRQARPQGAAGAGHRPDAEPGLPGPAQRTGGNPGADLGRGAEGRAGRGVRQLLRTRRAFAAGHPNRLAGAEGPATQRAATGDVRMHHGGRAGQLHRVPGPERDQRAEGRAPERPDVEAGNALRHAPRHRTDTCAGRVAERHEKGPPKTPGRPWRAFLQIRSRQTSPLTLRERGVRSGEPAR

SEQ ID NO: 23570 - protein, 65 aa, Pseudomonas aeruginosa
AYEGRLLSTVYMAVNCSQPNPFPEHFLVICVALGWPGKPIAIWRKTGAAGFSLPETLFFRGLVTC

SEQ ID NO: 23571 - protein, 64 aa, Pseudomonas aeruginosa
VFHHLRPASFLPSENRGQCRSVLSLRDGFAGPSIILLLGFYPIPGLLREPAEMSGGAVRRFQGL

SEQ ID NO: 23572 - protein, 136 aa, Pseudomonas aeruginosa
SWSPGCSTTAPASPRRSRWRFAPGKACATSRAISRRWAATTASSPPTSTTRAAASTPAACSASTASASSTRARRRARAARSAPGASTSAWPARWPTASASWKAKASCTCAPPRSTTAAAACAPSAAAAARGWSLAA

SEQ ID NO: 23573 - protein, 117 aa, Pseudomonas aeruginosa
IDFPRSVIPCSLIIYFFDFKRRALTSLSLLPQSPEPPAPPSLAGRSPGQRMRCLEKKGLLTMSSQLIGMLAASTQGDADAKSLQTGAWVAGNATQHNYLSHWQEEKKRQEVDGCKDK

SEQ ID NO: 23574 - protein, 96 aa, Pseudomonas aeruginosa
LCKTGIEAKWAIISAQQDVGIVVGVGGGIGLSTAETAVGVYELVKNWRETYAALEQLATSPEFRQQFGDNYLKGLEERAAFLANKGDRFIFPALIL

SEQ ID NO: 23575 - protein, 200 aa, Pseudomonas aeruginosa
RWSGWSSRPGRRMRTKATGRAADGRSSEFSFGRFSRRRILLQSRRNRSSLDHSGKFPLRSYVSSGEPPGWRRLFEGRFHVCRFHLVVAFPQPADPGPGRPARAAGRWPHRDRCRREPPALPRPCPRRVAVARPGGRPRPRPPARHHARRQGVARDGAGRTPVARPAGRRAPGPAPDLQRRRRHRTDPDPHPAPHPADPGA

SEQ ID NO: 23576 - protein, 263 aa, Pseudomonas aeruginosa
FAGAAEPDPATPAGGACGKAPRRAEGVLEAGGEAGHAAGGAAGCRTCAGHLPLAPAASRRRAPAVADPGGQHPPLRGPGRQRRALPEPAAAPRRAGFLPAQRRPAGPATGRSRHLAPGVAGGGAAGPAEPYAVAQQPRAAAGRAGLAGAARRRPCRDLGPAAQGRAARQGGAPRLYQPGPGQPAPADALHAAGLRSRGPALSAAGAVRRGPLRARRTDPDHPRQPDRCRAHPPDPGGDCRQCRRQQPGPRAALQRGLRRHARP

SEQ ID NO: 23577 - protein, 376 aa, Pseudomonas aeruginosa
AAALVAAALCIERGACRSRAFRFQLRRAGLGLHRLPLPGTLRQGAEPVRLVLVGAGRAAAAVAGTAVRRWRAFAAGVLPQFRPARGARGGRHSRQQPQPARGAARQGLPAALPRVPRRSRLRGVEPGACRRVAGLVAGALSRLAGVGRIAACGYPPCRGLEVGEDCPERVRNAHRVAESEKIVQGHLPASADRGQSAFASIERQGCSRCADSCARYSAPRSSACTQRWSRLPPKAKSSACSSAGRPPTGSAAARPWKGSMRRAWTTMAARRRASAPSPPSRPSSPAIPTSSSASSLRRRSCRATRKAATRCASSSRYASTDACATIRGCSWPSAPGRAIPGASSARATRSPATPSTRATPRWLAAASPVPKRTSPG

SEQ ID NO: 23578 - protein, 111 aa, Pseudomonas aeruginosa
WPTRRTAPPCATNTRIAAATSGAPTRASRPSRWAVAPARCSASSAASTTAAASACNCCVPGGPAPGPSRRCWKSATASGCGCCRTSPPPGTTPRPNWCCTRPTRSSRAGCW

SEQ ID NO: 23579 - protein, 197 aa, Pseudomonas aeruginosa
TRTSGGWSATAPASVSTSRARDWPATTTTSCSPTCWPGWACSSARSGASRRCSVKGGWCACSATTTSTRGRSGPPSMSSIRGTGATRGRSARSSSTCAPACSDRGCAIGCNASVTSGTNSFRLPEKPLLSGVCALVREMSGGSVTKAFHGGPVRVSPAPGHAPWRQGRGRLAPCLLRAAAEQSPVPTGRPADNEDPA

SEQ ID NO: 23580 - protein, 969 aa, Pseudomonas aeruginosa
TPTPTPEDPVMTDNLNLGAIDLGTDDEFIARHIGPRAADTQAMLQRLGYDSLDALIGNVIPDSIKGSSVLDLPAGMGEAEALASLKAIAARNRALRSFIGQGYYNCHTPAPILRNLLENPAWYTAYTPYQPEISQGRLEALLNFQTLVSDLSGLPIANASMLDEATAAAEAMTFCKRLSKNRTSQAFFASRHCHPQTLDVLRTRAEPLGIEVVVGDESTIEDFSAYFGALLQYPTCDGEIVDYRELVSRFHAVDALVAVAADLLALTLLTPPGEFGADVAIGSAQRFGVPLGFGGPHAAYFATRDAFKRDMPGRLVGVSIDRHGKPAYRLAMQTREQHIRREKATSNICTAQVLLANIASMFAVYHGPQGLLRIARRTHRLTAILAAGLERLGVAVEQKHFFDTLSLATGARTAAIHAKARAAGINLREIDAGRLGLSLDETVRQADVETLWGLLAEEGQALPDFATLAASSGDRLPVELLRQSAILSHPIFNRHHSETELMRYLRKLADKDLALDRTMIPLGSCTMKLNAASEMIPVTWAEFGNLHPFAPAEQSEGYRQLTDELEAMLCSATGYDAVSLQPNAGSQGEYAGLLAIRAYHQSRGDSQRDICLIPSSAHGTNPATASMVGMRVVVVACDARGNVDVEDLRNKASEHKERLAALMITYPSTHGVFEEAIREICAIVHDCGGQVYIDGANMNAMVGLCAPGKFGGDVSHLNLHKTFCIPHGGGGPGVGPIGVRAHLAPFLPGHARGERKEGAVSAAPYGSASILPITWMYIRMMGGEGLKRASEMAILNANYIAHRLEEHYPVLYAGGNGLVAHECILDLRPLKDSSGISVDDVAKRLMDFGFHAPTMSFPVAGTLMIEPTESESKAELDRFCDAMIRIREEIRAVERGELDKEDNPLKNAPHTAAELLGEWNHAYSREQAAYPLASLVEAKYWPPVGRVDNVYGDRNLTCSCPPIEAYSEE

SEQ ID NO: 23581 - protein, 475 aa, Pseudomonas aeruginosa
LNRSAAMVAANPQAETSMSLSVFDLFKIGIGPSSSHTVGPMRAAARFAEGLRREGLLEATASVKVELYGSLGATGKGHGSDKAVLLGLEGEQPDTVDTAAIPARLDAIRSSGELRLLGERPIRFVEKEHLALIRKPLAYHPNGMIFRAFDAAGLQVRSREYYSVGGGFVVDDEAAGLDRIVEDRTPLAFPFKTARQLLDHCVREGLSISQLMAENEKAWRPAEETRAGLLRIWQVMQDCVEAGCRNEGIMPGGLKVRRRAAALHRQLCQRPEAGLRDALSVLDWVNLYALAVNEENASGGRVVTAPTNGAAGIIPAVLHYYARFIPGADDDGVVRFLLTAAAIGILYKENASISGAEVGCQGEVGVACSMAAGALCEVLGGSVQQVENAAEIGMEHNLGLTCDPVGGLVQVPCIERNAMASVKAINAARMALRGDGQHFISLDKVIRTMRQTGADMKSKYKETARGGLAVNIIEC

SEQ ID NO: 23582 - protein, 374 aa, Pseudomonas aeruginosa
NMTAETLAKTPLHALHLELGAKMVPFAGYDMPVQYPAGVLKEHLHTREQAGLFDVSHMGQIRLVGADAALALESLVPVDILDLPVGQQRYALFTDEQGGILDDLMVANLGDCLLLVVNAACKHQDLAHLRRHLEDRCSVEPLFEERALLALQGPAAVRVLERLAPQVAQMTFMQFARVELLGQDCYVSRSGYTGEDGYEISVPAAHAEALARRLLAEPEVAPIGLGARDSLRLEAGLCLYGHDMDSATTPVEASLGWAISKARRADGVRAGGFPGAERIFAQQAQGVASKRVGFLPQGRMPVREGAEIVDAQGWAIGKVSSGGFGPSLNAPLAMGYVPSELAGLGNEVTAMVRGKPVTLVVSKMPFVAQRYYRG

SEQ ID NO: 23583 - protein, 209 aa, Pseudomonas aeruginosa
ERRRCGMAGDGAFASRGSGGLPAEGDCLSRLLGNGLEAMLMGGLHDRCARPAGRDGRRSPHPPRCAAGPAGRNGYPPGHCARRRRSGSQADRGRRAGRVARRVWCELGRTPAGGRRNAAGAGGGRGRDSPRRKGLPMGAAPVRAGRSEAGRCFPGGGPAPSRQRCTVREPGRPRARPAARPDRGVPACAGGGRGCGCDAGRRRCVRTPP

SEQ ID NO: 23584 - protein, 342 aa, Pseudomonas aeruginosa
TAGCSAAYARSAWMHGVSTSASASRSRCSAPACTWGYPGRWGGCWRWRTGWSTSWPPASPPATAEPSRSRPPKVRPRIAPTACGTPPTSARNRRSSPAWPTVGRASRSSNMDVRIVCRIALDDAAALAATYRSADVPTLVRSTASRVLVHAFASRTLDEVLGEQRAGLAEQIGQAVQADLDRLGSGVEVLGAAVEAIHPPAGAANAYHAVQAAQITAQALIARERGQAAAQRNEAQLQASVAHDRASAKARETLAAAQAADRRFAAEREGYADAGQAFLLEAYYRQLGRGLGKANLLLIDHRIAGAGAPTIDLRSFGLGRLDSPSSSRPSAAPASAAGQSAP

SEQ ID NO: 23585 - protein, 416 aa, Pseudomonas aeruginosa
RATTTGRSSRSGSSPRRKPWTTYAGRTRASRNSRRGSPREVRMSEPTAHGSHGGCAHHHHHLPFGGGLLSRDEQRRAARQLSLAMLALGLLLLGLAWRWLAADQAGVSQILLGVASLLVALPVARSGLGQPAASEPARRHRPVDRAGHARRLGQRRPADRRAGADHHDLGPCAGGAQRDRLPGGHRRPRRADPQPCPADRGRRQPERGGQRQPASGRPGGSARRRPGSGRRAGPAGPGQSRHRADHRRVGAARGGAGDGGLRRRDQPRRPAAHRDNPYRRGLDPGQGDRPDAAGRARQAADHPPAGALRRAVHVAGVADRRGHLVRHQRCPGHARRAGRRLSLRPGAVRPGHGYRRDRRGRPPRYPDPQLGLPRGAGGPDFAGGRQDRHPDPWQPAPAGAAPGRCRRGGVGAAPGR

SEQ ID NO: 23586 - protein, 290 aa, Pseudomonas aeruginosa
SAATCAGSAPACGSAGNAGGPCRSTWRSASAGPWRSSPRQPLACSARPGRWSRRCCTTSAPCWCWAMPDACCVSRSPSGSPGRPWRDAKRRVHREAGANATQRLALAGPGGRHAVRAEPGRGVDGALAGGLAGQRPARRAARPGRRRPAPARGQVAGRRLPGTGDGSDADAPAERAGSEPGESPRAHAQAGADRVPAQRPADRLHLAAAVHHRRAGGAGDHLHHSPARRRGDEADLAHRGRQDLGLFAVLCRPGRGLRRQPGGNPRGTGKPALRVSEIGRGRGGGWSVGG

SEQ ID NO: 23587 - protein, 65 aa, Pseudomonas aeruginosa
PRLVAPWPTAPARPRRRPRISLRLLDWKRTRRMNPERETSMSSRFIAAWSAANRCLEVRGRAWKG

SEQ ID NO: 23588 - protein, 642 aa, Pseudomonas aeruginosa
SWRCSPSNRCRSSSPWDSGWPLCTAGGTLLRYTDSHAFVLSGFTAVIVAVLSIPDPENTFMLAVVRVTETLLGVACVALVSLLSARPQAVAKGYFAQVDGLIRSTARHAAAVIRGDEGDESFNQRQMQLVASITALDGLRRHLYFDAPNLRRADGLVQLLGNLLVLMASRLLLLRQHRLLVRAHWVGPLPADIQALLDRALRVLDALAEQGRAVPSEVLEEFQAVRQAFDAAATRAESYDEALSPALRPQVAILRWEYARLFQRLGEVLELNDAIQSGRHASSFYRRGQAQALHLDWALASMNAVRAFVALSCAAWLWITSAWNGALSSLLLVGVMCSLMATFPRPLLAAQNFLRGLLLAILISAALLFVLLPASADFEWLALWMALLLYVVAVGLSSPLSAGIAMGIGLETLLMVAPQNIAVYYSNASQWFEFVGGFLAAAVLAVLVFALVYPFRADPRLRRLLYLSRQDVAEMSRCEASEAQRFAFETRMIDRLAVMVGLLPASQEPAAAERFQCALGCVVMGVALNRLREPLHDAGVVPLELQPLLGEALREVAAYIAGGADAPRQDLALAALRRFGRGLEALLAQPSKDLGATRQRFIMNVAVLILQQSLQRYRTLLEEDRGAPAVVEEPEEEGGHAR

SEQ ID NO: 23589 - protein, 399 aa, Pseudomonas aeruginosa
CRGRGRLPAADRPGAAAGLADPAAAQPAVAALRRVAAGLARSAVPGRVVLRDLRRSDPVDGRDVPMNLLQGKWPRLATLLAVLVAAALVFLAWERYTRTPWTRDARVRADVVTLSADVSGLITRLPLSDNQPVEKGELLLSIDPARYELAVLRAERAVNVARAALGESRAAIEASQAQLRQRRSEAQRRSALQKRSMLSVEENEKAQTDVSLAQAELLRNQASLGLAQANVELAEAALQQARLDLERTQVRAPVSGYVTNLQTREGDYAHAGVPLLALVDRDSFYVSGYFEETKLPGIRVGSRARVELMSGERFDGRVQSIAHAITDRENAEGSRLLANINPSYTWVKLAQRIPVRIAIDPAYRQRNTLRAGVTATIRVLPAEDTAKVDSAAPGTALRP

SEQ ID NO: 23590 - protein, 309 aa, Pseudomonas aeruginosa
RGEQRMDSYGDTSGRIGRDWLDRHDEELEQELLDDELNLDELFGPEQEDAPGELSRRRYFRELFRLQRELVKLQNWVVHTGHKVVILFEGRDAAGKGGVIKRITQRLNPRVCRVAALPAPNDREQTQWYFQRYVSHLPAGGEIVLFDRSWYNRAGVERVMGFCNDEQYEEFFRSVPEFEKMLARSGIQLLKYWFSISDAEQHLRFLSRIHDPLKQWKLSPMDLESRRRWEAYTKAKETMLERTHIPEAPWWVVQADDKKRARLNCIHHLLQQMPYREVPQPPVHLPERLRHADYVRHPTPGEIIVPEVY

SEQ ID NO: 23591 - protein, 406 aa, Pseudomonas aeruginosa
WPFGRTPGWTGKFAAGCDVTQASPTSSRPCFRPQPPACRFRRPSSAARPIHMPAATGSGLRATSRTSRRRSVLNLSRPAHSSRRSAGVAIPRACFTPLGRGSGESRSGWRSGWRRWSTISTWTVPLSRRGQRWERSAAKPRRAFAAAAANPSIFATSARRCCCWEPISPPGPRRRRRRCAATGAEECSPPSAAGAEMGDVVALALGGDLAAVHQGVADHEVDQGRRDAQFLGDVLLWHAVQAVHLEGVAGALGQLGEGIRDVFEGRVVDVRGFRRGALDHHVQAFFLRPRVFLFERLLAVVVDGQVADDLEQVAELCLERRSDLRRRLEPEERILDHIFGSRAATGNAGGDLHQDRAVIDESLEERVSHLRVDSCSDMEITLLRRGLQSTGGGVRPTHGATNYVER

SEQ ID NO: 23592 - protein, 294 aa, Pseudomonas aeruginosa
QRGQVPGAPACAAGDGNADRSWESALPRTRATTAAQGGRQVSPAVSLQLFCLPYSGASATLFRRWQPSLPGWIRLLPLELPGRGLRFGEALHTDAASLVAQLASELHGTLDSASPYAFFGHSLGGLLAFELAHAMRRRGLEGPLALFLSGVSPPAENDVSGYRRAKADAELVAALRDYRGTPEAVLNDPSLMQMLLPVVRADFLVTGSYRYQAHGPLDAALHLFGGREDSLRSAELLGWLHEAGGDFTLDLLDGQHFFIREQQGQLLRLLRRYAGQHLLRWHKDKVRGSMRAAS

SEQ ID NO: 23593 - protein, 117 aa, Pseudomonas aeruginosa
NSIASRIQAGKHMMDAFELPTTLVQALRRRAVQEPERLALRFLAEDDGEGVVLSYRDLDLRARSIAAALQAHAQLGRSRGTAVSQRPRLRRGVLRLPVCRGHRGAGLPAGIGAPPSP

SEQ ID NO: 23594 - protein, 246 aa, Pseudomonas aeruginosa
TCCSTNSRGSTPKPAAASRPTWRRWNCTTPSSLPGNGSGWTRARAPANWPTGGNAWATRRRCWNWPPTIRARRARRRPPRATACGSTKPWRGLSARPRWTMRRVSSCGCWRRSRRCCIATAGRARSASACPAPTASAWRPRGWSASSSTPWSCAARPGRASRSPHCSARLARRPSAPRPTRTCRSTRCSRPAARAASCSRCCSTTSSATCRRCAGCPACSPTSCPGTAAKPSSTCNCRARRTLAVA

SEQ ID NO: 23595 - protein, 133 aa, Pseudomonas aeruginosa
PASTCNGFARPSPRRRSSMPTDRPRRWSCRWPAWLPNDWRRVPPACRSAAWSARGSPTSWMPTWPWCRRARPANSTSAAPAWRAATMSVRRSAPSASCPIPSLPRAAACTAPATWCACATTARWNMSAASTTR

SEQ ID NO: 23596 - protein, 1151 aa, Pseudomonas aeruginosa
DARTVNELAQAYLAELQALIEHCLEDGAGGLTPSDFPLAQLSQAQLDALAVPAGEIEDVYPLTPMQEGLLLHTLLEPGTGIYYMQDRYRIDSPLDPERFAAAWQAVVARHEALRASFVWNAGETMLQVIHKPGRTRIEFLDWSELPEDGHEERLQALHKREREAGFDLLEQPPFHLRLIRLGEARYWFMMSNHHILIDAWCRGLLMNDFFEIYGALGEGRPANLPTPPRYRDYIAWLQRQDLEQSRRWWSESLRGFERPTLVPSDRPFLREHAGESGGMIVGDRYTRLDAADCARLRELAQRYQLTVNTFAQAAWALTLRRFSGERDVLFGVTVAGRPVGMPEMQRTVGLFINSIPLRVQMPAAGQRCTVREWLNRLFERNLELREHEHLPLVAIQESSELPKGQPLFDSLFVFENAPVEVSVLDRAQSLNASSDSGRTHTNFPLTVVCYPGDDLGLHLSYDQRYFEAPTVERLLGEFKRLLLALADGFHGELEALPLLGEDERDFLLDGCNRSARDYPLEQGYVRLFEAQVAAHPQRIAASCLEQRWSYAELNRRANRLGHALRAAGVGIDQPVALLAERGLDLLGMIVGSFKAGAGYLPLDPGHPTQRLTRIVELSRTPVLVCTQACREQALALFDELGCVDRPRLLVWDEIQQGEGAEHDPQVYSGPQNLAYVIYTSGSTGLPKGVMVEQAGMLNNQLSKVPYLELDENDVIAQTASQSFDISVWQFLAAPLFGARVAIVPNAIAHDPQGLLAHVGEQGITVLESVPSLIQGMLAEERQALDGLRWMLPTGEAMPPELARQWLKRYPRIGLVNAYGPAECSDDVAFFRVDLASTESTYLPIGSPTDNNRLYLLGAGADDAFELVPLGAVGELCVAGTGVGRGYVGDPLRTAQAFVPHPFGAPGERLYRTGDLARRRADGVLEYVGRIDHQVKIRGFRIELGEIEARLHERADVREAAVAVQEGANGKYLVGYLVPGETQRSSADSPAGLMVEQGAWFERIKQQLRADLPDYMVPLHWLVLDRMPLNANGKLDRKALPALDIGQMQNQAYQAPRNELEETLARIWAEVLKVERVGVFDNFFELGGHSLLATQIASRVQKALQRNVPLRAMFECTTVEELASYIESLAPSEISEQKAERLNDLMSKLEML

SEQ ID NO: 23597 - protein, 82 aa, Pseudomonas aeruginosa
LLQGTVRPGVAQRSLARLLLGFTTHLARLTEARQVLAALVIRVEIVQKVSRYLHASGFVLSVGKERLGPSRCSIVNGWRRTA

SEQ ID NO: 23598 - protein, 507 aa, Pseudomonas aeruginosa
PPLSFVVRLVQQRLRHARQPGRHEPAPGRRRPAQPAGRPDLQPGRRPRGAGRQPGQPPGHAPGPGRQPAAYRRRAGQPGRPPGQPGRQPRPAERQPRQRRRRRAQQRQGLAEAGHRAVRQQRRRHPGAVAGDSRRARRAQPAGPSLGAGRRQPHRHRRLRQPGRRPLRQRPAQPRRPALPQPGRGGGPGRQGRRRAHRLQPGRRAGQPLRPVGKRKRAAPARRRDRQQRRQPARPRPQRQLAVGRWRPEQRLRRAGKRQPGPRPATGQPGQRRRAHPPYRQRHLRPGFRAGDPRRRRTDHQWPAGHPRQRMDQQQRAASRTPEPGHRHLPPDGRGQAAGGAVLHWPRRRLEQRRPAGQRRQLATRAERRLPWQRPRHQPRRLRPERRQPRPRQCRQPRRRRQCHAWRRQPAGQPWADHRCRRPRGQRREPEQLRHPGRRWQPAIERARPAQRARVAVQWRRHDPARRRHHQPLRGCVQPRQAGYRPRRCGGLGKSLGEHFREFREHR

SEQ ID NO: 23599 - protein, 160 aa, Pseudomonas aeruginosa
QQEAPGRRFIRAAPGTRSDRPAYGAALHRRIEQRRSDVPLSDGQRHRQQGRIGTDPWRHPQRRPGGRADPRHRLAGRSRGEWREGPRPRGLPGPGRGAVGPERRADPGARREPDHRRGPEERRYPARAERPQRDSRQHRQQRPDRGRQPPRPAGQRLHPQ

SEQ ID NO: 23600 - protein, 154 aa, Pseudomonas aeruginosa
QEDPARRNHRCDGSGQPNIQRRRPHPAQWRRPDLPGREAGIGQRPGHRQRRRGDLRRGEGPAPGEPREEQGRPGVAVVEGQGPDRRNRAPEPDRGPGESGDQGRGRAEDRPQAYRPEDREPDHRRDGAGGSATGLAEADGAARRCGLAARAGTA

SEQ ID NO: 23601 - protein, 209 aa, Pseudomonas aeruginosa
RVFEGVWEMTQWQLLADDLWGGEKNICFFVHSGACFWVVDDKFNFSLDAEKDYRAYLDKGHITQEQYASACMTFRGGVLKLTSENFLKYLRAEERWVLSRQDLKDMFVCGLDLSESLHGRVEDYYLSGVELSASYFHDANAVASRLPMFYVNFDRKIYMHMDCNRAHEELAYSDWLAKCSDFCHLVPDRERYWVLEGMDYWKYRFLQSA

SEQ ID NO: 23602 - protein, 213 aa, Pseudomonas aeruginosa
SGRGRCSCSSRRARPPARAGRGRRPGRGRRGGGSMGGCAWGSALSAGGDGLAGLASLGVVLVAGDPAGLADLHREEQGRVPVGCDGARLRSAGGLGARGLQATGVVLVGGQVAVVVAFAGEQTLVIVGKGGIAAGAVGRGFAFDGNDAFDALDHLEAVGGLLAVFVGDGGGAVIVVGEGDLFGAVGVFAGDGAALVVVGPGGEAGSIFIRYPG

SEQ ID NO: 23603 - protein, 744 aa, Pseudomonas aeruginosa
RGRQGAPGSGCPVRRCIADAAGAGRRDGRAVAVPRDRAWNRRCGRRRPGRPCGCCAPGWRRSTTAGWPRAGRIAWFDSFPGVRHRADGGSGGLHVLDAAHLVLVDAGALAVQLLQFVEAGTTIIARGIHRLDLAAIVEGDDGRGGAAGQDGECGRKQQGGQQTGGHRNFPSDGFRGGGFYSSRGATALAWITAANFRCDRTSLPVSRPDGGASSKGDSMSAVSTSLLLFLNLLTPAQAAQPVPLADGRIEIAAGESRQRYLDLAPGELQLLDLEVDRGRVRLRATTPDGKALRATELAGRQSLGLQAGERQGLRLTFSADEDTALTLTPTQRLTPQTPALDSPAPQSPTLQRLQAELAEKRPGALKAFWKQVAKQGTPLVEPLDAERVLVTFLWRQQRPGDVRLLWPTPEVNTRRFEALAGSDVRYLSLPLRRDARVSYQLSADLPDLQQADRGTLRLALQAAARPDPLSRTPWLNSRALPRAEQASLVQLGGAPAETWDQPRKDVPRGKVERLGYTSQALANQRQLTLYTPPGYDPEGQRYPLLVLFDEDHYARDVPTPTILDNLIAAGRIRPTLAVIVGNVDASSRGRELPCNEAFADMLAHELLPWLQQRYALSEEPADRVLSGSSYGGLASGCIAYRYPERFGKVLSLSGSFWWGPDEQQPQWLVRQFAAGERLPLAFFLSSGLLEEPEADGILGSNRSLRAALQGKGYPLHYREFPGGHDYAAWSLELAEGLQALLPAH

SEQ ID NO: 23604 - protein, 518 aa, Pseudomonas aeruginosa
LLAVIRRAAAWRWGKTVRSVSAMPTALRNRKKSSRAICQRRRIGDNRRSPQSNDKDVLDAPTLAPGILRRALLPVPSAGPGCRRKRNPRPVPALAGRPRAAQRQGPGRGLCAAPGLLWPRADARAHPLRQAGLLRPPSRLRAAHRRCAADRAGRPGRPLRGALRQAGTPRRTPAQLSGAAPGRARRAGRYLALRRRERRDHPLRRRPALHPAGSRPLRRCRSGLRLGSGPRAEQRRLVRRIRGLPLRPLERRRARPAQAAGQLHRRGAQRPRRPRRQRPRAPATAAYLVDQHLDQVVAAGNPRRPVGAGAAGHLHHLGRRRGRTGAVQGRPAAAGPGAGDRNRDGRRGRLEPPHPQRGAAPRTLTPAPWAGRRQAVQSTALWRASPQSRFPHAHPRLLHRPCRHHPGGAGAAGWAQPEPGCGGNGAAERLHRRADPQSRSAGGTARSAAGHPWRAGDDRGRHPSRPAPPPAARCVAGGDGRSGAGGGRQGPGAAGQPGLQRALRTRPGRRAAGQPVRR

SEQ ID NO: 23605 - protein, 382 aa, Pseudomonas aeruginosa
PCRGVRDAPRRFPADPHPEDPCAARGGARRAAADPRRDRYRQGTGGARLPCPECAAQLAVPGAELRGVAGEPGRKRAVRLRPRRLHRRPARRQAGPAGAGPPGHGVPRRDRRDVPLSASQAAALPQRRQLPPGRRRPRGEGRRADPQRHPPQPGEDGRRGQLPRGPVLPPQRAQPGSPAVARARPRHPAAGAALHAAGLCADPAPGVPAGAGHLPGAAEQPLAGQRAPVAERDLPCRCDLREQPGGYRRPGDRRHRRGAAERRRGGQPGGGGGGLRESPAGEALRQLSIDPPVGGAPANLAHRHRPPPAQVRHRSARLKRAQPSLEYTGLPANQVFSTLVSPSCVSGTSNTSRSRTMKSACLPGSRLPIRCSRPMVRAALRV

SEQ ID NO: 23606 - protein, 130 aa, Pseudomonas aeruginosa
LQPWRRAPGQDALGADQGRRPPGSGTRCPPVRAHHPQPGADRGRADLPGGGSSVPGNAAHGGAGDRTAGVGVARRTAPRRAAVVRRGVPPAGLRQLPRGASADQPAGGPRRNLPRSQRRRLRPRPARRPH

SEQ ID NO: 23607 - protein, 111 aa, Pseudomonas aeruginosa
PRRASSAPTWPSAAPSASACRSASAARTRPISPPATPSSGTCRDAWSASPSTATASRPTAWPCRPASSTSAARRPPATSAPPRCCWPTSPACSPSTTARRACCASPGAPTG

SEQ ID NO: 23608 - protein, 479 aa, Pseudomonas aeruginosa
PAPARPSRRTARSDGRGGRRQRRRPRVSGDTPFPAPRLRSGAAATLAPASVLTPTRQEASAMFSKHDQLQGYDDELLAAMDAEDRRQEDHIELIASENYASKRVMQAQGSGLTNKYAEGYPGKRYYGGCEHVDKVERLAIDRARQLFGADYANVQPHSGSSANAAVYLALLNAGDTILGMSLAHGGHLTHGAKVSSSGKLYNAVQYGLDTATGLIDYDEVERLAVEHKPKMIVAGFSAYSKTLDFPRFRAIADKVGALLFVDMAHVAGLVAAGLYPNPIPFADVVTTTTHKTLRGPRGGLILARANEEIEKKLNSAVFPGAQGGPLMHVIAAKAVCFKEALEPGFKDYQAQVIRNAKAMAEVFIGRGYDVVSGGTDNHLMLISLVKQGLTGKAADAALGAAHITVNKNAVPNDPQSPFVTSGIRIGTPAVTTRGFREGECRELAGWICDILDDIDNPEVGERVRGQVGEFCRHFPVYAD

SEQ ID NO: 23609 - protein, 177 aa, Pseudomonas aeruginosa
PSCSSPASSCSARTATSAAPAIPVKTATRSPCPPPMPRPWRGACWPSRKWRRSASARATRCAWKPACASTATTWTAPPRRSKPASAGPFPRRAAPTACAPAASPAPSGSLPSRRRALPASASVSCRRGGCRCARAPRSSMPRGGRSARSAAAVSVRVSTRRWPWATCRASWPAWATR

SEQ ID NO: 23610 - protein, 312 aa, Pseudomonas aeruginosa
SCGRLRRPGRYLRVLPGVKMRVDLDAEGVAAESLPRFQQAPRQLRQLWRWAAASVALAAVCAVLGFFIGLFAADSLWPPLLYNLGAAWLVLFAGLHAVYRVPALAVAWSSARRPSARAAWLRWQRDEPDATADSAYERLLERLGPGHRPRLGPDRARCAVAGGERGAGVVPGSRRLASRHAAGQFRASGRPRHRYLPAAGLRGAGAGTSPRQPRAGAVAGSPGPRATGAGVDRYPGAGRPLSVPGSPGTPLGPAPGGTARPVAGGAGAGVAGQGDPGDVRAAACRPRTAPGRHQPAGRPVALAAASPAASAA

SEQ ID NO: 23611 - protein, 141 aa, Pseudomonas aeruginosa
RQPLVGRLPRQREIAGHRQPGRPSAELPDRPTWTCASSAASLSTTRQRWRRPTAAPTCRRWCAAPPAAYWCMPSPRGPSMRSSASSARAWPSRSARPCRPISTASAAASRYWARRSRRSIRRPVRRTPTTRCRPRRSQPRR

SEQ ID NO: 23612 - protein, 295 aa, Pseudomonas aeruginosa
SPASAGRPPRSATRRNYRPAWRTTGPARRPARPWPPRRPPTGVSPPSGKAMPTPARLSCWRPTTANSDAAWARPTCCSSTTASPAPARRPSTCAASASAAWIPRLRPVRPPLRRPRPGNPHHEESALEPRSLPLAQPPRASSRSRSRSRSRSRSRSRRTGRAALAPAAGRRAAGAVRRRRRLPGAGTFRRGDGHHPFRQPGAGPARTGPGLAPAVAVRERDPGRPAPAHHLQRPAGRRYPRWPADHRPGLRGLAGPGRRRQRAALHARGAQPAGRGCPAVAHLRRLGAGNHRQRL

SEQ ID NO: 23613 - protein, 728 aa, Pseudomonas aeruginosa
PGRPGEYGGVAGAYRRLRSAPARTDRPSVAGDLRGQGGAGRHRAPDPAQGDPRRHRRPHARRARDHRHRAYRRGPSPGCGDPFGGGARRPGDPGRGFGESRGDRGPGTGRGGAHLRQGLRRFAAAIQPAALAGHPRHHRQRRYPAGLAHRCRTVPRAGRRAAGVPRRSAGQRAPAMSGEAREGLRSPWLQAGRLAFLALFGVTLLAALAWAFSNVRQIGPENRRRSAAPGRAGAPGRSRPAAGLAAAAGAGGAAAVRRTGDRTPRRGPAAFRAGASRRSRRQPVQRRAGRLRLPADRRRRGGATGRAGVLQGRRPVRLRPPGRPRAAGAGPAGGAQRRAGLRRARPGHHPGGAPGVARQRQRGRRAPRTPARRPGAGHQPQPGGVGRGRQRAGHPGGAGRRAVEPAAQCGKRLQRGADRQPTGRAERRQGAHRGGETHPGRHRGGRPHPAARPRRGRRTAGPGAPRHRQHRWPGPGAGRDRCRPALAPVPRTGAGDPRQGRFGRQRRSARRWPPDSARWAAMSRCPTVPFAGCETMDGQANVKRLPCVGINLRYALPPAERGAESNNQANGTGNDGRRYSIHGQRCAAITRQGPAVRAGAVAVRRRGAGAAVAERHAGGLRGQRAVPGHHPEEAQAEPAAQRAHPGAGEEDRQLFGGAVGAHPHGAEPVHRLWPHAPAQGQFRRPEERQQRAGQADLGAHREGSPGLRTPAGRALPAIAAAARPGRCA

SEQ ID NO: 23614 - protein, 803 aa, Pseudomonas aeruginosa
AWRCSPSACCCSAWPGAGWRRTRPGSARSCSASRRCWWRCRWPARAWDSLRHPSLHGVTDQLIALAMLGAWASGDLLTAALVQIIMILGHVLEERSVIGSQEAIAALGELTRSHARRIEADGSLSEVDNASLRAGDQVEVRAGDRVPADGRVLQGQASLDTAPITGESVPLEVAPGMEVYGGAINLDGLLRIEITRTGEASTLGKVIGLMQQAERAKPPITRLLERYAGQYMLLVLLIAAVTWFVTNDAQAMLAVLVAACPCALVLSAPATAIAGIAVAARHGILIRSSAFLEELADLTSLVVDKTGTLTHGSLRLQALRLADAAEEASVLRLAASLGAASSHPVSRALAALAAHDAYHPLSDIRERQGFGVVARTAAGEAALGRPELFQQLGIDASEVPEHEGPIAGIALDGRFLGWLLLGRQRTRGGRRGHGRSARTGSGPATVADRRSPGGGRRRGQAGGDSPTGGAGVAGGQAAPGRRGDRQRFPADGGRRRHQRFAGAEGRCGRGGNGCRRRRHRPGLGGYRADRQRPAPARHLRAAQPAMPADPAGQRGDRPRLDPGDRRRGSLWPARRGRGDGRGAAAQPQHLAGAGQCRTPAAFRGAPRAAPAGRGGTRRGGYTVRQAQTRRNGWRWLALAVGTLSALSLAEASMARWPAGWQVSDLPAAQPGQAGAGQRQRAVKLQADGSQALVMEVTRMPLQSGQAVNLEKVLGHMRKLVQIEFLRNGLQTACTSPQPSTTGGLAALETTCTIRQRGAVVMKQTLLTAAGKTSAYSLSYAGLAEAYDASQAEIRAVRESLRFE

SEQ ID NO: 23615 - protein, 505 aa, Pseudomonas aeruginosa
AKSDAVGAGAGVSADNACGAIRPTEGCIGGGRITACGYPPCVCRGSFLPGVLQDLQGLGGGGDAALGVAAGLVLPGLGLEFLDLGDPRTGDRGLAAHGEDIVQLLQVGAAQVGAFGGLGGTAEQGGGDEQGTHDHGSSPLWAGWPDGGETTGSWESSPHAQYLTGASPEWFGRSAVAPGRDRQRLLEMLDERLDLRRHRRRPRIHRVDHVVEWAQAGRGVHQAAVLEVLGDDEQRQQRQSLAAQGGVAHGLAVVAAEASAWRDGAGLGTGERRFEGPNLARRGVVVAQALVLHQLFEGVQRAVAFRVVGAAADHPLAVGQRPGDQRTVVQAGDADAQVVAFLLEVGEAVVHLQDDLQARVLAHEVGDDRRQPEGAEAHRGDDAQFAAQVVLAQGDNLRGVVEFLQRGLGGLVEEMPGLGRLDVARGAIEQADAEASFEIADTLADHRLGQAHALGRRRHAVEFGDVEEGFDIVETQAHRWAHDTVAIARRILGSSWSFSLGFLSA

SEQ ID NO: 23616 - protein, 100 aa, Pseudomonas aeruginosa
SCSSRCNAIGRCWRRTAAHRRSSKNQKRRADMPADVEVGGAYLPPIAQALLLAWLILLLLNPLLRRFGVLQRVWHEALFQGALYCAICAGLILWMGEMSR

SEQ ID NO: 23617 - protein, 163 aa, Pseudomonas aeruginosa
SSASPSASTRGSAGSPRCPRRTTASRPSGISSATSRTCRPVARSSCSTAAGTTVPGSSGSWVSATTNNTRNSSAACRSSKRCWRARASSCSSTGSPSPTPSSTCVSSAVSTIRSSSGSSVRWTWSRGGAGRPTPRPRKPCSNAPTSPRRPGGWYRPTTRSARG

SEQ ID NO: 23618 - protein, 423 aa, Pseudomonas aeruginosa
WTPSNFPPPWSRPCVAALSRSPSAWRCASSPRTMAKAWSSAIAISTCARGASPRPCRPMRSWGDRAVLLFPSGPDYVAAFFGCLYAGVIAVPAYPPESARRHHHERLLSIIADAEPRLVLTTADLREPLLQMNAQLSAANAPQLLCVDQLDPAVADAWDEPRVRPGAHHLPPIHLRFNRIAQGRAGHPWQPGRQQGADPPRLRHRCRRRDRQLAAAVPPHGPDRRPAATDLQRRTLRADVAALLPRTSGALAGSHQPVRRHRQRRSRFRLPAVQRAGRRVGPAASRPERLAGSLLRFRADPPGQPGTLRREIRRQPLRCVQFLRLLRPRRGDPVRHRRPARPGHSRPGGGWRGAGAQPHRRRRRQRADVLRPQPAGTRRADRRRGERRGPRRRQRRRDLGRRAEHRPRLLAQPGSFGEDLRRA

SEQ ID NO: 23619 - protein, 492 aa, Pseudomonas aeruginosa
RAHLAAHRRPRLPPRRRTVRHRAPEGHAHRPRPQPLSAGHRTHRRERGAVGAQGQGRGLRGHGRWRGRHRHRRRDRSRRPEIGAGPGADRLDPPGGGRGLPGSAEGGGAAQSRRLAEDVQRQAATFRLPPAPGRRQPGQLCAVSRPPGRAGGAAAGRRRRTAGTHRRDLEGPAGRGAGSAARSLLPAWRQFHRRRPGGRPGARQSRRRPRPAPTVRGADPAGLQRHGGPPTGRRPAGRGTDGAPAARCRPAAVGGAAASLADLADRSAERRLQHPRRPAPARRAGRSGAARQLPAAGRTPRSAAHAFPRARRRGLAAYRRAGRVRLAVRRPRRAGRARTRRGCRAAPRSRGAAAVRPGKGAAAAGQPGAPGRTGAPALGHPASHRRRWLVAEPAARRILAALRRSLRRPAGRPGAAGTALRRVRCLATAVAGRGRGRPPTGLLAGTPGRHGAGAGTGHRPSAHGAPGVARRALQPAGRRSPGAGYPRGRAGP

SEQ ID NO: 23620 - protein, 497 aa, Pseudomonas aeruginosa
GECLHVAAGGVPGAAASPQRAGRDPHRRAQRQPPAPGDPGAGRLLHQHPGPARHAPGAPAVRRIARRGSRGDPRRPGQPGPAVRPGARGLRPGRPVVPGAVQPPAARPVGVAPAARPARRRAALAQPRSQVRPATAERGGRSRSPDPEFRLRRGPLRRGQHPAFRRAIPGAAAPGRGRPAALPRRYRPGRRRAGGAPRRMGQRALRAGARLAAGAAGAATGAVRRTRRPGVGRRQPRLRRTARPGQPPGPLPARQGRRPGRAGSDLRRAFAATAGRSAGDRQGGRRLRAAGPGLPQRTPGLHARRQRRRVAADPGPSVRAPAWRGGRHADLPGQPQARQLAEPGTGPAPARRQSRLRHLHLRLHRPAEGRGQHPRGAGRAPAMDAGHLRPRRRRRADAEGAGELRRVGVGVLLAAGHRLPAGPRRPRRAPRSGAPGGTGAAVRGDHAALRAAAAATVHRRTRRRRLRQPAPPVLRRRGASGGAAQPRVATPAGGGPA

SEQ ID NO: 23621 - protein, 420 aa, Pseudomonas aeruginosa
PLRADRDRHQRHPLAVPRGRRRAFADRPTAGQRALPRAGRRVQPAAGRRRRRAVHRRPGPGPRLPGAPGAERRALRRRSALGRWRAPVPHRRPRALERRRRAGIPRPPRPAGQAAWLPHRAGGNPGTPAGAAGGGPGGSGDPRRRGRQPVGRVLHWRCRRRGGSRAEPASARRATGRTAGIHGPGAVDAPGADAPRPERQAGYAGAAGAGLAAARARRAADRAATAHRRDLERSARPAAGRPARRFLRARRAFPAGHPHRLAHPPGLRRRTAVARAVRGQRTGGLLRTGPRSPGRRTYRQPRRDPPHRPRAAGAAVLLAAAHVVPLATGAGQPGLQRRRPGTPERAAGRGALRGRATGPGAAPRDPAHHVPQRRRRAGTARARRWRPAHGLAGLLRARPRQPPAAPADPRRQRGAPALRP

SEQ ID NO: 23622 - protein, 432 aa, Pseudomonas aeruginosa
GHRPRPAPRLLPDLQPRPVRRTAHRADGRTLAEPAGGAAGRPAAAHCRIAAVRRRGAEATAARRHGRRGRAPGHPPWPVRRPRGGQPPGPGADLRRTDPELCRTRCPLQPSGARPAQSRRRPGSAGRPGPGAFAGDGRRPAGDPQGRRRLRAAGPGISAGAPAIHDRGQRRTPAAQPRGAVRGPRRAAGRRGALVPRGGRPGAGRRGPRAAGSAERAAAPGLPDLYLRLHRQAEGRGGLPRRDRHALRRGDRVLRHARRGLRTALLFDQLRRCQRAPAGPVAVRRPRGAAGPGPVGRGGNLRADPRGGREHPRLHPELRQPARPVAGEPGPAVAGAHVHHRRRSADRRAPATDSPGLRPGVVLQCLRTDRDGGHAAGLPGSRTTGGGCRQRADRQRGRRAGRLHPGCRPGPGAAGRDRRTLRRRRRPGARLP

SEQ ID NO: 23623 - protein, 276 aa, Pseudomonas aeruginosa
ASGAQRRALRARSLRCRGRPPVPHRRPGAPVRQRPGGICRPHRPPGEDPWLPHRTGRDRGAPAGASAGSRSAGPGARQPERQAVGRLCRQRGGRAGRGRPGGAARGAENASQAAIAGLHGAGPPAVARQPAADRQRQARPPRAAGARPGAQPAGLRGPAQRAGAATGRGLARGAERRAGRSRRQLLRTGRRFDPVDPGGQPRPPARHPLQPPRPVPAPDRAEPRRGGPAQPGQPGRAGAGAGRQRADADPALVLRPAAGAPRTLEPGAAVAAAAGH

SEQ ID NO: 23624 - protein, 107 aa, Pseudomonas aeruginosa
PWSAIRVMTSACTCPTTSATSRRRPSSACSASSSACCWPWPTVSTANWRPCRCSARTSATSSSTAATAAPATTRWSKATCGCSRRRWQPIRSASPPVAWNSAGATPS

SEQ ID NO: 23625 - protein, 118 aa, Pseudomonas aeruginosa
MPTGRRNAPTTWRSSASTWPPPRAPTCRSAVPPTTTACTCSAPAPTTPSNWCRWARWASCAWPAPASVVATSAIRCAPPRPSSRIRSARRASVCTVPATWRGGAPTECWSMSGGSTTR

SEQ ID NO: 23626 - protein, 403 aa, Pseudomonas aeruginosa
PVCSMIKKSPAAPWPTSTVRCCRCSAMPCPKSRRATRACSAAPWRDAPGLAGGFAASPSQDLSRPNGTLDRRPGPRETAANCPKLPTLFSDDFLRPYKSASYETSKKEGFWQGKTRRSCFPPNGYRFSGPAQCHADNQEMLRERVRLRAVHRHIDSGQEPTLIGLAVQRACAIGDFVQGLAIAVLQALSVGFFRRRLRFPAGHSLLAQHPRAACLPAAPAEARQRTAQRRISPMHGHTQLAPHYFFRQQRLLRALLIDDQAWFVLDDFARLIEHSQPEQMLARLDDDQARRESLRSERGEDQAQWLISESGAYAALIYQQRGDGSELRRWLSGEVVPELRSATDDSGMPRYVKLRWERQVVHMLDWQGKLWVNFSEMPDLLERQGEPMVQLGWRRWLRKLRPL

SEQ ID NO: 23627 - protein, 1413 aa, Pseudomonas aeruginosa
VQRSTRLAAVDLAIDAQLVGQRRLLVVDRPGGLVQRLEQGVGEALVELSEVVEGDRRRGQRGHRLAHRRIGEVAQHAVAEAFVRHRAELFFDRLDRLARALRRGQAQRVGAGEPADAAGQVDIVEQRLAAMPFQLHQRRWLPAPAAEHASEGGQQQVVDLGAVGRRRLLQQLPGTLRVEPQADTFRQRLAVVALRAVARPLDRLPTQPGLPPAQLLAQRFAAGVGLQASGPVAEGAGLGRQRRFGALGELTVDLLQVLQQHPPGHPVHHQVVDRQQQALLTGRAVHQHRAQQRPLFEVEAALGLGEQLGAFVEGLHRDVPEQFLFAQRTMLRQPLAVDLAERQAQGIMLFDQALQGLAQQTEVNGLPRLQQQRLVPVFAARQRQVEEPVLDRRQRAVALHRPLLGLAGLAVPGHRGEALHGLVLEQVAGAEVDAELAGAADHLDRQDRIAAQFEEVVAETYPLDVQHLAPDPGQLLLQHAARGLVGLPVERRVGRRQRAAVELAVGGQRQAGEQQQVGRHHVVRQLLLEMRFQRLAQRRLGVLVLLGHRAGDITGQLLAARAVERQDQRFANLRMLQQARLDLAQFDAEATDLHLVVDAADIFHLAVVAQAHQVAGAVQAAALGSEGIGHEALGAERRTLMVAARQAGAADVEFAGRALRHQGQVGIQDVGDPRADHAADRHAGGTLLQSFGSQAGQRHDHRLGRSVGIEERRRGEGLANPLQVLAGQRFAAGDAHAHRQLPALALQPLGELAAVARGEAEDAHALRADQLADFLRAPLALGPQHHAGAAQQRGQQALAGSVEVDRIEVQFAILGAHAEALDHRGAVHGDLAVGDRHALRLAGGAGGIDQVGLVLRPAQRCQRRGVLGVQRRAVLLEAPARHACRQLAEGLEQRRVAEQQAYAAVLDHVLQALQRIFRVQRHVGAAGLEDRQQADDHLQRTLQGQADPHFRADAVTAQDARQTVGAGIEFGIAQGLSGEGQRRGLGAGRHAGGEQAMEGVLEPCLAGRAGEQQLLPLLGGEQRQFGNAPLRVAQQRLQQVLPVSGHPRDARFVEQVAAVGQAAAEALVEVGDLKVEVELGRPRIVGDVLDGHPGQLPGLLELPALDVAHHLEQRVVGGAARRLQGFHQVVERQVLVRLAIDHGLPHLLKQLADAHLSVEPAAQHLGIEEGADQPFALRADAVRHRRADTQVLLAAVAVEQGRKGGGHGHEHGQPAGGVEATHALGQLGAQVEAVEVALVALHRRAWPVARQFEQRMLVAQLGLPVVELALALAALQPLALPHAVVQVLDRQRLQRRFAVVEEGLVERAQFAGEDVHRPAFGDDVVQGHHQVVLALGHLHHADPQQRPALKVEGPVRLAVGEGLQVLLAAVAVERGEVLPVHVQAAIAVHALYRHAVDAGERGAQGLVALHQGL

SEQ ID NO: 23628 - protein, 1411 aa, Pseudomonas aeruginosa
RGAQTLVLLGFRLGADSASVVPDQLAAGHAFADHHYRLGHPRLRQQACLDFLRLDAEATQLDLLVEAAEVFQHAVGVPARAVAGAVQALASGRERIGDEALGAQRRAPQVAAGQAQAADAQLAGDAGRQQVELGVQHAAEHVAQRSADRRTLAVFRAALPMGDVDGGLGRPVAVMQGHRRQALQHAVAQLRRKRLAAGEQAAQAAAGGDAGFVDEQLQQRRHEVQRGHPELPHQFHQARRIAVLAGGGEDQPATGDQRPEALPHRHVEAHRRLLHQHVVAVEGVGGLHPLQALGQRRVGVAHALRLAGGAGGVDDVGEIVAVQVQARCLARPVVELEAVQADRRDALRARQALEQMGLGQQQLDAAVGEHVGQAFAGVVRVQRHVGAARLDDRQQTDQQLRRTLGADRYPHVRADALVAQVVGQAVGPGVQFGVAEAAAVPLQGDAFGGLHQLPLQQLRQPGARRLAGRAAPFGEVRRLLGVDQGDIAEAALRVFRDLAQQLQVLRGETPDAGLVEEVRGVVEIQGQATASVLLALQLQVELGFAAVPGQLVGEQAGQPAQRRQVALLVVEQHLEQLAALAAGREHLVERQVLVGLGAEGRLASLAEQCGERLARPGRAAQDQGVDEEADQPLGLQALAVGAGHADADLALPAVAMQQRLERRQQPHEDTRLMVQRGLADSPRQGFVDPQAVARGGRRLARRARMVGGQFQHRRRVAQAFPPVGQLAGALARVQPLPLPGSELGVVQFQRRQVGRLAAAGFGVEPREFVEQQVQRPTIGDDVMQGDPELVLLFVQAHQADPQQRPLFQVERLLRLGFAALRGSRGAFVLGQRGEVDELPGELAPLVDTLQGRAVALEETRAQRFVAFDQPLEAGAQRRFVQLAAQAQAAGDVVGGALRIDLPGQPETLLRRRLRQVDTARQVRHRCLGRQAGGQLAGHRGAEGLQGRRLEQLAQVEGDAETVAHLGDHLGGADGIAAKQEEVIARRYLRHAQPGLPDLADACQQFVVACRRLRLLHGLEAGKQRIAVQAAVFQAQAAGGTLQLAAGRLRQGAGIEQRHHLRRFLVGLGHRLADRVDQLLGRHRFLDAATDLGGDADAFLAIDRDREGRDPALARRRHLALDGAFDVLRIEVVAADDEHVLQAPGDEQFAVAEEAEVAGAQPGAPVTLDEGLRRSFRVAPVAVGDARPGGPDLADVVVAEDLAARRVDDQHGVFRLAAAAAHQHAAFAFGDAVARQRLAIHRQGGNALAALAAGDEQGRLGEAVAGEETGRIEAAGGEFLGEAFQAVLADRLGTGEGYPPAAQVETLQGRLGDPLAAQPVGEIGTAADGAAVLADGFQPAHRTFEEVARRHQHAGYAAEDRLQQAADQAHVVVQRQPADDHVVGTDAEASADQHLVGDQVAMGDLHALGQCG

SEQ ID NO: 23629 - protein, 494 aa, Pseudomonas aeruginosa
ACSRLDRFSLRIKRIESPRKTTRRSRECVERLPLYRGPTDEPAFRRYRSLPQRRRTQQRDVGGRAHEPVQVGDQQACQRSRTTPRRPPALSHHAQRRADRGRAFLLQGRQGLAAGTQQRRGDCRPARERPVRRIAHRHPDELRHPLAVADHRRLHEPAPAPGDRPADGRPPHRLREGRLRPEHPRHPPGRQFADRPAAGQQPAGGLLQPRLRGTPRHAGHPRTTDAARVPGLQQRHAEPGLDLRTGVPRCQAPRRLATRTLQQQQRPGHARRRPARPGTGVAAAVHRRRGPQERPPGGRRARPAPTRRRDLRDVFAGGGDVAEGQGVHPASPAGAVDPALGQRLSDRTIPARLRSDTGHAEKTPRSLSSLPRPATRPTKENCHDRAYPAHRRRPARRYRPSRRKHRPVRRQPAEAGRYPRRARQDLGHRCAGHRGQGTPGQGQAGPGQRRHQGLHHRHHPGPADPAERREEMIRDRRKADNRKRLSALPQCNPP

SEQ ID NO: 23630 - protein, 424 aa, Pseudomonas aeruginosa
CRRRVAVSRSLVRPLFHSPRRAPSGSGSWLPTLQNQAAIVARIDAADRTGLAEDRRHPFAVQAPEQAGIGRAQRRGQANDAGGVAARLGQPFAGLGAGELQGAVGPLGGGLGEFLRLGARLGDVLLGQLAGGQHRVEGAYRIARQARLHVDPHHLDAQPAAGRGQRRQAVVDALHQVAAQAFAALGDRAVVAEQLRARHQDGVQVARGADLHGVARHQPVQRRQHVGALEDVGVRVVDLVEHPHVQLHHPGVAGQQVAGAGQRVAGQADVEIGATRLLGTQQALDAAFDHLFGGRQQHHLLQRLRPGQQQAGTGQALQRAQAQHYGDGSPGRSGGRWKTPRPAPPGGSRRTVRGTPGVRPAARGCAAPRALRRSWPAPVGRRFGGERRRPVDQHAERCGIGAQDQPGIAVDDGAEGVQRAQQVV

SEQ ID NO: 23631 - protein, 313 aa, Pseudomonas aeruginosa
PQVQAGAEHRDRLAEALVDTPCIHADLAYAAEQPAVQQHHRQHRQERPPHETEGPDLAQVDAEALVQLMLQTLQGTRRPAQQVGQQAGGDQARFEAGTLRREHRQDRPAQQLQRQRRRQQAEQYRQARGPGVSLASQEQTEGGQHQGTDQRPRQLPEDRGFRPLHRPLAGEATFQHQHREGQQQADTDGEVGRLPGTGPRHVETPAGGYQAQRQRRARRQPQRSVPDLGQAVGDGLAPGAPATVHRRCRRWRRVRPAASAARQPARWASAPRTTQRPGPGPGRPRADRRTGPARPRRGCTAAAARASRRRTGR

SEQ ID NO: 23632 - protein, 515 aa, Pseudomonas aeruginosa
PAQLARSGGRDALAGRCDCRRTLAGTAGGLQRRGTHGGVRTHRRRPASQPQPRPPPAQAGTPRSGLAAGLARGLPGSRTVQRWRLGAGPPPGKQRPASLRPARTGAAPIGRPLRRGLSRPRPPPAPAALRRPPAGVLPSSHHTRRATRPARRPRSAWLPLRLRRAQWPGGYPLRPAGPAAHRGGCGDRRPSRPAGLAHLSWSPPMSMASSPFPRRRDRQSPSAGRPPEPREANAPSPAMPQRRRSQGYGQPSWPGISKDRPMTADTPTSVATINHLLLGAPYTSPLVIPGDWLVDELEGAVEVGGFTDGLFRWPTRKRSGRPSPILCGDLLRAVRTECAESVQFWWGFSPSLVGRWRRALGVTRRNNPGDQAVARARAALARSLDRKAPPKAPAAWSSEEVEFIRRHGSKRSLAWCAYMLGRSYQSVSQQGRGAFPAQRARPQQCDLEQVRGRSVAPALPAARLAMVRAADRQDPPQRYSTGPRSWACNGSGRNTREAGRRLLPPRRERASAQPR

SEQ ID NO: 23633 - protein, 187 aa, Pseudomonas aeruginosa
PAKGTIFAPSSRCRACRGVLARVSAVMFHSMASRPPVCRRAAIDCREREKKRRRSGAVQHSMMFTARPPRAVSLYLLFMSAPVWRMVRMTLSREMKCWPSPRRAMRAALMAFTEAIALRSMQGTWTSPPTGSQVSPRLCSMPISAAFSTCCTLPPSTSQSAPAAIEQATPTSPWQPTSAPEIEAFSL

SEQ ID NO: 23634 - protein, 153 aa, Pseudomonas aeruginosa
ASGLRISARCSFSTKRIGRSPSRRSSPLERMASSRAGIAAVSTVSGCSPSRPSSTALSLPWPLPVAPSEPYSSTLTLAVASSNPSRLSPSAKRAAARIGPTVWELDGPMPILNRSKTLRDMLVSACGLAATMAALLFNQRRPGSAGRIRRPGP

SEQ ID NO: 23635 - protein, 130 aa, Pseudomonas aeruginosa
WRLKIGWLRIADWRSSSTGRRSPLLAARVAKSGSAWPSSASRPQSVSTSAWRTVSSSDRPRRPASISRRLIPAARALAWIAAVRAPVARLRVSKKCFCSTATPRRSRPAARIAVSRWVRRAMRSRPCGPW

SEQ ID NO: 23636 - protein, 585 aa, Pseudomonas aeruginosa
PRRWSMAWVSAARGPIWRAMNSSSVPRSMAPRFRLSVMTGSSGVGVGVQQAVVGGLVEQLFPGAGVGRTEAEEPGLAERILVDQLRGVRQRVVDRHHLAVQRHQDVAGGLDRLQHRHFTAGGVFAEFRQLHEYHVTEGVLGVGGDADGQQPVVVLAQPFVVGGKAQLAHAGSSLSAGRPVGTGLCSAAARSKQGAKRPRPCRHGAWPGAGETRTGPPWNAFVTDPPDISRTRAQTPDSKGFSGNRNEFVPLVTEALQPMAQPLSLQAGAQVLEERADLPRVAPVPRIEDMDGGPERPRVEVVVAEQAHQPPFTEQRRDAPLRAELQAQPGQQVGEQEVVVVAGQSRARLVDTLAGAVALHPPEVLVQRRVLEDQPGVPLEILRALRRGLPRQVGGAGAKHDLVRRQRPRHQPRQVNGAVAQAEVVAAFAEIEEGFVEVHPQADPRMRLEEAGAGLLEERRGERRRRGEAQFAAQLRLQQFDLLPRRAQRFQGLTSRLQVDLPGLGQRQAAGGALEQAGTEFRFQVGDGLGQRRGRLAQALGATAEATGFGSGDEHRQGIQFVHRLLPFRHKCCASRPVLPGRRFG

SEQ ID NO: 23637 - protein, 916 aa, Pseudomonas aeruginosa
RPGSPASRCIPARAEPASGARTDAVLAQAVGDGGVRGLQARRQLAGRWIADVELLQQGFLEALHRLLQAAHLAVVLPRHGGAGDLQVADIHQAALADRSGTEDHVLQLAHVARPAVAQQRRVGARRQPAHRALDLRTGLLHEVPRQQQDVVAALSQRRDFQAEHVEAVEQVLAEAALGDHLLQVAVGGAEDPHVDPHLAVAADPAEAAVAEEAQQLGLQIGGHLADLVEEHRALVGQLQQARLAAALGAGEGAGGVAEQLAFGQVLRQRRAVQRQERRVVPRTQGMAAARHQFLAGTGLAVDQQRRVERRHALRTGLQGADRLGIAEEHLEPLGMVMVQGRQALADAVRFVEGQQAAGQVPLALARPFGDRRGIEQQGLAHEGHFAQRQAEALLDQRILQGFIVEQAGQPLAGRVASAALAEGRVGQQHQALAVHRQHRIGHRRQQRIELQAAALAGKDVDHGHRLHATDAQQRCAQFLQHFGTEGRRVDVDVRRHHFHRIQVQVAPTQQRQHLLGDADTVDEGDVDAHAGTWTAATLAIKPSIVRPGAAQPKGPASGYGAQRLAAGAVAPVALVVHHGFGHQHPARLLRVGLVQHQFGLGVVPGGGDVRQHPHPLAVADFQQRRLGPGAGPPGTQQLQALAAAVVEAAEDAEHRAGATAQRLGRDARVGAPEVAAAILVFVAQGGAVRRVGHYPGEVRFGTGEAAASQRGVARVDGVAGDLVALADEAPGIARPGALGQEQPRIVAQASVEAYLLDEAHLVAAFLVARHDLRRSDDALLEVGMAGEEGLLGGEGALARLRAAIVVQARRIDPFQGLAAALPVGGLPALEQAEDFAFGGSLDQRWVQAEERGAEYRAQESAHREHPCRSIEANADCPLSADAGKWPWTIFSDSATRWALRTRSGQSSPTSRPRHGG

SEQ ID NO: 23638 - protein, 208 aa, Pseudomonas aeruginosa
GRTPAANARQRRTAVPATAAAARPAPTRTSRTGSAPCRSVPGNGRRCSPRPARRSWNRKARDRQAPRSMHSAAATRAAAHGRACRRRPRCRAARGPGCWRRHCRQSPPGSGGCARQRSGCRGWSGSVRRARSGPRRTAPAADSAGPRDRSPAACRASAGAGWPGPGWYSRGAPPCRAARPCAAGPRSRQGRRRAAPARPARPAAARGC

SEQ ID NO: 23639 - protein, 329 aa, Pseudomonas aeruginosa
FRLLRTGATGRQAHPRQQGPGAQHQGHVIPRTRHPRGGALQGRSRTMRSDLHEANRLSWNAATRAHNSHKADQAAFFRNGGSTLYPEELQLLGHLDGLRLLHLQCNAGQDSLSLARLGARVTGVDIADSAIDFARQLSRDSGIAADFQRDDILRWLPVAATRGERFERVFASYGTLVWLSDLKRWADGIAQVLVPGGRFVLVEFHPFALYFDPHWQPAYDYFSREPIAESGVSDYVAESGASLAPSGYRAGVENFSNPHPSYEFQWGLADVIGALLGAGLQLERLEEYPYANGWAGFDGMRDGGGGRMLPPADRPRLPLMYGLSARKPR

SEQ ID NO: 23640 - protein, 974 aa, Pseudomonas aeruginosa
PGSAHQQTRQQRQPDHLPVQRPWPGDLAHRGRRHCAGAHHHNRLAPDPVPPGAGQRARPDHPLPVRRRGTQDRRDRHHPLTRPTPMRIPPYFPRLGALVLACALALPAQAAERAWSYSYNALGLIKRADGPRTDVQDVTLYAYDSRGNLTQVTNALGQVTRLGDYDERGKPGSITDANGVTSSLAYTGVDGWLASVSTAGSTTRFDYDAVGQITRVTRGDGSWLSYEYDDARRLVAIGNNLGERLEYDVDTKGNRTAQRIKDASGSLVRQQQWAYDELGRLLRAVGAGGQTRSFAYDLNDNPVGETNPRQFAHSQAFDALDRLVGQSDPLGGKTRLAYDAQDNLTEVKDPRGVTTRYEYDGLGNLTRLVSPDSGTTTFEHDAAGNVIRRTDARGAVTEYRYDALNRLVERRSPSDPSLDVQYRYDLTADGNKGIGRLGAIDGARDSLVYRYDERGNLVEQVRSIRLDQQTLLDRVTYRYDAANQLLEIGYPSGLAIGYPRNAGGQVASVTLAVGDKAPSTLVGQIAYLPFGPLLRLTWGNGITLSREYDQDYQLLRQKVGPWQSDYQHDANGNIQQHRHSLWGTLDYQYDPLDRLTEERGVQGGRSYAYDAVGNRTQRSDNPASGGTASSQDYQYAPDSNRLTAIGAQAVTSDAAGNLTQDRAARKLAYDAQGRLQSVSLDGQQVAEYRYNALGQRIVKLTPESVTTYLYGPDGQLLGEAEHDGSGRKLRAQYYLWLDSLPLATIDADYDAQGKVGNPTLLYLHGDHLDTPRLATDASGQIAWQWQSDAFGRGEALSQGSTQVNLRFPGQYYDAESGLRYNYFRDYDPETGRYVESDPVETLRKLNNPEMTFLNSGESMLQATPYWEHGFTPNHNYTYSDNNPTAKSDKHGLSPNPTDNLIYTPDTNCTCTLECKKKFTGNGKSFLVGALCSKATTPFFGGVVCNSTIVMICGASCSQECNRAPSCEKEGSGNE

SEQ ID NO: 23641 - protein, 671 aa, Pseudomonas aeruginosa
SGRGAGLGRGPFVVDAGSQPRSRASDYIAPQRIAGGHVLDDIPQVSPVVDGADRSIAGHAAERCGTCRVQPARRSRSGSGCGRACHGGSGPGRCNRPAGCARREVSHDDRYRQLRADAQPGVAVLPAVMQFLHAPPIHIAALLHLLQPGQLRIRLHHRVDGLAHGLLVDMLEVDLQPFHGLDRQIPLGHDLALAHGFVGLALALRRLPRQVALALLVALLVQVLHRVEGHRAAADDGQVVARFQLRALVSLVAATEQGEVAAAGYLAAHCRHIGDFVAPGLLATEAAFALLVVEVVTAVVGGQQLQLVAGHQVGFVAGAGLARDQPQVLSGIDRQVAASVHASGLLGDLVVLESDLLGLAIGMLFVGSRDQAHIATRLECHVVTSVDAAAHDADIASGADADIAPRHDFGAHLGRLGLVCLASCRPAPLRYRSRNQDIPAALQGEVALAVDDTANIGYIATCRNGQLLRSLDTRGAIGKCLSGTGSPVGGLVLGHRPFIDDVSGKGGEAYLAPGNDAALVIADGAAGQQVEAVAGLDQAAVVDVAGCRAEVVLRAQGTGVPQVPAGDQVHVAPLDQRAVRAQPPLGLGQVDHGGEDLLAIHLDFFQPNDVVGQRGHLGGAEGDARGQSQYVLAGDGVVHQIAEHRFVAVQSGDEALPRTLDDRFAYQALLV

SEQ ID NO: 23642 - protein, 160 aa, Pseudomonas aeruginosa
TVAQALLAVIRIDTQATEQVVRVEELLQLGERRVGLDQILVAVARCGIAGHALNARNRRQGLQRWLPNRRLGKNGAPLFEARQAALSPNGRRQCLHRRLLSRQIGKDAAIATWTGNYPLYTHCRRRGLDRRLRTLPIGENSSIPIVTGRCALNTISRGKA

SEQ ID NO: 23643 - protein, 503 aa, Pseudomonas aeruginosa
IPGNVLQAICPAPRIVAGDIQPAEAVHIPVEVGDVAGAQGHVGATEQQPALVEQGGRVQSQVATAAQGAVVVQARGAGHEVAGSGDPPTVDQQVAGAKRDIGAAGEAGGIAEVEAGGVQGEVAEAGGAAVATVAAAQLESQAAVAGQQAVVAPVAAAASEGLHRQQLALGRLAEGADVQVQASGLQHAAVGPFAGADVQQAIGGQFAAGADHLPGIQAEGAVAGMEDAPAGVGQAAQLQVEVLVGAFQHAVGVVQAASDQPRAAAAAEGAQAAAAVVDRGGAQVQLAFAFQLAEAVGQRAGQAEVDAPGADLAALARRRALVEEALAVEAEQAAGVEAAALVVEVGGDDAVVAAQRREMALLVAHALPGANLQRLRLGDAGAVVEQPGDQLQPTLGAVEHAAGAVVEAAALQVEVAGPAVQAAALVVQRAADTQPVVALGLERALAVVQAAGLHLEGAGLAEDQAVLLVAQGAAAQAQAHAGLAGERAGGAVVRASPQRIGGG

SEQ ID NO: 23644 - protein, 267 aa, Pseudomonas aeruginosa
  UNSURE (96): Identity of amino acid at the above locations are unknown.
RLIAPQFVKPKFKGDKHDAQDAEAICEAASRPSMRYVPVKSAEQQAVQSVHRVRSRLVRARTALCNEVRGLLGEFGLIATRRGRAATMALLETVTXTEPAPLPAPMGELLRELKDELQTLEARIARLERQIQAHVRGDARIQRLLAVEGIGPISASAVAASAGDARQFRTGRQFAAWLGLVPRQHSTGGQQRLGNISKRGDTYLRTLLIHGARAVVRCCANKTDARSRWLQGLLQRRPANVVAVALANKNARILWALLSRETCYRPG

SEQ ID NO: 23645 - protein, 104 aa, Pseudomonas aeruginosa
SRSGPGTRCSWPALPPWCIRTSPVAARCVAGPSAPARRFGWPAANARRVRRSCRTPRPARPSAPRPRSAPGFPPVRCAGPGRPGSASGRCPAPAAPCGRACRWR

SEQ ID NO: 23646 - protein, 196 aa, Pseudomonas aeruginosa
SARTRRPAPPSVRPASRRWNAVSRREPGSPPGTCRSPLPAPPPPPRGRRRVRAGAPRSRPARCGSRGSSPGGRSARHTPALRRRAAAPGRRYGTDARPARRTDAGRRPGRCAADRRRSHDRRRCRPRTARPPRPAAPVRRRRRRRRRAGTGGCCRWDCRSAGRCSRWRPGRRGRTPRRRSIPPARRHSPGRSAGSA

SEQ ID NO: 23647 - protein, 203 aa, Pseudomonas aeruginosa
TSSAPRPGGSGAGGTAAVRVGRSRPRARACAALAGVPRGRPPAVRSSRGTRCGCDRACGSPATSFRRHSRRTTHAAPRGGPPPPARRRRSARDRAGCRSGSGPACSRCRCPVPAGCVTATLPASGSADRRPRSRRPAPPGRPVAPGSVAPAGSRTGSGRRRRLPGNARSAPAVRRDRPAPARSPSARPSARGCRSSAAPDSPP

SEQ ID NO: 23648 - protein, 232 aa, Pseudomonas aeruginosa
TCCRSSSSTRQDTPSTTRWWIASSRRCSPAGPSTSTARSSGPCSRSRLRWALANSSAHSSKDCTGTCQSSSCSRSGRCCASHSPSTWRNARRRASCCSTRRCRDLRSRPRSMACRGCNSSAWFQCSRRASGRSKNQCWIGVSALSPCTGPCSAWLAWLCRATAARLCTVWCWNRSRGLKWMPSWRARLTTWIDRIESPPSSKKLSPRPTRSTFSTSRQTPASCCSSTLRGAS

SEQ ID NO: 23649 - protein, 89 aa, Pseudomonas aeruginosa
YPTNWLPATPSRITTTAWATPGCASRRAWISSGSMRKPRSLTCWSRRPRYSSTPSAFQRARSPVRYRRSPAAESGSATKRSALSAGRPR

SEQ ID NO: 23650 - protein, 202 aa, Pseudomonas aeruginosa
RGDISTQGTPLKIGCSRPPIRPMWWYSGSQLTITSSAPMPKPRRISTLLATRLPWVTCTPLGNAVEPEVYWRKVMCSGTHSRLVPGIGNGRVQLVDAEQLRGVGGGQLRVHLQQWLAQVSGGQDQARLGVGDDRQQAFMVMAARRFRRVGRHRDDPGIQATEERRDVVGAAGKQQYRAIAPAAHGPAGPRRCSARAGRDRDS

SEQ ID NO: 23651 - protein, 273 aa, Pseudomonas aeruginosa
SAAASPRGPSTAAPARPPGPGRNAAGRPGRGPAAGRPRRRLCRRRPRAAPRPAAAATPAAPPRRHAAARAGGSTPRPSPRSPGRTGNVPPQPAPGSPAAGRPSPPGDRSSASRRRSAAPRWPRSATFPRRPGATGRAAGAGAGRRGTDRPGRTPARRGPPRRGSRRRTRTTAKRCCSRPRYSVAPPSARSPGRCPWRSRRSAGCSGRPRPRTAATPSTAPATRSRRMPATARTAAPPRSGSPAAARAGSSAPPAADAGRSPSASTSRRPAAGC

SEQ ID NO: 23652 - protein, 137 aa, Pseudomonas aeruginosa
VRALRPGAGTAARIPSAGSPPAGAAPGSAPRRRTPRASPRHRRPGAPPGTPPAPRRVPPAPARPARPAPATHDPAVPGYPPATARPSAPAPAGDAGAAATAARPSAPAGYPATAPGHRRGAGSARRNRGAGAGRPAR

SEQ ID NO: 23653 - protein, 328 aa, Pseudomonas aeruginosa
KAQGKRPGGAENASSDCHCIVGPPMSLRFDDIEAFLNVAELNSVTSAAERMSLSKSVISKRVSDLERRLGVRLLYRTTRNVEPTEAGHFFYKAAKASLQELNNAAEIVALRENDLCGELRIVTPMSFGTLWLSPIIADFMSQHPRLEIVLQMDDRLTDFEKEGYDLSIRVTRLDDSSLIARPLANSQRVVCCSPDYAERHGTLDTLEQLMQHECLGYNNATPSQVWTFEPAFPGAKPRAVSPRGRFSSNNGQAMRDAALRGQGLALLPLFIVAEDLKNGRLVDAAPGLRPLDDVIYAMYSRAAAMSPKVKAFIQHLQQALSIPPWGNG

SEQ ID NO: 23654 - protein, 127 aa, Pseudomonas aeruginosa
ATEPFRRGSGQILGMRRRLPGACRLSPVRPPGPQRRTAMIVRTLLIAAALLGGTAQAAESTDLCGANLQKLDDILAVRGKTSVTGARVTEVKELQAKARQDQASGDTKGCITATTQALQILQNAGKK

SEQ ID NO: 23655 - protein, 823 aa, Pseudomonas aeruginosa
SATDARRITASGYPPSPNATLRRANSAAGVIRRHSSPRPDRVRFRSLEAQAFPYRADFRLAGVVGLGQAGIGQRIGRGLAGRGEQGLLHHHGAALANGAGGLQRRQPAGGGRLRRGAGGLQAVAQELDLHQLAHVPEDFLQVHCLPALQGHPRHFHHQCLGAVCLQLDRALALAGAGLAGLRGGQVADLPARRPARHRRLGQAQRGQRADRQGQPAPAVASRLRLPHGVPSSSRPSTAGRGCPRGSSKRSRRPALPSTSKVLRLCSSAATIAPAAPSRPKAAAATIARVQPRPIATLTCRVRRHCRLSRTQVPSRRRSLPISTISAEARAMSAPPAPIATPTTPAFSASESLMPSPTTIGRKPLPISAPTWRSLSSGNACATSWRIPTCLATASATARRSPVSNSCRPRPSSRRSAMASAASARTLSAQQQPAEEAPVQGDSGDRSLMLRHLAGVDAQLLEQFGPAEGGFARRCSCDHAEPLAFADIAQWMIGIVRRQGCQRSAHRMAAGGAEASGQAQHRRLLGGICQAQRLQAQAAMGQGAGLVDHQRSQVRQLLEEGRAADQDTVAGGHGDPGDSRGRGGQHQGAGTGGDQHGEHGLGIVGDEPGDRGDQQHQQHVLPGVALQQAGDRRLGALGLLHQADHLAQGRGLAGTGYLDAQQAVEVDRAAVDLHPRRHLERHRLAGDRRGVETGLALQDPPVGRNPVAGAHFHLVARSQAGVVHLAQAAVGLDPPGMAAGQLAEGGDGLLGADHAALLQHMAQDHDDLHQRGGQQVAAGPGAEHGQRDQLVGDAVQARMPQAVPGPSGPPAAPPAATRRRAGSG

SEQ ID NO: 23656 - protein, 173 aa, Pseudomonas aeruginosa
PEPASASLDRLTSRSARRACSERSRPSTRRSITCSADGSSTTCSSGCGQASSRPGPARRSSAPRRSTTATVLRADLADVGKRPGQRRQEGHAEQCEERQASGLQPGAAQPLARFAAHGRRPLAGASAGNAGGPSTSTRNGAASVRKTSRVSPLTMVPRVSSERSRLYSCGEPA

SEQ ID NO: 23657 - protein, 196 aa, Pseudomonas aeruginosa
SARPAPRGRRSPHRPADGSPRPPRPVPRRRCRGGRDRPARPGRSARPGPRAARRGPHRGSARRRHAPVRGWRCCAPASARRRCGRSPPALPRRRERCGRRCARPCWTIWKLCRRSARLAMTCDFSLTWEASHKRLALSGAGPSAGASGSAPPSPAATLVANSWTTPFSTANTRPSGQGSPRCRPGPSTATGLPKRS

SEQ ID NO: 23658 - protein, 329 aa, Pseudomonas aeruginosa
RIVDEPGEAMRSLIGMTFLNSSVGQRRLRQNGIVLRLGPVVADRRRATLPHRQGHCLDRQGLETLLLWLQRHFLCVPLEHLLEGPAPACLRIALSVDGNPAELAELVYPLLERYEMPASAFIGGDPRSWREAVAETLWQADATAAGPLLELLEGYSGAALMAVFERTGDDQRRSRNLDLLLRKLERLDPASQQALHAACPVPAPYSAGDWERVRRLENSGLLRFGLRGQEPHPSAGLCAEDCLGRAHRQLQQHCAAPLPVFCQARTTPAAQPGLRAALGRLGYRFAFGARNGLVDTRCDPLDLPRIEVDAAIAARPGRLAWRIYRGARP

SEQ ID NO: 23659 - protein, 624 aa, Pseudomonas aeruginosa
TDRRHSGTCSSPLADWPPPWRRSCSISVDREVPAEFADLAPDPFADLGIVDIVEDVADPAGQFAALAFAETASGHRWGADADAGGDERALRIVRHGVLVHRDVRRSERRVGGLAGQPLLHQADQHQVVVGAAGNHVVAAPDEHLGHRLGVADHLRLVVLEARLQRFLEAHRLGRDHVHQRAALGAGEYRGVELLLDLLVGARQDQAAARAAQGLVGGGGDHVGEGDRVRVEAGGDQPGDVGHVDEQQRADLVGDGAEAREVEGLGVGGEAGDDHLRLMLHGQALDFVVVDQPGSGVQAVLHGVVQLAGGGHLGAVGEMAAVGQAHAEDGVAGVEQRQVHRGVGRGTRVRLDVGVVGAEQLPGAVDGQPLDLVDVFAAAVVALARIALGILVGQAAALRLHDPLAGVVLRGDQFDVVFLPPVFGVHRGEQFVVVALELVVLAEHGAGLLSCRCQDARWRERGRGAATQARRRERGIAGNARTPPLAAPSSSVTPRCTPRWAGRSRSGCGRRRRCRRGPPAASTWPPPGWPADRRPARGCRRGSIRRAVRRRCAARSSAGCLPCPARRVPPRGFPRGCGSSRRRNDPARPSTRSRWARSSACRPPGRTWSAHGSRSPSGAWPRRRR

SEQ ID NO: 23660 - protein, 719 aa, Pseudomonas aeruginosa
ICPASVSARLRVVRSNRRAPSSASRWATALVSAEGVLPRRSAPRLKLPVSAVATNIARAFNLSIDSFRSGTSVVRRARFCRAGALASLALPGPRYTRPRSKGNHHEATDSHPPRRRLPGHPPAHPRRRRPAGGQRQDLHRQSAATLRRGPGGGGRADPRGRRRGRAARPGRWRQPGRRSRRQAPDARPDRHPFARGVRRPGAGRRGHGQRTGRPRRTGTAPARLARQRQGATWRHAQCQRHAYRLLEPGQGLPRALRPRRMGRPAAGLHRQRPPHRLGQRRHAETRRHRRRAGPRPARGTAQHHRPRRRRHPQRLPRRCRSRRGARGTAGAERGTDARSRTQRGALQQLAGPDRMDGPGRQWLAGRRPVQPQARREHRRRATGLPAAGQGRRTQRPRRRPPGRQPTQPAGRPRGAGQGAPALPRQPQPDPAGNQGVRRRRTGIPGADRRAPRALPQQQEDGRTADRPGALRRTGQRRRRPRLAGPRPRHRRPRGARGAERHAAGAARPRQRHRPFDYPPATGQSQGVRALQAAWRDRLDAAVLGRRRRNHSGPDEALYQCLRLPLPVPGALPAEQGRDHRRGQRLAGVQPVAVEGHPAGGDPQGPAGRAQRRRTPGPPDHVLRLHPQRCADHRPGAPDRQPGAGQAGGLHRPRPRRVRGAGDATGRNQGAEDLVRRQAGVFQRGLSPLQARGPMPYLRRRWAMAVCEVCRRAANWRVDG

SEQ ID NO: 23661 - protein, 139 aa, Pseudomonas aeruginosa
RVSRPPARCRSPSPGPSVIGVASSSRAWPMKVTSRSGRRKPCSTSASSRVSSSNRLASRSPAGSRPQRSLKAGLASSTRPLPSTASTGSAIAASNASSCRRRRWPGRMSTTVIACTPRMPSSAARSSSSTSGLRVGASM

SEQ ID NO: 23662 - protein, 675 aa, Pseudomonas aeruginosa
TPSRALPLRCPWAACQRWNRPRISLSAAAWTSAGYRQKSAAQNTGRKSRRIENILVVRLRRTPIVPYPPTLANGPGRFFPIPQRGGHCGHAPDSLPPPPGRGTADNRKQLSAPRQPAGSMRRQQGLQPFGKLQAPRRVVVTAGELAVVQRVALALQRRAQAAVAAENAVRLGLLEQAGTEEERQRQTLASGELPYQPLRLLLVRPPPERAGQAQHLAEAFRVTVGDAARGQPAVAGTGKHAIGRLLAQCIALLQPGQQLMGEHVGEGLVAGQLAAPAAGVDIADNHRQGRADAPGSDQVVEDGRGRYVARVVVLVEQHQQRIALALGIVARRRVERQLALVGQGLAGIAEALHLAARHVLARLVPGLGRGAAELHQRGLLGPRQRAAVEPRRTAQRVRPRRRLQRQAQGAAIGLLQVRQVGAELVGNPRVAAQRQAQVAHVAAGQGLEAAGVDLRGRPQQAHVAGTLLAPEEGDQHTFGIQRLHQRRALLRHLLPERLQRAGALFRKLRLQALQGRALRRRRIKRRGLRGEALGGGQGQCGVFVGAEGQAQALALAGLQAERLASGQLRRAQRLAVGRGGAQADAAAVDLQVEQLQLAGGKVEVALAALAGSDLDAAIGQRHGLGGLGRGQQVEEKQQRGGNGRHGISLRRGAAIRAAHRKRRTIAAEICRCDPG

SEQ ID NO: 23663 - protein, 94 aa, Pseudomonas aeruginosa
SGCAATGVESAASKTVRRKIPMTSRLLPALLLSSAFAVLAGCSTPTIVTLNDGREIQAVDTPRYDRSSGFYELEQLDGKRTRVNKDQVRSIKDM

SEQ ID NO: 23664 - protein, 158 aa, Pseudomonas aeruginosa
AWRALAPASPGSTSPTAPSTSPASCPATAASPPTSSATTSSAGCPSPPPAANASNGSSPPTARWSGSPTSSAGPTASPRYWFPAGASSWWSSILSPCTSTHTGNRPTTTSAASRSPRAASATMSPSPAPAWRPPATAPASRTSATLIPATSSSGAWPM

SEQ ID NO: 23665 - protein, 167 aa, Pseudomonas aeruginosa
CTASAQGNHDDRRTPAAPRRNPPGLGDRPQRSDRTPVFRRGRPTGAAPRVLRHARLAGGRGRALHADPARLLRPRRLVPRPVRPGPPDRRGSPRPTPPRPRARLAATEVPPPQPRLPPPRPRRPPLPPRRHPGPPPRRQRALRFGYAVAEHGGFLYETRMPAVHGTG

SEQ ID NO: 23666 - protein, 530 aa, Pseudomonas aeruginosa
GVVSVGAGGCSPCLSNTQRITLRIACTMKTRLNILQTLIYLSIFNPVMADVYWYGNGTEDKKIKSPNELCRYYAEQRRKDSYERPGAGGHISLRGIKLKYVSENIRDCNFYYIFISGAQAGSENYGQARLLRKGECSPSESYSHATGTCEKNGGPAGKSPPLSTTCNIPNSTIGNPVVVGYGTKAHEEPLITKPFPISLLYNSIDTEWKTSLSYKALRGSQTTIVVTPDGKELKYKADFDSFIPETLAQGILSINSNKLTYTEKQKEITFNNENPEKIKYHHAHSISLEHKGDLLIATTKEQEKIEITFNEHGQPKSLETSNARIDLFYNQNGSLIKRKTSSSTFNSERNYHYENSQNPRLLTGITDENGARFATWTYDNQGRAISSEHANGAEKVSLAYNDDGSTTVTNEYGKQATYRFQVIQGIKRIVAIEGEPSPNCPSSNSTFTYDDQGLLTSKRDNNGNLTTYQYNARGLETSRTEAAGTAQARTITTDWHPTLFLPVQVSEPGRITRYQYDAEGRKTGETVTTR

SEQ ID NO: 23667 - protein, 145 aa, Pseudomonas aeruginosa
PATPPATSPRTAPRANWPTTPRAACKASASTASRSPNTATTPSASASSSSPPRASPPTSMVPTASCSAKPNTTAAAGNCEPSTTCGWTACRWPPSTPTTTPRARSATRPCSTSMATTSTPRAWPPTPAARSPGSGSPTPSAAAKR

SEQ ID NO: 23668 - protein, 144 aa, Pseudomonas aeruginosa
SALPTLTQSCPEHPGLILILPSVFTVIRFWLVAAPEPPPSTLKYVSVLGVAPFAPPPSRPKSPTAPSCELILPETGDSAIALTRFLAAVGSLAVICAPPFTAVRTPTSSAANLPPSTPAVTEPCQPASSYAWVKNAARSSSPFR

SEQ ID NO: 23669 - protein, 105 aa, Pseudomonas aeruginosa
PMAKPNDTSNPEVTESSPRFVPLLPTSQADMCPRSATLYVDTHALPTHLFDNAKVRLRSAINILAMTRLLDDKEEPGGTLAYINGALLSLLSDALSEIEAGHPSL

SEQ ID NO: 23670 - protein, 64 aa, Pseudomonas aeruginosa
PLLSHGQHETAGMKITRNLLDDLYTDDQGSQDLTGLRQPRKMRRETKEKPRKRTLRDSRPDRPL

SEQ ID NO: 23671 - protein, 940 aa, Pseudomonas aeruginosa
RHVALQGLLHPRGDLGGQQRMPAEFEEVVEHPDPLDLQHLGPDPRQGFLQFVARGLVGLVLHLADVQRRQRLAVELAVGVERHPVQHQPVQRHHVVRQVGAQLLLDPLEPGALLHHQSGRRVGAGTLCLAGNQVAHQVLAVRPFLHRHRRLADVGAFVQARLDLAQLDAEAADLHLVVDPPDILQHSVGAPPRQVAGTVQTLARRAERMRDEGLGGAQRIADVATTDAGAGHAQLAHRAQRHQFEGVVGAGAEQVQAVVVGGTADRQVGALGGGQVDAEERHVVGAFRRPVGIHQADPRVALEPLARQFRRHRLAGGQHPAQAVEGLALFGEHALDQRRHAFQHRDALFADVRQQALRIVGDGVRHDRHAGAEQRRGEELPDRDVEALRGGLGDHVVLVQFQVRDLAQLVVEHARLLHHHALRQSGGAGGVDHVGEVLRPAVDLRIVLGALALLDLVPHQQARPVDAAEFVEQRQRLLAAGLGADQHRRAAQLDDPGQALGRMAGVERQVAGTGLEAADDHAEQVEAALGQQCHRLVDADAGGAQGVAEAVGPSVQLGVAPALFQATGGDALRMGCHLRLEQPHVALLQRVVAGAAVAAVEEEVALVLAEQRQGLQFAVETVGQGQQQALELAEQALDGRRLEVALVVGQVQAEVITRIADHGQREVGVGTPGVGTGVQALRAVQYRDFHRSVLEHEQAVEQRLALGQLAAFLDGYQGQVLVLAQLQVALEQPVQPFAHRAALAGGRHLHAQWDAVDEQADGALHFRHAHRTPGHGDAEEHVALAAEAAQGQRPGGLGEGVDGELVALRQFAQARAVGGVQTRVAVTDDHPAAFAGVLAEERAVAGHQGRPLEAAQALAPPASRLLQVLALQPGDVVAVARRRRQVRRAAFAEGAVNLEEVVHQQATAPGIDEDVVVAHHEPVARLAQADQAQVERRLFE

SEQ ID NO: 23672 - protein, 247 aa, Pseudomonas aeruginosa
HFPPAPRGCRPAGGRTATRPAAHPAGLATSPAPRAAIRCRRRPAGVRPSRGRRWSWPAAPVRRPRRTDGRPVAGPPAAPARTPRPPPGGGSPAAGVAHRPGRPPAPRAAAAPVRGRGCAGPWRTARRIRRRIAPGRARAVPVRAADDAAPATRRRPGGTPGAGHHAVRPGVAGTCAADRGQWPAAAATAAPGSSVRGAPAAGRRTSAGSASARCRPAPAPARPGWPGCAGPPRRGSARSGAGTGRGG

SEQ ID NO: 23673 - protein, 142 aa, Pseudomonas aeruginosa
GSPAGRRPSPANAPGPGRPALPGRRRDCAGRAPDGWSGHRVRHSSGSVRRRSAPGPGGWPPRGRRTGHGGCPGALPRRPCRRAAVASAPRRRTAAIRQCAAAGRPAAPPAGSASVRPSARCAVRRTGRGCRSGSSRGAGRGR

SEQ ID NO: 23674 - protein, 335 aa, Pseudomonas aeruginosa
RCGAGSPPGSARARPSSPCRPAATARSQGRRAGAPRCRRGSAGAAGGCRGRARRSPASPCAGRHRRARAVPARRRRWGTWCAGSRGAAPGPVARPRSAPRPAARSGVPGRRRCRPGCPAPVARGTTCAAASRTAAPAARGRCGGSRRGCRYVRRPGLRGPVRRRPPVRWPRTARATAVRRRRPGGCARRCGWPAGNARRARRNRRAGRPAAGRALRSRSRRCAVAARSAARRARAAARPAPAAPAYPACRSGRGASAPGASTAPGPCIPAVRPVARRADAGSARLPPRRRQRQCSTRPTGCRPRLRGSPLPPGPPPAAPAGVPGFPPARCGSHAA

SEQ ID NO: 23675 - protein, 179 aa, Pseudomonas aeruginosa
RSPADRPAVAANARRRSLPARPGRRPCRAGSGPGGWPGRAVRRSRGCRRPTPGRRVRRTAPVAAPAAPAARRAPARRARCPIRRGAPPARRRPGRYRRGSAAGLPRPGAAAPGIARRNAGCWPRRRGPRRSRNSGSGDRERPPRSAVAGRTWLRGCARAARRRAGRAAGATPTGRAAGG

SEQ ID NO: 23676 - protein, 141 aa, Pseudomonas aeruginosa
PAAAAPFPGRTAAAPRLRGAARQPRRVRARPARRGRRTARRTRPARRYAARPRRRARGNACAALRGVRPAAGSWRAAPLRPARRAGAGRRGCCRRRSADRSARSARDAAAPPTAAGRHRAAGAPSVPRPAGRRPVGGPPWR

SEQ ID NO: 23677 - protein, 218 aa, Pseudomonas aeruginosa
QSLSFNIICCAMCGSYPTASALQPPPQQGDFHVGTTVYPQMRYPLLQAFVDNRTILVKIAARITGCRSRAEDVVQDAFFRLQSAPQITSSFKAQLSYLFQIVRNLAIDHYRKQALEQKYSGPEEEGLNVVIQGASPETSHINYATLEHIADALTELPKRTRYAFEMYRLHGVPQKDIAKELGVSPTLVNFMIRDALVHCRKVTAERQGDNVTHLSARR

SEQ ID NO: 23678 - protein, 406 aa, Pseudomonas aeruginosa
MRRSRQVQDAPAPARATRCTQAAACRSGHMDRPRGARGATETTGWRLGTEAWPATRGACLSNVASRREFTRPARRPAERPSIDFRHDDLAGRRMPDVIGVAQALRQVYRRLRNFPVGHLLQQVVDAVQPRALLVVGLYHPPGRLGDVGAFEHGFLGLGVGLPAPPRLQVHRTELPLLERIVDTAEETQVLLGVGDGEPVLEQLDARARQHLFELRHAAEEFLVLFVVAETHDPLDPGTVVPAAVEQDDLATGRQVRDVALEIPLGLLAVVRRGQRGDPADPRVEALGDALDHAALARRVASLEENHHLVPGVHHPVLQFHQFPLQAEQFAEIAAPTQFAGRILLLGTEQLVQVQLVVEQFLLQLFVVSIEPVATDAARGIAIGVHALLSTSCRNTANARRVFMTVW

SEQ ID NO: 23679 - protein, 118 aa, Pseudomonas aeruginosa
MTWPKLASLSALSTCSAHPGDRRGEPRPCGAIDRRSTMQAFSKQQLIDALNAQSSDLATLQSLVMGLYLWIRDSHGQASVDAAFQRAREEARQFRQQSGNQADERLILHLAEIVREQP

SEQ ID NO: 23680 - protein, 207 aa, Pseudomonas aeruginosa
PVRPDSRPQGSPGRRGIDFRGVLRGQHPDGRGHAGAQGVALAIGGIDGDAHRNSLGQLDPGIARVDVRQQARALGILPVGDGMGDALHAPVEALAAHQFHPRPAADADARQLGLLEVSADIERIAVHQRQQWHPGVGVVALAGLQVGHVAADRGAHLGTFEIETGLLQGGFGKLHVGLGQAEAGLVPQQLGLGQADVGLGLFVLFHR

SEQ ID NO: 23681 - protein, 190 aa, Pseudomonas aeruginosa
HRALLQCRAPLRLAAALAQLGLAGLDRRARLAQRRPRHVHRALGAQHRQFIARRIDAEQQLALLHGLVVAQRQPGDQPGNVRRQRHHIGADPRVTGPRRAGVAFPGEEHQRRRHQHRQQGGQARPFALQQVHRDISPIHRIRPAQIAQYNAPWNSASCQTRCNTPKRRNSGLSSSRISQASSSAWAIGGR

SEQ ID NO: 23682 - protein, 648 aa, Pseudomonas aeruginosa
APPTSTSAGMSALLFWFFDDRRCAAVLLQQRPIALQRLLQDQYRDIHDEALPRRPEVLRRLRQQGLQAPAETPQGGQGEVLPRGVRAAGYVGGDLAQRLAQQRLQLQRHHPGVMQRLAQAVQRHAHHHAAQGALETFRRSRLLARRQQADHHRQAIDHPRLEGEALRLAGLAARHFRDVLARQVEQPAQARVGAERIDQGEHQHGEDRRGEEAADELEPLRSVAVVDRDILWRHHQQGLQADAHGDPGAQRAAQADRDHVQQQRHPQRQPLEVGGCRQQHEQQRRRDQDRQQQPAQEVLRRQQRTREGRHQRAHHADQQQAAEGAVPGAGDPQPGGAGQGDESAHGVHRGQRPVQVQRLRLATAVETAGVAAGLDRIVEFEHFAQALEQPRVFPAQDRHLRAQRRAQRLVVGLRARRRGIEGLAHRLELLQHLGGYRPPLLGQRVQHPQRTIQQCLDIRRQRPDPVRPHQQAMLAQQQQPRGHQHQQVTQQLHQAIGAAQVRRVEIEVPAQAVQRGDAGDQLHLPLVERLVALVAADHRRGVPRGTADQAVDLGEVALRHRLRSRAEQADQGHAGDAQQGLGDPHHGEHEGVFRIGNRQHGDDHRGEAAEHEGVRVGVAQQGAAGGAERPARVPGRRRTATVAGRTAP

SEQ ID NO: 23683 - protein, 138 aa, Pseudomonas aeruginosa
CRRRPPSAGNRCRSPRRPGAACPPATPAPPVGESPPAWPRRRPPPGDRRSATVAGPDPVRADRPWPRRPPRVRCRPSSSQPRKRPSRAIPAIGPSCSGTSLASMPSCWNSSGRPRAASPAAVRATTPNPWRSRISLNG

SEQ ID NO: 23684 - protein, 246 aa, Pseudomonas aeruginosa
TSIPGATSSGTDSPVIGAVSRLAWPCRTRPSAGTRSPARTSTWSPARRLALSTSLRLPSASIRRAWLRVSSPRAAMASWEPITLRSSSTWPKIMMICTSAAVSRSPLAQAPSMASAINWSVTPCRLGCRRLSQARAGHRQRHQQRRDAEQDLADPGLVRRQPAPGQAEQQQAEGEHRQAQLARGTALLVAAEQAAAERQVMMVMRAAAMAAVGGRLAHAHLPGRAAAAIAGSARPAGVRSPGLPSR

SEQ ID NO: 23685 - protein, 141 aa, Pseudomonas aeruginosa
RRDRRDAPARNAAGPRRGVRSPVRRTAAAPPAPAAAARPAAGRDRPGAPARPGAALRRRFSGPIWRTLENAQASAARRVTPNSARNARRPACSQGLRSPSRASPLMAGARWPALRRGTPAARRPARGTVRHRCARPAGYRR

SEQ ID NO: 23686 - protein, 176 aa, Pseudomonas aeruginosa
PSPRRNVPAPGKRRRRRTAPAARRPAAGARAARPVRRDRDRDRDRDRDRDRDDARGGCASGSDRGSRALSSWCGLPGRGRRSGGRTGRRRGIQAAEAEAAQVDGRRAGAGDAVVDEQQVGLAQAASELAVVGLQQESLAGVGIAFPLGGETPVGGLRGGQGLAGLRAGPVVRHAGL

SEQ ID NO: 23687 - protein, 194 aa, Pseudomonas aeruginosa
NRRPRPGAGRCRSAGATHAADAAGDAAASATGRPAGWWRPGAVRGRHAAARTSPGSPCPATPAPAPPATGRAVPPGAGPRGVPGEPGTDRGRPAPGYRSTPAPVARGPGLPATAPALGWRGDVPAPAPRRPAAGRYRWRGRPLARNWPAACRDASRRLPGTTPAPRSPPATAQRARSGPSRGRWPGPRRSSNRS

SEQ ID NO: 23688 - protein, 526 aa, Pseudomonas aeruginosa
ASTATLRNWPSWSIRCWNATKCRRAPSSAVTRAVGAKRWPRRSGRPMRLPPDPCWNCWRVTAARHSWRCSNAPATTSVAAATSTSSCASWNASIRPRSRPCTRPARFPHRTALATGSGSAAWKTAACFASACADRSRTHRQAFAPRTVSAAPTASSSSIAPPPCRCSAKLAPHPPRNPACAPPSVGLATASPSARAMAWWIPVATRWTCRASRWMRRSPPVPAGWPGASIVEPAHEHGFQPVPKEARQAVALRRKTARTTGSERAVARHAAATPLSGIWPAQLARYQQGSSHDCRHPYLCRYHQPPAARRALHQPTGDPRRLAGRRAGRRRGGRRLHRRPVPLADAQAQRPPFADSLRRPAARGTYRMRRVGAVLVGFQSEPGGALAPRPRRDPPQQSRRPGGGARPRRPRPLAGPQGAAEGTGRLVQRRSRVHPPPRQQAQPGLVRLHARPQLPECLPARPRSFPRTAGATATMRSGASPRKICCASTTSSAARYGARSRPARPAAAVFHRAKKLGLQRQRPKHP

SEQ ID NO: 23689 - protein, 898 aa, Pseudomonas aeruginosa
GRSPPSPAEAREGQCSTAVVALRHEGHLADHQGHRLAAHHRRHLVAQAGQLARHVAHGQRRVETRTETAAADLADRPPLGIDDLGALAHRHPPLRQETDALAGNALRLLGKDPLGAGEAAGAHAVGAARLGNGPAEAGFDRRGGAVHVVAVEAQAGFQAQRVARAEADRRHFRLGQQAPRQGLGMGGGHGDLVAVFTGIAGAADVAVLAEQLDAGELHEGHLRHLRRQALQHPHRRRSLEGEQGTLLEQRLDAATVFQVTTQVRQVLVLAGGVDHQQQAIAEVGHHQVVEDPALLVGEQRVALLAHRQVEDVHRHQAFQGQRRIGAHQADLAHVRDIEQTGLLAGVQVLLEHPGRVLHRHVVAGEGHHLRPQFQVQGVQGRLGEGFCGHVSLHGIPASCLPESRDRLSGKRKEAPAQRRGSAFDDVHGEAAARGFLVFAFHVGAGLAHGADDLVERDEVLAVAAQGHARRVDGLHRSHRVAFDAGHLDQPANRVAGQPEVVLHADFGGVLDLLHATAEHFAERPGGHRTGHPDLALATDLGAGDRGVFLVEDADRRGGEQEAHHAVVVGPGDEARVVMQNRRNDPRRAVGRRGHHAAAAGVLLVHRQGVEVDPVEHAESIAQAGLRPLAQLAVERRRAAPDLQSAGHDALVAAAGLDAILHHLPDTQQAGAGFLGGAPGLLVLGHQLADRQAFADAMVEQLPRGLEGERQRRAVLDDAVEAGGLVVDHETAAHRVVLAAADLQAGGVEGTEDHAIGMVGQRLADQRKVFLLDEADRPLAEQAQLAAGTDGIEPSGNRGGIHRVRLLALQAEQYRLVAAVALAGGAERAVQLDLDAGSGLQQPLAPQPLGKARGGTHRPHGVGAGRPDADLEQIEDTQGHARLRLRIGRHHGGAPVQSA

SEQ ID NO: 23690 - protein, 108 aa, Pseudomonas aeruginosa
TGKCRQNSPTWPLTRSPTSGLSISSRMSQIQPASSRHSPSRKPRVVTAGVPMRMPEVTNGLCGSFGTAFLFTVMCAAPSAASAALPVSPCFTRLISIRWLSVPPETTS

SEQ ID NO: 23691 - protein, 1061 aa, Pseudomonas aeruginosa
PWSWSCLLNMALASCRVGVRTLAGASVAAAPLRKRGAGKGVSPETRGRRRWRRPPRPSLLAVRLDGRAGAGQVAVAVDVVDAAHRRPVLGLHQAGQRIGGLLAAVGVVPFAEQFGGGVRRVLQRVVFLVQLAAFHRADFLADADHRVAETIQLGLRLALGGLDHQRAGHREGHGRRMEAEVHQALGHVVDADPAAVLERTQVEDAFVGDQAVAAGVEHRVVLLQAMGDVVGIEDGHFRGALEAFAAHHADVHPGDRQDARAAVRRRAHRAFLALAASVAGEERRQVRAHADRADARAAAAVGDAEGLVQVQVGNVATELARGAQADHGVHVGAVDVHLATAVVDDGADLADRFLEHAVGGRIGDHQRGQAFLVLAGLVAQVLDVDVAARVAGHHHHAHADHAGGSRVGTVGGGRDQTDVALAVAAALVVGTDRQQAGVLALGAGVGLQRHGVVAGGGTEHRLQFVGELAVAFALLGRGERVQVAEFGPGHRDHLAGGVQLHGAGAQRDHRAVQRQVLVRQLAQVAHQLGFRVMAVEDRVAEDRRLAQQLDRQAVPAAGGKGGEVRERLALFSQQAPERFHVGLADGLVERQAETAGIDLAQVDPGGAGLGMDRRGTRAGGQAQGVEEMLLLDGHAQALQAGGEDRGQPVGAPGDAQQALRAVVDGEHAGDVGQQHLGGADVAGGLLAADVLLAGLHGQAVGRLAVAVDGDADQASRHVPLEGVAGGEIGRVRAAEAERHAEALGAADGHVGAELARRGQQGQRQQVGGHRDQRIDRMEAADQFAVVDDLAVAGGVLQQRAEVGGEVFDGALVADHHLDAQRLGTGAQHVEGLRVAMAGGEECLAGAVLRQTLAEGHGLGGGGRLVEHRGVGDRQAGQVADQGLEVQQRLQAALGDFRLVRRVGGVPGRVLQEVAQDRCRGVAVVVALANEGTQRAIARGDRLQAGQRLGLAHAGRQVEHAAALDAVGDHVADQRVQRVVAQALEHGLGVGGTRADMAGDEFVVGAQVDGAEVQVIGHDGILRRRRWRSAGGRRRPGRAAFPRRRRRPDGSGRTRPRRADPG

SEQ ID NO: 23692 - protein, 192 aa, Pseudomonas aeruginosa
QQRFFRQSERIRSTRNRSVTADGTAPVAASWRAGARGTRGPSACCAGAPDRGHGWRARTAPGRSGSRRAGAPAALHRAAARRSTAGRTAGPARPAGGRAGSRSCRWPVAGAAGRYAGGRRRAPSTRSSGSAKGAGRPARRAARNPPGLAARVAAPGRRGWRKARSGSAPAAAPPAPAGQWGRRAGRGRSRLR

SEQ ID NO: 23693 - protein, 639 aa, Pseudomonas aeruginosa
SYRFRQWRRTSPGHSICPSTPSVPAQVLCVAPGSAGPALWLVSPCPGHATQDQEAKETTMKQRIPTLLAGACLAIPLHTLGAADLLVVNARIFTANPQQPFAEALAVEDGRILAVGDEAGLRALADGDSQVVDLGGKRLMPGLIDTHSHAVFGGLELAGADMGNEQVGLDELERRLRAWRDNGKARHGDMLNVSGMHTAYWSQVKDFRARFDHGEWADQPLAFIGSDHHTGWANAAMLKRAGIDAARVRALPEEQRNTIGHDADATPNGFLADAGLDAVLAVLPAPSAEQMLEAGRSAVRYSNSLGLTAWMDPAANGSPGDALFSLRPDENTVGVLPVYQRLAKGGELSAHVAALLVANPRSRPADLEVLDKVRQRFLGSPNLTLPGIKVFADGVPEYPAQTAALLEPYRNSRKTGELLIDPAHFGELVSAADARGWLVHVHAIGDRAVREALNGMQQARRDRDSGIAHSITHLQLVNPKEFERFRPLGVIASMQLYWAAADETTVDLMKPYISAFAYRYQYPAHSLLSKGATIAGASDWPVSSLSPWKAIQQAVTRKGPQGVLNAGERLDRQTMFYAYTRNAARTIGLEHRIGSLEPGKQADFIVLDRDVFEVPETQLGETKVLKTWFAGKPVYSSEG

SEQ ID NO: 23694 - protein, 551 aa, Pseudomonas aeruginosa
PPVCCPPCCFRPHSPSWPAAPPRPSSPSTMAARSRRWIPRAMIVVPASTNWSNWTASAPASTRTRCAASRTCNPPDPPSARWRTPGKESNHAIRPARGQPAVVERRHPGAQQPQGRPGRLLPQRRFHALSRGTATARPSRRPAPAASAMQRRTGQPEPGAPWRPRHRGRHRRQRHRLRPPAVPRQRHRRRLPARRHPPLAARRRHPRRTLRTGLRLLRHAGLALRPQALGRRHRPGTGSRRALRPGGVPSFRPVLRPTLATGLRLLQPRADRRERRQRLCRRVRRQPGALRLPRRRRELQQPSSQLRVPVGPGRCDRRPARRRPATRTAGGIPLRQRLGRLRRHARRRRRTHAAARRSSAPAADVRPQRKETTMTEERLLRRDEIPLVWEIDRSEVIEHLYSVEAGQLVLRPEFYDMRGWPEGEAEHYTPILLDCFDRGGWFLGLFDQGRLIGAVVLDPRRLGPERDWLQLKFLHLSHAYRRRGLGAHLFHLAATQARHLGASALYVSATPSQNTVDFYMRLGCRLCMEPDEELYRLEPEDVHLVYQILSA

SEQ ID NO: 23695 - protein, 150 aa, Pseudomonas aeruginosa
PPTSTTPVAWRPRAPRPPALRRRAPSQPTGTRPCSSRCRSASPAGSPATSTTPRDARPARPSPPADKADPHAHPPILPPPRRPRPGLRPRPARAGGRARLELQLQRPRPDQARRRSAHRCAGRHPLCLRQSRQPDPGDQRPRPGHPPRRL

SEQ ID NO: 23696 - protein, 618 aa, Pseudomonas aeruginosa
RGRPDHPRHPRRRQLAELRIRRRTAPGSDRQQPRRTPRIRRRHQGQSHRPAHQGRQRQPGAPAAMGLRRAWPAAPCGRRRRPDTQLRLRPQRQSGRRNQPAPVRPQPGLRCPRPAGRPERSPRRQDPTRLRRPGQPHRGQGPARCHHPLRIRRPRQPDPTGQPGQRHHHLRARRRRQRHPPHRRSRCGHRVSLRRPQSAGRAPLAERPEPRRTVPLRPHRRRQQGHRPPGRHRWRSRQPGVPLRRARQPGRAGAQHPPRPADPARPRDLPLRRGQPTAGDRLPLRPRHRLPAQRRRPGRQRDPGSGRQGAEHPGRADRLPALRPAAAPDLGQRHHSQPRVRPGLPTAAAEGRPLAERLPARCQWQYPAAPPQPLGHPGLPVRPAGPPDRGTRRPGRAQLCLRRGRQPHPTQRQPRLRRHRQQPGLPVRARQQPIDRHRRASGDQRRRRQPHPGPRRAQTGLRRPGPPAKRQPRRPAGRRIPLQRPRPAHRQAHPRERHHLPLWSRRPVARRSRTRRQRPETASPVLPVAGQPAAGHHRRRLRRPGQGRQPDPALPPWRPPRHPAPGHRRQRPDRLAVAVRRLRPRRSAEPGQHPGQPALPRAVLRCGERAALQLLPRL

SEQ ID NO: 23697 - protein, 777 aa, Pseudomonas aeruginosa
CAAMTRPRSPRSRNSKARPAPGLNKWLGWALKLGLVGLVLLAGFAIYLDAVVQEKFSGRRWTIPAKVYARPLELFNGLKLSREDFLRELDALGYRREPSVSGPGTVSVAASAVELNTRGFQFYEGAEPAQRVRVRFNGNYVSGLSQANGKELAVARLEPLLIGGLYPAHHEDRILVKLDQVPTYLIDTLVAVEDRDFWNHHGVSLKSVARAVWVNTTAGQLRQGGSTLTQQLVKNFFLSNERSLSRKINEAMMAVLLELHYDKRDILESYLNEVFLGQDGQRAIHGFGLASQYFFSQPLAELKLDQVALLVGMVKGPSYFNPRRYPDRALARRNLVLDVLAEQGVATQQEVDAAKQRPLGVTRQGSMADSSYPAFLDLVKRQLRQDYRDEDLTEEGLRIFTSFDPILQEKAETSVNETLKRLSGRKGVDQVEAAMVVTNPETGEIQALIGSRDPRFAGFNRALDAVRPIGSLIKPAVYLTALERPSKYTLTTWVQDEPFAVKGQDGQVWRPQNYDRRSHGTIFLYQGLANSYNLSTAKLGLDVGVPNVLQTVARLGINRDWPAYPSMLLGAGSLSPMEVATMYQTIASGGFNTPLRGIRSVLTADGQPLKRYPFQVEQRFDSGAVYLVQNAMQRVMREGTGRSVYSQLPSSLTLAGKTGTSNDSRDSWFSGFGGDLQAVVWLGRDDNGKTPLTGATGALQVWASFMRKAHPQSLEMPMPENVVMAWVDAQTGQGSAADCPNAVQMPYIRGSEPAQGPGCGSQNPAGEVMDWVRGWLN

SEQ ID NO: 23698 - protein, 369 aa, Pseudomonas aeruginosa
REEDFRIRRACRQCRARGLRQPAARGDPGGGFRYSGVQPGKRRFPHHPYPGTAYPARRRHPGHSPGRRLRCGGDGAAGRQFRTDPDFPGAVRRRADQQRSARHRHPVPGSAQQRLHATAGWQLQHAAQRRQSFRAHRHSGLRLGRQPGGRRAVGRAGPGDAHNRPATAGQRRPEQRRRQPRASPAHRSARAAGALSPGPGAPGPGRCGPGRAGRAPWLELRQWPAGLAGRALGTDRPGSGEAGRLRRRCAGPAEGQGQLLMDRRVYALADQLLLIERELRALGWWSESSPAPEALASPEPFCVDTLALEQWLQWIFLPRMKLILESDSALPQASGILAIAEVAYAQRGEEVAGLLAALGEFDRLIGGPS

SEQ ID NO: 23699 - protein, 580 aa, Pseudomonas aeruginosa
RSRGENVELLSGAEMVVRSLRDEGVKYIYGYPGGALLHIYDALFKEHDVTHILVRHEQAATHMADGYARATGKPGVVLVTSGPGATNAITGIATAYMDSIPMVILSGQVPSNMVGTDAFQETDMVGISRPIVKHSFIIKHPSEIPEVIKKAFYLAQSGRPGPVVVDIPKDMGDPTQKFEYSYPKKVKLRSYSPAVRGHSGQIRKAAEMLLAAKRPVVYSGGGVIMGNAAAPLTELAQMLNLPVTNTLMGLGGYPGADRQFLGMLGMHGSFTANLAMHHSDVILAVGARFDDRVINGAAKFCPNAKIIHIDIDPASISKTIKADIPIVGPVDSVLTEMVAIVREIGETPNQDAQAAWWKQIDEWRGNRGLFPYDKGDGSIIKPQTVIETLYEVTHGDAFITSDVGQHQMFASQYYKFNKPNRWINSGGLGTMGFGFPAAMGIKLNFPDDDVACVTGEGSIQMNIQELSTCLQYDLPVKIVNLNNGALGMVRQWQDMQYNSRYSHSYMESLPDFVKLAEAYGHVGMRITDLKDLKPKMEEAFAMKNRLVFLDIQVDASEHVYPMQIRDGAMRDMWLSKTERT

SEQ ID NO: 23700 - protein, 298 aa, Pseudomonas aeruginosa
SLGRRSCLPSQKCCRHIRTPSVPKELSMSERPEEPNKASDEESLLPIDEHIEEGHDAEGRKVRHRGIYLLPNLFTTAALFSGFYAIINGMSGQFANAAIAIFVAMVLDGLDGRVARLTNTQSAFGAEYDSLSDMVAFGVAPALVAFEWALGSLGKVGWMVAFIYVAGAALRLARFNTQVGKADKRYFIGLASPAAAALVAGTVWAFSDFEIQGAKVAFLVALLVAAAGVLMVSNIKYHSFKDLDLRGRVPFVAILIVVLAFAVVFTDPPRILLLLFLAYAASGPVQYLLQLRRRKQPS

SEQ ID NO: 23701 - protein, 349 aa, Pseudomonas aeruginosa
STGTKLVIAEPVMLIKIPSRSDCSESEVTSETLYLSRRRLLGASFAGLALASGLPRLGFADEQRYAGVEPVPAPGWFAEKLPQTRWQAVDVQREAITPFKDATHYNNFYEFGPNKGDPAENASALKTEPWSVVIDGEVGKPGTYALEDFVKPYQLEERIYRLRCVEAWSMVIPWLGFPLADLLKRVEPNGQAKFVRFETLQRPEQMVGQRSGFSVIDWPYMEGLRMDEAMHPLAILAVGMYGRLLPNQNGAPLRLVVPWKYGFKSIKSIVRISLVREQPKTTWESIAANEYGFYANVNPQVDHPRWSQARERRLPSGLFSPNVRDTQMFNGYGSEVASLYSGMDLRKYY

SEQ ID NO: 23702 - protein, 506 aa, Pseudomonas aeruginosa
AQANGYPTELLDDHRALEPPDPFPNSEVKRRIADGSVGSPHVRVGHRQAPIPKPLVSDDQGFCFCAWKKACFLASFLDCECRRRLSQLPWKLPILHETDGRLPPPGGSKTRSRGPPRPLRERLEPLCFQAFRGVAGLLPRLAEKCRKADGISSNCHIPFIESSCGLTILAPVPSNPILSKEQGMKLKRLMAALTFVAAGVGAASAVAAIDPALPEYQKASGVSGNLSSVGSDTLANLMTMWAEEYKRLYPNVNIQIQAAGSSTAPPALTEGTANLGPMSRKMKDVELQAFEQKYGYKPTAVPVAVDALAIFVHKDNPIKGLTMQQVDAIFSATRLCGSKQDVKTWGDLGLTGDWAKKPVQLFGRNSVSGTYGYFKEEALCKGDFRPNVNEQPGSASVVQSVSQSLNGIGYSGIGYKTASVKTVALAKKEGAAFVEDNEQNALNGTYPLSRFLYVYVNKAPNKPLDPLEAQFLKLVLSKTGQQVVVKDGYIPLPAKVAEKAIKELGL

SEQ ID NO: 23703 - protein, 128 aa, Pseudomonas aeruginosa
TVATSCWKTPTPRSPRAPNCWAASRCWWATPRVASPSGSWLAIPTANRACRTFATSIWMARRSAPSLRNNGARASSPWTRRATSASSTAPRTVPCWSSRSPTLPGSSPCRRGPTACCWSRVARSTASP

SEQ ID NO: 23704 - protein, 508 aa, Pseudomonas aeruginosa
SVSVCARNTRRCKRRRYSSVKQKQETVKAWFGSGSPWVWMNAGAVSIAVIMTIGLLAVIAVRGLGHFWPANVIEASYQIPGEAAKTVIGEVVQAEEVPRARLRSAGMPVPEAGPEFMTRELLKLGNRELYGSDFSWVVGEWLQDIKRPEALMVLERREWGNFYGYLLSVKENGQVVAEGDAAVGELQKRMQRVDDLYAKLYKLEKGDIGGINHGLERLRLKERKLQLDGKLDAAAQADLAAERSELQARYKVLEEQLNGLHQEFNRDSVVMRDASGRESEITLGKLVHAYQPNAMGLGTKMTVYFKKLWEFLSDDPREANTEGGIFPAIFGTVMMTLVMALIVTPFGVIAAVYLREYAKQGPLTRVIRIAVNNLAGVPAIVYGVFGLGFFVYVLGGSIDRLFFPEALPAPTFGTPGAVLGLADPGDPRRAGGDRRHRGRPGADSARGPRRLPGARRDQGGNAVEDRPADGQPGDDDRPDPRRGPCRRRSGAADAGRRGETGTVAAGRR

SEQ ID NO: 23705 - protein, 257 aa, Pseudomonas aeruginosa
LVDVTGRSGSRRIPHMINKDSLTHHISQQFNAELEDVRSHLLAMGGLVEKQVNDAVNALIDADSGLAQQVREIDDQINQMERNIDEECVRILARRQPAASDLRLIISISKSVIDLERIGDEASKVARRAIQLCEEGESPRGYVEVRHIGSQVQKMVQEALDAFARFDADLALSVAQYDKTVDREYKTALRELVTYMMEDPRAISRVLNIIWALRSLERIGDHARNIAELVIYLVRGTDVRHIGLTRMKEEVENNRGE

SEQ ID NO: 23706 - protein, 149 aa, Pseudomonas aeruginosa
PTGGQDQEGPEPQRQAGSPGGPRAAPGDRQRHGQRFAGRPDRWSRRGDQACRQSGKTGPRAEAGFGSPGQRASRRQRQPAGAGAIAPAAEQHALRDQGGQSEGSATGGEARRPVAAGAGKRGAGPRGKQRRGAPERLPARHRRAGAEAG

SEQ ID NO: 23707 - protein, 463 aa, Pseudomonas aeruginosa
SSATSAWRWSRFPTTSPSRSTACRTSPSSASLEKSPAPWRRRLVSVELDHLGQDDLRTAHLLHDDPQALGVEDFLFLRHPLQGVVDQPGESVRLDMIEVDAEQALELEQRCVAAHQQLARLVGEDAALGLAVFVLDVADQHFQHVLHGQEADHLVIGLFHHGEVRAALAELLQQARQWGVLGDDLQRAHQFVEVEGLRQAVQGGQRQQQVLDVQQADELALVAVPDRVAAVLMAADHREDVRQRRVVLEVDQVFAGVGPVDHLQFAQLHRRGQHAHALVAGVLGAAGVEDQLQFVAAVVMLVVRAGLALAGDLEDGVGAGVEQPDRRVHQPVEEVQRHRRPQRQQFRLADRPGLGRQLADHDVQVGNDEERGEEGDTADQFVGMHADHRQQRFQEFGEGRLADPAQAQGGQGDAQLAGGQVGVQLVVNLAQDGAAPAVLLGDGFHAGGAELDHGELGGGRRSH

SEQ ID NO: 23708 - protein, 377 aa, Pseudomonas aeruginosa
RQDGRLARRPAGHGLDGRRPARRSTQRVVGDRAEEDRQASPVVVQEGAEAGLRVAVAGRPGFPDEAGRRHRQAEVEAQAQFEAVAGQRQQEQGQALQAADDQAVGIAEEDCGGLDADLQVVLAVGHRVVGVVGDRPQHVGQEQQPGAGRQFTALGGEGHQDAPGIGGAQHHLRIVGVALHEGVERGHGYRAERQPDGRCVGQQDQAEAQRDQDGEGDPGLAHADLAGGQRARLGACDVAVEIAVGEIVDHAAGGAHQDDAEDEDQQVLQFRHAVRGDPQRPEGRPEQQVDADRPVQPHQLDEVPGAGVQAGQRLDQGDEHGDLRSRPGDYTSAIPAWSHRRGRYTSATSTPSAPRENRERRPQRPSARTSAGRPAAG

SEQ ID NO: 23709 - protein, 527 aa, Pseudomonas aeruginosa
TPAGPRRPRGTGCGRLLIPPTTTTRTAAMNILYDERLDGPLPQVDKDGLLAELRLRLPDLELLHAAEDLRPYECDGLSAYRCTPLLVALPERIEQVQGLLALCHRLKVPVVARGAGTGLSGGALPLENGVLLVMARFRRILEIDPLGRFARVQPGVRNLAISQAAAPHGLYYAPDPSSQIACSIGGNVAENAGGVHCLKYGLTVHNLLQVDIVTLEGERLSLGSSALDSAGFDLLALFTGSEGLLGVVVEVTVRLLPRPPVAKVLLASFDDVESAGRAVADLIGAGIVPAGLEMMDNLSIRAAEDFIHAGYPVDAAAILLCELDGVEADVHEDCERVRELFEAAGATSVRQAQDEAERQRFWAGRKNAFPAVGRISPDYYCMDGSIPRRELPRVLHGIAELSREYGLRVANVFHAGDGNMHPLILFDANLAGELERAEALGGRILELCVAVGGSITGEHGVGREKINQMCAQFNADELTLFHAVKAAFDPAGLLNPGKNVPTLHRCAEFGAMHVHHGRLPFPELERF

SEQ ID NO: 23710 - protein, 172 aa, Pseudomonas aeruginosa
AWTCRWRRRCASWPSGEASHCRSVRPATTAKPCACAWRAARARYARRATASVAKRSRTASGPTCASSACRSSIDPRPLWRLSLPALAPETPLPGRQLLDWGGALRWLKSDAPAADIRAWTAAHGGHATCYRAGHLDAPFQPLPPGLLGLHRALKRQLDPQGIFNPGRMYAEL

SEQ ID NO: 23711 - protein, 411 aa, Pseudomonas aeruginosa
GGAMQTNLCDSARQRAEAAEAERILRSCVHCGFCNATCPTYQELGDELDGPRGRIYLIKQFLERDEASERTRLHLDRCLSCRNCETTCPSGVEYHKLLDIGRDLLAERLPRGFRQRLLRDGLRLLAPRPGLFGALAGTAGRLRPLLPEAMQGKLPRRVAAPGRRPQPRHARRVLLLEGCVQPALSPNTNAAAARVLDRLGISVTPAAAAGCCGALDFHLDAQERGRQRARRNIDAWWPLLREGAEAIVQTASGCGAFVKDYAYLLRDDPRYADKAHEVAAAARDLVEVLRDEPLESLGLRCDQRLAFHCPCTLQHAQRLGGAVEAVLRRLGFHLTEVADGHLCCGSAGTYSLTQPALSRRLRDNRLDALESGAPDVIATANVGCQAHLDGAGRTPVRHWIELLDQALPGGE

SEQ ID NO: 23712 - protein, 84 aa, Pseudomonas aeruginosa
PPGAGRSARNAAGRHAPGPGSRNCAAGRPGSSGRTPGAARAAWRGSGPRSPRRCKSLAASRAWPAVAGPWAGSGSCPGRGRGPG

SEQ ID NO: 23713 - protein, 178 aa, Pseudomonas aeruginosa
GNAARRGSRSAPSAPPGSRPLWLAGRRGRRPRSCRHRRRLAPGAASARPGPGRRRSPRRPGVARRSAGSRGWQGSVSASGWPPASAALPASARLRAGAAGITGGSAVLRRPGATAPSAGLRPVPRCRHPAAAGAGSGSPGRAGQVGSRGPVPPAASRAGCWGRAWPGPVGSTGAGAAG

SEQ ID NO: 23714 - protein, 288 aa, Pseudomonas aeruginosa
EGDGFMSQTVMIAGCGDVGGRLGEALLADGWRVHGLRRSVDALPQGILPVAGDLQAPECPAQWPSEPLDYLVYSAAASQHDEAGYRAAYVDGLRHVLGWLQARGQRPRRLLFVSSTGVYAQTDGGWIDEESPALSQVYSGRIMLDAEQVALDSGIPATRVRLAGIYGPGREWLLNQVRQGYRVVSEPPLYANRIHADDAAGLLAFLLRADAGGQALEDCYIGVDDAPVAMHEVVDYLRQRLGVSQWADEHSVRRAGSKRCSNRRARALGWVPRYPSYREGYAAVLGDA

SEQ ID NO: 23715 - protein, 532 aa, Pseudomonas aeruginosa
NRVGAGAPDDTGKSGSATQAGDPDHSLEGAQLLDDAGQVDAIVHADDQLDHADATVALVHADLLDVAVGRVDAGGEQGDQATLVLQFDAQFDIEFAGDILGPAELDAFFRVVAYFADVLAAFQVHHHALAGGQVADDRVAGNRRAALGVAQDQAFGAADRQRTLGAWRFLALAGQQAAGDHVGHAVAQADLFQQVLEDFHAVLGEHGLDAFLRNLLEVAVEAGKGLVQQALAEVDRLGAALQLERMADMGARLAGDHEAQPGRVRPGARGGDDFHRLAALQRLGERRQATVDAAGDATVADVGVHRVGEVDRGGTLGQFHDAALGREHVDLVREQVDLHVLDEFQRVAGALLQFQHALHPLPGAGMGALGRLVVGLVQPVRGDPVVGHLFHLAGTDLDLDGHPVHAEQGGMQRLVAVGLGNRDVVLEASGERLVQAVHGAQHAIAGIDLVDDDAEGVDVHDLVERLTLAAHLLVDAVEVLLAADHLAFHAFAGEAVDQRLLDLADDLAAVAAGLLHRLADALGAHRVHGLET

SEQ ID NO: 23716 - protein, 249 aa, Pseudomonas aeruginosa
KIANLYGRADLGEQTTEQFGVALLLGVLAQLAGAEDRLEVVQGVGEIVVDHQVIVLHVVAHFADGFAHAPLDHLVAVLAAVGQALAQGFLARREDEDRLGLGHQPAHLLGALPVDLEDQVEAFGEGFLDPALRGAVEVAEDFGMLEELVALEHGEEFLAAGEVVVDPVHLARTHAAGGMGDGHADLGGGVEQGLHQAGLAGAGGSGNDVQGAGHEVFLVLRTGWKEIGRRRPRVIRCSGPARASARSGP

SEQ ID NO: 23717 - protein, 181 aa, Pseudomonas aeruginosa
PARGQPRQAGRSYPGDPAPDRPLPASGAGPQQARREHPVHRLRRDPGRRRHPHRLDHRRHRGADRRPGGAEEAWRAQGQSAEADGRRRFRGHLPGRAGPRPGLPGGFRRGNRPERSDDRCRRLHRGAGNRRRRAVPSRRAERHARTGPAGHAGAVRTSARRAGRMSRRPALPAGPRRRSAT

SEQ ID NO: 23718 - protein, 232 aa, Pseudomonas aeruginosa
RPIAPNTVSEPFTRDWHGRTGCNALPDGPGAGAPGDFLRRPGGAGRSGGAVPLRQRQGRGGARPPGCAAAVHRQGLPGPQRPGPGYPHRTAGADRRGTAAAQGGPSPGQLRCAAAAPVFQPRGRRPRSRTAPGGTGRAEQRGARQPAVAQAATGQPARPGGQPGACRTSGGAGAGGPVGRSQAGGKAPAGRDRAFPEGPRRRGKNLCRRPRAALPATRRESLIPLATVARTP

SEQ ID NO: 23719 - protein, 216 aa, Pseudomonas aeruginosa
RRCPADRPPPSEPAGNGRRCSSGAVLRCSCRLLDAAADIDSRPPSRGAKGLAAEPPVAGPHCPHPRGVAALVLFDENARRAQRERNTMSSTLRPGPGNSRLCRPGLLLALGLMLVACGESTEPPARAADSQRVPADPALAQVYSASCKLCHANPASGAPLTGDAAAWAPRLAQGIDTLLDHSINGYKGMPPMGMCMQCSEKQFRALIDFMSAAQDR

SEQ ID NO: 23720 - protein, 431 aa, Pseudomonas aeruginosa
PERSDAVNRRKFMFAGLGAGALLAGAAAWMRPADRGGPYDDYFRALNRELKANGPMCPVLLIDLDRLDHNIDVVMRSVRRGGKHLRLVEKSLPSPGLLAYIARRAGTRRLMSFHQPFLNHDAVAFADADILLGKPLPVRSAELFYREHKGAFDPARQLQWLIDTPQRLRQYLALAQGLGTRMRVNIELDVGLHRGGVADQAALGELLALIAAHPQHLEFAGFMGYDPFVGMGVPGILGSPEELFAKVMALYQGHVDFARQRFAALWTPQLTLNTAGSPSYRMHEKETLSSEVSVGTAMLKPSHYDLASLAEHVPAVYIATPVLKSTGAVQIPALDGKSRLFSWWDPNQRGTFFIYGGNWMADFASPEGLRSNGIYGRSSNQEMVNGSPSVGLEVDDQVFLRPTQSESVLLQFGDLLALRGGRIVERWPVYA

SEQ ID NO: 23721 - protein, 175 aa, Pseudomonas aeruginosa
GAGVRHRGVLRQPAGVWACPGQPGVRTAGHRTHPCRSALRGRVPAPAGPPGTLRLPAQPHGDRQPLAGHAPAQPQPAGVAPGAGPAGAGKHPGAPETRPGPGGGTGHRPRPQPGQPDRKDFRRTEHEQPHPAAPAGRTRADLRGVAGAGATRAGDEPAGQPWDVHRTYHRGSGIP

SEQ ID NO: 23722 - protein, 141 aa, Pseudomonas aeruginosa
  UNSURE (86): Identity of amino acid at the above locations are unknown.
GRCRGCRRAAPAAPRVPAAAARPGSKRRCRACSSVSSSDCRCPALAHPCPAPAYRVAAAPGPVRRRTAGPVVPGRHRPARAAGRAXAVAGRPPAAACLAGSGRRRAPARRCTAASAGRPCRLRRRRSGHFPPGAGYPGRRS

SEQ ID NO: 23723 - protein, 314 aa, Pseudomonas aeruginosa
PGRGCRCPGRPGRARSGGHRPRRPRPAGCAGRPRCGWRRRFAGLRGRGGWPRRRGCRRRVAARPGARRRPGLRPRPRPTGAAAPHRRRRRRRTRAGRRRPPRPVGWRICRATGPCRQRVRTLPWRGFFSGSSTSPNSFPSLGGALEKLHAASPRRLVLCSGSVAAGMAEAAGAALAFVERFDQLEMRLHHRHQYQLRDALADGDGERRLAAVPARHHQLALVVRVDQADQVAQHDAVLVPQAGARQDQGGEAGIGDVDGQAGGNQQGLARAEDAVFLEHGAQVQAGRARRGVLREREVGAQAGVEDLGLERVHQ

SEQ ID NO: 23724 - protein, 474 aa, Pseudomonas aeruginosa
LSVLVVLASWGQGGASRPPGSDAGADGLGQALDDLVDVGLVDDQRRRHGDDVAGHPDHQVVLPEAALEDVVAALAGAVRVRRQLHAADQAYGADVDHVGQVAQAEQRVLPVAFQFDGPLEQVVATVDVQGRQGGGAGYRMAGIGIAVEELDGALRALHEGSMDLLVDEYGAHRDAAVGQPLGAGQQVRDDAPALRGEGFADAAETGDHFVEDQQDAMLAGYLAQPLKVALGRQHHAGRAGHRLDDHRGDILGAVQGHQAFQLLGLFHAMLGQADGEGVAGDVQGVRQVVDPRQQVGGEGLAVVDHTAYRQAAEADPVVAQFAADQAGAGAPADGALVGKGDLQRGVRRFRAGVGEEYFVQARRGDFRQPRGEFERQRVTHLERRGVVEGGDLPGHRFADLAPAVAGIAAPEAGGAVEDAAPALGDIVDAFGAFQQARPHLELAVGGEGHPEVVEAARLRLVIHCHRATQVAREG

SEQ ID NO: 23725 - protein, 183 aa, Pseudomonas aeruginosa
RSRRHSPCRAGPGDPRAGRRGRRHRAVELPAADVLLETRSGPGHRQLGDPQALREVAADRHPHRPVGRRGRHSERRVQRAAGLWPHGRQGAGIAHGCRHPGVHRFDQDRQATDGLCRRVEHEARLAGGRRQEPEHRLRRRPGPEGRRRSRCRRHRLQPGRSLHRRFAPAGGALHQGQVPAPGD

SEQ ID NO: 23726 - protein, 433 aa, Pseudomonas aeruginosa
VGPSGPALSSHTRGRVSFWKPGRCASCAGYIRSPRQGFRGANGRIAMRWGSYFAVCSAVISIGLALGLTMPLVSLRLESWGYGSFAIGVMASTPAVGVLLGAMIAGRLAARVGTPRLMQLCLLTGAASVGLLALLQSYPVWLLLRLLIGVQLTVVFILGESWINQLAVEKWRGRLVALYGTGYALSQLSGPVLLTFIGTADDRGFWFGVCLLIAGSLLLLGRSGAPRVDPHSASGRGLWAFCRGLPAIAWAVVLFAAFEAMILTLLPVYGLRQGFPQAVALAMVSTVVVGDALLQLPIGWLADRVSRSGLFGGCGLVLLLSSLAIPLLLQTPLIWPLLVLFGASAGGLFTLALILIGERYRDDALVRANAHVAQLWGIGCLLGPLATGAASQWISGHALPLMMALGAAGFVVLVRLRGAIPADDEATGLEASE

SEQ ID NO: 23727 - protein, 382 aa, Pseudomonas aeruginosa
RKCDLPPAGCGGCCGRSCPARACSDAGYAWMEAPRLARKIRKFSANITSKAGKNTGQGKRLDLARGPRHPWPGRQRTEVGHAFAQKDDVAAGICSAVAAGVRLRLACLAQPVARAGCRAPGVARPGPVRRRHRAATAGAGAARRGWRQPATGRGTRAAALARAVGLASASTRPARGASGARLATGCREFRRRRRCAGLDVPARDPRLAAGTDPPRTLPSRPALSRRPLRAGRRTGHRPPVGSAVSAGCATAPATGGAAGPARRPALRGAYWLAPADARATRPAGAADAGQPARAVRWRRPLAGAPGGARPAGHPWPGGLAQSLVAGSPAPARRTASPASASGLDDPPGAWQRLAGAAPGARRRWLGGAAGAGSASLAAARSG

SEQ ID NO: 23728 - protein, 289 aa, Pseudomonas aeruginosa
RHRVAPGVHQRGREYAEAGDAARPAGHLAVGRQAGGGSLAGGRAAPAIPGLESRATGRGDSPGGPAGRAARQPLLRQGRAVAGGVPGRAVDAAPWPAPPRPRRGRSRTGLPAAGAAFRRAAAGAGRTTPPGQPQTVGLDLRGAARHHPRAHQPEGTAEQRRGVGGGHPAAARREDAPGALRQAGRGVLPYRQSAGRDPRRLAGAARTGQWASDRRGRLEARCGGRLVPRPGPDPERPRRYLRPQRAEGAGRQPGLAPAWRSVEPGQPRPEPGRGQSRPAAGAGEFPRAL

SEQ ID NO: 23729 - protein, 89 aa, Pseudomonas aeruginosa
NHSPTCAGAHAETQGFGAMSHTGEPPMRLCALFAVLLLGSLTMACTPTVQLAAPSEPININLNVKIEHEIYIKVDKALDGIINENSGLF

SEQ ID NO: 23730 - protein, 118 aa, Pseudomonas aeruginosa
RSGSMTTRSKLGIALLALGISLSAMAMDLGQAMSALGGAKAQGLVGEQADGYLGVVSNSGQAADIAAQINAARRAEYQKVANSSGASLADVEAMAGKKAMERTPAGQYVQVGGKWVKK

SEQ ID NO: 23731 - protein, 71 aa, Pseudomonas aeruginosa
TRSAWSACPSTAAIASTNCAPRPASPTRAAPSAPPNCSAPRRSWTPPARTSPCSSAPACPTRFSTATASPA

SEQ ID NO: 23732 - protein, 143 aa, Pseudomonas aeruginosa
WRRSARRSVPKAWIFPAIAIPRRTPRMPIQRQHTNERMSQIVVHNGTVYLAGQVGEDMSAGVEQQTRETLAAIERLLEEAGTDKTRILSVTIYLKDIDADFEGMNRVWDQWLPRGVAPARATVEAKLCEPEILVEMSVVAALP

SEQ ID NO: 23733 - protein, 387 aa, Pseudomonas aeruginosa
VLSGPAGEPGFFSPDERCAMPHLAEERPVAMRPARALIDLQALRHNYRLAREATGARALAVIKADAYGHGAVRCAEALVAEADGFAVACIEEGLELREAGIRQPILLLEGFFEASELELIVAHDFWCVVHCAWQLEAIERASLARPLNVWLKMDSGMHRVGFFPEDFRAAHERLRASGKVAKIVMMSHFSRADELDCPRTEEQLAAFAAASQGLEGEISLRNSPAVLGWPKVPSDWVRPGILLYGATPFERAHPLADRLRPVMTLESKVISVRDLPAGEPVGYGARYSTERSQRIGVVAMGYADGYPRHAADGTLVFIDGKPGRLVGRVSMDMLTVDLTDHPQAGLGSRVELWGPNVPVGALAAQFGSIPYQLLCNLKRVPRVYSGA

SEQ ID NO: 23734 - protein, 208 aa, Pseudomonas aeruginosa
YGRLGVASRVRPRFALPARRIRRTPPLDVGARLQTIRKLKGLSQRELAKRAGVTNSTISMIEKNSVSPSISSLKKVLGGIPMSLVEFFSLDLEQDSHTQVVYKADELIDISSGAVSMRLVGKAHPSRAIAFLDETYPPGSDTGEEMLNHEGEEAGVLVDGRLELTVGSETYVLERGDSYYFESNKPHRFRNPYDVPARLISATTPANF

SEQ ID NO: 23735 - protein, 250 aa, Pseudomonas aeruginosa
KPRSSICPVCNNAGTVSRKAASWRLFRIRGAGFSRWRIVPPANRVQTSGYPFAGGHRLEPNLFHRRRSRSLAADHRGPDSHGPAPRAGQAQPTGQCVVPAPADPAGAPTDAVYRAFPGASRRWRRPATAFPRAFRRTGLRRLPGAGLPARPTPRRTAGEHPRRGVLPAARQPAGQRAGAAALHQLQLQPRRPRHQCQGRQRGGPAGGAASRAAGQAEPGLQPGYHPGPPADAGEASRRWRDHRRHRRGPR

SEQ ID NO: 23736 - protein, 152 aa, Pseudomonas aeruginosa
RGSDRRAAGHRRLALPAGAGRAGPVGRQAAEGFRPARTLSQQYPGAPAGLAPGPRSGAAGVSPGQRFRRDRAGPAAGAGLAQAQAEAERDPRTGQGDPGCAGARSLPGASAAHGPGRSAGASRGTLPALAAGRPASQPGRAGLSGAQSRNST

SEQ ID NO: 23737 - protein, 265 aa, Pseudomonas aeruginosa
RLDVLEAPAEHGLGGVERGVGDLAELDLRRHHQLRRVGMHVQQRRTGLGEELLHRRLELLGARHLASVEADHFGETGEVRVEQVGVAVQQALDLLFQLDEVQRGIVQHHYLDRQFFLDGRQQVAEQHGQAAVAGDRDHLALGVGLLQPQRLGHGVGHGAVDQAGEGAALAVAVDVTQQPDHRRAAVGGEQGVLAGVLVEQADQVLRMDQLALAGLLLFFQRPQRALAVLQAFVEEAALLAGFEQRQELGITSPTTPRSMGWRRPR

SEQ ID NO: 23738 - protein, 728 aa, Pseudomonas aeruginosa
LANFGRAWSGKSSSPEARHRARHFCENRDSRGAAGSALEHGADVGEGGVALGRLDLLRGVFHAFPFEVFGGQFVEEAARRAVDDLAVLLALGGEGHRQVLPRAGDADVGQAALLFHRVGLDAGTVGQDLFLHAHDEHVGELQPLRRVQGHHLHAFGAFLFFLLALQHVAQDQLGDGLLDGHVAFLVALEGVLQCLDEEPDVAHAEFGDLVAGGVLPQPVLVVDVHHHAAQHGDRLVLRALSADIVHPALEALQAFVETAVEVLGQAHLVAGGVHRDLALGGVVAELLQGRRTDFPARHVDHPEEGVVVVGVHQQAEVGHQVLHFLAPEEAGAAREPIGNLVVLELQLHQLGLVVATVEDGELAVRPLGAQVQGEDFHGDALGLGVLVAAADHPDRIAVAHLAPQLLLEYVRVVGDEDVRALEDAAGGAVVLLQHHHLQRREVFLQLHQVFRTRAAPGVDRLIVVADHGELGAVLHQQLDQQVLAGVGVLVLVHQHVAHLVLPLLEDVRMFLEQLHRLQDQVVEVHRVVGAQGALVMQVDDRGGLLLGVAGLFQRLLRKDQVVLPGADVVLDLVDAVVPGILLLHDVGQQRLDVRLVEDRETGLVAEPFVFLADDVQAEVVEGRDGQALALAAAQQGADALLHLPRGLVGEGHGDDVLGADTALLDEIGDLAGDHAGLAGAGASQDQQGTADVVHGFLLPGIESGHRNRPEERVEAGAYSNRLAGIREN

SEQ ID NO: 23739 - protein, 437 aa, Pseudomonas aeruginosa
TPESAGACLFAEHRHHLGGCGHPVRRRAPGAAPGHAGLPAAGDSLSLAGDPAVAAGAGAGAGWGGRLAGRRTAFRGQPAPLPALRARAPGFAGDPATARRAGSADRHRQPPGLPDPARGAPQRIRRAWPGARPPRPGQLPSRQRFPRPPGRRPPDPAGGQPPARLHGERRQPGAPGQRRVRPAAGHPSRSATRRAGRRTHRRMPRRALLDRWREPVAGLQPGTRPCPCRRRCRPADVACAHRHAAGQEPPGLHLPCLRRTHQPWRAQPRRPRSRTAPGAASRRAGAALPAATVPGQRAHRRPGGAGALAPRRAGPAHAQRVRPAGRGERADRAARLLGHRPRPARHAVAQRARPGAVAHGGEPVVPPVPGQPVAADPATVDRRARRRRALARVRTDRDRRDAAQRPGAADHAGARPTGRALFAGRLRHRFLVLRPPQ

SEQ ID NO: 23740 - protein, 351 aa, Pseudomonas aeruginosa
GSGGDGCRDGLSALRMRLFSVRLAWLHKRKNKMPGMSKSHERGNSPMTRRLPPLYALRAFEAAARHASFTRAGEELAITQSAVSRHIRTLEEHFGCRLFERHGRQLQLTEPARLLLPGLRDGFDALERACTALRVDDATLRLKAPSTLTLRWLLPRLSRFRHLNPDIEVQLTSAWMDVDSVDFQREPFDCAVLLGSGQFSPEWETAALFAEWLVPVCDPDEAVEPWTLQRLRDSELLHPTPDRRDWRRWLQRTGLGEEVSLKGGQVFDTLELGIVAAARGYGVSIGDLVMVAEDVAQGRIGLPWPVAVASGESYHLVWPRARRGQERFQRLRDFLLAEVAAMRLPVVERLA

SEQ ID NO: 23741 - protein, 399 aa, Pseudomonas aeruginosa
  UNSURE (155): Identity of amino acid at the above locations are unknown.
RRRTTPGADATLQVAAVAGPGAGFALGSLVVACRERQGTELPSNRPKEPAMTFAKGILAALALAAAVGQASATELEHWPAPAARQLNALIEANANKGAYAVFDMDNTSYRYDLEESLLPYLEMKGVLTRDRLDLSLKLIPFKDQAGHKESLFSYXYRLCEIDDMVCYPWVAQVFSGFTLRELKGYVDELMAYGKPIPATYYDGDKLATLDVEPPRVFSGQRELYNKLMENGIEVYVISAAHEELVRMVAADPRYGYNAKPENVIGVTTLLKNRKTGELTTARKQIAEGKYDPKANLDLEVTPYLWTPATWMAGKQAAILTYIDRWKRPILVAGDTPDSDGYMLFNGTAENGVHLWVNRKAKYMEQINGMIKQHSAAQAKAGLPVTADRNWVIVTPEQIQ

SEQ ID NO: 23742 - protein, 434 aa, Pseudomonas aeruginosa
HVHHQRAGVGRGDEEHHHHQHRHQRDHAAQREVLEEGEQRHRTVLVDHFGQLGEALLQDHVDGGIAEHRHPQQGEAGRDEQHAADELADGAAARDTGDEQADEGRPGQPPAPVQQGPAADPIGGLVGVQVEGLVDDVGQVGPGVLHVGLQEKHGRPEDQHEEQQDHRQAQVQFGQDADAAVQSAGHRERGEAAGGGDQGDLHGLVHRPAEQVVQAAVDLQHAVAERSRHAEHGADDREDIHRVADGAVDTFADQRIQRRAQGQRQAVAIAEEGQDQRDDGVDRPGMQAPVEEGQLHRFLRRLHGVRLAHRRGGEVHHRFGNAEEHQADAHAGGEQHGEPGGVAVVGTTVVGAELDVAVAADGEEHHADQDQRHGQYIEPAGVGDDPLLDVVEQRLRFFLEEHGEQHQGQDQGGGGIEDRRIQGAPGGSGCLHVS

SEQ ID NO: 23743 - protein, 148 aa, Pseudomonas aeruginosa
ATGCARRRRPPAGRAWRRPGPGPRPGLDKGRARGAGRGPGRAAAGPGRRGVRRSPAGGPRRTPSARWPGWPLRHFPSVPPERALRRAPPARPAIRLALAGSPRTGPVRRGTPGRRGRCRATGRWRRGCRVRWPGRSDRRPWVGRRGRG

SEQ ID NO: 23744 - protein, 180 aa, Pseudomonas aeruginosa
SSTGAADEAVAGGRQVAASNGRSRARSGRRVPIMLPRGTGALQSQTLRLDCPRVRFPGASPPNTGESFMKLVTAIIKPFKLDDVRESLSEIGVQGITVTEVKGFGRQKGHTELYRGAEYVVDFLPKVKIDVAIADDQLDRVIEAITKAANTGKIGDGKIFVVNLEQAIRIRTGETDTDAI

SEQ ID NO: 23745 - protein, 455 aa, Pseudomonas aeruginosa
AQPNPQKPQENTNMTLRKIAGLGALLSLALPGVALAAEEPVLNSGDTAWMLISTALVLLMTIPGLALFYGGMVRAKNVLSIMMQCFAITGLITILWVVYGYSLAFDTTGMEKGVLNFNSFVGGLDKAFLSGLTADGLTSATALFPESVFITFQMTFAIITPALIVGAFAERMKFSAMLIFMAVWFTVVYAPIAHMVWSGDGALMWDWGVLDFAGGTVVHINAGIAGLVACLVLGKRKGYPTTPMAPHNLGYTLVGAAMLWIGWFGFNAGSAAAANGTAGMAMLVTQIATAAAALAWMFAEWITHGKPSALGIASGVVAGLVAITPAAGTAGPMGALVIGLASGVICFFAATSLKRALKYDDSLDAFGVHAVGGIVGALLTGIFAAPSLGGFGSVEDIGAQFFVQFKGVAFTVVYTAVVTFVILKVLDLVMGLRVTEEEEAVGLDLALHNERGYNL

SEQ ID NO: 23746 - protein, 700 aa, Pseudomonas aeruginosa
PLRRSAAPAARWHCGRSGGACLTHCSVFSGEQLSTNPNSCYLFRSAAAPDSRRLFSRASQCPPLCRGRPLNGETHEQYPSPRRMPGLRPVPDHLGGEPPGAAVHRLRGAFRLRRGSYRQRFLRLCARRTAGAAGTRRVVRSDRAQAADRRRAAAVDGGHPGDGALAAPGGARRGAPVARRRHGPGIGHRDGLHERTDRGRGFSHLGQLGDRQHLARLRPRRGTDQSVPAVPGEPGARQLLGPAGTGLRGPGGGGGPAGRGAARARYADAAAAVLSRRQPAVRPLDPAGMGHCGSGHRGPAFAAGGPRAGALVGLLDLHRDQLRPAVPAAGAADGAGLGDLPGAGDPAAELCPAGLGRDPRLTGCGAVRCAGREQFLLRLHLPGRAVGGECPGRCGKAAGQRGLLPVGLPRLQPAGDLHRVDRGSLRCVDGVAAFRRVADVGCRCGGVFHLARGRALKGQRFACLGATRDRGPGPSLQAGEQGRQLGEAADLRARLFLPGPGLAAWVEPDGTHAGAARSGDVVAGVVADVYRCRGLDAGALQGFAEWRRVGLADAQFLGAEGEPEVVGQAQAAHVGVAVGEHAEGEAVGEDLQGRVDLGKQGDPVARFEEYLETGLGQAFRLRLWITGVEQGMEQDAPAQLAETVAQHRLAIQQAGADRPQVLDGYRTQARRVARQPFAEQGPRRCSSPGRRPTGCRRGRR

SEQ ID NO: 23747 - protein, 224 aa, Pseudomonas aeruginosa
SVAGCSWVVASIGVALALGAGMGAVVDRGQVLEVQVGIDLGRGDVGVAEQFLHGAQVAGRLQQMAGEGVPQHVRVQVLAQLADAGLAHPQLDRPRRQALAAATDEHRTVFRSGLGAQRQPGFERLARGLADRQLADLVALAAHSHQAFLEVQPFEIEADQFREAQPGGIEQLQQGLVAAGDEVILHGTVEQLQGAVGVEGPGQLARTLRRAQAVGRVVPAAPFA

SEQ ID NO: 23748 - protein, 200 aa, Pseudomonas aeruginosa
QVLVEAARRREQPCQAAAGLALLVQAGDEGAQAAGVEGVPVGEPGLFGEGEDLQQVAAVAVEGVRGDLALAAQMFEEGIQVGAHLGPPAALSGPSAAARRNAAARGPGPRRRSRGTGCRGNSCNAADRDCRWRARRVGPGNSGRPPLRSRSRRGRSRRRGTPVRADAARRRRSCRRRAGRRWPGAPPRCSPSGPPRRYCR

SEQ ID NO: 23749 - protein, 143 aa, Pseudomonas aeruginosa
RAGRDLPTRCAGGRRGGRSAPAIAASPGESRQPPRRRRRCRRLGSRRRRAPRRAGAHGADRAPGGSRCWPSSGSADGLPVADRGCVPVRCRRSRRAARHGDCPWIPRPVRRAGHSPLSHRTRLRARPGTVSRPGPGAADPCPP

SEQ ID NO: 23750 - protein, 194 aa, Pseudomonas aeruginosa
QRPGPRPGERRRRAHRTLRERLAADPQPPGAVAPAVGGCEVGRLPLRLRRGQRPLAPRWQPGTAGRAAQPGDPGAGGRGCRVPRPLRLRRRRWPRPAGACAASTMRTFASAADVPWRKSASGARPTIPAACRSGHRPLDASRWRAVSPDRGDVANSCDCVSVRENPAFGRGFCFFAIPAFHRSTEPDQGARLRS

SEQ ID NO: 23751 - protein, 415 aa, Pseudomonas aeruginosa
PTRVSLLNTARAAGGFSLSIWFSMAWISFSSAKPSSWLSSCSLIGRSSFWRKVPLVRRREVVHPAWPTDGREGSDTRHDHLLHPFRRPPGATPARRCPAGVAAGHPVDRPASPDPRRGAPARIPPAGEHPDPRGDGRDRGFVALLRGRQRPLHDHFGGRRDHRAPAEHRGSDLRSQREMADYRALRRPAFVPRVREPLHPPARRQPQQHPVVRPDDGQPGGPHRRRVGGRTGATEQHVAGDLRRVHRPDPQAEDRPAADHQAPRAQQLAAVQAQRQPAQHQSDEQLFPPGLQRLAFRAGEGAGEDRGARRALAGRVPGEDVHRDQLPPRRDPWPDQHRAEQHHQGVLHRRRTVPAADPGGHRLRHELQGHARAGLVHRLSDGAGDDGGIGDPSVPLVQVQELALRHSAGVQLFAG

SEQ ID NO: 23752 - protein, 725 aa, Pseudomonas aeruginosa
RRGQESPRRVDAALFVVGSFRSSLRALVSPAPGRTIESVACASEGQRMFAAANQTHFSLAIDGLALDLQVLSFSGREAISQPFAFDLELVGERPVPDLESLLHKPAFLTLGPAGNGIHGLVRSAGQGDSGKRLTRYRITLVPQLAYLAQRTNQRIFQHLTVPQIVGRVLEEHGILADAYRFQLGTRYPEREYCVQYDESDLQFVQRLCCEEGIHFHFQHSATAHLLVFGDDQTVFPRLAPVAYQQDSGLVADRAAVKPLRRTPGNPHQPRHPPRLRLRETAPDAGKRRPRRSPAGPRGLRLSRSLRRPRARQAPGQACPRTAAQRLPPGRGPQRPIVAAQRPLPAAGRPSPGGLERPLAAHRGDSRGAAAAGAGRKHRLRRLCEPGRLPAGLPQPLPGHALGGVLSSPADAAEAAHPRHAERGGDRTEGRGNPLRPLRSGEGAIPLGSRGPGRRQQQLLVTRCLRLGGKELRCHRHPAGRHGGAGDLPRRRSRPAAGHRLPVSQGTSGALRTAGAQDPQRLQEPQQPWRRWLQRAAHRGPQGPGADIRPCPARLGRKHRARPEDPRRSPTPRHRAGEQLQRVQGRGTPHHPRRAQGGDPRQRPPHRSQRPAPEDRQRPVRRGRPGDPPEQRPEGGTGGRRRTDPQGRRQLPQARRQRRDPLRGQRPGQLRRQPGQRQRRGAAVAGAAAAGRQRQGRRPPHPGPDQYPEAQRALLRRVREVQGRCL

SEQ ID NO: 23753 - protein, 435 aa, Pseudomonas aeruginosa
RDARPPRPGTCAPPRAVLHRPLSGPQREGTAGPARRDQAGAEHPAAPVAGDELDRQRHRRRRQAQTPPRPHRRGRAVGKGAASRAVAAAPTLLRGSRRRSGLRLAGGQSHPGSGACRQPRRSGDGGRRLTPHGPGAWTLDKPTGCPLAPLQLPRRAPAGQRHGHGGCQQRQYRQHQQQHRSQHRAAGDVQPGHDPQRRIEVFLLEQTQAQPEGGSADQRKQREVHQRLPVPALQRIVGNRQQAPALAQQGQENRQPYRPGQRGAAKARLDQVLEPQQQVGAEQAEEQAQPVGVDPERGAVAECLQQAEHHQHHAAGYRGQAEPGEDAQLRGRPAPAESIRYALLDQFDTRRGVGVCIHGEAPRQMPGSYQLRQLPAAATVWPTMSAAVPGQPLAGCLGCAKQKKMIGTPRLAQPAPWLRPPPCPVVPHTPWKYPA

SEQ ID NO: 23754 - protein, 263 aa, Pseudomonas aeruginosa
CARSASARCWFRSTPASRPATTSTAPSACKTISSGNPMVSTRSNRPRAPLPRYLSALGMTGMTAYFALLDVGQPNNRETVVISGAAGAVGSVAGQIARLKGCRVVGIAGGAEKCRFLVEELGFDGAIDYKNEDLAAGLKRECPKGIDVFFDNVGGEILDTVLTRIAFKARIVLCGAISQYNNKEAVRGPANYLSLLVNRARMEGMVVMDYAQRFPEGLKEMATWLAEGKLQSREDIVEGLETFPETLLKLFSGENFGKLVLKV

SEQ ID NO: 23755 - protein, 588 aa, Pseudomonas aeruginosa
PAPLPPRLVPSGCPGRAVGSGNPDPHRHRLRPDRRLPAPGRPLCVHPADADLRPDRQLAAVDGRPRRGDRGDGRRRHHPAGGGRSAAPGGPVDDRRDHGRAVLHRRRPGPRRVHRQLPLATDPGRLPQRHRPEPAGRATGQAVRLRGGDQRLRRRHPRAAGEPAAHPLADADPRQPLALADGAAAAALPAVARGALRRLPGQPRRGAAGPGSLRRGTAWRGTGRAAATELAADQPGGTEKPAARRHRHHGGQLLQRHAHRAQLRRPSRLQHQPQPRIRRPRPGQHRRRGLPGLRHQRRRLTHRGERHGRRQDPTGRRGRRAGDRRHPVAAEQAPGLGADAGARCGPVAGRLGPDRRAGAEGLLEAQPLRVQPLPADHRRRAQRRRAAGNLRRRQHRRTAPALLHLSPERRGARLDARHRRPGRAGQVPAGHHSSRPGDLPLRRPPAVLQRRVLQAAGACRGGRQRAAECGAAQRRSHDQPRHQRPGHPPRGATDPQGPGRAPVAGAGDRADAGPAATLEHARRDQAAAGVQLGALRGQCLSLLAAPAGKTRRPGRGYKRKCLTMPCSSRPSSASCSLDEAVDCMAWAD

SEQ ID NO: 23756 - protein, 360 aa, Pseudomonas aeruginosa
SATSRIAVTLRLISSATALCCSEAAAICWFICWISATAVAMLPSAASVCNASSTLWSTNWWLRCIRCTACCVPFCKAPIRVSISAVDCWVRRASARTSSATTAKPRPWSPARAASMAAFSASRLVCSATLLITSSTLPMRWLSALSASTLAVAARTASASRSIRSRVWRTTSWPTLTLPSALSAAPAASSALCATSWTVAAIWFIAVATCSVSARWLSIPRRVRVVTPDSASEAPAIRPTPSCNWLTIPRRLPVMARIAAISWPTSSRRSLSTRTARSPSAIRCATPIAWRSGRTISRLMPKAAPRPTSSASTAAPTISREFVRRLWSMACCCASQLRSTRAITCPARSPMAAYICRSWS

SEQ ID NO: 23757 - protein, 417 aa, Pseudomonas aeruginosa
QCWERRPCGTPPGRAHPSGGYRRETVRGSAGCCRALQHLYRETLSLDQLADRRQLQAEFRRHGEELRLAFRSHRHQQAAAGLRIAKQQLLHFRQWRDALAIAVEVAQCAARHAALLQVIFGTGQARYRGVLHACGELAAVGHFHQVAEQAETGDVGHRLDPRQPAEARAGPVQGAHPVTRHADVLGAQPGLLLGSGEDADAQRLGQVQPAAGLGGVVAFHEALLHHAGHGQAEDRLGGVDGVSAGQRDAGFLANLAAAGDHLAGDFRGQHVDRPAEDGDGHQRVAAHGVDIADGVGRGDTAEIEGVVDDRHEEIGGGDHPALLVEGVDSRVVARGVADPELRIEVLRAAAGEDHLQYLGRNLAAAAGAVAVLGQADRLAHRCTPVDVGKVPILAKPAPPPEDRSPRPAQRPARDSRI

SEQ ID NO: 23758 - protein, 959 aa, Pseudomonas aeruginosa
YGGTCGSAVRRRSAGCCSAIGSWHSARQVNTATGQRRRRGNGRNSASAGARQVRRAHSSPSSCPRSGCGCSGRCRTSVVPRPSRPSPTLIRPPWAPIMPWQIARPRPVPWPPRSPRAAVYNMSKIFSRSGLGNPRPLVAHRETQLGGILADLDAQPAVARREARGIFQHVDQRLFDQRRMHVEQRQVVGHDRLHPVRRQHRAQAVQRAADDVARRHPVARQLQATVAETGHVEQVLDIAVQSLGLVAGAFQQFATIRRRDRLAQRQQAVDGTAHGRQRRAQVVGHRGEQGAAQLLGLAVQARGLQVLGQARTGQGLGQGLAEGSEQAPALRAQRLAVQRRDAEQCQRSLFRRQRPPPPASSGQRASTEAGRLVVGPGPVRGDPFLVGELPLHAGLGLPLAIDLTEQADLDVLPVVELLGGGGQHRLAVGGGGELARQLQQQAGFLLGIAQRLQLAPLACRQVAGEAGHEQEERQAQQVFVAMDGEGKMRRDEQEVIGQERRHRAQQCRHQAGAHCHQQHRHQEHQGDVRQLQQVRHDPGQAAGQGGRQQRQQIVVPHHRIAWPRFRRAQVGLAVQGTDLQALAVAQQTPGETTAEGPAVPAAPRLANQDQAGAALAGMLQEGPRHLAGAQHDDLAAEPLGQLLRTLQAHPRVLAAQAAGIDVYHAPGQVPTFGDPAGVAHQAFGLFVTVDAHQQPPAQRRRFLAALAVAVVEVGVDPRGGGLHRQFTQRGEVGLREERIDRRPRLFRHVDLALAQALQQLARRQVDEDDLVGLLQHPVRHRLADLHAGDVADLVVEALQVLDVDRCVDVDSRRQQLLDVLPALGVAAAGNVAMGQFVDQGQRRRVGEETVEVHFLQFHPSILEAAQRLLRHACEEGLGFRPRVGLDHPGAQFHALAQLGLGGLQHGEGLAHPRRRAEKDFQAAAPVSGQVGQQRVGACGVGHGSVVIRCSAPRTADDHK

SEQ ID NO: 23759 - protein, 474 aa, Pseudomonas aeruginosa
RGEFMGGVLCRRLAVSIEEQRHGARPGGAGGMAVRSETGQALANAVDQPVEAGRVVGVYALALDRLRRCQRLAGSLLGADHVESRVGRVLAFRLALRKPAGDHRFGRLAVEDQERHAGFFRDVASGLALTLLQVGGIDHHRIASLEDLRGQLVKVRIGRFAGLAAIDAGGELAPVVFRLLAEQTLAFDIRAQAHGAQSLHQTHGHLALADRGDTMGDRQEARGNGAVAFRQVGVVAVLAQGRGALHGIGLVAEAEQRDLGADHGAVGLVEVQQFQGLVVAGVFQIEADEASSVALQAAIFQVHREEGEVGADIGEAERFVEFDAVEQHYPAVDQRGVAQVDVAVAFADEALRLALLEHRQQAFEAAFRPGFEGIQLLQVGLVLEQRANLLEILPHRRHAGLGGAQRVLQRHLRSVLVEVRDLLGQFVDMLVGQFAAALDCRQQVVLRELAHLQQVFDCLAVAADPRRLFAAGDR

SEQ ID NO: 23760 - protein, 266 aa, Pseudomonas aeruginosa
IDPRGPDVKKIFVFAALAGSAVLAGCASPQHGAIPVVDSGTPVSNQESGGFRITRTQVPRTQQGAATQGIPQGGDSGVVVMVPQGANSAPIQTFPAQSGAAPISSAPLGTGTQYQAPPSSASTPPLGGSYNMPPSGASRSAPTGIPASGSAGSLAADEQLDGPVLAMLTTAQQQQGSGDLNSAAASLERAQRIAPREPQVLYRLAQVRLAQGDAAQAEQVARRGLSYANGRPALQAGLWELIAQAREKQGDSAGAALARQKAKVSS

SEQ ID NO: 23761 - protein, 171 aa, Pseudomonas aeruginosa
SSRSARVSTTGSSTARRSSARTPRSSTSTSIRRRFPRPSRPTSRSSARWTAFSPKWSRSSGKSARPRTRMPRLPGGSRSTSGVVTVGCSRTTRATAASSSRRPSSRRSTRLPMAMPSSPPMSASTRCSPRSTTSSTSPIAGSTPAVSAPWASASRRRWASSSTSRTTMSPA

SEQ ID NO: 23762 - protein, 750 aa, Pseudomonas aeruginosa
LQYASPATQAPHPCPQGPPDPLVRAGRRPGRAGGDHPDLLLPGLRRAPPVPRRRPGDPRSADSGLDAAGAGAPAAQHRGAEPGGHARRRPGRDSLLQRQDRCRTEACRSAASGGQRDPLDRPGPAGQPDGRPGPVQRTGAGVPAHLQGHLPGQQEDHHPGDRLPLRRDPDRSRSAGPPAGACEHQCRRRQPAAGWLRRQATAAVEHDSGREHADRRKHAGRGAHRTPADRRTGESHLPRPAQAVAVRDQRTCHRRCVRPAQPPVERSLQAAGRPQRRGHREHPTAGRHLAAGGRLQGWHRPVVHGSRYRRRTAPVARSRLQSGWRADQRHRSGTTAQGLHRPGREGQPRRLPQHRAPYPAGPAGRRLFRGHHPVAAGQPPAAGAGWQDPPLRPEQPAPGNLLERALGQGLVRELRQAGLRLAVHRRDHRLRTEAEPLAADLRHAQGRLLRDDPGSSAGHRGRRLHRLFHGSGDAPQGQAGDRADGGAADGDPRLLRRPVPGALRRRPPAGCVQPAVADAAGHPSCRPALEPPARAYPSEPAGRLGSRAADPGGACRRRLRPVAEPAPGDHLLRRRHAPLAEPRPGHHLRPAQCPDRRAGNGLRGDPEYLLDRRGRHLQRAAQPHLRLPGPGRHALADADPRGDPDRQSRHLLGADDRHGPRRRRDHDRADGDRQYPGDGSEYLRGDAHPGGQRRGGDARVGGRRQPLPRAVPLGAGTADVHLRDEHPGRADPSASAQEIRVVVSGGGIAL

SEQ ID NO: 23763 - protein, 206 aa, Pseudomonas aeruginosa
TTSPAYRRSSTACSAWVSSSTCWAVPSTGCSSPRPCRRRPSVPPGLFWASLTLAILAVPVVIVATEEGLARIPRAVREGSLALGATKAETLWKIVLPMASPAMMTGLILAVARAAGEVAPLMLVGVVKLAPSLPVDGNYPYVHLDQKIMHLGFHIYDVGFQSPNVEAARPLVYATALLLVVVIALLNFSAIAIRNRLREKYKALEN

SEQ ID NO: 23764 - protein, 282 aa, Pseudomonas aeruginosa
LRELPMQNETASHGINFDALGRDRQSLDLASESVELEVPGLNLFYGAKQALFDVRMNIPKQRVTAFIGPSGCGKSTLLRCFNRMNDLVDGCRVEGEIRLDGHNIFAKGVDVAELRRRVGMVFQKPNPFPKSIYENVVYGLRIQGINKKRVLDEAVEWALKGAALWEEVKDRLHESALGLSGGQQQRLVIARTIAVEPEVLLLDEPCSALDPISTLKIEELIYELKSKFTIVIVTHNMQQAARVSDYTAFMYMGKLIEFGDTDTLFTNPAKKQTEDYITGRYG

SEQ ID NO: 23765 - protein, 331 aa, Pseudomonas aeruginosa
PGALFLRATAARLGILPAGEAILGGPVQEKSMSKVSALVVDDAPFIRDLMKKGLRDNFPGLHIEEAVNGRKAQQLLSRQNVDLILCDWEMPEMSGLELLTWCRAQENLKTTPFIMVTSRGDKENVVQAIQAGVSDYIGKPFSNDQLVAKIKKALSRSGKLEALAAHAPRREIASGMANDSLAALTGGRAEVIKPAASPAKPAPAPKPASAPQASARPAGSGNPLGQAQLRLPQSSMPCVIKAVSLKEAQLVVKRADPLPQVLESAVLDLEENSDVARLNGYLHAIAALEPKPDSDWLLLTLRFVDRDPQKLDYLSRLIARGSTQKHYVPGA

SEQ ID NO: 23766 - protein, 202 aa, Pseudomonas aeruginosa
GAVSSLASLGRADAGGAALRRGSLRRLALGLGDLRRGEMAGEGAALAGHAADFQARAVADQHVLDDGQAEAGAAGVGGAAGVHPVEALGQARQVLGVDADTGVLHRQVRALFVGPPADADLAFVGGVLHRVEYQVGEGAAQFRLAALELHSGCGVQADAVVAPGGQGLGVVTDAGEESVHRHRLVVAGVTRWPPAWPAGAGR

SEQ ID NO: 23767 - protein, 72 aa, Pseudomonas aeruginosa
SGCRRSVRHASGVAPVRCRKCRGASSRAGSGPACGRRSPRAPAGYFPPPGTRSRPSPGPRRSSRESVLRHQR

SEQ ID NO: 23768 - protein, 160 aa, Pseudomonas aeruginosa
FPPTARGGAMLNRFRCRPCGRRTLHLKTQERDAMNRIHLALGLALALPAFAALAQETVAPATEKDGVLVDGKGMTLYTYDKDSEGQSACSGQCAKNWPPLAAAQGAQASGDWSLVAREDGTQQWAYYGKPLYTFIQDKKPGDKNGDGKMGAWHVAQPDMD

SEQ ID NO: 23769 - protein, 148 aa, Pseudomonas aeruginosa
RRRPRPAAAARWISTWMRRSAAASARGAISTPGGRCCARVPRPSCRPPAAAAPSSRTTPTCCATTHGTRTRRTRSPPLPATWWKCFATSRWSPSACAATSAWRSTAHAHCSTRNDWAGPWRRCCGDWASISPRWPTVISAAGPPAPTR

SEQ ID NO: 23770 - protein, 194 aa, Pseudomonas aeruginosa
PSRRCPGVCATTAWTPWKAARRMSSPRPTSVARPISTGPDGPRYATGSSCSTRPCPEESETMHSKPVLGREEVARVLGAAREEAQRQGWAVSIAVVDDGGHPLALERLDGCAPIGAYIATEKARSAALGRRETKRYEDMINGGRSAFLSVPLLQATLEGGVPILVDGQVVGAVGVSGVRAEEDARVARIGAEGL

SEQ ID NO: 23771 - protein, 609 aa, Pseudomonas aeruginosa
RLAVPRLRRRQAGLRDDRNRLSPARRRRRRPWPPFFMPGQRPSRSYPWDLGPVIDCPAGNARQPCRWPATDAELGSTNEEGGYAQVAMRGLRLHLRRSPGPARRRHSGGNPLGRHPGGLGLPGLRCRQDRFRDDRDRLSEIHRSGARRRQSQRNGNERACAPGNHRNRPGGLQLGPRVAQAGQRDAAADDHRRRRPFLFQADALHRLLEEQGRRRPGHGRTGRHGRATERTHPDPYPGHRYRSRPSADLDRRGRGALSRPGPGLGRGADPGAGRGRCPGRALPDQRPGRLRALPPGGCRQAPGTAARCGADRLRIRQRPLQRRLPARRGGALRAGHAGPAPPGRGEGRAGRPGRPRRALPPGAGAGQPEEGRRGAGSASFGWRGDSLRPGGLRRRPASAHRTGLRRRAGGQPRDRRRPLAAHLPRQHLRAGRLRRSGRPQPALCDAADGLRTRAGADPRRQPQPGGLRSHAGDGEDPGLPAGGVATAPRNGWPMASGRLWNGPQGPVPGYRWSSDRLCPDRSGGERKIGPEQRVTRPHGLNAIGSGRYAVETCGKIVGRYWRSPREHAILHRVYRSLEPMVPVDCGAFERCWEDSTDTKTTNRQRGNYA

SEQ ID NO: 23772 - protein, 344 aa, Pseudomonas aeruginosa
LVQLGQAKALGVLDDHQAGVGHVDADLDHRGRHQQLQHAFLEGLHHHGLVRRLHAPVDQADTQFAQRRGKLFVGGLGGLAGKLLGLFDQGTHPVGLAPFAASRADSLDHLDTAAVGHQHGIHRGTPGRQLVEDRGVEVGIGAHRQGPRDRRGGHDQLVWAEPAVHALLAQGQALLHAEAVLFVDDRQCKALEFHFILEQRVGADHHRRAVADAFQCRRAGLALELAGQPGDFDVQRLEPLAEVEEMLLGEDLGRRHQRHLVAGLYGLQGGEGGDHGLAGTDVALHQAQHRLVLGQVVGDLRADPALRAGRLEAEVGKEAFRQAAGRRQARRCLRAHGFAQALQG

SEQ ID NO: 23773 - protein, 221 aa, Pseudomonas aeruginosa
LVGQQFFEGQAQLRPVPAFGQFLDVGIRRRPVQVADRLVERAKLVVAGQFRRQPVGQAAGAEHGQGLLAQLAQALLGEALGSRVDRRQGLLHRNRLVAVQRAVFRMVDLQARGTRPDFAVAAQVGAALETVLLRLAEMVEAQAQGAAAVLQAHQQAAAAPHHHVGAGHHALDHRVGPWPQGADGGDAGTVLVAQGQVEQDILQGFQAYPSELLRQRGAYAL

SEQ ID NO: 23774 - protein, 798 aa, Pseudomonas aeruginosa
SPAAAMSAGASARRCWPMAGGSMACVARWTPCRRGSCRWLAICRLRSVPRSGRASRSTTWCTAPPPVSTTRLATVPPTSTACAMCWAGCRPAASGPGACCSSPAPGSTRRPMAAGSTRSRRRFPRSIPDGSCSTPSRSRWTAGYRLPACAWPASTVRGGSGCSTRCVRGTGWSASRPCMPTGSTPTMRPGCWPSCCAPMPAARRWRTATSVSTTRPWRCTRWSTTCASAWASANGPTNIRYAAPAASVAATAAPGRSAGCRAIPATARATRRCSGTPDGCQPVVGASLAAWRGAVPCGLLRPGVRPPQPFGLRHRLDPPRRRRLPVPRAAPCAAGRHPVADEPGRATYRARRIRAAGLPDALCRGNAPARPARPQTVAARLRRTEPGRRRQRGGWPGVAGRGFPAQRRIGVGKPPAGLARTGLRASRRLAPGGRGAPRRRNHRTPARLPGSACYRGARSGPTGAVAAAPPAPPDRGFPACLRRAAAYLPTAMPGAPGQAPVAGRTAAGGTRPAPRLLRPGALLHDLPAFHRGHSGAVPAQRQDLSFFQYGARRAAQTGGLRVSRGLHVRRVRPCRQYPFRRPAVAGAGLLPVGARRPAARPAPGRRGGRRHRPGQPPEHAAGARPVGQRAGLGAQRLALAAGARRTVLPLAGGPGAACAEATGNAGAARRPVPRRLSARAARRPAGEQPESQAADLLCGAVRRAGALQPAGLGAGPVPGVDEPGGAVLGHGAGAPAGQAALARLVATAGRCAGPAVRRPAAGAGRLAGAGRPLRGLSAPAARRACRARSWASRWRRRY

SEQ ID NO: 23775 - protein, 281 aa, Pseudomonas aeruginosa
SVGFPVEFLHQEVQAPTGGAAGLEDPADLADVGGEAVQLLGDIALLRQQDQFLLQALRIEFGLEFGEAVEDLLPLVGQHGRHQFAQVADFHQHRVEPIVEQLRQLQAFARAAGLELLQGLAEGFQGGGVERLRIGRVGHQYAGPGQHGERIERRRLADQGGYAFGGGDQLAGALLVDLQALAGGFLGEAQGAFHLATRQALAQRLAHRALEVAEGVGQAQVGLQVTVVDRAQLPAQGAVGTSLLDAGEGGHAVHHGSTSIVVWGVRSAPVARGCRDSSRAL

SEQ ID NO: 23776 - protein, 252 aa, Pseudomonas aeruginosa
WRPIPLSQYRISTMNRPSGRAADQLRPIRITRHYTKHAEGSVLVEFGDTKVICTVSAESGVPRFLKGQGQGWLTAEYGMLPRSTGERNQREASRGKQGGRTLEIQRLIGRSLRAALDLSKLGENTLYIDCDVIQADGGTRTASITGATVALIDALAVLKKRGALKGNPLKQMVAAVSVGIYQGVPVLDLDYLEDSAAETDLNVVMTDAGGFIEVQGTAEGAPFRPAELNAMLELAQQGMQELFELQRAALAE

SEQ ID NO: 23777 - protein, 173 aa, Pseudomonas aeruginosa
VHPQVRAHQPLFLQCRPVRQRPGAGPPGTLLRRGGDRQRNRLRRPVRPGLQGHSPGRHHRGGPRRAAPARPALVLQPQGSQGPRRRRHAGRRAAERPGADHRRRDHRRHRDPRSDADHRRPGRQGRGRADRAEPPGARQGRAVGDPGGRARLRHAGGEHRFPGAGAGISCRRC

SEQ ID NO: 23778 - protein, 230 aa, Pseudomonas aeruginosa
TEEASAGGRGLSRPIRYLNLSQGTGMVGQDVMRCLMALGLVLQGISFGAQAAPGGAVELYRYVNDKGVVVLDRQGVPPQYIGKGYQVLNDQGRVIRTVPPAPTAEELRQRKAAQAQASSDAQLLRLYSSLEDVDRARERRLAELDGLSSVARGNLQSLKLQQANLQGQAANQERAGRPVAQALVDQLDDLKQEEKRLQGEIGRFQKAREDAERTYAADRARLSQLLGVSP

SEQ ID NO: 23779 - protein, 915 aa, Pseudomonas aeruginosa
AARSRWAPPCSSRATTTWRPWPSMCRPSTSPRRYSRAPARCRSRRWTASRGCFPGGTPTSAAPSSSTAATGWPTSPRPRDCAATASTGAARTRKWSTARLRWAWRWTTRSSCGRPRASRCCCNSATCWRCAAGGSSSAGRFTPRTPGAFPSRWRQPADTGLPLRSDASEFERNGQLGPEHVAFGAVLHVEFLGPADLRAGVLEEGQVHGRADGEDLAAYAVVDFLAETEHPYGLAVLFVVGGLLEVVAVQAEAQVVGHPIAGGIVEMEDLPRAIVGVVVFHVEAVGGLQRQLGAFGGQPGEGEQRLVGVEVVAGVGQPLGIVLAGGHGDLHGGGQGQVLAHVPEDDRREGGVTHAFPFVAQAERGHPLADIGLGDVAAQAPAEDPQRAQVVQARDDRIRADLHVGHLAAEGADVQLPGFVVVVVDVEGEHVVREVVDVQWQGEETVGSWTYVVHAAFAGMGAAAEGEGDAGGQAQGPAGVGPIHGRALIIVWRGSGYGIGISPIDRPRQGIDGQRGGDLRTPCNALLHLCGTLYDGTLIPCRDPPPEQERSRDRLRISPMHNNAADARYELAQVSTFLLQTLAEVVEGHGVDPARLCRGLGFTVEDLQDPTQRISYRQAVSMIQRALQALPERGLGLWVGHQNVLGTLGLLGHVLSLCRTLRDAFDIGVRYQHSSGGIVTSSVYQQGETFFVEVECHLPSSEVQVFAIEEFFASLLVYGRALVSPAFEPLGIELIHAAPPYAGEYLRLLGPQVRFGCLHNRMAIASHWLDMRLPNHNLPALRQALALLEQENTQVHRKLDLVQAVERAIARDLSLGSQIERISAELNMSSRTLRRRLAEHGLTFEALLEQVRRGRAMSLLGNPGMSIERITEEVGYRDIRSFRRAFKRWTGVSPATFRSEGASPLEQAFALAARR

SEQ ID NO: 23780 - protein, 846 aa, Pseudomonas aeruginosa
  UNSURE (686): Identity of amino acid at the above locations are unknown.
GRASERTLATWAASSRLRVMGSSDMSEGHGQRGIHCLQLVTEDGLDALQLFLGVRFEAQDQHGSGVGGAYQAPAFGVVDPHAVEGGDVAFAPLGVALQRLDDGELAVLGDGDVDFRGGNVAREGREHVLAVTLILAEDFQQAGGAVDAIVEAEPALLEEHVAAHLASQQGAGFLHLLLDQRVAGLPHHRTAAVAADQGDQTAGALDVEDDVGPRVARDHVLGEQHQQTVRIDDGTGIGDHADAIAVAVEGQAQVGVLGLDLGDQVLQVLRLARVRMVVREVAVDLAVQRDHAAAQGLDQLRGDHPGHAVAAVDHHLHRLGHGDVVADLLEVARQDVDLLYAADAGCQVVFLDALAQGLDLLVGQGLAGDHDLEAVVVRRVVAAGQHHPGLALEHVGRVVQHRGRHHAHVADLATAVHQALDQLLDQLGTGQAAIAADSDARFAAGEAFRADGATDPVGGLGGEGIAYHATDVVGAEDAGGQRRCFCSAHDGGLLQSQEVLVFIENVDIQNVGVLEQRICQCRLLARRRFRHRHRRCLGRAGHAGRLRLAPRLAGQCLDQRGEARQARHRGFGSALPAEFLKILTEGQDILMQAAQQRRTGEVGAEDAAEQRQQRRECQQQRRGLGRSDAAGRVVQFPVRIAAVQRLRTLARRRRTALQQHLGRCAGELLDQLYLAGIARQGRQGAXQPLQVDRQQQRALQALVGAAHRRGAVQQPALADLVGFGGDVLATFHPVQDIQGGEADRAGAVVVLGGLAGRVQVGIDHAVPGQQDALGGLDAGGVAALQGFEGEGAGRGGAGVGGELLQGLAQGAGLAFGPGRVQLALLRLTGAAEDAEPEQGAGGRHAQ

SEQ ID NO: 23781 - protein, 489 aa, Pseudomonas aeruginosa
MDRPVGISRVWPGPRTLSSLSMARRSRPAEPGVAYCGSGKSEPRRGSRILAWRECISNSLLVEAVGDEGDQLASDLALAGLGEGARMQVAVDHRDRVLVAVEADRGVGHVVGDDQVEVLVLQLACSIVQQVFGFCGEAHAEGTILALCEGGENVGIAHQLQEQALAAGRVFLQFVRGDHFRAVVGDRRGGDQQVAGHLRLAGGQHVAGADHVDALHPVGRGQVHRAGDQGHPCAGFHRRLGEGEAHLSGTVVGDVAHRVDVFLGRAGGDQHMHAGQRLALEAVGGALRQFLGFEHASEADIAAGLAARCRTEQVEAALAQQLGVGLGRGVAPHGLVHRRCQGDLRVGGQHQGGQQVVGHALDQARHEVGGSRCDQHQIGPAGQFDVAHRGFRRRVQQIGMHRMAGQRLEGQGRDELAAALGHHHSDFSALVAQAADQFGALVGGNAAAHAEDDAFPIEPLHRLALIRKWMTCASANAPPQVVCRAKRMG

SEQ ID NO: 23782 - protein, 190 aa, Pseudomonas aeruginosa
DSTASAREQRAGSMGKANEHPRLARSRTASGEASGAGRGGPFRCRAVGDLPAYGSDRLQCGRAVAAAVERVRRAACPARGGPRLVLRPSRARRGQVCAIAGRAGDGPAPPGRAPASRFDTGEPAGGARLSQGAPAPRAARGVRLPVPRHEAPGPGVRGAVPGQHRWRQRLPAPGGQAHPGAQRGGADPDP

SEQ ID NO: 23783 - protein, 535 aa, Pseudomonas aeruginosa
RRSRSIAGFSRAWPSAFHGDPREILATERIDLVALHLLAGKGEGGRVGQGQPERLFVDQFLRLVVQAGALFLAAGGLAVGNQLVQAGVAIAREVEPRLDAGAAELRSEEVVRIAVVACPTHEQQVVFAVLGTTDQLAPFDDADVGLDPGLRQVGLEQLGAEARVGVEQAAGRAGPDVQLGKLLAGQQLARLFGGVRVGGNIPGIAPGVRRIDAGGGTGAAFEYRLQVAGAVEGQVDRLAHLGIVQRRMLGIEGDEGGHEGRRLLDLQAGVLARALHVQRLRRQGDLAFAAAQLLQAHVGVRGDGEDQRVDRRLAGEVLGVGGVAHHRVLLEALEHERAAADRLGVELFRGSGLHQLVGVFRRIDGGEAHAQHRQEGRVGVVENEQHLVVAAFLHPLDQLRQLHRLGVREAVLRHLVPGIGRIEHALEAEHHVVGVERTARLEVGGAVEVHTLAQVEAIAQAVVGHRPALGQRGHHRPLAGVELDQAIHQHIGRGVGGGHRVVLDHVEALGAGFGAHAQGGSGGGLGEQQGGEEQG

SEQ ID NO: 23784 - protein, 79 aa, Pseudomonas aeruginosa
GMSRVCQVTGKGPVTGNNISHAHNKTRRRFLPNLQHHRFWVESEKRFVRLRVSAKGMRIIDKRGIEAVLADLRARGEKF

SEQ ID NO: 23785 - protein, 529 aa, Pseudomonas aeruginosa
GGGHHGPRARLAESDSAPVSQAPRTPIRGHVVMTTLTRADWEARAKDLKIEGRAFVNGEYSNAASGETFDCLSPVDGRFLAKVASCDLADAEQAVKVARNAFDSGAWSRLAPAKRKQTMIRFADLLLENAEELALLETLDMGKPISDSLHIDVASAANSLRWSAEAIDKIYDEVAATPHAELGLVTREPVGVVAAIVPWNFPLLMSCWKLGPALATGNSVILKPSEKSPLTAIRIAQLAVEAGIPKGVFNVLPGYGHTVGKALALHMDVDTLVFTGSTKIAKQLMVYAGESNMKRVWLEAGGKSPNIVFADAPDLKAAAEAAAGAIAFNQGEVCTAGSRLLVERSIKDKFLPLVIEALKGWKPGNPLDPETNVGALVDTQQMNTVLSYIEAGHKDGAKLVAGGKRTLEETGGTYVEPTIFDGVTNAMKIAREEIFGPVLSVIEFEDAEEAVRIANDTPYGLAAAVWTSNLSKAHLTAKALRAGSVWVNQYDGGDMTAPFGGFKQSGNGRDKSLHAFDKYTELKATWIKL

SEQ ID NO: 23786 - protein, 561 aa, Pseudomonas aeruginosa
YWMSRLRWAARISAARATKASSLAPRRWKPDWPGWSRPWISACLASQVPSAGSADDGCGGGVLAQPERARRASRRNRRSKDISRGNSNDRLIPVVRILGVFLGRAMPRLIFSESAEPRMGSATEFFLQPVPGHAQRQQWRAQQLAAGEGDVRHLGEQVEAVALLAADGFGEQLPGEVRGVHPVSGIGLGEVHVGLPRQAADLWQAIGADADHAAPLVVDADVRQLREYLQHLRPHVGGDVAGVAAGIMAGATEQQAVVGGEPVVVEGHALVAHRHVLRQQLAGQLLVQRFGGDHVAAGRQYLAAEQRVEVVHVGVAAQHQGLRPHLAGGGMHLDFRAVVDPRHRRALEQADAQRLGSGGFAEDQVERMQVAGAHVHQAADVAIGADHAAHLRGRHQAHLVAIAEGLEFLHVLAEALVVAGLVRQVAVAPAQIAVDGVLLDPATDDLHRLQAHQLECLHAVGADHREELLDVMADAADQLAAIAPTGAPADPVRFQQDHGEAALGQFQRRVHSREAAADDAHVGLFFAGQGRALDASVERGGVVGGGVLGGMHRLVNAGVHV

SEQ ID NO: 23787 - protein, 888 aa, Pseudomonas aeruginosa
RRKQGKTLARENALILHEGPATLGRVGNGQRWDMRLRRRTTLLLVFAVLLLLAFGYGWHAWRSLLREQGVERLEWQGLGLSAEGIGLRRLALERRGADGASLRLDVEHALLRWPGLSGWRPRLPGLRVEQVALAWQPAAASSDDDAAALDWTSLRETLAWLPEQIHLERFHLDLPCPAGRCEQDGGLDIGRPSGALFPLAAQLRLQQEAQQAQLDAQLFEEPTGWRLRTRAQLDRQALLTLDSQLAPSDGDGLWQGRLEAPGLPDTRGLVVWLNRWLPEAQRLPDAPQALHLQADWTIRLAPGSDWLEPRRVLDGGGSAALLVQAPQAWPLPGLGNVQGELQVQLDGDEGAWLPRQLRSDLRLSQLHGEWLQALPAELRPSALGLRSEPLERDADSVTALRLAFTSEGASTLKLETRLDLLGISPWAARLVEGRLQVDAPRLQYLGWKAERLVAEIPLEGRLDGQRANLSFGRGARLQAASLAEPSTLHLGQPRLDLAGAALELAYQPLALHFAGPLQAQVGQLRQANLKPLAWTFEGPLDTTLERTSLKGRLSNGAGLAADIQLQRDAKTPLALSARLAEVFFRTGNPLAATLADWPGLLELGNGRATAAAGWKLDAAGASSLDLDLTLKGLDGIYDRSELKGLGGSLALRLRGGQLSLDSPGLSLAEANPGLPLGPVSFRGRYEAPLSAPGSGRLSWQTLQSGLFGGQASVPAGSIRLGQAEQKFALRIQGIQLGEIFRVYPAEGLAGEGALDGELPLMLNRWKPSVSGGQVKAREPGYLRFRSAKIEALGRSNPGMKLVADALDDFHYDVLQSSVDYHENGKLLLGLRLQGSNPDLEKGRPVNLNVNLEEDIPALLTSLQLSDRVSETIRQRVQERMQKRKASAP

SEQ ID NO: 23788 - protein, 383 aa, Pseudomonas aeruginosa
RSRPGNQLRQRRPGVSRLRFALGSPGHSPEGHEVAAGKARAAGHQAHLRSQPVRLDAADAAQLHRRALRREQGAHGPPVRVQPRLPRRTARRDRHRLRGPHPRHHPTVPHPGAAGRRRQGHRRARALRRALRGSRPRRHRPRRAGFGQGRRQAGRRLAPAQRPDRRLPAVHHPPGGNGQGPGRGVPLRPEHRAPGLRRRPHQRRAGQRRIAHRRPLRAGPGQLLAATAQAAGYQGSGLSAEGLFADRADHQPGDGADLDHPRRDLQGGDHPLRPAHPRRRHGGNRRLRPVAEPAPPRDPGNDHHRPLSRGRRHQPGDLLDRPAPGDPGWHPDRRRHPLPQPVPQYRPRHPGLDHGLRVGSLPGRPDGEEAPADQYRRPGYFPL

SEQ ID NO: 23789 - protein, 804 aa, Pseudomonas aeruginosa
RCDRQAPRAGRQGLRTRQGMRRRRRRRGSRRWRRCAFRRRHRRQDLQHLPRHRPAGRAEGWRQGRVGQARQGAGRPRWPAGQGDFRYQRHAAERHLRRLLGRRAESRDQAYVRSVTTPGQCREKPPPGGFFVSAVRVFPAGGSSRRQTGSKLPATHSPEGIVLSRTCSIDAAVDHLLQTIEGPIRMGLPLGLGKPNRLVNALYQRLRTLPERQLTLYTALSLGRPAAGGDLQRRFLEPFAERVFADYPELDYLHALRRDELPANIRVEEFYLQPGSLLDSAPAQQHYISCNYSHVARDINAKGVNAVAQLVARHPERPGKLSLACNPDITLDLLPMLEKRRAAGETIVAIGVVHDDLPYLPGDAEVEESVFDLLIDAPAESSRLFSTPNMPVNLQDHCIGLHASALVRDGGTLQIGIGSMGDALTAALLLRQRDNATYRALIDELGVRARWAETIERDGGLEPFRRGLYGCSEMFVPGLLALAEAGVLSRRVYPDEARQRAAERGEAPVEGGVWLHGGFFLGPLAFYRRLREMSLEERAGIGMTGIGFVNNLYRQEELKRLQRRDARFINSAFTVTLLGAGVADQLEDGRVLSGVGGQYNFVAQAHELEGARSILMLRSWRESGGEVSSNIVWQYAHTTIPRHLRDMVVTEYGIADLRGKNDAEVIAALLAIADSRFQQALAEQAQSAGKLPKDFVLPERYRNNTPERLQALHQAHAAALPEFPLGSDFDEIEQDLLRALGWLKRKLKLSEILELGKATLDAPEPEAYPAHLRRMDLDDPQGLREELYQRLLLAGLRASQEERG

SEQ ID NO: 23790 - protein, 563 aa, Pseudomonas aeruginosa
NFGGCLSAPAEPLRLLLLADTPDWAPLLGERLRALGPAFSLSIVTTWEGAATLFAAEPRGLLLATPACLPLGTPCPWPVILLLQQEPAQAPVGVVDWLAAEQLSEDSLRRCLRYARERLGLQATLQLLAEQDPLTGIANRQGFQTLLAARLSEFDGRGLVLGHLDLDNFRHVNDSLGHQGGDRLILQVVNRLRGFMENGDSLARLGSDEFALLLDTRRDPQRAERVAERIVECLGEPYWIDGESLLLGCSLGLAHARADEGADPLMWHAHIAMQQAKSRQGCTFHVFDERINRGVRSLADLEAELRRALRRDELELHYQPRLCLDSGRIVGLEALVRWRHGERGLLTPSEFVPLAEESGLIVPLGYWVIARALRDMQWLNGRGLEPLHMAVNLSFRQFQDSQLLPTLQRLIEEHGVDARWLEFELTETAVMRRSDQVLQTMQALGQLGVRFSLDDFGTGFSSFVHLNSLPITLLKIDRSFVGGMDQRAENFQLVRAMINLAHNLNLEVVAEGVETLRQQEQLRDFGCDQVQGYWISPPLPLAELARFLGIGERSAHRGQPLGN

SEQ ID NO: 23791 - protein, 198 aa, Pseudomonas aeruginosa
RMPRLVASRCSALNRPQIDARSTMENGSALAMVAVCSALRPSARSRAMATTPISTDQNIRCQSGEWSLPLEASMSTTSAPESAEVTKNTTTISTATSEITLPSGKCSRKANSATELSWLTTSANWVKPSCRTMWMAVSPNTVIHSRVKPAGTNSTPQTNSRMVRPREIRAMNRPTKGDQDSHQPQYSRVQPPIQSVGS

SEQ ID NO: 23792 - protein, 433 aa, Pseudomonas aeruginosa
SIALLNYYASRGGHCPILQGFRQVPAFDGIDALQVGQRPGHLEYAMQGAQGKFQALSGSLQPAAVRFGECTIAVHRLEIEMGIGAALAGQLPLPCGAHPFADLGGSGFAVSWLQAGAFAEHADVQVDAIEQRSGQLAPVALDLFRGAAAAATGIAEVATGTGIHRRHQLEARRETYPAVGPGNDDLAAFQRLAQDLQDLALELRQFVEEQHALVRQGDLARLRAAAAADQGRRGGGVVRLAERSLRPVPEGDVAGHRMDRRDLQGFVLVERRQQAGQAAGQEGLAGARRAAEQQVVRAGGGHQQGALGGGLALDLGQVWIREGRAEQAAGLVGRQRGLAGEVSGDLQQVVHGEHRQPAGQAGLFGIFLRYHQNAPCVARRQRGRQYASHWPDRPGQGQFAEALQAVEGGAGQLAAGGEDAECDGQVEATAVLG

SEQ ID NO: 23793 - protein, 116 aa, Pseudomonas aeruginosa
LTCFCSTERLTMSEEELEQDELDGADEDDGEELAAADDGEADSGDGDEAPAPGKKAKAAVVEEELPSVEAKQKERDALAKAMEEFLSRGGKVQEIEPNVVADPPKKPDSKYGSRPI

SEQ ID NO: 23794 - protein, 330 aa, Pseudomonas aeruginosa
KDYPPIKFTPVPADFPGHAGHIGCHPMEFKTFRRTLLLAAVLFVPAGTSMAANLYAFGGRDIAVPSILPEGSVMSRYTFTPMQLCGKPSCDLIGVSLYNKGSVWDPIDGPDLNTNVPGLSVRLLLDGIPASSRFKGTFSQIAEIQLFRNSTPLSDGQFASGAFNSYFLITYKDGLIASGTSSIRLTGSVTTINATCQVADQTVKLQSIAAARLNGVGTYAAVTPFNLVVAGCPRGYNRVGYSLQAVGGAVAEGSGVLPRLAGSTATGVSIRVTDEAGVPLRMGLSLPVTAYDKNTGGAYWIPMKASYVQTAEKITPGSVLAAMVILLDYQ

SEQ ID NO: 23795 - protein, 261 aa, Pseudomonas aeruginosa
GAEAGAGGVVVHAVGEKELRLVRAEDRLQRGGVRAVAGARHAEHLHPVELQQVEQVVVAGVLHHHHVARLEQRAYQQVEGMAGAGGGEDLLRVDMDIDQPQAFLDVLAQRRQAQRSAVVEQPGEFAAGDLADRVAEFLDFPPTVRNPAAAELEFRRAAAELAPCVFRAFVPFAVEVGSGGGRLGDEEPRAVPRFQHPQGDQAVVGLDHAGLAELVFPGQLAYRRNPRAGADAIAADPAADPCDDLLHQRLAGIAVDPEVHV

SEQ ID NO: 23796 - protein, 393 aa, Pseudomonas aeruginosa
TEKRMSNTRRHAACLAFGLCLITLAVNLQAPLYTAYAELSGYGAAATASAFSGYVLGVLPVLLVLGGLSDRIGRKPPIVVALLLSMVATLVMALWPRLEALGVARLLLGVGTALASATGTAYMSELIAGGDSRTSANWVTASTSLGFGLGAALTSLFLLFRESLVPGSFWVQLGLACVALAAVAGLPDEAPRGRDTPMLRLPFFPAGSLPYGLSILLAWATVGLVIAVLPSLLAAHGLARWSGFSTFTVISCGLLFQPLARRMAPASATCLGLVILPPSYALLAWGAIHGSLAAVLFGALGASSSCYGFTYLGGLSAVNVLAGAEKPRASAGYFLLAYLGFSLPVIFTGLIADRFGASTALLLFGVSLTLAAVAVAFSILRGVGRLKASASRA

SEQ ID NO: 23797 - protein, 520 aa, Pseudomonas aeruginosa
ALETQGDHRCGADLVAVALAEEERQFVRTQHAADGLAAGEQAADGLVRLRAAHRAAHRDATVAEQDQAHVGHLELVAQAVLDGTDHVFQAGGVEQVEDQAAGLVEQAVVLAGHVHQLREPVAHLDVALAQQAYLALHQRHCVAGLVWDAQLGDQLVMLDEELRVLAQIGGHLLGVQRCCRFLAFLGHKRLGSRGRRPLQADLAFIHADGRPGHHNGLAGTCPLDVQAAAGEVDLHRRLQPALANPGNRRGAGAGAAGLGLADAALPDAQARMVRIEHLEEADVGLLREARMDFQLRTEAVYRCAVDVLDAQHAMGIAHGYRGQFDALAIHLYLIGQGFALGLERYLGRGQARRTHVHRDLAVRADIQLDDAALGFYADALLHRQALVLNEAGEAASAVAALLDLGAVGVEDPVAEVDVGAARGFDDQQLVEADSGVAVAPELDVLGLHMGVLADQVEDHEVVAQAMHLGEAQKHGLGLTAAAGFRRRRALGRSRGDGPRGSARHPPAPPRRGRGCCSSSS

SEQ ID NO: 23798 - protein, 141 aa, Pseudomonas aeruginosa
GTRHGSAARRRWRRWTGPARTPGSGRGRAGARGWRGCSRRPAAAVRRGSAPRGHHRGPGGECRCLCRPGGRPARAGARGRRGRAPAGSTASRCGSRRRSPPGGQARRRGRRPPRPRRWRCRTCSLSGRWRYRGGSGRPRPG

SEQ ID NO: 23799 - protein, 117 aa, Pseudomonas aeruginosa
RMPRQCMSTMNEARFHDLVDALQQQVEDAFDDSDLDLDLENAGGVLTVRFENGSQLILSRQAPLRQLWVAAKSGGFHFDYDEASGLWRHDGSQEPLGALLNRATLEQGGEDVEFPGL

SEQ ID NO: 23800 - protein, 173 aa, Pseudomonas aeruginosa
RDSAGRRDHELHRALPRGKQRQGVHPDPGLSRRRRRRRQGLDPRAGGHRAAGPDHRPDHRLAGAERQDAEADPAGNRIPAGSRRRLRALIGFRPSPFGDGLRDPQSPPPPPHPPPPQPLPPSPPLSPPLPWRESCPSEPKVLPLSLAQPLLQPIWLAQYTAAPPSCRCAQFRA

SEQ ID NO: 23801 - protein, 643 aa, Pseudomonas aeruginosa
LVQRGPGQGLRRLARLDMHSAVVGEQLVVADIQRGRHLFRQRQGVAPVQQRLQEALQRCEQAAFVTQCLALAPEGVAFVEQADLGAVEVAPVEHLDAVRPPHGQDQPEVLALQGVTIQLQGAVAISLAAQVLEQARQVGQALVADRFRRHFQQVVLLADLQQVAAWLAAKQLPVGLAEQLFDPHGDGGGPVATEAAHHQFRRLRRASGLFADGVEELGKALGQRLGACVMAHRQFVPAVEAELVEGQHQVVAHPGITEHVGTPGSHVQVHLAVVAQRVDTDVDQQQDALEPTRLQQVGVVHGRQGDRQELPQAAQEIVQFGIAEVALAGMQGQPGGAVDDAVAMAPGEQLDQPEAAFQRRVVRPLVSAQGTGEDRPLRLLAVVVGGQLDQGQDVFAEIRGDPRVDVLHLACLALEGGIQAAAEQAQVTAVDAAVSALLAGDLEQQAVAVGQFVDHRATLFHHLAHLPLAAAVEQGQAARLPLPFRDEPLHRQVLPALLRLALATAELAPDLEVQAAPHEFQAFRRLLFPQVAFEMAIDQDVGVQFVEIELAGEYLLLEAQGDAADPRVLAGVGFGEQQLEQRLVGRIDGLGQLPEAGADELPGGDVRQVAEVEHLFGADEAFAEQGPAVFVVAPFMGLRHQPP

SEQ ID NO: 23802 - protein, 161 aa, Pseudomonas aeruginosa
RGASAEPDRATVELVEQQEVLGIAVAAGLFPVFAFVLAETGDVDQETVHLAALAARPVLDQRALAAQLLARAGLQFWGMADPEVEIALFLLGQAPQAAHQEQAVDRLLCGFLPAWLVDKRAGQALGFGEYFVVRLETAQARWRAGRQVARQQRMVDVEQQR

SEQ ID NO: 23803 - protein, 396 aa, Pseudomonas aeruginosa
TQRAPPADSRFRSGSRWPGSVFPRRSRLPGCRPVRSSGVPRSGAKYRLCGGGKLSTLLGQRMAAKVAIPDMITYYILSGDRLERRQHDDAQRGLPPGTLWIDLHHPTPEEERLLESHLQVNIPTREEMAEIEDSSRFYEDGNVLYMTTSVVGGITEHRPSTEEVTFVLSEKWLITVRYADLRSFREFENRCIRQLDANRSSTQLFALMMDSLVDRIADVLEAVQGQLSSMSREIFAESTAQTRKPKTDLQQIIKHLGRSSSLLSKLNDSLLSINRMNSYFRQGCNGWLSEPAKVLAKTVERDVRSLDEYLAKMSTEINFLLDATLGLINIEQNSIIKVFSIAAVLFLPPTLVGTVYGMNFKDMPELDWSIGYPMALGMMVVSAILPYLWFKFKNWL

SEQ ID NO: 23804 - protein, 594 aa, Pseudomonas aeruginosa
PATASPSSRNWPTSPSAPTSASSSTSRCRRSSVGCWRNTASSPTPTASSSAPATPSANTACSTTRATCSSSSACAARRASIFISSTAPRRTCWCSATTRRCSRGSRRWPTSRTPAWSPTGRRSSRFGVRLETRTSRVTRRDYDFEKPRLTLESAARGEARPDLEDYDYPGRFVDRERGKHLARRALERQRSDYRLAEGRSDQSLLLSGHFLPLAAHPQAGWNDLWLLTEVIHEGRQPQVLEESIVSDVSASPDDFRQGYRNRFQATPWEAFFRPPPTPPKPRILGTQSAVVTGPKGEEIHCDRYGRVKVQFHWDREGQADDSSSCWLRVASGWAGRNYGAIAIPRVGMEVLVTFLEGDPDQPLVTGCLFHREHPVPYELPGHKTRSVFKSLSSPGGGGYNELRIEDRKGQEQIFVHAQRDWDENIEHDQKIRVGHQRHDTVQANSYSEFKAEEHRTTHAERKVEIRASDHLTVANDQHLKIASGQFVEAGQEIHLSSGLKVVLEAGAELTLKGGGSFLKLDASGVTLSGANVRVNSGGSPGSGSGAAPLLPGPLRQADSDKAGALLTPAQINTLKRNAPFCEECEKCKDGACDL

SEQ ID NO: 23805 - protein, 1626 aa, Pseudomonas aeruginosa
DRRPVVEQGPDPMISSFYAMFMLRGVNAKQPDASQLIGEFSSGVLNRYEEYANSWLWGWALDVQQTIALSDGNGNELTRLKADKDANILEDVASCPVNGQLKLLHTFESTSFVPIGNTPYEITRIGSRTPQFKGVLDADGMASISGCAPNTLYQVKFYPEVSIQEIDALYRSYDDVIAKLNEWLLEQWNGPLSAEWKRLAPVGDRRRMEQINDAYLDGMGKALVNLWDDVVELFSILANLDEHAAKLLEFINEADFEKLKAQAKELLGTALLIASDEPLLFIYASAIVCWTQLLPPTTAAEMVAELSTGLLLDILLGIILTGGAGLAVRLAVKGSKAIKASEGAMLLRKAMQVLIDTSCRHSLQLHAEKLKPLAVRGEVMANSSNKITAQIQSTAQGIARTEPDTLPLSRGKRANTSLSSSHATPDASAPGRTPAGKPADQAAQTCVKDCPVSMVTGEELLTLTDCELDGPLRFAWTRLYRTSAAEIDNGLGFGWSHALSHRLDRDGDELVWTDHENRRTRFPIPDAQRPAITNRLSRAAIYLGGDPSELILAQAGEKPRFYHFRKDPDGAYLIAISDAYGNRLELSRDRLGRPRRLSHKAGRALLLCYQGRHIERVEYQVYQPADNLEACWHTTQVLARYRCNERGQLIEAGNALYEAERYRYDARNVILERQLAGGASFFWEWEGEGKQARAVHHWASFPQMDSRYVWNEDGSVTAINADGSEEVYVHDDNARLVRQVDPDGGETLRHYDEKGQLVAERDPLGTITEYRYDQAGRLEALLPAEGEPTCYSYFDGFVRSVRRGEAQWKYERNAQGDITRQTDPEGNVTHYAYDHRGCLVEITHADGSLHQLTWNPLGQLIEEQLPDGSVRRYRYDTLGRQITRQDESGAITRFQWDAAGRLSQITLPGGASRMYRYNAYGKVTSECDEQGRMTRYEYLDDLHLVSRRINPDGSQLRYRYENARLLLSEIENERGERYRLDYHGNGLISQETGFDGRRTAYRYDLKGQLLEKTEYGDDGSELRTTYQRDSTGRLLAKTLPDGNRVDYRYDTLGRLVAVDDGTWPLAYEYDLRDRLVREHQGWATLHYAYDALGQLIHCRLPDGNRVDYRYQTGGTLSAIDLNGQSLTRHQFGSGRERQRQQGELLSQYHYDEQGRLLAHQVSQRQRHLYQRQYRYDASGNLAAIEDSRKGIRSFHYDPLDRLLGVRGETPESFVHDPAGNLLAQGGQFDARQMEVRGNRLLTQGDRHFDYDAHGNLVRERRGTGQKLVTEYSYDCQHRLIGVSLPDGRQVVYRYDAFGRRIAKQVDGRNTEFLWLGERLLAESGDRHYRTYLYEPDSFRPLALLDGEGPEQVEPCYYQLDHLGTPQELTRADGRLCWSARYRAYGNVLKLDIAEVDNPLRFQGQYFDAETGLHYNRHRYYNPSTGRYLTPDPIRLAGGLNSYRYVPNPTGWVDPLGLASNKTRCPEALDNNPRKGINSTSGSKKPAGPIVELDAQGNEIYYRTLSEQHLEILRNNFEVPPTSETFISPLQSYSQEYDGKLVRLTASPGTMNELSKIGVTANSGTGLLLPDLPPARKGWKQNNALFKLEALKKPTINEGGGVINTGLGDGKALEIFNKNLIDFEVID

SEQ ID NO: 23806 - protein, 147 aa, Pseudomonas aeruginosa
RNLMKTIYNFKQRIKEDPEYIRKAHELTLNTTKPKAGLKGTYGLLGSKEWWDNLENGSIPQKEISGTIKKVYLTGQDNTEDFNTIDIETENKTLCTEGTYTNKNTDRKHYEAGKKITIKYAFDPLKKPKPNGEIDYSKIVVEISISE

SEQ ID NO: 23807 - protein, 229 aa, Pseudomonas aeruginosa
TLYIVSLLGSDGRRPRRSADEGSGRFGGLGVADDLGQAPQAFVQALRGDVAEVQPQTPEVLLRLGEERFAGHECDIGGQRRLEQGAGIQRLPEGQPEEQPALRDIPFGQLTEVLQQRLLHGVAADPVELAQFGQVLAVGLAAEPLQRLPLPYPVGMQVGRLFQPQQVGEQVRGGDQETDAQARQQGLRHRAGIDPAGLAQAADQRGCAALVEHQFAIGFVFDQGHAEFV

SEQ ID NO: 23808 - protein, 174 aa, Pseudomonas aeruginosa
VKLLDRSYDAAPGSVNMPDLKNHAVQQQAMMEAFFFAYQAFTTKPDEMLARRGLGRVHHRVLFFIARYPGLSVKELLALLGVTKQALNIPLRQLLEMNLIGSATADDDKRKRLLGLTAEGVRLEKALRREQSRLLQRCFEEAGGEAVSGWLAVNRTLARAHAGSRGEAATEAAD

SEQ ID NO: 23809 - protein, 446 aa, Pseudomonas aeruginosa
SALRASRNLPRGSAHRRARSSRTLHGSTRHDRNHPAPASSASVRRLLSRRRGGRLRRHAHRLHQLAGTDVTGRAERRSQQRADFLVDLGPVDRHGPGDHRPDPALPGADRDRLVHPRRGAADQQPARSAVQRGDRRLHRLRPPDHPVRRHRQLRTPDAPGSLLAGLGAAGRGAVPHRHRDLQRRRATDPAGAGDVLQLSAVQTLLAALCGVRCATGGGAAGRDTGPTGLQQVPPGTGGTGVDHAELLPGRHHQHRHPAVHRRHGFAEHARHRRAARRRLPGASLAADLEYRHRLDPAGTVRLPRDQPGGDQRGDLHRSLGPRGPAQALYRGALVRLLQLRRRNLRRHPGSVVRGVPQGTGTVHRRHRPARLDHERPGQLDGRRAPARGRAGDLHGNRLRLHPAVHRLGVLGPGGRPADSVRAQLAARLTDLSPAPSRAPAWPGGHG

SEQ ID NO: 23810 - protein, 313 aa, Pseudomonas aeruginosa
SPGSGLARQTACRPVTECECPAPGHPGCIAARSDRRRPAVHRQGDTGGEARVVAAQVEHRGGDFLDPPDPTQRMHRGGELGLARIGLVGAAEHVGVDHRRTHGVDADALLRVLDRRRFGQADHRVLGSSVDAHLRRRAEPGDRGGVDDRATALGQHQRDLVLHAQPDALHVDSHDGVELGFVAVGQLALLDLDTGVVEGVVETAVGRRATLYQRLDLGVAGDVAANEEGFATCLADRFDRALAAGAVQVGDHHLDPGGGEGQRGSAADARRTASDQCDLAGKKFAHLLLLGKSPSANRDGTGPRQSSQGRRKA

SEQ ID NO: 23811 - protein, 125 aa, Pseudomonas aeruginosa
SPAPPVRWAALPGRSPGSRAAGWWASPAAPRNVASWSKNWASTAPSTTRTKTSPPDSSANARRVSMCSSTTSAAKSSTQCSPASPSRHASSSAGRSASTTTRKRCAARPTTCRCWSIGRAWKAWW

SEQ ID NO: 23812 - protein, 596 aa, Pseudomonas aeruginosa
FPAILQPVLRAKLRHPRLQGISRMPLARWVPGLDSLLHYRRAWFRPDVQAGLSVAAIQIPTAIAYAQIAGFPPQVGLYACILPMLIYALIGSSRQLMVGPDAATAAMVAAAITPLAAGDPQRLVDLSMIVAIMVGLFSIVAGLARAGFIASFLSRPILVGYLNGIGLSLLVGQLGKLFGYEAATSGFVAGILALLENLLHIHWPTLILGSLSLLLMVLLPRRFPQLPGALCGVFLASLAAALLGLDRYGVELLGEVPAGLPQLSWPQTSLEELKSLLRDATGITVVSFCSAMLTARSFAARHGYSINPNHEFVALGLANIGAGVSQGFAISGADSRTAVNDMVGGKTQLVGVVAALVIAATLLLLNKPLGWVPMPALGAVLLLAGWGLIDVQALKGFWKLSRFEFSLCLLTTVGVLSVGVLPGIFVAVSIAVLRLLYYTYRPSDAVLGWMHGIDGQVELAKYPQATTLPGLVIYRFDAPLLFFNAEYFKQRVLAVVDGSERPNAVLLNAEAMTNLDISGLATLHEVQQILKAQGVHLSLARVTGQTLDLLQRSSMLGEIKPPLVFSSVRSGVSAYRYWLRQQERLAAQAAATSGNA

SEQ ID NO: 23813 - protein, 554 aa, Pseudomonas aeruginosa
TCPTLTQEPCHELSRKLPLRNHRLRSRRRPRPGDPVQLFTVQPARLAAVVRPARPSGAEDAGQRDAHLHLQHPSPAASLLPHLRLRAVQRRHRPGRPGDGRGQRALPGGHRRQRAPGTALRWPQRLTLAQVADHLGLVAAELHAVFLALPLEGVHRVVVLLEQPLDPATMGIHRAVAALLFQRLHEDRRQPLVALAAEALDDAGEALLQVGGEGGEALLHAHHALELAAQVDHVVPEDTLDTLLEGILQPDQRVALHALVQLQRQGAAADDPPLVLEDELADATMTLLQDVDGQAVLEVDLRRLRRGSPAKAGAAMVGVAFEIEAVVQRRDHLGLAATGEAADQHEIALVDRRAGGFEKEVAQRLVAADHPWVVDAGVLLQPLLDDLRAQAAAEAIQVAVRVGFGEGFPGRQPFGLERPADQFVAKGDGGLLAVLLVAGADLLPLDVVHQRPVDSVGKGALVVLHRGAHIHQGDIVEKQFAVVLGVVAHYSTCTARLCRSTSSPIGASCRPSSAATARNSASPSGATATSRPPLVCGSQSNSFCTSGSGAMRSP

SEQ ID NO: 23814 - protein, 170 aa, Pseudomonas aeruginosa
YSALARRGTAAYSTRAVSLLPSAISTRWPSRPKPVTSVIALTPANRPKRAPGLFRVHIQSRATPTSSARSLAFFSAVVRMPMPSGLVRYSLQPASAVSLRFMKRFSTTPVTARPKIGSGASMECPPASGMPASSQTLRPPAITSRATSAASTLTGQPRMAMAISGSPPMA

SEQ ID NO: 23815 - protein, 378 aa, Pseudomonas aeruginosa
GRRRHGKRESGGTWRPSWRVDRRIRRRQAVAAEHSAAAPGIRAPPRRAAVSEDRPADPLAEFLQRGDTRQRIARGVQLRRPDADREAPRHHRDDAAADAALARQADPVGKVAGLVVEPAGGHDRVDLLGLPLVEHLLAAVLAEALVGEEAERPRQVDAAHAQRAMMEIAEQHRLDVVVEVAERFHQVGRRRVARAVLVLRARHHRVRHHFRVAAQAPDEIAHRLRRRGETRLVDVADHQGAGIDERIARLAALELQLHQGVERLAGGLVAEALPDVLAGMLDRLDQAEHLGNALDGKRPQGVAGMEQLAVAAVHGDPQLVRLDAGERGNVVGDLAAPDQRADFIENLVQQLLHDDLRRDTGAPTRRIRASANARHHRR

SEQ ID NO: 23816 - protein, 251 aa, Pseudomonas aeruginosa
TRGRHAPRAELRCASAVAQAIADARLGHQEARAGRIVAEFLPQVADHDPQVMGVFDVGRAPDILEQLLLGHYPSEMACQRGEHRVLLTCQRHFRTLQGDSAIGEVHLQRADRHRRLRAFALRRLAQQDAHAGEELLDAERLGHVVVGAAVQGQYLLALAGAHRQHQHRHLRPFAQVAKDVLAVAVRQAEVEHHQVRSVQRGLGQPLFAGAGLEHPVALGIEADTEELADLRFVVDQQDAVLQLGHGTRHGR

SEQ ID NO: 23817 - protein, 164 aa, Pseudomonas aeruginosa
RSSRSASSRVLSSSSRRSAGGIASPSASRLSMEPRMAVSGVRRSWDTEASKALRSCSVSPCRRAASRSSARRARARAWARGWPRAASRRRRCGLSGWPSSGATPSSASGPSSADSGHHHQRPPGSVPVPRPAGWSWAQAQSAATRSWSASCRCTPASVFHSPLT

SEQ ID NO: 23818 - protein, 138 aa, Pseudomonas aeruginosa
TSIPAASNSWMSCQRLAWRLPGTLLWASSSTRASAGGSARRPSRSISCSFIPRYSRLRSGCCGTPARRDSVSAREWVSTTPARSFTPWRNWAWAACSMAKVLPTPGAAPRKTFRRPRPSAGRSASSASARAVSVMDRS

SEQ ID NO: 23819 - protein, 339 aa, Pseudomonas aeruginosa
VHLRVPGWCPPAYLRRALQGARRDPHPGAPRTGGYPYGRRLRPRHRQARCRAGDFRPGRDQRHHRYRHRIHGLHPDGDPVGPGAEQHGRYRRVPGNRHGRDLPADREAQLHHQASLGNSRGDQEGLLPGAVRSSGAGGRGYSEGHGRPDAEVRIFLSEEGQVAFVQPGRSRSLGTDPQGRRDAPGRQAPGGLFRRRRDHGQCRGAADRAGADAQPAGDQHPDGPRRVSRRGPPVPWHARDARQLHRQPGDASQRRDPRGRRAFRRPGHQRRGEVLPERQDHPHRHRSGVDFQDHQGRHPDRRPGGQRSHRNGRDRQGNRRDPEPGCPGCLVEADRRVAW

SEQ ID NO: 23820 - protein, 179 aa, Pseudomonas aeruginosa
RRDARHVAEQDGAYLIMRHIISLLLENEPGALSRVVGLFSQRNYNIESLTVAPTEDPTLSRLTLTTVGHDEVIEQITKNLNKLIEVVKLVDLSESAHIERELMLVKVKATGAQRAEVKRTTDIFRGQIVDVTSSVYTVQLAGTSDKLDSFIQAIGTASILEVVRSGVTGIARGDKTLSI

SEQ ID NO: 23821 - protein, 342 aa, Pseudomonas aeruginosa
RGIPMRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 23822 - protein, 211 aa, Pseudomonas aeruginosa
RHGSEEVLLMRYWYLRLAVFLGALAVPAWWMYQAWIFALGPDPGKTLVDRLGLGALVLLLLTLAMTPLQKLSGWPGWIAVRRQLGLWCFTYVLLHLSAYCVFILGLDWGQLGIELSKRPYIIVGMLGFICLFLLAITSNRFAMRKLGSRWKKLHRLVYLILGLGLLHMLWVVRADLEEWTLYAVVGASLMLLRLPSIARRLPRLRTRHGVS

SEQ ID NO: 23823 - protein, 62 aa, Pseudomonas aeruginosa
SAPLIRVRSAVRICPDPPIVGVLRDPIRGHSSAGRAPALHAGGQEFDPPWLHHLKQSSKAQK

SEQ ID NO: 23824 - protein, 802 aa, Pseudomonas aeruginosa
RLCRRALGSAGLSRQRGSAGGLCCVMLLSSVCHTEPLGCHPMNDMANSPMNSSLAPERIDFNTPALQRKRRIRALKDRLTRWYVLVGGLAVLAAITLIFFYLAYVVLPLFRGADLETREALTPAWMQQAQVPLLLSIEEQNQVAMRVGGQGEILFFNAKTGVELKRVALPLPAGSEIRSIAQDQPGSPTVALGLSNGQVLVFQHTYKVTYPDNKKTITPEIAFPYGETPIGLDPQGRPLEHVSINAGDDSLLLAGSVDKQLLLLSMTREENMLTGESTLDEERIELPQIAEPVKAIYLDPRKQWLYVINGRATADVFDLHSRQLNGRYKLLEDPNAEVTASTQLLGGISLLVGDSKGGIAQWFMARDTDGEPRLSHVRDFNLDGAPISAIAPEQRRKGFIALDEKGNLGVFHSTAHRTLLVQPVADSSGVITLSPRANRLLLEQGGKIHRFALSNPHPEISWSALWGKVWYESYDKPAYVWQSTAATTDFEPKLSLSPLTFGTLKAAFYAMILAAPLAIAAAVYTAYFMAPAMRRKVKPVIELMEALPTVILGFFAGLFLAPYVEGHLPGVFSLLLLTPLGILLAGLLWSRLPERIRLSLPAGWEAALLIPVVLAVGAFALWLSPHLETTFFGGDMRLWLSHDLGITYDQRNALIVGLAMGFAVIPNIFSIAEDAIFSVPRSLTYGSLALGATPWQTLTRVVILTASPGIFSALMIGMGRAVGETMIVLMATGNTPVMEVNIFEGMRTLAANVAVEMPESEVGGSHYRVLFLSALVLLTFTFVMNTLAELIRQRLRKKYASL

SEQ ID NO: 23825 - protein, 352 aa, Pseudomonas aeruginosa
SPAEVPRSTTFPAPERFFPDDPFTARSLSSRPGNKALLVLPIRDNQNDTIRAVMLGRLLLLCGLFAAAAPAAALTIYKYTDANGVVTYSDRAVAGAQVFVFRDRMVEHLEREVKLETKKHAGGETLQVRNDLYAPVEVELRIRNPRNAVGVPDGPIRWVVPARSQVRLATLAPRKAGKPMSYAPKLRYALGDPRQQPLLYRYPLPWRGGPFRLSQGANGKYSHFTPKGRYAMDIAMPEGTPIIAARGGTVVKIENNQSGRGNNPSGNFVRILHDDGTMGVYLHLMRHSVLVAEGQRVQVGTPLARSGNTGNSSGPHLHFVIQRNVGLALESIPYDFAQPVDSLPNFAIVREP

SEQ ID NO: 23826 - protein, 328 aa, Pseudomonas aeruginosa
KRSVRRGRCLGSTPIPVSCTDRCAPCSSAHQRMRISPSSGVYFTALNTRLEKALRSSASLPLSCTAGAASRLMRWLRPADRAWASLRMLARRASTATGLLSPGLLGGLQLGQQEQVVEQVLHASGLLLHLLQGAQPARVHILDVVEEGLQVAGDHRQRRTQLVGDVGHEVLAHLLQLVDAGDVADQHQVLAVAVEGDVELQAQALVDRRGDFQRLAVILLVEVFLEARMADQVAHRLATVLRGLQAEQVFRGEVPPFQVAVAVEHDHRVTQGRGGLLDPVDHRLQAATGALVAALQVVDIVEDFAPEAVAVRRWLVWLVVAQPLVQAQ

SEQ ID NO: 23827 - protein, 319 aa, Pseudomonas aeruginosa
LPEGPAEVESQAEGQGPAVMAADHAEHEAGGQHEKQVADQRSTPVLVHDGLHPVQWRSVTDRPGETTPAAGRPGAGSALGGETIAGPADSLNQIFVDLAERLAQAADMHVDGALLDIDVAAPDLVQQLAAGIGAFLVSHEELQQAVLGGAHLGRLAVDGHAVADRVQQQAADLDRRLAVARPGAAQHGLQAGDQLAGRERLGDVVVGADLQALDLVVLLALGGEHDDRDVDGQFVTLQASRQFDAGSAGEHPVEQDQVRLAVDDHRVRLLGIFRLQALVAGHLQGHGDHLANRCFVINDEDCLANHGLASGRSVLRRIR

SEQ ID NO: 23828 - protein, 171 aa, Pseudomonas aeruginosa
RSIPTTRTAKGNPPVPGSARRTGRRWQRPRERRPAATGAWSLARTAPSSGPTTASPFIPSSRTRSLATRTVTARWAPGTSPSRTWTRRSPACAPLNAARSRRPCRGRSPGQPSGCAGRRGSRPAGRGRGSTRLPRRSRPPPPPGRGRSTGPVRSGCRPAPAGAGSGPAGCR

SEQ ID NO: 23829 - protein, 306 aa, Pseudomonas aeruginosa
DQLDACWTPASARYRLWTLADPADNHNKDSRHEHPLRRASGRSAAAGGQGWPAGRVAPPPARPRTAARRGRPASLRVRRTLGVSLHAVAGGIAGTHRTGSGPARPLPSAEGAGRGARCRHRPVRRRAAAGERRAAGDGAFPADPRDRSAGSFRPGPAWRAQPGDLPGRCPSWSVLRTGPVLADRLLHRRQRRGERRRRALPEVRPDRAQPVAGGHRDPGRRAPEPGVQRPGQRRLRPAGAVHRLRRAARRGGGGHRQAVAAPAGGEGPAGQLRRCGKRRAGGGRPDRCRHRPGRAGNDGQPVDPRR

SEQ ID NO: 23830 - protein, 597 aa, Pseudomonas aeruginosa
SAGRQDPRVVRGGRRQHHRRTWRRPREDQPDVRSVQCRRADPVPRREGGVRPGRAAQSRQERAHPASLRRVRRHARPPRSTAVPRTGAFLMSQPYFDPDAGADHAGALLERVRDALARRAPLRIVGGDSKAFLGRPVAGEPLALAEHRGIVAYDPCELVITARAGTPLDELQAVLARGGQMLACEAPGFGGRATVGGVLASGLSGPRRPWAGAVRDFVLGTRLISGLGTHLRFGGEVMKNVAGYDLSRLLAGSFGCLGVVTEVSFKVLPMPRCQAGLSLDLPVATALRKLAEWGGQPLPISAACHDGEALRLRLEGGEGSVRSARDRLGGEALEDGFWADLREQRLPFFDRPATALAPVAAGAGAGDAVARSSVAGLGRGAALAEERRAGRGHPCVDRRPWRPRHLLPRRPSRCAVPAATAWTARPAPGTQTPARPAGHLQSRADVRRTLRRRDANQPLRFRPATRRGRRSRAHPAQLRALRFLQRHLPDLPGAGRRTRRPARTDLPDQAVPRARRGQRAHPPAPRSLPELPQLRNHLPVRSRVPQAAGYRPRPPRRTPAARLPATPAARRAAPAGPAPGVVRRAGRHCRAAEASAA

SEQ ID NO: 23831 - protein, 295 aa, Pseudomonas aeruginosa
GDAGQAATSGRGAGQAAAAPACTARAAARRLRAAGAVAEHQRRRRAGSGPPGNQRDAGGRGRLLRRAGFPPGCAGARPPARAAQYRRLVAVAARGCRGHRADRQRLRRLRQGLRLPAARRPTVRGQGARGRRRCPRPGGSASRRAAGVPRPALRPAPGVPLPMHTAARATTGRGRGGGAAATGLPSHRGGRRSSLLRVRRHLLADPAGAVPASARQPPGRPGKRRAGCHRHGQRRLPGPSRRGRTDPGTPLDRAARPGLARRRVKPCTASRYSAARRSPASLARPARRHSAKAGR

SEQ ID NO: 23832 - protein, 63 aa, Pseudomonas aeruginosa
VRRTRRVAMRKWQCVVCGFIYDEALGLPEEGIPAGTRWEDIPADWVCPDCGVGKIDFEMIEIA

SEQ ID NO: 23833 - protein, 401 aa, Pseudomonas aeruginosa
AKSTEAAPGAGNHRGTEMSERAPLVIIGTGLAGYNLAREWRKLDSETPLLMITADDGRSYSKPMLSTGFSKNKDADGLAMAEPGAMAEQLNARILTHTRVTGIDPGHQRIWIGEEEVRYRDLVLAWGAEPIRVPVEGDAQDALYPINDLEDYARFRQAAAGKHRVLLLGAGLIGCEFANDLSSGGYQLDVVAPCEQVMPGLLHPAAAKAVQAGLEGLGVRFHLGPVLASLKKAGEGLEAHLSDGEVIPCDLVVSAVGLRPRTELAFAAGLAVNRGIVVDRSLRTSHANIYALGDCAEVDGLNLLYVMPLMACARALAQTLAGNPSQVAYGPMPVTVKTPACPLVVSPPPRGMDGQWLVEGSGTDLKVLCRDTAGRVIGYALTGAAVNEKLALNKELPGLMA

SEQ ID NO: 23834 - protein, 120 aa, Pseudomonas aeruginosa
SLWFRWTAVPLSAAGKTARTQKQQTVKEATMRKPELAAAIAEKADLTKEQANRVLNALLDEITGALNRKDSVTLVGFGTFLQRHRGARTRKNPQTGQPVKIKASNTVAFKPGKALRDAVN

SEQ ID NO: 23835 - protein, 175 aa, Pseudomonas aeruginosa
PPRARSQSGSGLRRRRFRAHRKDSCSPPREQLQCAAHLPGYRGACMKFRLLLWMLGRLMAKASRDNPAFQKQLEGKDLVFQLHTLDGKVARHYLVRDLRVSSKRGTHPQPSFSLGFKDGAYGFAAMTSKNPQLAFMQGIQNKDIQIQGNPALVIWFQGLVKYLKPKKKAPEKKAA

SEQ ID NO: 23836 - protein, 572 aa, Pseudomonas aeruginosa
SGVHCRRFDAYTARLVVGRRRLHVANSDDRRLRRCRRAPRRGAAGRWLAGPWPASLGGRLAAGDPAGGWRSAGSGVSRAVAERAARLPGVQRRRQSARRGWLPCRLRRRPAPCAGLVAGPRPAAQAPAVRLQHRGLRADRWRLDRRGVAGAFPGLFRTDHARRRAGRAGQRDTGYPRAPGRHLRSGAGVAAQPGASGVPGGQRAAPVCQPDPRRRCGRAAGLPVARRCRRPGAGGLLHRCRRRARGDARGGRLPAPAPGRQPMGRRTFGTPRRQQALQQPPRPGARLGAALSQLPRGLRGGARGRLMAANRLLARPWLPGVELFHADFSGQAFGRHSHSAFAIGSILHGVGGYQCRGRRHALPAGTLSLMNPEEPHTGHAESERLVYRMLYVEETRLLGLLGRKQLPRGFGELNPADDGSVAAGLAWLAEDFQRSDALGLESRLLALLEQVFVRHGGLRPAAAAPRDGGTTARLRDYLEAHATEALGLDQLAQLLQRHPRHLIEAFRRAYGVPPHTYQLQCRVRQAKRLLLEERPLAELAQHLGFYDQAHFSTTFRRFTGVTPGQFRRSAKT

SEQ ID NO: 23837 - protein, 228 aa, Pseudomonas aeruginosa
VFSNTAPAVLHRLEAFAFRGAFMFAAFVLVASTHFAALLSPGPDFFLLVRAALLRGRRQADGVAAGIALANLLSMLLVLGLLASVPDSAHSALRWLQALGGLYFLWLAGQALLAQRRLEMPAQRDVPSRGGYLRGLRDGLLASSLNPKLPIFYAGLFGVLARFSLPGWALALCLAWMSLAVLCWDMALVRLLDRPRWRGWLQRRVGALDRLCGVLLLALGGWLVLAAL

SEQ ID NO: 23838 - protein, 405 aa, Pseudomonas aeruginosa
EASALQQPDALAGHVAGHLVGAGGIDRFEQLQLVVVEAEQQFAAAVALLQPDAVVVAAHRCAIAGQAQRVAFGAGQTADQAIGLELDLAALALAFADLPAALQIAAIQGPLETAAGRAVGRGLRVETAETLFRAVGAGLLDQLLAVQFETLLVVVAIEGNLPVLVIALAQGPFAQFEAVAEGGFACLAVELPFQVRAIGEQGLAQLAVLARGVDRGLVDPGAGRIGRAGAAGQQGGGCGEENHAAHRATPCRATGPWAPSRTSGLFEDDDGVHFHLCALRQGGYADSGARRVGLGEVAAHDLVDLGEVRQVGEEDVQLGDVVQVAAGSLDHRLEVLEHLDGLLLEAFHQFHGLRVQRDLPGHVDGIAGLDGLGVGADGGRGVVGVDNGLGHGNSLLKSSGRGGAG

SEQ ID NO: 23839 - protein, 276 aa, Pseudomonas aeruginosa
GVPGASYGLERDRAEAPAGHSMFWTCSRICSIRTLRLTAAWVERGSNALEPRVLASRLSSCIRKSRRRPAAPPALRTRRTSPTWVARRSSSSATSLFCASRTSSCSRRCGSSSALSSAKRSRIFCRWLASMVGTSSRRLPTSTSIASSRSLSSFASSRPSRERPALSCSRAWPKASRAAALSACGSAESATSTPGQASTASGSSGAGWRIRAATPSAAATSWRARSWSTCRLLPAVSSAKRRVHSTLPRDRPWRSASRTAPSRSRKASGRRRWGSR

SEQ ID NO: 23840 - protein, 163 aa, Pseudomonas aeruginosa
TPCSNWPSRACRSCSNFSAPRWPNEQTPGTACRAPEKERYMNDVSEEVAATPGQEARQWAMFCHFAAFIGLVFPFGSLLGPLIVWQLKRESDPFVDAQGKEALNFQITVALAMFVSFLLMLVVIGFFLLGLVCLAALVLTIIAGIKANEGKAYRYPFCLRLIK

SEQ ID NO: 23841 - protein, 222 aa, Pseudomonas aeruginosa
LNSCGLVSFMQAYQRDFIRFAIERGVLRFGEFTLKSGRTSPYFFNAGLFDSGLALARLGRFYAEAVIDSGIDFDVLFGPAYKGIPLAATTAVALAEQHQRDLPWCFNRKEAKDHGEGGTLVGAPLSGRVLIIDDVITAGTAIREVMQIIDAQGARAAGVLIALNRQERGKGELSAIQEVERDFGMPVVSIVSLEQVLEYLAEDAELKKHLPAVEAYRAQYGI

SEQ ID NO: 23842 - protein, 643 aa, Pseudomonas aeruginosa
TAIARCERAGRRTPRRWPALPSSSGRRGLSVVRRERTPCATREEHHVVHAPPRTGQLAPLPPGVAACPGPDAGGLRRIHGAAGAGRRFPACPCGPCVGAGVFRQLQALSRQSRLRRAADRRCRCLGATPGAGHRHPAGPQHQRLQGHATHGHVHAVLGKTVPGFDRFHVRSAGPIGDTGMPSHLSRRQLLQRAGALGAFAAMVGNPALAELLRAPRLIPWRNWSGAQSCLPLAREAPKDLDELVRIIRQASGRIRPVGSGHSFSALVPTDGTLLSLAYFSGLLSHDSATLQAEFGGGTPMSQMGAPLKEIGQALVNMADIDYQTLAGAIATSTHGTGVGFGSYSAQVRGLQLVTASGEVLECDAKRNVEVFDAARVSLGALGVVTRVRLQNRAAYRLRERQWIARTEELLEDVEKNTRENQHWEMLVVTHSDYALSIALNETDEPKTPPLDPAKEGGNEFVGLIEGLDKYLSDFPETRRTLLNSLRHFARFDERVDDSYAVYANVRNVRFNEMEYSVPAEHGPACLREILALIRDKDLRTWFPIEYRYVKADDIPLSMFEGRDSCSISVHQHYSMDHHNFFAAVEPIFWKYAGRPHWGKLHGLNAHQLQGLYPRWKAFAEVRQALDPRGRFLNAHLSSILGVT

SEQ ID NO: 23843 - protein, 203 aa, Pseudomonas aeruginosa
SSVPSRPCRSGDWGCGSDTRTCSAPLACWAMCCRCAGPCATRSTSACATSTARAGSSPPASTSRAKPSSSRSNATCPAVRCRCSPSRSSSPACWCMGVPWSARRSNRWASNSSMPLRPTRASTCACWAPRYASAACTTAWRSPATGWTCACPTTTCRRCARRWPCWSRKTPRCTGNSTWSRRWNGPSPATSAWAARSKGFPPN

SEQ ID NO: 23844 - protein, 226 aa, Pseudomonas aeruginosa
ASAATFWPLSTRCRISRAAKLTGPGLSLSWAAWPGAFRWASTTPSQASRMRWAASMRVASPLCRASRARGLAAAARVSAASCCKAWRKAPAWPSAQAASNWRCCASPAPPKTPNQSRAPAAATPSRLAHMPGNRSLPSARSDAALARLLFRFEHVAQLVPILGRCAGKASCRVSSASRPVFGVSGCRNGRSRRRRAGFRRTLRPARNAPAPPAPVPTARCARRRRW

SEQ ID NO: 23845 - protein, 71 aa, Pseudomonas aeruginosa
SATAAEAISRSQGISASQAASMSRALTTSTRCTRSGVGRCTGPVTRVTRAPASTAASARAKPIFPELWLVM

SEQ ID NO: 23846 - protein, 186 aa, Pseudomonas aeruginosa
RTGSMFSWVGPAVISTCTPVSAWRWKQSAARCASSSASSMRPRPTSPQAWLPAAGPNRWKPRWRSSSALAWVAVSRHMAWFIAGARAICASVASTRVVSRSLATPWTRRAMRSAVAGAISTRSAQRASSMWPIAASAAGSSRSVCTGWPDNAWRVRGVMNSRPPWVITTRTSAPWSRRRRTSSALL

SEQ ID NO: 23847 - protein, 263 aa, Pseudomonas aeruginosa
HALRQTRLPRSSAAQKGWAKIAQRPHGNSGRARWGKRMSIRDWPEAERPREKLLEQGAAALSDAELLAIFLRTGVTGCSAVELSRRLLSEFGGLRALLEADLASFCGHLGLGVAKYAQLQAVLEMGRRHLAERLRRDSILESPQAVRDYLKARLRHEQHEVFACLFLDTRHRVLAFEVLFQGSIDGASVYPRQVVKRTLAHNAAALILTHNHPSGERPSESRRPPAHCAPQGNPWRSSTCGCSTTFLIGRRGSPLSLAEYGWL

SEQ ID NO: 23848 - protein, 499 aa, Pseudomonas aeruginosa
RRPGSSSDRLGRPFRAGSLEPHPRPGFLLEARPLCFVRRIYPLAPARLSGCQRENRNALGKLFRRLFRSHQHRSRPWPDHAAGLVAPGELGLRQFRHRRDGQHAGSGRAARRDDRRAPRRARRHAAADAVVPAHRGSLRRPAGAAAELPGMAVAAPADRRAAHRGVHPRGKLDQPVGGGEVAWPAGRAVRHRLRPQPTVRAGTADLHRYRRRPWLLVRRLPADCWLVAAAGPQRCAQGRSAQCLRARFVGLLPGSAGDRLGGGVVRCLRGDDPHPAAGIRVAPGLSASGGAGHGQYRGGGRCIVAAADRLARRPGLAQRPVRRLRPGAAAEQPGDSPAAADAVDLAAAGAVRGQRRRVVHPGADPDRRALPRRCPGPGQCPCRAAMGHRLPARPAGHRRRQPVDQRSRPAVDDGARRGGLRGAGAAARGDSGGRRGDRPGSLRVTLRASFPVRSFPRPRRSGVATGCPARGAGPGAGRRVRRSRPASAGYRCGRCAPGS

SEQ ID NO: 23849 - protein, 224 aa, Pseudomonas aeruginosa
SCTRAPPPLAGSATDRGGTCVCAEGRRCCWYLQCCCCWRSATAGMPGAACCASRVSSAWSGKAWACPPKASGCDGWRWSGAARMAPACDWTWNTRCCAGPGCRVGVRVYPACAWSKWRSPGNRLPRVPTTTPLRWTGRPCARPSPGCRNRSTSNASISTCLVPPAAASRTADWTSAARRERCFRWLRNCACNRRRSRPSSTPSSSRSLLVGACGRARNSTGRRC

SEQ ID NO: 23850 - protein, 462 aa, Pseudomonas aeruginosa
LFLPPSSYTARIYTLKITNVRGSSATWEATMRVLVLGSGVIGTASAYYLARAGFEVVVVDRHDGPALETSFANAGQVSPGYASPWAAPGIPLKAMKWLLEKHAPLAIKLTSDPSQYAWMLQMLRNCTAERYAVNKERMVRLSEYSRDCLDELRAETGIAYEGRTLGTTQLFRTQAQLDAAGKDIAVLERSGVPYEVLDRDGIARVEPALAKVADKLVGALRLPNDQTGDCQLFTTRLAEMAKGLGVEFRFGQNIERLDFAGDRINGVLVNGELLTADHYVLALGSYSPQLLKPLGIKAPVYPLKGYSLTVPITNPEMAPTSTILDETYKVAITRFDQRIRVGGMAEIAGFDLSLNPRRRETLEMITTDLYPEGGDISQATFWTGLRPATPDGTPIVGATRYRNLFLNTGHGTLGWTMACGSGRYLADLMAKKRPQISTEGLDISRYSNSPENAKNAHPAPAH

SEQ ID NO: 23851 - protein, 157 aa, Pseudomonas aeruginosa
SVSCPGVISHDEGVRVNLIKKMLAAQAAVLALWAVSAQATTTDDAIAKRLEPVGKVCVQGKECEGVGAVAAAAGGGGARSGEDIVGKTCNTCHGTGLLGAPKVGDKAEWGKRAKEQGGLDGLLAKAISGINAMPPKGTCADCSDDELKAAIKHMSGL

SEQ ID NO: 23852 - protein, 370 aa, Pseudomonas aeruginosa
PGAADGSARPCRLAPLFPASAASARGAPGIRRGSCAPRGLRATARAGDHVADHAEIDGVAAAQVTAIAVDLDQGGLLRIELRPGEVGAEQQEGVALGHHVEAGLDPEHTGHAHVEGVVVLDEVLGPRRVRDGRLEAVGEGHQQVVGALAAGAGVDADLLAVGQQAGDVLQFGVAGAQHRLREMHRERQVVLHRGLADVGRQDHHRHAAPVERRLAGQGHHPARLFRAVHLLAEHRAAGVDRLEVDLLGKLHAQLRGNDLAGDQHHRRAVALGLVDAVDEVQAARSAGAGAGGQASADVGLGARGEGRRFFVAHVDPLDLAAMDGVGDMVEGVADDAIAMADAGGFQGFHDDLGDFLARHEAVLEWNSLAS

SEQ ID NO: 23853 - protein, 133 aa, Pseudomonas aeruginosa
IITLHVEVIARYCRASARCRRSMASMRSRSASVRATLSMRCKARKESSRRSPAASSQRRSASASAQLRCIAWRSRWALAQPWRASCRCRAAPTRSLTSAVAVSPCPGCRLVLSRSTLTCRSMRSSSGPDSLPR

SEQ ID NO: 23854 - protein, 286 aa, Pseudomonas aeruginosa
GGSGAWPERCPAISSRWSTANTVSPLARLASSAFSFGTTRTRLASRAASAAGNTPRTGRIAPDRASSPRHSRPSRAVPGNWPLAARMPSAMARSKRPPSLGRSAGARLRVMRRAGKSKPALSRALRTRSLLSRTAVSGRPTRVSEGRPLARCASTLTQGASTPTWARLWTIARDMDRSLISRRSQGGGSVGGRRQLAFEFRYLGLQGFQPCASAGEDQHLAVELLAADQVELAEGALHQGAELRLQLGLGQRRFAGEQAAGLLAEGFEDGFGRQHGEGSGNEWAAV

SEQ ID NO: 23855 - protein, 181 aa, Pseudomonas aeruginosa
DRRARSPIVPRFAGRRPGRRGARPEQRRHRLDADLHCARPAHDHPRPGAVLRRHGASEERAVDHDAVLRHHRPDHHSLGGLWLQPGVRYHRDGEGRPQLQFLRRRTGQGLPQRSHRRRPDFRHRAVPGKRVHHLPDDLRDHHSGADRRRLRRAHEVLGDADLHGGLVHRGLRADRAHGLER

SEQ ID NO: 23856 - protein, 328 aa, Pseudomonas aeruginosa
RRPDVGLGRAGLRRRHRGAHQRRYRRSGRLPGAGQAQGLPDHADGAAQPRLHLGRGGHAVDRLVRFQRRFRRRRQRHRRDGHAGDPDRHRRRGPGLDVRRVDHPRQAERPGHRVRRGRRSGGHHPGRRHRRSDGRAGDRPGLRGDLFLRRHQSQARAEIRRFPRRLRRTCGRRYRRRAAHRDLRGAVAGRLRQRGGHRRAVLRAVQGRGLHRGLHRRGDLRDPQGAGPGHGPAGHRGRGSGRPRPGAAQRARLQPVIPADARLSAGRRFASRARLRRTPCPCASKVLGASRDCHHLSATGLSVTASGLRHHQLSQVCLLRSLLFQMPR

SEQ ID NO: 23857 - protein, 155 aa, Pseudomonas aeruginosa
NARRDGSEPIWNSSMWQQTLITLRPRPRGFHLVTEEILDALPELRQCRVGLLHLLLQHTSASLTLNENADPAVRRDFERFFERLAPRGEVGYEHNDEGPDDLPAHFKASLLGCQLTLPIQSGGLALGTWQGIYLGEHRDRGGARRVLATWQGESV

SEQ ID NO: 23858 - protein, 163 aa, Pseudomonas aeruginosa
DGGAASARDPAGGCGSPTSARWVPDPGAPRCSPAIRGAGPSALFITGATSHRVSSRSKVISRRLLMGRCLHRRCPCAWRGDGRGRRPRPGAGSPGGYRSGSWRCRRGRAVPARRAGRRTTPADGWRRSAAACAGAGAGPARGRRPGAPAAGSPAASGACRRDR

SEQ ID NO: 23859 - protein, 155 aa, Pseudomonas aeruginosa
SHPPRHRRAIAGRGRRRGSWAACADSSARSGRWQGRAGSALRVAGTGRGRASPRAAVPGCGWTGPAGAGGRRRCAGCGCRGRSSRRARPFRRGRGSSAGRGGSRRGCARRPGARCADVRGRHPGRRASRTARRAQRTERSGEEKRGSTRARTSAT

SEQ ID NO: 23860 - protein, 165 aa, Pseudomonas aeruginosa
AATCSASSAAVGSWLFSVISVSVLAGDGPYRRTWPSYTRTAGPVIITGWPGPAHSMCRRPPGRSICTGDCSQPWRIPATAAAQAPVPQAWVSPTPRSQTRRRAWCGSSTWRKPMLAFFGKRGWTSSCGPRLCTGALSTFSTRSTPWGLPMDTAASSTRWPFTSIS

SEQ ID NO: 23861 - protein, 530 aa, Pseudomonas aeruginosa
RKSTSGLLGASTISNWSKPIPVLRSPQSLTCLGCTWACWLTRSRTMKSLPRPCILVKRKSMVWASLRQQAFAGVELLDGLAATDLVGLLAIHQHLRGAAAGVVVRAHDEAVGAGRAHRQEVAFGERQVAILGEEVTGLADRPDQVVAARRGVARAYRLHVHPGLVESRADQVVHRRVDDGEILVLGVLEVLDTGQQHAGVGDDGPARLEHQGQVAAVQALADGADVVAGQRRLFVAVAHPEATTEVQVANADAFAGQAVDQPEQALEGVEEGLQLGQLRADVAVDADHLQVVKLGGAGVDRLGLVDGDAELVLFQAGGDIGVGLGVHVRVDPQRYRRFHAEFRSYPLQALQLFAGLDVEAVHADFQGAAHVVAGLADAGEHHLGRIAAGGQDTLQLTAGNDVETGAEARQHIQHPEVGVGLDREADQMRHAGEGIGIGAVLGLDVCAGIDVGGRAETLGDAGKRHPFREQLTVAVTECVHGRSLRNRSGLCCVLSWLFRRPAGTAGLSGRRRRWSRRGGRARRRTGTAAS

SEQ ID NO: 23862 - protein, 167 aa, Pseudomonas aeruginosa
CPGKPRLRAGFLLFCDSCFSSINRTGPRSTPAIMSTPPITITRLDLQRLERLLDGLDEFGPAAEALEAELSRAQVVGHDEIPPGVVTMNSTVRCREESSGKEYTLTLVYPEDVAGEGKVSILAPVGTALLGLTIGQTIDWPAPSGKTLKLTLLEIEYQPEAAGDYAR

SEQ ID NO: 23863 - protein, 428 aa, Pseudomonas aeruginosa
APVSVVGLGRSVGGLAPAVEDLLILAAGEDALHAEVEAFEQMLGLRVAARERQVQLRAVDRGHRLELAFQFGMFAEQLASRIAVGQGVVDAAALEHEETVVVLAYRDAHQVVAAIEAVAVFIAEGHRDFPAAQRLLRIHRPRFVASRPELDLRAEQRMPGQTVVGEDVRVRRGVEAAGDQAFQGQLHAAGVGVGIELDRRVRSPEGGPHDVRAHALDAAVLVGGIGIPVVFGAEHQGFCRDGRCRAGKGQQQADGQEVEPGSHPVSLRESRWHGEWAPPFYQSGRRLAKQNRMDTRGIRRHQSARLRSFVVRQRRQGTQRMLVAGAVESAVGGEHGVDLVGQHVGHHAQRLVALVADQGQLVEHSARRRRILAFDLVLDGLDQFFLGEAVFLVVVLFAHRAFLVLAQSTACAAAGSCPPCLANGWPRR

SEQ ID NO: 23864 - protein, 189 aa, Pseudomonas aeruginosa
LPHQDMSSRLPLTRNASMATPAYMSITGTKQGLITAGAFTEDSVGNTYQEGHEDQVMVQGFNHEVIIPRDPQSGQPTGQRVHKPVVITKVFDKASPLLLAALTSGERLTKVEIQWYRTSAAGTQEHYYTTVLEDAIIVDIKDYMHNCQDPGNAHFTHLEDVHFTYRKITWTHEVSGTSGSDDWRSPVAG

SEQ ID NO: 23865 - protein, 238 aa, Pseudomonas aeruginosa
GTTDVRSSQPDPFQPRHRRPRPRPAGALLQRPRSHQSAVRLRPGAGRRTPRAGPRKPAAQTRLPYPRARRQRYPRPGAQRRTGRLGQAPDPLPHHPRPATGLPRPAHQPAHLPAPHGAADRRSGAGGTRHPRRRLPLPARHPLPRARILRAVRRERPAVRPAPVLRGGHPFSFPAQRHGAPAGVRRRPDGVPAARAGGLPAGLRPGRRPGGGQAASAYAWKPAPAASPAATTTSRNRA

SEQ ID NO: 23866 - protein, 260 aa, Pseudomonas aeruginosa
SATRPSAKSARSARTVPVTSDALSPRTWLARHPLQAGECLYAIFGSASDAAPLQAYYREDSPPLPLPLWNGTPYADWQPVMPYLAKLSPSSVFLDWAASEKSRDWGWLAVSTWSTDAILEHLRSLTQVRMPDGSEVFFRFWDGRHLLPILAHLGEKAHEVLPMFGRYLINGKALETGQGHLHAARPYPWWEVPRALVDTLHADDPTTAIDNLLQWLRENHADLYFAYPERSLQLRARRLIAKAVAMDEIGGLLLNKDLTP

SEQ ID NO: 23867 - protein, 202 aa, Pseudomonas aeruginosa
SKPETHSTRPNAIATTRAMSSSSASWPAAPRSSGNGKAKASRPARSITGPASRRWTRATSGTKTAALPRSTPTAARKSMSTTTTRAWYARSIPTEAKPSGTTTRRANWSPNAIRWERSPSTATTRPDAWRHCSRPKASQPAIATSTASCAACAAARRSGSTSATLRATSPARPIPKATSPTTPTTTAAAWWKSPMPTAACTS

SEQ ID NO: 23868 - protein, 88 aa, Pseudomonas aeruginosa
SASACRTGARSSTATTPSADASPSRSTGAIPSSSGSANACSPRAATGTTAPISTNPTASARWPCSTAKARNRSNPATTNSTTSVPRRN

SEQ ID NO: 23869 - protein, 139 aa, Pseudomonas aeruginosa
SAAPPPTTTSANASSASPPRACGWKRRCVASSRGCSNAASRKPAAKRSPAGWRSIAPWLGRMQAAAAKRRRRPPTDAPWAWRMDARQADRLPASSAPTPAPRASRPAPWPRWLPAAAVPPAPATAPKPASRRRRCPARP

SEQ ID NO: 23870 - protein, 525 aa, Pseudomonas aeruginosa
APSAPRRRLSRPGRARRGCAVARASSAGGKHPVCPARPIRHAAWRRGLHPWRSSSANAGKLPAPPASGSCDCMANYVRGCTGTAPGRLFRLRKTEKDDRHSAPRATCPVAPPTAVPGRPAHSMEVPGMTETTQPQPRLRPFADSSPAAVVAGFVAMLTGYTSSLVLMLQAGQNAGLSSAQISWWIWALSIGMGLATIGLTLRYRVPIVIAWSTPGAALLISSLPGVPYSEAIGAFIVCALLITLCGVTGSFERLMRQVPSSLASALLAGVLFRIGIEICNAAEQQTLLVLAMFFSYLLCKRFSPRYAVFAALLVGVLLAGILGQLDFSRFRLELAVPEWTTPSFSLAATISIGIPLFIVAMASQNMPGIAVLHADGYQVPASPLISSTGIASILLAPFGSHGINLAAISAAICTGPSAHEDPHKRYTAALWCGFFNCVAGTFGATLAALFAAFPKALVLSIAAIALLGSIMNGLANSMADERQREAALVTFMVTASGFTLLSIGSAFWGLVAGLLTQFVLNWRRG

SEQ ID NO: 23871 - protein, 335 aa, Pseudomonas aeruginosa
PTSVRRRHGRRRGLVATADPPAEGRRGEEHQHSVDRRRNRHGAVVQQARTQRQGDRQGAVVDADLHADGHRLGLRQAQQARHPVAHRQAQQVEGQRGQPDHRRVGDEGLPVLGQRQQDDHQQQQRGKDLHRLLQAIRHGRQAVAHQHADGHRAEDDDEDLHDLAELQGNRLPVAHEVLQRQIDDQRHGEDGDHRVHRGQGDVQCHVAMRQVAVEVGGGAAGRGRQQHHADRQGRLQGEALDDQETGQGQQDDLAHQADQHRLRVAHHAEEVGRGQGQSETEHDDAQCDGEEQGQDGIGGHYCYCSDAMETGSGPGFSTQVSPPAVAWRAKPRADL

SEQ ID NO: 23872 - protein, 133 aa, Pseudomonas aeruginosa
AAAQPSTSALTSASRVTSQRMKRASPPAWRIASTVPSPPALSRSATTTLTPAAAKASAVARPMPAAPPVTSATWPERSLLICCSSENRLPPTATEPGRASLARAGARHSTIRGLEDGPSSPLIRLMAANHRHR

SEQ ID NO: 23873 - protein, 176 aa, Pseudomonas aeruginosa
PVISALAFACRRRRRRLSLGACFPTFECPAMTSQINRQYQLAQRPSGLPGRDTFSFVETPLGEPAEGQILVKNEYLSLDPAMRGWMNDARSYIPPVGIGEVMRALGVGKVLVSKHPGFQAGDYVNGALGVQDYFVREPNGFYKVEPSPRAAATLSLGAGHDRHDRLLRVARRRPAK

SEQ ID NO: 23874 - protein, 208 aa, Pseudomonas aeruginosa
QGDRGDLRRRRCGGQRCRADRQAQGLPGGGHRRRRREMSLPGRRTGLRRRHRLQERRPRRRTQARMPEGYRCVLRQRRRRNPRHSAHPHRLQGTHRPLRGDQPVQQQGSGARPGQLPVAAGQSGAHGRHGGDGLCPALPRRPEGDGHLAGGRQAAIARGHRRRPGDLSRNAAQAVQRGKLRQVGVEGLRSAAGAKKRRIAPRLEERVH

SEQ ID NO: 23875 - protein, 523 aa, Pseudomonas aeruginosa
FAAQLRQLFAGRSRRLHGLGRLIGHLADRRDAAVDLLGDRALLLGGRGDLLVHLLDQRHRRGDVAQRRLGLQRVVDALVHQLVAALHTLHRLLRAILQGTDQGLDLGRGLLGAPRQRPHLVGDHGEASTLVAGPRRLDGGVQRQQVGLLGHALDHVQHAADALAVGAQRLDAGGGRAHRLGQSLDPLQGLAYHLLADADLAVGAFRRPRGFLGVVRHFMDGGGHLVHRRGHLFGFRPLAVDSQAGARGNAGQRLGSAGNPPDAVLQLADDTAQAAGHGAHRGHQLANLVAPLAVDPYRKVAFGDPVRHTHRLAQRTDDQQADAEGRAQAHQQRQHGGADDQQGVCPQAVEHGLLLRLPATVNTRHHLPGALAHGGVHLPLLELTGAVLGELVGETADIGQHVLDHRHVGIVGDRLLQPGCQLQRLAQRFRRPLLRIRGARFETRAGLVQPLKDQAIDLGDLGRLLQQRLAVVPLALLQRIGAILGQAGLEDIEAVGGAVQRPTGAFPSQLASLDGLLEAAERF

SEQ ID NO: 23876 - protein, 172 aa, Pseudomonas aeruginosa
WHDNGQERYAQVVSRISGLTSVERGAILGAPWKKELAMRPVFPLLLSLSLCAPALADWSGPIEQPLWSLPAAPGLSRWLIVHNLSSAAADGLYHVEVLERRQGQQPWQFQRLAAHLALTEQALRASIVAPLKRGGVYPESYQFAYRQWQERQAAGQAPVCRRTVDECLRAPD

SEQ ID NO: 23877 - protein, 165 aa, Pseudomonas aeruginosa
SPVAWRSRGNRRRGRRLCRSPAALATVCAAALRHLEAAARLALPSPRSPAMNYRGSCHCGTIAYEVEGDLDQVIQCNCSLCSRRGWLLWFVPRDRLALKTPASAMHTYTFNTHRLQHHFCPTCGCAPFSEGIGPDGQAMAAVNARCLEDIDASALPVQHYDGRNA

SEQ ID NO: 23878 - protein, 572 aa, Pseudomonas aeruginosa
RNRWWRPPRAPRRGRRQPRRRARRCRPRASDRGSARRCRRGSPPVPWAKSCSRSRRRGCTGSGGSPRSSVYSRGCRKSAHSSKAGAAARGPIAAPGSAPGARLTDIEARLLGLAGAALVGLELLLGLGPGEQGQGLRVADGAGETFGLGQVEFLPGRVQLVGAVLPVGGLAGAAGQGQGKDGQNDPGFHRTISGQGKGRASPRRTWRRPGDTRIVFASSRSIGKGLQMSKQVALVLGSGGARGYAHIGVIEELEARGYEITCIAGCSMGSVIGGIYAAGKLREYREWVESLDYLDVLRLLDVSFRLGAIRGERVFGKIHEILGEVNIEDLSIPYTAVATDLTNQQEIWFQEGCLHQAMRASAAIPSLFTPVMQGSRMLVDGGLLNPLPIVPVVSAHSDLIIAVNLNATNQKQYHLPVIERPAALKGRFDSMIESLGHKLSFFRRHGDDNTPPELSADALLHPVPAESEEPAEPQLQQPAAAPQGKDSPKSASGTTVVESSGPASLLELVNQSFEVMQTSLAQYKIAGYPPDILINVPKRVCRFFEFYKAPELIALGRQIASDTLDRYEEDNA

SEQ ID NO: 23879 - protein, 230 aa, Pseudomonas aeruginosa
SAPVRSAPHARRATAGRWPRSPAPGTAPAPRAGGSARCRRCRPAPPSRAPASGHRGRDGSCRAGSGYSGPVARPRRGCFPAVRDDPPAGSPRPAPAGCRWNRAWPSAACAGRGTPRRARRCAVARSRRAGARPPGPRPGAHGPGPGPGAGRGQRAGAGAAGSAAGRPAARRRAVPAVPLPPTAATTTSVLRAACQYRGRPAGRGPRPSPRRPVPGRRVAAARRPRSSTRH

SEQ ID NO: 23880 - protein, 133 aa, Pseudomonas aeruginosa
SPGPGRRAADARRDHRRRPGGTSGAATGQPGPGWRGARGHVAGGSAPPRRRAARRSRRRAARPVAAHPAGASARARRASRRYRRVPRSRAGADVRRPGRRGAPGVRPVRHRRCPPAAARATPALPRRAGGSGG

SEQ ID NO: 23881 - protein, 160 aa, Pseudomonas aeruginosa
PLCRRRFPPPATPGCPASAWRGGCRERCYGPVRRPGPAPAGRRGDRRGPFPAVSSLDTRGCAAAAAARLRGGTRFPPASGSRPPRRAVSRPGATGPGRPAAWRRSCPPPAPRRERLSGGRARQRAGRPAARRRVRCRSWIGRNPLLCAPHGGRSQVIRTG

SEQ ID NO: 23882 - protein, 938 aa, Pseudomonas aeruginosa
SLVIVRRAGRRATDYDRSMTDTARADALLADLPADGRGRLKVFLGAAPGVGKTFAMLQAAQAQLRQGVKLRAGVVETHSRAETESLLAGVPQQPLRSLEYRGMKLQEMDLDGLLADPPALALVDELAHSNVPGSRHAKRWQDIQELLAAGIDVYTTVNVQHLESLNDQVRDITGVQVRETVPDWVLQEAYEIVLIDLPPRELLERLREGKVYVPEQARAAIDAFFSQTNLTALRELAMQTAAARVDADLNHRYRQRGEEAPALRGRLLVGIDGDEQAERLVRHACRVAERRHLPWSVVHVDTGGLRGEHARMRLQGAQQLAERLGGEIVVLRAGEVARTLLQHARERRASLVLVGQSRRRWYRRAFGGGLAGRLLRDGQGLEISALDSEADLRPAEPRPRYPVVWNDYLLALLATALASGLAWIVAHLLELPNISLVFLMAVLLVAVRTSLMPALLCAVASFLAYDFLFIPPHFSFAIHRHEDLLSLAFFLFMAGLTGNLAARQRRQLEALRDTQEETSLLLELSRKLTAATDRQAVLAAAAQQFDDWKDVEVCLLGQVNGEWKTEAGVQRQLADQERVAADWAWAHDQPAGLGTGTLPGGRWWWWPLSAEEGPLALLGVAPLDGQPLSPQRRRLLAALGQPLAQALARARLAEDLEAARLHGETEQLRSALLASVSHDLRTPLTAMRGSIDSLLALGEAIPPADRRELLESTRDEAERLDRYIQNLLDMTRLGHGGLKLARDWVAPGDIVGSALNRLRAVLAPYRVQAIVANDLPLLYVHAALIEQALINVLENAARFSPSHGRLRIEVSQDAAELRFAVSDEGPGIPEARAGEDLRHVVHRCPWRPRWPGHRPGPGDLPGHDRRPRRAYQRRRRPRRSRHHAGPAPAAASAAGPRATGGRRMSPAHLPGACARAIPAVSATPPLACRRVHLPCRVP

SEQ ID NO: 23883 - protein, 356 aa, Pseudomonas aeruginosa
NGHFSDIHGSTPMSEAIRLTQYSHGAGCGCKISPKVLEVILAGSGAQNLDPKLWVGNASRDDAAVYALDEERGVVSTTDFFMPIVDDPFDFGRIAATNAISDIYAMGGDPLMAIAILGWPVNVLAAEVAREVIAGGRKVCEEAGIPLAGGHSIDAPEPIFGLAVTGVVEKRFMKRNDTAEAGCRLYLTKPLGIGILTTAEKKARLRAEDVGVARDWMCTLNRPGARFGRLAGVKAMTDVTGFGLLGHLVEMADGSKLTARVEYAAVPRLASAEYYLEQGCVPGGTLRNFDSYGERIAPLPEVQKLLLCDPQTSGGLLVAVAPEGEAEFLAVAAELGLQLAPIGELVERQSLAVQVL

SEQ ID NO: 23884 - protein, 197 aa, Pseudomonas aeruginosa
PLPPGGAGPRRRRSRELRGCGIIGVPSVDFRETAMQLDFTTIAPAEAYRWLASTVTPRPIAWGLDPVRRGRQQPGPVQLLPGDQRRAADPDGQRQPARRRQPQGHPAQRPGHRAVGDPPGRRRPGRDHERHLRLAAPWRERDRDGRHPYRVQRTRGAAADRRGGGGLRVRGGGDQAVSGGEPQLPPDLRPRAAGPCR

SEQ ID NO: 23885 - protein, 323 aa, Pseudomonas aeruginosa
RQARPGRSPGRQPLQLYPRHVQHDPAQVAGLSPAPAGTRRPCAGTPAPGPRPGVPATGDRRTGSFPDTPRRVSAAPRYSRAAPVRSAPGARPGAGTARAAGPDGAPGPRRGTGRRPPRSTGCARSASATGPAPPATTRAAARSGRSSRPGRGRTDSATATAEIRDAWQAPFSMGRPVWLRARPTSARISWKRPAHISPGHYRATTLPGRSGSAKNARHSGKCARRRRVTGEGSHAGVAAQAYGRSRHGEEIGHRFYPGPAIDRAGGRARGALAACAGAALRAPAGDERDQSRRAGGSPGREGICPARGKERRRALAPAPGRDP

SEQ ID NO: 23886 - protein, 190 aa, Pseudomonas aeruginosa
TGGPAQGRRRRRSGAWHGRGGAGAGGIPRSVRPLRAVHPGTPIGLGKRQLVAERRRQQPRYPPVQPGRGWRLCAEGEPGARRRAAVAAGGPGRPGQSPGPSGAGRGPLASRSARRGCAGGAAEIAARGAGAGSPAGAGDHRRCLRVGGQGRADQYPRFRRQARRVPRQSAPGAADVRRHGRARRAGDGAC

SEQ ID NO: 23887 - protein, 242 aa, Pseudomonas aeruginosa
SGAQRRGSRGGGGKRRRQGQRRPGGGTPDPGADRATGRGGARGHRQRRGAERRQPAHRQRAGRDQERGRADQPAGAERRHRGGAGRRPGSRLRRGRRRGAGAGAAHPTVHGRDRDPDRCLAEWHAAGGAAYAAQPPVGGPERRRRVADRGGAGQHRHGGGADPADEPADRRGLRAAERGRRGDQPQRHGDPRGGRSVGPSHAVDGFVQRTTGGAGPRTTGHGQAFPLVAAAWAASLSCWRSQ

SEQ ID NO: 23888 - protein, 303 aa, Pseudomonas aeruginosa
WSRLSSPGTQRASGMRLIPCRRGCRSLARRTGCRIAGNHYFFSAHALRGEALSAASSRRRRTSDLQHQLAEVFPAEQLEQRFGKGLQAFDDVLARLQLAFRQPGGHLLQAFWEALGIVHHHHAFHARPIDQQRQVVGRAAHRFLVVVLADRPAEDDACLEGDAGEHCVEDFAADVVEEHIDTLRAFALESGGEVFVLVVDGAVEAQFFDQEATFLGAAGDAHHPAALEPGDLPGNAAHRTGGAGDHHGLPVIWLADVEQREVGGHAGHAQRREIAWQRRAGTVRPCRNHWVPGRNSLARRGRR

SEQ ID NO: 23889 - protein, 97 aa, Pseudomonas aeruginosa
STPTCSAAPTRPIRARPSSPPRCIRWVGSGGSRKSPPRCSTCAATTRASPPVSPCRWTAGRRRSERAAIQPGCPGAGHSHSVTGRHAVWRARPLPGD

SEQ ID NO: 23890 - protein, 325 aa, Pseudomonas aeruginosa
PGSRIRGLSPSPSHRSNNNNDRRSHPDPVPPHRTGHHHARSRTVPDPGRLPPRGALPEAGAGRPGVPDRPAAPGLFPDRPGLRPGGGPGGRHDVAGGLARRHHRQPLQPPGAWRRGTEHHPDRGELGDRHPHHAADRQSVAAILHGRRAGDSPAVRQGRAGLRHRPRPGGHRHAGAQPPAGRGGSPAEAGEDPFRAAVAGDHPAGAGQGLADLRHLRAGGRAGRAGLQPAEPGGGLLGAAPAAPAEGPGGGHRHGDRHPQRHPGDRPGAESEPAEQQHHGDSAGDLRSADVLHRGGLRLVGQPWPPGHAGARDGAGLRSVSRAAS

SEQ ID NO: 23891 - protein, 249 aa, Pseudomonas aeruginosa
TAGQGLSRYSRGHSWPYSRSCRKLAELVTSRHLPRSFAMDANPYATPRVELVEQGIPDAFRRRWTPAQLRILAWLCLASIAGGVVLMVLSLLEAFGDGAAFRVYADWLGLLLSLLGAYLLLRLKHLVESRFRGPSLAWPVWLSILLTLLGEGWSLLAVTDDALQGWNWQALVYFALLALIGATTLWLGLRLLKQENLYPSLRIMAWLDIAGGAMLASVLLLVLAVLPLLAATVAMALACWRAARELERS

SEQ ID NO: 23892 - protein, 249 aa, Pseudomonas aeruginosa
TSATSPRSACTKACGAWPRSSATPRPPKRPEPSSALLRGRRPSDPRSDTMYKVYGDYRSGNCYKIKLAMSLLGIDYQWVPVDILKGETQTPEFLAKNPNGKIPVLELEDGSCLWESNAILNFLADGSALLPSEPRLRTQVLQWQFFEQYSHEPYVAVARFIKLYLGLPEARRAEFEEKKIGGYKAIDVMEKQLSRTPFLVGEQFSIADITLYAYTHVAHEGGFDLTAYPAIRAWIKRVGEVPGYVGMLD

SEQ ID NO: 23893 - protein, 226 aa, Pseudomonas aeruginosa
STSPVSARTNAKTGKSPAATAIPSTSCCSTSSTVARSGSADAPLYGGWCRRPMNGATTNTAGPCSANASSAPKRCSTSATWRTSPPGSSSAPASGSCPRPSIRPTSRCSSCCSPKPTPASTRGSAASPCASRSRYSPASSISTNWTPTSWSIAISNATCGNSRRRNAWNSCGAACTSRSGASSAVASARRRRAGSTCRWSGSSRNGNGSLAAWPCSTAAASGRCAR

SEQ ID NO: 23894 - protein, 258 aa, Pseudomonas aeruginosa
TRRCWNNDPAPHRAGLDKDVRMALLGITLLAGAAFVGGYLYRRGLDRRRYRFIQQFRLPPRVAQAVRERYPQLSEEQVQRVLGGLREYLLLCRAAGKRMVAMPSQVVDVAWHELILHTRLYQHVCRKGLGRFLHHTPAQAMRSPRQAQEGIQRAWKLACRREGIDPLNPTRLPLLFALDTELAIADGFRYALNCAQRQDGGAAVYCASHIGCSSGCASDSGSTFGSDGQDSRHGSGGDSGGDGGSGCGGGGCGGGGGD

SEQ ID NO: 23895 - protein, 141 aa, Pseudomonas aeruginosa
GSRSPSPNGDGRKPISARSRRRLPAGIRFPAGSASASCRSAPASRWSGRWSGPAARCPPARGSRPCLRRRRLRDRPGSGCTPCRCFPRGSARWSSWSRRPAESRHAPPPGRATVRPPAPRRRVRIRPGHPAGAPGAAGPDE

SEQ ID NO: 23896 - protein, 71 aa, Pseudomonas aeruginosa
SGSHRQGAGGSVYSGTIHVLYKDSVMKRLFLSFVALALLAGSIAACGQKGPLYLPDDEKAKKEHSKDRYGF

SEQ ID NO: 23897 - protein, 156 aa, Pseudomonas aeruginosa
PPGGDRRRLPHRLAVDPAGALPRRPRAPARAGRPPGRQRHRHSPPGPRWWPRGALPRRTAAAGRRLHPRHPRAPARPRPDPGVRAGPVHRRQRRRAADPCRVPQAHRAQGFRHRRRGDERPDPPGSLPGLDGRAGGTPARRRAAPLRPGRADLRDR

SEQ ID NO: 23898 - protein, 360 aa, Pseudomonas aeruginosa
VSRAYTACSPSAVPIRSITRVPSAPCSSATSPRSWPACCRVSPRRCARSAERGGRSEMRADLDAFLEHLRSERQVSAHTLDGYRRDLLKILALAEKAGLSDWNALDTRSLRTFVARLHQQGQSSRSLARLLSATRGLYQYLLREGRCRHDPANGLSAPKSPRKLPRTLDADRALQLLDGAVEDDFIARRDQALLELFYSSGLRLSELVGLDLEWLDLKEGLVRVRGKGNKVRELPVGKAARQALEAWLPLRAQAAPEDGAVFIGRGGKRLTPRAIQLRVRQAGVRELGQHLHPHMLRHSFASHLLESSGDLRAVQELLGHADIATTQIYTHLDFQHLASVYDRAHPRAKRKGNADGGNDP

SEQ ID NO: 23899 - protein, 210 aa, Pseudomonas aeruginosa
TTPRALLREWLASNAARLGPVPIEHLWAIRTRLLDREPMLRHRLSELRRRILFHALLDAGYPQAEAESLAEAGFQVFLEARHRVTLFPEVHPTLEILADRFTLGVLTNGNADVRRLGLADYFRFALCAEELGVGKPDPTPFREALKRAGVEASAAVHIGDHPSDDIAGARRAGMRAIWFNPSGKPWAGEEEPSAEIRSLAELPALLARLQ

SEQ ID NO: 23900 - protein, 198 aa, Pseudomonas aeruginosa
HKARHPLREAGLGMARNQMGRLPYLLSGFFGGSATTLGSISCTFPPRERNSSIALARASRSFCLASTEGSSSSTTAAFAFFPGAGASSPSPLSASPSSAAASSSPSSSSAPSSSSCSSSSSLMVNLSVLQKQVSYSPAARFDERRRKKFILTRPARWRARAVPRPCPGVHRDRSPARCPVPTLPTVSAGSVGSPAGWP

SEQ ID NO: 23901 - protein, 524 aa, Pseudomonas aeruginosa
SGSAATCCCSKSAPIRRAAHSSAAFEKAKSVRGRPVKADGGAVRWQSLKDRLRKGGGSRGKRPGLSTHKGMAFGEGERGRQTDARRKAGRRQVLQVVAALVVQRQVEADRFLFLGDPQAHDQVQHLEDHEGHHGGVDHGEGHALELHEELRADVLHAAEAAQRRRREDPGEQRADDTADRMYAEGVEGIVVFQRALETGGGEETDHPGGQADHQRAHRTGGAGGRGDGHQTGDHAGRDAQGARLAVGDPLGEHPGQGRGGGGDLGHQHGHPGGAVGGGGGTGVETEPADPQHGRPDQGVAEVVRRHRRGRVALALAQHQAGDQTGDTGVDVHHGAAGEVQHAPVPHQGAVTAPDHVRDRRVDHGEPDRHEDQHRRELHALGEGADDQRRSDDREGHLEGDEHAFREQRGGGSQAVGGETAEEGLVQSADEGIEVEDALLHPGGIERQAVAIDHPENGDQAGDGEALHHDRQHVLRSHHAAVEQRQAGDGHEQDERSGDQHPGGVAAVQDGLLGGQGDARQSEGQ

SEQ ID NO: 23902 - protein, 191 aa, Pseudomonas aeruginosa
RCSPWTTCWRSPDTSPARPRCRPTRPAACSARPSLIQTWPRSRARPPPSAPCWWPPPARTTCCSAARRAPARPSWPAACPACCRRSTRTKPWRSRRSIRWPATSPSGTGRSDRSASRTTPPPRRPWSAAAAARSRARSPWRTRACCSSTNCRSSSARSWRSCASRWKAARSSLPGPTAGYVSRRASNWWRR

SEQ ID NO: 23903 - protein, 692 aa, Pseudomonas aeruginosa
GFSNQISYHDVLGCFVFRLRRAIRSQGELAYMETPTTPRSTLNPPVFYTSAALILALVLFTVLLQEEAQSLFNHVQQWIITNASWFYVLAVALILISVVFLAVSRYGDIKLGPDHSRPDYRNTTWFAMLFSAGMGIGLMFFGVAEPVMHFTTPPVGEPNTVQAAKEAMKLTFFHWGLHAWAIYAIVALILAFFSYRHGLPLTLRSALYPLIGERIYGPIGHAVDIFAIIGTVFGVATSLGYGVLQINSGLHHLFGWPVNQTVQIALIAATCGLATLSVASGLDRGIRILSELNLSLAVILLLFVLVLGPTVFLLQTYVQNTGAYLSDIVNKTFNLYAYEPTDWIGGWTLLYWGWWLSWSPFVGLFIARISRGRTIREFVCGVLFVPAGFTLLWMTVFGDTAIHMVLQEGFTQLAEVVNQDSSVALFAFLEHFPLGSVISLVAVLMVVVFFVTSADSGALVVDMLASSGKDHSPLWQRIFWSVLMGVVAIALLLADGLKALQTATIASALPFSIVLLASIWGLFKALHLDATKRGIRYQALTFSRPTTRSGASEGDGWQRRLRNIAMFPRRSHVNRFITDVARPACEDVAAELRKQGYEVQVQDGEDGRVRLEVSHGGEVDFIYEVRPRAFTTPSFVMRDTEDSSESRKYFRAEVHLQEGGQDYDIMGWSRDGVIGDILDQYERHMHFLHVVR

SEQ ID NO: 23904 - protein, 495 aa, Pseudomonas aeruginosa
ALLIHVLAIPRRTQSHPAPGGPVDRRPAGLCRHGLHRHRDDGQARPRRAGRRRPGRGQLRLRLDVLCRRGGSGRQPGGDPSRLRRRRWRRRGRSLRTLGRRRAGPGRRPAAMEPAAAAPGLRPGAADGGRRHAVPPQPDIRPARLHGLHGPARLHQRHRPRRPGDGDQRARRAGQPGSQLFLHRRPVRPAAPGPGRYRPGHRPRHELHAAAAGPVYPPAAGLCRVLAAARTGTAAAGDGRGDTAPGAAHRWHLRGGVGDVHGRHPVHGHHRRSRPGRAPDRHPGGIRGVHGAGGVVVRHHLPHRPAFRRRPPARSTPRRACRHRLRRAVHAALRRALLVDAGGHHRPVPRPRRPGQPGGGRDGRLAAGDRRLVRAVRRHPERRHGRDPRSQGRPHHLPGRPGLLLAGRRAAGLPAGVRGRLGRRGRLVGAGRRPGLRGHWPDPGLRVEDRAVAAESHGQRGVGAQLPSGWPRCAERSPMPRKRASSANGSGGLIQ

SEQ ID NO: 23905 - protein, 703 aa, Pseudomonas aeruginosa
TISGSVTACTLILADASQPVRIRPRFNPLFRPVPMSRLNPRQQEAVNYVGGPLLVLAGAGSGKTSVITRKIAYLVQQCGIRAQYIVAVTFTNKAAREMKERVGTLLRGGEGKGLTVSTFHNLGLNIIRKEHERLGYKPGFSIFDESDIKALLTDIMQKEYSGDDGVDEIKNYIGAWKNDLILPEEALEKARNPKEQTAAIVYLHYQRTLRAYNAVDFDDLILQPVKLFQEHPDVLQKWQNKVRYMLVDEYQDTNASQYLLVKLLVKDRAQFTVVGDDDQSIYAWRGARPENLMQLKEDFPSLKVVMLEQNYRSTSRILKCANVLIANNPHVFEKQLWSEMGHGDPIRVIRCRNEDAEAERIAMEILTLHLRTERPYSEFAILYRGNHQAKLMELKLQHHQIPYRLSGGTSFFGRQEVKDLMSYFRLLVNPDDDNAFLRVINVPRREIGSATLEKLGNYATQRKISMYAACDEMGLAEHLDSRFHERLQRFKRWMDDIRRQCAENEPIAVLRSMVMDIDYENWLRQNASSDKVAEFRMSNVWFLIEALKNTLERDEEGDMTIEQAIAKLVLRDMLERQQEEEEGAEGVQMMTLHASKGLEFPYVFIMGMEEEILPHRSSIEADTVEEERRLAYVGITRARQNLAMTFAAKRKQYGEIIDCSPSRFLDELPPEDLEWEGMEDAPQEVKAAKGNAALADIRAMLKR

SEQ ID NO: 23906 - protein, 578 aa, Pseudomonas aeruginosa
LTNSIRGQLHVEQESRRDRRGNPGSRRRPPLLWHRRRHPQPCHRRHPSQPDPVGPRAPRRSGGLRRGRRVLHQRTPDRLRRLLRTGQPALHQRRLRGPAQPRADGADRQPDRYPATGHGVSPGGRLQGGLRQLLGVLRAGAQPGTGAPGGGPGLPGGAQPARRGGGDPAGRHQPGHGEGRPAVLGAFPATGAAPQRRRTAGRRPPAGPRQEDRHLRRLRLPGRPRPAGGPRRPPQGAHRAHVAGQGLRRVRQPLQHGHDRYARDRVRLPHDDRVRHPPAARRRLRLGAVLSAEGHPDPGRPRWQSPGPPPPHRSRRGRRRDPQLLPLLEAREERSFLDECLEHRERSLRTLEKEEQAGKGELIHPQHLVSLLDQHASEDALFTADGGSAMVWLLRHIHSNGKRRTLTSLVHGTMANAMPQALGLKKAYPERQVISISGDGGLAMLLGDLLTAIQEKLPIKVVVLNNASLNFVELEQKVEGLLDSYTDLLNPDFARLAEVIGFHGRKVTRSEELETAVQEFLAQPGPALLDVHTNPAELVMPPKIEFGQVADTALYAAKAVLSGRFKDVETLLVNNLLK

SEQ ID NO: 23907 - protein, 487 aa, Pseudomonas aeruginosa
FDPAAQPGLGMVGKVDGEHVHRYPANQAPRLAVDEHKGAVGGVARIAIGVAHGDHADALATLGAVARAVADRFAGRQVADADHLRFQGHHRAQAVGQRMCALERRGSVEQDARTYPIAGHLRPAEHGWRIAQANLAFQALASGREGGELFLGARAIQFVGAGEVTHHHDLRHLAAGPQALVGGAEVLGEEADAVHARIHLQPDVQRAGQAGAFDRLQLPGAMHHAPEVVGDDQLQLGRLEEALQQQDRLADTGLAQLQALLDAGHGEAIGLGHQRFGTAHRAVAVCVRLDHRERTGAGGLAGQPIVVTKGLQVDQGTGGAHGDGSLFSEVRHRAPFIRRKKARLSGRARQNSGQRSDHRHLYQDLRLAELGFDGGARRRDAARQPLVPDAVHAFEVGVDVLQVDGHREDPSLVGAGLFQQTLDGRQGLAGLLLDARGHVLAHLARQVDGAVVDDDLAHTLVSVLALDGHSWRSPGNCYSGKYPGLRY

SEQ ID NO: 23908 - protein, 449 aa, Pseudomonas aeruginosa
ASSRAAPARSRRGWPRCSVDGSARDAACNRAPLPKERLARCPSSRPSRGISATSRSAFQPRYCRRGASTCKRPSTSLAAHGEMPSRSSRVSSFSVLAPSLVNARRNAVTLSASRSSGSLRKPSALGRNSAGSACNHSPCNWLRRKSLRSWRGNQAPSSPSSWTCSSPCTLPRPGSGQACGACTSSAAEPPPSSTRRGSSQSLPGARRIVQSACRCRACGASGRRWASGNQRLSQTTRPRVSGRPGASRRPCQRPSPSDGASWLSSVSSACRSSCARVRRRQPVGSSKSWASSWACCASCCRRSCAASGNSAPDGRPMSSPPSCSQRPAGQGRSRWKRSRWICSGSQARVSRRDVQSSAAASSSELAAAGCQASATCSTRRPGRRGRQPDSPGQRSSACSTSSRRLAPSAPRRSSASRRSPMPSADRPRPCHSRRSTPCSRNRLRQACQP

SEQ ID NO: 23909 - protein, 564 aa, Pseudomonas aeruginosa
RKNSVAEPIRGSADSEKIRRGIALPRKTPRIRTTGMSRSFEFPREMSLLRRFLLLALLALSGCASTPPPQPSSALPAEGTWLARQAEIQGRDHPGQSGFHLLGASEDAFVARAALIRAAQRSLDIQYYIVHDGLTTRALAYELLKAADRGVRVRILIDDTASDGWDYEIGVLSAHPNIQVRLFNPLHLGRATGITRGVGRLFNLSQQHRRMHNKLWLADGTAAIVGGRNLGDEYFNAKPEMNFTDLDLLGVGPIANQLSHSFDQYWNSAISRPIEDFLWRAPYPGELESARRKLQRYLRKESVKESGYIRHLFDRGDQPRLGNWLENLTWARAEAIWDAPLKVLSRGEPDPHLLLSPHLAGLFKGVQKELILVSAYFVPAKDGLNYLTGKADSGVRVRLLTNSLEATDVPAVHAGYAPYRMALLEHGVKLYELRANPDQPLSGAPWRLHGSSSASLHSKAMVFDRRKVFIGSFNFDPRSILWNTEVGVIVDSPLLAEQVRQLALEGMAPSVSYQVRIDRSGSRPKLVWIDERDGRPQVLRHEPGSLWRRLNAWVAGMIGLEKML

SEQ ID NO: 23910 - protein, 448 aa, Pseudomonas aeruginosa
LRDMGIGPDQGIVSVALADQDQRQGEQPAGAGPEQHQQRPDQRRLQQQGNRQAAQQQHQAAAAEQAAARDPVGEPADRQLQQCIAHHHGTDHGQRHRLRKALAQPVYRQQGEDHRLEGSEQHHRPGDRRQTPAEGPQTAPGGTVRIDPGRTAAAQQQQRASNQQADAEPEATVVGGTDEGQQYRPGQLAEGVAGAVQRDQPATPLLHRQLVDPAFPEDEHHGELHADQQAQQQPYRVALQQRQQADGGCPGEQAQLHQPRRADARGEAPGDHRAEQHAHCRRAGHHADGETAVAPALQAQRDQRHGQAKGETDADDCGTDGEIASPTHCDSPVGTPKALPGRADISGARSTAAGLPEGNPAAGVARESRPGRADLGDQSLIQVAFSSVYLSKACSDLSRPLPDCLKPPNGAVMSPPSYWLTQTLPARRALAVRCALDRLLVQTAAASP

SEQ ID NO: 23911 - protein, 170 aa, Pseudomonas aeruginosa
ILSIASALQRRLLAALATSMCSESLIGLPMSRVSSSASSSAFSSSRSAKRIIVCLRLAGARRDQAPESKALRATLTACSASARSQLATLARKRPSTGLRQSKVSPEAALLYSPLTKARPSIFRSLARASQSARVRVVMTTCPLIGVLGAWETGALSDSARRARGPWCPPP

SEQ ID NO: 23912 - protein, 487 aa, Pseudomonas aeruginosa
TRAAPVFNIFDRNPSNSLVTFIILNIDSPGLASSSLACNLGGPMTMNNEPQSSSLDNFWMPFTANRQFKVRPRLLESAEGIHYIAQGGRRILDGTAGLWCCNAGHGRREISEAVARQIATLDYAPPFQMGHPLPFELAARLAEIAPPGLNKVFFTNSGSESADTALKIALAYQRAIGRGTRTRLIGRELGYHGVGFGGLSVGGMVNNRKAFSANLLPGVDHLPHTLDVARNAFTVGLPEHGVEKAEELERLVTLHGAENIAAVIVEPMSGSAGVVLPPKGYLQRLREITRKHGILLIFDEVITGFGRVGEAFAAQRWGVVPDLLTCAKGLTNGSIPMGAVFVDEKIHAAFMQGPQGAIEFFHGYTYSGHPVACAAALATLDIYRRDDLFQRAVELEGYWQDALFSLRDLPNVVDIRAVGLVGGVQLAPHADGPGKRGYDVFERCFWEHDLMVRVTGDIIAMSPPLIIDKPHIDQIVERLAQAIRASV

SEQ ID NO: 23913 - protein, 193 aa, Pseudomonas aeruginosa
NAEGHARENPAMDLDRLYLPHWQFSEHHQRLIDAPAAAVLDAVEDLLRFDDPLVRAFLVLREAPGRLAGLLGRRNDLAGRPRFGLHEFTRLERRADQAIAYGLVGRFWRADFALERIADGEHFRCYDQPGVAKLVLCFRCTPSASGTLLHTETRVFCPDRASRLRFTPYWLAIRPVSGLIRRRLLAGIERRLG

SEQ ID NO: 23914 - protein, 165 aa, Pseudomonas aeruginosa
SPSSPTASTSNELLMHSLQAKILDPRLGSDFPLPQYATPGSAGLDLRAMLKEDSVLGPGQTLLIPTGLSIYIADPGLAALVLPRSGLGHKHGIVLGNLVGLIDSDYQGELMVSCWNRGESPFTIAVGERIAQLVLVPVVQAHFELVEAFDESQRGAGGFGHSGSH

SEQ ID NO: 23915 - protein, 145 aa, Pseudomonas aeruginosa
PRTQDETPRRRGMKLFQRTAQGWERVGRRARTGKEAAPRQRPNALTARTCCPAYAPAYWAWRPPAPCSGSASSAAPVRRSSASWTRPGPKARPAPCARPCSNSPPTPAPPRPAPSPSKPCKAATPPASRPPSASCWPGTAWSMPT

SEQ ID NO: 23916 - protein, 125 aa, Pseudomonas aeruginosa
AATCSSRSAGSASTMASTAPPACWKSSARISVTASTCSRPSRATFPPRKSTSPSPRTASSPSSRRCNATPNGAKATSPPSTACGSTTPKAGAWYAPPTPLPCWSCASKRTPRKSWSASRPSSVTN

SEQ ID NO: 23917 - protein, 318 aa, Pseudomonas aeruginosa
RQWIPRCPCPSDMSELPMTLSRDDAAQVAKVLSEALPYIRRFVGKTLVIKYGGNAMESEELKAGFARDVVLMKAVGINPVVVHGGGPQIGDLLKRLSIESHFIDGMRVTDAATMDVVEMVLGGQVNKDIVNLINRHGGSAIGLTGKDAELIRAKKLTVTRQTPEMTKPEIIDIGHVGEVTGVNVGLLNMLVKGDFIPVIAPIGVGSNGESYNINADLVAGKVAEALKAEKLMLLTNIAGLMDKQGQVLTGLSTEQVNELIADGTIYGGMLPKIRCALEAVQGGVTSAHIIDGRVPNAVLLEIFTDSGVGTLISNRKRH

SEQ ID NO: 23918 - protein, 472 aa, Pseudomonas aeruginosa
PFRSNSEASERSGSPVSAGCRHRLGKAPGVLGVNRPALDDPPAAQRQQVAELQQHRLALGRPQEDLVVHLQAHRRRAVDHFLVRAAPVDAVAAQSLGRGEVGHPVAAVDEEGAALVGVPPGKQPRLAVQRRDLHRAGALEYRRGDVDGRHMLGQGRQVVVARLEHGGAHRDLAAQRFLLVHAIAGAAGGIQGQLWCPQRGEALAGEVDMSLVERHDLGEQFLGRTEDARHTHSDEGVVAHEAGELQVLRMRRDQRQQFTQRGLVGHPAAMQADVQFDVDAHPGPQPLGQRQVLTQALRRIDQPLQLPRRVERALVLAVEQFRRTHRQRLAEEDVGIRKSDCVVVEERLVEGHQPPGAGAPGDVRQQAGRGQRLLHQPQMLAAAADRTHHHIDVVVQAIEVDEQHRAHRAIGLEFAVQRAEIVVVRPATVGGTHPGGSSRQQRAGPEAGEHELASIHGVAPFRSRPGWRRGAH

SEQ ID NO: 23919 - protein, 264 aa, Pseudomonas aeruginosa
FWGPFMRIISVNVNGIQAAAERGLLSWLQAQNADVICLQDTRASAFDLDDPSFQLDGYFLYACDAELPEQGGVALYSRLQPKAVISGLGFETADRYGRYLQADFDKVSIATLLLPSGQSGDESLNQKFKFMDDFTHYLSKQRRKRREYIYCGSLYVAHQKMDVKNWRECQQMPGFLAPERAWLDEVFGNLGYADALREVSREGDQFSWWPDSEQAEMLNLGWRFDYQVLTPGLRRFVRNAKLPRQPRFSQHAPLIVDYDWQLSI

SEQ ID NO: 23920 - protein, 146 aa, Pseudomonas aeruginosa
MPTETAATICFSGLPLSAPRFFSTARASISATVAPVIEAVRVPPSAWITSQSMYRVFSPSLLRSSAARRERPIRRWISRVRPPCLPRLASRWLRSPVERGSMPYSAVNQPWPWPLRKRGTPDSALTVQITLVSPNSTSTEPSACLV

SEQ ID NO: 23921 - protein, 235 aa, Pseudomonas aeruginosa
SSRCASRSRTSNDPRAPPPDLFPTRTKHQEHLMSGTLYIVSAPSGAGKTSLVKALLDAAPEVRVSVSHTTRGMRPGEVDGVNYHFTSREEFLAMLERNEFLEHAEVFGNLYGTSQRWVEKTLAEGLDLILEIDWQGAQQVRRLMPEAQSIFILPPSQEALRQRLTNRGQDSDEVIERRMREAVSEMSHYVEYDHLVINDDFAHALDDLKAIFRARQLRQDAQQQRHAELLGRLLA

SEQ ID NO: 23922 - protein, 673 aa, Pseudomonas aeruginosa
YAEQAHDGQRRRSGEPYVTHPLAVSNILADMHMDHQSLMAAMLHDVIEDTGIAKEALTAQFGETVSELVDGVSKLTQMNFETKAEAQAENFQKMAMAMARDIRVILVKLADRLHNMRTLEVLSGEKRRRIAKETLEIYAPIANRLGMHTMRVEFEDLGFKAMHPMRAERIRQAVKKARGNRREIVGKIQESLVNCLAREGMEGQVIGREKHLYSIYQKMRGKRKAFNEIMDVYAFRIIVDKVDTCYRVLGAVHSLYKPFPGRFKDYIAIPKANGYQSLHTTLFGMHGVPIEIQIRTREMEEMANHGIAAHWLYKSNDETPKGTHARARQWVKGVLELQQRAGNSLEFIENVKIDLFPDEVYVFTPKGRIMELPKGSTAVDFAYAVHTDVGNSCIACRINRRLAPLSEPLQSGQTVEIVTAPGARPNPAWLSFVVTGKARTHIRHALKLQRRSESINLGERLLNKTLTGFDSHLEKIPQERIQAVLAEYRMEVFEDLLEEIGLGNRMAYVVARRLLSSEGEEAPSAEGPLAIRGTEGLVLSYAKCCTPIPGDPIVGHLSAGKGMVVHLESCKNISEVRHNPEKCIQLSWAKDVTGEFNVELRVELEHQRGLIALLATSVNAADGNIEKISMDERDGRISVVQLVVSVHDRVHLARVIKKLRALKGVIRITRLRS

SEQ ID NO: 23923 - protein, 230 aa, Pseudomonas aeruginosa
RALEGCLLWRRQPGESRTGRQGADPAGQRQRPGTAFPPSRPATRGQQPCRQRFRAGLVWQLSEGQLEDPRRPGPGRQGRVPGQWPGQRSARRRTLRAVPGRRLRSDERRQRQHLAATRQPRPRIAVQPRRRRAATVRSGQYRRRQRDAQLRARQARLAAGALRPLRGRPAPASRPAPAAGRRTAGPAHLPAVATSRASAACPAGAPAPCPSTAPPGSSTPGTGPAPSPAG

SEQ ID NO: 23924 - protein, 140 aa, Pseudomonas aeruginosa
SAPARRTAPHRRSAAWDSGCSPAGRRAARADSRRGTGRRAAPAFPVASAQAAPGPPARGSTVRRAPAASARRCAPSPARWPTGRAPAACSGGWPGRCRRPPRRPGAGRAAGRRAPTGRSPAPATAGRRNGYWRQGRTRRT

SEQ ID NO: 23925 - protein, 505 aa, Pseudomonas aeruginosa
HALPGNRAGVRWFRRRGAPRPPGASRRDARRPVRARPAGGFPTPMRRCAGNPRPATPGQPPRCRRRPGSVRRSRAATVCGRAGRAGAFPRHRASGRPAARIRRARYVALPGSSATGCRPAAHGAARGTGSRRRRGGSSRWRRPNGCGGRTPGRRSPHGTAPRQAARDAPTTGWQPSGVPEHRRVALAVAGIARHPAERPGAAVAATLAAGAAYRMFVGPLADAQALAQVVDHLVHRHGRVVDTDVAVLQRLAAGIGAQQEGQQPGRIVGVDPVGIQGRLADHPVPLTHLVEQPLPPRTVDAGQAHAGSRYPAVQRDLLGVEHDPSGIDLGKRRRLLVDPAAIGLRVDPGAGDEQQAPGPLAAGLQPAQHMAQAVDVGGTVASLVVLTGGGAVHQVVERLARPLRGTLRSLQIASHRQDPLRQGVHRATQAMDPPAIGQQRLAEAPADIAAAGDHHCLRHEAVSFLQQGGQCRRRIVCNARPIMPPEVGSRRCSRYAWPILTDEQP

SEQ ID NO: 23926 - protein, 142 aa, Pseudomonas aeruginosa
CRPTIPGPPRPASIPSCSTTRACSCSAKATASATRCWKPGPTVRKGDENKHTTVESSSLETIRHMVASGLGVSVLPFSAVDSHHYAPGVIEVRPFSAPVPFRTVAIAWRASFPRPRAIEVLADSIRLCSVARPQTQEQPQIA

SEQ ID NO: 23927 - protein, 85 aa, Pseudomonas aeruginosa
SSRTPSALAWPNCTSYAAGLAGAAPPATACCSTTHRCRRSAASGWASCAKPATASSSPRRTWNCAAPAKCSAPARPACCNSRSPT

SEQ ID NO: 23928 - protein, 172 aa, Pseudomonas aeruginosa
GKIQLAWSRHDRSRPGLRRCSARPPGHPPAARQARHRLPRGQRQRGAACRPPGPGGAAGRRRRHPAGAVPAEPVAGPRPAHRTDRPQAAGDQARAPGTNARQARVAPPAGVAAPDQFALPVRRAPVAGTAPADRVRPARHPPGDRQQRLPRPAGQGQRRALRRTAGKHQPEP

SEQ ID NO: 23929 - protein, 499 aa, Pseudomonas aeruginosa
APIGAQPSRRSSASGWPPSSTTAMLTAQPWRCASSRAAPRTRATSSRPSTGLLCMVSLSSGQGLVEQLDPVAYRGPSGPVEMGLATDVGRGDDIRRAAFQGVQAVVAQTPGQRRLGQRVGAGGPAAEMTVGHLGEMEAQSPQHRLHGPAQSLRVLQCAWAVERQALVAAQAEGLQRLVAKHFHQVAGSGGDLVRLVRVPWVVAQQVGVVLDEGAAAAGGLHDGLGTLAQQRPPGVDIAPRALAAALLRIQVEIQRAAAAGRGRRRHADSQAVQNPRGGGVGVRRQRRLHATFEQQHAPCMPGLRPPARRRDPTWQLALHRLRQQRPQPPGSAGQRAEQPRARGQQAQPVAQQALPEAARQAFGEEVAADIQQLVVLDSGRAGGFAVAAAQAAIEVQAGALAGLVALEELLDQVDPSARAVEFVAQLLVGRAGGVAETAVHAAAQDALGFGGLGALPGGIAEVGLHRASSEFGVHPPGIEDALRVELAFECPVQAEQSRR

SEQ ID NO: 23930 - protein, 623 aa, Pseudomonas aeruginosa
SPVRRDRRRRSHGVRRAPAVRPQPACRGTPCYRRRRCAAARAAPGRRGPARAARRHGRRQRPDRNTAGSSETLQFGERQSTVVDVHGAELGAAMQGGHVLAGIEQPGRVERRLHGVEQGQLVGIELSAHLVDLLAADAMFAGDAAAYRHAQLEDPAAQRFSALQLARQVGVEEDQRVHVAVAGVEYVGHPQAVFARKLGDAMQHPRQLAARDAAVHAVVIGGNPPDRRKRILAPGPEALALGLVLGLSHRGGASRLEQLADPLAILVHVGFHAIQFAEQDRRRVDRVTGVDEILSGADRQVVHHFQPGRDDAGTDQVGHRPPGAFHIVEAGQQDLRHRRARQQPDGDLHHHAEQPFGAGEQRQQVEAGAVQGAGPQAQALAFQGHDVHLQQVVHGQAVLQAMHAAGVLRDVAADGAGDLRGRVRCVVQTMRGSGLGDRQVAHARLDPGETTQRIDLEDPPETRHHQQHAVLQRQRAAGQAGAGTARHDRHLQPMAEGEQALNLFDAFRQCHQQRRAAIRRESVALVGTQVFRGVQQFEVGQAEAQLGQQAILVHLRQRTVQTLVVEDVHGGCPCCGCRRDQQASTACTARTPGSSRRLTGPTSITRSHGHEAHARKSLSFYSE

SEQ ID NO: 23931 - protein, 264 aa, Pseudomonas aeruginosa
RQPTGPTSATGASMQKQRVADQVAERIERLIVDGVLKVGQALPSERRLVAKLGCSRSALREGLRALRGRGIIDTEHGRGSFVADLDRNADVSPLMHLFGSQPRTLYDLLEVRALLEGEAARLAALRGTEADFVLLARRYEEMLASHEEAQPIDPREHARRDHAFHRAISEASHNPVLVHTLQSLNELLLSTVFASVNNLYHRPPQKRQIDRQHARLYAALRERQPDQAQRAAREHIHSIRDNLREIEQEEQRLVRATLRLNGWG

SEQ ID NO: 23932 - protein, 415 aa, Pseudomonas aeruginosa
RLGPRGLPAWPRPSLGVRPQRGGAQRPGRLGLRPGAARHPLAGRVAVQRQRLRARAHRSLPLSGGRSARRGPRRGSLGPSLTVFPRRARGAGGGGVPTAPVGPGGNRRRIIPRSTPEVPMFVTLIKPLARLHPRAWDFVQLVRLDRPIGIYLLLWPTLWSLWIAADGVPELKNLLIFVLGVILMRAAGCVINDFADRNFDGHVARTKARPLATGKISVREAWITFAVLVALSFGLVLLTNATTVWLSFGAVAVASLYPFMKRYTYYPQVVLGAAYSWGILMAFTAERGELPASAWLLFLANVLWTVAYDSYYAMTDREDDLKIGIKSTAILFGDADRLIIGSLQGLTLLLLALAGNRFELGLCFYLGLAVAAACFVWEAWSTRDRDPQACFRAFLHNHWAGLAIFLGTVADYALR

SEQ ID NO: 23933 - protein, 225 aa, Pseudomonas aeruginosa
RGDHARQRRQPGMVEPRRGKPARPEDPAGRWPAGEQPDPPSALQGILRPGGLPRAAGNPLADQRAPAPAIPHHPLRQPRAPDAGPRRHPRPPAGADAQGLRGQRLPRAAYAADGDRRLPGDPPRQRRGCEPALAARPAADAAAGRTHAEPAQRPAPAGQAGGHRVTPATTSRWRWTLSSPASVTTPRPCPPGATTASAWTPHPLCSSRAARRNCAAPSPTWYSTR

SEQ ID NO: 23934 - protein, 428 aa, Pseudomonas aeruginosa
SSSRFSSSCSMASSSAAEFAMVKLRATRVETIAKQHGWRGAILRKVHNQLDAYLSACQLGITLASLGLGWVGEPAFAELLEPLLAMIGVHSDELIRGISFFTAFFIISYLHIVVGELAPKSWAIRKPELLSLWTAVPLYLFYWLMYPAIWLLNASANAILKIAGQGEPGPHHEHHYSRDELKLILHSSRAQDPSDQGMRVLASAVELGELEVVDWANSREDLVYLEHDAPLADILAVIRRHKYSRYPVWDSHKGEFIGLLHIKDLLLALSALDSLPETFDLDELVRPLEIVTKHTPLSRLLEQFRKGGAHFAVVEEADHKVVGFLTMEDVLEVLVGDIQDEHRKTERGILAYQPGKLLVRGDTPLFKLERLLGIDLDHVEADTLAGLVYDTLKRVPEEEEVLDTEGLRIIVKKMRGPKIVLAKVVKLD

SEQ ID NO: 23935 - protein, 170 aa, Pseudomonas aeruginosa
SGCTCHWRPGTGGTARRARAADSDRAAAAGAGRRARNAASGRSSSACRPCAAPGSPGAPGCAPGPPSESARRAPQRHCAGCGSATRPRPARRGRCAPAGSRHPRASSSPASLPVPGARPSGRGRRTPAPRPRRGRSRSPRHWRRCTCRWSGPQPELPRRTGHREGEGALA

SEQ ID NO: 23936 - protein, 344 aa, Pseudomonas aeruginosa
RPGKLSRNPFFIRSRMKGASSTTSALTLLIDFSWTGPPRIASPAGRMPSLAAVARRNKAPGQGSLACGRSLAAVVLDLFLHAGQADVANVGAANQVDHQLGDVARMVADALQRAQGPDDVEHAGYRPRVFHHVGDQLAQGGLVLAIDGLVVLRHGQRQVGIEAGEGVQCLLHHLLYLAADVPNLDVAARRLAFLAQLDGAAGDLGGLVADPLEVDHRLRDADDQAQVGGRRLTPGEDTHALLVDVALHLVDLVVDLADLLGEAGVGVDQRVDRVVDLLFHQPAHGQEVAAHILQLGVELLGDVMGETVFVDHVGNPSGAAATGDINELRRAPEAAVSPRLRTRR

SEQ ID NO: 23937 - protein, 87 aa, Pseudomonas aeruginosa
MLLGNGLGFWNTMPTRRRSSATSTPLAKMLWPSRRISPSTRQPSTRSFIRLKQRSKVDLPQPDGPMKAVTRCFGMFIRTSKRACLAP

SEQ ID NO: 23938 - protein, 519 aa, Pseudomonas aeruginosa
LPSTGSDGASFTTPTSISGATSPAARATARIRPVIIAGLAIGRTIFHSVSALVAPSAREPSRTARGIRARPSSVATITTGTARIARVSEAQNSPGGTEGRRRQGLGEEQPVDGTAQHVDEETQAEHAVDDRRYAGEVVHGDADHPGQRPLLGVLAQVDRSDHAERGDDQRHHQGHHHGAEDRREDTALGIGLARIVAEELPELLEVHRHLGAQAHGVGLVGMHQLAKGDFALAAAGVAHYHAVAVELLVQAVELLFQDLVARLQLAALGGQVGLGGGVQLAVQLQLALFQAQALETVVDPADVALLQLVELGVEVIHPLHALLQLAYRGVAFSDHLAVLLDAQQVAVEVAPLAAFENHQRFGALDVLQPLADDPGEIAAVKLAVAQLEQLAGHEFGAGLRDRHAGAAQARARHFLGLDHLADHGLGGFARDLVRRLDDVRRPEVAEAAYRDHRQQADGHDHRDRHRAGVHPHPGRAAAEPGFDGFLFLFHRAIPPPLTTTRISCADADGSALPGCSSRR

SEQ ID NO: 23939 - protein, 104 aa, Pseudomonas aeruginosa
ADIEVPNTAVDMNSWAVSACYPRSTFYPLSDGPSIQNHRITKTYFRTCSTCLSRSQARFCLYTLRPISDRSERTFVLLRYSLGGDRPSQTAHHTLSSIRITDQS

SEQ ID NO: 23940 - protein, 91 aa, Pseudomonas aeruginosa
QVGSHCLYAYGFRFYFTPLSGVLFAFPSRYWFTIGQSVVFSLGGWSPHVQTKFLVLRPTRFHFKDPFAYGAITHYGRTFQSVPLKSMKLKG

SEQ ID NO: 23941 - protein, 101 aa, Pseudomonas aeruginosa
RTVLVQRPEINVHSRTFISELSTIVLDGGAKEDRTPDLLRAKQALSQLSYGPVSDHAAHQQLVGLGRFELPTSPLSGVRSNQLSYRPNRLTSESSNSCGSL

SEQ ID NO: 23942 - protein, 320 aa, Pseudomonas aeruginosa
VAAIPRRPAPVDRPGSCPGQVRGQRSRLGTSTRPALPAPPGIPQGADTSSASVVLPQIHAAIKGSDLAPVAIEHLRIPYIGAEQPTGQAPLASLGPSRVVDLRIDVGIEPVLVGGNAFPGGLRLLADQTDTHDGLDALEAILPRHHQAQRRAILVGQQPPVHAHRQNCQGMHRLVHAQAFHIRPVDHRETGALADHLFRTLQGFETDELRLPIGFDPLEQVRQGKAQPRDHHRPGFHAAQPIDALFQLVGFDEILEGIGTRLADLAVDHHRPGLGLQGRGVFRRVALVRPEFVEIVVVGGVLEWRDRLPLDIHRLPAGLR

SEQ ID NO: 23943 - protein, 571 aa, Pseudomonas aeruginosa
SGTLRLAQPHVAHRAVTDLHRIDVFAGVHLDVEEDQAILHGERLLHLRLQILQVGDAHADMPVGFGKLDEVRQGFHVGMRITAVVLHVLPLADHAQGTIVQVDDLHRQVVLQAGRQFLDIHLDTALAGHAGDIVVREVELDAHRRREAEAHGAETAGVDPAIGLVELVVLRGEHLVLADIGGDEGIAMGNLVERLDDGLRLDDAAVALVVREQPTVTTPLVDLLPPGSLGILVRGLADFPDDRDHFGENAVHRADDRDVGLDGLGNRRRIDVDVDDLGVRAELRRAVDDPVVETRADREDHVAVMHRQVGGEAAVHPEHAKELAVRAGIPAEAHQGVGHRQVEHLRQLGQRRRGIAHDHAAAGIDHRALGGQEHLGGLADLSRVTANGRAVRTQLDLLRIGIFELLRRVAHVLRNIHDHRPRTTGLRQVKGLLDHLGNFRGMLDDEAVLHDRPGDPDHVGFLERVGTDHVARHLARQDHHRDGVHVCGGDTGDGVGRARAGSHQHDTGLAGGAGVAVGHMGSRLFVAHQDVGHVVLLEERVVDMQEGTTRVPVDVLNAFVAQRADDHFSAR

SEQ ID NO: 23944 - protein, 973 aa, Pseudomonas aeruginosa
LPPSGGVEALLGGAWYWVPVPSGALLIGAAPDCAGKVWIGAELAPCGTITTTPESPPWGMPWVAAPCWVRGTWVRVMRKPPLSWLDTGVPESTTGIAPCCGLAQPASTALPASAANTKIFFTSGPLGSIQPATYPVHHLAGGVLAPAAWALGGLAATNIGHLYGIRAIRRRALPGLRVHPGHHHVLRHRHFQRLRMRLAHEAGPHLQGTGGAGKRRLAVVVATEPDHSLEVAAETGEPAIARVVAGAGLAGEGQRRRQLTVHRTPGAFAHDPLHGVLHQVDGARVEALFDLERIALERLAVGSEDAADPPQRRVEAAAGDGLVHGGDLHRTERTGAQQHRRIGRPVTVDTQPGDGLQHVGHTDVEAELGGGQVVGVCQALVQEDRAMRAPVVVLRSPDLAVLAFHREGLVLHPGGQGVLARPLESGQVNRRLDQRTDRPHRVQGPVEAGEARVATADQGLDLAGFRIGHDHRRLDLVDSLAPTEALERFVDGGLGLLLQDRIEAGEDAQPFLGQVLVAVVLAQLALDQVEEGRIGAVGHAALPGNAERALLGGVDFLLGRHALLGEHVEHQVAPRQRTIRVTPRVEVGRSLDHADQQRHLVELELGQRLAEEILAGQAEAMDRSLPILAEEHLVEIGLEDVALVVVQFQQHRHHRFVDLAAQAALIAQEEVLHQLLGQGAAALAQLAGRGVDPHRPGHGFQRHAMVVPEVAILDRDQGVDQVGRHLVELDQDAILMVRRIQAADQQRLKARHRQFLAVGLAQPADIVAVEAHAHALGRFRAFVELEATGIEFDRAGRHRYGSRAAHAGLATVAEGVEFAQEVFPAQLQAVEQLQRAGIDLRRDGPAPAGEFLLHHGIEIDGEAGEEHQADEAELEGPAEPFVQAGCRACFAVTGTGGSGTRHGGALYVLYPQRTDTASAASTVCAAPVDRRGGSAAHSTGDPANGCYPPARFALSPLPAIMRVFAYFRGKDIP

SEQ ID NO: 23945 - protein, 168 aa, Pseudomonas aeruginosa
TPTTRPASTGWSTAFASACPVSERTAMPPAPPGRAPCRCSSILTASLLHRTPPMNSPRQLDSPLYQLLHAEDIEGFNRQKPADGWIDLAGGDFRGLDLRLLDAARVDFSDAYFRGADLRGVDLREARLEGASLAHAQISGTYFPLRLAPDEIRMSVNFGTRLRYLPEP

SEQ ID NO: 23946 - protein, 97 aa, Pseudomonas aeruginosa
AASQGPTMNDELLNLKNLGKTSTQWLHAVGIHSATDLRRLGSVGAYRAVRARGFRASKVLLYAIEGALLDVHWNELSPDHKAALLGELETFPVRNKS

SEQ ID NO: 23947 - protein, 300 aa, Pseudomonas aeruginosa
LTPATGRYLLPPGRPPIVSWTFVPPLPTRQLKEMAMYLLGEQPAYADQLINRLQGIPHRLLEGLAPSGPALELERSDDLERELPADQVFLVESGLLHALVDERPLFYLQEGDLLGLRRGLELPACRHANEEPIRLLPYSRDALLRHIHADQERQELLLQYLIGQTALLGDALAHLKQPEVRPATGFRHFAAGEALIRQGDDADHVFIIIEGHAEALVDGQKVGDVQKDEIFGAMAVFTREKRSATVVASEPCTVMVIPKEQFLGLMQNNPRIAHSLIEGMARRIDLLNREVTQLRLRRSA

SEQ ID NO: 23948 - protein, 335 aa, Pseudomonas aeruginosa
NCRKWTSTVSSPTRRRWPWSTNWPIATFPAAATPSAGRTSRSCWRRESTSTQRSTSSTWRASTTRSATSPACRSARRCRTGCCRRPTRSSSSTCRRASCWSACARARSTCRNRRGRRSMRSSRRPTSPRCVNWRCRPPPRGSTPTSTTATASAARKRRRCAGGCWWASTVTNRPNAWCATPAGSPNVGTCPGAWYTSIPAACAASTRGCACRVRSNWPSGSAARSSCCAPARWRGPSCNMPASAAPAWSWLASRGAAGTAGPSAVVSPGVCCATARAWRSVPWTARPTCARRNRGHAIRWCGTTICWRCWRPPWPAAWPGSWRTCWSCRTSPWCS

SEQ ID NO: 23949 - protein, 142 aa, Pseudomonas aeruginosa
AWRSSCSWPASPATWRHASGASWRRCAIPRRKPACCWSCRASSPPPPTARRCWPPPPSSSTTGRTSRSACSVRSMASGRPRPACSGNSPTRNGSPRTGPGPTTSRPASVLARCPEDAGGGGRCRRKRDRWHCSASRRWTASR

SEQ ID NO: 23950 - protein, 82 aa, Pseudomonas aeruginosa
ATRGRGFPRPEREKIFDMLYTAARGDRGGQGTGLGLAICQGMIGAHGGRISVGEGLDGRGTTLVLHLPLHPQPDLGQLEGDE

SEQ ID NO: 23951 - protein, 191 aa, Pseudomonas aeruginosa
ARRTCLAPALALFLPFPRRRRWPVAVFTCRAECHDPIAEQHPADRRRTADPQVPPYQPQCPGLPGARGRHRRRGAGPGRAEPTGPGGARPRPAGPRRPGHPSRPARMVAGAGAGAVGARQRGREGTGPGRRRQRLRDQAVRHPGVPRPRARPAAPGGAGRKPGGVGGGRPVAGGLRLSPSHPGGCGSGADT

SEQ ID NO: 23952 - protein, 530 aa, Pseudomonas aeruginosa
SPPADRARQGRRLHSRARRRRAEPTGDRRVQPRRRAVPCRRRPAAVFHPEHFQGVQPGPGDPAFRRGHLATPRPRALRPAFQLPGAAGVRARQAAQSVHQCRRPGDLRHQPVAFRRAGAIDARFRPAPVRQPGSGVGLGGGALGVPAPLAQRGGGLPDEIVRQLPQRRRGGAAQLFPSLRVAHELRRPGAGVLLPRRQGLLQAQRRAGAQRAADQAGQRDHGHQRALRRGRQLCLPGRPAGQERRRRRHHRGGAGALHGLRLVAGAERRGQFAGGYRRAGETQRADRLVDLLKPPPVVVALEFPAPLRYVLRLPLAGAGCAGPLARMVAMSRPIPVSRVFACLTVLAACAHAGAAEPDWRGYTSDQQQRSVLAVEQDAEAINKRYYDSAFEEFLPELEQLELSLAQPVVAVDEKGLLGDWKCRSTQADQYGIYRYPNFQCRIRRTDRGLFLEKTSGSQRVSGYLFREGTQRYVFLGGATVNDEPQVAFSGLAHGAPAESDVVALLRPHAGGFILLFPERRGGYEVLEFSR

SEQ ID NO: 23953 - protein, 121 aa, Pseudomonas aeruginosa
RSENDTRVARPPPSASRRCAALSLSGDRSMKTWIVLPVLALTLAGCAGKTAYRENCADQLDAAWKELDLAKAEGFAGTVSYSKALTLLTGAKTQQQFEAYEGCTSKAEKARFYIRESRAGR

SEQ ID NO: 23954 - protein, 570 aa, Pseudomonas aeruginosa
PTSPVSACSATWWKWPTAASSPHAWSTPRYRAWPVPNITWSRAACLAAHCATSTAMASASRHCRKCRSCCFAIRRPAAACWWRWLRKARRSSSPWRRNSACNWRRSASWSSDRVSRYRCCNARQHPALPRTVSRRYPPDGCARPGGVPQGRLSQHCQPAADERHRAAEGRHQLQAARPAGRHRPWPRTGLRGAQGRTAGGLESLRRSQPERLPVLLPRRPALADRPAVAEAGRRHRLPTGDRRLQGVAQLPFRNHPRGGRRVRFRAGRRPHRLRQDRGDRGAGQQPRSRRPRQPSRLQLWPASHAAAGADRLREPPGHRHPEEASSWRRPVRPRGRGADRRQLLLAAGAVPGHAGLPAGLAGGCLRAACRAYPQGLRDRPAQRVRARGVRGGGLRRLLRLPAEEPRRHRQAPRRRALPAAGGDPRAGAGRAGPRRLGGYPSWLDRGAAQGVLRPDVRLPAAEQGRPRGVPRQPGRGDRLPAPASGVAAIVVLYRERAGVDVLQAARVDRGHRLAVRAYAFAERRAAAGGAEVMLQAMGVEGVGVHRAGRRLQRQTVARDEPQQPAAPAAQ

SEQ ID NO: 23955 - protein, 214 aa, Pseudomonas aeruginosa
SASPPSISARPPCNWTSPPSLPPRPIAGWLPPSPRDRLPGVSTLSAEGASNLAPFSFFQVISDEPPTLMVNVSLRDDGSLKDTLRNVQATGQLVIHLVGAAQAETMNATSAWLPHGVSEIETVGIPTVSSVRVAPPRIAAAAVAFECEVAEIKPYPAENPNCHLIFARVLLAHVDDAVLADERHVDSDRLDLVGRLGGSHYSYTRDTFSMIRPR

SEQ ID NO: 23956 - protein, 857 aa, Pseudomonas aeruginosa
PGSVRRPQALVDRAPAHRRLARGLAFLPLAIGELVAFRIHPAAFQRRHDTRAQRLFGQRQVRGQALELPGLLALTALQDLDVVQAVGRRARQVVHDQPARQARRRRQRPERLLDRAAPVGQGGGAQTQRQQQRKYGTHGKLLFPWGAQYGSALDRRQPGYPGNDLRISLLAIIVPLPCPAAQVRRKTRDTAGNAHADGASRGRGVMLGLLRRRMADLGTAKKLAIGFTLVLLLTALVAALAVLSLHALGQRFARLQEMSAINRDVLEVRQAEKEFALHGEKSDAERLRQRLAATLERVGRLKADGDADQALGMAEVEQVLAAYLEAFGRFEQSIQGRQLAWESASWSLNGAANSLDILQSSLAEDGAYALKESQGHDGEPLLQQAAQVAQVNRLVLQGLDEARSRLEARAADAQEGPPKSLREALELAARLEQAITDDAYVSVVKDVLTNIRGFADKLAEYRASQLQERQMYAAMGERAGQVMARVDRSWEAQQQAMLHSLRTNSLLIVGAAVLALLVGLGAAFGISLLIVRPLRQAMGVAHRIAEGDLAVRVDSERRDEVGQLMAAMRAMTGSLRGIVSQLQDGVGRIAGASEALSGVTTRTRLGIDSQRAETEQVATAMNQMAATVHEVAHNAEEAAGAAESADGKVSVGQEVVRQTLERIERLAEAVRAATASVEALSADSQRIGSVLDVIKSVAEQTNLLALNAAIEAARAGDQGRGFAVVADEVRALARRTQQSTAEIETLIGALQNGTQQAVQRMQRSHQLVDQSVDDALQTEAALGNIATAVALIQQMNQQIAAASEQQSAVAEEINRSVTAIREVADQSAQAMQSTASSSEQLAELGRELQGMVRHFRL

SEQ ID NO: 23957 - protein, 314 aa, Pseudomonas aeruginosa
TGAARFRRGWRKAIFRGAADEQTSFRPGRTGHWRCGGHRPRYRAGLRRRRGQGGGRRPGQRRRRGHGRSDPPGRWRSPLHSLRRHPRRRGQGAGRGLRGGLRPSRLRLQQRRYRDRAGQAGRRQRSRVRRHHGCQREGRLVVHEAPDPADAGPGRWRDRQHRLGRRARRGAEDEHLRCFQARGDRPDQIGGDRVREEGHPRQRRVSGGDRHRHVPPRLRGRSAQGRVRRRDASAGSGRAGRGNRRRGALPVQRPRGLHHRYRLAGGRRGDGDLSGRRYNRDAPARGIRILLQVGTRFGAPGHCRGTNLGRESGA

SEQ ID NO: 23958 - protein, 308 aa, Pseudomonas aeruginosa
ARLHRIGAITIMTADPILTLFLPIALGIIMLGLGLSLTPADFLRVVRYPKPVLVGLVCQIVLLPLACFLIVQGFALEAALAVGMMLLAASPGGTTANLYSHLAHGDVALNITLTAVNSVIAILTMPLIVNLSLQYFMGDGQAIPLQFGKVVQVFVIVLGPVAIGMLVRNRLPAVADRLQKPVKILSALLLLVIILLALAKDWQTFVTYAPVVGLAALAFNLLSLAVGYWVPRLLRLPKAQAVAIGMEIGIHNGTLAIALALSPSLLNNSTMAIPPAIYGVLMFFTAAAFGWWVSRGHQATPAPVTAPD

SEQ ID NO: 23959 - protein, 216 aa, Pseudomonas aeruginosa
GRSAAPPVEHELSQQAGHQAPERRADGQQGEAGGGYHEGHQRGLALALVGHRVGQAVHDRAEQGDGGDGQYQCLGERREQRCQGGAEGSCDAVEEAAPERRGIALVRVLVGRGTGADRRADRRQVDPVGAERCQQDRGDAGTRDQRRGWHLVAVGVQHGDAGHVLRSHGDDEQRDADADGGGQGEARRGPLRYRQFQAEPAEVQLAQYPGQQHPHQ

SEQ ID NO: 23960 - protein, 143 aa, Pseudomonas aeruginosa
RSEHRIARREAFAQQIAEEHRQHQQGLLLGGVADLDADAEQHPGQQRRGQRGGNLAHQAFEAAGDAAQGDQEGADDEGADRLAVRHSGQAADQQRRAGGGPGDHDRHPVAQGQADGRQAHADRQGPDPPGNLRAAETGVLPGL

SEQ ID NO: 23961 - protein, 296 aa, Pseudomonas aeruginosa
THLPPEKLLDPRNPCRGAASGGDVVRRRAAGRADAAEGAVGADAGLHGPVRHERRRACPARSHRRRSACPRRPLRGEPGADRQRFAADPRPGQQAVHRSGHRGAARGADLPRRATGLPIVRRRLRDRAAGCRGPRPGCPAAAPGATQAGLRLPDPDFPESVRRALQRGTPRRGGGAARRIRRDPDRRRTLSRTGVRRGPRNPAGQPPAQVQLDLYRHGVEDPAAGPARRFPDRHPGPVPPPAAAETVGRPAYQPGRAVAGAAMVRQRGLPPAPGRTARVLPGPPRRHAGGAAGALR

SEQ ID NO: 23962 - protein, 281 aa, Pseudomonas aeruginosa
AGRMEYPGGRAVLLADPQAAAGYPHPAPAGAGRRCRIHARRTFLRRAGAEPRASAAELQPRRPGAPARRPAAPGQGRPRRPGRRSGLNPHRRSSEGAGHPIRGATRCTRSTVITVRATATRSSWPCRCSASTTSGYRWTFSRARPRPRSSWRRTPTARYRCWSWRTAVACGSPTPSSTSSPTAAPCCPANRACAPRCCNGNSSSNTAMSPMWPWRASSSSTSASRKPAAPSSKRRRSAATRPSTSWRNSCRARHSWSANSSPSPISPSTPTPMSPMKAAST

SEQ ID NO: 23963 - protein, 136 aa, Pseudomonas aeruginosa
PAAGRDRLRGRSPAPPCRPAGWRWHRSSFPPSRRQRVTSNCCCRRPGPRDPSGIAPSPDRSGRNGFPRPSVRSPPRSACRGCAASAASAGDERTPPRAWPGSGCGNPAGSRPGSQRRRRRCFLPAPAAAAPRESPR

SEQ ID NO: 23964 - protein, 279 aa, Pseudomonas aeruginosa
LMASRPLKESTCRSRARPSMARLKWVWLAAANIRCPSLAQATDSIVLPGAGETRARRLDRKLPTTNKAASTRRGLSWPRRYGSSRARRPARLAACGGRGSAGDRGAPVVGAGGAGDFVGPGDLAVGEVHVFQVGEVGVARVLAVVHVVLDVDDDRVFQDGGVVVLLGAGGGGAVPLDLDLGQALAGGQGGQQQRRGLVEDLGDDHRLVHALAGRLAGLRVARDDHFVVEALDHHLVLVAFLVGVADRILGEGAGGDQALLGAGDGHIGGGCHGCIPCQW

SEQ ID NO: 23965 - protein, 126 aa, Pseudomonas aeruginosa
SCRVSLPSRPSVGQAGWTTSRRRTSGTLRQNEERPMSEQDDNQEDGFAEEKLIQAIENQIESENPPAARAVFNKLTLVGYERDEALGMMAYVLAHEINAMLAADRAFDSAGYEHALRALPTLPDDE

SEQ ID NO: 23966 - protein, 299 aa, Pseudomonas aeruginosa
AEPGRLVPANAPRIHTVLFRQTPAALVERWRPLSVPPAFAERYRMRSWFHFLPICLLLALSGPAAAVPTEPLVLGAEDDWYPYTAYKDGRIQGMSADIVRAAFRAADTPVQLNPYPYSRCMKLALKGLIAGCFNTSPNPHILADYRLPRHPLFRAEIQLWARRDEARPVDAEQALSGRKVAVTLGYEYGDGFDRRHDLVRIPVRKDYYGFLMLQRGRVDYALAYRNTARQLFSEHPELEGQFQPVATVHRPELYLSFSRRHPQAEHLLERFDLGMQRILASGEYQKILDGWSQAADATP

SEQ ID NO: 23967 - protein, 91 aa, Pseudomonas aeruginosa
SNYTHRCSTPQGADMAFTPELIDELELLALFNLNNTQEGLKVHHTADGKAVAAARRLHDKGLIDQPDGGYLTSLGLDAAEQAQGLLTILKG

SEQ ID NO: 23968 - protein, 253 aa, Pseudomonas aeruginosa
RKRPSRPAPDRPRRLPRFAVRCSSRRASGRYNGMTGARHGAWPCLCPDAHEPTSRTQPRSRRWHRPQGPRPVAPTLPGGQCRSPATRPAGVVQPPGAGPAPATAAVPHQPSAAAGLPVGQHASGPERFRGGRRSTRRSPAPGPLVCLQATQARTRTAADPRPVPDGQPGEPGPGGTERSRPLGLPCPRTGARRAPGAAPQVRVDRGLGAQPGQRGALFPDRRRPFRPGRTQRLERVRRRRQYPALPAARRVLP

SEQ ID NO: 23969 - protein, 161 aa, Pseudomonas aeruginosa
LRASETQPQAGRAARLVPSQRRHRQRHPAVPASRPERPRRCRTGQSPGQPAAVPACPPGDRGRRRPAATASAQERPAAGQRRCRPAAPPQPDEPAHGYRAYRRARLCRGARQPGADPRPAQPQQLERTDGAPLRRPPGAARVPCRVPRRRPRKARKPAAAA

SEQ ID NO: 23970 - protein, 134 aa, Pseudomonas aeruginosa
TDGALLLSQPGRRHRRAGRRAVPRDLRATAWRPAKPLPAADPPAVPPAGNVAGSGQPREPARPAEPAPAPGPRARWLQRPEAGSSRPGGRGPRADPVHGAAGLHPGVLPARLRQRRDQPARRTQRPLAPAPGIA

SEQ ID NO: 23971 - protein, 229 aa, Pseudomonas aeruginosa
TARSGKTAAQRCIAPAISVAAAAAPAIAAVPSVRTDRIRATAAAAIAAETAAAVAGVEDAGAVGATEGREARRRMATGENRSARVVAGGFRLVFDFQQGQLQRLAARRRPVDGLADGQAQQRGAHRREDRDLAFAGDVFGIDQGQGVLLAAAFLAAAHGGVHGHDARRNLVMPHHLGARQFGLQRLGGGSEFVQAIQQALQALQVQTSDGDRRRAHDRRRAPWSGSVDR

SEQ ID NO: 23972 - protein, 464 aa, Pseudomonas aeruginosa
SGCSCPSSRSPSSPAPSPPAARKARCTCRTTKKPRKNTAKTATVSERAPMDTFSYRDGELFAEGVALSRIAERFGTPTYVYSRAHIEAQYRAYADALAGMPHLVCFAVKANSNLGVLNVLARLGAGFDIVSRGELERVLAAGGDPAKVVFSGVGKTRDDMRRALEVGVHCFNVESGEELERLQRVAAELGVKAPVSLRVNPDVDAQTHPYISTGLKENKFGIAIDEAEAVYARAAELDHLEVIGVDCHIGSQLTQLEPFLDALERLLGLVDRLAGKGIGIRHLDLGGGLGVRYRDEQPPLAGDYIRAIRERLHGRDLTLVFEPGRSIVANAGVLLTRVEYLKHTEHKDFAIVDAAMNDLIRPALYQAWMDVQAVRPRDAAPRRYDLVGPICETGDFLAKDRDLALAEGDLLAVRSAGAYGFVMSSNYNTRGRAAEVLVDGEQTHEVRRRETVQELYAGESLLPQ

SEQ ID NO: 23973 - protein, 143 aa, Pseudomonas aeruginosa
RLGGPLGEQRGGAPGHRRPALRRQDRLRRAASARTGVPLRRERPRRDRLRSGGLPEFPGPTRRARHRQSRSAALQEFPRHPVPRLRRRGPGPRAAAFLLAAALGPLSAAGGPRCAPTWMPSSNICAASARSPRTPSTATAATC

SEQ ID NO: 23974 - protein, 256 aa, Pseudomonas aeruginosa
RRGRSSCGCARPASASWASTCTRTCCGTPSPAICWSRPATCAPCRNCSATPTSPRPRSIPTWTSSTWPRSTTAPIPAPSARATPMEATTHEQPATDHLRPRRHPVGRRPGDEQRRGPCSANGWRATRRAWVRYPSSTCGRSAPACWIASRCCATVSASCAGASCSMPCSTPVIHRRRRKAWPRPVSRYSSKRATGSPCFPRSTRPWRSSPTASPSACSPTATPTCAAWAWPTTSGSPSAPRNWASASPTRRHSAKP

SEQ ID NO: 23975 - protein, 178 aa, Pseudomonas aeruginosa
PDPQWPMPAGSRGRTAGCRRERTAAAASAYRARAAPRPAGPPPPPGPRRPVPAGPRSCRAPGSPGTAGTDWSVPRRGRSRARCWRSPSWPRCENPRPRSVRSCRPSRWPMPGPCRRRATGAPRRAPPGAARAPSPGWPPSTAAARRRSAACARSDRTTRRVPAAPAVRRAHSRRKRWR

SEQ ID NO: 23976 - protein, 275 aa, Pseudomonas aeruginosa
VRHAPPDRPQCQRAAGAADRRRGQRLDPRQSRPRRHADSVDTPVGQGKPAQPVQRDRGLRPPGRPGDAGIAARLGVLRRRGARRHYRPRQRMARRRGKRMGPVQRQLDETQARLRLDSGQLAGSRGTQLRDPPGRPQRTRRAVRLQHSAGPAGAAPAHPETPAADRYPCRPGADPHHHRRQPCPRPVGTHAAQAGRRGGGGEPRLLQPVQPAEVPRGEDARRAAHPPRPGHRRAGDDPPRAQAEVPFHQQHVPQPHRHQPQPLSGPPRAATGRAA

SEQ ID NO: 23977 - protein, 188 aa, Pseudomonas aeruginosa
RCHRKGKGLGPSPAVPEQAKDRLANRDAAACQSDRRHSTRPAIPCGRRALGWREIRWGGCRTCCPASSADRPPRWVRSPAPFHRGKGTPPSPWRGRHALSAWLRPRAAPLPPRRLSPSSRGRGPRRRRRCPLRRRRPRPALRRRPRQRRPARPVPVLLRSWSTSRCCKSRLVIAQPRVLMSAAGKNSY

SEQ ID NO: 23978 - protein, 71 aa, Pseudomonas aeruginosa
SRRMLQKQVQQADPALPKLRQGVEYLLGDEVKAPRTRAQGDQGLLPHAAVPNRLRSVAPRILARHLKKQRA

SEQ ID NO: 23979 - protein, 162 aa, Pseudomonas aeruginosa
TTVKATPLNCTKNCAPMSSTLPKPPSDGAAKIPVSSAPTIPPTACTPKASRESSYFSARLRLVAAKKQITPEARPITSAPIGPAVPAAGVMATRPATTPDAMPRALGLPWVIHSANIQARAAAAVAIWVTSMAIPAVPLAAAAEPALKPNQPIHSMAAPTKV

SEQ ID NO: 23980 - protein, 344 aa, Pseudomonas aeruginosa
IASVSVSPVRMRMACSRFTTKILPSPILPVLAALVIASMTRSSWSSAIATSIFTLGRKSTTYSAPRYSSVWPFCRPKPLTSVTVMPCTPISDNDSRTSSNLNGLMMAVTSFMKLSPVFGGLAPGKRTRGQSKRSVWLCNAPVPLGSMIGTLRPDLALLRPFDAATCRPPATASSAAPVLLQCTPHPGQSRKLASSGKSAGFQVLSRQPGDSAERRAPGGAPNRRRRAPTVAQKVCNGPPASAADIVLDCRPLVTGTLAMLPPKAVFEALSQQASRLFAGESPLPKAELESQFRALMQSAFSKLDLVSREEFDSQMLVLARTRARLEALEAKVAELESKLTPPAD

SEQ ID NO: 23981 - protein, 525 aa, Pseudomonas aeruginosa
DQGAIHVPGDCPQPSPGRRRSPLRQRRGAPGQRPAFADPGRPAGNRGAREQGPRAQRPAQCRFRLPRAAHHPQPRPRRPTQGRRSLRPGHRTRHPRRQRPVARHRPRRPGVPRRTGPVRGDPASARRIAGRAGGARRKARSGGTEGKCRRGQPGQRADGVRRGPPAGDRRTPLRPGPAAALPGPRPAPRALPLSRPGRGPGPGRRQARPAGGRRRRAQPVAQRPAGHRQDPPGQPPARPAAGARRGRSPGGRGDPFGGQPRPPQALAAATVPPAAPLRLRAGPGRRRQPPAAGRDHPGAPGRAVPRRTAGVRAQGPGGPARAAGKRRDRHCPGQRPGTFPGALPTGGGDESLSLWLPRRSQWPLPLHPGTGPALPGQAVRTAARSHRPARQRAPRKHQPAARTRRNRYRRGQRTGGRRTATATGPPGLRQCPSRSPGDAPQLCTRRSGPPLAGGCRRAPGTFLARLASHTQGGPDAGRPGAHRCHRTPAPGGSPAVSGNDLHVKRNNSAKLSIKAFRIKLAITMC

SEQ ID NO: 23982 - protein, 240 aa, Pseudomonas aeruginosa
PRAAATMPSSSVSNTWPPLSDTSSPSPVRCSQRRQSRRSGVGCSNSLSRRRWRVQGSTASSGSQTGTSHSANSAAVSHSGLNWPLPSNTAQSKGSRWKSTESTSIQALVSCTSISGFRWRKRLRRGSSQRRVRVEGAFRRRVASSTRRAVQARSSASKPSRSPGSSRRAGSVSCNWRPWRSNRRQPKCSSRVRMCRLTALWVIASSSPARVKEACRAAASKARRAYSGGRRRVIGELPLS

SEQ ID NO: 23983 - protein, 530 aa, Pseudomonas aeruginosa
LLLMPGILFFLLWSHASRTENSRILNADRPSRQPSPPEPYSSMSSPSLVELKAILRLAGPLIAAQLAYVAMVFTDTVMMGKLGPDALAAGGLGAVSYAFVSTFCVGVVAAVGNLVAIRHGCDDAAGAAAAARSGLWVGAALALAAGLLLWNLRPLLLVFGQAPQTVDGAMQFLHSLTFALPGYMAFMVLRGFTSAIDRAGPVMAISVLGALANLALNYSFIEGLFGLPRLGLAGIGLVTALVMNCMPLLLALYIRLQPAYAEYSLLRGLGRPQRAMVEEILRLGLPIGGTYAVESGMFTVATLCMGIIGDHALAAHQIAIQAVYVAFMVPVGLSYATTYRIGQHFGAGRLLEARRAGRVGIGFGALCMLLFAGLFWWMPEAIIGLFLDRDAPANREVAAMAVSLLAIAAWFELFDGTQNVAMGAIRGLKDARTTFLVGLACYWLVGVPLACLLAFAAGWGAAGVWWGLAGGLACAAIGLTLAFEWKTARLLPKATASEASALNCRAAGRGAPSARLCPGNAPVPPTAAAD

SEQ ID NO: 23984 - protein, 360 aa, Pseudomonas aeruginosa
RIPFEDSFMSSKKVAEIVVETLEAAGVRHCYGIVGDTLNHVTDAIHRSQIQWVHVRHEEAAAFAAGAESYISGRLTACAGSCGPGSLHFINGVYEAQRNRAPMVLIASQIVTPQLGMEFPQEVDFKAVYASCSVFCEQVHSPEQARRVVALACQAALNRRGVAVVILPADISQATVKDDLPFSVHFPQPVLRPSDAELQDVARLLAHGKKIGIYAGSGCQGAHDLLVALADRLKAPIAHTSRAKDFVEYDNPFNMGMTGMLGIESGFHMMTECDTLLLLGADFAWAQFYPQKATLIQVDRDGSHLGRRHPIDLGVVGDVIPSSCRCSKPARSAASSTNAWSTASARCGRWKKRSKPARAS

SEQ ID NO: 23985 - protein, 246 aa, Pseudomonas aeruginosa
NEPAAARPACHGAAPGRRGFLTARSCSLVRENVARGAGWRYNAALHQRQPLRRKPPVDILKDKIRSEGIVLSEHVLKVDAFLNHQIDPQLMQQVGHAFAMRFRDQGITKIVTIEASGIAPAVMAGLELGVPVIFARKYQSLTLKDNLYISKVFSFTKQTESTIAISAKHLNAHDHVLVIDDFLANGHAAKALIDLIGQAGASIAGLGIVIEKSFQDGRALLESEGYRVESLARVKSLAGGQVEFLD

SEQ ID NO: 23986 - protein, 64 aa, Pseudomonas aeruginosa
APLSPALPGWLAGRPAASAGRVPREAPADRPGPCAADAPGRLLAPAHPGSPCPVRGSRSASACA

SEQ ID NO: 23987 - protein, 156 aa, Pseudomonas aeruginosa
RSRCRSCRSRRALPATSRAGAGRTPTDRGKSRRAATPRPPPAPHRARRHAAALRRGRPGGSARRPRPAPADPARTSRCNRKAPGGTAPGHRRARSSRPSAHAHPARRSTPGRWRCRAGAAAGRRSARRPSSRCRSAGCRRRAPARWRGDRYSDPAG

SEQ ID NO: 23988 - protein, 88 aa, Pseudomonas aeruginosa
CSAAAPARCPAGCRAAGRTPRRGCSPAVRRGVGRAGNPAPGSRRRPVRRKARGNAVAGRRQRRDAPGKARYTASVGAPAGSAGAGTTH

SEQ ID NO: 23989 - protein, 140 aa, Pseudomonas aeruginosa
LIITIFATLPLARRRSWAARKSSGKKPTRCMPESIFSQTFSGRARLARSIASNCQAQCTTHQKSWATISSSSDASKKPSSSRIGWRIPASRSSRPSSMQATAKPSASATSASAQRTAPWPYASALITASARAPVASRASR

SEQ ID NO: 23990 - protein, 475 aa, Pseudomonas aeruginosa
TVPLWTTIWLIRSLVCWRWMGILGVLRGIAIAGNIQAFGTDLRALLRHQVGQVATRPAGHGPTQGAVAGIEEQVAVAGGADDRGAIRGRRAQAGPEGRLADVAALGIEVGGDHFQGLAAARVQRQVEAGDFRHAADADALVEAGDRHLVGLVEDGRGRRHLRVGDRHGQRITLQRIDRSLDTQRLEQLRRVAAQGQHVVVGGEQFAVDQHAVDAVAGEVQALDVLAEAELHAQALGHFRQAGGEQLAVAGLVVGQAQGADQLVGDLGQSRLYAGDAVAVENLVGHAGALEHGDVLAGGVQLRLGAEQLGGAEGAALVGDAGLGAQFVEAIAAVLGQADHALLVHGVALGGAVAQHLQHPGVLAGIGGELDGQRRVLFQQPLHGLQGNARGCPGRSVAGRHLAGVGEAGFQGGTVMTVDHHHLEPGTGQVIRTGGTDDTAAKDQNSHCRLPRRGGTADVCYFERVDARSIGRGRQK

SEQ ID NO: 23991 - protein, 244 aa, Pseudomonas aeruginosa
PGRRRRWASSGSASAAARRPGRLRRPGPPPDRPGKSRRVVCPGYARRTSARPDPGGCSPRGPRPARRTGRSATSASSNGRCPARKAGPHSARGNSPAPAAGRDWPRPGSGRGCPGSTDRHAGARPGCRPAPSARCGRRYRRGLSGSGPGRGTRRPPHRASSRPRRSLAHCPVRAAPASRRGSRPADCRYGRTPRPAWRRAPGASSRRAAAGCPPPTPRRCSAVPSGWCARGWCRAAPRRSRPTV

SEQ ID NO: 23992 - protein, 444 aa, Pseudomonas aeruginosa
APRRAGRRAGPAAPPVAGAVAQPAETALPTGGRCPVRRPARSGRRDKAGRDGSVRGGSVPAARRGSRAGTSSPAQRRRRRNSRQPVARRAPLAPRAGRVDADANPTARASAAARVPRPVAGWRHPRRAAPAPAVAARCLRRTGPGLATPGARHPARATGCARHASRSRTPAATALQIPAATSSFCANACPTSVRCRPGQGWRGPRARSRRFPWPVFFPAFDVILAENFRIFRARRGASIHAYPASEQARAGQDRPQHPPHPAGGRSHFLHRAGRTRRPLDHTLHRTRAPPGARRPDHGLSRPAQSAASEGQPAGVRRDQPGLQVRRYLRRVSPGGAQAAPCTGMPPGVRPLRLPGEGSHLGNGVLPQAARRHPAETAARTRVEELYRHGRGQGVARPTGSGLTHDALRESARTPGIDGKHRLFCTRSPQHLAVFSFFALGERLD

SEQ ID NO: 23993 - protein, 106 aa, Pseudomonas aeruginosa
PRAPSPTSCSRQPTVACGYASSSTTPPAMAGTTRSVCSPPIRTSRCACSTRCTWAAPPASREASAACSTCPSNTGACTTSCGWPTARRPSSADATSATSISTPSRR

SEQ ID NO: 23994 - protein, 176 aa, Pseudomonas aeruginosa
RSPIRISARVNNPPALAPNSTSSGQINGVCSSRGIARLLSSSTRPQPPNRPLRETRSASQPIGSCNNASPTTTVLTMASATACGKPWRNPYTGSRVRIIASKAANNTTAQAIAGRPRQKAHKPRPEALCGSTLGAPLRPSSSNEPAISRQTPNQKPRSSAVPMKVSSTGPDSWLRA

SEQ ID NO: 23995 - protein, 72 aa, Pseudomonas aeruginosa
LKFDTQFHRGLTRCIPTKESVAPEKSAALYQKGAPRRKGEDHGAAAARLTAGFAPRPFVALPRCRCPPHGLG

SEQ ID NO: 23996 - protein, 572 aa, Pseudomonas aeruginosa
LRPTAADGHVNRSNGARHAPRRFIPVPRPPAARPARRRCRLERVHRSQPRGLRRGPVQLDDHHQRLGRCADESPGRVRRRQGDGGALAGRALVGVRRRPELSLRPAPGCALPQHRLLQAEPYARRRRRGVQLPAHARSGQSLAQGGAERLPARPVDATAGADQAGGEKRRPPGAVRSRPPRRDLPADAEHGLRLHLFGGIRRPVDEGRNPGKAQRRADRQRPVRVQALPEGRGGALRRQPRVLRRQAGGRRADLRHHPGRQRAPAEVAPRRMPDRPVAEAAGRGERAQGRQPEGRADAGLHDRLRRPQYPASAAGRSQGAPGDQPGLRPHQLPAGGIRRQRQCRHRHLSAEHLELCQGYSRLPARPRTGAQAAGRQAASRAEHLDPPVRQPAQPQPEPRRPTAPGRPGGGRDQGQHPRHRMGRVDPSCQERRTRPAVHGLGRRQRRSGQLPHSAIQLRQRQVGAQLRALLRPRPGQADCRRQGRQQPGTTHRPVPPGAETDPRTGALAAPGPPDRLRPYPPGGAGLPGQSVRSPGFLSGRRETLKATPGRTQRWISTVSTCRIGSSANTTSG

SEQ ID NO: 23997 - protein, 147 aa, Pseudomonas aeruginosa
STRRPQRYSTRWKTCCASTTRWCAPSSSCAKRREGWPACWAGATTWPAAHASACMSSPAWSAAPTRPSPTAWSAASGAPTSPWNASRTASISAATTSPEWPSSCCVSVARPAPAVPCCTRKPGCSAPIAPAACASPPTGWRSARSAG

SEQ ID NO: 23998 - protein, 370 aa, Pseudomonas aeruginosa
SPSGDDPGRPRVHHAPDPPGVVRPSGAYRSAGPGGGSRDGPHRTGPLGRSGADRTGYRRPHGAPGPGRGQRPADHPGAGHRRANRPGTGDEPGHVARHRDPGQRRAAAPARLPPVRSGSGQPGLRRCRPRTHARSRGTGAARRRLLPAPGADRRACADHRRPDPGKHRPGALHHQPQFRKDGLRPRRGGGGSRRTGDPGHRPGAPAHARPGAARRRGQRPRHAGRLRGGDALRPADRLRGGRRLPPGSGRRAQTEERPYQRRGLALAAGAQSRHSRHPRTARGSSLQRGLRRRNRKPAGLCCTQAEGQEPRPDRRQRRGQPLDRLQQRRERDHGDRPRPASEHLRPDQQGQDRSPADRLHRRPPQPAMSY

SEQ ID NO: 23999 - protein, 260 aa, Pseudomonas aeruginosa
  UNSURE (141): Identity of amino acid at the above locations are unknown.
GAAAPVGRGLGRRPGRRLAPGLAATRRRHPRRRGQPPRPRSPAKRRRHPHRGRPAHPAGLGRRGRCPPERARPGRPGQRQPRPGQLRRPGYPAPGGKWPERRRRSLQGRPALAAVQRRAGARRRPEPARHAAAGGRPATAXARPAALAGRCRPGTTGPAVLRRTGPGAAATRYAGAGQGCASAGQRQSELETELHARQRRFDPGLAAAAGTRGAAGAARRHPRHLPHPFVAVAPPASGCPDPRSVSSGTRRATHCQTPCA

SEQ ID NO: 24000 - protein, 370 aa, Pseudomonas aeruginosa
RPGPPGIGANPHHEHCKSTDAARQHLPRLRHPWRGRRYPHRRDRLLDRSRHRLGKPRPRRTVRRCRPRWPPVRSRAGQAADPGPGGLRLPGQRRGHGAYPGAVLRGQRARGQVRGDADRQPQPAGLQRLQDRGRRRDPGQRADPGPARAHREKRPGIRRRQRRAGRHPAALLQADPRRHRHGQADEGGGRLRQRRGRGDRPAVDRGPGLQRDPAVLRGRRQLPEPPSGPGQAGEPEGPDRQGQGRERRPGPGLRRRRRSRRRGHQYRYHHLSGPSADAVRQGRGLAQPGGRHHLRRQVHPPSDRPDQRLRRPSGDVEDRPLADQEEDEGNRRPAGWRDERPRVLQGALVRLRRWHLQRRPPAGNPQPGSA

SEQ ID NO: 24001 - protein, 463 aa, Pseudomonas aeruginosa
LVRVEAMQLAPVRTPGVFPEDRFHRGEEVVVVHAVVLMHGNGTTVAALEHAQGNVVGLHVAVLDGKPGAQVLVADQREDLPQAGGTMLGGDRILHLVETHVAHVGVDRIGIVDPLVEAGEMAQAVEQGAAGLREVAEVLVETFDQADELVAAFLRRVQGRGLRLVGLVEGDRQGVVGMGHHQHLPVLVLARILLHVFQQFFGPGDPLPFTQAVGRAVLQAHPGHDAQRPQRDPRGIEHLHVALGVALEHLAARGDQLQTANLGGIGTEADPGAMGGSSDGAGQGLVIDIGHVHQRLADLLERSAHLRHRRTAAELGLEGRAVVAEQAAEVGEREQGAVGRDQRAERMPGAHRADPAGRLADDPDQFVEVFRCLPRQGQAALRAGPVAPGNQARCAEQLRQRGVSHHGGERTERSRPLQELASRQMTWHAGIPYRSCAADMKSIKARNCFSEHCMHMPMGGMPL

SEQ ID NO: 24002 - protein, 259 aa, Pseudomonas aeruginosa
RSGTAPPLRPAPPGRRRKSPGAPAPGPSGNALHPVRPCQSLVKGSDTVLGAIGLYRRQMLLQFSIFGKIFQHLLQGNDAHHRHAEVALDLLDRRQLALAALLAVQRDQHARGPGALGVDDLHHFADRGAGGDHVVDDQHPAAQRRADQRAAFAVVLGFLAVEAPGQVALVLLGEGHRGGGGQGNALVGRAEQDVEVDSAVDHRLGVEASQAGQRQAAVEQAGIEEIGAGAPGLEGELTEAQNPALDGKTNEIALIRLHE

SEQ ID NO: 24003 - protein, 328 aa, Pseudomonas aeruginosa
THGAQHDRLRPRRAGWYPRHPELGAALGQPPLPGAPPAPARRLPRPRGRGARGAAPGPVAWQGGMHPALRRGNRRQEPAGRPGARPPTGRRRRRRSRPDPPAGAARSARRAGLARRTGGRLGRSAGAQRRRPGSLRPGPGATQGRPLARRPGAGEAAQRSARRDAGGSRQPARTGADHAGQPAAEDPRPLRRTQGRTRSAAPGAGTGPAGAEERCRRGAGPPRHPRRRGPPGPQGRRRRRSAPGLPDAGTQPGSQHSRLQGVRPALDPGGGQPQGPDRADARAGPEHRMTRGRLRPISFQPVRSTRNTSCPAPCTSFPLPPAPARPAW

SEQ ID NO: 24004 - protein, 106 aa, Pseudomonas aeruginosa
TIQSARQTSGSLFVTRNTMARVTVEDCLDNVDNRFELVMLATKRARQLATGGKEPKVAWENDKPTVVALREIASGLVDENVVQQEDIVEDEPLFAAFDDEANTEAL

SEQ ID NO: 24005 - protein, 125 aa, Pseudomonas aeruginosa
SAARSTSTASTRRCAASVRRSTRSWTSTPSASSSTRSIPAIACWAPCTACTSRSPDASRTTSRFPRPTATSRCIPPCSACTGCPSRSRSVPARWKRWPTTGSPRTGCTSPTTRRPRAPMPAPGNG

SEQ ID NO: 24006 - protein, 155 aa, Pseudomonas aeruginosa
SGSPACVADPLFPVSSGAPAPTRFQQGVPMTKTVIHTDNAPAAIGTYSQAIKAGNTVYVSGQIPLDPKTMELVEGFEEQTVQVFENLKAVIEASGGYLHDVAKLNIFLTDLSHFAKVNEIMGRYFTQPYPARAAIGVAALPKGAQVEMDAIVVLE

SEQ ID NO: 24007 - protein, 261 aa, Pseudomonas aeruginosa
AGCSRRGPRPRRSAWSSTMRRVIFLAAAATLLAGCAGTADPSGTWINQAAIDAASKDGKLREALLAYGPNLEWKLDSKAGEATFSNGFELGEGTLSKSDDEHWKVAFYGDDNQESLELDGKELIQQASANGPEQRFRRLDPQPAANSPAGSGFERALYGSYLKGSWKIREGQGQGGKVEFQANGLVSGLPGAERYALCLAGDCAAMSGDNDSIWLQQGNRGRELLFSLDDDELQLFEAVNTAGANEMPSYVPGKRVWLLER

SEQ ID NO: 24008 - protein, 506 aa, Pseudomonas aeruginosa
GLSEGGQHQPAAQRQQQDAAQPVQRTYPPLQPAAPARPVQQAHQRHVPAQHRQAHPRQAQGQRPARQAEARQHAEQPRIEDRQLGIQAARQQAVAQPAQIAAAGRDVALRRHFQSPLRKQRLARQPEEVQSAERLQPAQGAVRRVRHAGQQAEHQQHAQEVGQGDAGGHPVGLAPAAQQGGAHQQEEVRPRRQQGGEMGTGDKDERGEHEGPSKREGLQSVQHGGRRIGKNSGLGAAPELPRSDPGETPEGRGEVRLVVEAEVLGEFRQRPFFQQQALGLAHPALQLVGMRRHAVGTPESLDQVARVALQQLRQLVQTERLGSMRFQVIAQACGGSAVAGRRGRRAQAAVTHEDLFEQGQQAAFQPQCVAALEILGQPRQASRHAAVVGRVQFAEAARQLFAAEQAEQARFLDIEHPVDQPLGFGVPGMWLFRVHQRQGAGRQRMAPPAALVAADAVEDRADGEGRMAVAAERLAGEVRMEQLHARQPGTRQQPVGSHQASPSTAA

SEQ ID NO: 24009 - protein, 697 aa, Pseudomonas aeruginosa
RMSSHDPHRTALHRHPRPGTTLRPRRRALPRQPTDPLGRREEARGRAGGADLRAQQERRAPDASGRRHRRPGAEGPRTGPGHPRAGPGRQEPVGRAAEGRRHLHHRSLPVPAPDSPAAPGRAADAAVHRGELHPYPPRQAAYRRTRRDHHRPAVPGSRRPDQAAVRRALLCADAGRPSLDRQGQHRFRAAQRQEPAPARRRPLLPRPGAGSLARPCARATRTSTPRWSPRRWRPSATWLPPDWASRCCRSPRWTATTTRRASSKCARSARRCRSVPLPSPGAPASRVHAPSKCWPTRSACARWPVRKPRNNRKSHDRAVQGPGYRAKGRRRRAGGEARSGRPGNPAGYPVPPAPALPGPYPRHRHRRPAARGRRGGRGRGGRRRRGDGAPPQPAGAPAGRQRHPEPALLPFQPGAEGRSQARHPPALLRRSPAGCLGPGDLPSGIPRAERRRADSGGADPDADLPDYRGPHPAAPAPVEPTGPGHARPQQPARLAAGGTGPRLPTWPARPGDPLPAPAAAGCRHRGTGRRPALGAVAPGLRRTADPPVIPAAPARSRALAGSAALAGGQPLAETLPCQPRLPADRRATPGRRGDRLRPGPGRADAAPGARRRRCRQDRGRRPRRPASHRGRLPGGADGADRDPRRAAFPQLQQVAPAAGHRSRLAGRQAQGQGPRGGTGTHRRRRADGGRHPRAVPG

SEQ ID NO: 24010 - protein, 321 aa, Pseudomonas aeruginosa
SEIQAPCTGDHRRTAPLRRAAAPGPAPEGRGRQALPTPVDHDRHADPADPGDERLCRPRHLDPRRAAARAYPGEYRAGGRQPPYRGDRASPRGLPRRAPGLLGVYPDRRVRGAYLPGRRDHLRRAFLGAGRTACRPDPRAHEAGGQGRGDGGLQGRHVATAGGDHGDRGRRRRAQRQPDDHREPRAPWPGPTAPATRPGWPGQRRQPLRAALPPTAVADRPRAAGHHARNQRRLRHRREGPGIARPRRNARHPPDRPAAIQGRRPDARRRPAAGGPRCRPIPPGALAAACQPAARTVVAPRPAIRSSVIYFALADRRRSQS

SEQ ID NO: 24011 - protein, 256 aa, Pseudomonas aeruginosa
SSSGYTEGKSSSHGLVMTEAALASADAPHAPQVILQLLAKLGIACREVSDSAELPAARRVQAVLLDDAVGTLLVLFPQSQLLDLARLTELTGRKLLAIKPERLERMLGKHELHRLPALPPLTSSPCLYDERLLQEPRLLIESGQPGILLEIASNDFRGLLGKASAARFGEPLENINLNLDRPDDDRAEISQAVQAFTARRIQQRLEQTIEIPPLPQTAQKIIKLRVDPNASVDDITGLVETDPALAAQVVSWAASP

SEQ ID NO: 24012 - protein, 441 aa, Pseudomonas aeruginosa
PLAIHSAGRWRHHQRAGRGLHRHRHGTVGHLAGVAGEGLRQRACASHQRHHIEQVEAVHFGAVAQRVDVGVGGAQRAVDDDPAVDRQPGGEGQFGARTQADGGDHQVAGNHLAIRKMRFQPLAGLLQAGQHRPQVEAHAEAFQACLHGLRRGRVEQARHDLLARRHHVELVAAAGEVVGEFATDQPRTEQQYPVLAGSRLAEARVVFQVVDRVERVLGIALDRHPDRLRAPGQDQVAITHLFLADPDPLMAGIDTGDPGMGQDACVQLLGHGARFGHGQAVGVLVLREAGGEHRLGIGTAVVGGDHQQRRLAVQLAPLAGQVVARQAGSDDYQGRTLAHFRSSVIAGAGRRFCGFRSGDLDHLEIDLADTAIRADPVRRDVFPTGSRRNAFFGQAQGFVVDEAADHALPLAHSHPPRSSNLAQRRWPANGKAAGRSRQDSQ

SEQ ID NO: 24013 - protein, 209 aa, Pseudomonas aeruginosa
TAGADAPPRRRPAAGRTCYPRRLLPPSRSPVMPSNALWLRADQLSSVSPAVLDWLFDEGSLTRRLTALADGAFRVEPLLEGWQTLRDDECQGLDVPTGSSGWVREVYLHGHDRPWVFARSVAARSALEGSGFDLALLGTRSLGELLFSDSAFERGPIEVCRYPAAGLPAEVRAEGLWGRRSRFSRGALGVLVAEVYLPRLWDQAGIADV

SEQ ID NO: 24014 - protein, 122 aa, Pseudomonas aeruginosa
RYKGACRSRPTAGCRPRERPGSSRRWPALPGPLPAAASSSRTARNRRIALRCPCRRYRASCPCHRPARRPSRWPAPPFPGPARRTPAGPAPDPAPGGFCSSRLSPVSSGGAFAARRDGTGTC

SEQ ID NO: 24015 - protein, 263 aa, Pseudomonas aeruginosa
PRRGQSAETTPLCHIPDTISLSNAAQDRSTRGKTMVGKTILIVDDEAPIREMIAVALEMAGYECLEAENTQQAHAVIVDRKPDLILLDWMLPGTSGIELARRLKRDELTVDIPIIMLTAKGEEDNKIQGLEVGADDYITKPFSPRELVARLKAVLRRTGPGDSEAPIEVGGLLLDPISHRVTIDGKPAEMGPTEYRLLQFFMTHQERAYTRGQLLDQVWGGNVYVEERTVDVHIRRLRKALGEVYENLVQTVRGTGYRFSTKS

SEQ ID NO: 24016 - protein, 301 aa, Pseudomonas aeruginosa
PRSRPPSGRSRFPWTVRDGPPLDRMQSVVNQDWRGALIRHLLLVLAASLVLGVVSGHYGWALALGLALYLGWTLWQLLRLHQWLRNHQPDEPPPDSYGLWGEVFDNIYHLQRRNQRARGRLQAVIDRIQESTAALRDAVIMLDSDGNLEWWNLAAENLLGLKTPQDGGQPVSNLIRHPRFKEYFDQEDYREPLEIPSPINERLRLQFHITLYGNREHLMLVRDVTRVHQLEQMRKDFVANVSHELRTPLTVIAGYLETLLDNVEDVNPRWLRALQQMQQQAGRMQNLLNDLLLLAKLEATE

SEQ ID NO: 24017 - protein, 187 aa, Pseudomonas aeruginosa
RRPGPVRRAQPPHQPGRRTRCAAQGQRGGTAQRLLQPGIQRGEVHPRRRRDPHPLVGRRTGRAPVGAGHRYRRRPQAPAAPDRALLQGGLQPRLQHRRHRPRPGHRQARADPPPRAPGNQQRARQGQHLHLPFRPGAGRRGRAQGAEVNLVAVPRRRRRHGQGLQATTQPLILKGLLATAHPHGPFS

SEQ ID NO: 24018 - protein, 829 aa, Pseudomonas aeruginosa
DASMTFAGQKWPRPRTAITASRPMVMITAIDTAPAFIHTQGEPLPNQALTVSCFCFTELYLRRLQRRVFLAQTLTDQLCQGVHHEGERQQYQRREEQHAVVAAADLRLGHLHRDVGRQGAHPLEDIHFHHRGIAGRHQHDHGLADGAAHADHQRREDAWTGGQDHHAGQRLPGRGAQGQGAVGEAARHAEDGVLGDREDIRDHREAHCQPDDQGIALVVGDAQVVAQPEAHVAAEEGGLQVRAQPQGEGADGKHHRDQQRGFPAGRQAQTDTLGQAAPEQAGKKDAQRRQQQQAEHTRQVAFDVGRQEQAGEEAEDHRRQRLHQLDHRLDLAAHRRSHEIGGVDGGRDGQRSCQDHRVEGGLERAEGQRREAQLRFEVGGRGGGLPDVGRLVVALVPDLAPERAPGDFRVRVAQGEAVDLATLLQQQAVGPRRQGDDPGRVGDRLDQQGTVRGAVEDAEVALLVQGDEALAPLFRSDGADRRAIQIEVANVRQARFAVGIASHEPLGDATLGVAHQQRDAAQQLGARGDLGVGVFQQLVATVQLAAVQVEHIGGGTSVDHVQPLLARVEVDGFHRFGDLREFDALLVQRAFAGQHVLFPSHAQQQQLLVDGASQQQAVVAGIDAHMLQRAALRIETDRGLAVGEGDLRGDGLLVVRVGDLVGVLEHQHLSVGQAQGDRRAARLVLGDRADLAARRKRQSDTLQFDTGLGVEEENLALAADAHGHLVLLLDAEQQGHLRLLHPGRSQRFAGLQVGAAEQGEHDVGQVEEDQGDRRQHGQAADQHVPAGQAVLEGTDAALALQGWRIEVNPLGSKGGVHRGVGHVVHGVTP

SEQ ID NO: 24019 - protein, 79 aa, Pseudomonas aeruginosa
RCAGTLGLSAWVFFTPIVVTHVSIRTSDTSSKLLNSPSQAYRTLLYRVTYVTPAASVCGLSPVTSSAQADSTSELLRFL

SEQ ID NO: 24020 - protein, 80 aa, Pseudomonas aeruginosa
SFVSTPFRDRTAAANNLPERFTTPWKRIRKSLIFKHLLFVVAGSGAHYREIETGVNTYLKLLLRNTVTSSKPGQAASDRG

SEQ ID NO: 24021 - protein, 573 aa, Pseudomonas aeruginosa
LGRQLRRPRLYTRSPGKNEKTRPGPRFFVCRRSRLVLALVDDLVGCDPRHHRAQLLADLLDRVSGVVAAVGSHRRVVGRTFGNEHLRVFAVLDALQGVAHGSTGLGVDHLRTGYVLTVFGVVGDGVVHVGDAAFVHQVDDQLQLVQALEVGHFRRVTGFDQGFETGLDQLDATTAENGLLTEQVGFGLVLEGGFDDTGTTAADAAGVGQGDVLGVAGSVLVDGDQVRDATALDELRTHGVTRGLRRDHDHVEVGARDDLVVVDGEAVSEGQGGALLQVRLDLFLVQAALELVRGEDHDHVGCGDGGLHVGNLQTVRFGLGHGGGAATQAHGDVDAGVLQVAGMGVALGAVADDGNFLALDDREVTVFIVENAHGNSPSVRPRGPAFSSDAQSLVATGDASDATADHFQDRRSADGLDEAVQFVAGTRQLHGIDATGDVDDLPTEDIGGALDLGALGARGLDLHQHQLALDMGAFRQIHQLDHFDQLVEVLGDLLDHLIVPHGGQRQTRQGRVLGRRHGQAFDVVVALGEQADHAGQCAWLVFQQQGNDVSHDQVRSVLLSHMSRIAPSRICIG

SEQ ID NO: 24022 - protein, 161 aa, Pseudomonas aeruginosa
LAAVSAFQGLRMRRMILPASLLLALSSFAMAAPIYKWVDAEGVTHFGAQPPQGAQATTVNTQTAPPPDNFPLPPSTPAPTIQQKPADPEQKAIDDKVKQQVAKEEAERKQFCEETRNNLAQLKNNPRVRVDEGKGELRRLGEEERQERIAKAEKAIQENCR

SEQ ID NO: 24023 - protein, 403 aa, Pseudomonas aeruginosa
CGFSHISEARISREPDPDRRPAEPGPLPPPGGALRGHRDAHLLGPVDRSLRLQDQEADGFRLSRFHQPGQAPLLLQRRAAPEPAPHRRSLPGGPTDHRQRRGAADRRRRRGNRIPAEDAPVPAGQPAGGNPGPRRTVQPAYRRTGRADRALPPEHSEGAAGAPAGHRRVLHGAGAAEFRAGSPAAQGQGRPATAGCPRSLGGKQLRTPAAGAPGAQGEGLHPRMPRRHPPGQRRADRRQGSAVRLHRIQRTVPLHRCLRRLRLPRDGPGRSRPEVPRSTLRQPLSGTHRRLPGPGTAELLQGLPRHGPRQGRAVQPRLPDRCRAARRDPAPVPQLRQPGGKLQRHSLALPGGHPWCLRGRQEPGGHASGGGSGRRAPALGCRTQASVRRAAGTRQGPVRRRHL

SEQ ID NO: 24024 - protein, 191 aa, Pseudomonas aeruginosa
RTGRTPGAPRLPGRRTSAPALERGTRRYRRLARRARADAPAGCAATGRAARRRDRRAARRRGGADPPATCPRAPRQPGPGWPVAAPLVPPGLRRWSRRASAARRPGPGDQCPGQRGRPAPGGTAATLSGGVERLSAGAAGDRPGQRPGLDRGAPAGAAEHLPGVPDGGAAGGSAHQPDAGTAVRGGVVPGL

SEQ ID NO: 24025 - protein, 397 aa, Pseudomonas aeruginosa
LPVHPAAFFLRHPSPRRPAEPGVLPVHGRPHRQPGGTPAAPAGGAARYPGGNQPAAGAVAQAHRRHRPPGGAGRRRPAVRRLEGRRGLPARSGQWRVEDRGRRAAATRRPGTGRRGLGLGPRPAGRPRYWHAARRTLVVVAAVGGRGTAGTARRRAAGRPAAEPAAPAPARCPRPAPGPGPGPCAPGRGPGGRAPARRDRATAQRLARLGVPRPAHAADGHARFHRQPAGAGRGDPAGGSSRTAGKHPRRGRATGPLYPEPARHDPSRPRWPEAGARLGGAGRHRRQRAEPPARGAGAVPGAGDRGQRPAVALRACGADRTGADQRAGKCRALLAEPRPVAHRGQPGCRRAAFRGERRGAGDSRGPSGRRSSTCCTPLPVATAVARAPAWAWRSARA

SEQ ID NO: 24026 - protein, 304 aa, Pseudomonas aeruginosa
SAPTAGVSASAKASTVAAPRWSCTCRCIRSRTSGNWRATNEPGALAWRLRSRYSCRFRDAAAGLSPCSPAVPSAMTQLQNSILLIDDEPQIRKFLRISLNAQGYRVLEAGTGEEGLAQAALNRPDLVVLDLGLPDRDGQDILRDLREWSQVPVLVLSVRASEGEKVLALDGGANDYVTKPFGIQEFLARVRVLLRQAAQGESPEASVAVGPLQVDFAYRRVTLEGAEVALTRKEYAVLAALARHLGRVVTQQQLLKDIWGPTHVEDTHYLRVVVGHLRQKLGDDPASPRFLVTEAGVGYRLRDS

SEQ ID NO: 24027 - protein, 342 aa, Pseudomonas aeruginosa
RAAQFCARGMPPARSSPMMPRIRAGPDAPGRCPGVTTKVIMQQLLNEILDEVRPLIGRGKVADYIPALAGVEPNQLGIAVYSRDGELFHAGDALRPFSIQSISKVFSLVQAIQHSGEDIWQRLGHEPSGQPFNSLVQLEFERGKPRNPFINAGALVICDINQSRFAAPAQSMRDFVRRLCGNPEVVSDSVVARSEYQHRSRNAAAAYLMKSFGNFHNDVEAVLLSYFHHCALRMSCVDLARAFCFLADKGFCKHSGEQVLNERQTKQVNAIMATSGLYDEAGNFAYRVGLPGKSGVGGGIIAVVPGRFTVCVWSPELNAAGNSLAGIAALEKLSERIGWSIF

SEQ ID NO: 24028 - protein, 246 aa, Pseudomonas aeruginosa
NRRPSWWRSNSRRRCAMFCGYRLPAPDAPVHSPGWSPCPARFPFPVSSPASPFSPPARTPAPPSRTGVAIPATSSSAACWPSSRTPRPSTSATTTVPSRNSCRNWSNWNSAWRSPSSPSTRKACWATGSAARPRPTSTASIAIRTSSAASGVPTAACSWRRPAVRSGSAATCSAKARSATCSSAAPRSTTSPRWPSVAWPTARRLSPTWLRCCARTPAASSCCSRNGAAATRSSSSAAEAQALSSS

SEQ ID NO: 24029 - protein, 266 aa, Pseudomonas aeruginosa
PCSPGPRPSSSSRPTRAAPARPRRRASISVSRAPGAEPGAAIGPLAAAPALLEWALFRHPREYTDERGDPPDPVQPRRRLRLQDFAQGTGGDPRRQRRAEPRSEALGRQRLARRRGCLRPRRGARGGLHHRFLHADRRRPLRFRPYRRDQRHQRYLRHGRRPADGHRHPRLAGQRAGRGSRPRGDRRRPQGLRGSRHPAGRRTLHRRPRADLRPGRDRRGGEALHETQRHRRGRLQAVPDQAAGHRHPHHCREEGQAARRGRRRGA

SEQ ID NO: 24030 - protein, 511 aa, Pseudomonas aeruginosa
LDVHPEQARRALRPVGGGQGDDRRHRFRPARPPGGNGRRQQAHRTRGVRRGTAPGQCRILPGAGLRAWRHTAQLRQLWRAHRATAGSAEAVALRSADQRRPAGGGGSGRRGGVPRRGGGTRPATGADRRAGRATESRGTGAVMRDNTQHYRELFLDDIPLMDVRAPVEYHKGAFPNTVNRPLMNDIERQKVGTSYKQHGQQAAIALGHELVCGALKAERLAAWKAFAEANPNGYLYCFRGGLRSQIVQQWLKQDAGIDYPRVIGGYKALRNFLFETTRAAVDECDFVLVGGLTGCGKTEVIAALDNSLDLEGHANHRGSSFGRRATPQPAQIDFENRLAIDILKKRHRGVGQFVLEDEGRIVGSCSLPLELYQGMQGYPLVWLEDAFEQRVERILRDYVIDLRSEFERVVCVEEGFAAFSAYLQKSLAGIVKRLGGERYQRLAAILVQALEEQGRDGSVDTHRGWIEGLLKEYYDPMYAFQRQSKEDRVEFRGNQAEVIGYLRQRQALRPS

SEQ ID NO: 24031 - protein, 371 aa, Pseudomonas aeruginosa
VGAADGEALGDPGADVGQAEGDEFVVGVDAVAVTGGEAARGEHGAAEADHRDAGGVAQQAFQFLQAGLRPAQLRQPGRYLAKQFHAVAIQAQQRRGEAGQEDAAERPGQLREAPRQQHHQQEREAAEDQRRPMDVQQVLQQREDAGDEAAGRRLVAEQLAQLPDQQAQADAVEVADQDRSREEAGDEPGAGQAGDDGEQPDHDRDDHRQVHQALRIARRQRGDGGGDHRRGRRVGAYHQLPRAADQGVDQHRQDARIEAYLGREAGDLGVSDGGGDLDCRYRQPGLDIRTEPGAAVVEQAIESGYPAGEWHAADSLQARMPQLSPKDRLQDCRESLFLQCTRSSRRGAIRRFFAPAADLRPSTPTCRSFPR

SEQ ID NO: 24032 - protein, 301 aa, Pseudomonas aeruginosa
FAAISLISGLDGPSSSPLIVLCLAPALARLARPGSVAVGGRRFSEEQQMSKLLSGQVALVTGGAAGIGRATALAFAAAGVKVVVADLDSAGGEGTVEAIRQAGGEALFIRCDVTRDAEVKALVEGCAAAYGRLDYAFNNAGIEIEQGKLADGNEAEFDAIMAVNVKGVWLCMKHQIPLMLAQGGGAIVNTASVAGLGAAPKMSIYAASKHAVIGLTKSAAIEYAKKGIRVNAVCPAVIDTDMFRRAYEADPRKAEFAAAMHPLGRVGRVEEIAAAVLYLCSDHAGFTTGIALPVDGGATAI

SEQ ID NO: 24033 - protein, 827 aa, Pseudomonas aeruginosa
LAIQSQLPEAGGAGNFPAFAEELRHGCKPLRHAACRIGRAGHTGCFPPALDARATAHPRLALPGLDSRRRGADGAQPAGGIRRRRRVQGLRRLAGPAPQPARRLPAAAAQAPGRVALSRPLAGLAGMVVDSPDPAGRGLEPAGGYRRCAAGLELAGAGVLRAACADRRYHPLAGPASAQAGKPLSVAADHGLAGHRRRRDAGFGAVAGAGGTAAAGSHRGHGAGLLARGAGVGAELAGSRSACRASMRQAHGASVGGLRRRFAAAACMRPSQGAIDRQPAGDRFAAGFLEAALEQPRLLATQRLFQPHALGGEAEEAFALVVVGGGAADQVHLQQLAQRDVQRLLGHAEQGQQFLHAEARIAGDEEQHAVVHTSQAAAGEHLVRLGGEGLVREEEGFHHGLLLDGVVFQVRHIDASGRGIVASVKQFDSFFPAYATGDPMAFSERISRLKSSLIREILAAAQRPEVMSFAGGLPAEPMLPKVQWEQMPASMGQYGMSEGEPALREAIAAEARALGVPCEASQVLIVSGSQQTLDLASKLFIDPGTEVLLEAPTYLAALQAFQLFGADCVTVPLGAEGPDLVALRQRLERHKPAFAYLIPTFQNPSGVRYSEERRDAVAALLDEFGVTLIEDEPYRELVFDEGRATPLVSRLRKSSWIYTGTVSKTLLPGLRVGFLIATPDLFPHLLRLKQSADLHTNRVGQWQALQWFGSEAYRQHLAELREFYRVRRDAMQEALLEHFGELAEWNIPEGGLFFWLTLRQPLDTRTLLQPALAADVAFMPGEPFFAEPEQNLGRLRLNFSHVAPERLHEGLRRLAKVVRDAQAAEAA

SEQ ID NO: 24034 - protein, 373 aa, Pseudomonas aeruginosa
LAVGQGQQLLAGDHRNGTVLDAGLGGLVGGFAGGRPTGCGGIGRRMTAGERGVRALSSAQRQGVGLGAGDALGGALDLCGDLVGAVGHHFTADGQRFQLFRVQLEGMPTAGIDQHLHGFAQQHRTFGGLDRFRALDGQANGETGSAGQDDAEQNIEEQAGGEFRDHFRGSRGRQQLGPAHDGAGIDEQKRFVAGDQQGGTEEFLGLSLELFEIRFVDELKEFRRVLVEVREDAEQLDHIIPEIDQRFAHAVQIGVVYLLHPPTVANRREPFPFGGKRAVPLLQKPFVQLGDYVVVGAVERVDLLDAYLWVELDLVQRIGSAAAYARHPICIQYALELRCPAAYPSDFVRRVADGHETGRFESMQQFQLTVDRT

SEQ ID NO: 24035 - protein, 203 aa, Pseudomonas aeruginosa
PATAAVVGLALAIPVELHLHPTVAVAMDFLALRSGHHRALRAEDARLRRRRRGTKERLPGRGLEAVAVTLPEVVRARRDVGDDAFFQHLRLPPLVNHLGEQPEVVPARLGMGGQRQEVAAEQQRLVAAALGQAVVAALPFEGTPGQVLAALAVDEATGIVVVLEVRPGFAAGGAFQRQARFLEVVVAAGDAAGAGFQAYAEAA

SEQ ID NO: 24036 - protein, 405 aa, Pseudomonas aeruginosa
ASCCTVLCKNLLTSSKTPSGLGPSVVSTAFPEVIQQKVAHLPSASEPVLELEPEVRKDRRYHHHPQRHRIADGPVQLGHVLEVHAVDGAHQGRRQEQYGGDGEHLDDAVLLDVDQAKGRVEEEVDLGGHLRQVLVQRAHVALHGLRQHLRRLGKPAVATLAEIAVHPIDAEQAVVELGQQRAAAPEVLDDLLQVGLRLAGLGGGLGEDLPRHAAQLPLYGLQHVGDAVHQAVHHQGEQLGAAAVGVELADATVLELAERTQVGVAHGNQPFLAENEGHFLCARPVLGDPADHRSGHVEDVAVLVEARRILDLGHLLAGRDVHLQVGFEQALLFGGRVMQVDPQGARRQPPLGIVVLASLQAVAGKDVIGDHVGYRYLRGHPLAKQGGQLPAAAQAVLCARTRNAR

SEQ ID NO: 24037 - protein, 138 aa, Pseudomonas aeruginosa
PSAMNTATASIAATTWCASRYARTTTVSSCSSAAASTTPWPTAIRLASCSANIPNWKASSSRWPRSTARSCTCRSRAATRRPSICSNASTSACSASSPAASIRRSSTAGARPPTLRPSPTTLTGAQHRKEPTWPSLPS

SEQ ID NO: 24038 - protein, 965 aa, Pseudomonas aeruginosa
PEPGTAPGLACARTPMNRHPALSLDLDDGIDRKVLGQLRQRFLAVNAGRLQRARQALSSRQERVLRLLPLLFHINHPLLPGYLSASTPAGLSGFEADDEVLAEAQRLARSFVYKPRRQEPAQQPIHGLFLMGSLGSLAQEEQSDLDLWVCHAPELEPGARQELRRKCALIEDWARSQGSEVHCFLIDVARFGQDERKDWKESGGDGNTQHFLLLDEFYRSAIWLGGRTPLWWLVPQAHERRYDEYCRTLLGKRFIRAEEVLDLGHLAHIPAREFIGAGLWQLSKAIDSPYKSLLKLLLTEAYASEHPRVRCVALRFKEQVFAGQLDLDELDPYVLVYRHLERYLREQQAPERLELVRRCLYLKVGRKLGGRQRQAQKGWQHLSMERLVAEWQWEPRRLALLDSRSQWKMRQVMEERRTVVNELTYSYRLLFQIARQQGADSGIDSRDLGLLGRRLYAAFERKAGKVENINPGIAPDLGEDVLTLVQLPADDDREQAQWAIFPGALGAHQWPDYAPLKRSLRLVELLAWCHRNGVIDSATRLSLHPGQSDLGDAELDNLLGSLRQFLPVPLATVDDADLLQPRRLKSVLLLVNVGVDPLRHHSQMNLHMATGRTDVLGYAGVRDNLVLTLDQLSLNSWNELTVRHYAGPQALPECLAEFLDAVREKPGSPPQPPELMVRCFCRNRAAAIAVRVEELFRETYGQLLGGQPSRYLLQIRQQYHLLEMSPEAVSHESLPDLPSLLQHLGRERDGYSALKLDRHALEGEDLGLILSMGRPDCIQVFYRRDFDSAEISLLDERNALWRQRQALRDERSLLAPLQRFLQSLLYRRNALSLAEQVPAALDIRYYELLSNDGRVHVEPREAPEALAGPALYELQALLERGERKRVQVTLYCDHQEFSELEYGAGLFKAVARHILAHRAESEPYPCYLTDLDLSRLFADEQPQTLHYLRYKSVLETALNQALLEQ

SEQ ID NO: 24039 - protein, 321 aa, Pseudomonas aeruginosa
ARTTTPAAAPRRCWWMASRPTRSVAARPSKSSTPAKACCRSEAQTMLLRFTKMHGLGNDFMVLDLVSQHAHVQPKHVKLWGDRNTGIGFDQLLIVEAPSSPDVDFRYRIFNADGSEVEQCGNGARCFARFVQDKRLTVKKSIRVETKGGIIELNIRPDGQVTVDMGPPRLAPAEIPFQAEREALSYEIEVNGQRVELAAVSMGNPHGVLRVENVDSAPVHSLGPQLEVHPRFPKKANIGFLQVLDPHHARLRVWERGVGETQACGTGACAAAVAGIRQGWLQSPVQIDLPGGRLHIEWAGPGQPVMMTGPAVRVYEGQVRL

SEQ ID NO: 24040 - protein, 243 aa, Pseudomonas aeruginosa
GPSPARTETLMTEKSQEPTAALDAEQVAAYLSQHPEFFVEHDELIPELRIPHQPGDAVSLVERQVRLLRERNIEMRHRLSQLMDVARENDRLFDKTRRLVLDLLDATSLEDVVSTVEDSLRHEFQVPYVSLILFSDSSVSVGRSVSSAEAHQAIGGLLSGGKTVCGVLRPHELAFLFGESDRDEIGSAAVVSLSFQGLHGVLAIGSPDPQHYKSSLGTLFLGYVAEVLARVLPRFSSPLRSVR

SEQ ID NO: 24041 - protein, 417 aa, Pseudomonas aeruginosa
LHRPPRPGPAGAVLFLRAAPLGTGRPRSRMAGPQGRPGASARQGQQGPRAAGRQGRAPGARSLAAAARPGRSGRRCGVHRSRRQAPDAAGDPAAGAPGRRPRAGPAPAPAHAAALLRQPSAGVVRRPARRAGTARPRRHRHDPDLYPPGLPAPGLGLRPRPSPRQAQGQRRWRQRPMSSLRLITFDLDDTLWDVAPVMNNAEGPAPRMAGEQRGAPGSGTHRALVGDPHPPAGSRADAAPPSQRAAPAHPVPCPARRRLSTGGGGKPGRGRFPGIPRSAPPGHPVSRGPPDPGDPRRPLHPRRAHQRQRRRAPPGPGRLLPVRPLRRGTGRRQARPDAIPRSPEARRRRGLGSGTHRRPPQRRHRRSAPRRHACHLVQPKRQALGRGGRAERGDPQPRRAAGPARPPAMTDRAPGRG

SEQ ID NO: 24042 - protein, 302 aa, Pseudomonas aeruginosa
AVDRAPGQQGIARRQDHQPQAGRRGRRHPPRQRLEQQAAADHGEGREARPARQPVGRQQRRQDRDDQTHSGPCQQDREAVRQAAGGKERQPQHRRIAPARRLVRQARHRRQGHAGQSQLDPEAAGHQALPEQQEQTGQCRAEAEAERGAGGHPVGRGARIPARDQFAHVGRPGGRCQGRADAEQQARHAERLQARPERHHQGGHHRQQQRDDDRRLAPDPIGQPAEYQQHRQYAEHIAGESAGGSCRAVAGKLRVGGVQRRLEVHRQGDQAQAEGQACGVATGIAHAFLRSRACRGRAVGIG

SEQ ID NO: 24043 - protein, 495 aa, Pseudomonas aeruginosa
PARRGVDYPARRRYGTSNSCSDLCLTVRLKKPNSESDMHLRIDRNASEPLVQQIVAGVSGWIRGNRVRAGTRIPSIRQLARENQLSQSSVIEAYDRLVALGMLESRHGSGFFVAEAPAATTDLDSEWHEGAENAWGQFSGSSTKLKLGCGWIPDSWREVEELSYAIRQVARSELAGLFDYSTPLGLPALRQHIQKRLRLIDIHVDPEQILTTTGASHALDLLVRTLLKPGDVVVVENPGYYNLFNLLKFHGVKMLGVPRTRHGPDTAALETILRAHKPKFLFTNSMYHNPTGTSLSPSVAHRVLQLAEQHDFHIVEDDIYADFQNGPSTRLATLDSLRRVIYLASFSKTLSCSLRVGYLIAGPELIRRLADVKMYTSIGSQRFAECVVSTMLANGSYRKLVQRLRQRLTRQMAATLRVLGDNGWEVFAEPVGGMFVWAHIGDYPFAELQAMATRLDVLLSPGSGFSPEGEESDWLRINIAYASDPRALAFFEAFG

SEQ ID NO: 24044 - protein, 516 aa, Pseudomonas aeruginosa
RRPPTDPPPCERREIKERSMSLAIVHSRAQVGVEAPCVSVEAHLANGLPSLTLVGLPETAVRESKDRVRSALLNAGFDFPARRITLNLAPADLPKDGGRFDLAIALGILAASGQLPGTALDGLECLGELALSGAIRPVRGVLPAALAARDARRVLVVPKENAEEASLASGLTVFAVDHLLEIAGHLSGQAPLPPYQARGLLRAPFPYPDLAEVQGQAAAKRALLVAAAGAHNLLLSGPPGTGKTLLASRLPGLLPALDEDEALEVAAIHSVASHVPLRHWPQRPFRQPHHSASAPALVGGGSRPQPGEITLAHQGVLFLDELPEFERKVLEVLREPLESGEIVIARANGRVRFPARFQLVAAMNPCPCGYLGDPSGRCRCTPEQVQRYRGKLSGPLLDRIDLHVSVLRESTSLQPGHGETATAEVSERVGAARQRQLARQGCANAHLDLQAMHRNCALAEADRRWLEAAGERLELSLRALHRILKVARTLADLERIDAIERRHLAEALQYRAMTST

SEQ ID NO: 24045 - protein, 707 aa, Pseudomonas aeruginosa
LSRCVRLFRLPPSAGNPITRRASLHGDTHYPPEHPESSGLLYLRRPDPGPGAVHRAPPGRSAIAVQPRPAMDHHQRQLVLCTGRGADPDQRGVPRRQPLRRHQARPRPQSSRLPQHHLVRHAVLRRHGHRPDVLRRCRTGDALHHPAGGRAEHRAGGEGSDEADLLPLGPACLGDLRHRRADPGLLQLSPRPAADPALGAVSADRRTYLRPHRPRGGYLRDHRHRVRRGDFARLRRAADQQRPAPPVRLAGEPDRADRPDRRHLRPRHALGGQRTGPRHPHPVRTEPEPGGDPAALRAGPRADRVSPADLRAEHRGLPVRHRQQDLQPVRLRAHRLDRRLDPAVLGLVAVLVALRRPVHRPYLARPHHPRVRLRRAVRPGRLHPAVDDGVRRYRHPHGPAGGLHPVGRSGQPGQFGGAVRLPRALPAGQRDLAGGGADGGGVLRHLGRLRRAGGGHASLQRQGPLAALAADILVGADGRGGHRPAPRRWPQGAANRDHRQRAAILHRAPGVDLGPVQGAAPGCHQARHPLPGADLLPPHHAQRRKRGRRLAAPPAQHRHVPKAQPRQPLHHRCGATGLRGRRRRTAQAGLRSPGAGRRGRPGSAGSQPRRRGRFHLRGASARLHHAELRDARHRGQQRVAQVFPRRGPSPGRRPGLRHHGLEPRRRDRRHPRPVRAAHALPARGALRDAGAGQCRPLAVSPTGSAPE

SEQ ID NO: 24046 - protein, 235 aa, Pseudomonas aeruginosa
TACRCCWPCISACSRPMPSTRCCADWDGRSGRWSRRYCAWGCPSVAPTRWSRGCSRSPPCAWASSAITPWPRTRSPSRRYTWRSWCRWGCRTPPPTASASISAPAACSKHAAPGVSASASARCACCSSPGSSGGCRRPSSACSSTATPRPTGRWPRWPSRCWRSPPGSSCSTAPRTSPWARSAVSRTPAPPSWSAWPATGWSACRWPACWRSRPAGAPRASGGGWPAAWPARPLA

SEQ ID NO: 24047 - protein, 558 aa, Pseudomonas aeruginosa
PWPSSGRPRGCCRKPRPARRRRSIAERLAAVRRALAYAQETRQFRQRQRRTDPVALHLVATEIAQLLLLAQGLHAFGNHFQVEVVRQVDHRPHQLEVFRPLVHAADEAAVDLQQGDRQAIEVDEGRETGAEVVQRKAHAQLAERLHGLQHLVAAPHHGGLGQFELEPARVDAVLFDQPLQGRQQLAVLELAERQVHRHVQRLQAAPVEPLHVAQGAGDDPVAERHDQPALLGQRDELAGREQAPLAVAPAHQRLQADDAPAVQAQSRLVVQLQLVATQRPAQFGFEVGEAAHATVDAFVEDMEGATLAALGLLHGDVRMPHQRVGTFVGTGMGESQAATQQQALAIDPVGLAEAFDDAFGDPLGALRIATGVQQQGELVAAQARQAVAVLHEAAQAVDHLQDQAVAALVAEGIVDVTEVVQVEVAEHQATPVEFAEARREQGLEALAVGDAGQRILLGEQLQGRLQTQALARVAQAAAQAVLGKLFGGQPVDHPNRRLRRLLLQQQDHRPGTGSPQRQAGRRGQEQPPGLGGEQGGRTLPGGDDAQRKGRPQRSQAFT

SEQ ID NO: 24048 - protein, 701 aa, Pseudomonas aeruginosa
NTPPLQPSLPACSYVPTQSPAARSRELRRRSPAGPGWRRLRQDQRDHPQDRLSRPAVRYPRPVHRRRDLHQQGRAGDEGARRHPAARRRGQGPDRLDLPQPRPEHHPQGTRTARLQARFLDLRRVGHQGAADRHHAEGVFRGRRRRRDQELHRRLEERPDPSGGGAGKGPQPQGADRRDRLPALPAHPARLQRGGLRRPDPATGEAVPGTSGRPPEVAEQGALHAGGRVPGHQRQPVPAGQAAGEGPRPVHRGRRRRSVDLRLARRASGKPDAAEGRLPFAEGGDAGAELPLHQPHPQVRERPHRQQPARIREAVVERDGPRRSDPGDPLPQRGRRGRAHRHGNPHPAPAHRAAVQRVRHPLPWQPPGQADGAEAPAPPDSLSALWRHQLLRAPGSEGPDVLLPPAGEPRRRQRLPQGDQRAAPGNRFGDPGEARQLRHPAQDLDVRRLRRDGPGRAPRQPFPRTPATLQALDGRYPPTVRGERADRRAAQHGDGHRLRELAAAERLQRQGRRIPHEQRLVPHRGTEEHPRARRGRRHDHRAGHRQAGPARHAGAPAGRRGRRRRRADDDPARVEGAGVPLRVHHGHGGRDPAPPFQHRGRHGGRGAPPGLRRHHPRAAEPGDDLRRQAQAIRRDHRLLAEPLPRRTAPRRPRMGRHGRRPARGQGGQGQRRPRRHPRHAQALSPPRLDCLDFHKSVLPDA

SEQ ID NO: 24049 - protein, 564 aa, Pseudomonas aeruginosa
NRWPAVRSSSSTERHSAPLFLAGSQAGQQQALVEFLAKPLRIVQVHAPQMRRVGFWLRRIQGRLAQFEDLAQLQLALEPTQRPQQVLLDLVEIAAQGKLRQRRCVGLVQGLQALRGIVAIAFGQDEILRQLAGRLGLLGQRLLEARVGDGQQRGDHFRVILAAQVGDPVLGHHHVTQVPGNGGVGVLPDDVRTDLPAGFAPATQHQDRTCALQLVSLGDEVVLPADATEHPAVLQLVGDPGAEQGHGEGAVDEARVAPLQTLQLFLAVQVVDEADAGHADPGALFQRHLAQAPVERQRTEEKAAVQPHPALHRRLTALGGTLPRFVGVDPAAQHAGLGQRQQTRHEHLAATVKPPAERLQATVALDRLGPARTHTQLVDQRPVGGVVALAQQQGGGQRVAHRADADLQGAAVAHQRAGVETDTVILQVDRHVRRGEQPAAFRRRVDQQVEYRLLDLGVARQVGQVIVDHADGDDGLASGATLLQHRQEVQGDIRVAGQAQLARPLGMPRHQLGHRVDALGIDVAGDVAVVATDVVLLRRRAVQQAAGLQVELLDADVRRQFVAA

SEQ ID NO: 24050 - protein, 147 aa, Pseudomonas aeruginosa
RPRRRRAVPRCAGNPVRRRGRSDSSSRSSPPCRWPAGARGRRGSPRGRSRRGACPNPSSARRSAGGPGWRVRSPPIARRNAPRTRSRGRRSAPARTPRRSPPAAGSAGGYRPRAAPGPPRCRPRRSHRPRPPALRHSAPRRGRMRPP

SEQ ID NO: 24051 - protein, 804 aa, Pseudomonas aeruginosa
SARWEPPAARWACRPSSGCPAAGQRIERRGASGVLLYGSWRRSLAFLHALLHTLANGFTDPVAQLQAGQQCRDILLQIDVEVDRAPLLQVRVAALQAQAEQQLAVLMIIDAALQDVVMEIVEGIGDQLHPRVAAPQRLDLRRAEAQVAGLAGLDLAAGDAGLPAVQHQRQLAVQGAFAGQALRRIDPENLAELYALDTQGELLLGLTQADAPRGDRGLPAEQAALQRLPAQTAAARRGKRGLIAPAETHRPQRQAGIGLGQAQAGAVQAQLTATQAQGQAAAQPLQLAAVVDTVEAFQGQVQVEGRGARRIELPAGRGGRSPIAQFEQPRPVGEGRGQRIAGTEEHLGQPGGERQGRLRVALQLDVRRQPRAVAQPSLQAGALEGGVERPLEGPGQRFEVGLAELSDLRLQRPGEMQRQRLVGQFESGPGEVEAGLAKVQRRRLGQGRRLQPRAPAEGEVGALPVQPALQGNLRDQSLGFPAQVLQARRVHLQATLHQPGGPRRDAQQVEPRLQLQRTRALAGERQAQRGDAIGIALQRLAAQAQRARPQLGRQRLQPLAVQLAQAQVAAQLAWQPGALVSIQLDLQFALYITQTGQRPGLRSLHQQRRRATAVEHPARLQPVAARRQADRPVRLQMQGLRCVGQALGFRQPAIEPDHQATGVRQAGRLQAPLPEAVAIGRRELAVQRQQRLPVELRARPQAPTSRLLEELGVELGLLRLLLQAQLRSQRKQRSRRAADVQSAVLLAAAGGTRQVEMEAFEVDLFRQPGEGLAQGRPVQRSGVVVGTRGSRLPGERHLLHAQAG

SEQ ID NO: 24052 - protein, 302 aa, Pseudomonas aeruginosa
TRTPTRQPGPAQQRVFHVQSQAGAIRAAPLQRQPSQPDAFGGQAQALPLQALDTLLAQQAAPGMPAVAERQQQQHCKYQQQRRPSAQTHVPPLSVADPAKGGGALVQDQGVFPGQCFSLLSTLYWRKISGFSEPDGEPPSMRTQHQSKRELDKIDRNILRILQEEGRISFTELGERVGLSTTPCTERVRRLEREGLIMGYHARLNPQHLKASLLVFVEISLDYKSGDTFEEFRRAVLKLPHVLECHLVSGHFDYLVKARISEMASYRKLLGDILLKLPHVRESKSYIVMEEVKESLDLPVPD

SEQ ID NO: 24053 - protein, 484 aa, Pseudomonas aeruginosa
TGNTVFSVHDPRNTSQFFPFSPLASASTDVYAPSNFPHIIIRISHMNARVHQPVHTAQHAPSYYAATLNRRIECPPLAGEEQADVCVVGGGFSGVNTALELAQRGFSVVLLEAHRIGWGASGRNGGQLIRGVGHDVEQFFPVIGADGVKALKLMGLEAVEIVRRRVEQYAIDCDLRWGYCDLANKPGDYQGFREDMEELQALGYRHEMRLVPAAEMRSVVGSDRYVGGLVDMGSGHLHPLNLVLGEAAAAQSLGVRLFERSPVTRIDYGAEVQVHTATGKVRAKTLVLGCNAYMNDLNPLLGGKVLPAGSYVIATEPLDEQLARQLLPQNMAVCDQRVALDYYRLSADNRLLFGGACHYSGRDPSDIAAYMRPKMLEVFPQLANVRIDYQWGGMIGIGANRLPQIGRLPGQPNVYFAQAYSGHGVNATHLAGQLLAEAIGGQQSDGFDLFAKVPHITFPGGKLLRSPLLALGMAWYRLKEKLGS

SEQ ID NO: 24054 - protein, 602 aa, Pseudomonas aeruginosa
LRNRRRNSFPNALRFSRWHPESLAGASGYIRRTKHSGRASRRKPGRGCGSREPARKGRPRRSELDPGRLQLGVLVEGVQRLVATVARLLEAAERSGHVAAVVLVDPDAAGAQGLGSQVRLGQVAGPDRRRQPIGRVVGDAHGFLGILELDHREHRAEDFLAGDLHRIGHAVEDGRLDVGAAGFFQGPLAAGDQLGAVFVTGLDVGQHGVHLLGVHQRADVGFRIQRVARLPALEGLNHQGQELVLDGALHQQARTGGADFALVEGDGAGSGFGGGLQVRGVGEDDVRALAAGLQPDALHVRLAGIDHQLLGDLGRTGEHQGVDIHVQCQRLAYRVAIARQHVEHAFRNAGLDGQLGDADGGQRRLLGGLEDHRVAGGQGRTEFPAGHQQREVPRHDGGDHADRLAGHQAQLGMGSGGDFVIDLVDRLGAPAQAVGGAGDVDVQRVADRLAHVQGFQQCQLLGVLQQQIGEADHRLLALGRRQARPGAGIEGIAGDLDRLLGIGQVATGDLGQEAAIHRAQAIEGLAGGGVAVFAVDEGTAFDLQVFGAGFPVGAGQGGHDNVSSYWCSGRLGDRRAVRFCKAGARPVVSATLNQSSACFQYI

SEQ ID NO: 24055 - protein, 582 aa, Pseudomonas aeruginosa
RAAVEQPRQLLDALHRQPPVQGAAAPAGKRRRHPLYRPGRAPHPRRHRRPLVLQCRPRPARDQRSGGPADRHPRLRPAVPDGSPAAVRTRRAAGGNRPAGPEQSILHQLRLGIGGHRAEDRPCLPARHRPGHPHPPDRPRTGLPRGRLRRPVGRRYGQQPQGLLRQPAAGGRPPAAHPGRRPQRLHRRPARAWRGKGRGAGTPGDPARRREYRRGDRRADVRLGRRGAAAQGLPSAAARDNPQAWHPADLRRSDHRFRPRRRSLRRAALGRRPGPADLRQGADQRQHPDGRRIRRREDPCCLHARPAGRHRVLPRLYLFRPSGSLRRRPGDPGHLPSRRPVPAGRRTGRLLAGRAVQPARPAQRGRHPRRRPGRRRATGAARGRPRQARLRRLRALLLGARPDGPGDRRHHRHVAAADHRQAPHRPDRRAPGPGHPRQRLIQAGGWRRPAPNWPEPQEPRVSMNIEQIVDFAQANSAPEHYSPAPEKILKGDPKQSVRNHYGSPCGQFNAGIWEGAVGQWTVNYTEHEYCEIIQGVSVLRDRHGNAKTVRAGDRFVIPAGFQGTWEVLEACRKVYVIFEAKA

SEQ ID NO: 24056 - protein, 555 aa, Pseudomonas aeruginosa
GSDSRSPTALHDCAQPLRMGMLTVRMEPVMRLAALSLFLAPLLLAQPAAAAALSVCTEASPEGFDVVQYNSMTTTNASADVLMNRLVEFDAGKGTVVPSLAERWSVSDDGLSYRFDLRQGVHFHSTAYFKPSRTLDADDVVFSFQRMLDPANPWHKVAQNGFPHAQSMQLPELIKRVEKSGDHQVLFVLDHPDATFLPMLSMGFASIYSAEYADQLMKAGTPEKLNAEPIGSGPFVFKRFQKDAVVRYAANPEYFAGKPAVDALIFAITPDANVRLQKLRRGECQIALSPKPLDVESARKDASLKVEQTPAFMTAFVALNTQHPPLDDPKVRQAINLAFDRTSYLQAVFEGSASAATGIYPPNTWSYARDIPAYPHAPEQARKLLAGKQLPELNIWTRPSGSLLNPNPSLGAQLLQADLAEAGIKANIRVIEWGELIRRAKNGEHDLLFMGWAGDNGDPDNFLTPQFSCASVKSGLNFARYCDPGLDKLIADGKAASSQEQRTGLYHQAQKLIHEQALWLPLAHPTAFALTRQEVQGYQVNPFGRQDFSRVAVKR

SEQ ID NO: 24057 - protein, 405 aa, Pseudomonas aeruginosa
GKPMQRLYRKRIVLGVGGGIAAYKSAELVRRLRDQGAEVRVVMTQGGREFITPLTLQALSGHPVHTDLLDPAAEAAMGHIELARWADLVLIAPATADLMARLVQGVANDLLTTLVLATDAQIALAPAMNQAMWRDTATQANAELLRQRGFHLFGPAAGSQACGDVGLGRMLEAEELAQRAADCFQRQALTGVHVLITAGPTQENIDPVRYITNHSSGKMGFALAEAAVEAGARVTLVTGPVHLPTPDRVQRVDVVSARDMLAACEAEMPCDLLIASAAVADYRPEVVAAHKLKKDPTSGEGLLLQLVRNPDILATLAQREDRPFSVGFAAETENLLDYAARKLKDKNLDLIVANDVANPSIGFNSDENAITVIDRDLHPSTFAQTSKGKIARQLIAFIADRLNQQ

SEQ ID NO: 24058 - protein, 1032 aa, Pseudomonas aeruginosa
  UNSURE (373): Identity of amino acid at the above locations are unknown.
VTDALSPSQDPRPPPGLRLPAPAVRHAGLGRPGPARHAQGRQRPRPGPDPADSHRPVHLHRRSRPRRPGPAALRPGAQARHRAGQPGRPDRLGLPGRADGVVLEPRRVAVHHRRRRAHRAVGTGAGGAGAFRAGRSVRRKPARRRRLRPFRQPLTPNTGRDAEETRHEAFPAHRPRMGTSWATCSNRKRSRAKAASERADGKDLLPGICASLLGVAAAGALLWFGVFGGAGEAQQRQLDAAWAEGQAGALRQALQQLAADTRAAAASPLALEALQSGDATRIEAAQRILLAWDGVVDAHLNAPGQAAQDNDSPGPVSFAALDILHRVESGQNVAAEAYKVGQRWLLYSAAPVRGADQSLQGTLLLAVDLQRLXRALPPLPGDAGQVQLVQQFSGAPAQVLLQRGTPAPGKGAQALDSGNPNWKLNYTPGSVASTQASPLLLALAALLALLGGILGTYLTRSSLLRRLHQDVLTLGQYLQELGGQRTAKPPVPSLPGFAPLIQALARQPRRKPEPTSVPSPAKAAPVAVAKAPPREEPALADPLFQNTDILDIDILDEDQDLLGLEQTPIMSTAKAPTLPASIFRAYDIRGVVGDTLTAETAYWIGRAIGSESLARGEPCVAVGRDGRLSGPELVKQLIQGLVDCGCQVSDVGMVPTPVLYYAANVLEGKSGVMLTGSHNPPDYNGFKIVVAGETLANEQIQALRERIEKNDLASGVGSVEQVDILPRYFKQIRDDIAMAKPMKVVVDCGNGVAGVIAPQLIEALGCSVIPLYCEVDGNFPNHHPDPGKPENLKDLIAKVKAENADLGLAFDGDGDRVGVVTNTGTIIYPDRLLMLFAKDVVSRNPGADIIFDVKCTRRLIALISGYGGRPVMWKTGHSLIKKKMKETGALLAGEMSGHVFFKERWFGFDDGIYSAARLLEILSQDQRDSEHVFSAFPSDISTPEINITVTEDSKFAIIEALQRDAQWGEGNITTLDGVRVDYPKGWGLVRASNTTPVLVLRFEADTEEELERIKTVFRNQLKAVDSSLPVPF

SEQ ID NO: 24059 - protein, 693 aa, Pseudomonas aeruginosa
RRPGCQGPFRGPALHPPLRRQDAGDQVRRQRHGERGAEGRLRPRRGADESGRHQPGGGAWRRPADRRPAQAPVDREPLHRRHARHRRGDHGRGGDGPRRPGEQGHRQPDQPPRRQRHRPDRQGRRADPREEAHRDPPDPGDDQAGDHRHRPRGRSHRGQRRAAEHAGQGRLHSGDRADRRGQQRRVLQHQRRPGGRQGGGSAEGRETDAADQHRRPDGQAGPGADRAVHRTGQRADRRRHHLRRHAAEDPLRPGSGTGRRDQRAHHRWPGAECRAAGNLHRQRRRHPDQQPQASLIARPWRAPARHDGSPLASRGQREGLLQRARTLAAEGRRAHSRPTLESAPETADVTVSHFLGDTFDGHPRVAQQAHRPPSSHLLQQRLEGQPVFGQPAPQGAAAHVQFGGNPFDLAAQAEVAGDGPFHRLDQVEFPVHLGVFLLQQGQRLAQRRQVVVGQAHVQPVAGDRHAVVQAAEAYLGAQQAQVLARVGRSGMDEFDAQRFERRADQGTPIHQQAGEELLDGEHLHLTAGQVAFDLDEEGFALLVDAGGDDPARAVLVAHADVERVAQGPAQRQHMAQQAKGAEHVLVSDPQPQSPLRQGLEGTLDHAHGLAVGDALGRVLQVFDGEAQAPAQPRGIDTMAFDHLGQRLQQEGGYLGEFVARIGGIVVHGRNPEPVSASFLFWRWIATWDERPII

SEQ ID NO: 24060 - protein, 358 aa, Pseudomonas aeruginosa
QSIARCPQIPPSLTVNALPRPVDRAYSYAVPRATPNNNKSPPMNRTHPRRPLRLAACVTLAFSCCTHASEGGVDNIGPGTDGFFTLPLDVDNLPDHMFAFNVYYNHYEARKLNISSFGGKVSDVKISSDAIIPRLDYLSPLRIFGGRLGGYIAQPYIRQRVAAFGLSDERESMGDTTFAPIILWDMGKDLTLAAAVEVTVPTGKYDAERLANTSNNFYTYKPLFSFTWLPTERTELSLKATYSFNMENHDTDYRSGQIFHFDYSASYRVTDNLRLGLNGYYLKQTTDDKQNGETVRVFGFGEEVDDGVRGQVFAIGPAVHLTFLKYASAEIRWAKEFDVENRPEGDMLWAKLTIPFEL

SEQ ID NO: 24061 - protein, 165 aa, Pseudomonas aeruginosa
SRCLQQRRGAGMSSAAQRQNYTFFHSLRVRWAEVDPQGIVFNGNYLTYLDVATTEYYRQLGMSYPADLLRGGGDLFAVKSTLEYRAPAHFDDWLDIGTRVARLGRSSLVFELGIWRDEQLLTVGELVYVYADANERQSQPLPDWLREKIRAFERQSPVESGTHAE

SEQ ID NO: 24062 - protein, 134 aa, Pseudomonas aeruginosa
ASTAGRCFFSSASSARYSSTCSRETMLTTGMPKSRSTSWIADSSPLPRSWRFSAISTPAALAPWASMICITSRIAVPAVITSSMISTRPLSGAPTSVPPSPWSLASLRLKHQGRSRWCCSARATAVVAARGMPL

SEQ ID NO: 24063 - protein, 268 aa, Pseudomonas aeruginosa
RSFSGARQAVPGVCSFGQRGALKFEQLLHALLGQFEHGVQLGGTERRAFGGSLHLDEAAGIGHHYVQVGFRGGILQVVQVEDRHALVDAHGNGGDHLLQRIALERATLLQHRQGVDQRHGGAGDRGGAGAAVGLDHVAVDVQGVLAELAEVQRRSQGAADQALDLQGTTALLAAAGLALVTLAGGARQHAVLGGQPTLALALEEARHPGLRADGADHLGIAELDQHRTFCVLGVMAGDTDRAQLVGGTATGTIHRGYPVLRKRNWPPL

SEQ ID NO: 24064 - protein, 332 aa, Pseudomonas aeruginosa
RPARALNHRRRAGPAGRGLQCPARITAAARDRRRTHSPHDYRGRPMVHSMTAFARVEQAGTHGTLSWELRSVNHRYLEPHLRLPDAFRDLEGAVREALRQGLSRGKVECTLRFAEETAGKSLQVDQERARQLVAAAEGVAALIRQPAPLDPLAVLAWPGVLVADSADPQALNAAALEAFGQALEQLKAGRSREGLELAKLLNDRLDAMLVEVGNLRELVPTMLANQRQKILDRFAELKAELDPQRLEQELVLLAQKSDVAEELDRLATHVGEVRRVLKAGGAAGRRLDFLMQELNREANTLGSKAFDPRSTQAAVNLKVLIEQMREQVQNIE

SEQ ID NO: 24065 - protein, 361 aa, Pseudomonas aeruginosa
PAGASARSLSNPYEAPGTPHVRHPVHRFRSLRRRQDQPGEGPARRRPRGPRVRLPYHPRHASGRGGRGQLPLHQPRGIPRHARAQRVPRACRSLRQPLRHLAALGRENPRRRPRPDPRDRLAGRPAGAPADARGPIDLHPPAEPGSPAPAPDQPRPGQRRGDRAAHARSRQRNEPLRGVRSPGDQRRFRPRPGRPQGDLPRPPVAPGRPAATPRRTARSSARLNRLFHKDWRFFRLFSPPGKRRAHFSLRGTPWPASPLKTAWTTSITVSSWSCSPPSAPVSWLPAARSRKWPGKTTSRPSSPCARSLPAWSMRTSSSRKTSSRTNRCSQRSTTRPTPRPCKPWPRLDVACERRNPPTGRG

SEQ ID NO: 24066 - protein, 448 aa, Pseudomonas aeruginosa
GVQRDHGRLRLPHHRRQGRYLLSRAGRRAQPVQAVPRTLQGLHRDSQGQRLPVAAYHPVRHARGAHRDPDPYPRDGRDGQPRDRRALAVQVQRRDAQGHPCPRPAMGEGRAGTAAARRQLAGIHREREDRPVPGRGLRVHAQGPHHGTAQGFHRGRLRLRGAHRRRQQLHRLPHQPSPGAALRAVAERPDGGNRHRPGRPAEPGLAELRGHRQGAHPYPPCAQAATPLRVDQPRRAPAEQDPYRLRQPPREDSSGTHPGRARRVPHGSLRGPAGRDRPGQPHGLRGRPPPAVQRGRGSAKRRGSAGDPRHRRPGPELRQVLHADSRRPDRRPPVRRQGHGGAPGKLQEHQRSTPQPGKMHPAQLGQGCHRRIQCRTARRTGAPAWPDRPARHQRQRGRRQHREDQHGRARRSHQRGPAGRQRARSRPPGPRHQEAARPQGSDPDHPPA

SEQ ID NO: 24067 - protein, 134 aa, Pseudomonas aeruginosa
AATTTASGCNKATAAANCCSASTTTSCNCSKRSIPPAPTRCPATCPASASGCWSAEASQRAASTSQPPSASSRTPHSRSSAPTRRCNQPRQRGLSSRRTSAMSQHSTARLIHARHRASAQPGRLKRASTPNSPA

SEQ ID NO: 24068 - protein, 136 aa, Pseudomonas aeruginosa
SVRNRPGKAPATPRRSSRHRSARRPRCWRRTAGAWAAGRGPATSPAHGAGRRRRRHGSQPRRADWRRRCTPGSRAARSATARDTPEPADRQPPAGSPAARRPPSDAGHGPASHRPAAPRRGARRHRRSRRSSLFAT

SEQ ID NO: 24069 - protein, 1003 aa, Pseudomonas aeruginosa
AAMTLTELRYIVTLAQEQHFGRAAERCHVSQPTLSVGVKKLEDELGVLIFERSKSAVRLTPVGEGIVAQAQKVLEQAQGIRELAQAGKNQLAAPLKVGAIYTIGPYLFPHLIPQLHRVAPQMPLYIEENFTHILRDKLRTGELDAIIIALPFQEADVLTKPLFDEPFYVLMPADHPWTAKASIDSELLNDKSLLLLGEGHCFRDQVLEAWPDRAQGRREQAHHGGVLVAGDHPPHGCLRTGRLGAAVLRGGQPPLRAGRHRSAPVQRAGAVPYRCHRLARQLPASTRHRSAGRLDPPVLGGPSANPGTTANRMTELSRVPVTALKGVGAALAEKLARVGLETLQDILFHLPLRYQDRTRVTAIGALRPGADAVVEGVVAGADVVMGRRRSLLVRLQDGSGTLSLRFYHFSQAQKDGLKRGTHLRCYGEVRPGASGLEIYHPEYRALNGDEPIPVEQTLTPIYPTTEGLTQQRLRQLSQQALAMLGPSSLPDWLPAELARDYQLGPLDQAIRYLHRPPPDADIEELAEGRHWAQLRLAFEELLTHQLSLQRLREAVRSQAAPRLPAASRLPKRFLANLGFQPTGAQRRVGAEIAYDLAQDEPMLRLVQGDVGAGKTVVAALAALQAIEAGYQVALMAPTEILAEQHFLNFSKWLQPLDIEVAWLAGKLKGKARAAALERIGDGAPMVVGTHALFQDEVKFKRLALAIIDEQHRFGVQQRLALRQKGVDGRLCPHQLIMTATPIPRTLAMSAYADLDTSILDELPPGRTPVNTVLVADSRRIEVIERVRAACREGRQAYWVCTLIEESEELTCQAAETTYEELSSALGELRVGLIHGRMKPADKAVVMEAFKEGMLQLLVATTVIEVGVDVPNASLMIIENPERLGLAQLHQLRGRVGRGSAASHCVLLYHPPLSQIGRERLGIMRETSDGFVIAEKDLELRGPGEMLGTRQTGLLQFKVADLMRDADLLPAVRDAAQSLLAHWPQHVSPLLERWLRHGQQYGQV

SEQ ID NO: 24070 - protein, 308 aa, Pseudomonas aeruginosa
TLTARTTTARKSARPCRPSPPGASSSAWSRPSRFHRCRRRRRRSSSCGSTPTPASTTSPAWWKPIRRSPPRWSVGRPRPNTPRRARSARVEDAIVRVLGFDLVINLALGLALGKSLSLPKDQPQQATPYWQQAIYTAAVIEGLTRAMPRELRPESGLSYLGGLLHNFGYLVLAHVFPPHFSLICRHLEVNPHLGHAYIEQHLLGITREQIGAWLMRVWDMPDDLYCALRFQQDPSYTGPNAVYANLICLTNRLLRNSGIGDGPQQAIPAALYERLGITPEKAGDAVKKVLEAEAALRELAAQFNRLPG

SEQ ID NO: 24071 - protein, 103 aa, Pseudomonas aeruginosa
MLAWEVRSERSTTIPRLTASPAAKASSVRGRRPTAETTRSQGITSPSERCASSPSPAFFRLASTGPRWKRTPRPSRPACTAFAAAGWSRPGMTCSQGATTSSW

SEQ ID NO: 24072 - protein, 142 aa, Pseudomonas aeruginosa
FPGGPEPARRRRWCSATAPAARNLRAAARAVHAGAAAACPAPRPDVAACPASPQAAEASAARQCRPARRTTPGAGPAGAARRAAGVAGSRAAGVRRGGRGRYPAACGTRLRTGRWFRSCGSSGSDRGAGGCARWPRRARGTA

SEQ ID NO: 24073 - protein, 186 aa, Pseudomonas aeruginosa
VPGAGRAVQAVAAGTAHRDGRRGSRWRGRHGRRSTHGCPRPARRSSASAAPRPSPATDDRATASPAPAPAATGARAVAGRSKNGRRCSRRSAQKPSSSASPPRRSRAERTEPSPPSRRRRRASPSWQAALIGNGWPPHSASLRNAVATGRSRLRPAWQRGMGSTLKDTSVTTPRQPKLPASNRDRS

SEQ ID NO: 24074 - protein, 90 aa, Pseudomonas aeruginosa
PATFFITSPPKRRWVPRPLISRVPRTKSRTAPAQGRRGPDRPLASTPPTVARPPKPGASQASICPPRASTACSSSSGVPARAVITSSQGS

SEQ ID NO: 24075 - protein, 250 aa, Pseudomonas aeruginosa
TAPAGRSRRCPGRWTPGSGARLPGSRCPPATGCARSGRTSGNARRRRSPRRCRRWSRRSARTGPVRSTDHEGQRPGRSPGCARQAGPGRNDPADRSRGSAGNAPSPAARRSPAAARRRTGRCRHRAPRPAPSADGRGRAGPEPVRCVPAMPPATACSDTPRVRRTRRDAGLPRRAAVRGRAGGGATRPAGHPCPPAAADRPDARRRGCSWRLSLLWLSAGSASVHSLYRADAGVQQASNWSYQYHQEPWA

SEQ ID NO: 24076 - protein, 322 aa, Pseudomonas aeruginosa
VTTANWSYQCNGSFHAETAGGRPGRRAYRAADRRRRAQGRPGSAVRAAPGGQARLLALGPARGPAGAARARHHRHRAWPWVVRRRPRPQRRRQPADAPVRLPAAHPLRPARSPRPAGGRGGPPGSATRHRGRLRPARPTLRRDARQPRGSPADRSPRARPPRPRVPPGDQRGIAQSGAGAYPAIAQRTAAEHGVRLSEQPLSPAAAETPDRPPARAPLRGPPRAPAGPGATGGARTYPQHPRQPAGDRAGRTAPGPRHPAPERLGLTRHRVADRPPAERATLAAFCRRLVVPSCPAMRSGFAPTNCQASPPPSSTGCSTRGR

SEQ ID NO: 24077 - protein, 201 aa, Pseudomonas aeruginosa
TRAGCAPCSRCSSRPDACRTCSTTCSCWPSWRPPSNPGDNKPVAVDALLASIRNDAQALSAGRNHRISLDAAPAVQLKGSEAELRSAFSNLVFNAVKYTPDEGEIRIRWWADEQGAHLSVQDTGIGVDPKHLPRLTERFYRVDSSRASNTGGTGLGLAIVKHVLIRHRARLEISSVPGKGSTFTCHFAPAQVAEAERKAPK

SEQ ID NO: 24078 - protein, 218 aa, Pseudomonas aeruginosa
VQPLPGLGQPQGRVHRPAAHQGPAAGAVRPGQPAGDLRPRRTGAPAGDRHQAHPTVAPAGAVPQGRRALRRGGRGRSQGGRLPDHGGRAGSAGRRHPGRTPQDRARHPRLPAGQAAGARRHTAVQARAPARHRPRSCRGGHSRRAGLRHPEAGAGGRGSPRHRGPADHREEDARSEDRPGQGGQARLRRAGAATAPATFQGSRTMAKFGRLSTGWAKS

SEQ ID NO: 24079 - protein, 538 aa, Pseudomonas aeruginosa
HQRATESAGGSGIAAPPDAPLAVAAGDVVFGLLLRRVGEQRIGVAELDQLAHVHERRIVGNPRGLLHVVGNDDDGELRLQLVDQLFDLQRGDRVQRRARLVEQQHFRFHRDGPGDHQALLLAAGQAEGGLVQAILHLLPQRSPLQRPLDGLVKYALLVDALDTQAVDHVLVDALGERVGLLEHHADATAQLGDVDALGEDVVAIEANLAFDAAAIHQVVHPVEAAQQGRLAAAGRADEGGHALLRNVHPDVEKGLLGAVEQVQPGHFQFDTFGSQVEALAVAAERIEVDAVAGGLVLHGKLPQSVFQGLVLLAQAIADRDGGEVQQGDHHDQQQRRSVYQRPCGLDVGALETDVVDMETEVHDLLVEMHVRIVTVDRQRRCQFHHADQHQRRHFAGGTGHGEDQAGHHRRAGHRQDDLPQRFRLGRAERQGAFADRARNPRQAFLGGDDHHRHGEDRQGQRGPEQPRGYRRSAPAGPRGRTAGRWNRPARRRRNPGRTRRRRSPVRRRGCSRRCGSPGSAAPAWRTRAGRPQRSRRTG

SEQ ID NO: 24080 - protein, 103 aa, Pseudomonas aeruginosa; identical to SEQ ID NO: 21288

SEQ ID NO: 24081 - protein, 63 aa, Pseudomonas aeruginosa
ILHPSRRTFSRSYGAILPSSFTRVLSSALVFSTRPPVSVWGTVPGYLKLRSFSWKHGINHFVI

SEQ ID NO: 24082 - protein, 81 aa, Pseudomonas aeruginosa
IKQFVWELMKKLRSSIKEVIQPQVPLRLPCYDFTPVMNHSVVTAPLAVRLATSGATHSHGVTGGVYKARERIHRDILIHDY

SEQ ID NO: 24083 - protein, 517 aa, Pseudomonas aeruginosa
GSTKARANSVASARKNARSESPRPKRRSRRIAAEANTAPSRSMGLTRLSALLEAKKNPACSRVFLYCRSFMTARRSAGRTRQAPPAGRRLPRHAAHRPPRLWPGYPRLAARRCRFRESASSVAGRSIAAIARAPAYPRRTARGWPALPGRGCFRSTSRGHATHARSATTGRPAHRPVDPSGADLGLLPGQRSAGGVSLLLPSLGDQFPEPGLQGRPAIGVAQATARDLLGLGRIALGQAHLGQAIEHLRLARSDALGSLEAGGGAVQVAAALLLLGGCEHRQDRPVQLLVGRQAAGRAGGRNAGGRGTTGAAGRHVVAATQRWRGGAAGRSLVLGAGAERSAADRRGAGLRRESLDRCGIGALRHHHHHTGVAALGNALGGGALLGTRYLGTGDAETAAFLVGHRSTGIHHRDRPVLRAGAAREHGTAGKRGEYENLLHVRSSRINSASHVPSPSPRRRGSGSRSLGPGRARCHEYRASVRHSGNPPPSPARSARPPRPSPRSPASAFPAIADAPCA

SEQ ID NO: 24084 - protein, 563 aa, Pseudomonas aeruginosa
ARRQRGAFDRRSGKWLLSASEVCTVTPSRHNAGFRIFQRQGYPVSQTLIAALQNPALYPHPVERFEVIETHISWVLLTGPYAYKIKKPMDFGFLDFTSLDKRRFYCNEELRLNQRLTDDLYLEVLPITGSEEAPRIGGDGEAIEYLLKMRQFPQDNLLAAIQGRGELSNQHIDELAEQIAHFHQNTPKVPLEHPLGTAESCMAPVRQNFEQVRPLLKDKADLQQLDALEAWAESSFERLLPVLQERKAKGFIRECHGDIHLGNAALIDGRVVLFDCIEFNEPFRFTDVCADFAFLAMDLEDRGLKCHARRFVSLYLEHTGDYQALELLNFYKAYRAMVRAKVALFSLGYQTDAVQRAATLRQYRNYANLAESYSAIPSRFLAVTHGVSAVGKSQVAMRLVEALGAVRLRSDVERKRLFGEQPEHDRGQFAAGIYSSQASEATYAHLHQLAAKILQAGYPVVIDAAYLKQSQRQAACHIAEETGVPFLILDCQAPEAVIAGWLAQRQAEGKDPSDATLDVIRTQQATREPLTAAETVQSKRVDTHDAASLDGLVDGIRQRLPGL

SEQ ID NO: 24085 - protein, 206 aa, Pseudomonas aeruginosa
SARRSRRRGTTTAGKSRARRRPGSARRSAAWPSCSARPPAASAAGSAPAPRRRPAPGTVAPAPAPAGCQSPAWSSAAPRPGTAAARSWRSSRRSARWSAPASADQQRDVADQRLGVFHQLPQQPGAQHDQGEQDHHQARQEAQGLFVDLGSGLEHRHHETDQQARNHQHADDHRRQPQRLAEQVECHLRGHVSLQRASGASSRRHR

SEQ ID NO: 24086 - protein, 384 aa, Pseudomonas aeruginosa
SGRASGRAGSAPHRPAPAPAGRADPAAGWQGCGSSGCRADRPVAPGAPARRAGRSGRSPGPGRAPVGPVARRRRKRRPPSARRHPSSPRRRTAARSARRVPAGSRRTGSDACQRSFLMRSLGLITSVRRMPNFSFTTTTSPWAIRVPLTSTSSGSPARRSSSITDPWLSCSRLRMLMSVCPTSMEMVTGMSRITSRLGPSRPEMVGAFGEAPNSSIGARGVLDSATGVAPPWAISASMSSWLASPASASAAAHSSASACSSVVTFSSSAMVRLSSGGSGQRERSTASRICSARLPLWAPSLTLKAGTPLARITMCSGISTGITSPGCMCRMSRSLSWRRTTVAPSGTWTSSTSSRRALIQRSSWSSWSDWKPASSISRIGSIIE

SEQ ID NO: 24087 - protein, 561 aa, Pseudomonas aeruginosa
RQMKGFTGAEQGLCHFCNAAPPPGTSPGGLSEMIDGADITAWPQEIIPVFCEIARSGKRKASRRRPKGEMQSFASGVVVDQTARRRRTRPAADLADSGEGFLIARGLAGQAASARRSALALLLALPAPRQRLVGDVHVELVHALLAEHVAQPVHLAFQGVANAGVGTGEGHLGLVGGHVDAHVQASQLGRVELDLRRLQVLAGHPHHPVHHRLAPAVLLYRHRLAGHRTVHRTVGQGLLRHGLGQPVELGRERLAARLRLALQQALGGGAGDGRLGGLLQLGLERLAVDGLGQGVGSQAGKGIAEVRLARIGALRRPAFRRLRGVLGTLLQGHVHRRNAVELDQGRVAAGFGQAGRSTASRRHGRRQQSRLGILVEHRHGAAEAEQLQRIDRRFDFIFAVGLGLAVGRQRLAVFGNGRLPGGIRRLRLGSLLAGVPRLVPRTLGGTVGALGGLLRGLLGIHVGEAGSLVVTRLRRFLLALRRSGLGLYIRRRRQQHTRGDGHGNSPFAKGLHRGLRKGWSKVRANFAESVRETLARAPQQARSLCPQVPSGLQSRAASLPR

SEQ ID NO: 24088 - protein, 272 aa, Pseudomonas aeruginosa
GAPGDRDFPRAAQGAHHPRAGQRRRPRAALRPRPRRRAGRLRPARLVHRLHGRRVPSRGSLVRAGRGGSQRAAAAYHGRLRPVRRAARVRRDRPRPPPGGRHGRADSRPADQPVPALPGAGRKARPAQAAHALRSAAVAQREIRPSARAWVRYSLQAVGFLSVALGVIGIFLPVLPTTPFLLLAAACFMRSSPRFYHWLVGHPRLGPWIRDYLDGEGIPLKGKVYAIGLMWASIALSCYLVRRPWAQGFMLTSAVLVSIYILRQKTRPPHDA

SEQ ID NO: 24089 - protein, 133 aa, Pseudomonas aeruginosa
KRSNRCLRCSSAIGTPGLLTATRTSSPRRSTPTRSVPPAAVCWAALYSRLVTARWNRARSTSARASPRTSIPTPASSKITSRKSTVVAISPASEVSSRSQARRPWSARARNSMSLTIARSRSSSSRLDCRTSS

SEQ ID NO: 24090 - protein, 324 aa, Pseudomonas aeruginosa
SMVPMRAKITTAAPANIPARRVDKDMPTSARLRQRTVLQDVAHAPDGMQQLVLERTVELGAQALDRHLHDIGVGIEVDVPDQFGDRRLRQDLAAALGQHAEQRVLLGSQLQTGVATEDLAAEQVDGQVGDAHLRMAFMVAAAPGQGLQAGDQFEEGERLDQVVVGALAQPAHPVFHALARGEHDHRGLPPLAQRPQNAVAVDARQHHVEHDHVVLAMERQVATVDAVVRQVHGEPLFAEATVQVVRRLRLVLDNQYPHLSPDPLFAFASRAGRMPACILATRRRPGKPRPLRLMSPSPQRFRRPRSWSRAGGTAAPGPGIPPAC

SEQ ID NO: 24091 - protein, 461 aa, Pseudomonas aeruginosa
SGWSGSPPPATAPHRAGGTPAAPAAARPGSAARWRSGAVCTSRKSRRAASRLPLRRLSQARARLLDIDQGAGHQPRVAVHHHLVTAGQAFHHTEAVDVLEHPHWHRLDPVGGDPVDEIALQAAAHRFARQHQLVAPDPGVQAHRDELPGPEPGLAVIEGGAHADGTGGTVDLVVDGQQPALAQRAPAVAAVGAHRRLAAEQRLQLGQLFLLQGEDYGDRCDLGHAEQAETVADPHQVADIDVADTDLAGYRRGDPGVGQAHPLGVDGGIVGLQGRAQLVDRRLLLVQQLARHRTLGIQAAVALQVLLGGFQLGLVARPGGLSLLQRGDDGAVIDGRQQLARLDHLPFAHQQAGQLAVDLGADHHVVQRSHRADAADLLLDVAPLHPRHVHRDPGRRGRRLRPGVAAEPCPTAEGDQARRQHAHQDPSPTTAQRLHLSTFPSGRPRAADFVLLYKQRSGTPP

SEQ ID NO: 24092 - protein, 247 aa, Pseudomonas aeruginosa
TSLSPSGARSMSPTPGARRPCPRAYAPWLLSLAATLLLAVGAALAQWDLESILSRAEQRYGELGAAKSRLGDWGRLLEQGGTLDEAAKLRAVNDFFNRSLRFTDDIEIWQQEDYWATPVEALVKGAADCEDYAIAKYVTLRRLGVASDKLRITYVKALRLNQAHMVLTWYASPGADPLVLDNLIGEIRPASQRDDLLPVYAFNAEGLWLPGADGGRRTGDSKKLSRWQDLLTKMRAEGLDLDAPKED

SEQ ID NO: 24093 - protein, 650 aa, Pseudomonas aeruginosa
MSLLKQLFLAICLFLVVAFSGSFVSSVENSREQLRGQLRSHAQDAATALGLSLTPHVDDPAMVQLMVSSIFDSGYFASIRVIDIKSGKPLVERVQAHAERTVPGWFERLVDLQPQGGDALIMRGWEQAARVEVVSHPQFALARLWDSALGSLYWLLACGAASLLLGGWLLRRQLRPLDQMVRQAHAISRREFLSLPRLPRTPELRRVVQAMNQMVEKLRTLFAEEAARSDKLRAQAYQDSLTGLPNRRLFDARLNEQLGAGEHEHAGQLLLVRLNDLNGLNQRLGGQRTDELIQAVARLLVDSCGQQGRADWLLARSRGGEFAVLAPGCSREQAERLAEELCEGLENLARTGASDLTPVAYLGISAFAEGDSPADLLARADQALAQAESQPAQPWASQDGTALAALNDSQDWHDWIDQALTERRLLLYFQPVVDCLDTQRVLHHKVLARLLDPQATAIAAGRFLPWIERFGWAARLDLAMLEQSLEHLRRHPRPLALSLSAASVRNAQTFAPLLALLKAHPQEARQLTLELDERHLPAAAELERLSQVLRELGCGLGLQHFGGRFSLIGNLTHLGLAYLKLDGCYLHAVDREGDKRLFIEAVYRTTHSIDLPLIAEQVETLGELEVLREMGLRGAMGRLFGSPAPWSGDA

SEQ ID NO: 24094 - protein, 150 aa, Pseudomonas aeruginosa
SWRSVAAAEWPGCGLRATAYRSGPVRYPRRWRPPLRAPGRWSPGCRNRPCNGGRRAARRWPPRRSPSPPAPTHRSGPTRRHGSSSFRTAAGRPAPGRRRPAAPRRPVPGVRRPAPGAGRRAGPGHAAKACRGWRPARWPPCPPGRNRSAR

SEQ ID NO: 24095 - protein, 910 aa, Pseudomonas aeruginosa
QLRRPVGVEHQGQGRLQAFAAAQRRARLGEPFSRQAELRQARAQPAFAATAIDLQQLLQHASPVVQHAQPLVEIGGAHRHRAGSRQRRPLPGQQPQQGRLAAAVRADQRQPSRTAQEQVDFAQRPAQMRQDRALQLDDPALCRQFGIGRIEQQRRRLLDLPGSLAHLAVETLALRLVGVAHLAGADLATFPEPTEQDLRLVRRLAFAPAAGLAPLLALLLFAHGQGLPLALQTTLVQATFGGLARLLPALRVEGIAAAIAAQAEGRQLDDPLHALQQFAVMADQQQAAVPCRQARPQQSACRPVERVARFVEDEKVGVVEECAEQRYAHAFAAAQAFARGIRAEMAEPLGGQGVGQALADVPALAQAFVVGGVEATRLDPRQRLQPWADAGQIGDGRVVGRFELLRQVAHAPLAPDAAAGRLQVSGEQAREQRLANAVASHQPGVPGVERFVEIGKQKAAVRQLERDAIERQGRRIRHGYPLDAMHSPGPSGQGRKTGRADTAASIAHRTNTSYGRKDRGSLLRPCGPANRAYFSFPTDTTDRHGQTAHLRTLRTGTLALGRPWRPLPLAGNGRATGGRVLAGFRSGPGTPARRDLRAPQRPFAGIRCLDLPRAPRPRRHVQRHGQPGVLARNGNPGTARPLSAAALLAEMVAPIGVLAHRRDLPLDQGIEGFQQGFVGTRRLQFVERRSDCFDGRQRALSRRLAQAITRRHAFGQAHPRQGRQGRVQVQELARLAPGAVRHHQQEGLAGGLGGHLCQRTRLLAGKQQAGPVARYPPGLLGETLANPQLRIAQAEDGQSCGIQRVPDLAGVLQDQHPRTRRQGGNQRAEAMAGGASATLAADTWHGTTPGRGPVCHRRRGLPLTRKNVIFPTNGGNLFHPLRITTNFCRSMKKYNRPTLSTPAHRRRRQG

SEQ ID NO: 24096 - protein, 294 aa, Pseudomonas aeruginosa
NAPLRRHRHHDAPAPCPVPRRTRRPRCRLRRRAPRHRHLPALRYPLRPPRDPRRVGDDPSLQHGHRRRPLRLAERGGHRRRRDQHLQPAGSRAHHRAGIRPHPRSRHPPADPRRRPHHHPADPPRDQEEARQGRPGPRRRPRRRQRPHVRREDRPRHHLPPRGGRRPAGLRPCCADRPARPGLHRRGLQLEPQAGLPRGAGRGVLAQVAGAADGRGPREGRRRPRLPELRHRRHRPGLGARHRHPGNRRPDHHPGDGNHPRLPGPGPDRLRPGRSLAALRHHRQHFVAGRQPAL

SEQ ID NO: 24097 - protein, 156 aa, Pseudomonas aeruginosa
NALRPPGRGASLSRSATMTDDRVEQVLEAARRLVAAFARNDAEAYFAAFSEDASFIFHNWPQPLRSRAAYRKLWERWRREDGFEVLACESSNTCVSLQGDLAIFSHDVATRLRLQGTESLNRERETILFRLEQQEGRWLACHEHLSAMPEYLPSTS

SEQ ID NO: 24098 - protein, 509 aa, Pseudomonas aeruginosa
LSRENVMDNNNNQHAITRIETFGVEQIPDHERNATPVDLFRMIFGGANTFATAVLGSFPVLFGLSFQAGLWAILLGVTLGALILAPMGLFGPLNGTNNAVSSGAHFGVHGRIVGSFLSLLTAIAFFSLSVWSSGDALVGGARRLVGLEESELNLGLAYGLFAVLVLTVCIYGFRFMLLVNRIAVWAASLLFLLGLFAFAGPFDAAYAGSVQLGQPGFWAAFIGATLLAMSNPISFGAFLGDWARYIPRQTSQARIMLAVIGAQLATLVPFLFGLATATIVAVRAPDYIAANNYVGGLLAIAPGWFFLPVCLIAVIGGMSTGTTSLYGTGLDMSSVFPRLLSRVQATVLIGVASIGFIFVGRFAFNLVQSVSTFAVLIVTCTTPWMVIMLIGLLTRRGFYRPDDLQVFTRGQRGGAYWFEHGWNWRGMGAWIPSAAAGLAFVNLPGQFVGPLGELAGGIDLSLPVALGLAALLYLALLRLFPEPPCVYGPRGPRWVRAHGTRRAPAIATA

SEQ ID NO: 24099 - protein, 494 aa, Pseudomonas aeruginosa
  UNSURE (232): Identity of amino acid at the above locations are unknown.
GGGHTRRDASVPRFRRLAGYNNDNEKLGRPDMALDIFVVLIYAAGMIALGWYGMRRAKTRDDYLVAGRNLGPGFYLGTMAATVLGGASTIGTVRLGYVHGISGFWLCGAIGLGIVGLSLFLAKPLLKLKIYTVTQVLERRYNPAARHASALIMLVYALMIGATSTIAIGTVMQVLFGLPFWVSILIGGGVVVLYSTIGGMWSLTLTDIVQFLIMTVGLVFLLMPLSINDAGXWDALVAKLPASYFDFTAIGWDTIVTYFLIYFFGIFIGQDIWQRVFTARSETVAKVAGSAAGIYCVLYGMAGALIGMAAKVLLPDLENVNNAFASVVEHSLPNGIRGLVIAAALAALMSTASAGLLAASTTVTQDLLPRLRRGRGQSDNGDVHENRIATLLLGLVVLGIALVVSDVISALTVAYNLLVGGMLIPLIGAIYWKRATTAGAITSMTLGFLTVLVFMIKDGLDANTPIYYSLAVGLLSFVLVSLFSRRPTGVASAA

SEQ ID NO: 24100 - protein, 157 aa, Pseudomonas aeruginosa
TRHNPDRRGTFPRLFHSREHEKGTAMTTCGEFLVKQLEAWGVETVFGIPGVHTVELYRGLPGSRIRHVTPRHEQGRRLHGGRLRTGHRQARRVLHHHRPGDDQHPHRHGPCLRRLDSDAGDLQRQRTRAPGPRQRLPARAAEPAQPGRQRLPLQAIP

SEQ ID NO: 24101 - protein, 230 aa, Pseudomonas aeruginosa
CATTRRAWPSTATPGWPCACCWPNCRAARPRRTAPGPGAPPPCASAWPKTSPAGRTIASCSPRSSPSGRTPASSATRPRPSTAATTWSISTSRAAGSTPPPATAPSAMACPPPSAPSSVSPGRPVVSLMGDGGLQFTLPELASAVEAKVGIVVLLWNNHGYGEIKRYMERREITPLGVDIYTPDFLAIARGFGCAAERARDLEHLRELMRGAPADRPLIVEVLQAAPFHP

SEQ ID NO: 24102 - protein, 722 aa, Pseudomonas aeruginosa
PGARHGRFRTLPLPLRDPRRPWRARQCRARRAGPRLPSAEPRRKLPGPAGKHRPGRRRGASVPPGGTRPGTPGRTHRPGRRRRRASRRRAALAAQAEPHTSAGCGQPDPRPRRRRHPRTGPGAGRRGRTRPRHRSRRARQRQRRRAGRDQRRRHPRLPLRHHAPARARPGSGTRRRQRLQRPARAAEEHHRLRPQAVVRRRRRHPRHRHPCGTAPGAVAASRRHRPARPARRRRGDHHRRAPAPRARRTPVRLRDPLARLPAMHRRTHGRQRAEPGALPSLPAGGTGRGPPPGCRRGAHRPAGRLLRGRAGGRRPARRQRNPAPGHLAPARRLRRGHPRRRRQPVLRRIAPGAGPGRLRRAHPAAPGRPGEGHAGLPLRPFPRRQPARHARRRRPAAAAAPGGGGNPLRRVGRMRWRDLRRARHRPGEEGSPGTLRRSAEARADGADQGTARPQRAVQPGQGHTLNAYPSGIAFPPTETAMRIVSRDRWFETRHFYNGISLIHEPYVRPFYRCNMWHVQGRERDVLVDSGSGLVSLREQLPWLTERPLLAVASHTHFDHIAGHHEFAERLAHPAEAEILAAPDGDNTLARAYVGDEMFEAHPECPLCYAEYRVRAAPATRLIDEGDVLDLGDRVLQVLHTPGHSPGGISLWEAATQTLFSGDIVYDGPLVEDAYHSNLDDYASSLARLRELPVRTVHGGHFASFSGERLREMIVAWFRNHDR

SEQ ID NO: 24103 - protein, 294 aa, Pseudomonas aeruginosa
PESSQRRFPPLQETDPGLQVGADHALAPDQPGIRPGERFGQRMHRHRLPPRQALQHRHRHQRHPAAGHHAGQHAVVGLDLHHPAHAHPRAGEPGLQQQAIGAARAEGDHRAAGHVLGTAHRRVAILGDQHHALLEHRQALQTVEVQRAVHQHGIQAPAQQRLDQLAAGRGLQLQVHRRIAPVVFRQARRQVDRRGAVHRAEGEVAHRFAPLHRRARLLLQGEQPRGVVQQDLAGRRQLQALAFAEEQVDAKLFLQLPQARRQVRRHPVQAFGGAGDGAFLGDRLENPQLAELHD

SEQ ID NO: 24104 - protein, 648 aa, Pseudomonas aeruginosa
PGACHEQLVEQRQAWRCLGQPGAAHCHRGRAPGHPGEQAESVAEQHPPIHFRPRQASAEGHRYAAEAHRHAQPLQGPQAFAGKQEVQPEGREDRRGIEEHRHVRSRGVLQAEGDEQELQGEQRAGQQAGAQGALAQALPAAAPAHQQADQGGGDAGTDGRLHDRRDVRRRPLDGHLLDAPDHAEQQHGLEGEGIGGLTHGGLTGRHGRKRPPAATVGQRHYGQAGAPGRSLEATSSGPWAAVPACLPGLAWPGLGDAIRPANPPSGRGRSLAGLDLAPGPRAQPLQLRRQHFHRIQPGLHFFRRVDVRVVAQLRRDQAVRRLVRVGVGHVVGDRRHYLRAQQVVEEGVRLLDVLRVARNRQHVEPGRGALLRDAVLDAYAVLRFPGPVGRLHRSAGPGDGHADVTVGQVADELRGTEVGDVRAQLRQVLLGSAVVFRLVAVGRQAEIVQHLGDHLGGRVEEGHAALLQLRQVLRLEHQVPGVQRRIVAEHRADLVEVVGDAVGAPHVGHHVAVAGVLAGEHLEQGRVEVLPVRQLALVQRLEHLGLQVVGQEAVAGHHQVVAGMPGQQLGLEHLVAVVDVVLRRDAGLRLEVLQGVRGDVVEPVVDPYFRRGLNQPGGNGQREAGQQLASRLHASLLSGPRLRSPAAR

SEQ ID NO: 24105 - protein, 816 aa, Pseudomonas aeruginosa
ASQDRKGDSMRRASLHMLLCQFAMALGLLLSLGSEAWAARPAPQAAVDLEAPAALAEDASLDQLNAQLDLIRQRVTADASDDLLAELRQSALQVQRQADALLALRVADIERLDDQLKVIGPPQPDEAESLAAQRQALTRQKNALLDDERQATQLGQSSRDLAAQIVNLRRSLFNSQISSRAATPFSPSFWSTLIRPTDDDLRRLDKLKAEALVAFDSAIAPGHRWAFAGTLLATVLVWSFGRRLLERMLTWAMIRWLPEGRLRRSALALAVGLATILTIVGAVSLMRWGLESNASLSPDMASLTDQLVSLATFCAFIAGLGRALLMLPRPSWRLPAIPDRIASALGPFPAILAVALMLVATEERINSVTGTSLALTVALNGLTALVTALIFAAALLRYHHVRRKHDLERPGGIAGLIPFVASVWIAAILLALFTGYLSLAYFLTGKLLWISVIAATTYLLIAFFGDICETLLSPKHPSGLALANALGLSPRHQAQASTVLAGVGRTLLLLTALLLAFLPVGSSPSELLQGFAQLGESSRTLGNLNIVPQDILVALLLFVGGLFALRIVKRWLSERLLPETNMDAGMRASLVTLVGYLGFVLLAMLVMSTLRINLTSLTWVVSALSVGIGFGLQAIVQNFISGLILLTERPVKVCDWVSLGGVEGDIRRINVRATEIQMGDRSTVIVPNSQFISQTVRNVTMGNALGVVGVNLTLPLDTDAMKVRELLLQAFAEHPAILDAPAPSVTFKDLASNGLVLNASGFVNSPRSVAGARSDLLFTILDRLRSEGIALSSPQSLLMIQDGGPASAAPAPATPD

SEQ ID NO: 24106 - protein, 323 aa, Pseudomonas aeruginosa
NPPLFQRRTAMNREALDTLLQHLLAALSPAPAETRRLFHGRGRCWPGLEQLTADWLQGVLLVTLFKEPQPEELEALRRTLEQLTTAPAWAASQGRHLVLQHRYRPDSACEWLSGEPLETWDIVENGLRFRLDLGRNQNTGLFLDMRLGRRWVQEQAAGRRVLNLFAYTCGFSVAAIAGGASQVVNLDMARGPLNRGRDNHRLNGHDLGRVSFLGHELFKSWGKLRKLGPYDLVIVDPPSFQKGSFVLTQDYRRILRRLPELLVPGGTLLACINDPAIGPDFLLEETAREAPSLHFVERLENPPEFPDVDPAAGLKALLFRNAG

SEQ ID NO: 24107 - protein, 417 aa, Pseudomonas aeruginosa
PEDDLRRDILELVDQQMGERRQRRFRQGPAGHPLAELLERGVEGHQALLAQQRLEPRPEQCHGFDEDLLAQPAFQLAAVQAFDAQAQALGEPGLGMEGFVQRQRLELAGQLERLQRRLRLPPRALFRLRRRRQFQQLVDLGAERRALRVTLLVGLLQQALLGRTQASGGKGVVRLGGGVAVVQLFEPARIAEHLAGQAAERRMESAHALPRLGRVERVLPVREQPQQLFAQLRTGGVGEGNHCQPLRLDAQVAEHEHHPQDQGGRLARAGTGEDPRQRLAAEDHRPLFLGRRADHTERHGLRHLLAHGALLGFVDLQCGSRIDSLRRAPRGGSGLAWGPPNGALRRLAGGLGRSLRGVLPGAGLGRLQQGFASLALGLQVGGGTRETTRQGAGEHRLVAPYGRQHRGPVQTKHVAES

SEQ ID NO: 24108 - protein, 156 aa, Pseudomonas aeruginosa
RRLAGLLGSGSCRPDSSKETRMTRDRLAERYRAYIDCLNRQDWARLGDFVHDRVRYNDVQIGLDGYLRMLEGDFLAIPDLRFEIERLLVDPPGVACRLHFDCTPSGRLFGIPVNGQRVRFAENVFYEFEDERIAGVWSVIDKAAVAAQVQATPPSS

SEQ ID NO: 24109 - protein, 905 aa, Pseudomonas aeruginosa
GARALRADHLPGIHERPLAPRPRRRFSGDGQAAQEPGAGLRRVDHRVDLQVAGHVQRLAVAVGLVHHATEQRLAPLGVFLGRQLLGEAQPHRAFQAHGAELAAGPGDGEQRRMEAARRHGLGTQSVALAQDHGEERHRQAGGADEHPRDVAHRGLFFRLRANHEARGVAERDDRNVEGVAQLHEARGLVAGRGIDGAAEMARVVGDQAERPALDAQQRGDQAGSELAPQFQHAVPVGQDLDRLADVVGTQAVLRHQVAQLALVGATPVGQQALEIAEVAPGHRDRFGLVLHQYVDHSVGPLHARRTDLLGGETAQAAALDHRRAGHADGGVAGGDDHIAAAQQRGIAGEAATGDHSHQRHQPREPGHADEGMAIETGDADEIGIARAPAATLGEQHQRQAPLFGQAEQAVGLLVVHHPLGAGEHRVVVGQHQATRGLRAEAGGPHRTGAGDQAIGGAQLQQLLGGAPATLGGQGETAIFAEAALVQQVEHVLPRGTLSGLAPPGQRLRTTLVAQRCLALEYLGEIGADMRQVQRLFGRCLLVVILRRFEEQQRRALLQRLPEARRESPDDTAAGCLDLEFHLHRFQDRDPLAGTHPFAIAHFQGHQHPAARRRQRQAAEWRLDPRRRGVLGERALGAEPRMARRDRRQQCLQVAFDEAGVDPVGLYRRMQQKVAQQIQVARHALQAEFAERPVCPAQRGGIIRTTHDELGQQRIVAGADPIAGIAVAVHPQAGTAGRFVGADSAHRRTGAAVGRQGLQVDPQLHRAAADRRRSLQAEGGKLHAGGETQLGVQQVDPGDFLGDGVLHLDARIGFHEIEAPGALVVDQELEGTDPPIAHRAGHAQGAIDQRLASGLRQVRAGGYLQQLLLAPLQAAIALPEVADRTAAVAEHLHLDVPRPRYPLLDV

SEQ ID NO: 24110 - protein, 317 aa, Pseudomonas aeruginosa
  UNSURE (226): Identity of amino acid at the above locations are unknown.
AGAFPRQARANMNQPHEWSPLSRFDLNLFRVFEVVYRERNLTRAAGLLHLSQSAVSHALARLRDQLGDPLFVRQGRGVAPTPLAERLAPGIHDALAGLHRSMNRCQTFDPRRDARTFQLNMPEQLEPLVLPAILAHLRQAAPRIEIRCNSLHWADLKAELGAGRIDLAIEIARPTDAALRRQHLLDDSLCVMAGPGFAGDLSAEEYLAADHVAVTSRRRGICIEDXALGHLGLTRQVRQRCQHYLSAALLVAQGGYLLTLTRGYADLINRGLGNRLLPMPLALPAVTLNLYWSRQADDEAGSLWLRGELAELATRLR

SEQ ID NO: 24111 - protein, 286 aa, Pseudomonas aeruginosa
RRGRNRGKGARRSHAHGGAHEVREEYRAGPGQPATDCGHLRDPLRGADRPAARPEGRDLPADRCLVRPVPDRLHTAAPGHRALAGALPGAADLLHAARLRRHLVRPDRGRRGSAAAVRGDGLDQPGQRHALRLALPGHRHRPGAARATGHLSTDPGLAGPAVHGADADDHQYRHSLLRAPPAGAHAQGHRGSVAGEPGEIAPAGPGQPRPAPADPLHRPVHRLPARRPPGRRGTAPGGQHRPLAAQRLATVPLHPRSLHPRQRPAPAQAGERPPGRVAARPGPAQR

SEQ ID NO: 24112 - protein, 158 aa, Pseudomonas aeruginosa
SGALGRGGTAPAPLPPVDANRSGAAVDHAAEPALQQPQVRRRAPAADRRAAARRRPGRSHLRPGPGDRGGTPAAGVRGVLPGTRDARPRRRGNRPGAVHRPPPGAVDRDRGDAALAGRTRHRGDPARPAGGRRASPAPPRRSPAGRPAHRLAGVPGGR

SEQ ID NO: 24113 - protein, 183 aa, Pseudomonas aeruginosa
RHPRGVAAGRDAPAVRGQPVRRGRDDPGRAALHASAPPRSYPQWAATSPCPASPTTAAASSPWKGVSEALGKEVAGLGIAVTAVAPGSFRTDWAGRSMVRSPRTIADYDALFDPVRQARQEKSGKQPGDPRKAARAMLQAIDAENPPAHLLLGSDALGLVRQKLKALEEEIAAWEEVTRSTDG

SEQ ID NO: 24114 - protein, 907 aa, Pseudomonas aeruginosa
STREMLEYGFERVRMTRNSTRSACRTSRGDRSLWAQHSQGMPFQPANAATRRTFRPLSVAGSFVTRPRLPDNSRAACPLSPYARSPGRTCRGTEARRARRSRRSAASRRARPSFPHPPLDPPQARHAVHIHEAPIPHRVVAHLSFGLEAELAIQRQRRGVVGVDGEFDAAQVHPVVGDVQQFAEQAAADALALPGDGDAHADAAAVAAADARVLFEAGAADDVPLVQGDEDQQAVVVRAVVQALAALLHRLVGHLQDLAGHGGVVVQGGEAFHVAFAVAFEADRRRFGGHCGHPWAVWPPSISVCAGLDQPVGDRAFPAARLWLSSTFEQRKDASMVQSAPASEIAALILRGFDDYREQFREITDGARARFEQAQWQEAQRASAQRINLYEEKVAETGGRAARGAGRQRAAGRGALADHQERLHRADRPAAGRRAGRDLVQLDLLRAVQPRQHQRRHDVRAHHPALAARPRPRALHPHLPAGRRPAPGAGEDLRRLPLRRALRRPRARPRTDRRTAAQQPAGLGVQGPGPGHRADRLGVLSQQGRLPGGPPVHPGRAVAAGVPAAAPRGPRHPVRHGDHRRGGSLDHLLLHPFVLHGRRAGAGRAGGLPQASAAGQAPGRAVHLDRLLQAGQERVLPRPDQPPGDHRRPLRHGPRGARHGDERVHPARLQHGVQDHQGPLQPVEERRPRHGDPEVPVGEEPRPGRTPGRHPAVRRLPLPGEQVRAGVPGRTAGSGAVDGGDGRRRGADPPLLDGAAHDPAEHLPGERQRGADPRGAERLRAGDQATGGGEHLPRRHAAEELRRDPPRPGGVLRLRRDLLPHRGELPLHPRAALPRGRDVVRALVFGGAQRRVPGRIPALPVRRPQPAPAIRQAARQPLRRQILAGPPGADPRGQGDRRVSLSAAGDA

SEQ ID NO: 24115 - protein, 196 aa, Pseudomonas aeruginosa
LLFQRNRRTRTLMSKRIVVTGMGAVSPLGCGVEPIWQRLLAGQSGIATLPAELIGDLPISIGGQVPDRAQDPQAGFDPDLLLAAKEQRKMDRFILFALAAAQEALAQAGWAPQSAEAQERTATVIASGVGGFHAIAEAVRTTDGKGPRRLSPFTIPSFLCNMAAAHVSIRHGFKGPLGAPVTACAAGVQASATRRG

SEQ ID NO: 24116 - protein, 335 aa, Pseudomonas aeruginosa
LSLPRPPGTKKITQQLIAIACCVFTRSGPRGDVGQCHLRRFHSMFAGQRYVARAGRFRLRVGVAGEAAVQTDARVGRAGAVRVLAGKHAEGHRRVGQQAALLADGDFRQAHLEAAVEQVVGVLDRYRARPAALLGEPEEGHGAPGRLVGQADVADLAGAHLLVEHFQGFLQRCEALFLVLVAELAEEVGPPLRPVQLVEVQPVCLQALQAGIEGGDDVLAVELEVAVAHMADAVAGAGDLAGEDPVGAVAAAAEPVADDALGAGVGLGAGRHRIHFGGIHEIDPGGLGPGDLGEGVLLAVLLAPGHGAEAEGADFQIGAAERAILHAGVLVKLSG

SEQ ID NO: 24117 - protein, 416 aa, Pseudomonas aeruginosa
RRHHHRRGPGESLMNKFMAWVDARFPATKMWEDHLSKYYAPKNFNFWYFFGSLALLVLVNQILTGIWLTMSFTPSAEEAFASVEYIMRDVDYGWIIRYMHSTGASAFFIVVYLHMFRGLLYGSYQKPRELVWIFGMLIYLALMAEAFMGYLLPWGQMSYWGAQVIISLFGAIPVVGEDLAQWIRGDFLISGITLNRFFALHVIALPIVLLGLVVLHILALHEVGSNNPDGVDIKKKKDENGVPLDGIAFHPYYTVKDIVGVVVFLFIFCTVIFFFPEMGGYFLEKPNFEMANQFKTPEHIAPVWYFTPFYAILRAVPDKLMGVVAMGAAIAVLFVLPWLDRSPVRSIRYKGWLSKLWLVIFAVSFVILGYYGAQAPSPLGTTLSRVCTVLYFAFFILMPFYTRMEKTKPVPERVTG

SEQ ID NO: 24118 - protein, 278 aa, Pseudomonas aeruginosa
PSWPIRPTRTSWPPSVSVPTSCSTWPSSSYSPISSSASTGRTCTNPHVGLRSARPTGRARLFTSHKSTCEEGSMASINKLTCYSDPADHYCHRIRLVLAEKNVAVEVIDIEAGRCPPMLAEVNPYGSVPTLVDRDLALYEPTVVMEYLDERYPHPPLLPDYPVKRANSRLLIHRIQRDWCSLVDRILDARSKEAERVQARKELRESLTGVSPLFADKAYFLSEDFSLVDCCLLPILWRLPLLGIELPRQAKPLLDYMERGFARESFRASLSSVERDMR

SEQ ID NO: 24119 - protein, 221 aa, Pseudomonas aeruginosa
GNCCSLPGPGSGPGWRRRRRYGSFFTPEQLAVDQVAEAVDGQQVDFLDACGDLGRNADLHVFRQQQRSHAATVAAGQGDHQHLAVVGRLDGLDHVGRIAAGGNRQQDVARLAQGADLLGEDFVVAVVVGDRGDGRAVGGQGHGRQARTFALEAVEQFGGEVLGIAGRAAIAAGEDLALVEQRIDHHQAGLLDIGRQYFQRLLLGLDAGLEELADTVLHVHR

SEQ ID NO: 24120 - protein, 579 aa, Pseudomonas aeruginosa
QEGDAGQRLLGQRLEFLQRRRQVLGRRVLGVLLLPALDAGLLLLQGRRGLGDACQGQPAAEVAFVGARLQLVDRQAADQGPDLFLVLDHRRALEQRCEVDALLGCGKDLAVGGEGLGLGALGTNLLGHRQFAEMLHARMLQCLQGGLGLAAGEGQFGVQGAGEDLLGRLQAFQRNLSQDGGGPGEVLLLVGKVRCREAQQRRFLGLALAGLLQQLLDAGIRRTGKFAQSGIGRGRAGGQQTGQDQSRKRTQASDHIGLLMAHSRRVADCTGGPPRVRWRHPESRYNAAFSDSSRGIFVSAGTLFVMATPIGNLDDISPRALRVLREVALVAAEDTRHSIRLFQHFGIETPLAACHEHNEREEGGRFISRLQGGEDVALISDAGTPLISDPGFHLVRQAQALGIRVVPVPGSCALIAALSAAGLPSDRFIFEGFLPAKAAGRRSRLQAVQEEPRTLIFYEAPHRLLESLADMRDVFGGERRAVLARELSKTFETIRSLPLAELHDWVASDSNQQRGECVVLVAGWQAPEGEESIGAEALRVLDLLLAELPLKKAAALAAEITGVRKNLLYQQALQRQGKS

SEQ ID NO: 24121 - protein, 336 aa, Pseudomonas aeruginosa
SRPGGNQTTRWAAGRTTRPDPLTMNATYRHITVLLEEAVSALAPREDGCYLDGTFGRGGHSRALLEKLGAGGRLLGFDKDPQAIQTGKALAAEDGRFVIVQRSFAELGDEVRARGLEGRVDGVLLDLGVSSPQLDDPERGFSFLNDGPLDMRMNPGQGISAAEFIANATEEEIARVFKEYGEERFAKRMARAIVQRRQERPFERTADLAEVITVANPAWEKGKNPATRAFQGLRIHVNNELGDLERGLDAALESLAVGGRLVVISFHSLEDRIVKLFMRKHAKGEADNLPRDLPIRSKVFEPRLKLLGKPQYASEEELKANPRSRSAVMRVAEKLR

SEQ ID NO: 24122 - protein, 444 aa, Pseudomonas aeruginosa
PADGHRTAAGQCCARKRRAWLMPMSLNQLFPQAERDLLIRELTLDSRGVRPGDLFLAVPGGRQDGRAHIADALAQGRGCRGLRGGRRRRVAAQRCAADRGEGAGRATVGGRRAFLRRAEPRAGPDRRHRHQRQDQRQPTGGPGPGSARRALRHRRHPRHRFLRRPGERPAHHAGPARGAGHAGHAEAGRRPRGSDGSVFPRPRPGPRGGARFRYRGVHQSVPRPPRLSRFDGSLCRRQGQAVRLAGPALPGDQPGRRFRPSTGRRGAGLGADHLQPHRQLGVPLLPRSALRRRRHRGGAGHSARRGPAAQPVARPLQPEQPAGGGRCVAWPGLSPGRYPPHLAATAGAGRPHAAPGRRRQAAGGGGLRAYSRRPGKSPGGPASARGRAPAVPVRLRWRSRCRQASADGCDRRTPGGWGAGHRRQPAHRGQCGDHRRYPQRLRCR

SEQ ID NO: 24123 - protein, 119 aa, Pseudomonas aeruginosa
SPPTTSASLSASARAACPWCATWRAAACLSPLSIPERTRRSWPPCVPSIRRWKCVAANSTPSSSAPPANSTSAPACRCAPPRWYRPPRKVCASPVTSISSPARRRPRSSPSPVPTRRAP

SEQ ID NO: 24124 - protein, 390 aa, Pseudomonas aeruginosa
SAVPVWGCCCASNGNGEPTWVARNMSSTKRTLPMKGNVLIMAGGTGGHVFPALACAREFQARGYAVHWLGTPRGIENDLVPKAGLPLHLIQVSGLRGKGLKSLVKAPLELLKSLFQALRVIRQLRPVCVLGLGGYVTGPGGLAARLNGVPLVIHEQNAVAGTANRSLAPIARRVCEAFPDTFPASDKRLTTGNPVRGELFLDAHARAPLTGRRVNLLVLGGSLGAEPLNKLLPEALAQVPLEIRPAIRHQAGRQHAEITAERYRTVAVEADVAPFISDMATAYAWADLVICRAGALTVSELTAAGLPAFLVPLPHAIDDHQTRNAEFLVRSGAGRLLPQKSTGAAELAAQLSEVLMHPETLRSMADQARSLAKPEATRTVVDACLEVARG

SEQ ID NO: 24125 - protein, 550 aa, Pseudomonas aeruginosa
RRRRRARDQHPPGRHAHLVHRVAPGARAAGRLGEHARPAQRAEFPGDHRHRYRRGHLRRSHRPGAVRLPGRRPALPGLRRAAGRGWQRDAGGRLRPPSARSRRGDQGDPWRLAGASPGDGLPAASLYPYPRPVRRLRAGAGRSQRAAVDGGLSGRRRADPGSRQPPAVPQHPPARPARPDLLRARRRPGAAGQAAAARWRHPALPGRWRCRRPGPATDQEPAVRRQGREGRMNLCLDSLLNGTQDPKAFGRVAVLFGGKSAEREVSLKSGAMVLQSLLAAGVDAFGIDVGEDLLQRLVEEKIDRAFIILHGRGGEDGSMQGLLECAGIPYTGSGVLASALAMDKLRTKRVWLSLGLPTPDYAVLASEDDCREAAQRLGFPLIVKPAHEGSSIGMAKVGGLDELIAAWREAARYDSQVLVEQWISGPEFTVATLRGQVLPAIRLGTPHTFYDYDAKYLASDTRYQVPCGLDEAKERELKELTARACDALGIQGWGRADVMQDAEGRFWLLEVNTAPGMTDHSLVPMAARAAGLDFQQLVLAILADSREARG

SEQ ID NO: 24126 - protein, 288 aa, Pseudomonas aeruginosa
AMNGVLLRHQQPGGLGRAPRKPMPRGASRLVAKEPLSVRLPKADFSFLKYLAWPLLLAVLGYGAYRGAEYILPYADRPIAKVSVEGDLSYISQRAVQQRISPYLAASFFTIDLAGMRGQLEQMPWIAHAEVRRVWPDQVVIRLDEQLPIARWGDEALLNNQGQAFTPKELANYEHLPRLHGPQRAQQQVMQQYQLLSQLLRPLGFSIARLEMSDRGGWALTTAQGVEIQIGRDHVVDKIRRFVSIYDKALKDQISNIARIDLRYPNGLAVAWREPVTPATVATASAVQ

SEQ ID NO: 24127 - protein, 362 aa, Pseudomonas aeruginosa
VEETVITMASVQSGKMIVGLDIGTSKVVALVGEVTADGQLEVVGIGTHPSRGLKKGVVVNIESTVQSIQRAIDEAQQMAGCRIHSAFVGIAGNHIRSLNSHGIVAIRDREVNPADIERVLDAAQAVAIPADQRVLHTLAQDYVIDNQEGVREPLGMSGVRLEAKVHVVTCAVNASQNIEKCVRRCGLEVDDIILEQLASAYSVLTEDEKELGVCLVDIGGGTTDIAIFTEGAIRHTAVIPIAGDQVTNDIAMALRTPTQYAEEIKIRYACALAQAGRCRRDHQGAQRRRPAAARTVAPGPGRSGRASLRRAVHPGPGRAAPQRLRGPDPGRDRPHRRHLEDGRRGRAGRGNLPHAGTPRRAV

SEQ ID NO: 24128 - protein, 400 aa, Pseudomonas aeruginosa
KGRRGEMFELVDNIAQTAVIKVIGVGGGGGNAVNHMAKNNVEGVEFICANTDAQALKNIAARTVLQLGPGVTKGLGAGANPEVGRQAALEDRERISEVLEGADMVFITTGMGGGTGTGAAPIIAEVAKEMGILTVAVVTRPFPFEGRKRMQIADEGIRALAESVDSLITIPNEKLLTILGKDASLLAAFAKADDVLAGAVRGISDIIKRPGMINVDFADVKTVMSEMGMAMMGTGCASGPNRAREATEAAIRNPLLEDVNLQGARGILVNITAGPDLSLGEYSDVGNIIEQFASEHATVKVGTVIDADMRDELHVTVVATGLGARLEKPVKVVDNTVQGSATQAAAPAQREQQSVNYRDLDRPTVMRNQSHGSAATAAKLNPQDDLDYLDIPAFLRRQAD

SEQ ID NO: 24129 - protein, 308 aa, Pseudomonas aeruginosa
VMHIIFLSRHHGAARSVHLQPRLLMLAGACVVGASLLAGGFMGAWLFRAPAPVAGIEVDAALQAQSAEISSAREDAQRQMDALSVHLGELQARLVRLDALGERLTELADVDPDEFDFSLSVGQGGVDEPLEGSAYAPPSFMATLDELAARLDTREQQLEVLEQLLADKHISQSTYLAGQPVRQGYISSPFGRRVNPVSGRLSMHKGIDFAAPAGSDVVAVAAGVVTWSGRKNGYGNVVEVGHADGYTTLYAHNQKNLVEVGDLVKRGQVLAKVGSTGRSTGYHVHFEVMKDGRVMNPQSFIARASVSE

SEQ ID NO: 24130 - protein, 600 aa, Pseudomonas aeruginosa
IPAALRQGRNARPIAARSLRRGSRGWQAGDGHAPLRRPADRWHDPARRQDRRNAYRRGQDPGGHPAGLPQRAVRQGRARGHGERLPGAPRRQLDAPAVRVPRPQRRRGHSLPAAGRQARRLRRRHHLRHQQRIRLRLPARQHGLQPGRQVPARAELRRGRRSGLDPHRRGAYPADHLRPGRRQLRAVHQDQQADPASQAPGRRGRGQADRGRPLQHRREDPPGRTQRAGPPVHRGPAEPERPARRRREPLLGAQPEPADPRLRSAARAHPVPPQRRVHRPGRPDPPDRRAHRPHHAWPSPVRGPAPGHRGEGRPADPGREPDPGLHHLPELLPPVQQAGRHDRHRRYRGLRVPPDLRSRRGGDPDPPADRAQGLQRPGLPDPGREVRGDHHRHQAVPGPRPADPGRHRVDREFRVRFQAVARGRHRAQGAQRQVPREGSRDHRPGWRARFGDHRHQHGRPRYRHPPRRQLGSRSRGPGEPHRGADRPDQGRMAEAPPAGDRGGRPARDRLRAPRIPPDRQPVARPCRSSGRPGFQPLLPVAGRQPDADLRLRPGEELHEGAGHAVRRGDRAPHGDQRHREGPAQGRRAQLRHPQATAGIR

SEQ ID NO: 24131 - protein, 634 aa, Pseudomonas aeruginosa
QDPRADRRRLLREGRAGRRRSPARLREADAAAGAGRPVEGPPVDHGPPAARHPPAWLRAEESEAGIQARVLHPVPGAAGLDQARHHPRAVPRPGPSRRPGRRGGPPASRGGGTGQAHAVPARRGSLDGAGRGRRGRRASRGPGSGRAARACAQRAEDRPQRALPVRFRQEIQALPRAAGLSFPPGSPTPRPVLPLAAFVRIGASPAPMRFPSRRRGRHRVHCLVKERVPMAVGLGPLSTLHPVPGFELGIASAGIKRPGRKDVVVMRCAEGSSVAGVFTLNAFCAAPVTLAKQRFLGEVRYLLTNTGNANAGTGEAGLAAAAQTCAKLAELAGVAETSVLPYSTGVIGEPLPVAKIEAALPAALADLAEDRWAEAAAGIMTTDTLPKGASRQFVHDGVTVTVTGISKGAGMIKPNMATMLGYIATDAKVAQGVLQDLLRDAANKSFNRITIDGDTSTNDCCMLIATGRAALPEVTQASGALFAALKQAVMEVSMELAQAIVRDGEGATKFVTVQVNGGATHQECLDVGYAVAHSPLIKTALFASDPNWGRILAAVGRAGVANLDVSKIDVFLGDVCIASRGGRAASYTEEQGAAVMAQAEIGIRIELGRGTCSETIWTTDLSHEYVKINAEYRT

SEQ ID NO: 24132 - protein, 240 aa, Pseudomonas aeruginosa
KSGICHRSVRLLSSLVHGRPRRAVEEERRMALTIVIGNRNDSSWSLRGWLALRMSGAAFDEILVPLGRPDTRERILQYSPTGKVPLLKSEDGDIWDSLAIAEYLAERFPEAHLWPRGEAARALARSVCAEMHSGFAALRGELPMDLRRQQPLVELSEATRQDIQRICEAWADCRRRFGQDGPFLFGHASLADAFYAPVAARFRSYAVELPDIARTYVETIYQWPAFRAWYDAALREQAGS

SEQ ID NO: 24133 - protein, 746 aa, Pseudomonas aeruginosa
CSCSTKRPATRWARKVSAFPSRSGWSRLCRARWPTEVRAIHEKGRRMPAFFILASVLLGVLVSRRRRLAGRRAAQPQPADQQQGGNAHHRGDVEEVLVAEALDHGSGVAADEARQQEHGRAEHGVLGGGELQVGQARQVGDEGRGGEAAAEVVEGDGHHQHQHVRLERHHQADHVMAGQGLGVQRAELGEHGEQQVGGSRSGTADEQDGEDAEAGDQHPAGGGADQGHEYAEDLADTGDDFLGEAHVDVEDPGHHPHHRVRQAIGGDQAEQQQGLPAIALDELGDRRQHRGHQQASGCRQAGRGDQQEQRAARPGAGVVGAAHGGDGDEEDDQHHHRDRLVDEIEQRHFLAARRHQQRPAHGGEQFADRADLLASPRRQADPHEQRVEAGARPGAVEEGGDHRRQRDQQDQQQEHREQLVVEVETRRVDVDRHVHRRLADQQAGDQPRQDQQGEQRIGQAPGRLAVVEAGGAEPFGENQRAGAGQQDRRAVAGHVAGSEGGLAAILGDFQAVGVDRNVLGGGGERHQQGQADQPGQVALRIAQGHAEQSQGDQHLREHQPGTAPAETADEGQAPLVEHRRPDPLEGVHQPQPTGETDGIPRHAGFAQPHRQGVEHQHGRQAGGEAEQQEGQAGGRLVGDQGLSPGLLSHGVTVPQKITRTLTALLRCKPAMPTYVHPVVVQENAFLAQACALFATAGTVRRQADATAGAENPMPGQAGIHRQLAERPADPAGGRGLCRPVRPVARS

SEQ ID NO: 24134 - protein, 335 aa, Pseudomonas aeruginosa
TPMSLRALCSIVVMLLAGPALADTVWLDNGDRLSGEIVLMDGGKLALKTRYAGQVLIDWKDIDTISSDKPLLIKQQGVSGQRSRTLEAAGKGMVRIVDGGSHTVPLASIRQMVPPRPLVEDLVWEGNLDVKLDSKRNDSDKDEWKLKGDTRLRHGAWRHVLAGEVEREKKDGRKVEDNWELDYDLDRFFDEHWFWRGSYSQKHDAIDNLERQSALGTGPGYQFWDDELGRFDLVAEISRWQLEWRDQPREDFTSYSLEWDYKRLLAGTRLELYSKGTVLVPGIERIDYLLDSEYGLRYRLNSWARLSFLYELDQLRTEGGTQSDRHYLIGVGVGW

SEQ ID NO: 24135 - protein, 336 aa, Pseudomonas aeruginosa
FVLMLSRILLCLAALASSTSALADTVWMKNGDRLTGKITLFDGGKLLLKTDYGGDITLKWDKISTFESEQNLLVKQDAETGEHSKGIKAAGPGQVTLVNGEPKTVELASIQQMMPPKPILQDWVWNGNVDFSLDRKQAENDVSDYDIDFKTNARHGLWRHNVQGEYNREKKNGQVSTDNYSGQYALDRFIDDHWFWQGQVAYKRDMIEDLAKKRTVGTGPGYQFWDNELGAFSIATLVNRNDYEFADGEKEHFYSSSFKWDYNRYLLAKQFELFTNGEVSKPLQSGLDYELQTEAGIRYKLTSWASLSMKAEWDKFSGNDGNVNQRRYTIGLGVGW

SEQ ID NO: 24136 - protein, 246 aa, Pseudomonas aeruginosa
PELDGWIHTVRLMNPGVPVMNNPPVDLDFSHKYDREHAEAYLKKHQDGLARKLSHRRDVQLARHALKLAGQPNLVLDLPCGAGRFWPLLAEKDNRVIIGADNSADMLAVACAGQPDGVVKRVRPLQTSAFAIDLPDSSVDNIFCMRLLHHIGEADDRRVLLREFHRVTRDSVILSLWVDGNFKAWKRRRMEARRVANGEQTGYQNRFVLPAETVEREFRDAGFVVQKHLDFIPLYHMWRVYILRKE

SEQ ID NO: 24137 - protein, 141 aa, Pseudomonas aeruginosa
AGGSPARAGGNPGAGWKGPARWRSASRARRSRRRPPGGCRWSRRRARARASSPAPPSARRRWRWSWPTARRDDRIRFSRWPCCRSVRGRAGTRPWPGRDRPRQCAGWLPRRRFPTGSAVGPASPGRRKGTVRRVPCRRLRR

SEQ ID NO: 24138 - protein, 407 aa, Pseudomonas aeruginosa
RRGSPVPPAGEKFRAIVRQAVAHVMQQQVGIGTNPLVGQLRLAGVGTGSEGGNVAGHAVGLGEQTLAGQHLRVVHLAPRRDRQVAAVEQHLGEDVVADFRLAAVGRPAALDLGGAAVVVGQQAAGQAHVVGEGVRVLLRDIRLAGLPAEAAERGALPRGIPDLVGAPADTVAVAVVRIGIGQDRLFGNRLEQAEPDHRRGDAGGKHRLRMHRPIAELADTQDRLAQFDLGAVLEPHLQRLVVHPHLAFRGDAGNADVLQLAAVGRLGNHPLVQQGLAVRRAGRDRQAYQHRHRADRVRSRRVAAAVLHMAVLAGVGIEQRSQTVARGGGGRGDDPGVAEETVAHAEVQAPARGEVGGGQGEGVAVALQHRGRAPGQVFAGLGAQRFVVGAASAQKERRQETGERHGR

SEQ ID NO: 24139 - protein, 497 aa, Pseudomonas aeruginosa
RPAKTAFEALKRSVRPWAARCWHRKESELVVGVVRLQVLDTQLASGLLDGAGLLDQGGDGVADLLLAVLVVRSDHLVEVHAILLGAVDDGLQLGLGVGQVGLQGVVGGGVGLGDQVGQARALDHAAVDALVLAEVDVADALAVEEQGVVGVVAEAVVLVFGGVGLQRDLHALAGQFAEGQAAHAEEHLAQAGIHRFGFQLGAVVVGDAGFPLSGHVFEVADQQVGDGLQVGGATVAMAAGAVLALGIVGGGTVAGARTGAVQVLAPEEELDGVVAGGDVGFGTAQLVQAGQFLAGDFLDVDLVFADLDLGVGDDVGGGAGVPQGVLVVLGDIVDQAFVQRPGVNLSFPVVDDRVAEAEGFALGVRGTSGEPGFLGGFQGLRVRLGEERVDGFLQVLGGAQGIGEGGFGEFRVVLDHRLGGGLVDLGGRGRRRARRAACWPPVLRALRLSCRRRSRRGRWRGPADWRWPGAYESWRIPLLYWWRAEAARACRKHPRGR

SEQ ID NO: 24140 - protein, 331 aa, Pseudomonas aeruginosa
SLVSLASRPPSCCSSARRRRPTSISRPCSAEMDFDLRWLFIAASLGLCAWAGWQFVHRLARARLLGDVPTSRIRSAAQGFVELYGVLEEGPEGPLQAPLTGKPCLWWRYRIEVEEKRSGREKAWRTVDKGASESPFGLRDATDACLVDPRGAEVRPLTQQRWEAFREAPIDTLRLLESFGTLVGGERLYRYTEERLHAGEPLYALGEFRSSGGGRQGLDAERAQGAVIREWKGDFHGLLARFDSDGNGELDEREWNRVRLAARLEAEDRHRASSAAPTRHRLGKPGEAHPFILSSQGEDDLAVQLRRQAAGAALLCLGSALLAGWLFSRLF

SEQ ID NO: 24141 - protein, 666 aa, Pseudomonas aeruginosa
SGPFAAGGLAQASRLLEVLGQFPGRQRLAVQVALTFVATFGDDVRLLLGGFHALGDHLHAQALAELDDGANDGRVVLVLQQVLDETLVDLDLVQRQALQVAQRGIAGAEIVDGDQRAGAAQAEEVLGGSGDVLHQAGFGDFQLQAARRQAVDLQQVADHPWQGVVVELHGGKIDRHAQVVEALVVPFAQLPAGLVEHPLADAEDAAVLFRQRDEQVRRDEAVQRMLPAQQRLDADHAVVAVVHLRLVDEVQLVALQGVAQVLFQFPAATHLAVHAGDVELVAVARAGLGQGHGLLGLLQQFLRGLAVLGEQGDTDGGAQAHLVLVDLERRFQAVEDALRQFGRLVGLLDVGLDQGELVAAQARQRTEPRAVPAQAVGEGDQQLVAELVGVLLVDPLEIVEAQAQHCHPALLAAGAVEDLVELLLQQLAVRQAGEEVVLGNAQQVVLGLAAQVAVAFDRGEQLVGGGHPEPQLVAFVPLEQRQLVLAGAVGIDADQVFDDLRQRLGQHPVVDQEQHQAHGQGAENAGDEDDFRSGDEVLAVGRGVQGDLQVAVVFAIGRAADQSNAEGAFLAEDRVGQPARRQVQQRPGFLRQHRLAGMADARLAHRLVLEQAFEDLHRHFPVEAVDRLGGRVADHREDALGVAAHRLLGLVGVEDDLRATEHYANG

SEQ ID NO: 24142 - protein, 391 aa, Pseudomonas aeruginosa
SDSGSEILRYEVPVDQVPERLDVLRTQVAVVDVVGVFPDVAGQQRGVAAGQRVAGTDGAGQGQGAVGLLHQPAPAGTEGADGSLGELFLELVEGAEGGVDGVGQGAGGLATAVRAQAVPVEGVVPHLGGVVEDAAGGALDDLFEALAFELGARDQVVQVHHVGVVVLVVVVFQGFCGNVRLKGVLFVRQRRQFESHGVSPILPQVRTGAASARPVHGAGPMPVREPVLDPRGDVRRSAPERAPGATRSLGSQCRELRIIAPVSGHIHAATVGAKAGGGALRRASASSPANTAAFSLDCLAARGFAREDGNCVIPGTAVARPCPASWPPPSGRAGARWPGAPARGPAMPRRGRGRRTTSARRWPRRGHRRPARPAGRRANRSEVRYRDRRGG

SEQ ID NO: 24143 - protein, 157 aa, Pseudomonas aeruginosa
SPGLSSGVSVRSRVRSEVSPAMVGPRRVDRKSAGECGRGRFIRKTNPADLSLGKLILFDYKLLAALAAVVEQGGFERAAQALGLSQSAVSQRIKLLEARVGQPVLVRETPPHPTDLGRRLFNHVQQVRLLEGDLQRWVPNLDEGGAPERLRIAAQRR

SEQ ID NO: 24144 - protein, 482 aa, Pseudomonas aeruginosa
  UNSURE (48): Identity of amino acid at the above locations are unknown.
NSRRDPGSPAGGALPGARRAGSGRTRWPSPGAPCGVRRGRCAPRPRPXCAGARGPPGRGPAMRLSTCPLSQSWTRCRPSSGRQRIDQAHAQAQQRRRRQVDLDVRDAGAVVGGGHVAPGNRHGVPQAAAEIDVAALVAQRHVAQAAILADLAAELEAFDAGLRGSRRKPAAGVEAQRQPLRVRQRLLQAGGQAIGGDHIEADARADHDAGLAGLGVAGVGLLEHRDLSSDIHVVGAGGAAGGDHRRAGGGERTGAMGHHLHLVQGFAAGLRIPQVEDPALQPELAAEGVQGGRVASAEERRQALALRLFSDQPAGVAVGAVDHPVTGHGASPSVQVAFRLDLVARSAASVAQRKSCRRPARSLFWHAVPVVARLRVARVAAQEEQREKRNADSGNGGDGLHRRAFRSLRPGAGPVGTGQRSSCGRGGTSGGAGRRVRSRRPRRPGAGRAPLRGCRGGGALCRRGRSLGTARTLPGGQRRACR

SEQ ID NO: 24145 - protein, 172 aa, Pseudomonas aeruginosa
ESFRFSVTGQGGHWSLPLPGIRHERIATIPFLPHHRLFPRHQQRLSPTPVLHGASARRGAARGAHRPAGRPDPGRDPPDQPGAAAQGPRPADPRPARLTPPGIPMTALTLGLIGNPNSGKTTLFNQLTGSRQRVGNWAGVTVDRKEGAFHTVRHAVRLVNLPGTYSLNTVSA

SEQ ID NO: 24146 - protein, 697 aa, Pseudomonas aeruginosa
ASLDEQIACRYIASGEMDVLVNVVDAANLERNLYLTVQLREMGIPCIVALNMLDIARSQRIRIDIDGLARRLGCPVVPLVSTRADGIDELKAAIDSLQLPQAALAVDYPPAIQAQVGYLLETRAPAASAIEPRWLALQALEGDIFNGPALGLPPATLEQARRGCGEEPELAIVDARYQLIGEICAAVCDHQQAQPHRLTQWLDRVVLNRWLGLPIFLLVMYLMFFFAINIGGALQPIFDKGSSAIFIDGIQWLGIRFGLPDWLTVFLAQGIGGGVNTVLPLVPQIGLMYLFLSLLEDSGYMARAAFVMDRLMQALGLPGKSFVPLIVGFGCNVPSIMGARTLDAQRERLITIMMAPFMSCGARLAIFAVFAGAFFGQGGALVIFSLYLLGIVVAILTGLLLKHTLMRGEASPFVMELPLYHVPHLKSLLLQTWSRLRGFVVRAGKVIILVSLVIGGLNSITLDGKPVQGDIGHSALASVSQRLTPLLAPLGVQPDNWQATVGLVTGAMAKEVVVGTLNTLYTAEQIQGEAFDYEGYDLPGQLRDALVETWDGLVDTFSLSVLANPVEASMADGDMETGSMGTMASKFGSPIAAYSYLVFVLLYVPCVTAMGAIARESSKGWMAFSVLWGLNVAYSLATLCYQVATFAAHPERSVLTIAVVLLFNLILMTCLRLFGREQVLQLPGRMADAPSGQGGCH

SEQ ID NO: 24147 - protein, 222 aa, Pseudomonas aeruginosa
YSAIRALGTRPSSARQRVSGAMTMRLGSSRSPSTMGSNRVAMEHPPLGNRRTGDQSRTGCAWARPFPEKAIRVASSASAASAAAASGTRVRPRPWSMTLPPTQAPSALPTLKAPMFRVATRFGAACPTRTTLTCSAGTAAKAAAAQKNRVISAGSRAWLVQLNSAETSAMAANTAAMVVPRRQSARRPPITLPTVRPTPISSRVQVTPRGLTPVTSPSSGAT

SEQ ID NO: 24148 - protein, 172 aa, Pseudomonas aeruginosa
ASPHELPRASPPRRPATGPTARQPVRRLRQGPPAGTMAGRDRAGHPVAPAHRRLHRQPPTGACGQAALPAGAPAFRRRPAGRVLRPLPGARLERLRRRTAAAVRRAGLRHPAHRLAAAGAPGAHRAADGGPGLVGQLPRVRGLARSAGRYVAEAVATAPAGRLLGRTGPALR

SEQ ID NO: 24149 - protein, 357 aa, Pseudomonas aeruginosa
PERGFPRLLPATPGFRPEPALSLAQRPLARPAESPINCFSPKHPLDAHQPAAVASIVQWGRRSTLCQWRWKMKRILVATDLSSRSELAVMRAAALAKARNAELTVLNVLDDDQPPVLIAPQRLAIANLLEVNGQALKERLGVESKAIVRVGDPVVVINAVAEEIGADLLVMGAHRHTPLRDLFIGTTLERVVRNAKIPVLRAAGAPEEEYRRVLLALDFSPTSTRAVQMAGQLGFLDAASLTALHAFEPFAKGMMRYSGIKEDRVEHYVDQEELKANVELRDYVAGLGLGREDIQLRVGEGLPINVIMTEVRRQAPQLTVLGTQGLTGFRRALIGSVAEAALGDLPCDVLAVPPKRD

SEQ ID NO: 24150 - protein, 421 aa, Pseudomonas aeruginosa
SAPSSTGSRTSSAASTCSARTTTACQAESALPGVIEAMLGLPLDRREGPPMPALPLSRRALAALALVFALPALAEDWPDTDWPRAQQPAGPALEAFERYAFGRRDDVRRKGIRTDAVVVIRDGRLVYERYAGPSRAETPHLTWSVSKSLLATLLGVAEGEGRFQLDDPVARYYPPFARHPEVTLRHLLNWSSGLDWQEDYEFAPLKSSVVAMLYTRGRDDMAGFVAETPQARPPGRRFRYSSGDSNVLAAALHGMLGADYAEYPWRALFEPLGIRSAVWERDAAGTFVGSSYVYMSARDLARVGLLMQRHGRWRERQLLPLAWVEFNLTPFARYRPSAEEEGEAVPGGQWWLNRAVKGAPAPWPDVAETAFAALGHWGQALYVLPEEKLVIVRYADDRDGRFRHNEFLRLAQAAFAGEARP

SEQ ID NO: 24151 - protein, 346 aa, Pseudomonas aeruginosa
PAPGHPRPSRTGLRGATHRRAGRRMPARLGLRSARRDRPHRRGRRPPPGRRHAAARPAGGHGCVADRRGHGARLQQLPRRAHARLRPRRTHRDAARRGTLPGGDAAFRRHPGTDLPARRGRPGRRRGDARRRAAGALSLRCAVRHAQHAGTGGRAPGLPRGTDDGFPGPAERHPGGRRWTRFDAAPERRSVARRVERGDGPAERGGAQRRSAEGRGGHGRRIAGRRGGQRHTPARRAAPEPAGARRPGARAGAAAGSPDHRVAGRQLWVPGQHRALPGLSGAGQQRRGNRVRPPGRGRAGRRGAGRRRHAEADGQRGLRLDDTALPRQLPVHRQRQRTADGAQPGL

SEQ ID NO: 24152 - protein, 121 aa, Pseudomonas aeruginosa
APPAIEATATRKSSRLTRCRCPRRSADANCPAARSCRPTWRRSNGSTRGSTPSSRCRRKAACSPRPTSATGNWRAANGWAGCTACRRRSRTSPPPPAFLPPWVRRCSPGRCRSTTPSSSSG

SEQ ID NO: 24153 - protein, 264 aa, Pseudomonas aeruginosa
SARWPCRYAPRVACSAAWRCTGRATRIASNGCAAGTWEPWPIPSVSCSTRSTDAGVCLLPGGRFKVAPDAKGARMHKLICLGLALLALPVQAAWYLDYESSRLSFISTKNATLSEVGRFLVMHGKVDDKGQARLRVELDSVSTDIPLRDERIREHLFETKRFAEAEITAQLDLAPIVELADGVQLEMRQPVTVSLHGKRKSYASDLLVTRLDEHRFQVVTLSPLVLDAADFDLAPGIETLRKLAGAGSIGLSVPVGAVLIFTSR

SEQ ID NO: 24154 - protein, 194 aa, Pseudomonas aeruginosa
WPARATGSPGPACCTAIRCCACRNSLAASWPTGCSAATATVAWCRDAACWPRWWRWWWRPSWWPTTCSPRAPNIGTSCCTTACCCRPSCCWCAFARCPPTRRALSSATGRRAWGPPRCRCSPCMCRCSPCSPVASALSPCRGVVSTTGAPAPRRRPRCHRRCSTTRCSWSCWWRSACCSRSAAWCRCASGWCAG

SEQ ID NO: 24155 - protein, 208 aa, Pseudomonas aeruginosa
VHPRYDRALPEGVRVMAAKKILMLVGDYAEDYETMVPFQALQMVGHQVHAVCPDKRAGQSVRTAIHDFEGDQTYSEKPGHNFTLNADFAQARAEDYDALLIPGGRAPEYLRLNEQVLALVRDFDAARKPIAAVCHGAQLLAAAGVLQGRACSAYPACAPEVRLAGGEYVDLPPDQAHVDGHLVTAPAWPAHPAWLARFLEALGTRISH

SEQ ID NO: 24156 - protein, 346 aa, Pseudomonas aeruginosa
PCCMPTTISTRPCSGPTRRSTVPSAADETAATPPGRSPVPDIRVGERRLAVAAGSNLLDALLAGGIAVPHSCRAGSCHACLVHCLQGEVDDTLPEALDPARREAGWRLACQCRVLSDLVLQPFDPERDGLPARVVACHWLGDVLRLRLEPERPLRYRAGQHLLLWSDDGVARPYSLASLPHEDPWLEFHIDCSAPGAFCDRARRLAPGALLRLGELRGGALRYEPDWQERPLLLMAAGTGLAPLWGILREALRAEHQAPIQLLHLARDHYLASELAELAGRHPQVRVNLVSAAQLPSALADLRLVPRRSMALLCGQPASVERFARHLYLAGVPRSQTLADLFLPHA

SEQ ID NO: 24157 - protein, 415 aa, Pseudomonas aeruginosa
GWPGCSAPANAATALSRAPRGGVSPWVPLSCPARSRSRPWLFRPHQFTEELQGLAGQHLVLAEQVGGADPEDHQAQHQGQRKADGEDVQLRRRAGHGAEGEVHHQQRGDRRQRQQQCRAHHPAELAGDDPEMVAAQALAHRQGDEALGDYLEHYQVSVHRQEQQRHQHGEELAEHRHRDAVGRVNHGSEAQAHLHRDDLPGDHEGVEQQLQGKAEQGADQDLLADQQHGLHAQRVHLRHRRQVRHQHHADAQRQVQSHPHRHQLGANHRHGHQQRRDPEQRQHEAGDPAADLRVGQLQHQPISSGMLPISVWVYSISCRSSQGPSTIRVSRITIRRGRKLRVCSLIWVAAWNIATTRPTSRLGTTSTPTIIAVSHNASRNRSSATSGVMSLSSAPAARQAGGTARRCRNCPPASR

SEQ ID NO: 24158 - protein, 124 aa, Pseudomonas aeruginosa
CRYARPPWKWSPGCPGSHPGWAPPGRKWSVPSAKRRTLPSAPAGYSTPPRESRRPGPSAHRCRPGWRRPPRPAPPPTRRPVPVPRWSLFLRLPWFVFPPGEAVSASARPLRESVAPGCPCGRPA

SEQ ID NO: 24159 - protein, 681 aa, Pseudomonas aeruginosa
STRPRAADAPGRLRISLTPARVSSSPEASPAKPRPRADPPSPCCWPCQPRASDWSETFTSSWFMPCWLNMSRSRCIWLSRASRTPALGLAKVTWVWSAVMWMRTSRRPSSAGSSWISADFRFWLDIHITRSTTASLQPFCCIATGWPGTVPFTGRLVRACCAMAWVSPLSLAAKGSPRGSALLSSRLSEAALAMAGSAVCCNWASSALPSTALGKESEVRLARASPRFAWRGSALFAGPPFAACAASWAPCSKAMFTAGTPLSLTRVGSLLASVRLAGALLAVGTAGGSKVAWVFSSSIGTAPPRPSSCSGSTGVSTLSSPSALAWPSAGKGLPSSATAGCPAASVGCASAASLPASRGLSREPLEGPSARSAGFFAVSLAYMSEKLEVLSLLGSGVFCWLFGAAALGFTSGVGGNNTPGATAMGILHLRRDCIVACARDGARSGPTSPRASVKRSPGRRSRHARFARRSRLDYNPEPHPSRGSTLMSFAEKLSRLQAFLDADDLHEEALDYVATHGYLTALSICPEQVPEREWIDALFAEPPHYRSDEERQEIETSLEQLKAHITRVLASDEDLELPCDLDLGDEPDDSDLRGWCIGFMEGVFLREEVWFEQAEEEVSELLLPIMVGSGLFDEQPEFDEIARDRHLVDDMVAQIPDLLTNLFLLCQAPEEKPALLKPRTH

SEQ ID NO: 24160 - protein, 135 aa, Pseudomonas aeruginosa
RWTGRGRGWPRCCCAPRRPDRSVRTGACGARRRSARRGCSPPPALRRRAARRRPAACRRRRCAGRRCTAGWSPPAGTGRARPARGPRRAPRYRPRPRRRSPRGNPPWWRSRRPARFPRARRPGVPGRRGRGTACR

SEQ ID NO: 24161 - protein, 120 aa, Pseudomonas aeruginosa
PMPRMVCSSLFSNGPSSLARRRLIATSTTLVSVSKLMSQTSSAIAVFDRISPLRWASTQSSAYSLAVSSRRVLPRKTLRLSRSMDRSAMRICEWLSWLPPRRVRACRRATSSRKENGLIR

SEQ ID NO: 24162 - protein, 1056 aa, Pseudomonas aeruginosa
PRAAVQESRVRYASCRRRPSGSAVRGRGPAPVEQPLQGQVYHRRAEQGQHLAHQQPADHRDAQRLAQLGTGAEADHQGYRAQQRGQGGHHDRPETGQAGLVYRLLRAHALLALGDDGEVDHEDAVLLDDADQQHDADQRHDREVLAPGPEHEHRADPRRGQGREDRQRMYETLVEHAEDDVHRDQRGEDQQRLRGQRALEGLRRALEHADNGRGHADLLLGALHRLHRLAEGHPGSQVEGQVDRREHAVVVDLQRPGARRRDLGDGRQRDHLAAQRRAQVEPVQAFRAAALARIEFEDHLVLVDLGLVLADLALAEGVVEGLADILGAEAETRRGHPVDVQRGDAGADLQVVGHIHQPRHLLQALGEALRPERQLGAVAAAQGVLVLGPRGSGTEVDVLRRAQVEHDSRHLRQLRAQPVDELADRDIALATVLEDDPETSVGQALATAGDAHRMVVALHRRVAGDDLGQLPVLGDHVVVGDILGSLARAEDEGGVLQGEETLGNPDVAGHRHQHGKGEADQHQPLVPERPAQAALVSAGQPFGEALSRRVGMPQCRHEARSQHRRQGQRSEHRDQDRHRHADREFAEQPADDPAHEQQGNERGDQREADGNHGKADLRRALERRLDLRGARFQVSVDVLHDHDGVVDDEADGDDQRHQGQVVEGEAEHVHRREAGAQGHRQHRGDDQGRRQLAEEQAHHQHHQANGQQQGQFDLVQRRADGPGTIVEHVYLDGRREHLAQARQCGLDRVGGIDDVRPRLAEDHQCHPGHTVRPGLHVVVLGRRDDPRHVLEEHRRALAVGDHQVVIVAGVEQLVVGRKGRHPPLAVERALGQVDAGRLQRLAQVGQGQLVGGELLRLGLDADRRALLADHEDLPHAVHLAELAGEDGLGVIAEFDQRHHLRVDPQDHDRAVRRVDLAPGRQVRHVHRQPPGRGVDRRLDLLGGDVDALVEAELQGQGGGAQGAAGSHLGDPGNRAELHFQGGGHRRGHGFRATAGQQGVDLDGREVRLRQRRHTEPEERQQPQQQRGQGQQRGGDRVPYAPAGNPGARRHGCRSAA

SEQ ID NO: 24163 - protein, 912 aa, Pseudomonas aeruginosa
PLFQFGDAEQAEPGQQHPRPLARGQADRAEQRLQRRRVGIEQLQHHAGGDRQQDLAVAEQALAAEHRIVDMPAVEQVEHLAHHHAVHRHGPRALQPGAMLQLPEEHAQGARHHQQRDQQHPPDEEQRQQGLRRRTRRTLHQAALGRIEGQRQAQGAGGDHVDPEDLRRRHRQGQLEQDRGDHDQRLATVGRQHEEDEFLQVVVDRPSLAHGIGDGGEIVVGEDHLGRLLGRLGALVAHRYADVGALQRRRIVDPVAGHRHHLAAGLQGLHQAQLVLRAGAGEHIDARQHFAQALVVEQLDLRAGQRRPVDADPEHGADRPRGVDVVAGDHLHRDTRRLAFGDRGHGFLARRVDDAHQGQQGEAMFHVGEIQRALLRRHRPSGDGQQAQAASGGVGGQAPPVVRVQRPHRVAHPFSLAHVEDALRRALQVDHRLACVVVVQGGHEAMLGLERNRIAAWPFRRQRLRIEAQLEAEAEQRAFGGVALQLPCLALLVQARLVAQQRRATDLLQIVASGGIEAFAVVAETTQGGVTGAADLDYLVGGDDTLHGHLVAGQGAGLVRADHRHRTQRLHRRQAADDGVAPGHALYAEGEDHRHDRRQSLGNRRGGQRHHQHEHVHHRLALPEGAEDESGAGQQQDRQGQPATEAGDLSQQRSGQGADFAQQRTDPAQFGIPGGGDHHSARLAAGHQGAGIGHATAVAEQRVDGHRDAALLHRHRLTGQGRLVDMEVLRFEQPQVGRHPVAGGQQHHVARYQAFGVQRLALAVAQDQGMQRKHVADGVQRVGRLALLDETDQRVDHHRQEDYRTVHPEAEQRGDQRGEQHHVQQDVVELPQQAQQRPLAFRRGQSVVAVRRQAAGGFVRVQAGGGAVQSFQHPLRRAGMGVAGRQGWDAVHGIPAPRSDEQNYRAGLRRNV

SEQ ID NO: 24164 - protein, 274 aa, Pseudomonas aeruginosa
TTLRPTLFPGIAHAQLPASFRPQAARLRLRRHRRALRRVPGSRRRAPCGGQRLSWATPGPTARRLRTEPAPVPQRRPRMHRRPAGPGLSAQRHRLAPEPARTGDRRRTLRRRRLLRRRSAGLGLRERQDPIAARRQPRSARLRLRGRRPAPDLHRRPQRRPGGPTVVPPAPFASLSGRRPTGAGRPARHPPALRLGPLPCLDTTRSSAADPGKPSPGQRSAVPASSTGVGPVLSRRPTPGHRPRQPPARALESGRRQPAQLRTGRTGPVPAGLP

SEQ ID NO: 24165 - protein, 324 aa, Pseudomonas aeruginosa
RHGRQPAGQSATRVCRPATVQGAADTGTTAAPERLPPSAGAIRPRRFSRPPDRPRGQRPGRPRARPGRPDHPQAPSRTLRPVQPPSAHRPWRSLLLPGRQSAGAAPGQGPVPPRPADLQDPRSATPGAPPGALQQPARLPAGQSPAAQRQGLQLAASRLRYPAPDLLRPGEPRHALGRDPVRPGQRLRAVARRTMDRTGAGRWSGRGTRPRQRRMSLALPHGRRHTAVPGSQRQTPRHRFQPRRSQPPAGRGGWPAHRSSRRQPAAVARSSPSSASRRRNTGSWDTTSKAPRYCPSMLSRACRAARSRWLSGSSSSSSCAGRSA

SEQ ID NO: 24166 - protein, 65 aa, Pseudomonas aeruginosa
STRARAAFRRSPPLSVAHGWASRSAGKPSCARRVRSQLSPRLRLTSSNCSSTPRPWSSTLSRWSR

SEQ ID NO: 24167 - protein, 177 aa, Pseudomonas aeruginosa
AAPTVTAQVPASGARCPASSRSRVDLPLPFGPTSASRRGPLRSRSISRNGPRKCGRTAPFNSTIRRCAASSASGESSSSGDASSTSRAASRTSRSRRSRSAWWALRILPALTSLRSLNPPSRIFAWFAVLPSRRPLAWHRSWRCCCSRMARVCRLRSRRRWSRRRSAASRASSRLCA

SEQ ID NO: 24168 - protein, 246 aa, Pseudomonas aeruginosa
RTRPWRRTLPLDGCKCPASRRASSDLPTPLRPTSPVCRVSNVSSRSENRRLPSGSWKETPSSVRVDVFVMDTPLMPCIPPGPRARDGKPAVQTRQHQLRIGRTPRTEGKTAAVYSAHAALPIGHTFRFRQTRPTDMARPRISELFEQEPSRWGGRGDPYLWQEMAGQLADASWPASAAALEHLLGETFERLSGHSLEYDALIYLARHAHGGMSSGMVSPEFWRETAIPELLDRYRRRRSWLRWLRR

SEQ ID NO: 24169 - protein, 478 aa, Pseudomonas aeruginosa
EFPDPAGLPPRRDPRQTASPALRRRLRAIGRLPALLGTPAARRTLFRPLQAHYPRGPATLAGSHLQSRTRRAGSTAQGGQVRQRHRCHRPPGTRDAEQARCPVPLDGDDRVRPRRQCPRGQRQLPRHHGLWPSRAGQRQPPSVLRTGLPRRPAVRRPLAPPEPRRVRHRAVPPGPPQRPAGLAGSQLQPGLRRRRQALQGGQVRQRCQRPHAPLPGRGGQRPPGPYPVHRDPYGRRTRRADHPERGGGNAQDREYPGCFLAEHRRTVTALATDHLDRQHHPRDRRADQPARPQCRHRGRPRRRPGSRLRRGGRRGAATGGTHQQVDQGDRRHDRSHPDRHPQRHRRHAAQPGTGAARRGAGQRGRRGDPRHPREHAQGGRSGAAVLAHPQRRSLGLRPGSSASATGRGRPGSAARASGRDGGSGRMAPGSRRSPAAGRAGAPARPTGERSAPAGNRCSRRKGSGSVAPPCSPPFPRCA

SEQ ID NO: 24170 - protein, 322 aa, Pseudomonas aeruginosa
GHPVDKNLHQPLGGNEMPRFGGIATMMRLPHVQSPAELDALDAAFVGVPLDIGTSLRSGTRFGPREIRAESVMIRPYNMATGAAPFDSLNVADIGDVAINTFNLLEAVRIIEQEYDRILGHGILPLTLGGDHTITLPILRAIKKKHGKVGLVHVDAHADVNDHMFGEKIAHGTTFRRAVEEDLLDCDRVVQIGLRAQGYTAEDFNWSRKQGFRVVQAEECWHKSLEPLMAEVREKVGGGPVYLSFDIDGIDPAWAPGTGTPEIGGLTTIQAMEIIRGCQGLDLIGCDLVEVSPPYDTTGNTSLLGANLLYEMLCVLPGVVRR

SEQ ID NO: 24171 - protein, 393 aa, Pseudomonas aeruginosa
SSIAACPAAVSAMSPRATSRGAGFMADGYARVTGKPGVCFIITGPGMTNILTAMAHAYADSIPMLVISSVNERARLAHGNGYLHELPNQRNLVGNVCPFRPYPDERRGVAGGARPRLRRVRQRAAAAGAHRAAARRHHRARRTPGPAPTHPRQPPGAGPRALARGRGAPAQREKATAAARRRLRRGRRRSACPGRRAGRADRPDDQRQGPATGRPPAAAGQQPVLRAGTRAGRRGRRGAGHRHRAGRNRLRRGVRRRLRPRWRVDPHRHRPAATDAQLHAEPGHPQRRPAGHARAAGRTAGRRGLAGQPRGPARRRRAPAPGRRLRRLVALSPAVRRDPRRVAGRPLRRRLDPDRLQRQPPGRSRRAAPLVQRLHRLRHPRLWPARRHRRQAR

SEQ ID NO: 24172 - protein, 477 aa, Pseudomonas aeruginosa
SSRCCKPRPSIPDPEPAMDDSELYRSLCEILGARGVRDSAALAGQDPGYHPQNLAGSFLVLPESTDQVAAVVRLCRQAGRALVPQGGLTGLVGGGAAQAGDVLLSLRRLNRIHRLDAASQTLDLDAGVTLEQAQALAAEAGLDPGIDLAARGSASVGGLVATNAGGIRAFRFGTMRQRVLGLEAVLADGSVYSDLRGLLKNTTGYDLKQLFVGAEGTLGIVTRAVLRLEPLQRPGATALLGLPDVDAAITIAARLRREHAERLFACEILWHDYLQCTAAPMGDSAPSLAPCPLYLLVELAEDRHLDAGEALTALLEDCFEDGLVEDALLAANETQRLAIWRLREDSDAAIHAGVDSLSFDVSLPVPALAGYVERIRRRLDDLVKGMQVFLFGHFLDGNLHVMLAADVPLLPLHQAVEEILYGELGECAGVISAEHGIGLEKKEALGRYADPLKLALMAQIKELLDPSGLFNPGKVIP

SEQ ID NO: 24173 - protein, 440 aa, Pseudomonas aeruginosa
FSSFAAGRPARLPAGTGGRHGGRALLPDPATAAPDPRRPARPDRRRPAGRRQLPRLPGRRAGRAVRPRSAAGALTPAGRAMGLLRPDPGLGLGRGLLAARAAALRSWRGQRLGTDHGHRPQPAPRRGKRSGPAGRAGVRRPRHRGDGHRPAGGIGQRPGPGLGVHLEALRRPRAGPDPHAPAAAAAPGRTQRRPRRACHGKRERRPRPPDLGLRTGRPRLHHPGHLSLADGRGAFPRAMAGRPVLALLRPGLGHRGSADQPAPAAPGRHPPLAGRRALATGPRRARLPAAGDRRTGPGGSADRPAVPRRHATGDAIRPRTGAAYAAAQRRPTDHRFRPRPVARPAAGGAQHAFRRRPATGAGARRARPGLRRPAVAPAALAQRRSRRRSHCSPLTRVMPARTSAAPATKFRLSGSPSSNTPKVTPNRGVMKEKIARLFAW

SEQ ID NO: 24174 - protein, 440 aa, Pseudomonas aeruginosa
TSPAETASARPASSLRVDCMLRSSAGRAFVALQHVDRVDADGFHRIAAFHDEQGRQAQPGDALAHPQVVRRIQLELGDRVFLVGVHAKGNHQGIRGVAGDPHAGVVERRRPEVPAAAMGQRIVVVAALAGAFAALVCVAEEVRVFDQRIAMDRGEQHIVAAVEDILGAVAMVIVDIEDRHAPGTLVEERLGGDGGIVEEAVAAHEVATGVMARRTAEGEGAAGALAHMFLGGQRDLGGAVDGLPGAGGDRRLGVEAVVAQFAHQRRGDRPVAAQAAAGEGGGHHVAAVAFGGPAGPGALEEVQVGGVVDAQQRLAAEILRRDHLAKVLRLHPGQHGVGPAGHFETGLQLAVDQFRLAEVQTMIVAVDAQHGETSQVSCSWWRDSAQRAVAAKRRRRPKRDRYGQNPCPFSAAWRLSTRGITRRPRRSILLEPVRIERGIR

SEQ ID NO: 24175 - protein, 118 aa, Pseudomonas aeruginosa
PRRRPGLRARAGTWSCSTATAQTAPANGCRASRWKPGTSWKTDCASASTWDATRTPGYSSTCAWAAAGCRSRPPAAACSTCSPTPAASRWRPLPAAPARWSTWTWPAARSTAAATITA

SEQ ID NO: 24176 - protein, 201 aa, Pseudomonas aeruginosa
PRTTAGSSAACRNCWCPAAPCWPVSMTRPSAPTSSSRKPPARRRRCTSSNAWRIRRSSPMSTPRRASRRCCSATQADRRAGGVSLGCRHGHARWLHPPAATRRTAGGLSPPARRPAPNPGPASVRAGRAQRLPVRQRRPRRGHHGALRPRPDPGPARPAQPRTGRATGNRAPGIAGAPPGSQQDRFRYRPPGPGPRSGQPR

SEQ ID NO: 24177 - protein, 158 aa, Pseudomonas aeruginosa
RSISASLRGCSENCLPTAPRVVVSKSPARLRSASATSGKASRRNTWNTRAPSAFTSRASSASRYSGAASLSATRIAASSHSERTNASTSRRKRSSGGRAVSSRISPSRRVVRRHSSLCRRKRIAALFGKYWYSEPMLTPARSATRAVVKRCAPSLART

SEQ ID NO: 24178 - protein, 283 aa, Pseudomonas aeruginosa
TAASRMLATNSLERACCGCLREEIAGFACRSWKAPECEWRNAMNPSHSRSTHLRAQTFPEPSMNTLTNAPLADLLQRLFAEAEASAPGDSPALADLSEAELKRLMGSKTEYREFYGRLKDLALPVSRETGCLLYMLARSSSARSIVEFGTSFGLSTLHLAAALRDNGGGRLIGSEFEPSKAERARRNLAAGGLLDLVELREGDALQTLAKDLPDSIDLVLLDGAKALYPEVLALLESRLRPGALVIADNAEHSPEYLAHVRSPANGYLSTPFAEDVELSMRLG

SEQ ID NO: 24179 - protein, 100 aa, Pseudomonas aeruginosa
TARTGRAWATSSMTGCATTTCRSDSTATCGCSKATSWQSPTCASRSNACSSILRASPAACTSTAHPAAGCSASRSTASGYASPRTSSTNSKTSASPASGR

SEQ ID NO: 24180 - protein, 147 aa, Pseudomonas aeruginosa
RLATATASASSSTSTSITPLGPCTPVGPTSSAAKRPRPPPSIIAGPAMPMVASRVAMITSQQPSNAALPAKQRPETTPTSGTSPESRAMPTKVWQSRPATPTKSVSPGRPPPPSANSTSGKRHCSARPSRRSVFLWFITPWVPANTV

SEQ ID NO: 24181 - protein, 272 aa, Pseudomonas aeruginosa
ASTRQRAACAPKLAAPTVPVPATRPSAGLSSSNSSAERRRRWAARAKPPYSLKLPSSSRSSTFSRAVRCPVLRRLASACGRRSSPSAAWRSSTSARSARICARSSACSVGACSSSSSVGSRNSSVAPSSRGSPRLAASRRTIPPPGALTSNSIFIASRIATRWPARTRSPSPTSRATSTPLLGADSGRLPSGASTRAGAASSASGHSARSRGWLAGIGASSVSRWLSTKRVSTRLACTAGCSRRLRSRSRLLATPSRRNSQSARYARRNAAG

SEQ ID NO: 24182 - protein, 91 aa, Pseudomonas aeruginosa
SPGVAVSAAHATLARYRPGPPFVRLRDEGGETEEKARGAPMHTEVHMKFEKNTELDQANLRLIVATCAILYVVLIGLLPGLKVETYLPIVA

SEQ ID NO: 24183 - protein, 494 aa, Pseudomonas aeruginosa
YGLFLIASILLRQAIVRWPGHYPARRIFCMLHDYAGTSFGLIVGGEAALPLYAVMVWINLGNGMRYGSRYLAIATALALLALLVIYRLTPAWQAQPFMVLMLMTTSTVIPFYAHLLLERTRKATEEALQANQEKSRLLAQASHDLRQPIHSIGLFTACLRDARLGDEERRLVDNIDRSLLNVSQLFRSILDLYTLDNGRLQPKQENVHLGELLRDLVRRNAEAARWAGVELRLRPCRLWTRTDPGLLSTMLQNLLSNSLKYAAERPLLIGVRRRGDGLAVAIYDQGRGIAEEHLPRVFEEFYRVRETRDRDVEGIGLGLSIVRRLGQLTGIEVTLRSRVGRGTAVTLHGLPAVAAQALPRRDDPLQAGLLTGLRVCLVEDDRNVLRATSALLERWGCTVQAETEADGWRTDCDILVVDYDLGPHASGVECIERVRRQRGEAIPALVISGHDIERIQASVEDTNIALLSKPVRPTELRATLRALRERPAAASHAS

SEQ ID NO: 24184 - protein, 258 aa, Pseudomonas aeruginosa
RSHTMSFRKTLLITGASSGFGQALAREALDAGHRVVGTVRSEEARSALEAVAPGQAFGRLLDVTDLAAIEPTVAAIERDIGPLDVLVNSAGYGHEGILEESPLAEMRRQFEVNLFGAVAMIQAVLPYMRRRRRGHILNGRLHHHARHRLLLRQQVRPGRGFPKPWARRWPASASPSPRWPPAPSAPTGPAVRWSAARAPSPTTTRSSTRSARLARKRAASNRATRARPRAPCSRPSTRKTRRRTCCWAAMHWGWCGRS

SEQ ID NO: 24185 - protein, 588 aa, Pseudomonas aeruginosa
ARPSNNERTPAWSRAPQPAKSPPSSCAVSTITESSSARSPTAPVPASSRRSGRKRSAPRRSGSTSTRKRSPRPVAGLRAGLADSELLDVERWPIIKSAYIAQIDLRLDDELAETWFNSIFCGLFSHDNISDGTMFVHTTRPSLRAHARAPYTRTYRPGGDLRQALEKIFDDYRFDVPYDDRERDLERIDALLHSNLPDWVCKDPDLAIELIGSVFYRNKGAYLVGRLFTPDEQWPLVFPLLHREGHGIQFDTVITDEAEVSIIFSFTRSYFMVDVPVPAELVAFLKRLLPGKHLAELYTSIGFYKQGKSEFYRALINHLATTDDRFVMAPGVRGMVMSVFTLPGFNTVFKIIKDRFNPSKSVDHATVIQKYQLVKNHDRVGRLADTQQFADFRFPVSKFEPECLAELLEVAPSTVVMEGDVVLIRHCWTERRMTPLNIYLENASEAQTREALNDYGLAIKQLAAANIFPGDMLLKNFGVTRHGRVVFYDYDEICYLTEVNFRYIPEPRFPEDEMSSEPWYSVGPNDVFPEEFPRFLFVDLNQRRLFAKLHGNLYDAKYWQGLQEQIREGKVIDVFPYRRQETPEQLLG

SEQ ID NO: 24186 - protein, 127 aa, Pseudomonas aeruginosa
SATCPSASAARSPTVPRTRRPASIPTCCWPPRNNARWTASSSSPWPPRKRPWPRPAGRRRAPRRRSARRPSSPPGWAASMPSPKRCGPPTARDRGACRPSPSRPFSATWRPPMCRSAMASRDRWAPR

SEQ ID NO: 24187 - protein, 252 aa, Pseudomonas aeruginosa
PPARRACRHRRRGADDPRGRGRRGALRRRGSDRPPGQPGRLRRRARPVQRFQRQPRTRLAPLRPGPRRLRHGRRRRPTGHRGTGARPGARRQAHRRAGGLRHQRRRLPHDRRAGRWQRCPPGHAAGAAPGRRGSGRGATPECPRHLHPSRRQGRTGRHQGRVRRWQRARHQRDQIRHRPPPGRRRRHRGYLHGPGTARPARPRHTQPGNARHRRRGPRPGSRRSPALADGTRAVQWLRLRRGECQLLFRRWV

SEQ ID NO: 24188 - protein, 485 aa, Pseudomonas aeruginosa
SIQISGGTSMKRFIQGEHRGQSSLLPESLDDYVADTNPVRVVDVFVDELDLGQLGFDGVVPAETGRPAYHPADLLKIYIYGYLNRIQSSRRLEREAQRNVELMWLTGRLMPDFKTIANFRKDNGKAIRGVCRQFVVLCQQLGLFSEALVAIDGSKFKAVNNRDRNFTSAKLQRRMEEIESSINRYLSALDTADRQEPAVAQVKAERLHDKIATLKAKLQELKEIEVQLNEIPDKQISLTDPDARSMKTRGTGMVGYNVQAAVDAKHHLIVTHEVTNDGVDRDQLSAMAKQAREAMGVEELSAVADRGYFKGEEILACHEAGITVFVPKTLTSGATAAGRFGKGDFIYDAAKNEYRCPAGQSLIWRFSSVEKGLKLHRYWSSHCQGCALKEHCTPSSERRVSRWEHEAVLEAMQSRLDQAPEMMRIRRQTVEHPFGTLKSWMGATHFLTRTLDRVSTEMSLHVLAYNLKRVLTMLGSGALMAAMKA

SEQ ID NO: 24189 - protein, 132 aa, Pseudomonas aeruginosa
LIMSATQNYGTGRRKTATARVFLRPGTGKISINNRGLDQFFGRETARMVVRQPLELTETVEKFDIFVTVVGGGVSGQAGAIRHGITRALIEYDETLRSSLRKAGYVTRDAREVERKKVGLRKARKRPQYSKR

SEQ ID NO: 24190 - protein, 197 aa, Pseudomonas aeruginosa
MSNDGVNAGRRRFLVAATSVVGAAGAVGAAVPFVGSWFPSAKAKAAGAPVQVNVGKIDPGQQIIAEWRGKPVFIVHRTKEMLDALPSLEGQLADPDSKASEQPEYVDPKLRSIKPELAVIVGICTHLGCSPTFRPEVAPADLGPDWKGGYFCPCHGSHYDLAGRVYKGQPAPLNLPIPPYTFDADDVITIGVDQEKA

SEQ ID NO: 24191 - protein, 167 aa, Pseudomonas aeruginosa
KWDQLAWKANHRGSADVFRGANAISLDAKGRLAMPSRYRDELVSRCAGQLIVTIDAVDPCLTVYPLPEWELIEAKLRELPSLREETRRLQRLLIGNAVDLELDGNGRFLIPPRLREYAKLDKRAMLVGQLNKFQLWDEDAWNAMAEADLAAIKQPGGLPDELRDLIL

SEQ ID NO: 24192 - protein, 604 aa, Pseudomonas aeruginosa
PHRKPGGGTVAHARSRPGRGQDGGAMKLNYFQGALYPWRFCVIVGLLLAMVGAIVWRIVDLHVIDHDFLKGQGDARSVRHIAIPAHRGLITDRNGEPLAVSTPVTTLWANPKELMTAKERWPQLAAALGQDTKLFADRIEQNAEREFIYLVRGLTPEQGEGVIALKVPGVYSIEEFRRFYPAGEVVAHAVGFTDVDDRGREGIELAFDEWLAGVPGKRQVLKDRRGRVIKDVQVTKNAKPGKTLALSIDLRLQYLAHRELRNALLENGAKAGSLVIMDVKTGEILAMTNQPTYNPNNRRNLQPAAMRNRAMIDVFEPGSTVKPFSMSAALASGRWKPSDIVDVYPGTLQIGRYTIRDVSRNSRQLDLTGILIKSSNVGISKIAFDIGAESIYSVMQQVGLGQDTGLGFPGERVGNLPNHRKWPKAETATLAYGYGLSVTAIQLAHAYAALANDGKSVPLSMTRVDRVPDGVQVISPEVASTVQGMLQQVVEAHGGVFRAQVPGYHAAGKSGTARKVSVGTKGYRENAYRSLFAGFAPATDPRIAMVVVIDEPSKAGYFGGLVSAPVFSKVMAGALRLMNVPPDNLPTATEQQQVNAAPAKGGRG

SEQ ID NO: 24193 - protein, 466 aa, Pseudomonas aeruginosa
PWIAAAFVRATCSWRCRAGARMVVRTSPMPWPKGAAAVAYEAEGAGELPPSDAPLIAVKGLAAQLSAVAGRFYGEPSRGLDLIGVTGTNGKTSVSQLVAQALDLLGERCGIVGTLGTGFYGALESGRHTTPDPLAVQATLATLKQAGARAVAMEVSSHGLDQGRVAALGFDIAVFTNLSRDHLDYHGSMEAYAAAKAKLFAWPGLRCRVINLDDDFGRRLAGEEQDSELITYSLTDSSAFLYCREARFGDAGIEAALVTPHGEGLLRSPLLGRFNLSNLLAAVGALLGLGYPLGDILRTLPQLQGPVGRMQRLGGGDKPLVVVDYAHTPDALEKVLEALRPHAAARLLCLFGCGGDRDAGKRPLMAAIAERLADGVLVTDDNPRTEASAAIIADIRKGFAAADKVTFLPSRGEAIAHLIASAAVDDVVLLAGKGHEDYQEIDGVRHPFSDIEQAERALAAWEVPHA

SEQ ID NO: 24194 - protein, 467 aa, Pseudomonas aeruginosa
YTERLFRAHRPGPRRHGRTRFLGRAGPPRGGRLRRWQGVRALCGRTADGPRRTGVRRHGPALRRPGQPDRGAGHRTTDNHHFDQGFPQCGDGQSRRGAVRFLRGESLMLLLLAEYLQQFYKGFGVFQYLTLRGILSVLTALSLSLWLGPWMIRTLQIRQIGQAVRNDGPQSHLSKKGTPTMGGALILTAIAISTLLWADLSNRYVWVVLVVTLLFGAIGWVDDYRKVIEKNSRGLPSRWKYFWQSVFGIGAAVFLYMTAETPIETTLIVPMLKSVEIQLGIFFVVLTYFVIVGSSNAVNLTDGLDGLAIMPTVMVAGALGIFCYLSGNVKFAEYLLIPNVPGAGELIVFCAALVGAGLGFLWFNTYPAQVFMGDVGALALGAALGTIAVIVRQEIVLFIMGGVFVMETLSVMIQVASFKLTGRRVFRMAPIHHHFELKGWPEPRVIVRFWIITVILVLIGLATLKLR

SEQ ID NO: 24195 - protein, 452 aa, Pseudomonas aeruginosa
RRADCPGTGQRGTAGARRNAGRSSPAGRRAGPRRRCGAVVAGLREPGHVQELRRTRTPVRQSRRGASVMLSVLRPFPSPLLSRHGIDLDFPLLAGCLALLGLGPGDGDFRVFRGGSGAVGQPAVFLRPSPDLPGDRPDFLRPDHDGPDGHLAALGLEAVAGRLRPAGAGDHPRYRPRGERLDALDRLRPVQHPAFGDRQGLRGDLHGRLPDPPPAGGPGKLDGLLQALRGVAADGRPAAARAGLRRHRGNDGRCRGHAVPRRGGAVPLRPDGAAGGRRGGPADPDPALPDGTPDQLHRPLGRPVRRRLSVEPGADRLRPRRLVGHGTGQQHPEAVLPAGGAHRFRLRRACRGAGHRRRPGDRRPVRVRQPARAVHRHLGRAGQAVLLRLRGLRPGLPLDRPVPDQHRGERRPAADQGPDPAVPQLRRQFAGDLLCLSGDVAAHRMGTANPPG

SEQ ID NO: 24196 - protein, 513 aa, Pseudomonas aeruginosa
CIPKPCAPWQTRHAAWRNPRLPGRWSMPAWRWPVVKEPNGVTRTMRRIRRIHFVGIGGAGMCGIAEVLLNLGYEVSGSDLKASAVTERLEKFGAQIFIGHQAENADGADVLVVSSAINRANPEVASALERRIPVVPRAEMLAELMRYRHGIAVAGTHGKTTTTSLIASVFAAGGLDPTFVIGGRLNAAGTNAQLGASRYLVAEADESDASFLHLQPMVAVVTNIDADHMATYGGDFNKLKKTFVEFLHNLPFYGLAVMCVDDPVVREILPQIARPTVTYGLSEDADVRAINIRQEGMRTWFTVLRPEREPLDVSVNMPGLHNVLNSLATIVIATDEGISDEAIVQGLSGFQGVGRRFQVYGELQVEGGSVMLVDDYGHHPREVAAVIKAIRGGWPERRLVMVYQPHRYTRTRDLYEDFVQVLGEANVLLLMEVYPAGEEPIPGADSRQLCHSIRQRGQLDPIYFERDADLAPLVKPLLRAGDILLCQGAGDVGGLAPQLIKNPLFAGKGGKGA

SEQ ID NO: 24197 - protein, 103 aa, Pseudomonas aeruginosa
ACACRKPTSVSSSTWPGRCCWPFSAMAPIAAPSTSCRTPTGRSPRSVSRATSATSASARCSSGSPRTWRRASSPSTWRACAGNWNRCPGSPTPRCAGCGRTRW

SEQ ID NO: 24198 - protein, 186 aa, Pseudomonas aeruginosa
SRSPATRSPMTSPWPCVRRPSTRKRSRSATPAPWPKLAGAGETIKVPSVGDRPPRELSRQALAEVVEPRYDELFTLVQAELRRSGYEDLIPAGIVLTGGTSKMEGAVELAEEIFHMPVRLGVPYSVKGLTDVVRNPIYSTGVGLLMYGLQKQSDGMSMSVSGSSYSSDEPKAPVLERLKRWVQGNF

SEQ ID NO: 24199 - protein, 307 aa, Pseudomonas aeruginosa
AAKAMIKQRTLKNIIRATGVGLHSGEKVYLTLKPAPVDTGIVFCRTDLDPVVEIPARAENVGETTMSTTLVKGDVKVDTVEHLLSAMAGLGIDNAYVELSASEVPIMDGSAGPFVFLIQSAGLQEQEAAKKFIRIKREVSVEEGDKRAVFVPFDGFKVSFEIDFDHPVFRGRTQQASVDFSSTSFVKEVSRARTFGFMRDIEYLRSQNLALGGSVENAIVVDENRVLNEDGLRYEDEFVKHKILDAIGDLYLLGNSLIGEFRGFKSGHALNNQLLRTLIADKDAWEVVTFEDARTAPISYMRPAAAV

SEQ ID NO: 24200 - protein, 928 aa, Pseudomonas aeruginosa
AFHSPRVDDQVDMFAPLLKKLFGSKNERDVKRMAKAVQAINALEPQMVALSDEQLKAKTAEFQQRYAKGETLDQLLPEAFAVVREAGKRVMGMRHFDVQLIGGMTLHDGKIAEMRTGEGKTLVGTLPVYLNALSGKGVHVVTVNDYLARRDANWMRPLYEFLGLSVGVVTPFQPPEDKRAAYAADITYGTNNEFGFDYLRDNMAFSLDDKFQRELNFAVVDEVDSILIDEARTPLIISGQAEDSSELYIKINKLIPRLKRQVEEVEGKPTEEGHYSIDEKTRQVELNEQGHQFIEDLLSQNGLLGEGESLYSAHNLSLLTHVYAALRAHTLFHRNVEYIVQGDQILLIDEHTGRTMPGRRLSEGLHQAIEAKEGLPIQAESQTLASTTFQNYFRLYNKLAGMTGTADTEAFEFRQIYGLDVVVIPTHRPIARKDFNDLVYLTQEEKYAAIITDIKQCQALGRPILVGTASIESSEYVSKLLQEAGIEHKVLNAKYHEKEAEIIAQAGAPGSVTIATNMAGRGTDILLGGNWEVEVAALENPTEEQIAQIKAEWQKRHQQVIEAGGLHVIASERHESRRIDNQLRGRAGRQGDPGSSRFYLSLEDNLMRIFASDRVKNFMKALGMQSGEAIEHRMVTNAIEKAQRKVEGRNFDIRKQLLEFDDVANEQRKVIYHMRNTLLSAEDVGETIKEFREETLSATINQHIPPQSLPEQWDIEGLEAALYSDFAVRLPIQQWLDEDDKLYEETLRSKILEQIVAAYYEKEELAGAEALRAFEKQMLLRVLDDLWKDHLSTMDHLRHGIHLRGYAQKNPKQEYKRESFTLFQELLDSIKRDTIRVLSHVQVRREDPAEEEARLRREAEELAKRMQFQHAEAPSMEQAVAGEEEELPEGPAPVVPLEPVRNEQKIGRNEPCPCGSGKKYKHCHGQLD

SEQ ID NO: 24201 - protein, 725 aa, Pseudomonas aeruginosa
IFDNRLPMDSTFLFVAPPQAATGLRQSGRQGLGLCRGDRFGAFQRQADAEAGAAAQFRAYFHLALVIVGDDEIRDGQAETGALADFLGGEERLEDTLAHQFGHAAAVVFHLDFRPGRRQARAQDDPALFAFLFVVALVDGLGGVLQQVEQDLLDLVGDHRHRAEVGVELVDDLQRLEVEAFGQVEVVTGDFHRLFEQCGQFASGHLPVAAAAEGEHVGDDLRCPRAGVLDAFQQARDVAAVEVVIDVFQRHSDLGRQLDVLRQLRGQAPLDVLHVVQDRAERVVDLVGHAGGEAADREHLLRLHHHFFQAQPLGDVVDADHRAAAGAAHQRVEGQGVVAWRVDQRPGDPFDTLHAVLLGSPGELRKERLERGKGEEHRLVDRIVQAGAGKLAGLLVPLRDVELLVHRDQRRRHGVDDAVEVVLETGELLLDLAAHLHFQFQLAVRAAGFLGQALGLLDRFLGIVAGALELLLAGLDAGQHGVERVGQAADLVAVAALGAEGVVLLAGDLPRQFLEIADRPGDQAAYLLRHQQPEQHADAEDRQAGGEGSGVERARQFTAGHQQQVAGTGVFLGQFDQRVEAVLAAPPVLQAVQAGRQLEGVAALQVGQHQPIAVVQGRGAQRLVIVELAQQDLGGLRRTECRLAERRVGDQPADGLHRLGGDALLGNPVGGADERQVGHQQHGSQQDQQGGEQFLPYGQVVEALAQVHGLWRSAAKRNGGQGNAL

SEQ ID NO: 24202 - protein, 267 aa, Pseudomonas aeruginosa
PAWLRARPIMALENLASSTTRMLRSGLGMNGLEKRMGAGTLPARARFVAGGRVPAAVARAIGKKSSVSATPAGIRSRGLGYNGRAFFTVKPGAVPSVNPVAPSIWRDDMPSFDVVSELDKHELTNAVDNAIKELDRRFDLKGKCSFEAKDKSVTLTAEADFMLEQMLDILRSNLVKRKVDSQCMEIKDAYPSGKVVKQDVNFREGIDKDLAKKIVGLIKERKLKVQAAIQGEQVRVTGKKRDDLQEAIALLRGESLGMPLQFTNFRD

SEQ ID NO: 24203 - protein, 188 aa, Pseudomonas aeruginosa
RGFSEPLAIPGIAIGSSAAATSPALSAPVGAASVRPRCADSYPGPETSPHGVRAGICKPVPFPLRKGGVFFREMEVMHGIELRPTGAADRVLAADRAGVQRQGRPGAADPGDRLVADQHPDRPGRRPARQAQRRPHPARLRRQPGEHRPEDPAGGQRGFHDRHPDHQLRRRHRRRRPGHRPGPAGQPG

SEQ ID NO: 24204 - protein, 227 aa, Pseudomonas aeruginosa
SSSRAYPGSVAEPWRRRARAWCGSSMAAAIPSRWPVFARWCRRDRWWRTWSGRAISTSSWIASATTATRTNGSSRAIPGFATVPGATCWRGKWSGKRRTGARSRTTGSWTTTSIASSTNTGSGAAAIRRSTMRSTTWSARARWEPAPATSSGTTNSGVSTWSPRSVAGNWSGAISRARISPPIRWSGTTSGCSPAPGWSCTAREPCWFPASSGSTTCSTANTACAIA

SEQ ID NO: 24205 - protein, 92 aa, Pseudomonas aeruginosa
CRPSRSSRTGYGTATSISRWTASRPRTMCPTTTSISRPTPATDSGATTCRASTTARRRTARSAPTIIPASTRWTASSTTTGSGRARSPTSAT

SEQ ID NO: 24206 - protein, 580 aa, Pseudomonas aeruginosa
RRNGTSSAATTATSTSAAIPSASGSAGKPACTKKPRDSGAFSLRGRGLQAQAAVQFENAAGVVVVLEDVGHRVGDLHRLAHTLEGDAGGHLLQRLGFHPGGHLGLDEARRHAGHADAVARQFLRPDHGIRGHPGLGCRVVGLAHVAGAGDRGNVDDRAFVLQLDHLRRHFAGAEEHTGEVDVDHRLPLGQAHLAQLAVLDLDGQAVAEDAGVVDQAVDRAEVAGDLGHHVGNLFLVRHVAHVGASVAAGGLAGSDGFVETFAVEIDQGQPGALAGEIFAHCPAEPLAAAGDDDDLVFQLHCLEPHEQFLEADLAGTCERTLICPSVYDGFYARSHKLSVEAAKNARELLLKEYRAVLSTHSKKWPGFPFGSVVPYCLDAEGRPLILISRIAQHTHNLQADPRCSMLVGERGAEDIQAVGRLTLLAEARQLAEEEVAAAAERYYRYFPESADYHRVHDFDFWVLQPVQWRFIGGFGAIHWLAAERVPLANPFAGEAERGMVEHMNSDHAAAIAHYVELAGLPAHAAAQLAGIDTEGFHLRIGQGLHWLPFPAACGNPGAVRQALVQLARAERWPTVEPEQG

SEQ ID NO: 24207 - protein, 178 aa, Pseudomonas aeruginosa
ILPPAGANYWWYRGQTGPAKDSEMRAFLFLLLLFPLVELAVLIKVGSVIGVGWTLFLIVASAFIGAALLRVAGVATAWRARERLARGELPEQEMLEGLLIAVGGGLLMLPGFISDIFGILCLIPFTRRLMLGGLRRRVEQQALRRRAFADDLNARYGQGPSRPNVIEGEYERRDDSRN

SEQ ID NO: 24208 - protein, 63 aa, Pseudomonas aeruginosa
NGLWRPYVTVTARSLPQGQAVLRGSRVESQPGNAGFNKTRRTSIRPLETTVWESYDYEASSSA

SEQ ID NO: 24209 - protein, 551 aa, Pseudomonas aeruginosa
RKENMAAKEVKFGDSARKKMLVGVNVLADAVKATLGPKGRNVVLDKSFGAPTITKDGVSVAKEIELKDKFENMGAQLVKDVASKANDAAGDGTTTATVLAQAIVNEGLKAVAAGMNPMDLKRGIDKATVAIVAQLKELAKPCADTKAIAQVGTISANSDESIGQIIAEAMEKVGKEGVITVEEGSGLENELSVVEGMQFDRGYLSPYFVNKPDTMAAELDSPLLLLVDKKISNIREMLPVLEAVAKAGRPLLIVAEDVEGEALATLVVNNMRGIVKVAAVKAPGFGDRRKAMLQDIAILTGGTVISEEVGLSLEGATLEHLGNAKRVVINKENTTIIDGAGVQADIEARVLQIRKQIEETTSDYDREKLQERLAKLAGGVAVIKVGAATEVEMKENKARVEDALHATRAAVEEGVVPGGGVALVRALQAIEGLKGDNEEQNVGIALLRRAVESPLRQIVANAGDEPSVVVDKVKQGSGNYGFNAATGVYGDMIEMGILDPAKVTRSALQAAASIGGLMITTEAMVAEIVEDKPAMGGMPDMGGMGGMGGMM

SEQ ID NO: 24210 - protein, 191 aa, Pseudomonas aeruginosa
TGTLRAIRRTPAFDRCLALCQSCRQEMAFLLQPPLGLMMPTHEPGKARRRSPAACPNRSYKDRTMWKSILAIALGAALGALLRWFLGLKLNSLLPSIPPGTLLANLVGGYVIGAAIAYFAQAPGIAPEWRLLIITGFCGGLTTFSTFSAEVVSLLQEGRLGWAAGAIATHVSGSLLMTLLGLFSMNWMLGK

SEQ ID NO: 24211 - protein, 242 aa, Pseudomonas aeruginosa
MRERRSIGLPAKEWDMRILVVEDNRDILANLADYLSLKGYTVDCAQDGLSGLHLAATEHYDLIVLDVMLPGIDGYALCRRLREDARRDTPVIMLTARDQLDDRLQGFRSGADDYLVKPFALSELSARIEAVLRRAQGGGRRELSVADLSYDLDTLEVKRAGKSLKLNPIGLKLLAVLMQKSPHVVRRDALEEAVWGDDCPDSDSLRSHVHQLRQVIDKPFSVALLHTVHGVGYRLAEEPNGV

SEQ ID NO: 24212 - protein, 140 aa, Pseudomonas aeruginosa
GHRSSADRPGEEPPPPYGEQGVPARPEAVEAPFVVDWRAVASLHLWLPDGVWQRHQRVADMKLEITRGLLLVGALAVATAAAAAWHEPAPNVVQMSGGHEYCPTPSALKAERPTRQEVQPNKDILLLMFGLSQGGASLSR
